United States Patent 8,877,916 (PROMOTER, PROMOTER CONTROL ELEMENTS, AND COMBINATIONS, AND USES THEREOF) - sequence listing, part 26

SEQ ID NO: 149163 - DNA, 7 bp, Unknown
  misc_feature (1)..( 7): Result.004 file - promoters60/5667814
atattta

SEQ ID NO: 149164 - DNA, 10 bp, Unknown
  misc_feature (1)..( 10): Result.004 file - promoters60/5667814
gaagaaaaaa

SEQ ID NO: 149165 - DNA, 10 bp, Unknown
  misc_feature (1)..( 10): Result.004 file - promoters60/5667814
gaacaaaacc

SEQ ID NO: 149166 - DNA, 10 bp, Unknown
  misc_feature (1)..( 10): Result.004 file - promoters60/5667814
caacaaaaaa

SEQ ID NO: 149167 - DNA, 10 bp, Unknown
  misc_feature (1)..( 10): Result.004 file - promoters60/5667814
gcgcaaaaaa

SEQ ID NO: 149168 - DNA, 11 bp, Unknown
  misc_feature (1)..( 11): Result.004 file - promoters60/5667814
aaattgaaact

SEQ ID NO: 149169 - DNA, 11 bp, Unknown
  misc_feature (1)..( 11): Result.004 file - promoters60/5667814
attttgatact

SEQ ID NO: 149170 - DNA, 11 bp, Unknown
  misc_feature (1)..( 11): Result.004 file - promoters60/5667814
aaatcgaagaa

SEQ ID NO: 149171 - DNA, 11 bp, Unknown
  misc_feature (1)..( 11): Result.004 file - promoters60/5667814
ccgttgataaa

SEQ ID NO: 149172 - DNA, 8 bp, Unknown
  misc_feature (1)..( 8): Result.004 file - promoters60/5667814
gaaaaaag

SEQ ID NO: 149173 - DNA, 8 bp, Unknown
  misc_feature (1)..( 8): Result.004 file - promoters60/5667814
caaaaaac

SEQ ID NO: 149174 - DNA, 8 bp, Unknown
  misc_feature (1)..( 8): Result.004 file - promoters60/5667814
caaaaaag

SEQ ID NO: 149175 - DNA, 8 bp, Unknown
  misc_feature (1)..( 8): Result.004 file - promoters60/5667822
caaaaatc

SEQ ID NO: 149176 - DNA, 11 bp, Unknown
  misc_feature (1)..( 11): Result.004 file - promoters60/5667822
attttttcttt

SEQ ID NO: 149177 - DNA, 11 bp, Unknown
  misc_feature (1)..( 11): Result.004 file - promoters60/5667822
tcattttgttt

SEQ ID NO: 149178 - DNA, 11 bp, Unknown
  misc_feature (1)..( 11): Result.004 file - promoters60/5667822
caattttgccg

SEQ ID NO: 149179 - DNA, 11 bp, Unknown
  misc_feature (1)..( 11): Result.004 file - promoters60/5667822
caattttcact

SEQ ID NO: 149180 - DNA, 8 bp, Unknown
  misc_feature (1)..( 8): Result.004 file - promoters60/5667822
ctttttac

SEQ ID NO: 149181 - DNA, 8 bp, Unknown
  misc_feature (1)..( 8): Result.004 file - promoters60/5667822
ctttttat

SEQ ID NO: 149182 - DNA, 8 bp, Unknown
  misc_feature (1)..( 8): Result.004 file - promoters60/5667822
agttttac

SEQ ID NO: 149183 - DNA, 8 bp, Unknown
  misc_feature (1)..( 8): Result.004 file - promoters60/5667822
atttttaa

SEQ ID NO: 149184 - DNA, 8 bp, Unknown
  misc_feature (1)..( 8): Result.004 file - promoters60/5667822
atttgtac

SEQ ID NO: 149185 - DNA, 10 bp, Unknown
  misc_feature (1)..( 10): Result.004 file - promoters60/5667822
atatattatt

SEQ ID NO: 149186 - DNA, 10 bp, Unknown
  misc_feature (1)..( 10): Result.004 file - promoters60/5667822
atattttatt

SEQ ID NO: 149187 - DNA, 10 bp, Unknown
  misc_feature (1)..( 10): Result.004 file - promoters60/5667822
ataaattgaa

SEQ ID NO: 149188 - DNA, 10 bp, Unknown
  misc_feature (1)..( 10): Result.004 file - promoters60/5667822
aaaaattgaa

SEQ ID NO: 149189 - DNA, 15 bp, Unknown
  misc_feature (1)..( 15): Result.004 file - promoters60/5667822
aatgtttattaaaaa

SEQ ID NO: 149190 - DNA, 15 bp, Unknown
  misc_feature (1)..( 15): Result.004 file - promoters60/5667822
caaatttcttaaaag

SEQ ID NO: 149191 - DNA, 15 bp, Unknown
  misc_feature (1)..( 15): Result.004 file - promoters60/5667822
aattttttttaatta

SEQ ID NO: 149192 - DNA, 15 bp, Unknown
  misc_feature (1)..( 15): Result.004 file - promoters60/5667822
agcccaaattaaaaa

SEQ ID NO: 149193 - DNA, 10 bp, Unknown
  misc_feature (1)..( 10): Result.004 file - promoters60/5667822
gtatatttta

SEQ ID NO: 149194 - DNA, 10 bp, Unknown
  misc_feature (1)..( 10): Result.004 file - promoters60/5667822
ttatgttttt

SEQ ID NO: 149195 - DNA, 10 bp, Unknown
  misc_feature (1)..( 10): Result.004 file - promoters60/5667822
gtaaattttg

SEQ ID NO: 149196 - DNA, 10 bp, Unknown
  misc_feature (1)..( 10): Result.004 file - promoters60/5667822
gttgattttg

SEQ ID NO: 149197 - DNA, 10 bp, Unknown
  misc_feature (1)..( 10): Result.004 file - promoters60/5667822
tctgttagat

SEQ ID NO: 149198 - DNA, 10 bp, Unknown
  misc_feature (1)..( 10): Result.004 file - promoters60/5667822
tttgttagtt

SEQ ID NO: 149199 - DNA, 10 bp, Unknown
  misc_feature (1)..( 10): Result.004 file - promoters60/5667822
accgtttgat

SEQ ID NO: 149200 - DNA, 10 bp, Unknown
  misc_feature (1)..( 10): Result.004 file - promoters60/5667822
ttttttatat

SEQ ID NO: 149201 - DNA, 10 bp, Unknown
  misc_feature (1)..( 10): Result.004 file - promoters60/5667822
tggaaaaaaa

SEQ ID NO: 149202 - DNA, 10 bp, Unknown
  misc_feature (1)..( 10): Result.004 file - promoters60/5667822
ttcaaaaaaa

SEQ ID NO: 149203 - DNA, 10 bp, Unknown
  misc_feature (1)..( 10): Result.004 file - promoters60/5667822
tataaaaaat

SEQ ID NO: 149204 - DNA, 10 bp, Unknown
  misc_feature (1)..( 10): Result.004 file - promoters60/5667822
cttaaaaaat

SEQ ID NO: 149205 - DNA, 10 bp, Unknown
  misc_feature (1)..( 10): Result.004 file - promoters60/5667822
tatacaaaag

SEQ ID NO: 149206 - DNA, 7 bp, Unknown
  misc_feature (1)..( 7): Result.004 file - promoters60/5667822
cataaaa

SEQ ID NO: 149207 - DNA, 7 bp, Unknown
  misc_feature (1)..( 7): Result.004 file - promoters60/5667822
tataaaa

SEQ ID NO: 149208 - DNA, 7 bp, Unknown
  misc_feature (1)..( 7): Result.004 file - promoters60/5667822
gataaaa

SEQ ID NO: 149209 - DNA, 7 bp, Unknown
  misc_feature (1)..( 7): Result.004 file - promoters60/5667822
tatcaaa

SEQ ID NO: 149210 - DNA, 11 bp, Unknown
  misc_feature (1)..( 11): Result.004 file - promoters60/5667822
tttattttgtt

SEQ ID NO: 149211 - DNA, 11 bp, Unknown
  misc_feature (1)..( 11): Result.004 file - promoters60/5667822
attaatttctc

SEQ ID NO: 149212 - DNA, 11 bp, Unknown
  misc_feature (1)..( 11): Result.004 file - promoters60/5667822
ctttttttttt

SEQ ID NO: 149213 - DNA, 11 bp, Unknown
  misc_feature (1)..( 11): Result.004 file - promoters60/5667822
atttatattga

SEQ ID NO: 149214 - DNA, 10 bp, Unknown
  misc_feature (1)..( 10): Result.004 file - promoters60/5667822
gttgactttg

SEQ ID NO: 149215 - DNA, 10 bp, Unknown
  misc_feature (1)..( 10): Result.004 file - promoters60/5667822
cttggcttgc

SEQ ID NO: 149216 - DNA, 10 bp, Unknown
  misc_feature (1)..( 10): Result.004 file - promoters60/5667822
attgaatttg

SEQ ID NO: 149217 - DNA, 10 bp, Unknown
  misc_feature (1)..( 10): Result.004 file - promoters60/5667822
attgaagttt

SEQ ID NO: 149218 - DNA, 9 bp, Unknown
  misc_feature (1)..( 9): Result.004 file - promoters60/5667822
ttattttaa

SEQ ID NO: 149219 - DNA, 9 bp, Unknown
  misc_feature (1)..( 9): Result.004 file - promoters60/5667822
ttattctaa

SEQ ID NO: 149220 - DNA, 9 bp, Unknown
  misc_feature (1)..( 9): Result.004 file - promoters60/5667822
ctattttaa

SEQ ID NO: 149221 - DNA, 9 bp, Unknown
  misc_feature (1)..( 9): Result.004 file - promoters60/5667849
atatattat

SEQ ID NO: 149222 - DNA, 10 bp, Unknown
  misc_feature (1)..( 10): Result.004 file - promoters60/5667849
caaaattaat

SEQ ID NO: 149223 - DNA, 10 bp, Unknown
  misc_feature (1)..( 10): Result.004 file - promoters60/5667849
aaaaattctc

SEQ ID NO: 149224 - DNA, 10 bp, Unknown
  misc_feature (1)..( 10): Result.004 file - promoters60/5667849
taaaattttc

SEQ ID NO: 149225 - DNA, 11 bp, Unknown
  misc_feature (1)..( 11): Result.004 file - promoters60/5667849
taataatttgc

SEQ ID NO: 149226 - DNA, 11 bp, Unknown
  misc_feature (1)..( 11): Result.004 file - promoters60/5667849
ggcaaactctc

SEQ ID NO: 149227 - DNA, 11 bp, Unknown
  misc_feature (1)..( 11): Result.004 file - promoters60/5667849
cacaaattttt

SEQ ID NO: 149228 - DNA, 13 bp, Unknown
  misc_feature (1)..( 13): Result.004 file - promoters60/5667849
cgaaaaaagtttc

SEQ ID NO: 149229 - DNA, 13 bp, Unknown
  misc_feature (1)..( 13): Result.004 file - promoters60/5667849
atccattagtttc

SEQ ID NO: 149230 - DNA, 13 bp, Unknown
  misc_feature (1)..( 13): Result.004 file - promoters60/5667849
accaaaatgtttg

SEQ ID NO: 149231 - DNA, 13 bp, Unknown
  misc_feature (1)..( 13): Result.004 file - promoters60/5667849
atccattggtttt

SEQ ID NO: 149232 - DNA, 13 bp, Unknown
  misc_feature (1)..( 13): Result.004 file - promoters60/5667849
tggcattggctta

SEQ ID NO: 149233 - DNA, 13 bp, Unknown
  misc_feature (1)..( 13): Result.004 file - promoters60/5667849
ttttaatattttt

SEQ ID NO: 149234 - DNA, 10 bp, Unknown
  misc_feature (1)..( 10): Result.004 file - promoters60/5667849
gtatttatat

SEQ ID NO: 149235 - DNA, 10 bp, Unknown
  misc_feature (1)..( 10): Result.004 file - promoters60/5667849
ctatatataa

SEQ ID NO: 149236 - DNA, 10 bp, Unknown
  misc_feature (1)..( 10): Result.004 file - promoters60/5667849
ttatttatga

SEQ ID NO: 149237 - DNA, 10 bp, Unknown
  misc_feature (1)..( 10): Result.004 file - promoters60/5667849
ttataaataa

SEQ ID NO: 149238 - DNA, 10 bp, Unknown
  misc_feature (1)..( 10): Result.004 file - promoters60/5667849
ctatatatta

SEQ ID NO: 149239 - DNA, 10 bp, Unknown
  misc_feature (1)..( 10): Result.004 file - promoters60/5668073
ttataaaaag

SEQ ID NO: 149240 - DNA, 8 bp, Unknown
  misc_feature (1)..( 8): Result.004 file - promoters60/5668073
tttgattg

SEQ ID NO: 149241 - DNA, 8 bp, Unknown
  misc_feature (1)..( 8): Result.004 file - promoters60/5668073
tttgtttg

SEQ ID NO: 149242 - DNA, 8 bp, Unknown
  misc_feature (1)..( 8): Result.004 file - promoters60/5668085
tttgatag

SEQ ID NO: 149243 - DNA, 6 bp, Unknown
  misc_feature (1)..( 6): Result.004 file - promoters60/5668085
acacca

SEQ ID NO: 149244 - DNA, 6 bp, Unknown
  misc_feature (1)..( 6): Result.004 file - promoters60/5668085
acacca

SEQ ID NO: 149245 - DNA, 6 bp, Unknown
  misc_feature (1)..( 6): Result.004 file - promoters60/5668085
gcatgg

SEQ ID NO: 149246 - DNA, 6 bp, Unknown
  misc_feature (1)..( 6): Result.004 file - promoters60/5668085
gcatgg

SEQ ID NO: 149247 - DNA, 6 bp, Unknown
  misc_feature (1)..( 6): Result.004 file - promoters60/5668085
tggtat

SEQ ID NO: 149248 - DNA, 6 bp, Unknown
  misc_feature (1)..( 6): Result.004 file - promoters60/5668085
tggtat

SEQ ID NO: 149249 - DNA, 6 bp, Unknown
  misc_feature (1)..( 6): Result.004 file - promoters60/5668085
acaata

SEQ ID NO: 149250 - DNA, 6 bp, Unknown
  misc_feature (1)..( 6): Result.004 file - promoters60/5668085
acaata

SEQ ID NO: 149251 - DNA, 6 bp, Unknown
  misc_feature (1)..( 6): Result.004 file - promoters60/5668085
gttgtg

SEQ ID NO: 149252 - DNA, 6 bp, Unknown
  misc_feature (1)..( 6): Result.004 file - promoters60/5668085
gttgtg

SEQ ID NO: 149253 - DNA, 7 bp, Unknown
  misc_feature (1)..( 7): Result.004 file - promoters60/5668085
tgtggat

SEQ ID NO: 149254 - DNA, 7 bp, Unknown
  misc_feature (1)..( 7): Result.004 file - promoters60/5668085
tgttgat

SEQ ID NO: 149255 - DNA, 8 bp, Unknown
  misc_feature (1)..( 8): Result.004 file - promoters60/5668085
tttagctt

SEQ ID NO: 149256 - DNA, 8 bp, Unknown
  misc_feature (1)..( 8): Result.004 file - promoters60/5668085
tttatctt

SEQ ID NO: 149257 - DNA, 6 bp, Unknown
  misc_feature (1)..( 6): Result.004 file - promoters60/5668085
gaatta

SEQ ID NO: 149258 - DNA, 6 bp, Unknown
  misc_feature (1)..( 6): Result.004 file - promoters60/5668085
gaatta

SEQ ID NO: 149259 - DNA, 6 bp, Unknown
  misc_feature (1)..( 6): Result.004 file - promoters60/5668085
gcggaa

SEQ ID NO: 149260 - DNA, 6 bp, Unknown
  misc_feature (1)..( 6): Result.004 file - promoters60/5668085
gcggaa

SEQ ID NO: 149261 - DNA, 6 bp, Unknown
  misc_feature (1)..( 6): Result.004 file - promoters60/5668085
aaagaa

SEQ ID NO: 149262 - DNA, 6 bp, Unknown
  misc_feature (1)..( 6): Result.004 file - promoters60/5668085
aaagaa

SEQ ID NO: 149263 - DNA, 7 bp, Unknown
  misc_feature (1)..( 7): Result.004 file - promoters60/5668085
tattttc

SEQ ID NO: 149264 - DNA, 7 bp, Unknown
  misc_feature (1)..( 7): Result.004 file - promoters60/5668085
tatcttc

SEQ ID NO: 149265 - DNA, 6 bp, Unknown
  misc_feature (1)..( 6): Result.004 file - promoters60/5668085
tccttg

SEQ ID NO: 149266 - DNA, 6 bp, Unknown
  misc_feature (1)..( 6): Result.004 file - promoters60/5668085
tccttg

SEQ ID NO: 149267 - DNA, 7 bp, Unknown
  misc_feature (1)..( 7): Result.004 file - promoters60/5668085
gatatat

SEQ ID NO: 149268 - DNA, 7 bp, Unknown
  misc_feature (1)..( 7): Result.004 file - promoters60/5668101
gatgtat

SEQ ID NO: 149269 - DNA, 9 bp, Unknown
  misc_feature (1)..( 9): Result.004 file - promoters60/5668101
tataatttg

SEQ ID NO: 149270 - DNA, 9 bp, Unknown
  misc_feature (1)..( 9): Result.004 file - promoters60/5668101
tataatttg

SEQ ID NO: 149271 - DNA, 6 bp, Unknown
  misc_feature (1)..( 6): Result.004 file - promoters60/5668101
attcat

SEQ ID NO: 149272 - DNA, 6 bp, Unknown
  misc_feature (1)..( 6): Result.004 file - promoters60/5668101
attcat

SEQ ID NO: 149273 - DNA, 7 bp, Unknown
  misc_feature (1)..( 7): Result.004 file - promoters60/5668101
ttagaat

SEQ ID NO: 149274 - DNA, 7 bp, Unknown
  misc_feature (1)..( 7): Result.004 file - promoters60/5668101
ttacaat

SEQ ID NO: 149275 - DNA, 7 bp, Unknown
  misc_feature (1)..( 7): Result.004 file - promoters60/5668101
aatctat

SEQ ID NO: 149276 - DNA, 7 bp, Unknown
  misc_feature (1)..( 7): Result.004 file - promoters60/5668101
aatatat

SEQ ID NO: 149277 - DNA, 8 bp, Unknown
  misc_feature (1)..( 8): Result.004 file - promoters60/5668101
tttatgtt

SEQ ID NO: 149278 - DNA, 8 bp, Unknown
  misc_feature (1)..( 8): Result.004 file - promoters60/5668101
tttatgtt

SEQ ID NO: 149279 - DNA, 6 bp, Unknown
  misc_feature (1)..( 6): Result.004 file - promoters60/5668101
taagtt

SEQ ID NO: 149280 - DNA, 6 bp, Unknown
  misc_feature (1)..( 6): Result.004 file - promoters60/5668101
taagtt

SEQ ID NO: 149281 - DNA, 12 bp, Unknown
  misc_feature (1)..( 12): Result.004 file - promoters60/5668101
cttgtaaccaca

SEQ ID NO: 149282 - DNA, 12 bp, Unknown
  misc_feature (1)..( 12): Result.004 file - promoters60/5668101
cttttaactaca

SEQ ID NO: 149283 - DNA, 6 bp, Unknown
  misc_feature (1)..( 6): Result.004 file - promoters60/5668101
ttaata

SEQ ID NO: 149284 - DNA, 6 bp, Unknown
  misc_feature (1)..( 6): Result.004 file - promoters60/5668101
ttaata

SEQ ID NO: 149285 - DNA, 7 bp, Unknown
  misc_feature (1)..( 7): Result.004 file - promoters60/5668101
tatatgt

SEQ ID NO: 149286 - DNA, 7 bp, Unknown
  misc_feature (1)..( 7): Result.004 file - promoters60/5668101
tatttgt

SEQ ID NO: 149287 - DNA, 9 bp, Unknown
  misc_feature (1)..( 9): Result.004 file - promoters60/5668101
ctaagaaac

SEQ ID NO: 149288 - DNA, 9 bp, Unknown
  misc_feature (1)..( 9): Result.004 file - promoters60/5668101
ctaaaaaac

SEQ ID NO: 149289 - DNA, 6 bp, Unknown
  misc_feature (1)..( 6): Result.004 file - promoters60/5668101
aaaaat

SEQ ID NO: 149290 - DNA, 6 bp, Unknown
  misc_feature (1)..( 6): Result.004 file - promoters60/5668101
aaaaat

SEQ ID NO: 149291 - DNA, 6 bp, Unknown
  misc_feature (1)..( 6): Result.004 file - promoters60/5668101
atacaa

SEQ ID NO: 149292 - DNA, 6 bp, Unknown
  misc_feature (1)..( 6): Result.004 file - promoters60/5668101
atacaa

SEQ ID NO: 149293 - DNA, 6 bp, Unknown
  misc_feature (1)..( 6): Result.004 file - promoters60/5668101
gttttt

SEQ ID NO: 149294 - DNA, 6 bp, Unknown
  misc_feature (1)..( 6): Result.004 file - promoters60/5668101
gttttt

SEQ ID NO: 149295 - DNA, 7 bp, Unknown
  misc_feature (1)..( 7): Result.004 file - promoters60/5668101
tttttag

SEQ ID NO: 149296 - DNA, 7 bp, Unknown
  misc_feature (1)..( 7): Result.004 file - promoters60/5668101
tttttag

SEQ ID NO: 149297 - DNA, 6 bp, Unknown
  misc_feature (1)..( 6): Result.004 file - promoters60/5668101
aaagaa

SEQ ID NO: 149298 - DNA, 6 bp, Unknown
  misc_feature (1)..( 6): Result.004 file - promoters60/5668101
aaagaa

SEQ ID NO: 149299 - DNA, 7 bp, Unknown
  misc_feature (1)..( 7): Result.004 file - promoters60/5668101
aaaaata

SEQ ID NO: 149300 - DNA, 7 bp, Unknown
  misc_feature (1)..( 7): Result.004 file - promoters60/5668101
aaacata

SEQ ID NO: 149301 - DNA, 6 bp, Unknown
  misc_feature (1)..( 6): Result.004 file - promoters60/5668101
atcaaa

SEQ ID NO: 149302 - DNA, 6 bp, Unknown
  misc_feature (1)..( 6): Result.004 file - promoters60/5668101
atcaaa

SEQ ID NO: 149303 - DNA, 8 bp, Unknown
  misc_feature (1)..( 8): Result.004 file - promoters60/5668101
atcatatt

SEQ ID NO: 149304 - DNA, 8 bp, Unknown
  misc_feature (1)..( 8): Result.004 file - promoters60/5668101
atcagatt

SEQ ID NO: 149305 - DNA, 6 bp, Unknown
  misc_feature (1)..( 6): Result.004 file - promoters60/5668101
atgtca

SEQ ID NO: 149306 - DNA, 6 bp, Unknown
  misc_feature (1)..( 6): Result.004 file - promoters60/5668101
atgtca

SEQ ID NO: 149307 - DNA, 7 bp, Unknown
  misc_feature (1)..( 7): Result.004 file - promoters60/5668101
tgactct

SEQ ID NO: 149308 - DNA, 7 bp, Unknown
  misc_feature (1)..( 7): Result.004 file - promoters60/5668101
tgattct

SEQ ID NO: 149309 - DNA, 7 bp, Unknown
  misc_feature (1)..( 7): Result.004 file - promoters60/5668101
ttgcaaa

SEQ ID NO: 149310 - DNA, 7 bp, Unknown
  misc_feature (1)..( 7): Result.004 file - promoters60/5668101
ttgcaaa

SEQ ID NO: 149311 - DNA, 6 bp, Unknown
  misc_feature (1)..( 6): Result.004 file - promoters60/5668101
atatct

SEQ ID NO: 149312 - DNA, 6 bp, Unknown
  misc_feature (1)..( 6): Result.004 file - promoters60/5668101
atatct

SEQ ID NO: 149313 - DNA, 6 bp, Unknown
  misc_feature (1)..( 6): Result.004 file - promoters60/5668101
ttattt

SEQ ID NO: 149314 - DNA, 6 bp, Unknown
  misc_feature (1)..( 6): Result.004 file - promoters60/5668101
ttattt

SEQ ID NO: 149315 - DNA, 7 bp, Unknown
  misc_feature (1)..( 7): Result.004 file - promoters60/5668101
ttgatta

SEQ ID NO: 149316 - DNA, 7 bp, Unknown
  misc_feature (1)..( 7): Result.004 file - promoters60/5668111
ttggtta

SEQ ID NO: 149317 - DNA, 10 bp, Unknown
  misc_feature (1)..( 10): Result.004 file - promoters60/5668111
agaaaaatca

SEQ ID NO: 149318 - DNA, 10 bp, Unknown
  misc_feature (1)..( 10): Result.004 file - promoters60/5668111
tgcaaaatcg

SEQ ID NO: 149319 - DNA, 10 bp, Unknown
  misc_feature (1)..( 10): Result.004 file - promoters60/5668111
acaaaaatcg

SEQ ID NO: 149320 - DNA, 10 bp, Unknown
  misc_feature (1)..( 10): Result.004 file - promoters60/5668111
tcataaatcg

SEQ ID NO: 149321 - DNA, 10 bp, Unknown
  misc_feature (1)..( 10): Result.004 file - promoters60/5668111
tgcaaaatta

SEQ ID NO: 149322 - DNA, 8 bp, Unknown
  misc_feature (1)..( 8): Result.004 file - promoters60/5668111
taatcaaa

SEQ ID NO: 149323 - DNA, 8 bp, Unknown
  misc_feature (1)..( 8): Result.004 file - promoters60/5668111
taaacaaa

SEQ ID NO: 149324 - DNA, 8 bp, Unknown
  misc_feature (1)..( 8): Result.004 file - promoters60/5668111
aaatcaat

SEQ ID NO: 149325 - DNA, 8 bp, Unknown
  misc_feature (1)..( 8): Result.004 file - promoters60/5668111
aaaaccaa

SEQ ID NO: 149326 - DNA, 11 bp, Unknown
  misc_feature (1)..( 11): Result.004 file - promoters60/5668111
tttatattatt

SEQ ID NO: 149327 - DNA, 11 bp, Unknown
  misc_feature (1)..( 11): Result.004 file - promoters60/5668111
tttattttatt

SEQ ID NO: 149328 - DNA, 11 bp, Unknown
  misc_feature (1)..( 11): Result.004 file - promoters60/5668111
tacataatata

SEQ ID NO: 149329 - DNA, 11 bp, Unknown
  misc_feature (1)..( 11): Result.004 file - promoters60/5668111
ggctttttatt

SEQ ID NO: 149330 - DNA, 11 bp, Unknown
  misc_feature (1)..( 11): Result.004 file - promoters60/5668111
cttttaatata

SEQ ID NO: 149331 - DNA, 9 bp, Unknown
  misc_feature (1)..( 9): Result.004 file - promoters60/5668111
aaaaaccct

SEQ ID NO: 149332 - DNA, 9 bp, Unknown
  misc_feature (1)..( 9): Result.004 file - promoters60/5668111
taaaaccct

SEQ ID NO: 149333 - DNA, 9 bp, Unknown
  misc_feature (1)..( 9): Result.004 file - promoters60/5668111
agaaaccct

SEQ ID NO: 149334 - DNA, 9 bp, Unknown
  misc_feature (1)..( 9): Result.004 file - promoters60/5668111
taaaaccga

SEQ ID NO: 149335 - DNA, 8 bp, Unknown
  misc_feature (1)..( 8): Result.004 file - promoters60/5668111
tcacaaaa

SEQ ID NO: 149336 - DNA, 8 bp, Unknown
  misc_feature (1)..( 8): Result.004 file - promoters60/5668111
gtacaaaa

SEQ ID NO: 149337 - DNA, 8 bp, Unknown
  misc_feature (1)..( 8): Result.004 file - promoters60/5668111
tcataaat

SEQ ID NO: 149338 - DNA, 8 bp, Unknown
  misc_feature (1)..( 8): Result.004 file - promoters60/5668111
tgacaaaa

SEQ ID NO: 149339 - DNA, 9 bp, Unknown
  misc_feature (1)..( 9): Result.004 file - promoters60/5668111
gaaaaatca

SEQ ID NO: 149340 - DNA, 9 bp, Unknown
  misc_feature (1)..( 9): Result.004 file - promoters60/5668111
gaaaaagct

SEQ ID NO: 149341 - DNA, 9 bp, Unknown
  misc_feature (1)..( 9): Result.004 file - promoters60/5668111
gaacaatta

SEQ ID NO: 149342 - DNA, 9 bp, Unknown
  misc_feature (1)..( 9): Result.004 file - promoters60/5668294
taacgatta

SEQ ID NO: 149343 - DNA, 10 bp, Unknown
  misc_feature (1)..( 10): Result.004 file - promoters60/5668294
tgacaataca

SEQ ID NO: 149344 - DNA, 10 bp, Unknown
  misc_feature (1)..( 10): Result.004 file - promoters60/5668294
tgacaaaatg

SEQ ID NO: 149345 - DNA, 10 bp, Unknown
  misc_feature (1)..( 10): Result.004 file - promoters60/5668294
tgaaaaaaaa

SEQ ID NO: 149346 - DNA, 10 bp, Unknown
  misc_feature (1)..( 10): Result.004 file - promoters60/5668294
ctaaaagaaa

SEQ ID NO: 149347 - DNA, 10 bp, Unknown
  misc_feature (1)..( 10): Result.004 file - promoters60/5668294
tgtcaaattt

SEQ ID NO: 149348 - DNA, 10 bp, Unknown
  misc_feature (1)..( 10): Result.004 file - promoters60/5668294
agtcaaatat

SEQ ID NO: 149349 - DNA, 10 bp, Unknown
  misc_feature (1)..( 10): Result.004 file - promoters60/5668294
tgtcaatcag

SEQ ID NO: 149350 - DNA, 11 bp, Unknown
  misc_feature (1)..( 11): Result.004 file - promoters60/5668294
acgaaatccat

SEQ ID NO: 149351 - DNA, 11 bp, Unknown
  misc_feature (1)..( 11): Result.004 file - promoters60/5668294
acgaaattagt

SEQ ID NO: 149352 - DNA, 11 bp, Unknown
  misc_feature (1)..( 11): Result.004 file - promoters60/5668294
acgaaacaaag

SEQ ID NO: 149353 - DNA, 11 bp, Unknown
  misc_feature (1)..( 11): Result.004 file - promoters60/5668294
cagaaattttt

SEQ ID NO: 149354 - DNA, 11 bp, Unknown
  misc_feature (1)..( 11): Result.004 file - promoters60/5668294
aggaaaataga

SEQ ID NO: 149355 - DNA, 11 bp, Unknown
  misc_feature (1)..( 11): Result.004 file - promoters60/5668294
ctaaaagtttt

SEQ ID NO: 149356 - DNA, 13 bp, Unknown
  misc_feature (1)..( 13): Result.004 file - promoters60/5668294
gtagaagaaagaa

SEQ ID NO: 149357 - DNA, 13 bp, Unknown
  misc_feature (1)..( 13): Result.004 file - promoters60/5668294
cctgaagaacagg

SEQ ID NO: 149358 - DNA, 13 bp, Unknown
  misc_feature (1)..( 13): Result.004 file - promoters60/5668294
atagaacaaacgc

SEQ ID NO: 149359 - DNA, 13 bp, Unknown
  misc_feature (1)..( 13): Result.004 file - promoters60/5668294
atcaaagaaacaa

SEQ ID NO: 149360 - DNA, 13 bp, Unknown
  misc_feature (1)..( 13): Result.004 file - promoters60/5668294
caagaagaaaaaa

SEQ ID NO: 149361 - DNA, 14 bp, Unknown
  misc_feature (1)..( 14): Result.004 file - promoters60/5668294
aaggtagataaatt

SEQ ID NO: 149362 - DNA, 10 bp, Unknown
  misc_feature (1)..( 10): Result.004 file - promoters60/5668294
tccacaaaac

SEQ ID NO: 149363 - DNA, 10 bp, Unknown
  misc_feature (1)..( 10): Result.004 file - promoters60/5668294
tacacaaagt

SEQ ID NO: 149364 - DNA, 10 bp, Unknown
  misc_feature (1)..( 10): Result.004 file - promoters60/5668294
tactcaaaag

SEQ ID NO: 149365 - DNA, 10 bp, Unknown
  misc_feature (1)..( 10): Result.004 file - promoters60/5668294
aacacaaatt

SEQ ID NO: 149366 - DNA, 11 bp, Unknown
  misc_feature (1)..( 11): Result.004 file - promoters60/5668294
aagtcagaaga

SEQ ID NO: 149367 - DNA, 11 bp, Unknown
  misc_feature (1)..( 11): Result.004 file - promoters60/5668317
aacaccaatca

SEQ ID NO: 149368 - DNA, 10 bp, Unknown
  misc_feature (1)..( 10): Result.004 file - promoters60/5668317
aagaaattaa

SEQ ID NO: 149369 - DNA, 10 bp, Unknown
  misc_feature (1)..( 10): Result.004 file - promoters60/5668317
aagacattta

SEQ ID NO: 149370 - DNA, 10 bp, Unknown
  misc_feature (1)..( 10): Result.004 file - promoters60/5668317
tgtaaattaa

SEQ ID NO: 149371 - DNA, 8 bp, Unknown
  misc_feature (1)..( 8): Result.004 file - promoters60/5668317
caaactta

SEQ ID NO: 149372 - DNA, 8 bp, Unknown
  misc_feature (1)..( 8): Result.004 file - promoters60/5668317
gaaacttt

SEQ ID NO: 149373 - DNA, 8 bp, Unknown
  misc_feature (1)..( 8): Result.004 file - promoters60/5668317
gaatcttt

SEQ ID NO: 149374 - DNA, 8 bp, Unknown
  misc_feature (1)..( 8): Result.004 file - promoters60/5668317
tttggttc

SEQ ID NO: 149375 - DNA, 8 bp, Unknown
  misc_feature (1)..( 8): Result.004 file - promoters60/5668317
tttgcttc

SEQ ID NO: 149376 - DNA, 8 bp, Unknown
  misc_feature (1)..( 8): Result.004 file - promoters60/5668317
tatgcttc

SEQ ID NO: 149377 - DNA, 7 bp, Unknown
  misc_feature (1)..( 7): Result.004 file - promoters60/5668317
ttgtgtg

SEQ ID NO: 149378 - DNA, 7 bp, Unknown
  misc_feature (1)..( 7): Result.004 file - promoters60/5668317
gtgtgtg

SEQ ID NO: 149379 - DNA, 7 bp, Unknown
  misc_feature (1)..( 7): Result.004 file - promoters60/5668317
gtgagtg

SEQ ID NO: 149380 - DNA, 7 bp, Unknown
  misc_feature (1)..( 7): Result.004 file - promoters60/5668317
gaaaaaa

SEQ ID NO: 149381 - DNA, 7 bp, Unknown
  misc_feature (1)..( 7): Result.004 file - promoters60/5668317
gaagaaa

SEQ ID NO: 149382 - DNA, 7 bp, Unknown
  misc_feature (1)..( 7): Result.004 file - promoters60/5668317
gaacaaa

SEQ ID NO: 149383 - DNA, 13 bp, Unknown
  misc_feature (1)..( 13): Result.004 file - promoters60/5668317
gaaacaaagaaac

SEQ ID NO: 149384 - DNA, 13 bp, Unknown
  misc_feature (1)..( 13): Result.004 file - promoters60/5668317
gaaagaaagaaac

SEQ ID NO: 149385 - DNA, 13 bp, Unknown
  misc_feature (1)..( 13): Result.004 file - promoters60/5668325
tgaacaaatgtgt

SEQ ID NO: 149386 - DNA, 9 bp, Unknown
  misc_feature (1)..( 9): Result.004 file - promoters60/5668325
aatgcttca

SEQ ID NO: 149387 - DNA, 9 bp, Unknown
  misc_feature (1)..( 9): Result.004 file - promoters60/5668325
gatgattca

SEQ ID NO: 149388 - DNA, 9 bp, Unknown
  misc_feature (1)..( 9): Result.004 file - promoters60/5668325
gataattga

SEQ ID NO: 149389 - DNA, 6 bp, Unknown
  misc_feature (1)..( 6): Result.004 file - promoters60/5668325
tcaaat

SEQ ID NO: 149390 - DNA, 6 bp, Unknown
  misc_feature (1)..( 6): Result.004 file - promoters60/5668325
tcaaat

SEQ ID NO: 149391 - DNA, 7 bp, Unknown
  misc_feature (1)..( 7): Result.004 file - promoters60/5668325
tggattt

SEQ ID NO: 149392 - DNA, 7 bp, Unknown
  misc_feature (1)..( 7): Result.004 file - promoters60/5668325
tggcttt

SEQ ID NO: 149393 - DNA, 7 bp, Unknown
  misc_feature (1)..( 7): Result.004 file - promoters60/5668325
tgcagag

SEQ ID NO: 149394 - DNA, 7 bp, Unknown
  misc_feature (1)..( 7): Result.004 file - promoters60/5668325
tgctgag

SEQ ID NO: 149395 - DNA, 7 bp, Unknown
  misc_feature (1)..( 7): Result.004 file - promoters60/5668325
atatatt

SEQ ID NO: 149396 - DNA, 7 bp, Unknown
  misc_feature (1)..( 7): Result.004 file - promoters60/5668325
ataaatt

SEQ ID NO: 149397 - DNA, 8 bp, Unknown
  misc_feature (1)..( 8): Result.004 file - promoters60/5668325
tttgtatt

SEQ ID NO: 149398 - DNA, 8 bp, Unknown
  misc_feature (1)..( 8): Result.004 file - promoters60/5668325
tttggatt

SEQ ID NO: 149399 - DNA, 8 bp, Unknown
  misc_feature (1)..( 8): Result.004 file - promoters60/5668325
tttggaga

SEQ ID NO: 149400 - DNA, 6 bp, Unknown
  misc_feature (1)..( 6): Result.004 file - promoters60/5668325
aagatt

SEQ ID NO: 149401 - DNA, 6 bp, Unknown
  misc_feature (1)..( 6): Result.004 file - promoters60/5668325
aagatt

SEQ ID NO: 149402 - DNA, 6 bp, Unknown
  misc_feature (1)..( 6): Result.004 file - promoters60/5668325
ggtgaa

SEQ ID NO: 149403 - DNA, 6 bp, Unknown
  misc_feature (1)..( 6): Result.004 file - promoters60/5668325
ggtgaa

SEQ ID NO: 149404 - DNA, 7 bp, Unknown
  misc_feature (1)..( 7): Result.004 file - promoters60/5668325
tttgata

SEQ ID NO: 149405 - DNA, 7 bp, Unknown
  misc_feature (1)..( 7): Result.004 file - promoters60/5668325
tttgata

SEQ ID NO: 149406 - DNA, 6 bp, Unknown
  misc_feature (1)..( 6): Result.004 file - promoters60/5668325
gaaagt

SEQ ID NO: 149407 - DNA, 6 bp, Unknown
  misc_feature (1)..( 6): Result.004 file - promoters60/5668325
gaaagt

SEQ ID NO: 149408 - DNA, 9 bp, Unknown
  misc_feature (1)..( 9): Result.004 file - promoters60/5668325
ttttaccag

SEQ ID NO: 149409 - DNA, 9 bp, Unknown
  misc_feature (1)..( 9): Result.004 file - promoters60/5668329
tttgaccag

SEQ ID NO: 149410 - DNA, 15 bp, Unknown
  misc_feature (1)..( 15): Result.004 file - promoters60/5668329
ctaattatgtatcaa

SEQ ID NO: 149411 - DNA, 15 bp, Unknown
  misc_feature (1)..( 15): Result.004 file - promoters60/5668329
aataatatatataga

SEQ ID NO: 149412 - DNA, 15 bp, Unknown
  misc_feature (1)..( 15): Result.004 file - promoters60/5668329
caaaatctataaacg

SEQ ID NO: 149413 - DNA, 15 bp, Unknown
  misc_feature (1)..( 15): Result.004 file - promoters60/5668352
caaaacctacaaacg

SEQ ID NO: 149414 - DNA, 11 bp, Unknown
  misc_feature (1)..( 11): Result.004 file - promoters60/5668352
agtaatataaa

SEQ ID NO: 149415 - DNA, 11 bp, Unknown
  misc_feature (1)..( 11): Result.004 file - promoters60/5668352
agtaacatatg

SEQ ID NO: 149416 - DNA, 11 bp, Unknown
  misc_feature (1)..( 11): Result.004 file - promoters60/5668352
gtttatataaa

SEQ ID NO: 149417 - DNA, 7 bp, Unknown
  misc_feature (1)..( 7): Result.004 file - promoters60/5668352
gaaaaaa

SEQ ID NO: 149418 - DNA, 7 bp, Unknown
  misc_feature (1)..( 7): Result.004 file - promoters60/5668352
gaataaa

SEQ ID NO: 149419 - DNA, 7 bp, Unknown
  misc_feature (1)..( 7): Result.004 file - promoters60/5668352
gaagaaa

SEQ ID NO: 149420 - DNA, 11 bp, Unknown
  misc_feature (1)..( 11): Result.004 file - promoters60/5668352
tatcttcaact

SEQ ID NO: 149421 - DNA, 11 bp, Unknown
  misc_feature (1)..( 11): Result.004 file - promoters60/5668352
tttctttaact

SEQ ID NO: 149422 - DNA, 11 bp, Unknown
  misc_feature (1)..( 11): Result.004 file - promoters60/5668359
tttttttatgg

SEQ ID NO: 149423 - DNA, 8 bp, Unknown
  misc_feature (1)..( 8): Result.004 file - promoters60/5668359
atggatgt

SEQ ID NO: 149424 - DNA, 8 bp, Unknown
  misc_feature (1)..( 8): Result.004 file - promoters60/5668359
atggattt

SEQ ID NO: 149425 - DNA, 8 bp, Unknown
  misc_feature (1)..( 8): Result.004 file - promoters60/5668359
ttggattt

SEQ ID NO: 149426 - DNA, 6 bp, Unknown
  misc_feature (1)..( 6): Result.004 file - promoters60/5668359
ggtgtt

SEQ ID NO: 149427 - DNA, 6 bp, Unknown
  misc_feature (1)..( 6): Result.004 file - promoters60/5668359
ggtgtt

SEQ ID NO: 149428 - DNA, 9 bp, Unknown
  misc_feature (1)..( 9): Result.004 file - promoters60/5668359
agaacagaa

SEQ ID NO: 149429 - DNA, 9 bp, Unknown
  misc_feature (1)..( 9): Result.004 file - promoters60/5668359
agaagagaa

SEQ ID NO: 149430 - DNA, 11 bp, Unknown
  misc_feature (1)..( 11): Result.004 file - promoters60/5668359
agtatcctgtt

SEQ ID NO: 149431 - DNA, 11 bp, Unknown
  misc_feature (1)..( 11): Result.004 file - promoters60/5668359
agtgtccagtt

SEQ ID NO: 149432 - DNA, 7 bp, Unknown
  misc_feature (1)..( 7): Result.004 file - promoters60/5668359
tgcaaat

SEQ ID NO: 149433 - DNA, 7 bp, Unknown
  misc_feature (1)..( 7): Result.004 file - promoters60/5668359
tgctaat

SEQ ID NO: 149434 - DNA, 13 bp, Unknown
  misc_feature (1)..( 13): Result.004 file - promoters60/5668359
ttgaatcaatatt

SEQ ID NO: 149435 - DNA, 13 bp, Unknown
  misc_feature (1)..( 13): Result.004 file - promoters60/5668359
ttgattcaaaatt

SEQ ID NO: 149436 - DNA, 6 bp, Unknown
  misc_feature (1)..( 6): Result.004 file - promoters60/5668359
aagatt

SEQ ID NO: 149437 - DNA, 6 bp, Unknown
  misc_feature (1)..( 6): Result.004 file - promoters60/5668359
aagatt

SEQ ID NO: 149438 - DNA, 6 bp, Unknown
  misc_feature (1)..( 6): Result.004 file - promoters60/5668359
ttggtt

SEQ ID NO: 149439 - DNA, 6 bp, Unknown
  misc_feature (1)..( 6): Result.004 file - promoters60/5668359
ttggtt

SEQ ID NO: 149440 - DNA, 6 bp, Unknown
  misc_feature (1)..( 6): Result.004 file - promoters60/5668359
ttaacc

SEQ ID NO: 149441 - DNA, 6 bp, Unknown
  misc_feature (1)..( 6): Result.004 file - promoters60/5668359
ttaacc

SEQ ID NO: 149442 - DNA, 7 bp, Unknown
  misc_feature (1)..( 7): Result.004 file - promoters60/5668359
ctcactc

SEQ ID NO: 149443 - DNA, 7 bp, Unknown
  misc_feature (1)..( 7): Result.004 file - promoters60/5668359
ctcgctc

SEQ ID NO: 149444 - DNA, 6 bp, Unknown
  misc_feature (1)..( 6): Result.004 file - promoters60/5668359
atttct

SEQ ID NO: 149445 - DNA, 6 bp, Unknown
  misc_feature (1)..( 6): Result.004 file - promoters60/5668367
atttct

SEQ ID NO: 149446 - DNA, 13 bp, Unknown
  misc_feature (1)..( 13): Result.004 file - promoters60/5668367
gagaaccacattt

SEQ ID NO: 149447 - DNA, 13 bp, Unknown
  misc_feature (1)..( 13): Result.004 file - promoters60/5668367
gaggaccaaatta

SEQ ID NO: 149448 - DNA, 13 bp, Unknown
  misc_feature (1)..( 13): Result.004 file - promoters60/5668367
tcaacataaatta

SEQ ID NO: 149449 - DNA, 9 bp, Unknown
  misc_feature (1)..( 9): Result.004 file - promoters60/5668367
gattctaaa

SEQ ID NO: 149450 - DNA, 9 bp, Unknown
  misc_feature (1)..( 9): Result.004 file - promoters60/5668367
ttttcaaaa

SEQ ID NO: 149451 - DNA, 9 bp, Unknown
  misc_feature (1)..( 9): Result.004 file - promoters60/5668367
ttttttaaa

SEQ ID NO: 149452 - DNA, 9 bp, Unknown
  misc_feature (1)..( 9): Result.004 file - promoters60/5668367
gaaatatag

SEQ ID NO: 149453 - DNA, 9 bp, Unknown
  misc_feature (1)..( 9): Result.004 file - promoters60/5668367
acaatttag

SEQ ID NO: 149454 - DNA, 9 bp, Unknown
  misc_feature (1)..( 9): Result.004 file - promoters60/5668367
acattttaa

SEQ ID NO: 149455 - DNA, 9 bp, Unknown
  misc_feature (1)..( 9): Result.004 file - promoters60/5668367
gaaaaattt

SEQ ID NO: 149456 - DNA, 9 bp, Unknown
  misc_feature (1)..( 9): Result.004 file - promoters60/5668367
gaaaaacaa

SEQ ID NO: 149457 - DNA, 9 bp, Unknown
  misc_feature (1)..( 9): Result.004 file - promoters60/5668367
taaacattt

SEQ ID NO: 149458 - DNA, 7 bp, Unknown
  misc_feature (1)..( 7): Result.004 file - promoters60/5668367
catgatc

SEQ ID NO: 149459 - DNA, 7 bp, Unknown
  misc_feature (1)..( 7): Result.004 file - promoters60/5668367
catgatt

SEQ ID NO: 149460 - DNA, 7 bp, Unknown
  misc_feature (1)..( 7): Result.004 file - promoters60/5668367
aatgatc

SEQ ID NO: 149461 - DNA, 7 bp, Unknown
  misc_feature (1)..( 7): Result.004 file - promoters60/5668367
tgagttt

SEQ ID NO: 149462 - DNA, 7 bp, Unknown
  misc_feature (1)..( 7): Result.004 file - promoters60/5668367
tgatttt

SEQ ID NO: 149463 - DNA, 7 bp, Unknown
  misc_feature (1)..( 7): Result.004 file - promoters60/5668367
aatatag

SEQ ID NO: 149464 - DNA, 7 bp, Unknown
  misc_feature (1)..( 7): Result.004 file - promoters60/5668367
aatttag

SEQ ID NO: 149465 - DNA, 6 bp, Unknown
  misc_feature (1)..( 6): Result.004 file - promoters60/5668367
ataata

SEQ ID NO: 149466 - DNA, 6 bp, Unknown
  misc_feature (1)..( 6): Result.004 file - promoters60/5668367
ataata

SEQ ID NO: 149467 - DNA, 9 bp, Unknown
  misc_feature (1)..( 9): Result.004 file - promoters60/5668367
tccacaaac

SEQ ID NO: 149468 - DNA, 9 bp, Unknown
  misc_feature (1)..( 9): Result.004 file - promoters60/5668367
tccaaaaac

SEQ ID NO: 149469 - DNA, 11 bp, Unknown
  misc_feature (1)..( 11): Result.004 file - promoters60/5668367
ataaattcatc

SEQ ID NO: 149470 - DNA, 11 bp, Unknown
  misc_feature (1)..( 11): Result.004 file - promoters60/5668367
ataaatacatc

SEQ ID NO: 149471 - DNA, 11 bp, Unknown
  misc_feature (1)..( 11): Result.004 file - promoters60/5668367
ataaatacatc

SEQ ID NO: 149472 - DNA, 9 bp, Unknown
  misc_feature (1)..( 9): Result.004 file - promoters60/5668367
atttttttc

SEQ ID NO: 149473 - DNA, 9 bp, Unknown
  misc_feature (1)..( 9): Result.004 file - promoters60/5668367
attattttc

SEQ ID NO: 149474 - DNA, 7 bp, Unknown
  misc_feature (1)..( 7): Result.004 file - promoters60/5668367
tatttat

SEQ ID NO: 149475 - DNA, 7 bp, Unknown
  misc_feature (1)..( 7): Result.004 file - promoters60/5668367
tatatat

SEQ ID NO: 149476 - DNA, 8 bp, Unknown
  misc_feature (1)..( 8): Result.004 file - promoters60/5668367
ttttctat

SEQ ID NO: 149477 - DNA, 8 bp, Unknown
  misc_feature (1)..( 8): Result.004 file - promoters60/5668367
ttttatat

SEQ ID NO: 149478 - DNA, 7 bp, Unknown
  misc_feature (1)..( 7): Result.004 file - promoters60/5668367
atagtat

SEQ ID NO: 149479 - DNA, 7 bp, Unknown
  misc_feature (1)..( 7): Result.004 file - promoters60/5668367
ataatat

SEQ ID NO: 149480 - DNA, 14 bp, Unknown
  misc_feature (1)..( 14): Result.004 file - promoters60/5668367
ctaaattaacattt

SEQ ID NO: 149481 - DNA, 14 bp, Unknown
  misc_feature (1)..( 14): Result.004 file - promoters60/5668367
tttttataacattt

SEQ ID NO: 149482 - DNA, 14 bp, Unknown
  misc_feature (1)..( 14): Result.004 file - promoters60/5668367
tttttataccattc

SEQ ID NO: 149483 - DNA, 8 bp, Unknown
  misc_feature (1)..( 8): Result.004 file - promoters60/5668367
atttgttt

SEQ ID NO: 149484 - DNA, 8 bp, Unknown
  misc_feature (1)..( 8): Result.004 file - promoters60/5668367
ttttattt

SEQ ID NO: 149485 - DNA, 8 bp, Unknown
  misc_feature (1)..( 8): Result.004 file - promoters60/5668367
ttttatac

SEQ ID NO: 149486 - DNA, 7 bp, Unknown
  misc_feature (1)..( 7): Result.004 file - promoters60/5668367
tttaagc

SEQ ID NO: 149487 - DNA, 7 bp, Unknown
  misc_feature (1)..( 7): Result.004 file - promoters60/5668367
tttaagc

SEQ ID NO: 149488 - DNA, 8 bp, Unknown
  misc_feature (1)..( 8): Result.004 file - promoters60/5668367
tttcatga

SEQ ID NO: 149489 - DNA, 8 bp, Unknown
  misc_feature (1)..( 8): Result.004 file - promoters60/5668367
tttcttga

SEQ ID NO: 149490 - DNA, 8 bp, Unknown
  misc_feature (1)..( 8): Result.004 file - promoters60/5668367
attattga

SEQ ID NO: 149491 - DNA, 8 bp, Unknown
  misc_feature (1)..( 8): Result.004 file - promoters60/5668367
attcttga

SEQ ID NO: 149492 - DNA, 9 bp, Unknown
  misc_feature (1)..( 9): Result.004 file - promoters60/5668367
taagtaatt

SEQ ID NO: 149493 - DNA, 9 bp, Unknown
  misc_feature (1)..( 9): Result.004 file - promoters60/5668367
taattaatt

SEQ ID NO: 149494 - DNA, 7 bp, Unknown
  misc_feature (1)..( 7): Result.004 file - promoters60/5668367
acataaa

SEQ ID NO: 149495 - DNA, 7 bp, Unknown
  misc_feature (1)..( 7): Result.004 file - promoters60/5668367
acagaaa

SEQ ID NO: 149496 - DNA, 6 bp, Unknown
  misc_feature (1)..( 6): Result.004 file - promoters60/5668367
attctt

SEQ ID NO: 149497 - DNA, 6 bp, Unknown
  misc_feature (1)..( 6): Result.004 file - promoters60/5668367
attctt

SEQ ID NO: 149498 - DNA, 7 bp, Unknown
  misc_feature (1)..( 7): Result.004 file - promoters60/5668367
aaactat

SEQ ID NO: 149499 - DNA, 7 bp, Unknown
  misc_feature (1)..( 7): Result.004 file - promoters60/5668367
aaattat

SEQ ID NO: 149500 - DNA, 7 bp, Unknown
  misc_feature (1)..( 7): Result.004 file - promoters60/5668367
agatttt

SEQ ID NO: 149501 - DNA, 7 bp, Unknown
  misc_feature (1)..( 7): Result.004 file - promoters60/5668367
agatttt

SEQ ID NO: 149502 - DNA, 6 bp, Unknown
  misc_feature (1)..( 6): Result.004 file - promoters60/5668367
atttta

SEQ ID NO: 149503 - DNA, 6 bp, Unknown
  misc_feature (1)..( 6): Result.004 file - promoters60/5668367
atttta

SEQ ID NO: 149504 - DNA, 7 bp, Unknown
  misc_feature (1)..( 7): Result.004 file - promoters60/5668367
ttaaaat

SEQ ID NO: 149505 - DNA, 7 bp, Unknown
  misc_feature (1)..( 7): Result.004 file - promoters60/5668367
ttaaaat

SEQ ID NO: 149506 - DNA, 6 bp, Unknown
  misc_feature (1)..( 6): Result.004 file - promoters60/5668367
gttttc

SEQ ID NO: 149507 - DNA, 6 bp, Unknown
  misc_feature (1)..( 6): Result.004 file - promoters60/5668367
gttttc

SEQ ID NO: 149508 - DNA, 6 bp, Unknown
  misc_feature (1)..( 6): Result.004 file - promoters60/5668367
aaaatt

SEQ ID NO: 149509 - DNA, 6 bp, Unknown
  misc_feature (1)..( 6): Result.004 file - promoters60/5668367
aaaatt

SEQ ID NO: 149510 - DNA, 7 bp, Unknown
  misc_feature (1)..( 7): Result.004 file - promoters60/5668367
atttaat

SEQ ID NO: 149511 - DNA, 7 bp, Unknown
  misc_feature (1)..( 7): Result.004 file - promoters60/5668367
attgaat

SEQ ID NO: 149512 - DNA, 6 bp, Unknown
  misc_feature (1)..( 6): Result.004 file - promoters60/5668367
actttt

SEQ ID NO: 149513 - DNA, 6 bp, Unknown
  misc_feature (1)..( 6): Result.004 file - promoters60/5668367
actttt

SEQ ID NO: 149514 - DNA, 8 bp, Unknown
  misc_feature (1)..( 8): Result.004 file - promoters60/5668367
aaacaaaa

SEQ ID NO: 149515 - DNA, 8 bp, Unknown
  misc_feature (1)..( 8): Result.004 file - promoters60/5668367
aaacaaaa

SEQ ID NO: 149516 - DNA, 8 bp, Unknown
  misc_feature (1)..( 8): Result.004 file - promoters60/5668367
gaaataca

SEQ ID NO: 149517 - DNA, 8 bp, Unknown
  misc_feature (1)..( 8): Result.004 file - promoters60/5668367
gaaagaca

SEQ ID NO: 149518 - DNA, 7 bp, Unknown
  misc_feature (1)..( 7): Result.004 file - promoters60/5668367
aaaagtc

SEQ ID NO: 149519 - DNA, 7 bp, Unknown
  misc_feature (1)..( 7): Result.004 file - promoters60/5668367
aaaagtc

SEQ ID NO: 149520 - DNA, 8 bp, Unknown
  misc_feature (1)..( 8): Result.004 file - promoters60/5668367
aaggaaga

SEQ ID NO: 149521 - DNA, 8 bp, Unknown
  misc_feature (1)..( 8): Result.004 file - promoters60/5668367
aagtaaga

SEQ ID NO: 149522 - DNA, 27 bp, Unknown
  misc_feature (1)..( 27): Result.004 file - promoters60/5668367
gtcaacaaacgatggctatacaacaag

SEQ ID NO: 149523 - DNA, 27 bp, Unknown
  misc_feature (1)..( 27): Result.004 file - promoters60/5668375
gtcaacaaacgttggctatacaacaag

SEQ ID NO: 149524 - DNA, 8 bp, Unknown
  misc_feature (1)..( 8): Result.004 file - promoters60/5668375
gtttgaaa

SEQ ID NO: 149525 - DNA, 8 bp, Unknown
  misc_feature (1)..( 8): Result.004 file - promoters60/5668375
ttttgaat

SEQ ID NO: 149526 - DNA, 8 bp, Unknown
  misc_feature (1)..( 8): Result.004 file - promoters60/5668375
atttcaaa

SEQ ID NO: 149527 - DNA, 8 bp, Unknown
  misc_feature (1)..( 8): Result.004 file - promoters60/5668375
tttttaat

SEQ ID NO: 149528 - DNA, 9 bp, Unknown
  misc_feature (1)..( 9): Result.004 file - promoters60/5668375
tttttcttc

SEQ ID NO: 149529 - DNA, 9 bp, Unknown
  misc_feature (1)..( 9): Result.004 file - promoters60/5668375
tttttctat

SEQ ID NO: 149530 - DNA, 9 bp, Unknown
  misc_feature (1)..( 9): Result.004 file - promoters60/5668375
cttttctgg

SEQ ID NO: 149531 - DNA, 9 bp, Unknown
  misc_feature (1)..( 9): Result.004 file - promoters60/5668427
ttttccttc

SEQ ID NO: 149532 - DNA, 15 bp, Unknown
  misc_feature (1)..( 15): Result.004 file - promoters60/5668427
tttggggtttgattc

SEQ ID NO: 149533 - DNA, 15 bp, Unknown
  misc_feature (1)..( 15): Result.004 file - promoters60/5668427
tttgggattttctta

SEQ ID NO: 149534 - DNA, 15 bp, Unknown
  misc_feature (1)..( 15): Result.004 file - promoters60/5668427
cctctggtttgcttc

SEQ ID NO: 149535 - DNA, 9 bp, Unknown
  misc_feature (1)..( 9): Result.004 file - promoters60/5668427
taatctggt

SEQ ID NO: 149536 - DNA, 9 bp, Unknown
  misc_feature (1)..( 9): Result.004 file - promoters60/5668427
taatctgat

SEQ ID NO: 149537 - DNA, 9 bp, Unknown
  misc_feature (1)..( 9): Result.004 file - promoters60/5668427
tgatccgat

SEQ ID NO: 149538 - DNA, 7 bp, Unknown
  misc_feature (1)..( 7): Result.004 file - promoters60/5668427
tacattc

SEQ ID NO: 149539 - DNA, 7 bp, Unknown
  misc_feature (1)..( 7): Result.004 file - promoters60/5668427
tacatta

SEQ ID NO: 149540 - DNA, 7 bp, Unknown
  misc_feature (1)..( 7): Result.004 file - promoters60/5668427
gacatta

SEQ ID NO: 149541 - DNA, 8 bp, Unknown
  misc_feature (1)..( 8): Result.004 file - promoters60/5668427
tcaggtta

SEQ ID NO: 149542 - DNA, 8 bp, Unknown
  misc_feature (1)..( 8): Result.004 file - promoters60/5668427
tcaggttg

SEQ ID NO: 149543 - DNA, 8 bp, Unknown
  misc_feature (1)..( 8): Result.004 file - promoters60/5668435
tcatgttg

SEQ ID NO: 149544 - DNA, 10 bp, Unknown
  misc_feature (1)..( 10): Result.004 file - promoters60/5668435
tatatactta

SEQ ID NO: 149545 - DNA, 10 bp, Unknown
  misc_feature (1)..( 10): Result.004 file - promoters60/5668435
aatacactag

SEQ ID NO: 149546 - DNA, 10 bp, Unknown
  misc_feature (1)..( 10): Result.004 file - promoters60/5668435
tatatatata

SEQ ID NO: 149547 - DNA, 10 bp, Unknown
  misc_feature (1)..( 10): Result.004 file - promoters60/5668435
tatatagata

SEQ ID NO: 149548 - DNA, 10 bp, Unknown
  misc_feature (1)..( 10): Result.004 file - promoters60/5668435
tatataaact

SEQ ID NO: 149549 - DNA, 10 bp, Unknown
  misc_feature (1)..( 10): Result.004 file - promoters60/5668454
aataaaaagc

SEQ ID NO: 149550 - DNA, 9 bp, Unknown
  misc_feature (1)..( 9): Result.004 file - promoters60/5668454
tcttaatta

SEQ ID NO: 149551 - DNA, 9 bp, Unknown
  misc_feature (1)..( 9): Result.004 file - promoters60/5668454
atttaattc

SEQ ID NO: 149552 - DNA, 9 bp, Unknown
  misc_feature (1)..( 9): Result.004 file - promoters60/5668454
tcttaatct

SEQ ID NO: 149553 - DNA, 9 bp, Unknown
  misc_feature (1)..( 9): Result.004 file - promoters60/5668454
atttattta

SEQ ID NO: 149554 - DNA, 11 bp, Unknown
  misc_feature (1)..( 11): Result.004 file - promoters60/5668454
aaataaattct

SEQ ID NO: 149555 - DNA, 11 bp, Unknown
  misc_feature (1)..( 11): Result.004 file - promoters60/5668454
atacaaaatct

SEQ ID NO: 149556 - DNA, 11 bp, Unknown
  misc_feature (1)..( 11): Result.004 file - promoters60/5668454
aaaaaaattcc

SEQ ID NO: 149557 - DNA, 11 bp, Unknown
  misc_feature (1)..( 11): Result.004 file - promoters60/5668454
taatatatttt

SEQ ID NO: 149558 - DNA, 7 bp, Unknown
  misc_feature (1)..( 7): Result.004 file - promoters60/5668454
atctaaa

SEQ ID NO: 149559 - DNA, 7 bp, Unknown
  misc_feature (1)..( 7): Result.004 file - promoters60/5668454
ttctaaa

SEQ ID NO: 149560 - DNA, 7 bp, Unknown
  misc_feature (1)..( 7): Result.004 file - promoters60/5668454
ttctaaa

SEQ ID NO: 149561 - DNA, 7 bp, Unknown
  misc_feature (1)..( 7): Result.004 file - promoters60/5668457
ttctaac

SEQ ID NO: 149562 - DNA, 6 bp, Unknown
  misc_feature (1)..( 6): Result.004 file - promoters60/5668457
aaccct

SEQ ID NO: 149563 - DNA, 6 bp, Unknown
  misc_feature (1)..( 6): Result.004 file - promoters60/5668457
aaccct

SEQ ID NO: 149564 - DNA, 6 bp, Unknown
  misc_feature (1)..( 6): Result.004 file - promoters60/5668457
gaattt

SEQ ID NO: 149565 - DNA, 6 bp, Unknown
  misc_feature (1)..( 6): Result.004 file - promoters60/5668457
gaattt

SEQ ID NO: 149566 - DNA, 8 bp, Unknown
  misc_feature (1)..( 8): Result.004 file - promoters60/5668457
acataagt

SEQ ID NO: 149567 - DNA, 8 bp, Unknown
  misc_feature (1)..( 8): Result.004 file - promoters60/5668457
acatgagt

SEQ ID NO: 149568 - DNA, 6 bp, Unknown
  misc_feature (1)..( 6): Result.004 file - promoters60/5668457
aaaaaa

SEQ ID NO: 149569 - DNA, 6 bp, Unknown
  misc_feature (1)..( 6): Result.004 file - promoters60/5668457
aaaaaa

SEQ ID NO: 149570 - DNA, 7 bp, Unknown
  misc_feature (1)..( 7): Result.004 file - promoters60/5668457
gtttcta

SEQ ID NO: 149571 - DNA, 7 bp, Unknown
  misc_feature (1)..( 7): Result.004 file - promoters60/5668457
gttacta

SEQ ID NO: 149572 - DNA, 6 bp, Unknown
  misc_feature (1)..( 6): Result.004 file - promoters60/5668457
caaatt

SEQ ID NO: 149573 - DNA, 6 bp, Unknown
  misc_feature (1)..( 6): Result.004 file - promoters60/5668457
caaatt

SEQ ID NO: 149574 - DNA, 6 bp, Unknown
  misc_feature (1)..( 6): Result.004 file - promoters60/5668457
tattac

SEQ ID NO: 149575 - DNA, 6 bp, Unknown
  misc_feature (1)..( 6): Result.004 file - promoters60/5668457
tattac

SEQ ID NO: 149576 - DNA, 6 bp, Unknown
  misc_feature (1)..( 6): Result.004 file - promoters60/5668457
aaaact

SEQ ID NO: 149577 - DNA, 6 bp, Unknown
  misc_feature (1)..( 6): Result.004 file - promoters60/5668457
aaaact

SEQ ID NO: 149578 - DNA, 6 bp, Unknown
  misc_feature (1)..( 6): Result.004 file - promoters60/5668457
ttttgg

SEQ ID NO: 149579 - DNA, 6 bp, Unknown
  misc_feature (1)..( 6): Result.004 file - promoters60/5668457
ttttgg

SEQ ID NO: 149580 - DNA, 6 bp, Unknown
  misc_feature (1)..( 6): Result.004 file - promoters60/5668457
ggcttc

SEQ ID NO: 149581 - DNA, 6 bp, Unknown
  misc_feature (1)..( 6): Result.004 file - promoters60/5668457
ggcttc

SEQ ID NO: 149582 - DNA, 8 bp, Unknown
  misc_feature (1)..( 8): Result.004 file - promoters60/5668457
tttatata

SEQ ID NO: 149583 - DNA, 8 bp, Unknown
  misc_feature (1)..( 8): Result.004 file - promoters60/5668457
tttctata

SEQ ID NO: 149584 - DNA, 6 bp, Unknown
  misc_feature (1)..( 6): Result.004 file - promoters60/5668457
ggttga

SEQ ID NO: 149585 - DNA, 6 bp, Unknown
  misc_feature (1)..( 6): Result.004 file - promoters60/5668457
ggttga

SEQ ID NO: 149586 - DNA, 6 bp, Unknown
  misc_feature (1)..( 6): Result.004 file - promoters60/5668457
atgcaa

SEQ ID NO: 149587 - DNA, 6 bp, Unknown
  misc_feature (1)..( 6): Result.004 file - promoters60/5668457
atgcaa

SEQ ID NO: 149588 - DNA, 9 bp, Unknown
  misc_feature (1)..( 9): Result.004 file - promoters60/5668457
atgtttact

SEQ ID NO: 149589 - DNA, 9 bp, Unknown
  misc_feature (1)..( 9): Result.004 file - promoters60/5668457
atggttact

SEQ ID NO: 149590 - DNA, 9 bp, Unknown
  misc_feature (1)..( 9): Result.004 file - promoters60/5668457
agcccaaag

SEQ ID NO: 149591 - DNA, 9 bp, Unknown
  misc_feature (1)..( 9): Result.004 file - promoters60/5668469
agccccaag

SEQ ID NO: 149592 - DNA, 12 bp, Unknown
  misc_feature (1)..( 12): Result.004 file - promoters60/5668469
ttcttcatttat

SEQ ID NO: 149593 - DNA, 12 bp, Unknown
  misc_feature (1)..( 12): Result.004 file - promoters60/5668469
ccaatcatatat

SEQ ID NO: 149594 - DNA, 12 bp, Unknown
  misc_feature (1)..( 12): Result.004 file - promoters60/5668469
tataaaatttat

SEQ ID NO: 149595 - DNA, 12 bp, Unknown
  misc_feature (1)..( 12): Result.004 file - promoters60/5668469
ttcttctttttt

SEQ ID NO: 149596 - DNA, 12 bp, Unknown
  misc_feature (1)..( 12): Result.004 file - promoters60/5668469
gaccaaaattac

SEQ ID NO: 149597 - DNA, 9 bp, Unknown
  misc_feature (1)..( 9): Result.004 file - promoters60/5668469
aataacttt

SEQ ID NO: 149598 - DNA, 9 bp, Unknown
  misc_feature (1)..( 9): Result.004 file - promoters60/5668469
aatcactac

SEQ ID NO: 149599 - DNA, 9 bp, Unknown
  misc_feature (1)..( 9): Result.004 file - promoters60/5668469
tatatctta

SEQ ID NO: 149600 - DNA, 9 bp, Unknown
  misc_feature (1)..( 9): Result.004 file - promoters60/5668469
ttgatctta

SEQ ID NO: 149601 - DNA, 10 bp, Unknown
  misc_feature (1)..( 10): Result.004 file - promoters60/5668469
atataaaata

SEQ ID NO: 149602 - DNA, 10 bp, Unknown
  misc_feature (1)..( 10): Result.004 file - promoters60/5668469
gaatacaatt

SEQ ID NO: 149603 - DNA, 10 bp, Unknown
  misc_feature (1)..( 10): Result.004 file - promoters60/5668469
cagtaaaata

SEQ ID NO: 149604 - DNA, 10 bp, Unknown
  misc_feature (1)..( 10): Result.004 file - promoters60/5668469
cagtaaaaaa

SEQ ID NO: 149605 - DNA, 7 bp, Unknown
  misc_feature (1)..( 7): Result.004 file - promoters60/5668469
tttctta

SEQ ID NO: 149606 - DNA, 7 bp, Unknown
  misc_feature (1)..( 7): Result.004 file - promoters60/5668469
tttgtta

SEQ ID NO: 149607 - DNA, 7 bp, Unknown
  misc_feature (1)..( 7): Result.004 file - promoters60/5668469
tttgtta

SEQ ID NO: 149608 - DNA, 7 bp, Unknown
  misc_feature (1)..( 7): Result.004 file - promoters60/5668469
tttatta

SEQ ID NO: 149609 - DNA, 9 bp, Unknown
  misc_feature (1)..( 9): Result.004 file - promoters60/5668469
aaaattaag

SEQ ID NO: 149610 - DNA, 9 bp, Unknown
  misc_feature (1)..( 9): Result.004 file - promoters60/5668469
aaaaataat

SEQ ID NO: 149611 - DNA, 9 bp, Unknown
  misc_feature (1)..( 9): Result.004 file - promoters60/5668469
ataatgaag

SEQ ID NO: 149612 - DNA, 9 bp, Unknown
  misc_feature (1)..( 9): Result.004 file - promoters60/5668473
taaaatatt

SEQ ID NO: 149613 - DNA, 7 bp, Unknown
  misc_feature (1)..( 7): Result.004 file - promoters60/5668473
cacttta

SEQ ID NO: 149614 - DNA, 7 bp, Unknown
  misc_feature (1)..( 7): Result.004 file - promoters60/5668473
cacttta

SEQ ID NO: 149615 - DNA, 8 bp, Unknown
  misc_feature (1)..( 8): Result.004 file - promoters60/5668473
aaactcac

SEQ ID NO: 149616 - DNA, 8 bp, Unknown
  misc_feature (1)..( 8): Result.004 file - promoters60/5668473
aaaatcac

SEQ ID NO: 149617 - DNA, 6 bp, Unknown
  misc_feature (1)..( 6): Result.004 file - promoters60/5668473
atttgg

SEQ ID NO: 149618 - DNA, 6 bp, Unknown
  misc_feature (1)..( 6): Result.004 file - promoters60/5668473
atttgg

SEQ ID NO: 149619 - DNA, 6 bp, Unknown
  misc_feature (1)..( 6): Result.004 file - promoters60/5668473
aaaact

SEQ ID NO: 149620 - DNA, 6 bp, Unknown
  misc_feature (1)..( 6): Result.004 file - promoters60/5668473
aaaact

SEQ ID NO: 149621 - DNA, 6 bp, Unknown
  misc_feature (1)..( 6): Result.004 file - promoters60/5668473
cgtggc

SEQ ID NO: 149622 - DNA, 6 bp, Unknown
  misc_feature (1)..( 6): Result.004 file - promoters60/5668473
cgtggc

SEQ ID NO: 149623 - DNA, 7 bp, Unknown
  misc_feature (1)..( 7): Result.004 file - promoters60/5668473
agtatgt

SEQ ID NO: 149624 - DNA, 7 bp, Unknown
  misc_feature (1)..( 7): Result.004 file - promoters60/5668473
agtttgt

SEQ ID NO: 149625 - DNA, 8 bp, Unknown
  misc_feature (1)..( 8): Result.004 file - promoters60/5668473
taagactc

SEQ ID NO: 149626 - DNA, 8 bp, Unknown
  misc_feature (1)..( 8): Result.004 file - promoters60/5668473
taatactc

SEQ ID NO: 149627 - DNA, 7 bp, Unknown
  misc_feature (1)..( 7): Result.004 file - promoters60/5668473
tttagag

SEQ ID NO: 149628 - DNA, 7 bp, Unknown
  misc_feature (1)..( 7): Result.004 file - promoters60/5668473
ttttgag

SEQ ID NO: 149629 - DNA, 6 bp, Unknown
  misc_feature (1)..( 6): Result.004 file - promoters60/5668473
aacgtt

SEQ ID NO: 149630 - DNA, 6 bp, Unknown
  misc_feature (1)..( 6): Result.004 file - promoters60/5668473
aacgtt

SEQ ID NO: 149631 - DNA, 6 bp, Unknown
  misc_feature (1)..( 6): Result.004 file - promoters60/5668473
ggatca

SEQ ID NO: 149632 - DNA, 6 bp, Unknown
  misc_feature (1)..( 6): Result.004 file - promoters60/5668473
ggatca

SEQ ID NO: 149633 - DNA, 6 bp, Unknown
  misc_feature (1)..( 6): Result.004 file - promoters60/5668473
actaaa

SEQ ID NO: 149634 - DNA, 6 bp, Unknown
  misc_feature (1)..( 6): Result.004 file - promoters60/5668473
actaaa

SEQ ID NO: 149635 - DNA, 6 bp, Unknown
  misc_feature (1)..( 6): Result.004 file - promoters60/5668473
aaaatt

SEQ ID NO: 149636 - DNA, 6 bp, Unknown
  misc_feature (1)..( 6): Result.004 file - promoters60/5668473
aaaatt

SEQ ID NO: 149637 - DNA, 7 bp, Unknown
  misc_feature (1)..( 7): Result.004 file - promoters60/5668473
aatttta

SEQ ID NO: 149638 - DNA, 7 bp, Unknown
  misc_feature (1)..( 7): Result.004 file - promoters60/5668473
aatctta

SEQ ID NO: 149639 - DNA, 6 bp, Unknown
  misc_feature (1)..( 6): Result.004 file - promoters60/5668473
ttaaaa

SEQ ID NO: 149640 - DNA, 6 bp, Unknown
  misc_feature (1)..( 6): Result.004 file - promoters60/5668473
ttaaaa

SEQ ID NO: 149641 - DNA, 7 bp, Unknown
  misc_feature (1)..( 7): Result.004 file - promoters60/5668473
aatttaa

SEQ ID NO: 149642 - DNA, 7 bp, Unknown
  misc_feature (1)..( 7): Result.004 file - promoters60/5668473
aatataa

SEQ ID NO: 149643 - DNA, 10 bp, Unknown
  misc_feature (1)..( 10): Result.004 file - promoters60/5668473
ttttaaactt

SEQ ID NO: 149644 - DNA, 10 bp, Unknown
  misc_feature (1)..( 10): Result.004 file - promoters60/5668473
ttttgaactt

SEQ ID NO: 149645 - DNA, 6 bp, Unknown
  misc_feature (1)..( 6): Result.004 file - promoters60/5668473
aagccc

SEQ ID NO: 149646 - DNA, 6 bp, Unknown
  misc_feature (1)..( 6): Result.004 file - promoters60/5668493
aagccc

SEQ ID NO: 149647 - DNA, 9 bp, Unknown
  misc_feature (1)..( 9): Result.004 file - promoters60/5668493
aaatattag

SEQ ID NO: 149648 - DNA, 9 bp, Unknown
  misc_feature (1)..( 9): Result.004 file - promoters60/5668493
gaatattta

SEQ ID NO: 149649 - DNA, 9 bp, Unknown
  misc_feature (1)..( 9): Result.004 file - promoters60/5668493
aaatatttt

SEQ ID NO: 149650 - DNA, 9 bp, Unknown
  misc_feature (1)..( 9): Result.004 file - promoters60/5668493
aaaaattga

SEQ ID NO: 149651 - DNA, 9 bp, Unknown
  misc_feature (1)..( 9): Result.004 file - promoters60/5668493
ttatatttc

SEQ ID NO: 149652 - DNA, 9 bp, Unknown
  misc_feature (1)..( 9): Result.004 file - promoters60/5668493
tcaaattga

SEQ ID NO: 149653 - DNA, 19 bp, Unknown
  misc_feature (1)..( 19): Result.004 file - promoters60/5668493
caaaatgaacgacacgaag

SEQ ID NO: 149654 - DNA, 19 bp, Unknown
  misc_feature (1)..( 19): Result.004 file - promoters60/5668493
caagtccaacgaaacgatt

SEQ ID NO: 149655 - DNA, 19 bp, Unknown
  misc_feature (1)..( 19): Result.004 file - promoters60/5668493
tagagaatgagaatcgaat

SEQ ID NO: 149656 - DNA, 19 bp, Unknown
  misc_feature (1)..( 19): Result.004 file - promoters60/5668493
actcatgtggttatcaaat

SEQ ID NO: 149657 - DNA, 19 bp, Unknown
  misc_feature (1)..( 19): Result.004 file - promoters60/5668493
caagcccaaagaataaaaa

SEQ ID NO: 149658 - DNA, 19 bp, Unknown
  misc_feature (1)..( 19): Result.004 file - promoters60/5668505
tgcagtgaaaaaattatca

SEQ ID NO: 149659 - DNA, 9 bp, Unknown
  misc_feature (1)..( 9): Result.004 file - promoters60/5668505
gttattttt

SEQ ID NO: 149660 - DNA, 9 bp, Unknown
  misc_feature (1)..( 9): Result.004 file - promoters60/5668505
cttatttaa

SEQ ID NO: 149661 - DNA, 9 bp, Unknown
  misc_feature (1)..( 9): Result.004 file - promoters60/5668505
tatattttg

SEQ ID NO: 149662 - DNA, 12 bp, Unknown
  misc_feature (1)..( 12): Result.004 file - promoters60/5668505
tatgctaagaag

SEQ ID NO: 149663 - DNA, 12 bp, Unknown
  misc_feature (1)..( 12): Result.004 file - promoters60/5668505
tatgataataat

SEQ ID NO: 149664 - DNA, 12 bp, Unknown
  misc_feature (1)..( 12): Result.004 file - promoters60/5668505
aatgaaaataaa

SEQ ID NO: 149665 - DNA, 12 bp, Unknown
  misc_feature (1)..( 12): Result.004 file - promoters60/5668505
gctttcaataaa

SEQ ID NO: 149666 - DNA, 9 bp, Unknown
  misc_feature (1)..( 9): Result.004 file - promoters60/5668505
taagaagct

SEQ ID NO: 149667 - DNA, 9 bp, Unknown
  misc_feature (1)..( 9): Result.004 file - promoters60/5668505
taagaatat

SEQ ID NO: 149668 - DNA, 9 bp, Unknown
  misc_feature (1)..( 9): Result.004 file - promoters60/5668505
aaagaatat

SEQ ID NO: 149669 - DNA, 8 bp, Unknown
  misc_feature (1)..( 8): Result.004 file - promoters60/5668505
gttttttt

SEQ ID NO: 149670 - DNA, 8 bp, Unknown
  misc_feature (1)..( 8): Result.004 file - promoters60/5668505
atttgttt

SEQ ID NO: 149671 - DNA, 8 bp, Unknown
  misc_feature (1)..( 8): Result.004 file - promoters60/5668505
attagttt

SEQ ID NO: 149672 - DNA, 12 bp, Unknown
  misc_feature (1)..( 12): Result.004 file - promoters60/5668505
ttgcaattttat

SEQ ID NO: 149673 - DNA, 12 bp, Unknown
  misc_feature (1)..( 12): Result.004 file - promoters60/5668505
ttccaaatttca

SEQ ID NO: 149674 - DNA, 12 bp, Unknown
  misc_feature (1)..( 12): Result.004 file - promoters60/5668505
gttgaaatttta

SEQ ID NO: 149675 - DNA, 7 bp, Unknown
  misc_feature (1)..( 7): Result.004 file - promoters60/5668505
atatttt

SEQ ID NO: 149676 - DNA, 7 bp, Unknown
  misc_feature (1)..( 7): Result.004 file - promoters60/5668505
ataattt

SEQ ID NO: 149677 - DNA, 7 bp, Unknown
  misc_feature (1)..( 7): Result.004 file - promoters60/5668505
ttatttt

SEQ ID NO: 149678 - DNA, 9 bp, Unknown
  misc_feature (1)..( 9): Result.004 file - promoters60/5668505
aaagaaccg

SEQ ID NO: 149679 - DNA, 9 bp, Unknown
  misc_feature (1)..( 9): Result.004 file - promoters60/5668505
aaagaatat

SEQ ID NO: 149680 - DNA, 9 bp, Unknown
  misc_feature (1)..( 9): Result.004 file - promoters60/5668505
taagaatat

SEQ ID NO: 149681 - DNA, 10 bp, Unknown
  misc_feature (1)..( 10): Result.004 file - promoters60/5668505
acatacaaaa

SEQ ID NO: 149682 - DNA, 10 bp, Unknown
  misc_feature (1)..( 10): Result.004 file - promoters60/5668505
ggatataaat

SEQ ID NO: 149683 - DNA, 10 bp, Unknown
  misc_feature (1)..( 10): Result.004 file - promoters60/5668505
ggatatgaat

SEQ ID NO: 149684 - DNA, 8 bp, Unknown
  misc_feature (1)..( 8): Result.004 file - promoters60/5668505
aaattgtc

SEQ ID NO: 149685 - DNA, 8 bp, Unknown
  misc_feature (1)..( 8): Result.004 file - promoters60/5668505
aaattggg

SEQ ID NO: 149686 - DNA, 8 bp, Unknown
  misc_feature (1)..( 8): Result.004 file - promoters60/5668505
caatcgtc

SEQ ID NO: 149687 - DNA, 8 bp, Unknown
  misc_feature (1)..( 8): Result.004 file - promoters60/5668505
gctaaaac

SEQ ID NO: 149688 - DNA, 8 bp, Unknown
  misc_feature (1)..( 8): Result.004 file - promoters60/5668505
aataaaac

SEQ ID NO: 149689 - DNA, 8 bp, Unknown
  misc_feature (1)..( 8): Result.004 file - promoters60/5668509
aataaaat

SEQ ID NO: 149690 - DNA, 9 bp, Unknown
  misc_feature (1)..( 9): Result.004 file - promoters60/5668509
gaaaatatt

SEQ ID NO: 149691 - DNA, 9 bp, Unknown
  misc_feature (1)..( 9): Result.004 file - promoters60/5668509
aaaaataag

SEQ ID NO: 149692 - DNA, 9 bp, Unknown
  misc_feature (1)..( 9): Result.004 file - promoters60/5668509
aaaaattaa

SEQ ID NO: 149693 - DNA, 9 bp, Unknown
  misc_feature (1)..( 9): Result.004 file - promoters60/5668509
aaacatatt

SEQ ID NO: 149694 - DNA, 9 bp, Unknown
  misc_feature (1)..( 9): Result.004 file - promoters60/5668509
acaaataaa

SEQ ID NO: 149695 - DNA, 9 bp, Unknown
  misc_feature (1)..( 9): Result.004 file - promoters60/5668509
taaaatttc

SEQ ID NO: 149696 - DNA, 9 bp, Unknown
  misc_feature (1)..( 9): Result.004 file - promoters60/5668509
caaaattga

SEQ ID NO: 149697 - DNA, 12 bp, Unknown
  misc_feature (1)..( 12): Result.004 file - promoters60/5668509
aaaataaataaa

SEQ ID NO: 149698 - DNA, 12 bp, Unknown
  misc_feature (1)..( 12): Result.004 file - promoters60/5668509
ttaataaagcta

SEQ ID NO: 149699 - DNA, 12 bp, Unknown
  misc_feature (1)..( 12): Result.004 file - promoters60/5668509
aaaattaatatt

SEQ ID NO: 149700 - DNA, 12 bp, Unknown
  misc_feature (1)..( 12): Result.004 file - promoters60/5668509
tatgttaacaaa

SEQ ID NO: 149701 - DNA, 12 bp, Unknown
  misc_feature (1)..( 12): Result.004 file - promoters60/5668509
gagataatattt

SEQ ID NO: 149702 - DNA, 12 bp, Unknown
  misc_feature (1)..( 12): Result.004 file - promoters60/5668509
attataaaatac

SEQ ID NO: 149703 - DNA, 8 bp, Unknown
  misc_feature (1)..( 8): Result.004 file - promoters60/5668509
aaaacaaa

SEQ ID NO: 149704 - DNA, 8 bp, Unknown
  misc_feature (1)..( 8): Result.004 file - promoters60/5668509
aaaaaaaa

SEQ ID NO: 149705 - DNA, 8 bp, Unknown
  misc_feature (1)..( 8): Result.004 file - promoters60/5668509
taaataaa

SEQ ID NO: 149706 - DNA, 8 bp, Unknown
  misc_feature (1)..( 8): Result.004 file - promoters60/5668509
caaacaaa

SEQ ID NO: 149707 - DNA, 8 bp, Unknown
  misc_feature (1)..( 8): Result.004 file - promoters60/5668509
taaaaaaa

SEQ ID NO: 149708 - DNA, 8 bp, Unknown
  misc_feature (1)..( 8): Result.004 file - promoters60/5668509
gaaataga

SEQ ID NO: 149709 - DNA, 8 bp, Unknown
  misc_feature (1)..( 8): Result.004 file - promoters60/5668509
aaaacgac

SEQ ID NO: 149710 - DNA, 13 bp, Unknown
  misc_feature (1)..( 13): Result.004 file - promoters60/5668509
aattgggactaaa

SEQ ID NO: 149711 - DNA, 13 bp, Unknown
  misc_feature (1)..( 13): Result.004 file - promoters60/5668509
tatttggataaaa

SEQ ID NO: 149712 - DNA, 13 bp, Unknown
  misc_feature (1)..( 13): Result.004 file - promoters60/5668509
cctttgaataaaa

SEQ ID NO: 149713 - DNA, 13 bp, Unknown
  misc_feature (1)..( 13): Result.004 file - promoters60/5668509
aattaaaaaggaa

SEQ ID NO: 149714 - DNA, 13 bp, Unknown
  misc_feature (1)..( 13): Result.004 file - promoters60/5668509
gctttgaacatta

SEQ ID NO: 149715 - DNA, 13 bp, Unknown
  misc_feature (1)..( 13): Result.004 file - promoters60/5668509
aaggtcaataaat

SEQ ID NO: 149716 - DNA, 13 bp, Unknown
  misc_feature (1)..( 13): Result.004 file - promoters60/5668509
ttttaaaaaactt

SEQ ID NO: 149717 - DNA, 11 bp, Unknown
  misc_feature (1)..( 11): Result.004 file - promoters60/5668509
ttacaaaacta

SEQ ID NO: 149718 - DNA, 11 bp, Unknown
  misc_feature (1)..( 11): Result.004 file - promoters60/5668509
atacaaaaaaa

SEQ ID NO: 149719 - DNA, 11 bp, Unknown
  misc_feature (1)..( 11): Result.004 file - promoters60/5668509
tcacaaaagac

SEQ ID NO: 149720 - DNA, 11 bp, Unknown
  misc_feature (1)..( 11): Result.004 file - promoters60/5668509
tcccaaaaata

SEQ ID NO: 149721 - DNA, 11 bp, Unknown
  misc_feature (1)..( 11): Result.004 file - promoters60/5668509
tcctaaaatca

SEQ ID NO: 149722 - DNA, 11 bp, Unknown
  misc_feature (1)..( 11): Result.004 file - promoters60/5668509
aaataaacata

SEQ ID NO: 149723 - DNA, 11 bp, Unknown
  misc_feature (1)..( 11): Result.004 file - promoters60/5668509
acccaaaattg

SEQ ID NO: 149724 - DNA, 13 bp, Unknown
  misc_feature (1)..( 13): Result.004 file - promoters60/5668509
atattattagtag

SEQ ID NO: 149725 - DNA, 13 bp, Unknown
  misc_feature (1)..( 13): Result.004 file - promoters60/5668509
atattattagcct

SEQ ID NO: 149726 - DNA, 13 bp, Unknown
  misc_feature (1)..( 13): Result.004 file - promoters60/5668509
ttattatattgag

SEQ ID NO: 149727 - DNA, 13 bp, Unknown
  misc_feature (1)..( 13): Result.004 file - promoters60/5668509
atataattatttt

SEQ ID NO: 149728 - DNA, 13 bp, Unknown
  misc_feature (1)..( 13): Result.004 file - promoters60/5668509
gattaattctttt

SEQ ID NO: 149729 - DNA, 14 bp, Unknown
  misc_feature (1)..( 14): Result.004 file - promoters60/5668509
cgtttacttcaaaa

SEQ ID NO: 149730 - DNA, 12 bp, Unknown
  misc_feature (1)..( 12): Result.004 file - promoters60/5668509
ccattatatata

SEQ ID NO: 149731 - DNA, 12 bp, Unknown
  misc_feature (1)..( 12): Result.004 file - promoters60/5668509
cgcctatatata

SEQ ID NO: 149732 - DNA, 12 bp, Unknown
  misc_feature (1)..( 12): Result.004 file - promoters60/5668509
tccttataaata

SEQ ID NO: 149733 - DNA, 12 bp, Unknown
  misc_feature (1)..( 12): Result.004 file - promoters60/5668509
tccctataaatt

SEQ ID NO: 149734 - DNA, 12 bp, Unknown
  misc_feature (1)..( 12): Result.004 file - promoters60/5668509
gtgagatataat

SEQ ID NO: 149735 - DNA, 12 bp, Unknown
  misc_feature (1)..( 12): Result.004 file - promoters60/5668509
gccttaaaaacc

SEQ ID NO: 149736 - DNA, 12 bp, Unknown
  misc_feature (1)..( 12): Result.004 file - promoters60/5668509
cctttaaaaaag

SEQ ID NO: 149737 - DNA, 7 bp, Unknown
  misc_feature (1)..( 7): Result.004 file - promoters60/5668509
taagatt

SEQ ID NO: 149738 - DNA, 7 bp, Unknown
  misc_feature (1)..( 7): Result.004 file - promoters60/5668509
taaaatt

SEQ ID NO: 149739 - DNA, 7 bp, Unknown
  misc_feature (1)..( 7): Result.004 file - promoters60/5668509
taaaatt

SEQ ID NO: 149740 - DNA, 7 bp, Unknown
  misc_feature (1)..( 7): Result.004 file - promoters60/5668509
aaaaatt

SEQ ID NO: 149741 - DNA, 8 bp, Unknown
  misc_feature (1)..( 8): Result.004 file - promoters60/5668509
taacaatt

SEQ ID NO: 149742 - DNA, 8 bp, Unknown
  misc_feature (1)..( 8): Result.004 file - promoters60/5668509
ccaaaatt

SEQ ID NO: 149743 - DNA, 11 bp, Unknown
  misc_feature (1)..( 11): Result.004 file - promoters60/5668509
tccctataaat

SEQ ID NO: 149744 - DNA, 11 bp, Unknown
  misc_feature (1)..( 11): Result.004 file - promoters60/5668509
cgcctatatat

SEQ ID NO: 149745 - DNA, 12 bp, Unknown
  misc_feature (1)..( 12): Result.004 file - promoters60/5668509
atccttataaat

SEQ ID NO: 149746 - DNA, 12 bp, Unknown
  misc_feature (1)..( 12): Result.004 file - promoters60/5668509
atcctttttagt

SEQ ID NO: 149747 - DNA, 12 bp, Unknown
  misc_feature (1)..( 12): Result.004 file - promoters60/5668509
cgccttaaaaac

SEQ ID NO: 149748 - DNA, 12 bp, Unknown
  misc_feature (1)..( 12): Result.004 file - promoters60/5668529
gcctttaaaaaa

SEQ ID NO: 149749 - DNA, 8 bp, Unknown
  misc_feature (1)..( 8): Result.004 file - promoters60/5668529
ccgtatct

SEQ ID NO: 149750 - DNA, 8 bp, Unknown
  misc_feature (1)..( 8): Result.004 file - promoters60/5668529
tcgtctct

SEQ ID NO: 149751 - DNA, 8 bp, Unknown
  misc_feature (1)..( 8): Result.004 file - promoters60/5668529
ccgtttct

SEQ ID NO: 149752 - DNA, 8 bp, Unknown
  misc_feature (1)..( 8): Result.004 file - promoters60/5668529
tatcctct

SEQ ID NO: 149753 - DNA, 11 bp, Unknown
  misc_feature (1)..( 11): Result.004 file - promoters60/5668529
aaccgttgact

SEQ ID NO: 149754 - DNA, 11 bp, Unknown
  misc_feature (1)..( 11): Result.004 file - promoters60/5668529
ttaagttgact

SEQ ID NO: 149755 - DNA, 11 bp, Unknown
  misc_feature (1)..( 11): Result.004 file - promoters60/5668529
aaatattgact

SEQ ID NO: 149756 - DNA, 11 bp, Unknown
  misc_feature (1)..( 11): Result.004 file - promoters60/5668529
ttaatttgaca

SEQ ID NO: 149757 - DNA, 10 bp, Unknown
  misc_feature (1)..( 10): Result.004 file - promoters60/5668529
ttcatatgca

SEQ ID NO: 149758 - DNA, 10 bp, Unknown
  misc_feature (1)..( 10): Result.004 file - promoters60/5668529
ttcttatgtt

SEQ ID NO: 149759 - DNA, 10 bp, Unknown
  misc_feature (1)..( 10): Result.004 file - promoters60/5668529
ttattatgtt

SEQ ID NO: 149760 - DNA, 10 bp, Unknown
  misc_feature (1)..( 10): Result.004 file - promoters60/5668529
tgattatgtg

SEQ ID NO: 149761 - DNA, 16 bp, Unknown
  misc_feature (1)..( 16): Result.004 file - promoters60/5668529
tctcttcttcattgaa

SEQ ID NO: 149762 - DNA, 16 bp, Unknown
  misc_feature (1)..( 16): Result.004 file - promoters60/5668529
tcttttctctctataa

SEQ ID NO: 149763 - DNA, 16 bp, Unknown
  misc_feature (1)..( 16): Result.004 file - promoters60/5668529
acttttgtctatataa

SEQ ID NO: 149764 - DNA, 16 bp, Unknown
  misc_feature (1)..( 16): Result.004 file - promoters60/5668529
gcttatcttttataat

SEQ ID NO: 149765 - DNA, 8 bp, Unknown
  misc_feature (1)..( 8): Result.004 file - promoters60/5668529
aaaattat

SEQ ID NO: 149766 - DNA, 8 bp, Unknown
  misc_feature (1)..( 8): Result.004 file - promoters60/5668529
aaaattaa

SEQ ID NO: 149767 - DNA, 8 bp, Unknown
  misc_feature (1)..( 8): Result.004 file - promoters60/5668529
aataataa

SEQ ID NO: 149768 - DNA, 8 bp, Unknown
  misc_feature (1)..( 8): Result.004 file - promoters60/5668529
aaaaatag

SEQ ID NO: 149769 - DNA, 8 bp, Unknown
  misc_feature (1)..( 8): Result.004 file - promoters60/5668529
aaacatag

SEQ ID NO: 149770 - DNA, 10 bp, Unknown
  misc_feature (1)..( 10): Result.004 file - promoters60/5668529
tggaagtata

SEQ ID NO: 149771 - DNA, 10 bp, Unknown
  misc_feature (1)..( 10): Result.004 file - promoters60/5668529
aacaagtata

SEQ ID NO: 149772 - DNA, 10 bp, Unknown
  misc_feature (1)..( 10): Result.004 file - promoters60/5668529
tttgagtata

SEQ ID NO: 149773 - DNA, 10 bp, Unknown
  misc_feature (1)..( 10): Result.004 file - promoters60/5668529
aacaagtaag

SEQ ID NO: 149774 - DNA, 11 bp, Unknown
  misc_feature (1)..( 11): Result.004 file - promoters60/5668529
tgaccatgctt

SEQ ID NO: 149775 - DNA, 11 bp, Unknown
  misc_feature (1)..( 11): Result.004 file - promoters60/5668529
tgaccatcatt

SEQ ID NO: 149776 - DNA, 11 bp, Unknown
  misc_feature (1)..( 11): Result.004 file - promoters60/5668529
acaccataatt

SEQ ID NO: 149777 - DNA, 11 bp, Unknown
  misc_feature (1)..( 11): Result.004 file - promoters60/5668529
acacgataagg

SEQ ID NO: 149778 - DNA, 8 bp, Unknown
  misc_feature (1)..( 8): Result.004 file - promoters60/5668529
taaatatt

SEQ ID NO: 149779 - DNA, 8 bp, Unknown
  misc_feature (1)..( 8): Result.004 file - promoters60/5668529
taaatagg

SEQ ID NO: 149780 - DNA, 8 bp, Unknown
  misc_feature (1)..( 8): Result.004 file - promoters60/5668529
caaacatt

SEQ ID NO: 149781 - DNA, 8 bp, Unknown
  misc_feature (1)..( 8): Result.004 file - promoters60/5668533
caaatatt

SEQ ID NO: 149782 - DNA, 10 bp, Unknown
  misc_feature (1)..( 10): Result.004 file - promoters60/5668533
ttcttagtac

SEQ ID NO: 149783 - DNA, 10 bp, Unknown
  misc_feature (1)..( 10): Result.004 file - promoters60/5668533
ttcttaagga

SEQ ID NO: 149784 - DNA, 10 bp, Unknown
  misc_feature (1)..( 10): Result.004 file - promoters60/5668533
ttcataaatc

SEQ ID NO: 149785 - DNA, 11 bp, Unknown
  misc_feature (1)..( 11): Result.004 file - promoters60/5668533
gtacataaaac

SEQ ID NO: 149786 - DNA, 11 bp, Unknown
  misc_feature (1)..( 11): Result.004 file - promoters60/5668533
gtccttaataa

SEQ ID NO: 149787 - DNA, 11 bp, Unknown
  misc_feature (1)..( 11): Result.004 file - promoters60/5668537
atcattaatcc

SEQ ID NO: 149788 - DNA, 13 bp, Unknown
  misc_feature (1)..( 13): Result.004 file - promoters60/5668537
caatgttttctca

SEQ ID NO: 149789 - DNA, 13 bp, Unknown
  misc_feature (1)..( 13): Result.004 file - promoters60/5668537
caatattttatca

SEQ ID NO: 149790 - DNA, 13 bp, Unknown
  misc_feature (1)..( 13): Result.004 file - promoters60/5668537
aattattttctta

SEQ ID NO: 149791 - DNA, 11 bp, Unknown
  misc_feature (1)..( 11): Result.004 file - promoters60/5668537
ggagctaaaat

SEQ ID NO: 149792 - DNA, 11 bp, Unknown
  misc_feature (1)..( 11): Result.004 file - promoters60/5668537
ttttctacaat

SEQ ID NO: 149793 - DNA, 11 bp, Unknown
  misc_feature (1)..( 11): Result.004 file - promoters60/5668537
ttttctaaaat

SEQ ID NO: 149794 - DNA, 7 bp, Unknown
  misc_feature (1)..( 7): Result.004 file - promoters60/5668537
ataattc

SEQ ID NO: 149795 - DNA, 7 bp, Unknown
  misc_feature (1)..( 7): Result.004 file - promoters60/5668537
ataattt

SEQ ID NO: 149796 - DNA, 7 bp, Unknown
  misc_feature (1)..( 7): Result.004 file - promoters60/5668537
gtaattc

SEQ ID NO: 149797 - DNA, 9 bp, Unknown
  misc_feature (1)..( 9): Result.004 file - promoters60/5668537
tattttggc

SEQ ID NO: 149798 - DNA, 9 bp, Unknown
  misc_feature (1)..( 9): Result.004 file - promoters60/5668537
tatttttac

SEQ ID NO: 149799 - DNA, 9 bp, Unknown
  misc_feature (1)..( 9): Result.004 file - promoters60/5668537
aattttttt

SEQ ID NO: 149800 - DNA, 8 bp, Unknown
  misc_feature (1)..( 8): Result.004 file - promoters60/5668537
actgtatt

SEQ ID NO: 149801 - DNA, 8 bp, Unknown
  misc_feature (1)..( 8): Result.004 file - promoters60/5668537
actgtatt

SEQ ID NO: 149802 - DNA, 8 bp, Unknown
  misc_feature (1)..( 8): Result.004 file - promoters60/5668537
tactcaat

SEQ ID NO: 149803 - DNA, 8 bp, Unknown
  misc_feature (1)..( 8): Result.004 file - promoters60/5668537
tacttaat

SEQ ID NO: 149804 - DNA, 7 bp, Unknown
  misc_feature (1)..( 7): Result.004 file - promoters60/5668537
gtacata

SEQ ID NO: 149805 - DNA, 7 bp, Unknown
  misc_feature (1)..( 7): Result.004 file - promoters60/5668537
gtatata

SEQ ID NO: 149806 - DNA, 6 bp, Unknown
  misc_feature (1)..( 6): Result.004 file - promoters60/5668537
ttctta

SEQ ID NO: 149807 - DNA, 6 bp, Unknown
  misc_feature (1)..( 6): Result.004 file - promoters60/5668537
ttctta

SEQ ID NO: 149808 - DNA, 7 bp, Unknown
  misc_feature (1)..( 7): Result.004 file - promoters60/5668537
tgttaat

SEQ ID NO: 149809 - DNA, 7 bp, Unknown
  misc_feature (1)..( 7): Result.004 file - promoters60/5668537
tgtcaat

SEQ ID NO: 149810 - DNA, 6 bp, Unknown
  misc_feature (1)..( 6): Result.004 file - promoters60/5668537
tttcct

SEQ ID NO: 149811 - DNA, 6 bp, Unknown
  misc_feature (1)..( 6): Result.004 file - promoters60/5668537
tttcct

SEQ ID NO: 149812 - DNA, 6 bp, Unknown
  misc_feature (1)..( 6): Result.004 file - promoters60/5668537
ctacat

SEQ ID NO: 149813 - DNA, 6 bp, Unknown
  misc_feature (1)..( 6): Result.004 file - promoters60/5668537
ctacat

SEQ ID NO: 149814 - DNA, 8 bp, Unknown
  misc_feature (1)..( 8): Result.004 file - promoters60/5668537
gaaacgac

SEQ ID NO: 149815 - DNA, 8 bp, Unknown
  misc_feature (1)..( 8): Result.004 file - promoters60/5668537
gaaatgac

SEQ ID NO: 149816 - DNA, 12 bp, Unknown
  misc_feature (1)..( 12): Result.004 file - promoters60/5668537
tagatttattaa

SEQ ID NO: 149817 - DNA, 12 bp, Unknown
  misc_feature (1)..( 12): Result.004 file - promoters60/5668537
tagaattactaa

SEQ ID NO: 149818 - DNA, 7 bp, Unknown
  misc_feature (1)..( 7): Result.004 file - promoters60/5668537
taataat

SEQ ID NO: 149819 - DNA, 7 bp, Unknown
  misc_feature (1)..( 7): Result.004 file - promoters60/5668537
taataat

SEQ ID NO: 149820 - DNA, 6 bp, Unknown
  misc_feature (1)..( 6): Result.004 file - promoters60/5668537
aatttt

SEQ ID NO: 149821 - DNA, 6 bp, Unknown
  misc_feature (1)..( 6): Result.004 file - promoters60/5668537
aatttt

SEQ ID NO: 149822 - DNA, 7 bp, Unknown
  misc_feature (1)..( 7): Result.004 file - promoters60/5668537
tatccaa

SEQ ID NO: 149823 - DNA, 7 bp, Unknown
  misc_feature (1)..( 7): Result.004 file - promoters60/5668537
tatacaa

SEQ ID NO: 149824 - DNA, 7 bp, Unknown
  misc_feature (1)..( 7): Result.004 file - promoters60/5668537
tataatt

SEQ ID NO: 149825 - DNA, 7 bp, Unknown
  misc_feature (1)..( 7): Result.004 file - promoters60/5668537
tatgatt

SEQ ID NO: 149826 - DNA, 6 bp, Unknown
  misc_feature (1)..( 6): Result.004 file - promoters60/5668537
aaaaaa

SEQ ID NO: 149827 - DNA, 6 bp, Unknown
  misc_feature (1)..( 6): Result.004 file - promoters60/5668537
aaaaaa

SEQ ID NO: 149828 - DNA, 8 bp, Unknown
  misc_feature (1)..( 8): Result.004 file - promoters60/5668537
taaatttc

SEQ ID NO: 149829 - DNA, 8 bp, Unknown
  misc_feature (1)..( 8): Result.004 file - promoters60/5668537
taactttc

SEQ ID NO: 149830 - DNA, 7 bp, Unknown
  misc_feature (1)..( 7): Result.004 file - promoters60/5668537
aagagaa

SEQ ID NO: 149831 - DNA, 7 bp, Unknown
  misc_feature (1)..( 7): Result.004 file - promoters60/5668537
aagtgaa

SEQ ID NO: 149832 - DNA, 8 bp, Unknown
  misc_feature (1)..( 8): Result.004 file - promoters60/5668537
atggcttg

SEQ ID NO: 149833 - DNA, 8 bp, Unknown
  misc_feature (1)..( 8): Result.004 file - promoters60/5668541
atgggttg

SEQ ID NO: 149834 - DNA, 8 bp, Unknown
  misc_feature (1)..( 8): Result.004 file - promoters60/5668541
ctttcatg

SEQ ID NO: 149835 - DNA, 8 bp, Unknown
  misc_feature (1)..( 8): Result.004 file - promoters60/5668541
cttccatg

SEQ ID NO: 149836 - DNA, 6 bp, Unknown
  misc_feature (1)..( 6): Result.004 file - promoters60/5668541
ataatc

SEQ ID NO: 149837 - DNA, 6 bp, Unknown
  misc_feature (1)..( 6): Result.004 file - promoters60/5668541
ataatc

SEQ ID NO: 149838 - DNA, 6 bp, Unknown
  misc_feature (1)..( 6): Result.004 file - promoters60/5668541
aatttg

SEQ ID NO: 149839 - DNA, 6 bp, Unknown
  misc_feature (1)..( 6): Result.004 file - promoters60/5668541
aatttg

SEQ ID NO: 149840 - DNA, 8 bp, Unknown
  misc_feature (1)..( 8): Result.004 file - promoters60/5668541
cactgata

SEQ ID NO: 149841 - DNA, 8 bp, Unknown
  misc_feature (1)..( 8): Result.004 file - promoters60/5668541
cactgact

SEQ ID NO: 149842 - DNA, 8 bp, Unknown
  misc_feature (1)..( 8): Result.004 file - promoters60/5668541
tacttact

SEQ ID NO: 149843 - DNA, 7 bp, Unknown
  misc_feature (1)..( 7): Result.004 file - promoters60/5668541
tccaaaa

SEQ ID NO: 149844 - DNA, 7 bp, Unknown
  misc_feature (1)..( 7): Result.004 file - promoters60/5668541
tccaaaa

SEQ ID NO: 149845 - DNA, 7 bp, Unknown
  misc_feature (1)..( 7): Result.004 file - promoters60/5668541
ctccaga

SEQ ID NO: 149846 - DNA, 7 bp, Unknown
  misc_feature (1)..( 7): Result.004 file - promoters60/5668541
ctcaaga

SEQ ID NO: 149847 - DNA, 6 bp, Unknown
  misc_feature (1)..( 6): Result.004 file - promoters60/5668541
aaaaaa

SEQ ID NO: 149848 - DNA, 6 bp, Unknown
  misc_feature (1)..( 6): Result.004 file - promoters60/5668541
aaaaaa

SEQ ID NO: 149849 - DNA, 7 bp, Unknown
  misc_feature (1)..( 7): Result.004 file - promoters60/5668541
tttgaaa

SEQ ID NO: 149850 - DNA, 7 bp, Unknown
  misc_feature (1)..( 7): Result.004 file - promoters60/5668541
tttaaaa

SEQ ID NO: 149851 - DNA, 8 bp, Unknown
  misc_feature (1)..( 8): Result.004 file - promoters60/5668541
ttggattt

SEQ ID NO: 149852 - DNA, 8 bp, Unknown
  misc_feature (1)..( 8): Result.004 file - promoters60/5668541
ttgaattt

SEQ ID NO: 149853 - DNA, 6 bp, Unknown
  misc_feature (1)..( 6): Result.004 file - promoters60/5668541
ttttgg

SEQ ID NO: 149854 - DNA, 6 bp, Unknown
  misc_feature (1)..( 6): Result.004 file - promoters60/5668541
ttttgg

SEQ ID NO: 149855 - DNA, 7 bp, Unknown
  misc_feature (1)..( 7): Result.004 file - promoters60/5668541
tttgttt

SEQ ID NO: 149856 - DNA, 7 bp, Unknown
  misc_feature (1)..( 7): Result.004 file - promoters60/5668541
ttttttt

SEQ ID NO: 149857 - DNA, 6 bp, Unknown
  misc_feature (1)..( 6): Result.004 file - promoters60/5668541
tactgc

SEQ ID NO: 149858 - DNA, 6 bp, Unknown
  misc_feature (1)..( 6): Result.004 file - promoters60/5668541
tactgc

SEQ ID NO: 149859 - DNA, 6 bp, Unknown
  misc_feature (1)..( 6): Result.004 file - promoters60/5668541
gatctg

SEQ ID NO: 149860 - DNA, 6 bp, Unknown
  misc_feature (1)..( 6): Result.004 file - promoters60/5668541
gatctg

SEQ ID NO: 149861 - DNA, 6 bp, Unknown
  misc_feature (1)..( 6): Result.004 file - promoters60/5668541
tgaatt

SEQ ID NO: 149862 - DNA, 6 bp, Unknown
  misc_feature (1)..( 6): Result.004 file - promoters60/5668541
tgaatt

SEQ ID NO: 149863 - DNA, 6 bp, Unknown
  misc_feature (1)..( 6): Result.004 file - promoters60/5668541
aaccga

SEQ ID NO: 149864 - DNA, 6 bp, Unknown
  misc_feature (1)..( 6): Result.004 file - promoters60/5668541
aaccga

SEQ ID NO: 149865 - DNA, 7 bp, Unknown
  misc_feature (1)..( 7): Result.004 file - promoters60/5668541
cgtcaga

SEQ ID NO: 149866 - DNA, 7 bp, Unknown
  misc_feature (1)..( 7): Result.004 file - promoters60/5668541
cgtcaga

SEQ ID NO: 149867 - DNA, 6 bp, Unknown
  misc_feature (1)..( 6): Result.004 file - promoters60/5668541
cagact

SEQ ID NO: 149868 - DNA, 6 bp, Unknown
  misc_feature (1)..( 6): Result.004 file - promoters60/5668541
cagact

SEQ ID NO: 149869 - DNA, 6 bp, Unknown
  misc_feature (1)..( 6): Result.004 file - promoters60/5668541
tggttt

SEQ ID NO: 149870 - DNA, 6 bp, Unknown
  misc_feature (1)..( 6): Result.004 file - promoters60/5668541
tggttt

SEQ ID NO: 149871 - DNA, 7 bp, Unknown
  misc_feature (1)..( 7): Result.004 file - promoters60/5668541
agaatgt

SEQ ID NO: 149872 - DNA, 7 bp, Unknown
  misc_feature (1)..( 7): Result.004 file - promoters60/5668547
agattgt

SEQ ID NO: 149873 - DNA, 10 bp, Unknown
  misc_feature (1)..( 10): Result.004 file - promoters60/5668547
ttgtggctga

SEQ ID NO: 149874 - DNA, 10 bp, Unknown
  misc_feature (1)..( 10): Result.004 file - promoters60/5668547
atgtgggtga

SEQ ID NO: 149875 - DNA, 10 bp, Unknown
  misc_feature (1)..( 10): Result.004 file - promoters60/5668547
atgtggtcat

SEQ ID NO: 149876 - DNA, 9 bp, Unknown
  misc_feature (1)..( 9): Result.004 file - promoters60/5668547
gtgtcctct

SEQ ID NO: 149877 - DNA, 9 bp, Unknown
  misc_feature (1)..( 9): Result.004 file - promoters60/5668547
tcttcctct

SEQ ID NO: 149878 - DNA, 9 bp, Unknown
  misc_feature (1)..( 9): Result.004 file - promoters60/5668547
gtgtgctct

SEQ ID NO: 149879 - DNA, 8 bp, Unknown
  misc_feature (1)..( 8): Result.004 file - promoters60/5668547
gtttcttt

SEQ ID NO: 149880 - DNA, 8 bp, Unknown
  misc_feature (1)..( 8): Result.004 file - promoters60/5668547
ttttcttc

SEQ ID NO: 149881 - DNA, 9 bp, Unknown
  misc_feature (1)..( 9): Result.004 file - promoters60/5668547
ttttccttc

SEQ ID NO: 149882 - DNA, 8 bp, Unknown
  misc_feature (1)..( 8): Result.004 file - promoters60/5668547
tgtctctc

SEQ ID NO: 149883 - DNA, 8 bp, Unknown
  misc_feature (1)..( 8): Result.004 file - promoters60/5668547
tgtttcta

SEQ ID NO: 149884 - DNA, 8 bp, Unknown
  misc_feature (1)..( 8): Result.004 file - promoters60/5668547
cgttgcta

SEQ ID NO: 149885 - DNA, 7 bp, Unknown
  misc_feature (1)..( 7): Result.004 file - promoters60/5668547
ccgtgga

SEQ ID NO: 149886 - DNA, 7 bp, Unknown
  misc_feature (1)..( 7): Result.004 file - promoters60/5668547
acgtgga

SEQ ID NO: 149887 - DNA, 7 bp, Unknown
  misc_feature (1)..( 7): Result.004 file - promoters60/5668547
acgtggc

SEQ ID NO: 149888 - DNA, 7 bp, Unknown
  misc_feature (1)..( 7): Result.004 file - promoters60/5668547
gctaaaa

SEQ ID NO: 149889 - DNA, 7 bp, Unknown
  misc_feature (1)..( 7): Result.004 file - promoters60/5668547
gctgaaa

SEQ ID NO: 149890 - DNA, 7 bp, Unknown
  misc_feature (1)..( 7): Result.004 file - promoters60/5668566
tctgaaa

SEQ ID NO: 149891 - DNA, 13 bp, Unknown
  misc_feature (1)..( 13): Result.004 file - promoters60/5668566
ttcgtttccttaa

SEQ ID NO: 149892 - DNA, 13 bp, Unknown
  misc_feature (1)..( 13): Result.004 file - promoters60/5668566
ttcctttcttaat

SEQ ID NO: 149893 - DNA, 13 bp, Unknown
  misc_feature (1)..( 13): Result.004 file - promoters60/5668566
gaccttttttaat

SEQ ID NO: 149894 - DNA, 11 bp, Unknown
  misc_feature (1)..( 11): Result.004 file - promoters60/5668566
gtttccttaat

SEQ ID NO: 149895 - DNA, 11 bp, Unknown
  misc_feature (1)..( 11): Result.004 file - promoters60/5668566
cctttcttaat

SEQ ID NO: 149896 - DNA, 11 bp, Unknown
  misc_feature (1)..( 11): Result.004 file - promoters60/5668566
ccttttttaat

SEQ ID NO: 149897 - DNA, 6 bp, Unknown
  misc_feature (1)..( 6): Result.004 file - promoters60/5668566
aaatta

SEQ ID NO: 149898 - DNA, 6 bp, Unknown
  misc_feature (1)..( 6): Result.004 file - promoters60/5668566
aaatta

SEQ ID NO: 149899 - DNA, 6 bp, Unknown
  misc_feature (1)..( 6): Result.004 file - promoters60/5668566
aattag

SEQ ID NO: 149900 - DNA, 6 bp, Unknown
  misc_feature (1)..( 6): Result.004 file - promoters60/5668566
aattag

SEQ ID NO: 149901 - DNA, 6 bp, Unknown
  misc_feature (1)..( 6): Result.004 file - promoters60/5668566
tgcaaa

SEQ ID NO: 149902 - DNA, 6 bp, Unknown
  misc_feature (1)..( 6): Result.004 file - promoters60/5668566
tgcaaa

SEQ ID NO: 149903 - DNA, 7 bp, Unknown
  misc_feature (1)..( 7): Result.004 file - promoters60/5668566
attaaaa

SEQ ID NO: 149904 - DNA, 7 bp, Unknown
  misc_feature (1)..( 7): Result.004 file - promoters60/5668566
atttaaa

SEQ ID NO: 149905 - DNA, 8 bp, Unknown
  misc_feature (1)..( 8): Result.004 file - promoters60/5668566
agtaacac

SEQ ID NO: 149906 - DNA, 8 bp, Unknown
  misc_feature (1)..( 8): Result.004 file - promoters60/5668566
agtcacac

SEQ ID NO: 149907 - DNA, 7 bp, Unknown
  misc_feature (1)..( 7): Result.004 file - promoters60/5668566
atatagt

SEQ ID NO: 149908 - DNA, 7 bp, Unknown
  misc_feature (1)..( 7): Result.004 file - promoters60/5668566
atatagt

SEQ ID NO: 149909 - DNA, 7 bp, Unknown
  misc_feature (1)..( 7): Result.004 file - promoters60/5668566
ttttata

SEQ ID NO: 149910 - DNA, 7 bp, Unknown
  misc_feature (1)..( 7): Result.004 file - promoters60/5668566
tttaata

SEQ ID NO: 149911 - DNA, 6 bp, Unknown
  misc_feature (1)..( 6): Result.004 file - promoters60/5668566
ttaatt

SEQ ID NO: 149912 - DNA, 6 bp, Unknown
  misc_feature (1)..( 6): Result.004 file - promoters60/5668566
ttaatt

SEQ ID NO: 149913 - DNA, 7 bp, Unknown
  misc_feature (1)..( 7): Result.004 file - promoters60/5668566
aatcatt

SEQ ID NO: 149914 - DNA, 7 bp, Unknown
  misc_feature (1)..( 7): Result.004 file - promoters60/5668566
aatgatt

SEQ ID NO: 149915 - DNA, 6 bp, Unknown
  misc_feature (1)..( 6): Result.004 file - promoters60/5668566
gcttta

SEQ ID NO: 149916 - DNA, 6 bp, Unknown
  misc_feature (1)..( 6): Result.004 file - promoters60/5668566
gcttta

SEQ ID NO: 149917 - DNA, 8 bp, Unknown
  misc_feature (1)..( 8): Result.004 file - promoters60/5668566
ggtcttaa

SEQ ID NO: 149918 - DNA, 8 bp, Unknown
  misc_feature (1)..( 8): Result.004 file - promoters60/5668566
ggtcataa

SEQ ID NO: 149919 - DNA, 7 bp, Unknown
  misc_feature (1)..( 7): Result.004 file - promoters60/5668566
gttctct

SEQ ID NO: 149920 - DNA, 7 bp, Unknown
  misc_feature (1)..( 7): Result.004 file - promoters60/5668592
gttatct

SEQ ID NO: 149921 - DNA, 9 bp, Unknown
  misc_feature (1)..( 9): Result.004 file - promoters60/5668592
tgagctgtt

SEQ ID NO: 149922 - DNA, 9 bp, Unknown
  misc_feature (1)..( 9): Result.004 file - promoters60/5668592
tgatctgtt

SEQ ID NO: 149923 - DNA, 8 bp, Unknown
  misc_feature (1)..( 8): Result.004 file - promoters60/5668592
attacttc

SEQ ID NO: 149924 - DNA, 8 bp, Unknown
  misc_feature (1)..( 8): Result.004 file - promoters60/5668592
atttcttc

SEQ ID NO: 149925 - DNA, 7 bp, Unknown
  misc_feature (1)..( 7): Result.004 file - promoters60/5668592
agcaaat

SEQ ID NO: 149926 - DNA, 7 bp, Unknown
  misc_feature (1)..( 7): Result.004 file - promoters60/5668592
agctaat

SEQ ID NO: 149927 - DNA, 9 bp, Unknown
  misc_feature (1)..( 9): Result.004 file - promoters60/5668592
aaataagct

SEQ ID NO: 149928 - DNA, 9 bp, Unknown
  misc_feature (1)..( 9): Result.004 file - promoters60/5668592
aaaaaagct

SEQ ID NO: 149929 - DNA, 7 bp, Unknown
  misc_feature (1)..( 7): Result.004 file - promoters60/5668592
taaaggg

SEQ ID NO: 149930 - DNA, 7 bp, Unknown
  misc_feature (1)..( 7): Result.004 file - promoters60/5668592
taaaggg

SEQ ID NO: 149931 - DNA, 6 bp, Unknown
  misc_feature (1)..( 6): Result.004 file - promoters60/5668592
tgtctc

SEQ ID NO: 149932 - DNA, 6 bp, Unknown
  misc_feature (1)..( 6): Result.004 file - promoters60/5668592
tgtctc

SEQ ID NO: 149933 - DNA, 6 bp, Unknown
  misc_feature (1)..( 6): Result.004 file - promoters60/5668592
cctctg

SEQ ID NO: 149934 - DNA, 6 bp, Unknown
  misc_feature (1)..( 6): Result.004 file - promoters60/5668592
cctctg

SEQ ID NO: 149935 - DNA, 7 bp, Unknown
  misc_feature (1)..( 7): Result.004 file - promoters60/5668592
gtgacat

SEQ ID NO: 149936 - DNA, 7 bp, Unknown
  misc_feature (1)..( 7): Result.004 file - promoters60/5668592
gtgacat

SEQ ID NO: 149937 - DNA, 7 bp, Unknown
  misc_feature (1)..( 7): Result.004 file - promoters60/5668592
taacaat

SEQ ID NO: 149938 - DNA, 7 bp, Unknown
  misc_feature (1)..( 7): Result.004 file - promoters60/5668592
taataat

SEQ ID NO: 149939 - DNA, 6 bp, Unknown
  misc_feature (1)..( 6): Result.004 file - promoters60/5668592
tgtttc

SEQ ID NO: 149940 - DNA, 6 bp, Unknown
  misc_feature (1)..( 6): Result.004 file - promoters60/5668592
tgtttc

SEQ ID NO: 149941 - DNA, 6 bp, Unknown
  misc_feature (1)..( 6): Result.004 file - promoters60/5668592
ggtccc

SEQ ID NO: 149942 - DNA, 6 bp, Unknown
  misc_feature (1)..( 6): Result.004 file - promoters60/5668592
ggtccc

SEQ ID NO: 149943 - DNA, 6 bp, Unknown
  misc_feature (1)..( 6): Result.004 file - promoters60/5668592
tattat

SEQ ID NO: 149944 - DNA, 6 bp, Unknown
  misc_feature (1)..( 6): Result.004 file - promoters60/5668592
tattat

SEQ ID NO: 149945 - DNA, 7 bp, Unknown
  misc_feature (1)..( 7): Result.004 file - promoters60/5668592
tacatat

SEQ ID NO: 149946 - DNA, 7 bp, Unknown
  misc_feature (1)..( 7): Result.004 file - promoters60/5668592
tacttat

SEQ ID NO: 149947 - DNA, 6 bp, Unknown
  misc_feature (1)..( 6): Result.004 file - promoters60/5668592
attctt

SEQ ID NO: 149948 - DNA, 6 bp, Unknown
  misc_feature (1)..( 6): Result.004 file - promoters60/5668592
attctt

SEQ ID NO: 149949 - DNA, 10 bp, Unknown
  misc_feature (1)..( 10): Result.004 file - promoters60/5668592
taataaaaat

SEQ ID NO: 149950 - DNA, 10 bp, Unknown
  misc_feature (1)..( 10): Result.004 file - promoters60/5668592
taataataat

SEQ ID NO: 149951 - DNA, 8 bp, Unknown
  misc_feature (1)..( 8): Result.004 file - promoters60/5668592
caaaacta

SEQ ID NO: 149952 - DNA, 8 bp, Unknown
  misc_feature (1)..( 8): Result.004 file - promoters60/5668592
caaaacta

SEQ ID NO: 149953 - DNA, 6 bp, Unknown
  misc_feature (1)..( 6): Result.004 file - promoters60/5668592
aacttc

SEQ ID NO: 149954 - DNA, 6 bp, Unknown
  misc_feature (1)..( 6): Result.004 file - promoters60/5668592
aacttc

SEQ ID NO: 149955 - DNA, 7 bp, Unknown
  misc_feature (1)..( 7): Result.004 file - promoters60/5668592
tcaaggt

SEQ ID NO: 149956 - DNA, 7 bp, Unknown
  misc_feature (1)..( 7): Result.004 file - promoters60/5668592
tcaaggt

SEQ ID NO: 149957 - DNA, 7 bp, Unknown
  misc_feature (1)..( 7): Result.004 file - promoters60/5668592
attttga

SEQ ID NO: 149958 - DNA, 7 bp, Unknown
  misc_feature (1)..( 7): Result.004 file - promoters60/5668629
attatga

SEQ ID NO: 149959 - DNA, 9 bp, Unknown
  misc_feature (1)..( 9): Result.004 file - promoters60/5668629
aaaaatgaa

SEQ ID NO: 149960 - DNA, 9 bp, Unknown
  misc_feature (1)..( 9): Result.004 file - promoters60/5668629
aaaaaagaa

SEQ ID NO: 149961 - DNA, 8 bp, Unknown
  misc_feature (1)..( 8): Result.004 file - promoters60/5668629
aaagtgat

SEQ ID NO: 149962 - DNA, 9 bp, Unknown
  misc_feature (1)..( 9): Result.004 file - promoters60/5668629
gaaaaaggg

SEQ ID NO: 149963 - DNA, 13 bp, Unknown
  misc_feature (1)..( 13): Result.004 file - promoters60/5668629
cacgtgtaagaac

SEQ ID NO: 149964 - DNA, 13 bp, Unknown
  misc_feature (1)..( 13): Result.004 file - promoters60/5668629
cctgtgtaaaatt

SEQ ID NO: 149965 - DNA, 13 bp, Unknown
  misc_feature (1)..( 13): Result.004 file - promoters60/5668629
cacgtataatttg

SEQ ID NO: 149966 - DNA, 13 bp, Unknown
  misc_feature (1)..( 13): Result.004 file - promoters60/5668629
tccttataaattg

SEQ ID NO: 149967 - DNA, 12 bp, Unknown
  misc_feature (1)..( 12): Result.004 file - promoters60/5668629
attcttttatca

SEQ ID NO: 149968 - DNA, 12 bp, Unknown
  misc_feature (1)..( 12): Result.004 file - promoters60/5668629
ttgtttttgtca

SEQ ID NO: 149969 - DNA, 12 bp, Unknown
  misc_feature (1)..( 12): Result.004 file - promoters60/5668629
tcaattttataa

SEQ ID NO: 149970 - DNA, 12 bp, Unknown
  misc_feature (1)..( 12): Result.004 file - promoters60/5668629
ctaattttgtat

SEQ ID NO: 149971 - DNA, 12 bp, Unknown
  misc_feature (1)..( 12): Result.004 file - promoters60/5668629
tcaatcttattg

SEQ ID NO: 149972 - DNA, 12 bp, Unknown
  misc_feature (1)..( 12): Result.004 file - promoters60/5668629
aatatcttaaac

SEQ ID NO: 149973 - DNA, 8 bp, Unknown
  misc_feature (1)..( 8): Result.004 file - promoters60/5668629
atataata

SEQ ID NO: 149974 - DNA, 8 bp, Unknown
  misc_feature (1)..( 8): Result.004 file - promoters60/5668629
ttattata

SEQ ID NO: 149975 - DNA, 8 bp, Unknown
  misc_feature (1)..( 8): Result.004 file - promoters60/5668629
atataata

SEQ ID NO: 149976 - DNA, 8 bp, Unknown
  misc_feature (1)..( 8): Result.004 file - promoters60/5668629
atataaaa

SEQ ID NO: 149977 - DNA, 10 bp, Unknown
  misc_feature (1)..( 10): Result.004 file - promoters60/5668629
ttaattttta

SEQ ID NO: 149978 - DNA, 10 bp, Unknown
  misc_feature (1)..( 10): Result.004 file - promoters60/5668629
tcaattttat

SEQ ID NO: 149979 - DNA, 10 bp, Unknown
  misc_feature (1)..( 10): Result.004 file - promoters60/5668629
ttaattttct

SEQ ID NO: 149980 - DNA, 10 bp, Unknown
  misc_feature (1)..( 10): Result.004 file - promoters60/5668629
tcaatcttat

SEQ ID NO: 149981 - DNA, 9 bp, Unknown
  misc_feature (1)..( 9): Result.004 file - promoters60/5668629
aatttttat

SEQ ID NO: 149982 - DNA, 9 bp, Unknown
  misc_feature (1)..( 9): Result.004 file - promoters60/5668629
caattttat

SEQ ID NO: 149983 - DNA, 10 bp, Unknown
  misc_feature (1)..( 10): Result.004 file - promoters60/5668629
aattttctat

SEQ ID NO: 149984 - DNA, 10 bp, Unknown
  misc_feature (1)..( 10): Result.004 file - promoters60/5668629
tcaatcttat

SEQ ID NO: 149985 - DNA, 7 bp, Unknown
  misc_feature (1)..( 7): Result.004 file - promoters60/5668629
cttcaaa

SEQ ID NO: 149986 - DNA, 7 bp, Unknown
  misc_feature (1)..( 7): Result.004 file - promoters60/5668629
ctttaaa

SEQ ID NO: 149987 - DNA, 7 bp, Unknown
  misc_feature (1)..( 7): Result.004 file - promoters60/5668629
ttttaaa

SEQ ID NO: 149988 - DNA, 8 bp, Unknown
  misc_feature (1)..( 8): Result.004 file - promoters60/5668629
atttgaaa

SEQ ID NO: 149989 - DNA, 8 bp, Unknown
  misc_feature (1)..( 8): Result.004 file - promoters60/5668629
tatttcaa

SEQ ID NO: 149990 - DNA, 8 bp, Unknown
  misc_feature (1)..( 8): Result.004 file - promoters60/5668629
tatttcta

SEQ ID NO: 149991 - DNA, 8 bp, Unknown
  misc_feature (1)..( 8): Result.004 file - promoters60/5668629
aattgcaa

SEQ ID NO: 149992 - DNA, 8 bp, Unknown
  misc_feature (1)..( 8): Result.004 file - promoters60/5668748
tatctctt

SEQ ID NO: 149993 - DNA, 10 bp, Unknown
  misc_feature (1)..( 10): Result.004 file - promoters60/5668748
aaccaaaatg

SEQ ID NO: 149994 - DNA, 10 bp, Unknown
  misc_feature (1)..( 10): Result.004 file - promoters60/5668748
aactaaaaat

SEQ ID NO: 149995 - DNA, 10 bp, Unknown
  misc_feature (1)..( 10): Result.004 file - promoters60/5668748
tttcaaaata

SEQ ID NO: 149996 - DNA, 10 bp, Unknown
  misc_feature (1)..( 10): Result.004 file - promoters60/5668748
gaaaaaaata

SEQ ID NO: 149997 - DNA, 14 bp, Unknown
  misc_feature (1)..( 14): Result.004 file - promoters60/5668748
acattaatatgaga

SEQ ID NO: 149998 - DNA, 14 bp, Unknown
  misc_feature (1)..( 14): Result.004 file - promoters60/5668748
acaataatagtata

SEQ ID NO: 149999 - DNA, 14 bp, Unknown
  misc_feature (1)..( 14): Result.004 file - promoters60/5668748
ctgataaaatgcta

SEQ ID NO: 150000 - DNA, 14 bp, Unknown
  misc_feature (1)..( 14): Result.004 file - promoters60/5668748
aagataaaacttta

SEQ ID NO: 150001 - DNA, 8 bp, Unknown
  misc_feature (1)..( 8): Result.004 file - promoters60/5668748
taaaaata

SEQ ID NO: 150002 - DNA, 8 bp, Unknown
  misc_feature (1)..( 8): Result.004 file - promoters60/5668748
ataaaata

SEQ ID NO: 150003 - DNA, 8 bp, Unknown
  misc_feature (1)..( 8): Result.004 file - promoters60/5668748
gaaaaatg

SEQ ID NO: 150004 - DNA, 8 bp, Unknown
  misc_feature (1)..( 8): Result.004 file - promoters60/5668748
ataaaatg

SEQ ID NO: 150005 - DNA, 9 bp, Unknown
  misc_feature (1)..( 9): Result.004 file - promoters60/5668748
tgagaaact

SEQ ID NO: 150006 - DNA, 9 bp, Unknown
  misc_feature (1)..( 9): Result.004 file - promoters60/5668748
tgataaaat

SEQ ID NO: 150007 - DNA, 9 bp, Unknown
  misc_feature (1)..( 9): Result.004 file - promoters60/5668748
gtataaaat

SEQ ID NO: 150008 - DNA, 9 bp, Unknown
  misc_feature (1)..( 9): Result.004 file - promoters60/5668748
agataaaac

SEQ ID NO: 150009 - DNA, 9 bp, Unknown
  misc_feature (1)..( 9): Result.004 file - promoters60/5668748
aaaaatata

SEQ ID NO: 150010 - DNA, 9 bp, Unknown
  misc_feature (1)..( 9): Result.004 file - promoters60/5668748
aaaaaaata

SEQ ID NO: 150011 - DNA, 9 bp, Unknown
  misc_feature (1)..( 9): Result.004 file - promoters60/5668748
caaaatatg

SEQ ID NO: 150012 - DNA, 10 bp, Unknown
  misc_feature (1)..( 10): Result.004 file - promoters60/5668748
tatatttatt

SEQ ID NO: 150013 - DNA, 10 bp, Unknown
  misc_feature (1)..( 10): Result.004 file - promoters60/5668748
tatttttcct

SEQ ID NO: 150014 - DNA, 10 bp, Unknown
  misc_feature (1)..( 10): Result.004 file - promoters60/5668818
aatttttcct

SEQ ID NO: 150015 - DNA, 8 bp, Unknown
  misc_feature (1)..( 8): Result.004 file - promoters60/5668818
ttaattta

SEQ ID NO: 150016 - DNA, 8 bp, Unknown
  misc_feature (1)..( 8): Result.004 file - promoters60/5668818
ataattta

SEQ ID NO: 150017 - DNA, 8 bp, Unknown
  misc_feature (1)..( 8): Result.004 file - promoters60/5668818
atagttta

SEQ ID NO: 150018 - DNA, 10 bp, Unknown
  misc_feature (1)..( 10): Result.004 file - promoters60/5668818
tcagaataag

SEQ ID NO: 150019 - DNA, 10 bp, Unknown
  misc_feature (1)..( 10): Result.004 file - promoters60/5668818
tcataattta

SEQ ID NO: 150020 - DNA, 10 bp, Unknown
  misc_feature (1)..( 10): Result.004 file - promoters60/5668818
cgatagttta

SEQ ID NO: 150021 - DNA, 10 bp, Unknown
  misc_feature (1)..( 10): Result.004 file - promoters60/5668818
aaataattcc

SEQ ID NO: 150022 - DNA, 9 bp, Unknown
  misc_feature (1)..( 9): Result.004 file - promoters60/5668818
ggttttatt

SEQ ID NO: 150023 - DNA, 9 bp, Unknown
  misc_feature (1)..( 9): Result.004 file - promoters60/5668818
agttttatt

SEQ ID NO: 150024 - DNA, 9 bp, Unknown
  misc_feature (1)..( 9): Result.004 file - promoters60/5668818
agttttaac

SEQ ID NO: 150025 - DNA, 8 bp, Unknown
  misc_feature (1)..( 8): Result.004 file - promoters60/5668818
aatagtca

SEQ ID NO: 150026 - DNA, 8 bp, Unknown
  misc_feature (1)..( 8): Result.004 file - promoters60/5668818
tatattca

SEQ ID NO: 150027 - DNA, 8 bp, Unknown
  misc_feature (1)..( 8): Result.004 file - promoters60/5668818
tatcttct

SEQ ID NO: 150028 - DNA, 12 bp, Unknown
  misc_feature (1)..( 12): Result.004 file - promoters60/5668818
ctcctataaatt

SEQ ID NO: 150029 - DNA, 12 bp, Unknown
  misc_feature (1)..( 12): Result.004 file - promoters60/5668818
ctcttatatatt

SEQ ID NO: 150030 - DNA, 12 bp, Unknown
  misc_feature (1)..( 12): Result.004 file - promoters60/5668818
tgtctatatata

SEQ ID NO: 150031 - DNA, 12 bp, Unknown
  misc_feature (1)..( 12): Result.004 file - promoters60/5668818
aatcaaaaaaag

SEQ ID NO: 150032 - DNA, 12 bp, Unknown
  misc_feature (1)..( 12): Result.004 file - promoters60/5668818
aattaaacaaag

SEQ ID NO: 150033 - DNA, 12 bp, Unknown
  misc_feature (1)..( 12): Result.004 file - promoters60/5668818
atttaaacgtaa

SEQ ID NO: 150034 - DNA, 12 bp, Unknown
  misc_feature (1)..( 12): Result.004 file - promoters60/5668818
aaaaaaacaaat

SEQ ID NO: 150035 - DNA, 9 bp, Unknown
  misc_feature (1)..( 9): Result.004 file - promoters60/5668818
attttattt

SEQ ID NO: 150036 - DNA, 9 bp, Unknown
  misc_feature (1)..( 9): Result.004 file - promoters60/5668818
tctttattt

SEQ ID NO: 150037 - DNA, 9 bp, Unknown
  misc_feature (1)..( 9): Result.004 file - promoters60/5668818
attttatct

SEQ ID NO: 150038 - DNA, 10 bp, Unknown
  misc_feature (1)..( 10): Result.004 file - promoters60/5668818
ttttattttt

SEQ ID NO: 150039 - DNA, 10 bp, Unknown
  misc_feature (1)..( 10): Result.004 file - promoters60/5668818
atttattttt

SEQ ID NO: 150040 - DNA, 10 bp, Unknown
  misc_feature (1)..( 10): Result.004 file - promoters60/5668818
atttataatt

SEQ ID NO: 150041 - DNA, 11 bp, Unknown
  misc_feature (1)..( 11): Result.004 file - promoters60/5668818
ttaagtattat

SEQ ID NO: 150042 - DNA, 11 bp, Unknown
  misc_feature (1)..( 11): Result.004 file - promoters60/5668818
ttaaggattaa

SEQ ID NO: 150043 - DNA, 11 bp, Unknown
  misc_feature (1)..( 11): Result.004 file - promoters60/5668836
ttctagattaa

SEQ ID NO: 150044 - DNA, 8 bp, Unknown
  misc_feature (1)..( 8): Result.004 file - promoters60/5668836
ctttccga

SEQ ID NO: 150045 - DNA, 8 bp, Unknown
  misc_feature (1)..( 8): Result.004 file - promoters60/5668836
cttttcga

SEQ ID NO: 150046 - DNA, 9 bp, Unknown
  misc_feature (1)..( 9): Result.004 file - promoters60/5668836
aaatttaag

SEQ ID NO: 150047 - DNA, 9 bp, Unknown
  misc_feature (1)..( 9): Result.004 file - promoters60/5668836
aaatttaag

SEQ ID NO: 150048 - DNA, 9 bp, Unknown
  misc_feature (1)..( 9): Result.004 file - promoters60/5668836
aaatttatt

SEQ ID NO: 150049 - DNA, 7 bp, Unknown
  misc_feature (1)..( 7): Result.004 file - promoters60/5668836
attttat

SEQ ID NO: 150050 - DNA, 7 bp, Unknown
  misc_feature (1)..( 7): Result.004 file - promoters60/5668836
gttttat

SEQ ID NO: 150051 - DNA, 7 bp, Unknown
  misc_feature (1)..( 7): Result.004 file - promoters60/5668836
attttaa

SEQ ID NO: 150052 - DNA, 9 bp, Unknown
  misc_feature (1)..( 9): Result.004 file - promoters60/5668836
aaaaataag

SEQ ID NO: 150053 - DNA, 9 bp, Unknown
  misc_feature (1)..( 9): Result.004 file - promoters60/5668836
aaaattaaa

SEQ ID NO: 150054 - DNA, 9 bp, Unknown
  misc_feature (1)..( 9): Result.004 file - promoters60/5668836
tcgattaaa

SEQ ID NO: 150055 - DNA, 9 bp, Unknown
  misc_feature (1)..( 9): Result.004 file - promoters60/5668836
taataattt

SEQ ID NO: 150056 - DNA, 9 bp, Unknown
  misc_feature (1)..( 9): Result.004 file - promoters60/5668836
taaaaattt

SEQ ID NO: 150057 - DNA, 9 bp, Unknown
  misc_feature (1)..( 9): Result.004 file - promoters60/5668836
gagtagcca

SEQ ID NO: 150058 - DNA, 9 bp, Unknown
  misc_feature (1)..( 9): Result.004 file - promoters60/5668836
aagtaacca

SEQ ID NO: 150059 - DNA, 9 bp, Unknown
  misc_feature (1)..( 9): Result.004 file - promoters60/5668836
aaggaacaa

SEQ ID NO: 150060 - DNA, 7 bp, Unknown
  misc_feature (1)..( 7): Result.004 file - promoters60/5668836
aaattaa

SEQ ID NO: 150061 - DNA, 7 bp, Unknown
  misc_feature (1)..( 7): Result.004 file - promoters60/5668836
aaactaa

SEQ ID NO: 150062 - DNA, 6 bp, Unknown
  misc_feature (1)..( 6): Result.004 file - promoters60/5668836
ataatg

SEQ ID NO: 150063 - DNA, 6 bp, Unknown
  misc_feature (1)..( 6): Result.004 file - promoters60/5668836
ataatg

SEQ ID NO: 150064 - DNA, 7 bp, Unknown
  misc_feature (1)..( 7): Result.004 file - promoters60/5668836
tattaaa

SEQ ID NO: 150065 - DNA, 7 bp, Unknown
  misc_feature (1)..( 7): Result.004 file - promoters60/5668836
tattaaa

SEQ ID NO: 150066 - DNA, 7 bp, Unknown
  misc_feature (1)..( 7): Result.004 file - promoters60/5668836
cgaaaat

SEQ ID NO: 150067 - DNA, 7 bp, Unknown
  misc_feature (1)..( 7): Result.004 file - promoters60/5668836
cgataat

SEQ ID NO: 150068 - DNA, 6 bp, Unknown
  misc_feature (1)..( 6): Result.004 file - promoters60/5668836
atattt

SEQ ID NO: 150069 - DNA, 6 bp, Unknown
  misc_feature (1)..( 6): Result.004 file - promoters60/5668836
atattt

SEQ ID NO: 150070 - DNA, 7 bp, Unknown
  misc_feature (1)..( 7): Result.004 file - promoters60/5668836
tttggca

SEQ ID NO: 150071 - DNA, 7 bp, Unknown
  misc_feature (1)..( 7): Result.004 file - promoters60/5668836
tttagca

SEQ ID NO: 150072 - DNA, 7 bp, Unknown
  misc_feature (1)..( 7): Result.004 file - promoters60/5668836
tcattta

SEQ ID NO: 150073 - DNA, 7 bp, Unknown
  misc_feature (1)..( 7): Result.004 file - promoters60/5668860
tcactta

SEQ ID NO: 150074 - DNA, 9 bp, Unknown
  misc_feature (1)..( 9): Result.004 file - promoters60/5668860
gtgaagatt

SEQ ID NO: 150075 - DNA, 9 bp, Unknown
  misc_feature (1)..( 9): Result.004 file - promoters60/5668860
gtgtagatt

SEQ ID NO: 150076 - DNA, 8 bp, Unknown
  misc_feature (1)..( 8): Result.004 file - promoters60/5668860
catagatt

SEQ ID NO: 150077 - DNA, 8 bp, Unknown
  misc_feature (1)..( 8): Result.004 file - promoters60/5668860
catcgatt

SEQ ID NO: 150078 - DNA, 6 bp, Unknown
  misc_feature (1)..( 6): Result.004 file - promoters60/5668860
taaatt

SEQ ID NO: 150079 - DNA, 6 bp, Unknown
  misc_feature (1)..( 6): Result.004 file - promoters60/5668860
taaatt

SEQ ID NO: 150080 - DNA, 7 bp, Unknown
  misc_feature (1)..( 7): Result.004 file - promoters60/5668860
ttttaat

SEQ ID NO: 150081 - DNA, 7 bp, Unknown
  misc_feature (1)..( 7): Result.004 file - promoters60/5668860
tttaaat

SEQ ID NO: 150082 - DNA, 8 bp, Unknown
  misc_feature (1)..( 8): Result.004 file - promoters60/5668860
ttttattt

SEQ ID NO: 150083 - DNA, 8 bp, Unknown
  misc_feature (1)..( 8): Result.004 file - promoters60/5668860
tttgattt

SEQ ID NO: 150084 - DNA, 8 bp, Unknown
  misc_feature (1)..( 8): Result.004 file - promoters60/5668860
ataaagat

SEQ ID NO: 150085 - DNA, 8 bp, Unknown
  misc_feature (1)..( 8): Result.004 file - promoters60/5668860
ataaggat

SEQ ID NO: 150086 - DNA, 8 bp, Unknown
  misc_feature (1)..( 8): Result.004 file - promoters60/5668860
gataataa

SEQ ID NO: 150087 - DNA, 8 bp, Unknown
  misc_feature (1)..( 8): Result.004 file - promoters60/5668860
gataataa

SEQ ID NO: 150088 - DNA, 7 bp, Unknown
  misc_feature (1)..( 7): Result.004 file - promoters60/5668860
aatagtt

SEQ ID NO: 150089 - DNA, 7 bp, Unknown
  misc_feature (1)..( 7): Result.004 file - promoters60/5668860
aatggtt

SEQ ID NO: 150090 - DNA, 6 bp, Unknown
  misc_feature (1)..( 6): Result.004 file - promoters60/5668860
aatact

SEQ ID NO: 150091 - DNA, 6 bp, Unknown
  misc_feature (1)..( 6): Result.004 file - promoters60/5668860
aatact

SEQ ID NO: 150092 - DNA, 6 bp, Unknown
  misc_feature (1)..( 6): Result.004 file - promoters60/5668860
gaagaa

SEQ ID NO: 150093 - DNA, 6 bp, Unknown
  misc_feature (1)..( 6): Result.004 file - promoters60/5668860
gaagaa

SEQ ID NO: 150094 - DNA, 6 bp, Unknown
  misc_feature (1)..( 6): Result.004 file - promoters60/5668860
ttgcaa

SEQ ID NO: 150095 - DNA, 6 bp, Unknown
  misc_feature (1)..( 6): Result.004 file - promoters60/5668860
ttgcaa

SEQ ID NO: 150096 - DNA, 6 bp, Unknown
  misc_feature (1)..( 6): Result.004 file - promoters60/5668860
aaaaaa

SEQ ID NO: 150097 - DNA, 6 bp, Unknown
  misc_feature (1)..( 6): Result.004 file - promoters60/5668860
aaaaaa

SEQ ID NO: 150098 - DNA, 6 bp, Unknown
  misc_feature (1)..( 6): Result.004 file - promoters60/5668860
tctcta

SEQ ID NO: 150099 - DNA, 6 bp, Unknown
  misc_feature (1)..( 6): Result.004 file - promoters60/5668860
tctcta

SEQ ID NO: 150100 - DNA, 7 bp, Unknown
  misc_feature (1)..( 7): Result.004 file - promoters60/5668860
agtattc

SEQ ID NO: 150101 - DNA, 7 bp, Unknown
  misc_feature (1)..( 7): Result.004 file - promoters60/5668860
agtcttc

SEQ ID NO: 150102 - DNA, 7 bp, Unknown
  misc_feature (1)..( 7): Result.004 file - promoters60/5668860
aaaagaa

SEQ ID NO: 150103 - DNA, 7 bp, Unknown
  misc_feature (1)..( 7): Result.004 file - promoters60/5668860
aaaggaa

SEQ ID NO: 150104 - DNA, 7 bp, Unknown
  misc_feature (1)..( 7): Result.004 file - promoters60/5668860
aatattg

SEQ ID NO: 150105 - DNA, 7 bp, Unknown
  misc_feature (1)..( 7): Result.004 file - promoters60/5668860
aatgttg

SEQ ID NO: 150106 - DNA, 7 bp, Unknown
  misc_feature (1)..( 7): Result.004 file - promoters60/5668860
tttttgt

SEQ ID NO: 150107 - DNA, 7 bp, Unknown
  misc_feature (1)..( 7): Result.004 file - promoters60/5668860
tttgtgt

SEQ ID NO: 150108 - DNA, 6 bp, Unknown
  misc_feature (1)..( 6): Result.004 file - promoters60/5668860
gctttt

SEQ ID NO: 150109 - DNA, 6 bp, Unknown
  misc_feature (1)..( 6): Result.004 file - promoters60/5668860
gctttt

SEQ ID NO: 150110 - DNA, 6 bp, Unknown
  misc_feature (1)..( 6): Result.004 file - promoters60/5668860
aattta

SEQ ID NO: 150111 - DNA, 6 bp, Unknown
  misc_feature (1)..( 6): Result.004 file - promoters60/5668882
aattta

SEQ ID NO: 150112 - DNA, 7 bp, Unknown
  misc_feature (1)..( 7): Result.004 file - promoters60/5668882
tttgtta

SEQ ID NO: 150113 - DNA, 7 bp, Unknown
  misc_feature (1)..( 7): Result.004 file - promoters60/5668882
tttctta

SEQ ID NO: 150114 - DNA, 7 bp, Unknown
  misc_feature (1)..( 7): Result.004 file - promoters60/5668882
tttgatc

SEQ ID NO: 150115 - DNA, 7 bp, Unknown
  misc_feature (1)..( 7): Result.004 file - promoters60/5668882
tttaatc

SEQ ID NO: 150116 - DNA, 7 bp, Unknown
  misc_feature (1)..( 7): Result.004 file - promoters60/5668882
aaatcat

SEQ ID NO: 150117 - DNA, 7 bp, Unknown
  misc_feature (1)..( 7): Result.004 file - promoters60/5668882
aaaacat

SEQ ID NO: 150118 - DNA, 8 bp, Unknown
  misc_feature (1)..( 8): Result.004 file - promoters60/5668882
atatgaaa

SEQ ID NO: 150119 - DNA, 8 bp, Unknown
  misc_feature (1)..( 8): Result.004 file - promoters60/5668882
ataagaaa

SEQ ID NO: 150120 - DNA, 8 bp, Unknown
  misc_feature (1)..( 8): Result.004 file - promoters60/5668882
acaagaaa

SEQ ID NO: 150121 - DNA, 9 bp, Unknown
  misc_feature (1)..( 9): Result.004 file - promoters60/5668882
ctttcatgt

SEQ ID NO: 150122 - DNA, 9 bp, Unknown
  misc_feature (1)..( 9): Result.004 file - promoters60/5668882
cttacatgt

SEQ ID NO: 150123 - DNA, 9 bp, Unknown
  misc_feature (1)..( 9): Result.004 file - promoters60/5668882
ttagtaatt

SEQ ID NO: 150124 - DNA, 9 bp, Unknown
  misc_feature (1)..( 9): Result.004 file - promoters60/5668882
ctagttatt

SEQ ID NO: 150125 - DNA, 9 bp, Unknown
  misc_feature (1)..( 9): Result.004 file - promoters60/5668882
ctagtttac

SEQ ID NO: 150126 - DNA, 7 bp, Unknown
  misc_feature (1)..( 7): Result.004 file - promoters60/5668882
tttaatt

SEQ ID NO: 150127 - DNA, 7 bp, Unknown
  misc_feature (1)..( 7): Result.004 file - promoters60/5668882
tttcatt

SEQ ID NO: 150128 - DNA, 6 bp, Unknown
  misc_feature (1)..( 6): Result.004 file - promoters60/5668882
atatat

SEQ ID NO: 150129 - DNA, 6 bp, Unknown
  misc_feature (1)..( 6): Result.004 file - promoters60/5668882
atatat

SEQ ID NO: 150130 - DNA, 6 bp, Unknown
  misc_feature (1)..( 6): Result.004 file - promoters60/5668882
atatta

SEQ ID NO: 150131 - DNA, 6 bp, Unknown
  misc_feature (1)..( 6): Result.004 file - promoters60/5668882
atatta

SEQ ID NO: 150132 - DNA, 8 bp, Unknown
  misc_feature (1)..( 8): Result.004 file - promoters60/5668882
acggcaaa

SEQ ID NO: 150133 - DNA, 8 bp, Unknown
  misc_feature (1)..( 8): Result.004 file - promoters60/5668882
acgacaaa

SEQ ID NO: 150134 - DNA, 8 bp, Unknown
  misc_feature (1)..( 8): Result.004 file - promoters60/5668882
atttattt

SEQ ID NO: 150135 - DNA, 8 bp, Unknown
  misc_feature (1)..( 8): Result.004 file - promoters60/5668882
attttttt

SEQ ID NO: 150136 - DNA, 7 bp, Unknown
  misc_feature (1)..( 7): Result.004 file - promoters60/5668882
tgtttaa

SEQ ID NO: 150137 - DNA, 7 bp, Unknown
  misc_feature (1)..( 7): Result.004 file - promoters60/5668882
tgtttaa

SEQ ID NO: 150138 - DNA, 8 bp, Unknown
  misc_feature (1)..( 8): Result.004 file - promoters60/5668882
tatcttct

SEQ ID NO: 150139 - DNA, 8 bp, Unknown
  misc_feature (1)..( 8): Result.004 file - promoters60/5668882
tattttct

SEQ ID NO: 150140 - DNA, 7 bp, Unknown
  misc_feature (1)..( 7): Result.004 file - promoters60/5668882
taggtta

SEQ ID NO: 150141 - DNA, 7 bp, Unknown
  misc_feature (1)..( 7): Result.004 file - promoters60/5668882
tagttta

SEQ ID NO: 150142 - DNA, 9 bp, Unknown
  misc_feature (1)..( 9): Result.004 file - promoters60/5668882
aaagtcaaa

SEQ ID NO: 150143 - DNA, 9 bp, Unknown
  misc_feature (1)..( 9): Result.004 file - promoters60/5668882
aaagttaaa

SEQ ID NO: 150144 - DNA, 7 bp, Unknown
  misc_feature (1)..( 7): Result.004 file - promoters60/5668882
cattaaa

SEQ ID NO: 150145 - DNA, 7 bp, Unknown
  misc_feature (1)..( 7): Result.004 file - promoters60/5668882
catcaaa

SEQ ID NO: 150146 - DNA, 8 bp, Unknown
  misc_feature (1)..( 8): Result.004 file - promoters60/5668882
gaagccca

SEQ ID NO: 150147 - DNA, 8 bp, Unknown
  misc_feature (1)..( 8): Result.004 file - promoters60/5668897
gaagccca

SEQ ID NO: 150148 - DNA, 14 bp, Unknown
  misc_feature (1)..( 14): Result.004 file - promoters60/5668897
taaaaatctgagta

SEQ ID NO: 150149 - DNA, 14 bp, Unknown
  misc_feature (1)..( 14): Result.004 file - promoters60/5668897
aaaaaattgaaact

SEQ ID NO: 150150 - DNA, 14 bp, Unknown
  misc_feature (1)..( 14): Result.004 file - promoters60/5668897
taaaaagcgaacaa

SEQ ID NO: 150151 - DNA, 14 bp, Unknown
  misc_feature (1)..( 14): Result.004 file - promoters60/5668897
ataaaatatttaaa

SEQ ID NO: 150152 - DNA, 14 bp, Unknown
  misc_feature (1)..( 14): Result.004 file - promoters60/5668897
caaaaatattgggt

SEQ ID NO: 150153 - DNA, 14 bp, Unknown
  misc_feature (1)..( 14): Result.004 file - promoters60/5668903
tgaaactataatag

SEQ ID NO: 150154 - DNA, 6 bp, Unknown
  misc_feature (1)..( 6): Result.004 file - promoters60/5668903
ataata

SEQ ID NO: 150155 - DNA, 6 bp, Unknown
  misc_feature (1)..( 6): Result.004 file - promoters60/5668903
ataata

SEQ ID NO: 150156 - DNA, 8 bp, Unknown
  misc_feature (1)..( 8): Result.004 file - promoters60/5668903
agacttta

SEQ ID NO: 150157 - DNA, 8 bp, Unknown
  misc_feature (1)..( 8): Result.004 file - promoters60/5668903
agaatttg

SEQ ID NO: 150158 - DNA, 8 bp, Unknown
  misc_feature (1)..( 8): Result.004 file - promoters60/5668903
cgaatttg

SEQ ID NO: 150159 - DNA, 9 bp, Unknown
  misc_feature (1)..( 9): Result.004 file - promoters60/5668903
tttaatttg

SEQ ID NO: 150160 - DNA, 9 bp, Unknown
  misc_feature (1)..( 9): Result.004 file - promoters60/5668903
tttgattgt

SEQ ID NO: 150161 - DNA, 9 bp, Unknown
  misc_feature (1)..( 9): Result.004 file - promoters60/5668903
tttcatttg

SEQ ID NO: 150162 - DNA, 7 bp, Unknown
  misc_feature (1)..( 7): Result.004 file - promoters60/5668903
aaacaat

SEQ ID NO: 150163 - DNA, 7 bp, Unknown
  misc_feature (1)..( 7): Result.004 file - promoters60/5668903
aaaaaat

SEQ ID NO: 150164 - DNA, 8 bp, Unknown
  misc_feature (1)..( 8): Result.004 file - promoters60/5668903
tggcacta

SEQ ID NO: 150165 - DNA, 8 bp, Unknown
  misc_feature (1)..( 8): Result.004 file - promoters60/5668903
tggctcta

SEQ ID NO: 150166 - DNA, 6 bp, Unknown
  misc_feature (1)..( 6): Result.004 file - promoters60/5668903
aaacga

SEQ ID NO: 150167 - DNA, 6 bp, Unknown
  misc_feature (1)..( 6): Result.004 file - promoters60/5668903
aaacga

SEQ ID NO: 150168 - DNA, 9 bp, Unknown
  misc_feature (1)..( 9): Result.004 file - promoters60/5668903
ataataaaa

SEQ ID NO: 150169 - DNA, 9 bp, Unknown
  misc_feature (1)..( 9): Result.004 file - promoters60/5668903
atagtaaaa

SEQ ID NO: 150170 - DNA, 11 bp, Unknown
  misc_feature (1)..( 11): Result.004 file - promoters60/5668903
aaaaaaataaa

SEQ ID NO: 150171 - DNA, 11 bp, Unknown
  misc_feature (1)..( 11): Result.004 file - promoters60/5668903
aaagaaaaaaa

SEQ ID NO: 150172 - DNA, 7 bp, Unknown
  misc_feature (1)..( 7): Result.004 file - promoters60/5668903
ttatata

SEQ ID NO: 150173 - DNA, 7 bp, Unknown
  misc_feature (1)..( 7): Result.004 file - promoters60/5668903
ttatata

SEQ ID NO: 150174 - DNA, 9 bp, Unknown
  misc_feature (1)..( 9): Result.004 file - promoters60/5668903
cttccacaa

SEQ ID NO: 150175 - DNA, 9 bp, Unknown
  misc_feature (1)..( 9): Result.004 file - promoters60/5668903
cttccacaa

SEQ ID NO: 150176 - DNA, 7 bp, Unknown
  misc_feature (1)..( 7): Result.004 file - promoters60/5668903
tatcatt

SEQ ID NO: 150177 - DNA, 7 bp, Unknown
  misc_feature (1)..( 7): Result.004 file - promoters60/5668903
tatgatt

SEQ ID NO: 150178 - DNA, 7 bp, Unknown
  misc_feature (1)..( 7): Result.004 file - promoters60/5668903
ttagatc

SEQ ID NO: 150179 - DNA, 7 bp, Unknown
  misc_feature (1)..( 7): Result.004 file - promoters60/5668903
ttatatc

SEQ ID NO: 150180 - DNA, 6 bp, Unknown
  misc_feature (1)..( 6): Result.004 file - promoters60/5668903
catttg

SEQ ID NO: 150181 - DNA, 6 bp, Unknown
  misc_feature (1)..( 6): Result.004 file - promoters60/5668926
catttg

SEQ ID NO: 150182 - DNA, 7 bp, Unknown
  misc_feature (1)..( 7): Result.004 file - promoters60/5668926
taatttt

SEQ ID NO: 150183 - DNA, 7 bp, Unknown
  misc_feature (1)..( 7): Result.004 file - promoters60/5668926
taatttt

SEQ ID NO: 150184 - DNA, 7 bp, Unknown
  misc_feature (1)..( 7): Result.004 file - promoters60/5668926
gtagaaa

SEQ ID NO: 150185 - DNA, 7 bp, Unknown
  misc_feature (1)..( 7): Result.004 file - promoters60/5668926
gtataaa

SEQ ID NO: 150186 - DNA, 9 bp, Unknown
  misc_feature (1)..( 9): Result.004 file - promoters60/5668926
ctaaattct

SEQ ID NO: 150187 - DNA, 9 bp, Unknown
  misc_feature (1)..( 9): Result.004 file - promoters60/5668926
ctaaagtct

SEQ ID NO: 150188 - DNA, 6 bp, Unknown
  misc_feature (1)..( 6): Result.004 file - promoters60/5668926
tttggt

SEQ ID NO: 150189 - DNA, 6 bp, Unknown
  misc_feature (1)..( 6): Result.004 file - promoters60/5668926
tttggt

SEQ ID NO: 150190 - DNA, 9 bp, Unknown
  misc_feature (1)..( 9): Result.004 file - promoters60/5668926
aattaatat

SEQ ID NO: 150191 - DNA, 9 bp, Unknown
  misc_feature (1)..( 9): Result.004 file - promoters60/5668926
aatgaatat

SEQ ID NO: 150192 - DNA, 6 bp, Unknown
  misc_feature (1)..( 6): Result.004 file - promoters60/5668926
atataa

SEQ ID NO: 150193 - DNA, 6 bp, Unknown
  misc_feature (1)..( 6): Result.004 file - promoters60/5668926
atataa

SEQ ID NO: 150194 - DNA, 8 bp, Unknown
  misc_feature (1)..( 8): Result.004 file - promoters60/5668926
catttaaa

SEQ ID NO: 150195 - DNA, 8 bp, Unknown
  misc_feature (1)..( 8): Result.004 file - promoters60/5668926
gatttaat

SEQ ID NO: 150196 - DNA, 8 bp, Unknown
  misc_feature (1)..( 8): Result.004 file - promoters60/5668926
cattaaaa

SEQ ID NO: 150197 - DNA, 7 bp, Unknown
  misc_feature (1)..( 7): Result.004 file - promoters60/5668926
tttgaat

SEQ ID NO: 150198 - DNA, 7 bp, Unknown
  misc_feature (1)..( 7): Result.004 file - promoters60/5668926
tttgaat

SEQ ID NO: 150199 - DNA, 12 bp, Unknown
  misc_feature (1)..( 12): Result.004 file - promoters60/5668926
caaactgtgaaa

SEQ ID NO: 150200 - DNA, 12 bp, Unknown
  misc_feature (1)..( 12): Result.004 file - promoters60/5668926
aaaaatgtgaaa

SEQ ID NO: 150201 - DNA, 12 bp, Unknown
  misc_feature (1)..( 12): Result.004 file - promoters60/5668926
aaaaataatttt

SEQ ID NO: 150202 - DNA, 7 bp, Unknown
  misc_feature (1)..( 7): Result.004 file - promoters60/5668926
aatctaa

SEQ ID NO: 150203 - DNA, 7 bp, Unknown
  misc_feature (1)..( 7): Result.004 file - promoters60/5668926
aatttaa

SEQ ID NO: 150204 - DNA, 11 bp, Unknown
  misc_feature (1)..( 11): Result.004 file - promoters60/5668926
ccaaatttggt

SEQ ID NO: 150205 - DNA, 11 bp, Unknown
  misc_feature (1)..( 11): Result.004 file - promoters60/5668926
ccaattttaag

SEQ ID NO: 150206 - DNA, 11 bp, Unknown
  misc_feature (1)..( 11): Result.004 file - promoters60/5668926
attattctaag

SEQ ID NO: 150207 - DNA, 8 bp, Unknown
  misc_feature (1)..( 8): Result.004 file - promoters60/5668926
aatataaa

SEQ ID NO: 150208 - DNA, 8 bp, Unknown
  misc_feature (1)..( 8): Result.004 file - promoters60/5668926
aatagaaa

SEQ ID NO: 150209 - DNA, 9 bp, Unknown
  misc_feature (1)..( 9): Result.004 file - promoters60/5668926
tatataata

SEQ ID NO: 150210 - DNA, 9 bp, Unknown
  misc_feature (1)..( 9): Result.004 file - promoters60/5668926
tataaaata

SEQ ID NO: 150211 - DNA, 6 bp, Unknown
  misc_feature (1)..( 6): Result.004 file - promoters60/5668926
cccaaa

SEQ ID NO: 150212 - DNA, 6 bp, Unknown
  misc_feature (1)..( 6): Result.004 file - promoters60/5668926
cccaaa

SEQ ID NO: 150213 - DNA, 6 bp, Unknown
  misc_feature (1)..( 6): Result.004 file - promoters60/5668926
attttt

SEQ ID NO: 150214 - DNA, 6 bp, Unknown
  misc_feature (1)..( 6): Result.004 file - promoters60/5668926
attttt

SEQ ID NO: 150215 - DNA, 8 bp, Unknown
  misc_feature (1)..( 8): Result.004 file - promoters60/5668926
ttttaata

SEQ ID NO: 150216 - DNA, 8 bp, Unknown
  misc_feature (1)..( 8): Result.004 file - promoters60/5668926
ttttaata

SEQ ID NO: 150217 - DNA, 10 bp, Unknown
  misc_feature (1)..( 10): Result.004 file - promoters60/5668926
tatctgagaa

SEQ ID NO: 150218 - DNA, 10 bp, Unknown
  misc_feature (1)..( 10): Result.004 file - promoters60/5668926
tatcttagaa

SEQ ID NO: 150219 - DNA, 10 bp, Unknown
  misc_feature (1)..( 10): Result.004 file - promoters60/5668926
agtctatata

SEQ ID NO: 150220 - DNA, 10 bp, Unknown
  misc_feature (1)..( 10): Result.004 file - promoters60/5668926
agtctctata

SEQ ID NO: 150221 - DNA, 7 bp, Unknown
  misc_feature (1)..( 7): Result.004 file - promoters60/5668926
tgatatg

SEQ ID NO: 150222 - DNA, 7 bp, Unknown
  misc_feature (1)..( 7): Result.004 file - promoters60/5668926
tgaaatg

SEQ ID NO: 150223 - DNA, 6 bp, Unknown
  misc_feature (1)..( 6): Result.004 file - promoters60/5668926
aacatt

SEQ ID NO: 150224 - DNA, 6 bp, Unknown
  misc_feature (1)..( 6): Result.004 file - promoters60/5668926
aacatt

SEQ ID NO: 150225 - DNA, 7 bp, Unknown
  misc_feature (1)..( 7): Result.004 file - promoters60/5668926
tctcttt

SEQ ID NO: 150226 - DNA, 7 bp, Unknown
  misc_feature (1)..( 7): Result.004 file - promoters60/5668926
tctgttt

SEQ ID NO: 150227 - DNA, 8 bp, Unknown
  misc_feature (1)..( 8): Result.004 file - promoters60/5668926
cttcttct

SEQ ID NO: 150228 - DNA, 8 bp, Unknown
  misc_feature (1)..( 8): Result.004 file - promoters60/5668951
cttcctct

SEQ ID NO: 150229 - DNA, 8 bp, Unknown
  misc_feature (1)..( 8): Result.004 file - promoters60/5668951
caaaccaa

SEQ ID NO: 150230 - DNA, 8 bp, Unknown
  misc_feature (1)..( 8): Result.004 file - promoters60/5668951
caaaacaa

SEQ ID NO: 150231 - DNA, 8 bp, Unknown
  misc_feature (1)..( 8): Result.004 file - promoters60/5668951
aaaaacaa

SEQ ID NO: 150232 - DNA, 8 bp, Unknown
  misc_feature (1)..( 8): Result.004 file - promoters60/5668951
taaaccaa

SEQ ID NO: 150233 - DNA, 8 bp, Unknown
  misc_feature (1)..( 8): Result.004 file - promoters60/5668951
tttcaatt

SEQ ID NO: 150234 - DNA, 8 bp, Unknown
  misc_feature (1)..( 8): Result.004 file - promoters60/5668951
attcaatg

SEQ ID NO: 150235 - DNA, 8 bp, Unknown
  misc_feature (1)..( 8): Result.004 file - promoters60/5668951
ttttaatt

SEQ ID NO: 150236 - DNA, 8 bp, Unknown
  misc_feature (1)..( 8): Result.004 file - promoters60/5668951
attcaact

SEQ ID NO: 150237 - DNA, 7 bp, Unknown
  misc_feature (1)..( 7): Result.004 file - promoters60/5668951
cttttct

SEQ ID NO: 150238 - DNA, 7 bp, Unknown
  misc_feature (1)..( 7): Result.004 file - promoters60/5668951
cttatct

SEQ ID NO: 150239 - DNA, 7 bp, Unknown
  misc_feature (1)..( 7): Result.004 file - promoters60/5668951
gttatct

SEQ ID NO: 150240 - DNA, 15 bp, Unknown
  misc_feature (1)..( 15): Result.004 file - promoters60/5668951
actaaaataactcac

SEQ ID NO: 150241 - DNA, 15 bp, Unknown
  misc_feature (1)..( 15): Result.004 file - promoters60/5668951
acagaaataaatcac

SEQ ID NO: 150242 - DNA, 15 bp, Unknown
  misc_feature (1)..( 15): Result.004 file - promoters60/5668974
acacaaatatgccaa

SEQ ID NO: 150243 - DNA, 9 bp, Unknown
  misc_feature (1)..( 9): Result.004 file - promoters60/5668974
gtctttttt

SEQ ID NO: 150244 - DNA, 9 bp, Unknown
  misc_feature (1)..( 9): Result.004 file - promoters60/5668974
ttctgtttg

SEQ ID NO: 150245 - DNA, 9 bp, Unknown
  misc_feature (1)..( 9): Result.004 file - promoters60/5668974
aactttttt

SEQ ID NO: 150246 - DNA, 9 bp, Unknown
  misc_feature (1)..( 9): Result.004 file - promoters60/5668974
ttcttttca

SEQ ID NO: 150247 - DNA, 9 bp, Unknown
  misc_feature (1)..( 9): Result.004 file - promoters60/5668974
aacttttgc

SEQ ID NO: 150248 - DNA, 9 bp, Unknown
  misc_feature (1)..( 9): Result.004 file - promoters60/5668974
aaatttttt

SEQ ID NO: 150249 - DNA, 9 bp, Unknown
  misc_feature (1)..( 9): Result.004 file - promoters60/5668974
aaactttaa

SEQ ID NO: 150250 - DNA, 9 bp, Unknown
  misc_feature (1)..( 9): Result.004 file - promoters60/5668974
tgatttttt

SEQ ID NO: 150251 - DNA, 9 bp, Unknown
  misc_feature (1)..( 9): Result.004 file - promoters60/5668974
gaattttaa

SEQ ID NO: 150252 - DNA, 10 bp, Unknown
  misc_feature (1)..( 10): Result.004 file - promoters60/5668974
atatttattt

SEQ ID NO: 150253 - DNA, 12 bp, Unknown
  misc_feature (1)..( 12): Result.004 file - promoters60/5668974
atcaaaatgttt

SEQ ID NO: 150254 - DNA, 12 bp, Unknown
  misc_feature (1)..( 12): Result.004 file - promoters60/5668974
aaaaaaatgctg

SEQ ID NO: 150255 - DNA, 12 bp, Unknown
  misc_feature (1)..( 12): Result.004 file - promoters60/5668974
actgaaatattt

SEQ ID NO: 150256 - DNA, 12 bp, Unknown
  misc_feature (1)..( 12): Result.004 file - promoters60/5668974
atccaaattcac

SEQ ID NO: 150257 - DNA, 12 bp, Unknown
  misc_feature (1)..( 12): Result.004 file - promoters60/5668974
ttttacatattt

SEQ ID NO: 150258 - DNA, 10 bp, Unknown
  misc_feature (1)..( 10): Result.004 file - promoters60/5668974
agcaagttac

SEQ ID NO: 150259 - DNA, 10 bp, Unknown
  misc_feature (1)..( 10): Result.004 file - promoters60/5668974
accaaattac

SEQ ID NO: 150260 - DNA, 10 bp, Unknown
  misc_feature (1)..( 10): Result.004 file - promoters60/5668974
ggcaatttaa

SEQ ID NO: 150261 - DNA, 10 bp, Unknown
  misc_feature (1)..( 10): Result.004 file - promoters60/5668974
ggcaatattt

SEQ ID NO: 150262 - DNA, 10 bp, Unknown
  misc_feature (1)..( 10): Result.004 file - promoters60/5668974
aacaattttt

SEQ ID NO: 150263 - DNA, 13 bp, Unknown
  misc_feature (1)..( 13): Result.004 file - promoters60/5668974
atataccaaacta

SEQ ID NO: 150264 - DNA, 13 bp, Unknown
  misc_feature (1)..( 13): Result.004 file - promoters60/5668974
aaataacaatata

SEQ ID NO: 150265 - DNA, 13 bp, Unknown
  misc_feature (1)..( 13): Result.004 file - promoters60/5668974
taataatatgatt

SEQ ID NO: 150266 - DNA, 13 bp, Unknown
  misc_feature (1)..( 13): Result.004 file - promoters60/5668974
ttataccaaaata

SEQ ID NO: 150267 - DNA, 13 bp, Unknown
  misc_feature (1)..( 13): Result.004 file - promoters60/5668990
gaatcacataatt

SEQ ID NO: 150268 - DNA, 11 bp, Unknown
  misc_feature (1)..( 11): Result.004 file - promoters60/5668990
tagattttgtt

SEQ ID NO: 150269 - DNA, 11 bp, Unknown
  misc_feature (1)..( 11): Result.004 file - promoters60/5668990
tagagtttaga

SEQ ID NO: 150270 - DNA, 11 bp, Unknown
  misc_feature (1)..( 11): Result.004 file - promoters60/5668990
aaccgtttgat

SEQ ID NO: 150271 - DNA, 11 bp, Unknown
  misc_feature (1)..( 11): Result.004 file - promoters60/5668990
cagatttagat

SEQ ID NO: 150272 - DNA, 9 bp, Unknown
  misc_feature (1)..( 9): Result.004 file - promoters60/5668990
acgtagtat

SEQ ID NO: 150273 - DNA, 9 bp, Unknown
  misc_feature (1)..( 9): Result.004 file - promoters60/5668990
ttgtagtat

SEQ ID NO: 150274 - DNA, 9 bp, Unknown
  misc_feature (1)..( 9): Result.004 file - promoters60/5668990
tcgtggtag

SEQ ID NO: 150275 - DNA, 9 bp, Unknown
  misc_feature (1)..( 9): Result.004 file - promoters60/5669010
ttgaagttt

SEQ ID NO: 150276 - DNA, 7 bp, Unknown
  misc_feature (1)..( 7): Result.004 file - promoters60/5669010
ctcgtga

SEQ ID NO: 150277 - DNA, 7 bp, Unknown
  misc_feature (1)..( 7): Result.004 file - promoters60/5669010
ctcatga

SEQ ID NO: 150278 - DNA, 7 bp, Unknown
  misc_feature (1)..( 7): Result.004 file - promoters60/5669010
aagaaaa

SEQ ID NO: 150279 - DNA, 7 bp, Unknown
  misc_feature (1)..( 7): Result.004 file - promoters60/5669010
aagtaaa

SEQ ID NO: 150280 - DNA, 8 bp, Unknown
  misc_feature (1)..( 8): Result.004 file - promoters60/5669010
atgaaaat

SEQ ID NO: 150281 - DNA, 8 bp, Unknown
  misc_feature (1)..( 8): Result.004 file - promoters60/5669010
atgtaaat

SEQ ID NO: 150282 - DNA, 6 bp, Unknown
  misc_feature (1)..( 6): Result.004 file - promoters60/5669010
tgttac

SEQ ID NO: 150283 - DNA, 6 bp, Unknown
  misc_feature (1)..( 6): Result.004 file - promoters60/5669010
tgttac

SEQ ID NO: 150284 - DNA, 8 bp, Unknown
  misc_feature (1)..( 8): Result.004 file - promoters60/5669010
tttataaa

SEQ ID NO: 150285 - DNA, 8 bp, Unknown
  misc_feature (1)..( 8): Result.004 file - promoters60/5669010
tttttaaa

SEQ ID NO: 150286 - DNA, 7 bp, Unknown
  misc_feature (1)..( 7): Result.004 file - promoters60/5669010
cccgtct

SEQ ID NO: 150287 - DNA, 7 bp, Unknown
  misc_feature (1)..( 7): Result.004 file - promoters60/5669010
cccatct

SEQ ID NO: 150288 - DNA, 7 bp, Unknown
  misc_feature (1)..( 7): Result.004 file - promoters60/5669010
tgtttat

SEQ ID NO: 150289 - DNA, 7 bp, Unknown
  misc_feature (1)..( 7): Result.004 file - promoters60/5669010
tgtctat

SEQ ID NO: 150290 - DNA, 7 bp, Unknown
  misc_feature (1)..( 7): Result.004 file - promoters60/5669010
ttgcttg

SEQ ID NO: 150291 - DNA, 7 bp, Unknown
  misc_feature (1)..( 7): Result.004 file - promoters60/5669010
ttggttg

SEQ ID NO: 150292 - DNA, 6 bp, Unknown
  misc_feature (1)..( 6): Result.004 file - promoters60/5669010
tgattt

SEQ ID NO: 150293 - DNA, 6 bp, Unknown
  misc_feature (1)..( 6): Result.004 file - promoters60/5669010
tgattt

SEQ ID NO: 150294 - DNA, 6 bp, Unknown
  misc_feature (1)..( 6): Result.004 file - promoters60/5669010
ttgtgt

SEQ ID NO: 150295 - DNA, 6 bp, Unknown
  misc_feature (1)..( 6): Result.004 file - promoters60/5669010
ttgtgt

SEQ ID NO: 150296 - DNA, 6 bp, Unknown
  misc_feature (1)..( 6): Result.004 file - promoters60/5669010
tcttct

SEQ ID NO: 150297 - DNA, 6 bp, Unknown
  misc_feature (1)..( 6): Result.004 file - promoters60/5669013
tcttct

SEQ ID NO: 150298 - DNA, 8 bp, Unknown
  misc_feature (1)..( 8): Result.004 file - promoters60/5669013
aaatcttt

SEQ ID NO: 150299 - DNA, 8 bp, Unknown
  misc_feature (1)..( 8): Result.004 file - promoters60/5669013
aaatattt

SEQ ID NO: 150300 - DNA, 9 bp, Unknown
  misc_feature (1)..( 9): Result.004 file - promoters60/5669013
aaattctct

SEQ ID NO: 150301 - DNA, 9 bp, Unknown
  misc_feature (1)..( 9): Result.004 file - promoters60/5669013
atattatat

SEQ ID NO: 150302 - DNA, 9 bp, Unknown
  misc_feature (1)..( 9): Result.004 file - promoters60/5669013
gtattataa

SEQ ID NO: 150303 - DNA, 9 bp, Unknown
  misc_feature (1)..( 9): Result.004 file - promoters60/5669508
atactatat

SEQ ID NO: 150304 - DNA, 11 bp, Unknown
  misc_feature (1)..( 11): Result.004 file - promoters60/5669508
cttgtttatat

SEQ ID NO: 150305 - DNA, 11 bp, Unknown
  misc_feature (1)..( 11): Result.004 file - promoters60/5669508
tttggttacaa

SEQ ID NO: 150306 - DNA, 11 bp, Unknown
  misc_feature (1)..( 11): Result.004 file - promoters60/5669508
cgagtttattt

SEQ ID NO: 150307 - DNA, 11 bp, Unknown
  misc_feature (1)..( 11): Result.004 file - promoters60/5669508
cttgtttactg

SEQ ID NO: 150308 - DNA, 11 bp, Unknown
  misc_feature (1)..( 11): Result.004 file - promoters60/5669508
acggtttgctg

SEQ ID NO: 150309 - DNA, 11 bp, Unknown
  misc_feature (1)..( 11): Result.004 file - promoters60/5669546
attttttttat

SEQ ID NO: 150310 - DNA, 7 bp, Unknown
  misc_feature (1)..( 7): Result.004 file - promoters60/5669546
gttcctt

SEQ ID NO: 150311 - DNA, 7 bp, Unknown
  misc_feature (1)..( 7): Result.004 file - promoters60/5669546
gtttctt

SEQ ID NO: 150312 - DNA, 7 bp, Unknown
  misc_feature (1)..( 7): Result.004 file - promoters60/5669546
gttcctc

SEQ ID NO: 150313 - DNA, 8 bp, Unknown
  misc_feature (1)..( 8): Result.004 file - promoters60/5669546
aaatgtta

SEQ ID NO: 150314 - DNA, 8 bp, Unknown
  misc_feature (1)..( 8): Result.004 file - promoters60/5669546
aaaagttt

SEQ ID NO: 150315 - DNA, 8 bp, Unknown
  misc_feature (1)..( 8): Result.004 file - promoters60/5669546
caatttta

SEQ ID NO: 150316 - DNA, 7 bp, Unknown
  misc_feature (1)..( 7): Result.004 file - promoters60/5669546
gttgatt

SEQ ID NO: 150317 - DNA, 7 bp, Unknown
  misc_feature (1)..( 7): Result.004 file - promoters60/5669546
gttgatg

SEQ ID NO: 150318 - DNA, 7 bp, Unknown
  misc_feature (1)..( 7): Result.004 file - promoters60/5669546
gttaatt

SEQ ID NO: 150319 - DNA, 8 bp, Unknown
  misc_feature (1)..( 8): Result.004 file - promoters60/5669546
cgacatgt

SEQ ID NO: 150320 - DNA, 8 bp, Unknown
  misc_feature (1)..( 8): Result.004 file - promoters60/5669546
cgacatta

SEQ ID NO: 150321 - DNA, 8 bp, Unknown
  misc_feature (1)..( 8): Result.004 file - promoters60/5669546
cgacatgt

SEQ ID NO: 150322 - DNA, 8 bp, Unknown
  misc_feature (1)..( 8): Result.004 file - promoters60/5669546
acacatgt

SEQ ID NO: 150323 - DNA, 6 bp, Unknown
  misc_feature (1)..( 6): Result.004 file - promoters60/5669546
acatgt

SEQ ID NO: 150324 - DNA, 6 bp, Unknown
  misc_feature (1)..( 6): Result.004 file - promoters60/5669546
acatgt

SEQ ID NO: 150325 - DNA, 6 bp, Unknown
  misc_feature (1)..( 6): Result.004 file - promoters60/5670300
acatgt

SEQ ID NO: 150326 - DNA, 8 bp, Unknown
  misc_feature (1)..( 8): Result.004 file - promoters60/5670300
caataaaa

SEQ ID NO: 150327 - DNA, 8 bp, Unknown
  misc_feature (1)..( 8): Result.004 file - promoters60/5670300
caaaaaaa

SEQ ID NO: 150328 - DNA, 6 bp, Unknown
  misc_feature (1)..( 6): Result.004 file - promoters60/5670300
aaaaca

SEQ ID NO: 150329 - DNA, 6 bp, Unknown
  misc_feature (1)..( 6): Result.004 file - promoters60/5670300
aaaaca

SEQ ID NO: 150330 - DNA, 8 bp, Unknown
  misc_feature (1)..( 8): Result.004 file - promoters60/5670300
gaattaaa

SEQ ID NO: 150331 - DNA, 8 bp, Unknown
  misc_feature (1)..( 8): Result.004 file - promoters60/5670300
gaaataaa

SEQ ID NO: 150332 - DNA, 7 bp, Unknown
  misc_feature (1)..( 7): Result.004 file - promoters60/5670300
caaattt

SEQ ID NO: 150333 - DNA, 7 bp, Unknown
  misc_feature (1)..( 7): Result.004 file - promoters60/5670300
caatttt

SEQ ID NO: 150334 - DNA, 6 bp, Unknown
  misc_feature (1)..( 6): Result.004 file - promoters60/5670300
ttaaaa

SEQ ID NO: 150335 - DNA, 6 bp, Unknown
  misc_feature (1)..( 6): Result.004 file - promoters60/5670300
ttaaaa

SEQ ID NO: 150336 - DNA, 6 bp, Unknown
  misc_feature (1)..( 6): Result.004 file - promoters60/5670300
gtaacg

SEQ ID NO: 150337 - DNA, 6 bp, Unknown
  misc_feature (1)..( 6): Result.004 file - promoters60/5670300
gtaacg

SEQ ID NO: 150338 - DNA, 7 bp, Unknown
  misc_feature (1)..( 7): Result.004 file - promoters60/5670300
gtggtta

SEQ ID NO: 150339 - DNA, 7 bp, Unknown
  misc_feature (1)..( 7): Result.004 file - promoters60/5670300
gtgttta

SEQ ID NO: 150340 - DNA, 10 bp, Unknown
  misc_feature (1)..( 10): Result.004 file - promoters60/5670300
tacgtgtcaa

SEQ ID NO: 150341 - DNA, 10 bp, Unknown
  misc_feature (1)..( 10): Result.004 file - promoters60/5670300
cacgtgtcat

SEQ ID NO: 150342 - DNA, 10 bp, Unknown
  misc_feature (1)..( 10): Result.004 file - promoters60/5670300
tacgtgtcaa

SEQ ID NO: 150343 - DNA, 20 bp, Unknown
  misc_feature (1)..( 20): Result.004 file - promoters60/5670300
ttggttattgcttcaccgcc

SEQ ID NO: 150344 - DNA, 20 bp, Unknown
  misc_feature (1)..( 20): Result.004 file - promoters60/5670300
ttagctattgcttcaccgcc

SEQ ID NO: 150345 - DNA, 20 bp, Unknown
  misc_feature (1)..( 20): Result.004 file - promoters60/5670300
ttggctattgcttccacgcc

SEQ ID NO: 150346 - DNA, 22 bp, Unknown
  misc_feature (1)..( 22): Result.004 file - promoters60/5670300
tctcgtgaccgactcgtcctcg

SEQ ID NO: 150347 - DNA, 22 bp, Unknown
  misc_feature (1)..( 22): Result.004 file - promoters60/5670300
gacctagtcgtcctcgtctttt

SEQ ID NO: 150348 - DNA, 22 bp, Unknown
  misc_feature (1)..( 22): Result.004 file - promoters60/5670300
gaccgagtcgtcctcgtctttt

SEQ ID NO: 150349 - DNA, 19 bp, Unknown
  misc_feature (1)..( 19): Result.004 file - promoters60/5670300
ttcttcttctataaattaa

SEQ ID NO: 150350 - DNA, 19 bp, Unknown
  misc_feature (1)..( 19): Result.004 file - promoters60/5670300
ttcttcttctataaaacaa

SEQ ID NO: 150351 - DNA, 19 bp, Unknown
  misc_feature (1)..( 19): Result.004 file - promoters60/5670300
ttttgcttctataaatcaa

SEQ ID NO: 150352 - DNA, 6 bp, Unknown
  misc_feature (1)..( 6): Result.004 file - promoters60/5670300
gcttct

SEQ ID NO: 150353 - DNA, 6 bp, Unknown
  misc_feature (1)..( 6): Result.004 file - promoters60/5670300
gcttct

SEQ ID NO: 150354 - DNA, 8 bp, Unknown
  misc_feature (1)..( 8): Result.004 file - promoters60/5670300
ttctggcc

SEQ ID NO: 150355 - DNA, 8 bp, Unknown
  misc_feature (1)..( 8): Result.004 file - promoters60/5670300
ttcttgcc

SEQ ID NO: 150356 - DNA, 7 bp, Unknown
  misc_feature (1)..( 7): Result.004 file - promoters60/5670300
tacatat

SEQ ID NO: 150357 - DNA, 7 bp, Unknown
  misc_feature (1)..( 7): Result.004 file - promoters60/5670300
tacttat

SEQ ID NO: 150358 - DNA, 15 bp, Unknown
  misc_feature (1)..( 15): Result.004 file - promoters60/5670300
cgccttagctttctc

SEQ ID NO: 150359 - DNA, 15 bp, Unknown
  misc_feature (1)..( 15): Result.004 file - promoters60/5670300
cgccttagctttctc

SEQ ID NO: 150360 - DNA, 15 bp, Unknown
  misc_feature (1)..( 15): Result.004 file - promoters60/5670300
cgccttagctttctc

SEQ ID NO: 150361 - DNA, 6 bp, Unknown
  misc_feature (1)..( 6): Result.004 file - promoters60/5670300
tttttt

SEQ ID NO: 150362 - DNA, 6 bp, Unknown
  misc_feature (1)..( 6): Result.004 file - promoters60/5670300
tttttt

SEQ ID NO: 150363 - DNA, 9 bp, Unknown
  misc_feature (1)..( 9): Result.004 file - promoters60/5670300
acaaaaagg

SEQ ID NO: 150364 - DNA, 9 bp, Unknown
  misc_feature (1)..( 9): Result.004 file - promoters60/5670300
acacaaagg

SEQ ID NO: 150365 - DNA, 7 bp, Unknown
  misc_feature (1)..( 7): Result.004 file - promoters60/5670300
acgaaga

SEQ ID NO: 150366 - DNA, 7 bp, Unknown
  misc_feature (1)..( 7): Result.004 file - promoters60/5670300
acgcaga

SEQ ID NO: 150367 - DNA, 6 bp, Unknown
  misc_feature (1)..( 6): Result.004 file - promoters60/5670300
gttcaa

SEQ ID NO: 150368 - DNA, 6 bp, Unknown
  misc_feature (1)..( 6): Result.004 file - promoters60/5670300
gttcaa

SEQ ID NO: 150369 - DNA, 6 bp, Unknown
  misc_feature (1)..( 6): Result.004 file - promoters60/5670300
gtatat

SEQ ID NO: 150370 - DNA, 6 bp, Unknown
  misc_feature (1)..( 6): Result.004 file - promoters60/5670300
gtatat

SEQ ID NO: 150371 - DNA, 9 bp, Unknown
  misc_feature (1)..( 9): Result.004 file - promoters60/5670300
atcttatga

SEQ ID NO: 150372 - DNA, 9 bp, Unknown
  misc_feature (1)..( 9): Result.004 file - promoters60/5670300
atctaatga

SEQ ID NO: 150373 - DNA, 6 bp, Unknown
  misc_feature (1)..( 6): Result.004 file - promoters60/5670300
tcagta

SEQ ID NO: 150374 - DNA, 6 bp, Unknown
  misc_feature (1)..( 6): Result.004 file - promoters60/5670300
tcagta

SEQ ID NO: 150375 - DNA, 6 bp, Unknown
  misc_feature (1)..( 6): Result.004 file - promoters60/5670300
aacaac

SEQ ID NO: 150376 - DNA, 6 bp, Unknown
  misc_feature (1)..( 6): Result.004 file - promoters60/5670300
aacaac

SEQ ID NO: 150377 - DNA, 15 bp, Unknown
  misc_feature (1)..( 15): Result.004 file - promoters60/5670300
aatacccaaagagct

SEQ ID NO: 150378 - DNA, 15 bp, Unknown
  misc_feature (1)..( 15): Result.004 file - promoters60/5670680
aatacccaaagagct

SEQ ID NO: 150379 - DNA, 7 bp, Unknown
  misc_feature (1)..( 7): Result.004 file - promoters60/5670680
tatgttc

SEQ ID NO: 150380 - DNA, 7 bp, Unknown
  misc_feature (1)..( 7): Result.004 file - promoters60/5670680
tatgttc

SEQ ID NO: 150381 - DNA, 7 bp, Unknown
  misc_feature (1)..( 7): Result.004 file - promoters60/5670680
gttttag

SEQ ID NO: 150382 - DNA, 7 bp, Unknown
  misc_feature (1)..( 7): Result.004 file - promoters60/5670680
gttctag

SEQ ID NO: 150383 - DNA, 8 bp, Unknown
  misc_feature (1)..( 8): Result.004 file - promoters60/5670680
ataagata

SEQ ID NO: 150384 - DNA, 8 bp, Unknown
  misc_feature (1)..( 8): Result.004 file - promoters60/5670680
ataatata

SEQ ID NO: 150385 - DNA, 8 bp, Unknown
  misc_feature (1)..( 8): Result.004 file - promoters60/5670680
atatgatt

SEQ ID NO: 150386 - DNA, 6 bp, Unknown
  misc_feature (1)..( 6): Result.004 file - promoters60/5670680
ttttaa

SEQ ID NO: 150387 - DNA, 6 bp, Unknown
  misc_feature (1)..( 6): Result.004 file - promoters60/5670680
ttttaa

SEQ ID NO: 150388 - DNA, 8 bp, Unknown
  misc_feature (1)..( 8): Result.004 file - promoters60/5670680
aaaaaatg

SEQ ID NO: 150389 - DNA, 8 bp, Unknown
  misc_feature (1)..( 8): Result.004 file - promoters60/5670680
aaaatatg

SEQ ID NO: 150390 - DNA, 6 bp, Unknown
  misc_feature (1)..( 6): Result.004 file - promoters60/5670680
agaaat

SEQ ID NO: 150391 - DNA, 6 bp, Unknown
  misc_feature (1)..( 6): Result.004 file - promoters60/5670680
agaaat

SEQ ID NO: 150392 - DNA, 7 bp, Unknown
  misc_feature (1)..( 7): Result.004 file - promoters60/5670680
ataagat

SEQ ID NO: 150393 - DNA, 7 bp, Unknown
  misc_feature (1)..( 7): Result.004 file - promoters60/5670680
ataagat

SEQ ID NO: 150394 - DNA, 9 bp, Unknown
  misc_feature (1)..( 9): Result.004 file - promoters60/5670680
caagacaat

SEQ ID NO: 150395 - DNA, 9 bp, Unknown
  misc_feature (1)..( 9): Result.004 file - promoters60/5670680
caagataat

SEQ ID NO: 150396 - DNA, 6 bp, Unknown
  misc_feature (1)..( 6): Result.004 file - promoters60/5670680
atagta

SEQ ID NO: 150397 - DNA, 6 bp, Unknown
  misc_feature (1)..( 6): Result.004 file - promoters60/5670680
atagta

SEQ ID NO: 150398 - DNA, 6 bp, Unknown
  misc_feature (1)..( 6): Result.004 file - promoters60/5670680
gaaaaa

SEQ ID NO: 150399 - DNA, 6 bp, Unknown
  misc_feature (1)..( 6): Result.004 file - promoters60/5670680
gaaaaa

SEQ ID NO: 150400 - DNA, 8 bp, Unknown
  misc_feature (1)..( 8): Result.004 file - promoters60/5670680
tgatggtg

SEQ ID NO: 150401 - DNA, 8 bp, Unknown
  misc_feature (1)..( 8): Result.004 file - promoters60/5670680
tgaaggtg

SEQ ID NO: 150402 - DNA, 8 bp, Unknown
  misc_feature (1)..( 8): Result.004 file - promoters60/5670680
aaatgttt

SEQ ID NO: 150403 - DNA, 8 bp, Unknown
  misc_feature (1)..( 8): Result.004 file - promoters60/5670680
aaatattt

SEQ ID NO: 150404 - DNA, 9 bp, Unknown
  misc_feature (1)..( 9): Result.004 file - promoters60/5670680
caagctcta

SEQ ID NO: 150405 - DNA, 9 bp, Unknown
  misc_feature (1)..( 9): Result.004 file - promoters60/5670680
caatctcta

SEQ ID NO: 150406 - DNA, 8 bp, Unknown
  misc_feature (1)..( 8): Result.004 file - promoters60/5670680
attttcat

SEQ ID NO: 150407 - DNA, 8 bp, Unknown
  misc_feature (1)..( 8): Result.004 file - promoters60/5670680
attttcat

SEQ ID NO: 150408 - DNA, 8 bp, Unknown
  misc_feature (1)..( 8): Result.004 file - promoters60/5670680
attttttt

SEQ ID NO: 150409 - DNA, 8 bp, Unknown
  misc_feature (1)..( 8): Result.004 file - promoters60/5670680
attttttt

SEQ ID NO: 150410 - DNA, 6 bp, Unknown
  misc_feature (1)..( 6): Result.004 file - promoters60/5670680
tcatat

SEQ ID NO: 150411 - DNA, 6 bp, Unknown
  misc_feature (1)..( 6): Result.004 file - promoters60/5670680
tcatat

SEQ ID NO: 150412 - DNA, 6 bp, Unknown
  misc_feature (1)..( 6): Result.004 file - promoters60/5670680
agaaaa

SEQ ID NO: 150413 - DNA, 6 bp, Unknown
  misc_feature (1)..( 6): Result.004 file - promoters60/5670680
agaaaa

SEQ ID NO: 150414 - DNA, 6 bp, Unknown
  misc_feature (1)..( 6): Result.004 file - promoters60/5670680
tttcaa

SEQ ID NO: 150415 - DNA, 6 bp, Unknown
  misc_feature (1)..( 6): Result.004 file - promoters60/5670680
tttcaa

SEQ ID NO: 150416 - DNA, 8 bp, Unknown
  misc_feature (1)..( 8): Result.004 file - promoters60/5670680
atcaaaat

SEQ ID NO: 150417 - DNA, 8 bp, Unknown
  misc_feature (1)..( 8): Result.004 file - promoters60/5670784
atcacaat

SEQ ID NO: 150418 - DNA, 8 bp, Unknown
  misc_feature (1)..( 8): Result.004 file - promoters60/5670784
attaccaa

SEQ ID NO: 150419 - DNA, 8 bp, Unknown
  misc_feature (1)..( 8): Result.004 file - promoters60/5670784
attaacaa

SEQ ID NO: 150420 - DNA, 7 bp, Unknown
  misc_feature (1)..( 7): Result.004 file - promoters60/5670784
aagaaag

SEQ ID NO: 150421 - DNA, 7 bp, Unknown
  misc_feature (1)..( 7): Result.004 file - promoters60/5670784
aagcaag

SEQ ID NO: 150422 - DNA, 8 bp, Unknown
  misc_feature (1)..( 8): Result.004 file - promoters60/5670784
agatgttc

SEQ ID NO: 150423 - DNA, 8 bp, Unknown
  misc_feature (1)..( 8): Result.004 file - promoters60/5670784
agaggttc

SEQ ID NO: 150424 - DNA, 7 bp, Unknown
  misc_feature (1)..( 7): Result.004 file - promoters60/5670784
actggtg

SEQ ID NO: 150425 - DNA, 7 bp, Unknown
  misc_feature (1)..( 7): Result.004 file - promoters60/5670784
acttgtg

SEQ ID NO: 150426 - DNA, 6 bp, Unknown
  misc_feature (1)..( 6): Result.004 file - promoters60/5670784
catcaa

SEQ ID NO: 150427 - DNA, 6 bp, Unknown
  misc_feature (1)..( 6): Result.004 file - promoters60/5670784
catcaa

SEQ ID NO: 150428 - DNA, 6 bp, Unknown
  misc_feature (1)..( 6): Result.004 file - promoters60/5670784
tatgat

SEQ ID NO: 150429 - DNA, 6 bp, Unknown
  misc_feature (1)..( 6): Result.004 file - promoters60/5670784
tatgat

SEQ ID NO: 150430 - DNA, 9 bp, Unknown
  misc_feature (1)..( 9): Result.004 file - promoters60/5670784
aatgcaaac

SEQ ID NO: 150431 - DNA, 9 bp, Unknown
  misc_feature (1)..( 9): Result.004 file - promoters60/5670784
aatccaaac

SEQ ID NO: 150432 - DNA, 9 bp, Unknown
  misc_feature (1)..( 9): Result.004 file - promoters60/5670784
tttaaaagc

SEQ ID NO: 150433 - DNA, 9 bp, Unknown
  misc_feature (1)..( 9): Result.004 file - promoters60/5670784
tttacaagc

SEQ ID NO: 150434 - DNA, 7 bp, Unknown
  misc_feature (1)..( 7): Result.004 file - promoters60/5670784
aaactga

SEQ ID NO: 150435 - DNA, 7 bp, Unknown
  misc_feature (1)..( 7): Result.004 file - promoters60/5670784
aaattga

SEQ ID NO: 150436 - DNA, 8 bp, Unknown
  misc_feature (1)..( 8): Result.004 file - promoters60/5670784
atttattt

SEQ ID NO: 150437 - DNA, 8 bp, Unknown
  misc_feature (1)..( 8): Result.004 file - promoters60/5670784
attttttt

SEQ ID NO: 150438 - DNA, 8 bp, Unknown
  misc_feature (1)..( 8): Result.004 file - promoters60/5670784
aatagtta

SEQ ID NO: 150439 - DNA, 8 bp, Unknown
  misc_feature (1)..( 8): Result.004 file - promoters60/5670784
aatagtta

SEQ ID NO: 150440 - DNA, 9 bp, Unknown
  misc_feature (1)..( 9): Result.004 file - promoters60/5670784
gttttggct

SEQ ID NO: 150441 - DNA, 9 bp, Unknown
  misc_feature (1)..( 9): Result.004 file - promoters60/5670784
gttttcgct

SEQ ID NO: 150442 - DNA, 6 bp, Unknown
  misc_feature (1)..( 6): Result.004 file - promoters60/5670784
ttaaca

SEQ ID NO: 150443 - DNA, 6 bp, Unknown
  misc_feature (1)..( 6): Result.004 file - promoters60/5670784
ttaaca

SEQ ID NO: 150444 - DNA, 6 bp, Unknown
  misc_feature (1)..( 6): Result.004 file - promoters60/5670784
agatta

SEQ ID NO: 150445 - DNA, 6 bp, Unknown
  misc_feature (1)..( 6): Result.004 file - promoters60/5670784
agatta

SEQ ID NO: 150446 - DNA, 7 bp, Unknown
  misc_feature (1)..( 7): Result.004 file - promoters60/5670784
atcaagc

SEQ ID NO: 150447 - DNA, 7 bp, Unknown
  misc_feature (1)..( 7): Result.004 file - promoters60/5670784
atccagc

SEQ ID NO: 150448 - DNA, 7 bp, Unknown
  misc_feature (1)..( 7): Result.004 file - promoters60/5670784
gtacacc

SEQ ID NO: 150449 - DNA, 7 bp, Unknown
  misc_feature (1)..( 7): Result.004 file - promoters60/5670784
gtaaacc

SEQ ID NO: 150450 - DNA, 6 bp, Unknown
  misc_feature (1)..( 6): Result.004 file - promoters60/5670784
ctgatt

SEQ ID NO: 150451 - DNA, 6 bp, Unknown
  misc_feature (1)..( 6): Result.004 file - promoters60/5670809
ctgatt

SEQ ID NO: 150452 - DNA, 9 bp, Unknown
  misc_feature (1)..( 9): Result.004 file - promoters60/5670809
tcccaaaaa

SEQ ID NO: 150453 - DNA, 9 bp, Unknown
  misc_feature (1)..( 9): Result.004 file - promoters60/5670809
tgacaaaaa

SEQ ID NO: 150454 - DNA, 9 bp, Unknown
  misc_feature (1)..( 9): Result.004 file - promoters60/5670809
tgataaaag

SEQ ID NO: 150455 - DNA, 8 bp, Unknown
  misc_feature (1)..( 8): Result.004 file - promoters60/5670809
agaagagc

SEQ ID NO: 150456 - DNA, 8 bp, Unknown
  misc_feature (1)..( 8): Result.004 file - promoters60/5670809
agacgagg

SEQ ID NO: 150457 - DNA, 8 bp, Unknown
  misc_feature (1)..( 8): Result.004 file - promoters60/5670809
ctaagagc

SEQ ID NO: 150458 - DNA, 9 bp, Unknown
  misc_feature (1)..( 9): Result.004 file - promoters60/5670809
caaaatctt

SEQ ID NO: 150459 - DNA, 9 bp, Unknown
  misc_feature (1)..( 9): Result.004 file - promoters60/5670809
taaaaactt

SEQ ID NO: 150460 - DNA, 9 bp, Unknown
  misc_feature (1)..( 9): Result.004 file - promoters60/5670809
taaaaaaga

SEQ ID NO: 150461 - DNA, 8 bp, Unknown
  misc_feature (1)..( 8): Result.004 file - promoters60/5670809
gcaagtgc

SEQ ID NO: 150462 - DNA, 8 bp, Unknown
  misc_feature (1)..( 8): Result.004 file - promoters60/5670809
gcatgtga

SEQ ID NO: 150463 - DNA, 8 bp, Unknown
  misc_feature (1)..( 8): Result.004 file - promoters60/5671204
atatgtga

SEQ ID NO: 150464 - DNA, 12 bp, Unknown
  misc_feature (1)..( 12): Result.004 file - promoters60/5671204
cttttcaaaaaa

SEQ ID NO: 150465 - DNA, 12 bp, Unknown
  misc_feature (1)..( 12): Result.004 file - promoters60/5671204
ctttttaaatgg

SEQ ID NO: 150466 - DNA, 12 bp, Unknown
  misc_feature (1)..( 12): Result.004 file - promoters60/5671204
gctatcaacaaa

SEQ ID NO: 150467 - DNA, 12 bp, Unknown
  misc_feature (1)..( 12): Result.004 file - promoters60/5671204
atttataaggcc

SEQ ID NO: 150468 - DNA, 12 bp, Unknown
  misc_feature (1)..( 12): Result.004 file - promoters60/5671204
cttttttgaata

SEQ ID NO: 150469 - DNA, 12 bp, Unknown
  misc_feature (1)..( 12): Result.004 file - promoters60/5671204
attgataggtgc

SEQ ID NO: 150470 - DNA, 11 bp, Unknown
  misc_feature (1)..( 11): Result.004 file - promoters60/5671204
acacaaaaata

SEQ ID NO: 150471 - DNA, 11 bp, Unknown
  misc_feature (1)..( 11): Result.004 file - promoters60/5671204
cctcaaaaaag

SEQ ID NO: 150472 - DNA, 11 bp, Unknown
  misc_feature (1)..( 11): Result.004 file - promoters60/5671204
gaacaaaaaaa

SEQ ID NO: 150473 - DNA, 11 bp, Unknown
  misc_feature (1)..( 11): Result.004 file - promoters60/5671204
acacacaaagt

SEQ ID NO: 150474 - DNA, 11 bp, Unknown
  misc_feature (1)..( 11): Result.004 file - promoters60/5671204
cacgaaaaaag

SEQ ID NO: 150475 - DNA, 11 bp, Unknown
  misc_feature (1)..( 11): Result.004 file - promoters60/5671204
aaactaaaacg

SEQ ID NO: 150476 - DNA, 11 bp, Unknown
  misc_feature (1)..( 11): Result.004 file - promoters60/5671204
aaacacaagaa

SEQ ID NO: 150477 - DNA, 11 bp, Unknown
  misc_feature (1)..( 11): Result.004 file - promoters60/5671204
caacacaaaaa

SEQ ID NO: 150478 - DNA, 11 bp, Unknown
  misc_feature (1)..( 11): Result.004 file - promoters60/5671204
aaacacaagaa

SEQ ID NO: 150479 - DNA, 11 bp, Unknown
  misc_feature (1)..( 11): Result.004 file - promoters60/5671204
gaacaaaaaaa

SEQ ID NO: 150480 - DNA, 11 bp, Unknown
  misc_feature (1)..( 11): Result.004 file - promoters60/5671204
acacacaaagt

SEQ ID NO: 150481 - DNA, 11 bp, Unknown
  misc_feature (1)..( 11): Result.004 file - promoters60/5671204
tcacacgaaaa

SEQ ID NO: 150482 - DNA, 11 bp, Unknown
  misc_feature (1)..( 11): Result.004 file - promoters60/5671318
aaactaaaacg

SEQ ID NO: 150483 - DNA, 13 bp, Unknown
  misc_feature (1)..( 13): Result.004 file - promoters60/5671318
tttataaaaccct

SEQ ID NO: 150484 - DNA, 13 bp, Unknown
  misc_feature (1)..( 13): Result.004 file - promoters60/5671318
actattaaagccg

SEQ ID NO: 150485 - DNA, 13 bp, Unknown
  misc_feature (1)..( 13): Result.004 file - promoters60/5671318
tatataaatggcc

SEQ ID NO: 150486 - DNA, 13 bp, Unknown
  misc_feature (1)..( 13): Result.004 file - promoters60/5671318
tatataaatccct

SEQ ID NO: 150487 - DNA, 13 bp, Unknown
  misc_feature (1)..( 13): Result.004 file - promoters60/5671318
attatttaaggcc

SEQ ID NO: 150488 - DNA, 13 bp, Unknown
  misc_feature (1)..( 13): Result.004 file - promoters60/5671318
gtggttaaagctt

SEQ ID NO: 150489 - DNA, 13 bp, Unknown
  misc_feature (1)..( 13): Result.004 file - promoters60/5671318
tatataaagttcc

SEQ ID NO: 150490 - DNA, 12 bp, Unknown
  misc_feature (1)..( 12): Result.004 file - promoters60/5671318
aggaggaagaag

SEQ ID NO: 150491 - DNA, 12 bp, Unknown
  misc_feature (1)..( 12): Result.004 file - promoters60/5671318
ggatagaaaaag

SEQ ID NO: 150492 - DNA, 12 bp, Unknown
  misc_feature (1)..( 12): Result.004 file - promoters60/5671318
ttatataaaata

SEQ ID NO: 150493 - DNA, 12 bp, Unknown
  misc_feature (1)..( 12): Result.004 file - promoters60/5671318
ttatatagtcaa

SEQ ID NO: 150494 - DNA, 12 bp, Unknown
  misc_feature (1)..( 12): Result.004 file - promoters60/5671318
ctatatacgcat

SEQ ID NO: 150495 - DNA, 12 bp, Unknown
  misc_feature (1)..( 12): Result.004 file - promoters60/5671318
ctatgtagatgt

SEQ ID NO: 150496 - DNA, 14 bp, Unknown
  misc_feature (1)..( 14): Result.004 file - promoters60/5671318
ataattttatatat

SEQ ID NO: 150497 - DNA, 14 bp, Unknown
  misc_feature (1)..( 14): Result.004 file - promoters60/5671318
ctaattctataaca

SEQ ID NO: 150498 - DNA, 14 bp, Unknown
  misc_feature (1)..( 14): Result.004 file - promoters60/5671318
atagtttctcttct

SEQ ID NO: 150499 - DNA, 14 bp, Unknown
  misc_feature (1)..( 14): Result.004 file - promoters60/5671318
aaaattatataaga

SEQ ID NO: 150500 - DNA, 14 bp, Unknown
  misc_feature (1)..( 14): Result.004 file - promoters60/5671318
tcgtttgtattatt

SEQ ID NO: 150501 - DNA, 14 bp, Unknown
  misc_feature (1)..( 14): Result.004 file - promoters60/5671338
cagctgatataatc

SEQ ID NO: 150502 - DNA, 9 bp, Unknown
  misc_feature (1)..( 9): Result.004 file - promoters60/5671338
tgaaatttt

SEQ ID NO: 150503 - DNA, 9 bp, Unknown
  misc_feature (1)..( 9): Result.004 file - promoters60/5671338
tttaatttt

SEQ ID NO: 150504 - DNA, 9 bp, Unknown
  misc_feature (1)..( 9): Result.004 file - promoters60/5671338
tgaaacttt

SEQ ID NO: 150505 - DNA, 10 bp, Unknown
  misc_feature (1)..( 10): Result.004 file - promoters60/5671338
tttaatgaat

SEQ ID NO: 150506 - DNA, 10 bp, Unknown
  misc_feature (1)..( 10): Result.004 file - promoters60/5671338
tttaattttt

SEQ ID NO: 150507 - DNA, 10 bp, Unknown
  misc_feature (1)..( 10): Result.004 file - promoters60/5671338
tttaatgaat

SEQ ID NO: 150508 - DNA, 10 bp, Unknown
  misc_feature (1)..( 10): Result.004 file - promoters60/5671338
tattttaaaa

SEQ ID NO: 150509 - DNA, 10 bp, Unknown
  misc_feature (1)..( 10): Result.004 file - promoters60/5671338
tatgttaaat

SEQ ID NO: 150510 - DNA, 10 bp, Unknown
  misc_feature (1)..( 10): Result.004 file - promoters60/5671338
agagttaaaa

SEQ ID NO: 150511 - DNA, 8 bp, Unknown
  misc_feature (1)..( 8): Result.004 file - promoters60/5671338
caaaatta

SEQ ID NO: 150512 - DNA, 8 bp, Unknown
  misc_feature (1)..( 8): Result.004 file - promoters60/5671338
caacatta

SEQ ID NO: 150513 - DNA, 9 bp, Unknown
  misc_feature (1)..( 9): Result.004 file - promoters60/5671338
taataattc

SEQ ID NO: 150514 - DNA, 10 bp, Unknown
  misc_feature (1)..( 10): Result.004 file - promoters60/5671338
gtaaatgtaa

SEQ ID NO: 150515 - DNA, 10 bp, Unknown
  misc_feature (1)..( 10): Result.004 file - promoters60/5671338
caaaatttaa

SEQ ID NO: 150516 - DNA, 10 bp, Unknown
  misc_feature (1)..( 10): Result.004 file - promoters60/5671338
gtaaatgtca

SEQ ID NO: 150517 - DNA, 8 bp, Unknown
  misc_feature (1)..( 8): Result.004 file - promoters60/5671338
ttttcggt

SEQ ID NO: 150518 - DNA, 8 bp, Unknown
  misc_feature (1)..( 8): Result.004 file - promoters60/5671338
attttggt

SEQ ID NO: 150519 - DNA, 8 bp, Unknown
  misc_feature (1)..( 8): Result.004 file - promoters60/5671347
attttgga

SEQ ID NO: 150520 - DNA, 9 bp, Unknown
  misc_feature (1)..( 9): Result.004 file - promoters60/5671347
ttttgtttt

SEQ ID NO: 150521 - DNA, 9 bp, Unknown
  misc_feature (1)..( 9): Result.004 file - promoters60/5671347
cattgttta

SEQ ID NO: 150522 - DNA, 9 bp, Unknown
  misc_feature (1)..( 9): Result.004 file - promoters60/5671347
aattgtttt

SEQ ID NO: 150523 - DNA, 9 bp, Unknown
  misc_feature (1)..( 9): Result.004 file - promoters60/5671347
cattgttga

SEQ ID NO: 150524 - DNA, 9 bp, Unknown
  misc_feature (1)..( 9): Result.004 file - promoters60/5671710
gcttgatga

SEQ ID NO: 150525 - DNA, 9 bp, Unknown
  misc_feature (1)..( 9): Result.004 file - promoters60/5671710
gaaaaagag

SEQ ID NO: 150526 - DNA, 9 bp, Unknown
  misc_feature (1)..( 9): Result.004 file - promoters60/5671710
taaaaagaa

SEQ ID NO: 150527 - DNA, 9 bp, Unknown
  misc_feature (1)..( 9): Result.004 file - promoters60/5671710
gtgaaagag

SEQ ID NO: 150528 - DNA, 9 bp, Unknown
  misc_feature (1)..( 9): Result.004 file - promoters60/5671710
taaatagat

SEQ ID NO: 150529 - DNA, 9 bp, Unknown
  misc_feature (1)..( 9): Result.004 file - promoters60/5671710
taaaaatgt

SEQ ID NO: 150530 - DNA, 10 bp, Unknown
  misc_feature (1)..( 10): Result.004 file - promoters60/5671710
aattttcaat

SEQ ID NO: 150531 - DNA, 10 bp, Unknown
  misc_feature (1)..( 10): Result.004 file - promoters60/5671710
gatttacaag

SEQ ID NO: 150532 - DNA, 10 bp, Unknown
  misc_feature (1)..( 10): Result.004 file - promoters60/5671710
gatttaagtt

SEQ ID NO: 150533 - DNA, 10 bp, Unknown
  misc_feature (1)..( 10): Result.004 file - promoters60/5671710
acaatacaag

SEQ ID NO: 150534 - DNA, 10 bp, Unknown
  misc_feature (1)..( 10): Result.004 file - promoters60/5671955
gatttaccgg

SEQ ID NO: 150535 - DNA, 9 bp, Unknown
  misc_feature (1)..( 9): Result.004 file - promoters60/5671955
taattttac

SEQ ID NO: 150536 - DNA, 9 bp, Unknown
  misc_feature (1)..( 9): Result.004 file - promoters60/5671955
gaatattac

SEQ ID NO: 150537 - DNA, 9 bp, Unknown
  misc_feature (1)..( 9): Result.004 file - promoters60/5671955
taatttact

SEQ ID NO: 150538 - DNA, 6 bp, Unknown
  misc_feature (1)..( 6): Result.004 file - promoters60/5671955
cagaca

SEQ ID NO: 150539 - DNA, 6 bp, Unknown
  misc_feature (1)..( 6): Result.004 file - promoters60/5671955
cagaca

SEQ ID NO: 150540 - DNA, 9 bp, Unknown
  misc_feature (1)..( 9): Result.004 file - promoters60/5671955
caaataaaa

SEQ ID NO: 150541 - DNA, 9 bp, Unknown
  misc_feature (1)..( 9): Result.004 file - promoters60/5671955
caattaaaa

SEQ ID NO: 150542 - DNA, 10 bp, Unknown
  misc_feature (1)..( 10): Result.004 file - promoters60/5671955
atattagaaa

SEQ ID NO: 150543 - DNA, 7 bp, Unknown
  misc_feature (1)..( 7): Result.004 file - promoters60/5671955
atgcgtc

SEQ ID NO: 150544 - DNA, 7 bp, Unknown
  misc_feature (1)..( 7): Result.004 file - promoters60/5671955
atgcgtc

SEQ ID NO: 150545 - DNA, 6 bp, Unknown
  misc_feature (1)..( 6): Result.004 file - promoters60/5671955
ctcaga

SEQ ID NO: 150546 - DNA, 6 bp, Unknown
  misc_feature (1)..( 6): Result.004 file - promoters60/5671955
ctcaga

SEQ ID NO: 150547 - DNA, 7 bp, Unknown
  misc_feature (1)..( 7): Result.004 file - promoters60/5671955
attttaa

SEQ ID NO: 150548 - DNA, 7 bp, Unknown
  misc_feature (1)..( 7): Result.004 file - promoters60/5671955
attttaa

SEQ ID NO: 150549 - DNA, 6 bp, Unknown
  misc_feature (1)..( 6): Result.004 file - promoters60/5671955
tttctt

SEQ ID NO: 150550 - DNA, 6 bp, Unknown
  misc_feature (1)..( 6): Result.004 file - promoters60/5671955
tttctt

SEQ ID NO: 150551 - DNA, 6 bp, Unknown
  misc_feature (1)..( 6): Result.004 file - promoters60/5671955
gaaaaa

SEQ ID NO: 150552 - DNA, 6 bp, Unknown
  misc_feature (1)..( 6): Result.004 file - promoters60/5671955
gaaaaa

SEQ ID NO: 150553 - DNA, 8 bp, Unknown
  misc_feature (1)..( 8): Result.004 file - promoters60/5671955
aatagtaa

SEQ ID NO: 150554 - DNA, 8 bp, Unknown
  misc_feature (1)..( 8): Result.004 file - promoters60/5671955
aataataa

SEQ ID NO: 150555 - DNA, 6 bp, Unknown
  misc_feature (1)..( 6): Result.004 file - promoters60/5671955
aaagga

SEQ ID NO: 150556 - DNA, 6 bp, Unknown
  misc_feature (1)..( 6): Result.004 file - promoters60/5671955
aaagga

SEQ ID NO: 150557 - DNA, 7 bp, Unknown
  misc_feature (1)..( 7): Result.004 file - promoters60/5671955
aacgaag

SEQ ID NO: 150558 - DNA, 7 bp, Unknown
  misc_feature (1)..( 7): Result.004 file - promoters60/5671955
aacaaag

SEQ ID NO: 150559 - DNA, 8 bp, Unknown
  misc_feature (1)..( 8): Result.004 file - promoters60/5671955
attttttt

SEQ ID NO: 150560 - DNA, 8 bp, Unknown
  misc_feature (1)..( 8): Result.004 file - promoters60/5671955
atttattt

SEQ ID NO: 150561 - DNA, 11 bp, Unknown
  misc_feature (1)..( 11): Result.004 file - promoters60/5671955
tactgttttag

SEQ ID NO: 150562 - DNA, 11 bp, Unknown
  misc_feature (1)..( 11): Result.004 file - promoters60/5671955
tactgtattag

SEQ ID NO: 150563 - DNA, 6 bp, Unknown
  misc_feature (1)..( 6): Result.004 file - promoters60/5671955
tataat

SEQ ID NO: 150564 - DNA, 6 bp, Unknown
  misc_feature (1)..( 6): Result.004 file - promoters60/5671955
tataat

SEQ ID NO: 150565 - DNA, 8 bp, Unknown
  misc_feature (1)..( 8): Result.004 file - promoters60/5671955
taatatta

SEQ ID NO: 150566 - DNA, 8 bp, Unknown
  misc_feature (1)..( 8): Result.004 file - promoters60/5672093
taatctta

SEQ ID NO: 150567 - DNA, 8 bp, Unknown
  misc_feature (1)..( 8): Result.004 file - promoters60/5672093
gaaaaaaa

SEQ ID NO: 150568 - DNA, 8 bp, Unknown
  misc_feature (1)..( 8): Result.004 file - promoters60/5672093
gaaaaaag

SEQ ID NO: 150569 - DNA, 9 bp, Unknown
  misc_feature (1)..( 9): Result.004 file - promoters60/5672093
caaacaaat

SEQ ID NO: 150570 - DNA, 9 bp, Unknown
  misc_feature (1)..( 9): Result.004 file - promoters60/5672093
caaagaaag

SEQ ID NO: 150571 - DNA, 9 bp, Unknown
  misc_feature (1)..( 9): Result.004 file - promoters60/5672093
caaaaaaaa

SEQ ID NO: 150572 - DNA, 9 bp, Unknown
  misc_feature (1)..( 9): Result.004 file - promoters60/5672093
caaacacaa

SEQ ID NO: 150573 - DNA, 9 bp, Unknown
  misc_feature (1)..( 9): Result.004 file - promoters60/5672093
caacgaata

SEQ ID NO: 150574 - DNA, 12 bp, Unknown
  misc_feature (1)..( 12): Result.004 file - promoters60/5672093
acaatgggctgg

SEQ ID NO: 150575 - DNA, 12 bp, Unknown
  misc_feature (1)..( 12): Result.004 file - promoters60/5672093
caaatgggccta

SEQ ID NO: 150576 - DNA, 12 bp, Unknown
  misc_feature (1)..( 12): Result.004 file - promoters60/5672093
gaaataggccca

SEQ ID NO: 150577 - DNA, 12 bp, Unknown
  misc_feature (1)..( 12): Result.004 file - promoters60/5672093
taaaaaggccca

SEQ ID NO: 150578 - DNA, 12 bp, Unknown
  misc_feature (1)..( 12): Result.004 file - promoters60/5672093
taaaaaatatct

SEQ ID NO: 150579 - DNA, 12 bp, Unknown
  misc_feature (1)..( 12): Result.004 file - promoters60/5672093
ccaaacggctag

SEQ ID NO: 150580 - DNA, 14 bp, Unknown
  misc_feature (1)..( 14): Result.004 file - promoters60/5672093
agtttcaaagaaag

SEQ ID NO: 150581 - DNA, 14 bp, Unknown
  misc_feature (1)..( 14): Result.004 file - promoters60/5672093
tctttcaaaatttg

SEQ ID NO: 150582 - DNA, 14 bp, Unknown
  misc_feature (1)..( 14): Result.004 file - promoters60/5672093
cctatcaaacaaat

SEQ ID NO: 150583 - DNA, 14 bp, Unknown
  misc_feature (1)..( 14): Result.004 file - promoters60/5672093
aaggtcatagacac

SEQ ID NO: 150584 - DNA, 14 bp, Unknown
  misc_feature (1)..( 14): Result.004 file - promoters60/5672093
aaaaaaaaacgaat

SEQ ID NO: 150585 - DNA, 14 bp, Unknown
  misc_feature (1)..( 14): Result.004 file - promoters60/5672093
attataaaattgta

SEQ ID NO: 150586 - DNA, 14 bp, Unknown
  misc_feature (1)..( 14): Result.004 file - promoters60/5672842
attgtaagtgtaaa

SEQ ID NO: 150587 - DNA, 9 bp, Unknown
  misc_feature (1)..( 9): Result.004 file - promoters60/5672842
gtatatata

SEQ ID NO: 150588 - DNA, 9 bp, Unknown
  misc_feature (1)..( 9): Result.004 file - promoters60/5672842
gtatataaa

SEQ ID NO: 150589 - DNA, 9 bp, Unknown
  misc_feature (1)..( 9): Result.004 file - promoters60/5672842
atatataaa

SEQ ID NO: 150590 - DNA, 9 bp, Unknown
  misc_feature (1)..( 9): Result.004 file - promoters60/5672842
atatataaa

SEQ ID NO: 150591 - DNA, 9 bp, Unknown
  misc_feature (1)..( 9): Result.004 file - promoters60/5672842
atatatata

SEQ ID NO: 150592 - DNA, 9 bp, Unknown
  misc_feature (1)..( 9): Result.004 file - promoters60/5672842
ccatataaa

SEQ ID NO: 150593 - DNA, 10 bp, Unknown
  misc_feature (1)..( 10): Result.004 file - promoters60/5672842
tttcgtaatt

SEQ ID NO: 150594 - DNA, 10 bp, Unknown
  misc_feature (1)..( 10): Result.004 file - promoters60/5672842
tttagtaata

SEQ ID NO: 150595 - DNA, 10 bp, Unknown
  misc_feature (1)..( 10): Result.004 file - promoters60/5672842
actcgtgatt

SEQ ID NO: 150596 - DNA, 10 bp, Unknown
  misc_feature (1)..( 10): Result.004 file - promoters60/5672842
tttagtgagt

SEQ ID NO: 150597 - DNA, 10 bp, Unknown
  misc_feature (1)..( 10): Result.004 file - promoters60/5672842
attagagaga

SEQ ID NO: 150598 - DNA, 10 bp, Unknown
  misc_feature (1)..( 10): Result.004 file - promoters60/5673124
attagtgaat

SEQ ID NO: 150599 - DNA, 8 bp, Unknown
  misc_feature (1)..( 8): Result.004 file - promoters60/5673124
ccaataag

SEQ ID NO: 150600 - DNA, 8 bp, Unknown
  misc_feature (1)..( 8): Result.004 file - promoters60/5673124
tcaataag

SEQ ID NO: 150601 - DNA, 8 bp, Unknown
  misc_feature (1)..( 8): Result.004 file - promoters60/5673124
ccaataca

SEQ ID NO: 150602 - DNA, 8 bp, Unknown
  misc_feature (1)..( 8): Result.004 file - promoters60/5673124
acgtgatg

SEQ ID NO: 150603 - DNA, 8 bp, Unknown
  misc_feature (1)..( 8): Result.004 file - promoters60/5673124
acgttatg

SEQ ID NO: 150604 - DNA, 8 bp, Unknown
  misc_feature (1)..( 8): Result.004 file - promoters60/5673124
acgatatc

SEQ ID NO: 150605 - DNA, 10 bp, Unknown
  misc_feature (1)..( 10): Result.004 file - promoters60/5673124
ggtttatttt

SEQ ID NO: 150606 - DNA, 10 bp, Unknown
  misc_feature (1)..( 10): Result.004 file - promoters60/5673124
ggtttattca

SEQ ID NO: 150607 - DNA, 10 bp, Unknown
  misc_feature (1)..( 10): Result.004 file - promoters60/5673124
attttatttt

SEQ ID NO: 150608 - DNA, 13 bp, Unknown
  misc_feature (1)..( 13): Result.004 file - promoters60/5673124
tttaatttaaatg

SEQ ID NO: 150609 - DNA, 13 bp, Unknown
  misc_feature (1)..( 13): Result.004 file - promoters60/5673124
tttgattccttgt

SEQ ID NO: 150610 - DNA, 13 bp, Unknown
  misc_feature (1)..( 13): Result.004 file - promoters60/5673124
gatgactccatgt

SEQ ID NO: 150611 - DNA, 9 bp, Unknown
  misc_feature (1)..( 9): Result.004 file - promoters60/5673124
agctttttg

SEQ ID NO: 150612 - DNA, 9 bp, Unknown
  misc_feature (1)..( 9): Result.004 file - promoters60/5673124
aacttgttg

SEQ ID NO: 150613 - DNA, 9 bp, Unknown
  misc_feature (1)..( 9): Result.004 file - promoters60/5673650
aacctgtgt

SEQ ID NO: 150614 - DNA, 12 bp, Unknown
  misc_feature (1)..( 12): Result.004 file - promoters60/5673650
tattgttacaaa

SEQ ID NO: 150615 - DNA, 12 bp, Unknown
  misc_feature (1)..( 12): Result.004 file - promoters60/5673650
aatttttacttt

SEQ ID NO: 150616 - DNA, 12 bp, Unknown
  misc_feature (1)..( 12): Result.004 file - promoters60/5673650
tattgtgtatgt

SEQ ID NO: 150617 - DNA, 12 bp, Unknown
  misc_feature (1)..( 12): Result.004 file - promoters60/5673674
aatttatacttt

SEQ ID NO: 150618 - DNA, 10 bp, Unknown
  misc_feature (1)..( 10): Result.004 file - promoters60/5673674
gaataaaatc

SEQ ID NO: 150619 - DNA, 10 bp, Unknown
  misc_feature (1)..( 10): Result.004 file - promoters60/5673674
aaatcaaacc

SEQ ID NO: 150620 - DNA, 10 bp, Unknown
  misc_feature (1)..( 10): Result.004 file - promoters60/5673674
taataaataa

SEQ ID NO: 150621 - DNA, 11 bp, Unknown
  misc_feature (1)..( 11): Result.004 file - promoters60/5673674
aaactcaaact

SEQ ID NO: 150622 - DNA, 11 bp, Unknown
  misc_feature (1)..( 11): Result.004 file - promoters60/5673674
cttatcaaacc

SEQ ID NO: 150623 - DNA, 8 bp, Unknown
  misc_feature (1)..( 8): Result.004 file - promoters60/5673674
aaagaata

SEQ ID NO: 150624 - DNA, 8 bp, Unknown
  misc_feature (1)..( 8): Result.004 file - promoters60/5673674
aaagaagt

SEQ ID NO: 150625 - DNA, 8 bp, Unknown
  misc_feature (1)..( 8): Result.004 file - promoters60/5673674
taagtata

SEQ ID NO: 150626 - DNA, 8 bp, Unknown
  misc_feature (1)..( 8): Result.004 file - promoters60/5673674
aaataagg

SEQ ID NO: 150627 - DNA, 9 bp, Unknown
  misc_feature (1)..( 9): Result.004 file - promoters60/5673674
aaacgaacc

SEQ ID NO: 150628 - DNA, 10 bp, Unknown
  misc_feature (1)..( 10): Result.004 file - promoters60/5673674
agaaagaaat

SEQ ID NO: 150629 - DNA, 10 bp, Unknown
  misc_feature (1)..( 10): Result.004 file - promoters60/5673674
atgaagaaat

SEQ ID NO: 150630 - DNA, 11 bp, Unknown
  misc_feature (1)..( 11): Result.004 file - promoters60/5673674
tagaacgaaca

SEQ ID NO: 150631 - DNA, 11 bp, Unknown
  misc_feature (1)..( 11): Result.004 file - promoters60/5673674
atcaaagaatc

SEQ ID NO: 150632 - DNA, 11 bp, Unknown
  misc_feature (1)..( 11): Result.004 file - promoters60/5673674
tgtaaagaaaa

SEQ ID NO: 150633 - DNA, 11 bp, Unknown
  misc_feature (1)..( 11): Result.004 file - promoters60/5673674
attaaacaaaa

SEQ ID NO: 150634 - DNA, 10 bp, Unknown
  misc_feature (1)..( 10): Result.004 file - promoters60/5673674
tataaaaacg

SEQ ID NO: 150635 - DNA, 10 bp, Unknown
  misc_feature (1)..( 10): Result.004 file - promoters60/5673674
tataaatatg

SEQ ID NO: 150636 - DNA, 10 bp, Unknown
  misc_feature (1)..( 10): Result.004 file - promoters60/5673674
gataaaaaca

SEQ ID NO: 150637 - DNA, 10 bp, Unknown
  misc_feature (1)..( 10): Result.004 file - promoters60/5673674
aataaatact

SEQ ID NO: 150638 - DNA, 10 bp, Unknown
  misc_feature (1)..( 10): Result.004 file - promoters60/5673674
ttgaaatcaa

SEQ ID NO: 150639 - DNA, 9 bp, Unknown
  misc_feature (1)..( 9): Result.004 file - promoters60/5673674
gatgtgata

SEQ ID NO: 150640 - DNA, 9 bp, Unknown
  misc_feature (1)..( 9): Result.004 file - promoters60/5673674
gatgtgtcc

SEQ ID NO: 150641 - DNA, 8 bp, Unknown
  misc_feature (1)..( 8): Result.004 file - promoters60/5673674
atgtgatt

SEQ ID NO: 150642 - DNA, 9 bp, Unknown
  misc_feature (1)..( 9): Result.004 file - promoters60/5673674
cttgtaatt

SEQ ID NO: 150643 - DNA, 9 bp, Unknown
  misc_feature (1)..( 9): Result.004 file - promoters60/5673674
ttataaaat

SEQ ID NO: 150644 - DNA, 9 bp, Unknown
  misc_feature (1)..( 9): Result.004 file - promoters60/5673674
ttatcaaac

SEQ ID NO: 150645 - DNA, 9 bp, Unknown
  misc_feature (1)..( 9): Result.004 file - promoters60/5673674
ccgtcaaac

SEQ ID NO: 150646 - DNA, 9 bp, Unknown
  misc_feature (1)..( 9): Result.004 file - promoters60/5673674
ttatcatat

SEQ ID NO: 150647 - DNA, 12 bp, Unknown
  misc_feature (1)..( 12): Result.004 file - promoters60/5673674
atcttcttgtaa

SEQ ID NO: 150648 - DNA, 12 bp, Unknown
  misc_feature (1)..( 12): Result.004 file - promoters60/5673674
ttcctcttttaa

SEQ ID NO: 150649 - DNA, 12 bp, Unknown
  misc_feature (1)..( 12): Result.004 file - promoters60/5673674
ttcttcttttgt

SEQ ID NO: 150650 - DNA, 12 bp, Unknown
  misc_feature (1)..( 12): Result.004 file - promoters60/5674194
tttatctattgt

SEQ ID NO: 150651 - DNA, 9 bp, Unknown
  misc_feature (1)..( 9): Result.004 file - promoters60/5674194
aaataaatt

SEQ ID NO: 150652 - DNA, 9 bp, Unknown
  misc_feature (1)..( 9): Result.004 file - promoters60/5674194
caatacatt

SEQ ID NO: 150653 - DNA, 9 bp, Unknown
  misc_feature (1)..( 9): Result.004 file - promoters60/5674194
taaaaaaag

SEQ ID NO: 150654 - DNA, 9 bp, Unknown
  misc_feature (1)..( 9): Result.004 file - promoters60/5674194
aaacaaaaa

SEQ ID NO: 150655 - DNA, 9 bp, Unknown
  misc_feature (1)..( 9): Result.004 file - promoters60/5674194
gaatacata

SEQ ID NO: 150656 - DNA, 9 bp, Unknown
  misc_feature (1)..( 9): Result.004 file - promoters60/5674530
gaatacaca

SEQ ID NO: 150657 - DNA, 7 bp, Unknown
  misc_feature (1)..( 7): Result.004 file - promoters60/5674530
acaaata

SEQ ID NO: 150658 - DNA, 7 bp, Unknown
  misc_feature (1)..( 7): Result.004 file - promoters60/5674530
acaaata

SEQ ID NO: 150659 - DNA, 9 bp, Unknown
  misc_feature (1)..( 9): Result.004 file - promoters60/5674530
gaagttaca

SEQ ID NO: 150660 - DNA, 9 bp, Unknown
  misc_feature (1)..( 9): Result.004 file - promoters60/5674530
ttagtaaca

SEQ ID NO: 150661 - DNA, 9 bp, Unknown
  misc_feature (1)..( 9): Result.004 file - promoters60/5674530
ttattaatt

SEQ ID NO: 150662 - DNA, 6 bp, Unknown
  misc_feature (1)..( 6): Result.004 file - promoters60/5674530
aaaaat

SEQ ID NO: 150663 - DNA, 6 bp, Unknown
  misc_feature (1)..( 6): Result.004 file - promoters60/5674530
aaaaat

SEQ ID NO: 150664 - DNA, 8 bp, Unknown
  misc_feature (1)..( 8): Result.004 file - promoters60/5674530
tctaaaat

SEQ ID NO: 150665 - DNA, 8 bp, Unknown
  misc_feature (1)..( 8): Result.004 file - promoters60/5674530
tctaaaat

SEQ ID NO: 150666 - DNA, 6 bp, Unknown
  misc_feature (1)..( 6): Result.004 file - promoters60/5674530
aacaca

SEQ ID NO: 150667 - DNA, 6 bp, Unknown
  misc_feature (1)..( 6): Result.004 file - promoters60/5674530
aacaca

SEQ ID NO: 150668 - DNA, 8 bp, Unknown
  misc_feature (1)..( 8): Result.004 file - promoters60/5674530
acacctgt

SEQ ID NO: 150669 - DNA, 8 bp, Unknown
  misc_feature (1)..( 8): Result.004 file - promoters60/5674530
acacgtgt

SEQ ID NO: 150670 - DNA, 8 bp, Unknown
  misc_feature (1)..( 8): Result.004 file - promoters60/5674530
aaaaaaaa

SEQ ID NO: 150671 - DNA, 8 bp, Unknown
  misc_feature (1)..( 8): Result.004 file - promoters60/5674530
aaaaaaaa

SEQ ID NO: 150672 - DNA, 8 bp, Unknown
  misc_feature (1)..( 8): Result.004 file - promoters60/5674530
agaacaaa

SEQ ID NO: 150673 - DNA, 8 bp, Unknown
  misc_feature (1)..( 8): Result.004 file - promoters60/5674530
atgaagtt

SEQ ID NO: 150674 - DNA, 8 bp, Unknown
  misc_feature (1)..( 8): Result.004 file - promoters60/5674530
atgatgtt

SEQ ID NO: 150675 - DNA, 9 bp, Unknown
  misc_feature (1)..( 9): Result.004 file - promoters60/5674530
ccaaataaa

SEQ ID NO: 150676 - DNA, 9 bp, Unknown
  misc_feature (1)..( 9): Result.004 file - promoters60/5674530
ccaaataaa

SEQ ID NO: 150677 - DNA, 9 bp, Unknown
  misc_feature (1)..( 9): Result.004 file - promoters60/5674530
aaaaataac

SEQ ID NO: 150678 - DNA, 6 bp, Unknown
  misc_feature (1)..( 6): Result.004 file - promoters60/5674530
catgaa

SEQ ID NO: 150679 - DNA, 6 bp, Unknown
  misc_feature (1)..( 6): Result.004 file - promoters60/5674530
catgaa

SEQ ID NO: 150680 - DNA, 8 bp, Unknown
  misc_feature (1)..( 8): Result.004 file - promoters60/5674530
acttaaat

SEQ ID NO: 150681 - DNA, 8 bp, Unknown
  misc_feature (1)..( 8): Result.004 file - promoters60/5674530
acttaaat

SEQ ID NO: 150682 - DNA, 9 bp, Unknown
  misc_feature (1)..( 9): Result.004 file - promoters60/5674530
aaaaaggag

SEQ ID NO: 150683 - DNA, 9 bp, Unknown
  misc_feature (1)..( 9): Result.004 file - promoters60/5674530
aaaatggag

SEQ ID NO: 150684 - DNA, 7 bp, Unknown
  misc_feature (1)..( 7): Result.004 file - promoters60/5674530
aagcaaa

SEQ ID NO: 150685 - DNA, 7 bp, Unknown
  misc_feature (1)..( 7): Result.004 file - promoters60/5674530
aaggaaa

SEQ ID NO: 150686 - DNA, 8 bp, Unknown
  misc_feature (1)..( 8): Result.004 file - promoters60/5674530
tgtttaca

SEQ ID NO: 150687 - DNA, 8 bp, Unknown
  misc_feature (1)..( 8): Result.004 file - promoters60/5674530
tgtctaca

SEQ ID NO: 150688 - DNA, 7 bp, Unknown
  misc_feature (1)..( 7): Result.004 file - promoters60/5674530
tagaaaa

SEQ ID NO: 150689 - DNA, 7 bp, Unknown
  misc_feature (1)..( 7): Result.004 file - promoters60/5674530
taggaaa

SEQ ID NO: 150690 - DNA, 6 bp, Unknown
  misc_feature (1)..( 6): Result.004 file - promoters60/5674530
aaatca

SEQ ID NO: 150691 - DNA, 6 bp, Unknown
  misc_feature (1)..( 6): Result.004 file - promoters60/5674530
aaatca

SEQ ID NO: 150692 - DNA, 9 bp, Unknown
  misc_feature (1)..( 9): Result.004 file - promoters60/5674530
caatcaaaa

SEQ ID NO: 150693 - DNA, 9 bp, Unknown
  misc_feature (1)..( 9): Result.004 file - promoters60/5674626
caaacaaaa

SEQ ID NO: 150694 - DNA, 9 bp, Unknown
  misc_feature (1)..( 9): Result.004 file - promoters60/5674626
gattacgaa

SEQ ID NO: 150695 - DNA, 9 bp, Unknown
  misc_feature (1)..( 9): Result.004 file - promoters60/5674626
gattaccaa

SEQ ID NO: 150696 - DNA, 9 bp, Unknown
  misc_feature (1)..( 9): Result.004 file - promoters60/5674626
tattaacaa

SEQ ID NO: 150697 - DNA, 7 bp, Unknown
  misc_feature (1)..( 7): Result.004 file - promoters60/5674626
gaatatg

SEQ ID NO: 150698 - DNA, 7 bp, Unknown
  misc_feature (1)..( 7): Result.004 file - promoters60/5674626
gaagatg

SEQ ID NO: 150699 - DNA, 6 bp, Unknown
  misc_feature (1)..( 6): Result.004 file - promoters60/5674626
ttaaaa

SEQ ID NO: 150700 - DNA, 6 bp, Unknown
  misc_feature (1)..( 6): Result.004 file - promoters60/5674626
ttaaaa

SEQ ID NO: 150701 - DNA, 7 bp, Unknown
  misc_feature (1)..( 7): Result.004 file - promoters60/5674626
aaaatca

SEQ ID NO: 150702 - DNA, 7 bp, Unknown
  misc_feature (1)..( 7): Result.004 file - promoters60/5674626
aaactca

SEQ ID NO: 150703 - DNA, 6 bp, Unknown
  misc_feature (1)..( 6): Result.004 file - promoters60/5674626
atatgt

SEQ ID NO: 150704 - DNA, 6 bp, Unknown
  misc_feature (1)..( 6): Result.004 file - promoters60/5674626
atatgt

SEQ ID NO: 150705 - DNA, 6 bp, Unknown
  misc_feature (1)..( 6): Result.004 file - promoters60/5674626
ttgaag

SEQ ID NO: 150706 - DNA, 6 bp, Unknown
  misc_feature (1)..( 6): Result.004 file - promoters60/5674626
ttgaag

SEQ ID NO: 150707 - DNA, 7 bp, Unknown
  misc_feature (1)..( 7): Result.004 file - promoters60/5674626
gaatttg

SEQ ID NO: 150708 - DNA, 7 bp, Unknown
  misc_feature (1)..( 7): Result.004 file - promoters60/5674626
gaaattg

SEQ ID NO: 150709 - DNA, 6 bp, Unknown
  misc_feature (1)..( 6): Result.004 file - promoters60/5674626
tgatat

SEQ ID NO: 150710 - DNA, 6 bp, Unknown
  misc_feature (1)..( 6): Result.004 file - promoters60/5674626
tgatat

SEQ ID NO: 150711 - DNA, 6 bp, Unknown
  misc_feature (1)..( 6): Result.004 file - promoters60/5674626
atataa

SEQ ID NO: 150712 - DNA, 6 bp, Unknown
  misc_feature (1)..( 6): Result.004 file - promoters60/5674626
atataa

SEQ ID NO: 150713 - DNA, 6 bp, Unknown
  misc_feature (1)..( 6): Result.004 file - promoters60/5674626
tatttt

SEQ ID NO: 150714 - DNA, 6 bp, Unknown
  misc_feature (1)..( 6): Result.004 file - promoters60/5674626
tatttt

SEQ ID NO: 150715 - DNA, 7 bp, Unknown
  misc_feature (1)..( 7): Result.004 file - promoters60/5674626
tttattg

SEQ ID NO: 150716 - DNA, 7 bp, Unknown
  misc_feature (1)..( 7): Result.004 file - promoters60/5674626
tttattg

SEQ ID NO: 150717 - DNA, 6 bp, Unknown
  misc_feature (1)..( 6): Result.004 file - promoters60/5674626
aatatt

SEQ ID NO: 150718 - DNA, 6 bp, Unknown
  misc_feature (1)..( 6): Result.004 file - promoters60/5674626
aatatt

SEQ ID NO: 150719 - DNA, 7 bp, Unknown
  misc_feature (1)..( 7): Result.004 file - promoters60/5674626
aataaat

SEQ ID NO: 150720 - DNA, 7 bp, Unknown
  misc_feature (1)..( 7): Result.004 file - promoters60/5674626
aatcaat

SEQ ID NO: 150721 - DNA, 7 bp, Unknown
  misc_feature (1)..( 7): Result.004 file - promoters60/5674626
ttagaag

SEQ ID NO: 150722 - DNA, 7 bp, Unknown
  misc_feature (1)..( 7): Result.004 file - promoters60/5674626
ttaaaag

SEQ ID NO: 150723 - DNA, 6 bp, Unknown
  misc_feature (1)..( 6): Result.004 file - promoters60/5674626
ttggat

SEQ ID NO: 150724 - DNA, 6 bp, Unknown
  misc_feature (1)..( 6): Result.004 file - promoters60/5674626
ttggat

SEQ ID NO: 150725 - DNA, 7 bp, Unknown
  misc_feature (1)..( 7): Result.004 file - promoters60/5674626
atttcca

SEQ ID NO: 150726 - DNA, 7 bp, Unknown
  misc_feature (1)..( 7): Result.004 file - promoters60/5674626
attccca

SEQ ID NO: 150727 - DNA, 6 bp, Unknown
  misc_feature (1)..( 6): Result.004 file - promoters60/5674626
atccaa

SEQ ID NO: 150728 - DNA, 6 bp, Unknown
  misc_feature (1)..( 6): Result.004 file - promoters60/5674626
atccaa

SEQ ID NO: 150729 - DNA, 7 bp, Unknown
  misc_feature (1)..( 7): Result.004 file - promoters60/5674626
attaccg

SEQ ID NO: 150730 - DNA, 7 bp, Unknown
  misc_feature (1)..( 7): Result.004 file - promoters60/5674626
atttccg

SEQ ID NO: 150731 - DNA, 7 bp, Unknown
  misc_feature (1)..( 7): Result.004 file - promoters60/5674626
gcttaaa

SEQ ID NO: 150732 - DNA, 7 bp, Unknown
  misc_feature (1)..( 7): Result.004 file - promoters60/5674626
gctaaaa

SEQ ID NO: 150733 - DNA, 7 bp, Unknown
  misc_feature (1)..( 7): Result.004 file - promoters60/5674626
aaggatt

SEQ ID NO: 150734 - DNA, 7 bp, Unknown
  misc_feature (1)..( 7): Result.004 file - promoters60/5674666
aaggatt

SEQ ID NO: 150735 - DNA, 10 bp, Unknown
  misc_feature (1)..( 10): Result.004 file - promoters60/5674666
gtaatcaatc

SEQ ID NO: 150736 - DNA, 10 bp, Unknown
  misc_feature (1)..( 10): Result.004 file - promoters60/5674666
aaaatgaatt

SEQ ID NO: 150737 - DNA, 10 bp, Unknown
  misc_feature (1)..( 10): Result.004 file - promoters60/5674666
taaaagaaac

SEQ ID NO: 150738 - DNA, 10 bp, Unknown
  misc_feature (1)..( 10): Result.004 file - promoters60/5674666
aaaacgaatg

SEQ ID NO: 150739 - DNA, 10 bp, Unknown
  misc_feature (1)..( 10): Result.004 file - promoters60/5674666
ccaaagaaag

SEQ ID NO: 150740 - DNA, 10 bp, Unknown
  misc_feature (1)..( 10): Result.004 file - promoters60/5674666
aaaaaaaatc

SEQ ID NO: 150741 - DNA, 10 bp, Unknown
  misc_feature (1)..( 10): Result.004 file - promoters60/5674666
acaaggaaag

SEQ ID NO: 150742 - DNA, 12 bp, Unknown
  misc_feature (1)..( 12): Result.004 file - promoters60/5674666
aaaacaaaaatt

SEQ ID NO: 150743 - DNA, 12 bp, Unknown
  misc_feature (1)..( 12): Result.004 file - promoters60/5674666
aaaacagaaatt

SEQ ID NO: 150744 - DNA, 12 bp, Unknown
  misc_feature (1)..( 12): Result.004 file - promoters60/5674666
tattgaaaaatc

SEQ ID NO: 150745 - DNA, 12 bp, Unknown
  misc_feature (1)..( 12): Result.004 file - promoters60/5674666
agtaaaaaaatg

SEQ ID NO: 150746 - DNA, 12 bp, Unknown
  misc_feature (1)..( 12): Result.004 file - promoters60/5674666
cgccaaaagaca

SEQ ID NO: 150747 - DNA, 12 bp, Unknown
  misc_feature (1)..( 12): Result.004 file - promoters60/5674666
tcttgagaaacc

SEQ ID NO: 150748 - DNA, 13 bp, Unknown
  misc_feature (1)..( 13): Result.004 file - promoters60/5674666
cttagactatata

SEQ ID NO: 150749 - DNA, 13 bp, Unknown
  misc_feature (1)..( 13): Result.004 file - promoters60/5674666
acaagactaaaga

SEQ ID NO: 150750 - DNA, 12 bp, Unknown
  misc_feature (1)..( 12): Result.004 file - promoters60/5674666
taagacaaaaga

SEQ ID NO: 150751 - DNA, 13 bp, Unknown
  misc_feature (1)..( 13): Result.004 file - promoters60/5674666
aaatgacgttctt

SEQ ID NO: 150752 - DNA, 13 bp, Unknown
  misc_feature (1)..( 13): Result.004 file - promoters60/5674666
aaatgaatggggc

SEQ ID NO: 150753 - DNA, 13 bp, Unknown
  misc_feature (1)..( 13): Result.004 file - promoters60/5674666
aaaataaatttag

SEQ ID NO: 150754 - DNA, 9 bp, Unknown
  misc_feature (1)..( 9): Result.004 file - promoters60/5674666
tttataaaa

SEQ ID NO: 150755 - DNA, 9 bp, Unknown
  misc_feature (1)..( 9): Result.004 file - promoters60/5674666
tttctaatg

SEQ ID NO: 150756 - DNA, 9 bp, Unknown
  misc_feature (1)..( 9): Result.004 file - promoters60/5674666
catataaaa

SEQ ID NO: 150757 - DNA, 9 bp, Unknown
  misc_feature (1)..( 9): Result.004 file - promoters60/5674666
tctattaaa

SEQ ID NO: 150758 - DNA, 9 bp, Unknown
  misc_feature (1)..( 9): Result.004 file - promoters60/5674666
tatacaaaa

SEQ ID NO: 150759 - DNA, 9 bp, Unknown
  misc_feature (1)..( 9): Result.004 file - promoters60/5675330
tatccaaag

SEQ ID NO: 150760 - DNA, 7 bp, Unknown
  misc_feature (1)..( 7): Result.004 file - promoters60/5675330
caacaga

SEQ ID NO: 150761 - DNA, 7 bp, Unknown
  misc_feature (1)..( 7): Result.004 file - promoters60/5675330
caagaga

SEQ ID NO: 150762 - DNA, 10 bp, Unknown
  misc_feature (1)..( 10): Result.004 file - promoters60/5675330
tttttggtga

SEQ ID NO: 150763 - DNA, 10 bp, Unknown
  misc_feature (1)..( 10): Result.004 file - promoters60/5675330
tttgtggtaa

SEQ ID NO: 150764 - DNA, 10 bp, Unknown
  misc_feature (1)..( 10): Result.004 file - promoters60/5675330
agtgttgtaa

SEQ ID NO: 150765 - DNA, 6 bp, Unknown
  misc_feature (1)..( 6): Result.004 file - promoters60/5675330
catgtt

SEQ ID NO: 150766 - DNA, 6 bp, Unknown
  misc_feature (1)..( 6): Result.004 file - promoters60/5675330
catgtt

SEQ ID NO: 150767 - DNA, 6 bp, Unknown
  misc_feature (1)..( 6): Result.004 file - promoters60/5675330
catgtt

SEQ ID NO: 150768 - DNA, 6 bp, Unknown
  misc_feature (1)..( 6): Result.004 file - promoters60/5675330
attgag

SEQ ID NO: 150769 - DNA, 6 bp, Unknown
  misc_feature (1)..( 6): Result.004 file - promoters60/5675330
attgag

SEQ ID NO: 150770 - DNA, 7 bp, Unknown
  misc_feature (1)..( 7): Result.004 file - promoters60/5675330
tacggga

SEQ ID NO: 150771 - DNA, 7 bp, Unknown
  misc_feature (1)..( 7): Result.004 file - promoters60/5675330
taccgga

SEQ ID NO: 150772 - DNA, 8 bp, Unknown
  misc_feature (1)..( 8): Result.004 file - promoters60/5675330
aaacagtt

SEQ ID NO: 150773 - DNA, 8 bp, Unknown
  misc_feature (1)..( 8): Result.004 file - promoters60/5675330
aaacagtt

SEQ ID NO: 150774 - DNA, 8 bp, Unknown
  misc_feature (1)..( 8): Result.004 file - promoters60/5675330
tcaagaag

SEQ ID NO: 150775 - DNA, 8 bp, Unknown
  misc_feature (1)..( 8): Result.004 file - promoters60/5675330
tcaggaag

SEQ ID NO: 150776 - DNA, 6 bp, Unknown
  misc_feature (1)..( 6): Result.004 file - promoters60/5675330
atctgc

SEQ ID NO: 150777 - DNA, 6 bp, Unknown
  misc_feature (1)..( 6): Result.004 file - promoters60/5675330
atctgc

SEQ ID NO: 150778 - DNA, 6 bp, Unknown
  misc_feature (1)..( 6): Result.004 file - promoters60/5675330
tttagt

SEQ ID NO: 150779 - DNA, 6 bp, Unknown
  misc_feature (1)..( 6): Result.004 file - promoters60/5675330
tttagt

SEQ ID NO: 150780 - DNA, 7 bp, Unknown
  misc_feature (1)..( 7): Result.004 file - promoters60/5675330
atgattt

SEQ ID NO: 150781 - DNA, 7 bp, Unknown
  misc_feature (1)..( 7): Result.004 file - promoters60/5675330
atggttt

SEQ ID NO: 150782 - DNA, 7 bp, Unknown
  misc_feature (1)..( 7): Result.004 file - promoters60/5675330
gaagttg

SEQ ID NO: 150783 - DNA, 7 bp, Unknown
  misc_feature (1)..( 7): Result.004 file - promoters60/5675330
gaatttg

SEQ ID NO: 150784 - DNA, 6 bp, Unknown
  misc_feature (1)..( 6): Result.004 file - promoters60/5675330
tgttat

SEQ ID NO: 150785 - DNA, 6 bp, Unknown
  misc_feature (1)..( 6): Result.004 file - promoters60/5675330
tgttat

SEQ ID NO: 150786 - DNA, 6 bp, Unknown
  misc_feature (1)..( 6): Result.004 file - promoters60/5675330
aatatc

SEQ ID NO: 150787 - DNA, 6 bp, Unknown
  misc_feature (1)..( 6): Result.004 file - promoters60/5675330
aatatc

SEQ ID NO: 150788 - DNA, 8 bp, Unknown
  misc_feature (1)..( 8): Result.004 file - promoters60/5675330
tgttggaa

SEQ ID NO: 150789 - DNA, 8 bp, Unknown
  misc_feature (1)..( 8): Result.004 file - promoters60/5675330
tgttggaa

SEQ ID NO: 150790 - DNA, 6 bp, Unknown
  misc_feature (1)..( 6): Result.004 file - promoters60/5675330
ggaaaa

SEQ ID NO: 150791 - DNA, 6 bp, Unknown
  misc_feature (1)..( 6): Result.004 file - promoters60/5675330
ggaaaa

SEQ ID NO: 150792 - DNA, 7 bp, Unknown
  misc_feature (1)..( 7): Result.004 file - promoters60/5675330
aaatgtt

SEQ ID NO: 150793 - DNA, 7 bp, Unknown
  misc_feature (1)..( 7): Result.004 file - promoters60/5675628
aaatgtt

SEQ ID NO: 150794 - DNA, 11 bp, Unknown
  misc_feature (1)..( 11): Result.004 file - promoters60/5675628
aacacaaatta

SEQ ID NO: 150795 - DNA, 11 bp, Unknown
  misc_feature (1)..( 11): Result.004 file - promoters60/5675628
aactcaaatga

SEQ ID NO: 150796 - DNA, 11 bp, Unknown
  misc_feature (1)..( 11): Result.004 file - promoters60/5675628
cccactaattt

SEQ ID NO: 150797 - DNA, 11 bp, Unknown
  misc_feature (1)..( 11): Result.004 file - promoters60/5675628
ttatgtaattt

SEQ ID NO: 150798 - DNA, 12 bp, Unknown
  misc_feature (1)..( 12): Result.004 file - promoters60/5675628
ggttctatggaa

SEQ ID NO: 150799 - DNA, 12 bp, Unknown
  misc_feature (1)..( 12): Result.004 file - promoters60/5675628
ctttccatggct

SEQ ID NO: 150800 - DNA, 12 bp, Unknown
  misc_feature (1)..( 12): Result.004 file - promoters60/5675628
tgtgccattgct

SEQ ID NO: 150801 - DNA, 12 bp, Unknown
  misc_feature (1)..( 12): Result.004 file - promoters60/5675628
tgtaccattgtt

SEQ ID NO: 150802 - DNA, 7 bp, Unknown
  misc_feature (1)..( 7): Result.004 file - promoters60/5675628
tctctgt

SEQ ID NO: 150803 - DNA, 7 bp, Unknown
  misc_feature (1)..( 7): Result.004 file - promoters60/5675628
tctttgt

SEQ ID NO: 150804 - DNA, 7 bp, Unknown
  misc_feature (1)..( 7): Result.004 file - promoters60/5675628
gctttgt

SEQ ID NO: 150805 - DNA, 7 bp, Unknown
  misc_feature (1)..( 7): Result.004 file - promoters60/5676027
actttgt

SEQ ID NO: 150806 - DNA, 8 bp, Unknown
  misc_feature (1)..( 8): Result.004 file - promoters60/5676027
tttcttaa

SEQ ID NO: 150807 - DNA, 8 bp, Unknown
  misc_feature (1)..( 8): Result.004 file - promoters60/5676027
ttttttat

SEQ ID NO: 150808 - DNA, 8 bp, Unknown
  misc_feature (1)..( 8): Result.004 file - promoters60/5676027
atttgtat

SEQ ID NO: 150809 - DNA, 9 bp, Unknown
  misc_feature (1)..( 9): Result.004 file - promoters60/5676027
taatttcaa

SEQ ID NO: 150810 - DNA, 9 bp, Unknown
  misc_feature (1)..( 9): Result.004 file - promoters60/5676027
taatttcca

SEQ ID NO: 150811 - DNA, 9 bp, Unknown
  misc_feature (1)..( 9): Result.004 file - promoters60/5676027
aaatttcaa

SEQ ID NO: 150812 - DNA, 9 bp, Unknown
  misc_feature (1)..( 9): Result.004 file - promoters60/5676027
gaatgtcag

SEQ ID NO: 150813 - DNA, 8 bp, Unknown
  misc_feature (1)..( 8): Result.004 file - promoters60/5676027
caatctta

SEQ ID NO: 150814 - DNA, 8 bp, Unknown
  misc_feature (1)..( 8): Result.004 file - promoters60/5676027
aaatttta

SEQ ID NO: 150815 - DNA, 8 bp, Unknown
  misc_feature (1)..( 8): Result.004 file - promoters60/5676027
aaatttgt

SEQ ID NO: 150816 - DNA, 13 bp, Unknown
  misc_feature (1)..( 13): Result.004 file - promoters60/5676027
aaattatttaaat

SEQ ID NO: 150817 - DNA, 13 bp, Unknown
  misc_feature (1)..( 13): Result.004 file - promoters60/5676027
caagtatataaac

SEQ ID NO: 150818 - DNA, 13 bp, Unknown
  misc_feature (1)..( 13): Result.004 file - promoters60/5676027
caagaatatacat

SEQ ID NO: 150819 - DNA, 13 bp, Unknown
  misc_feature (1)..( 13): Result.004 file - promoters60/5676027
atcatagacaaga

SEQ ID NO: 150820 - DNA, 8 bp, Unknown
  misc_feature (1)..( 8): Result.004 file - promoters60/5676027
gaataatt

SEQ ID NO: 150821 - DNA, 8 bp, Unknown
  misc_feature (1)..( 8): Result.004 file - promoters60/5676027
caattatt

SEQ ID NO: 150822 - DNA, 8 bp, Unknown
  misc_feature (1)..( 8): Result.004 file - promoters60/5676027
caaatata

SEQ ID NO: 150823 - DNA, 8 bp, Unknown
  misc_feature (1)..( 8): Result.004 file - promoters60/5676027
atttatat

SEQ ID NO: 150824 - DNA, 8 bp, Unknown
  misc_feature (1)..( 8): Result.004 file - promoters60/5676027
atttgtat

SEQ ID NO: 150825 - DNA, 8 bp, Unknown
  misc_feature (1)..( 8): Result.004 file - promoters60/5676160
ttttttat

SEQ ID NO: 150826 - DNA, 12 bp, Unknown
  misc_feature (1)..( 12): Result.004 file - promoters60/5676160
aagtaaattttc

SEQ ID NO: 150827 - DNA, 12 bp, Unknown
  misc_feature (1)..( 12): Result.004 file - promoters60/5676160
aagcaaattttc

SEQ ID NO: 150828 - DNA, 12 bp, Unknown
  misc_feature (1)..( 12): Result.004 file - promoters60/5676160
agtataattttg

SEQ ID NO: 150829 - DNA, 12 bp, Unknown
  misc_feature (1)..( 12): Result.004 file - promoters60/5676160
acactaattttt

SEQ ID NO: 150830 - DNA, 13 bp, Unknown
  misc_feature (1)..( 13): Result.004 file - promoters60/5676160
atcatatataaac

SEQ ID NO: 150831 - DNA, 13 bp, Unknown
  misc_feature (1)..( 13): Result.004 file - promoters60/5676160
agcatatattagt

SEQ ID NO: 150832 - DNA, 13 bp, Unknown
  misc_feature (1)..( 13): Result.004 file - promoters60/5676160
ttcatttataaac

SEQ ID NO: 150833 - DNA, 13 bp, Unknown
  misc_feature (1)..( 13): Result.004 file - promoters60/5676160
ttctttttgagct

SEQ ID NO: 150834 - DNA, 13 bp, Unknown
  misc_feature (1)..( 13): Result.004 file - promoters60/5676521
cgcgcttacaaaa

SEQ ID NO: 150835 - DNA, 6 bp, Unknown
  misc_feature (1)..( 6): Result.004 file - promoters60/5676521
tcttct

SEQ ID NO: 150836 - DNA, 6 bp, Unknown
  misc_feature (1)..( 6): Result.004 file - promoters60/5676521
tcttct

SEQ ID NO: 150837 - DNA, 9 bp, Unknown
  misc_feature (1)..( 9): Result.004 file - promoters60/5676521
aaaaaagaa

SEQ ID NO: 150838 - DNA, 9 bp, Unknown
  misc_feature (1)..( 9): Result.004 file - promoters60/5676521
aaaaaggaa

SEQ ID NO: 150839 - DNA, 8 bp, Unknown
  misc_feature (1)..( 8): Result.004 file - promoters60/5676521
ttggtttg

SEQ ID NO: 150840 - DNA, 8 bp, Unknown
  misc_feature (1)..( 8): Result.004 file - promoters60/5676521
ttgatttg

SEQ ID NO: 150841 - DNA, 8 bp, Unknown
  misc_feature (1)..( 8): Result.004 file - promoters60/5676521
tcttttag

SEQ ID NO: 150842 - DNA, 8 bp, Unknown
  misc_feature (1)..( 8): Result.004 file - promoters60/5676521
tcttatag

SEQ ID NO: 150843 - DNA, 7 bp, Unknown
  misc_feature (1)..( 7): Result.004 file - promoters60/5676521
ttacttc

SEQ ID NO: 150844 - DNA, 7 bp, Unknown
  misc_feature (1)..( 7): Result.004 file - promoters60/5676521
ttacttc

SEQ ID NO: 150845 - DNA, 6 bp, Unknown
  misc_feature (1)..( 6): Result.004 file - promoters60/5676521
gtgaaa

SEQ ID NO: 150846 - DNA, 6 bp, Unknown
  misc_feature (1)..( 6): Result.004 file - promoters60/5676521
gtgaaa

SEQ ID NO: 150847 - DNA, 7 bp, Unknown
  misc_feature (1)..( 7): Result.004 file - promoters60/5676521
aaaagaa

SEQ ID NO: 150848 - DNA, 7 bp, Unknown
  misc_feature (1)..( 7): Result.004 file - promoters60/5676521
aaaggaa

SEQ ID NO: 150849 - DNA, 7 bp, Unknown
  misc_feature (1)..( 7): Result.004 file - promoters60/5676521
aaaccca

SEQ ID NO: 150850 - DNA, 7 bp, Unknown
  misc_feature (1)..( 7): Result.004 file - promoters60/5676521
aaatcca

SEQ ID NO: 150851 - DNA, 7 bp, Unknown
  misc_feature (1)..( 7): Result.004 file - promoters60/5676521
ccgcaaa

SEQ ID NO: 150852 - DNA, 7 bp, Unknown
  misc_feature (1)..( 7): Result.004 file - promoters60/5676521
ccgaaaa

SEQ ID NO: 150853 - DNA, 6 bp, Unknown
  misc_feature (1)..( 6): Result.004 file - promoters60/5676521
ttgtga

SEQ ID NO: 150854 - DNA, 6 bp, Unknown
  misc_feature (1)..( 6): Result.004 file - promoters60/5676521
ttgtga

SEQ ID NO: 150855 - DNA, 6 bp, Unknown
  misc_feature (1)..( 6): Result.004 file - promoters60/5676521
gagatc

SEQ ID NO: 150856 - DNA, 6 bp, Unknown
  misc_feature (1)..( 6): Result.004 file - promoters60/5676521
gagatc

SEQ ID NO: 150857 - DNA, 6 bp, Unknown
  misc_feature (1)..( 6): Result.004 file - promoters60/5676521
gtgttt

SEQ ID NO: 150858 - DNA, 6 bp, Unknown
  misc_feature (1)..( 6): Result.004 file - promoters60/5676521
gtgttt

SEQ ID NO: 150859 - DNA, 8 bp, Unknown
  misc_feature (1)..( 8): Result.004 file - promoters60/5676521
cttcttat

SEQ ID NO: 150860 - DNA, 8 bp, Unknown
  misc_feature (1)..( 8): Result.004 file - promoters60/5676521
cttattat

SEQ ID NO: 150861 - DNA, 10 bp, Unknown
  misc_feature (1)..( 10): Result.004 file - promoters60/5676521
gatgttcttc

SEQ ID NO: 150862 - DNA, 10 bp, Unknown
  misc_feature (1)..( 10): Result.004 file - promoters60/5676647
gatcttcttc

SEQ ID NO: 150863 - DNA, 9 bp, Unknown
  misc_feature (1)..( 9): Result.004 file - promoters60/5676647
aacctaatt

SEQ ID NO: 150864 - DNA, 9 bp, Unknown
  misc_feature (1)..( 9): Result.004 file - promoters60/5676647
aacctatta

SEQ ID NO: 150865 - DNA, 9 bp, Unknown
  misc_feature (1)..( 9): Result.004 file - promoters60/5676647
caccaatta

SEQ ID NO: 150866 - DNA, 6 bp, Unknown
  misc_feature (1)..( 6): Result.004 file - promoters60/5676647
cgactg

SEQ ID NO: 150867 - DNA, 6 bp, Unknown
  misc_feature (1)..( 6): Result.004 file - promoters60/5676647
cgactg

SEQ ID NO: 150868 - DNA, 7 bp, Unknown
  misc_feature (1)..( 7): Result.004 file - promoters60/5676647
ttttttt

SEQ ID NO: 150869 - DNA, 7 bp, Unknown
  misc_feature (1)..( 7): Result.004 file - promoters60/5676647
tttattt

SEQ ID NO: 150870 - DNA, 6 bp, Unknown
  misc_feature (1)..( 6): Result.004 file - promoters60/5676647
tatttt

SEQ ID NO: 150871 - DNA, 6 bp, Unknown
  misc_feature (1)..( 6): Result.004 file - promoters60/5676647
tatttt

SEQ ID NO: 150872 - DNA, 7 bp, Unknown
  misc_feature (1)..( 7): Result.004 file - promoters60/5676647
aaagtga

SEQ ID NO: 150873 - DNA, 7 bp, Unknown
  misc_feature (1)..( 7): Result.004 file - promoters60/5676647
aaattga

SEQ ID NO: 150874 - DNA, 10 bp, Unknown
  misc_feature (1)..( 10): Result.004 file - promoters60/5676647
gaatatcttt

SEQ ID NO: 150875 - DNA, 10 bp, Unknown
  misc_feature (1)..( 10): Result.004 file - promoters60/5676647
gaatatcttt

SEQ ID NO: 150876 - DNA, 7 bp, Unknown
  misc_feature (1)..( 7): Result.004 file - promoters60/5676647
aagtggt

SEQ ID NO: 150877 - DNA, 7 bp, Unknown
  misc_feature (1)..( 7): Result.004 file - promoters60/5676647
aagaggt

SEQ ID NO: 150878 - DNA, 7 bp, Unknown
  misc_feature (1)..( 7): Result.004 file - promoters60/5676647
cttatta

SEQ ID NO: 150879 - DNA, 7 bp, Unknown
  misc_feature (1)..( 7): Result.004 file - promoters60/5676647
cttttta

SEQ ID NO: 150880 - DNA, 9 bp, Unknown
  misc_feature (1)..( 9): Result.004 file - promoters60/5676647
taaaaatga

SEQ ID NO: 150881 - DNA, 9 bp, Unknown
  misc_feature (1)..( 9): Result.004 file - promoters60/5676647
taaaaatga

SEQ ID NO: 150882 - DNA, 6 bp, Unknown
  misc_feature (1)..( 6): Result.004 file - promoters60/5676647
aggaaa

SEQ ID NO: 150883 - DNA, 6 bp, Unknown
  misc_feature (1)..( 6): Result.004 file - promoters60/5676647
aggaaa

SEQ ID NO: 150884 - DNA, 6 bp, Unknown
  misc_feature (1)..( 6): Result.004 file - promoters60/5676647
gacaac

SEQ ID NO: 150885 - DNA, 6 bp, Unknown
  misc_feature (1)..( 6): Result.004 file - promoters60/5676647
gacaac

SEQ ID NO: 150886 - DNA, 7 bp, Unknown
  misc_feature (1)..( 7): Result.004 file - promoters60/5676647
aatcatc

SEQ ID NO: 150887 - DNA, 7 bp, Unknown
  misc_feature (1)..( 7): Result.004 file - promoters60/5677029
aatcatc

SEQ ID NO: 150888 - DNA, 7 bp, Unknown
  misc_feature (1)..( 7): Result.004 file - promoters60/5677029
tttgtaa

SEQ ID NO: 150889 - DNA, 7 bp, Unknown
  misc_feature (1)..( 7): Result.004 file - promoters60/5677029
attgtaa

SEQ ID NO: 150890 - DNA, 7 bp, Unknown
  misc_feature (1)..( 7): Result.004 file - promoters60/5677029
tttgtaa

SEQ ID NO: 150891 - DNA, 7 bp, Unknown
  misc_feature (1)..( 7): Result.004 file - promoters60/5677029
attataa

SEQ ID NO: 150892 - DNA, 11 bp, Unknown
  misc_feature (1)..( 11): Result.004 file - promoters60/5677029
taaaagtaata

SEQ ID NO: 150893 - DNA, 11 bp, Unknown
  misc_feature (1)..( 11): Result.004 file - promoters60/5677029
taaaagtatat

SEQ ID NO: 150894 - DNA, 11 bp, Unknown
  misc_feature (1)..( 11): Result.004 file - promoters60/5677029
ctcaagtatat

SEQ ID NO: 150895 - DNA, 11 bp, Unknown
  misc_feature (1)..( 11): Result.004 file - promoters60/5677029
actttgtatat

SEQ ID NO: 150896 - DNA, 10 bp, Unknown
  misc_feature (1)..( 10): Result.004 file - promoters60/5677029
ataatgaatt

SEQ ID NO: 150897 - DNA, 10 bp, Unknown
  misc_feature (1)..( 10): Result.004 file - promoters60/5677029
tatatgaatt

SEQ ID NO: 150898 - DNA, 9 bp, Unknown
  misc_feature (1)..( 9): Result.004 file - promoters60/5677029
aaatgaata

SEQ ID NO: 150899 - DNA, 10 bp, Unknown
  misc_feature (1)..( 10): Result.004 file - promoters60/5677029
aaactgatta

SEQ ID NO: 150900 - DNA, 9 bp, Unknown
  misc_feature (1)..( 9): Result.004 file - promoters60/5677029
tattatata

SEQ ID NO: 150901 - DNA, 9 bp, Unknown
  misc_feature (1)..( 9): Result.004 file - promoters60/5677029
gtttatata

SEQ ID NO: 150902 - DNA, 9 bp, Unknown
  misc_feature (1)..( 9): Result.004 file - promoters60/5677029
tattataaa

SEQ ID NO: 150903 - DNA, 9 bp, Unknown
  misc_feature (1)..( 9): Result.004 file - promoters60/5677029
gattgtaat

SEQ ID NO: 150904 - DNA, 7 bp, Unknown
  misc_feature (1)..( 7): Result.004 file - promoters60/5677029
attgtaa

SEQ ID NO: 150905 - DNA, 7 bp, Unknown
  misc_feature (1)..( 7): Result.004 file - promoters60/5677029
attataa

SEQ ID NO: 150906 - DNA, 7 bp, Unknown
  misc_feature (1)..( 7): Result.004 file - promoters60/5677029
attgtaa

SEQ ID NO: 150907 - DNA, 7 bp, Unknown
  misc_feature (1)..( 7): Result.004 file - promoters60/5677029
attataa

SEQ ID NO: 150908 - DNA, 11 bp, Unknown
  misc_feature (1)..( 11): Result.004 file - promoters60/5677029
attgcgtattt

SEQ ID NO: 150909 - DNA, 11 bp, Unknown
  misc_feature (1)..( 11): Result.004 file - promoters60/5677029
attgtgtattt

SEQ ID NO: 150910 - DNA, 11 bp, Unknown
  misc_feature (1)..( 11): Result.004 file - promoters60/5677029
tttgtatataa

SEQ ID NO: 150911 - DNA, 11 bp, Unknown
  misc_feature (1)..( 11): Result.004 file - promoters60/5677029
caagtatattg

SEQ ID NO: 150912 - DNA, 8 bp, Unknown
  misc_feature (1)..( 8): Result.004 file - promoters60/5677029
aagtatat

SEQ ID NO: 150913 - DNA, 8 bp, Unknown
  misc_feature (1)..( 8): Result.004 file - promoters60/5677029
ttgtatat

SEQ ID NO: 150914 - DNA, 8 bp, Unknown
  misc_feature (1)..( 8): Result.004 file - promoters60/5677029
ttgtgtat

SEQ ID NO: 150915 - DNA, 8 bp, Unknown
  misc_feature (1)..( 8): Result.004 file - promoters60/5677230
aagtatat

SEQ ID NO: 150916 - DNA, 6 bp, Unknown
  misc_feature (1)..( 6): Result.004 file - promoters60/5677230
tgtgga

SEQ ID NO: 150917 - DNA, 6 bp, Unknown
  misc_feature (1)..( 6): Result.004 file - promoters60/5677230
tgtgga

SEQ ID NO: 150918 - DNA, 6 bp, Unknown
  misc_feature (1)..( 6): Result.004 file - promoters60/5677230
gacatt

SEQ ID NO: 150919 - DNA, 6 bp, Unknown
  misc_feature (1)..( 6): Result.004 file - promoters60/5677230
gacatt

SEQ ID NO: 150920 - DNA, 7 bp, Unknown
  misc_feature (1)..( 7): Result.004 file - promoters60/5677230
aaggaaa

SEQ ID NO: 150921 - DNA, 7 bp, Unknown
  misc_feature (1)..( 7): Result.004 file - promoters60/5677230
aagtaaa

SEQ ID NO: 150922 - DNA, 7 bp, Unknown
  misc_feature (1)..( 7): Result.004 file - promoters60/5677230
gagtaaa

SEQ ID NO: 150923 - DNA, 6 bp, Unknown
  misc_feature (1)..( 6): Result.004 file - promoters60/5677230
tttgga

SEQ ID NO: 150924 - DNA, 6 bp, Unknown
  misc_feature (1)..( 6): Result.004 file - promoters60/5677230
tttgga

SEQ ID NO: 150925 - DNA, 7 bp, Unknown
  misc_feature (1)..( 7): Result.004 file - promoters60/5677230
aaaatat

SEQ ID NO: 150926 - DNA, 7 bp, Unknown
  misc_feature (1)..( 7): Result.004 file - promoters60/5677230
aaaataa

SEQ ID NO: 150927 - DNA, 7 bp, Unknown
  misc_feature (1)..( 7): Result.004 file - promoters60/5677230
gaaatat

SEQ ID NO: 150928 - DNA, 6 bp, Unknown
  misc_feature (1)..( 6): Result.004 file - promoters60/5677230
agaatt

SEQ ID NO: 150929 - DNA, 6 bp, Unknown
  misc_feature (1)..( 6): Result.004 file - promoters60/5677230
agaatt

SEQ ID NO: 150930 - DNA, 7 bp, Unknown
  misc_feature (1)..( 7): Result.004 file - promoters60/5677230
ttttgaa

SEQ ID NO: 150931 - DNA, 7 bp, Unknown
  misc_feature (1)..( 7): Result.004 file - promoters60/5677230
tttcgaa

SEQ ID NO: 150932 - DNA, 6 bp, Unknown
  misc_feature (1)..( 6): Result.004 file - promoters60/5677230
tttgtt

SEQ ID NO: 150933 - DNA, 6 bp, Unknown
  misc_feature (1)..( 6): Result.004 file - promoters60/5677230
tttgtt

SEQ ID NO: 150934 - DNA, 6 bp, Unknown
  misc_feature (1)..( 6): Result.004 file - promoters60/5677230
accgtc

SEQ ID NO: 150935 - DNA, 6 bp, Unknown
  misc_feature (1)..( 6): Result.004 file - promoters60/5677230
accgtc

SEQ ID NO: 150936 - DNA, 7 bp, Unknown
  misc_feature (1)..( 7): Result.004 file - promoters60/5677230
aatcggg

SEQ ID NO: 150937 - DNA, 7 bp, Unknown
  misc_feature (1)..( 7): Result.004 file - promoters60/5677230
aattggg

SEQ ID NO: 150938 - DNA, 8 bp, Unknown
  misc_feature (1)..( 8): Result.004 file - promoters60/5677230
gaaagaaa

SEQ ID NO: 150939 - DNA, 8 bp, Unknown
  misc_feature (1)..( 8): Result.004 file - promoters60/5677230
gaaacaaa

SEQ ID NO: 150940 - DNA, 10 bp, Unknown
  misc_feature (1)..( 10): Result.004 file - promoters60/5677230
ggaaaagaaa

SEQ ID NO: 150941 - DNA, 10 bp, Unknown
  misc_feature (1)..( 10): Result.004 file - promoters60/5677230
ggaaatgaaa

SEQ ID NO: 150942 - DNA, 7 bp, Unknown
  misc_feature (1)..( 7): Result.004 file - promoters60/5677230
cccacta

SEQ ID NO: 150943 - DNA, 7 bp, Unknown
  misc_feature (1)..( 7): Result.004 file - promoters60/5677230
cccacta

SEQ ID NO: 150944 - DNA, 9 bp, Unknown
  misc_feature (1)..( 9): Result.004 file - promoters60/5677230
aaagaaaag

SEQ ID NO: 150945 - DNA, 9 bp, Unknown
  misc_feature (1)..( 9): Result.004 file - promoters60/5677230
aaagtaaag

SEQ ID NO: 150946 - DNA, 7 bp, Unknown
  misc_feature (1)..( 7): Result.004 file - promoters60/5677230
gtatata

SEQ ID NO: 150947 - DNA, 7 bp, Unknown
  misc_feature (1)..( 7): Result.004 file - promoters60/5677240
gtatata

SEQ ID NO: 150948 - DNA, 11 bp, Unknown
  misc_feature (1)..( 11): Result.004 file - promoters60/5677240
cctgttcttgt

SEQ ID NO: 150949 - DNA, 11 bp, Unknown
  misc_feature (1)..( 11): Result.004 file - promoters60/5677240
taagttgttgt

SEQ ID NO: 150950 - DNA, 11 bp, Unknown
  misc_feature (1)..( 11): Result.004 file - promoters60/5677240
taaattgtctt

SEQ ID NO: 150951 - DNA, 7 bp, Unknown
  misc_feature (1)..( 7): Result.004 file - promoters60/5677240
taccaaa

SEQ ID NO: 150952 - DNA, 7 bp, Unknown
  misc_feature (1)..( 7): Result.004 file - promoters60/5677240
tacaaaa

SEQ ID NO: 150953 - DNA, 8 bp, Unknown
  misc_feature (1)..( 8): Result.004 file - promoters60/5677240
aaaaggaa

SEQ ID NO: 150954 - DNA, 8 bp, Unknown
  misc_feature (1)..( 8): Result.004 file - promoters60/5677240
aaaatgaa

SEQ ID NO: 150955 - DNA, 8 bp, Unknown
  misc_feature (1)..( 8): Result.004 file - promoters60/5677240
aaaatcaa

SEQ ID NO: 150956 - DNA, 8 bp, Unknown
  misc_feature (1)..( 8): Result.004 file - promoters60/5677240
aaaatcaa

SEQ ID NO: 150957 - DNA, 6 bp, Unknown
  misc_feature (1)..( 6): Result.004 file - promoters60/5677240
tcatct

SEQ ID NO: 150958 - DNA, 6 bp, Unknown
  misc_feature (1)..( 6): Result.004 file - promoters60/5677240
tcatct

SEQ ID NO: 150959 - DNA, 7 bp, Unknown
  misc_feature (1)..( 7): Result.004 file - promoters60/5677240
gttttga

SEQ ID NO: 150960 - DNA, 7 bp, Unknown
  misc_feature (1)..( 7): Result.004 file - promoters60/5677240
gttttgg

SEQ ID NO: 150961 - DNA, 7 bp, Unknown
  misc_feature (1)..( 7): Result.004 file - promoters60/5677240
attttgg

SEQ ID NO: 150962 - DNA, 9 bp, Unknown
  misc_feature (1)..( 9): Result.004 file - promoters60/5677240
taaagattt

SEQ ID NO: 150963 - DNA, 9 bp, Unknown
  misc_feature (1)..( 9): Result.004 file - promoters60/5677240
taaaaattt

SEQ ID NO: 150964 - DNA, 6 bp, Unknown
  misc_feature (1)..( 6): Result.004 file - promoters60/5677240
ttatta

SEQ ID NO: 150965 - DNA, 6 bp, Unknown
  misc_feature (1)..( 6): Result.004 file - promoters60/5677240
ttatta

SEQ ID NO: 150966 - DNA, 8 bp, Unknown
  misc_feature (1)..( 8): Result.004 file - promoters60/5677240
aaaataag

SEQ ID NO: 150967 - DNA, 8 bp, Unknown
  misc_feature (1)..( 8): Result.004 file - promoters60/5677240
aaactaag

SEQ ID NO: 150968 - DNA, 6 bp, Unknown
  misc_feature (1)..( 6): Result.004 file - promoters60/5677240
atagat

SEQ ID NO: 150969 - DNA, 6 bp, Unknown
  misc_feature (1)..( 6): Result.004 file - promoters60/5677240
atagat

SEQ ID NO: 150970 - DNA, 7 bp, Unknown
  misc_feature (1)..( 7): Result.004 file - promoters60/5677240
agatata

SEQ ID NO: 150971 - DNA, 7 bp, Unknown
  misc_feature (1)..( 7): Result.004 file - promoters60/5677240
agagata

SEQ ID NO: 150972 - DNA, 6 bp, Unknown
  misc_feature (1)..( 6): Result.004 file - promoters60/5677240
taagat

SEQ ID NO: 150973 - DNA, 6 bp, Unknown
  misc_feature (1)..( 6): Result.004 file - promoters60/5677240
taagat

SEQ ID NO: 150974 - DNA, 6 bp, Unknown
  misc_feature (1)..( 6): Result.004 file - promoters60/5677240
aaagaa

SEQ ID NO: 150975 - DNA, 6 bp, Unknown
  misc_feature (1)..( 6): Result.004 file - promoters60/5677240
aaagaa

SEQ ID NO: 150976 - DNA, 12 bp, Unknown
  misc_feature (1)..( 12): Result.004 file - promoters60/5677240
aaaaacaaaaca

SEQ ID NO: 150977 - DNA, 12 bp, Unknown
  misc_feature (1)..( 12): Result.004 file - promoters60/5677240
aaacacaataca

SEQ ID NO: 150978 - DNA, 6 bp, Unknown
  misc_feature (1)..( 6): Result.004 file - promoters60/5677240
aaaaat

SEQ ID NO: 150979 - DNA, 6 bp, Unknown
  misc_feature (1)..( 6): Result.004 file - promoters60/5677240
aaaaat

SEQ ID NO: 150980 - DNA, 6 bp, Unknown
  misc_feature (1)..( 6): Result.004 file - promoters60/5677240
taaccc

SEQ ID NO: 150981 - DNA, 6 bp, Unknown
  misc_feature (1)..( 6): Result.004 file - promoters60/5677274
taaccc

SEQ ID NO: 150982 - DNA, 14 bp, Unknown
  misc_feature (1)..( 14): Result.004 file - promoters60/5677274
gttcgcctagattt

SEQ ID NO: 150983 - DNA, 14 bp, Unknown
  misc_feature (1)..( 14): Result.004 file - promoters60/5677274
cattggttagcttt

SEQ ID NO: 150984 - DNA, 13 bp, Unknown
  misc_feature (1)..( 13): Result.004 file - promoters60/5677274
ttattttaactta

SEQ ID NO: 150985 - DNA, 14 bp, Unknown
  misc_feature (1)..( 14): Result.004 file - promoters60/5677274
attctttgaactta

SEQ ID NO: 150986 - DNA, 14 bp, Unknown
  misc_feature (1)..( 14): Result.004 file - promoters60/5677274
aacattataacgta

SEQ ID NO: 150987 - DNA, 14 bp, Unknown
  misc_feature (1)..( 14): Result.004 file - promoters60/5677274
gttctttgcttcat

SEQ ID NO: 150988 - DNA, 15 bp, Unknown
  misc_feature (1)..( 15): Result.004 file - promoters60/5677274
atgcctttattcttt

SEQ ID NO: 150989 - DNA, 8 bp, Unknown
  misc_feature (1)..( 8): Result.004 file - promoters60/5677274
tcatatag

SEQ ID NO: 150990 - DNA, 8 bp, Unknown
  misc_feature (1)..( 8): Result.004 file - promoters60/5677274
acatttag

SEQ ID NO: 150991 - DNA, 8 bp, Unknown
  misc_feature (1)..( 8): Result.004 file - promoters60/5677274
acatttct

SEQ ID NO: 150992 - DNA, 8 bp, Unknown
  misc_feature (1)..( 8): Result.004 file - promoters60/5677274
acagttac

SEQ ID NO: 150993 - DNA, 8 bp, Unknown
  misc_feature (1)..( 8): Result.004 file - promoters60/5677274
ccatttct

SEQ ID NO: 150994 - DNA, 11 bp, Unknown
  misc_feature (1)..( 11): Result.004 file - promoters60/5677274
taggaatttgg

SEQ ID NO: 150995 - DNA, 11 bp, Unknown
  misc_feature (1)..( 11): Result.004 file - promoters60/5677274
acataatttgt

SEQ ID NO: 150996 - DNA, 11 bp, Unknown
  misc_feature (1)..( 11): Result.004 file - promoters60/5677274
tctagatttgg

SEQ ID NO: 150997 - DNA, 11 bp, Unknown
  misc_feature (1)..( 11): Result.004 file - promoters60/5677274
ttagaatttgg

SEQ ID NO: 150998 - DNA, 11 bp, Unknown
  misc_feature (1)..( 11): Result.004 file - promoters60/5677274
acatagtttca

SEQ ID NO: 150999 - DNA, 11 bp, Unknown
  misc_feature (1)..( 11): Result.004 file - promoters60/5677274
caaagatttga

SEQ ID NO: 151000 - DNA, 11 bp, Unknown
  misc_feature (1)..( 11): Result.004 file - promoters60/5677274
accttagaatt

SEQ ID NO: 151001 - DNA, 11 bp, Unknown
  misc_feature (1)..( 11): Result.004 file - promoters60/5677274
attttataatt

SEQ ID NO: 151002 - DNA, 11 bp, Unknown
  misc_feature (1)..( 11): Result.004 file - promoters60/5677274
ttctttgaact

SEQ ID NO: 151003 - DNA, 11 bp, Unknown
  misc_feature (1)..( 11): Result.004 file - promoters60/5677274
acattataacg

SEQ ID NO: 151004 - DNA, 11 bp, Unknown
  misc_feature (1)..( 11): Result.004 file - promoters60/5677274
ttctttgcttc

SEQ ID NO: 151005 - DNA, 9 bp, Unknown
  misc_feature (1)..( 9): Result.004 file - promoters60/5677274
agatatttt

SEQ ID NO: 151006 - DNA, 9 bp, Unknown
  misc_feature (1)..( 9): Result.004 file - promoters60/5677274
aaatattta

SEQ ID NO: 151007 - DNA, 9 bp, Unknown
  misc_feature (1)..( 9): Result.004 file - promoters60/5677274
aaaaattcc

SEQ ID NO: 151008 - DNA, 9 bp, Unknown
  misc_feature (1)..( 9): Result.004 file - promoters60/5677274
agataatta

SEQ ID NO: 151009 - DNA, 9 bp, Unknown
  misc_feature (1)..( 9): Result.004 file - promoters60/5677274
agaaaatct

SEQ ID NO: 151010 - DNA, 11 bp, Unknown
  misc_feature (1)..( 11): Result.004 file - promoters60/5677274
tgaaacataaa

SEQ ID NO: 151011 - DNA, 11 bp, Unknown
  misc_feature (1)..( 11): Result.004 file - promoters60/5677274
ttcaacataat

SEQ ID NO: 151012 - DNA, 11 bp, Unknown
  misc_feature (1)..( 11): Result.004 file - promoters60/5677274
tgacacataac

SEQ ID NO: 151013 - DNA, 11 bp, Unknown
  misc_feature (1)..( 11): Result.004 file - promoters60/5677274
tagtacatata

SEQ ID NO: 151014 - DNA, 11 bp, Unknown
  misc_feature (1)..( 11): Result.004 file - promoters60/5677286
atcaacaaaat

SEQ ID NO: 151015 - DNA, 9 bp, Unknown
  misc_feature (1)..( 9): Result.004 file - promoters60/5677286
tctcaaact

SEQ ID NO: 151016 - DNA, 9 bp, Unknown
  misc_feature (1)..( 9): Result.004 file - promoters60/5677286
tctaaaaag

SEQ ID NO: 151017 - DNA, 9 bp, Unknown
  misc_feature (1)..( 9): Result.004 file - promoters60/5677286
tatcatact

SEQ ID NO: 151018 - DNA, 8 bp, Unknown
  misc_feature (1)..( 8): Result.004 file - promoters60/5677286
gagcaaaa

SEQ ID NO: 151019 - DNA, 8 bp, Unknown
  misc_feature (1)..( 8): Result.004 file - promoters60/5677286
gagaaaaa

SEQ ID NO: 151020 - DNA, 8 bp, Unknown
  misc_feature (1)..( 8): Result.004 file - promoters60/5677333
gagcaatg

SEQ ID NO: 151021 - DNA, 6 bp, Unknown
  misc_feature (1)..( 6): Result.004 file - promoters60/5677333
ttgtca

SEQ ID NO: 151022 - DNA, 6 bp, Unknown
  misc_feature (1)..( 6): Result.004 file - promoters60/5677333
ttgtca

SEQ ID NO: 151023 - DNA, 9 bp, Unknown
  misc_feature (1)..( 9): Result.004 file - promoters60/5677333
agatttctg

SEQ ID NO: 151024 - DNA, 9 bp, Unknown
  misc_feature (1)..( 9): Result.004 file - promoters60/5677333
agagttctg

SEQ ID NO: 151025 - DNA, 8 bp, Unknown
  misc_feature (1)..( 8): Result.004 file - promoters60/5677333
ctgtacaa

SEQ ID NO: 151026 - DNA, 8 bp, Unknown
  misc_feature (1)..( 8): Result.004 file - promoters60/5677333
ctgtacaa

SEQ ID NO: 151027 - DNA, 6 bp, Unknown
  misc_feature (1)..( 6): Result.004 file - promoters60/5677333
ccaaga

SEQ ID NO: 151028 - DNA, 6 bp, Unknown
  misc_feature (1)..( 6): Result.004 file - promoters60/5677333
ccaaga

SEQ ID NO: 151029 - DNA, 6 bp, Unknown
  misc_feature (1)..( 6): Result.004 file - promoters60/5677333
ggttga

SEQ ID NO: 151030 - DNA, 6 bp, Unknown
  misc_feature (1)..( 6): Result.004 file - promoters60/5677344
ggttga

SEQ ID NO: 151031 - DNA, 10 bp, Unknown
  misc_feature (1)..( 10): Result.004 file - promoters60/5677344
caaaaataag

SEQ ID NO: 151032 - DNA, 10 bp, Unknown
  misc_feature (1)..( 10): Result.004 file - promoters60/5677344
aaaaaatcgt

SEQ ID NO: 151033 - DNA, 10 bp, Unknown
  misc_feature (1)..( 10): Result.004 file - promoters60/5677344
taaacatatt

SEQ ID NO: 151034 - DNA, 10 bp, Unknown
  misc_feature (1)..( 10): Result.004 file - promoters60/5677344
ccaaaataaa

SEQ ID NO: 151035 - DNA, 10 bp, Unknown
  misc_feature (1)..( 10): Result.004 file - promoters60/5677344
tcaaattaaa

SEQ ID NO: 151036 - DNA, 10 bp, Unknown
  misc_feature (1)..( 10): Result.004 file - promoters60/5677344
ctaaaatcaa

SEQ ID NO: 151037 - DNA, 10 bp, Unknown
  misc_feature (1)..( 10): Result.004 file - promoters60/5677344
ccaaaattga

SEQ ID NO: 151038 - DNA, 10 bp, Unknown
  misc_feature (1)..( 10): Result.004 file - promoters60/5677344
gacaaataaa

SEQ ID NO: 151039 - DNA, 9 bp, Unknown
  misc_feature (1)..( 9): Result.004 file - promoters60/5677344
taagattag

SEQ ID NO: 151040 - DNA, 9 bp, Unknown
  misc_feature (1)..( 9): Result.004 file - promoters60/5677344
taaaattcc

SEQ ID NO: 151041 - DNA, 9 bp, Unknown
  misc_feature (1)..( 9): Result.004 file - promoters60/5677344
taaaatttc

SEQ ID NO: 151042 - DNA, 9 bp, Unknown
  misc_feature (1)..( 9): Result.004 file - promoters60/5677344
taaaatttt

SEQ ID NO: 151043 - DNA, 9 bp, Unknown
  misc_feature (1)..( 9): Result.004 file - promoters60/5677344
caaaattga

SEQ ID NO: 151044 - DNA, 9 bp, Unknown
  misc_feature (1)..( 9): Result.004 file - promoters60/5677344
taaaataac

SEQ ID NO: 151045 - DNA, 9 bp, Unknown
  misc_feature (1)..( 9): Result.004 file - promoters60/5677344
tcaaattaa

SEQ ID NO: 151046 - DNA, 11 bp, Unknown
  misc_feature (1)..( 11): Result.004 file - promoters60/5677344
atttatttcgg

SEQ ID NO: 151047 - DNA, 11 bp, Unknown
  misc_feature (1)..( 11): Result.004 file - promoters60/5677344
attcattttaa

SEQ ID NO: 151048 - DNA, 11 bp, Unknown
  misc_feature (1)..( 11): Result.004 file - promoters60/5677344
ttttattctat

SEQ ID NO: 151049 - DNA, 12 bp, Unknown
  misc_feature (1)..( 12): Result.004 file - promoters60/5677344
ggtcaatttgaa

SEQ ID NO: 151050 - DNA, 12 bp, Unknown
  misc_feature (1)..( 12): Result.004 file - promoters60/5677344
atttcatttcca

SEQ ID NO: 151051 - DNA, 12 bp, Unknown
  misc_feature (1)..( 12): Result.004 file - promoters60/5677344
tacaaatatgaa

SEQ ID NO: 151052 - DNA, 16 bp, Unknown
  misc_feature (1)..( 16): Result.004 file - promoters60/5677344
ggaaaaaaaagacaaa

SEQ ID NO: 151053 - DNA, 16 bp, Unknown
  misc_feature (1)..( 16): Result.004 file - promoters60/5677344
aaaaaaagaagaaaaa

SEQ ID NO: 151054 - DNA, 16 bp, Unknown
  misc_feature (1)..( 16): Result.004 file - promoters60/5677344
aaaccaaaacgacgtc

SEQ ID NO: 151055 - DNA, 16 bp, Unknown
  misc_feature (1)..( 16): Result.004 file - promoters60/5677344
attagaaacagacttc

SEQ ID NO: 151056 - DNA, 16 bp, Unknown
  misc_feature (1)..( 16): Result.004 file - promoters60/5677344
atttgaattggtattt

SEQ ID NO: 151057 - DNA, 16 bp, Unknown
  misc_feature (1)..( 16): Result.004 file - promoters60/5677344
attacaaatatgaaaa

SEQ ID NO: 151058 - DNA, 16 bp, Unknown
  misc_feature (1)..( 16): Result.004 file - promoters60/5677344
tagtcaaacaaatgtt

SEQ ID NO: 151059 - DNA, 10 bp, Unknown
  misc_feature (1)..( 10): Result.004 file - promoters60/5677344
caaaaataag

SEQ ID NO: 151060 - DNA, 10 bp, Unknown
  misc_feature (1)..( 10): Result.004 file - promoters60/5677344
gacaaataaa

SEQ ID NO: 151061 - DNA, 10 bp, Unknown
  misc_feature (1)..( 10): Result.004 file - promoters60/5677344
ccaaaataaa

SEQ ID NO: 151062 - DNA, 10 bp, Unknown
  misc_feature (1)..( 10): Result.004 file - promoters60/5677344
tcaaattaaa

SEQ ID NO: 151063 - DNA, 10 bp, Unknown
  misc_feature (1)..( 10): Result.004 file - promoters60/5677344
ccaaaatcag

SEQ ID NO: 151064 - DNA, 10 bp, Unknown
  misc_feature (1)..( 10): Result.004 file - promoters60/5677344
gacaaataaa

SEQ ID NO: 151065 - DNA, 10 bp, Unknown
  misc_feature (1)..( 10): Result.004 file - promoters60/5677344
tttctagggt

SEQ ID NO: 151066 - DNA, 10 bp, Unknown
  misc_feature (1)..( 10): Result.004 file - promoters60/5677344
tttctatgtg

SEQ ID NO: 151067 - DNA, 10 bp, Unknown
  misc_feature (1)..( 10): Result.004 file - promoters60/5677344
tttttataat

SEQ ID NO: 151068 - DNA, 10 bp, Unknown
  misc_feature (1)..( 10): Result.004 file - promoters60/5677344
tttgtatcca

SEQ ID NO: 151069 - DNA, 10 bp, Unknown
  misc_feature (1)..( 10): Result.004 file - promoters60/5677344
aatttattgt

SEQ ID NO: 151070 - DNA, 10 bp, Unknown
  misc_feature (1)..( 10): Result.004 file - promoters60/5677484
tatttattta

SEQ ID NO: 151071 - DNA, 7 bp, Unknown
  misc_feature (1)..( 7): Result.004 file - promoters60/5677484
attaaat

SEQ ID NO: 151072 - DNA, 7 bp, Unknown
  misc_feature (1)..( 7): Result.004 file - promoters60/5677484
attaaat

SEQ ID NO: 151073 - DNA, 8 bp, Unknown
  misc_feature (1)..( 8): Result.004 file - promoters60/5677484
tgaaaaaa

SEQ ID NO: 151074 - DNA, 8 bp, Unknown
  misc_feature (1)..( 8): Result.004 file - promoters60/5677484
tgagaaaa

SEQ ID NO: 151075 - DNA, 8 bp, Unknown
  misc_feature (1)..( 8): Result.004 file - promoters60/5677484
attcttta

SEQ ID NO: 151076 - DNA, 8 bp, Unknown
  misc_feature (1)..( 8): Result.004 file - promoters60/5677484
attttttt

SEQ ID NO: 151077 - DNA, 8 bp, Unknown
  misc_feature (1)..( 8): Result.004 file - promoters60/5677484
tctcttta

SEQ ID NO: 151078 - DNA, 9 bp, Unknown
  misc_feature (1)..( 9): Result.004 file - promoters60/5677484
tcatattta

SEQ ID NO: 151079 - DNA, 9 bp, Unknown
  misc_feature (1)..( 9): Result.004 file - promoters60/5677484
tcatattaa

SEQ ID NO: 151080 - DNA, 9 bp, Unknown
  misc_feature (1)..( 9): Result.004 file - promoters60/5677484
ccatattta

SEQ ID NO: 151081 - DNA, 7 bp, Unknown
  misc_feature (1)..( 7): Result.004 file - promoters60/5677484
aaactaa

SEQ ID NO: 151082 - DNA, 7 bp, Unknown
  misc_feature (1)..( 7): Result.004 file - promoters60/5677484
aaaataa

SEQ ID NO: 151083 - DNA, 6 bp, Unknown
  misc_feature (1)..( 6): Result.004 file - promoters60/5677484
ttaatt

SEQ ID NO: 151084 - DNA, 6 bp, Unknown
  misc_feature (1)..( 6): Result.004 file - promoters60/5677484
ttaatt

SEQ ID NO: 151085 - DNA, 8 bp, Unknown
  misc_feature (1)..( 8): Result.004 file - promoters60/5677484
atgacata

SEQ ID NO: 151086 - DNA, 8 bp, Unknown
  misc_feature (1)..( 8): Result.004 file - promoters60/5677484
atgaaata

SEQ ID NO: 151087 - DNA, 6 bp, Unknown
  misc_feature (1)..( 6): Result.004 file - promoters60/5677484
ataaat

SEQ ID NO: 151088 - DNA, 6 bp, Unknown
  misc_feature (1)..( 6): Result.004 file - promoters60/5677484
ataaat

SEQ ID NO: 151089 - DNA, 6 bp, Unknown
  misc_feature (1)..( 6): Result.004 file - promoters60/5677484
taaatt

SEQ ID NO: 151090 - DNA, 6 bp, Unknown
  misc_feature (1)..( 6): Result.004 file - promoters60/5677484
taaatt

SEQ ID NO: 151091 - DNA, 6 bp, Unknown
  misc_feature (1)..( 6): Result.004 file - promoters60/5677484
ttatta

SEQ ID NO: 151092 - DNA, 6 bp, Unknown
  misc_feature (1)..( 6): Result.004 file - promoters60/5677484
ttatta

SEQ ID NO: 151093 - DNA, 8 bp, Unknown
  misc_feature (1)..( 8): Result.004 file - promoters60/5677484
taaactat

SEQ ID NO: 151094 - DNA, 8 bp, Unknown
  misc_feature (1)..( 8): Result.004 file - promoters60/5677484
taaaatat

SEQ ID NO: 151095 - DNA, 6 bp, Unknown
  misc_feature (1)..( 6): Result.004 file - promoters60/5677484
aacttt

SEQ ID NO: 151096 - DNA, 6 bp, Unknown
  misc_feature (1)..( 6): Result.004 file - promoters60/5677484
aacttt

SEQ ID NO: 151097 - DNA, 9 bp, Unknown
  misc_feature (1)..( 9): Result.004 file - promoters60/5677484
aaaaattaa

SEQ ID NO: 151098 - DNA, 9 bp, Unknown
  misc_feature (1)..( 9): Result.004 file - promoters60/5677484
aaaaagtaa

SEQ ID NO: 151099 - DNA, 6 bp, Unknown
  misc_feature (1)..( 6): Result.004 file - promoters60/5677484
tttaaa

SEQ ID NO: 151100 - DNA, 6 bp, Unknown
  misc_feature (1)..( 6): Result.004 file - promoters60/5677484
tttaaa

SEQ ID NO: 151101 - DNA, 13 bp, Unknown
  misc_feature (1)..( 13): Result.004 file - promoters60/5677484
ttttgcacttttt

SEQ ID NO: 151102 - DNA, 13 bp, Unknown
  misc_feature (1)..( 13): Result.004 file - promoters60/5677484
tttttcactattt

SEQ ID NO: 151103 - DNA, 7 bp, Unknown
  misc_feature (1)..( 7): Result.004 file - promoters60/5677484
aacgtaa

SEQ ID NO: 151104 - DNA, 7 bp, Unknown
  misc_feature (1)..( 7): Result.004 file - promoters60/5677484
aacttaa

SEQ ID NO: 151105 - DNA, 6 bp, Unknown
  misc_feature (1)..( 6): Result.004 file - promoters60/5677484
tgggcc

SEQ ID NO: 151106 - DNA, 6 bp, Unknown
  misc_feature (1)..( 6): Result.004 file - promoters60/5677484
tgggcc

SEQ ID NO: 151107 - DNA, 7 bp, Unknown
  misc_feature (1)..( 7): Result.004 file - promoters60/5677484
tctcgaa

SEQ ID NO: 151108 - DNA, 7 bp, Unknown
  misc_feature (1)..( 7): Result.004 file - promoters60/5677484
tcttgaa

SEQ ID NO: 151109 - DNA, 8 bp, Unknown
  misc_feature (1)..( 8): Result.004 file - promoters60/5677484
tttcattt

SEQ ID NO: 151110 - DNA, 8 bp, Unknown
  misc_feature (1)..( 8): Result.004 file - promoters60/5677484
ttttattt

SEQ ID NO: 151111 - DNA, 7 bp, Unknown
  misc_feature (1)..( 7): Result.004 file - promoters60/5677484
aataata

SEQ ID NO: 151112 - DNA, 7 bp, Unknown
  misc_feature (1)..( 7): Result.004 file - promoters60/5677484
aatgata

SEQ ID NO: 151113 - DNA, 6 bp, Unknown
  misc_feature (1)..( 6): Result.004 file - promoters60/5677484
tatttg

SEQ ID NO: 151114 - DNA, 6 bp, Unknown
  misc_feature (1)..( 6): Result.004 file - promoters60/5677484
tatttg

SEQ ID NO: 151115 - DNA, 7 bp, Unknown
  misc_feature (1)..( 7): Result.004 file - promoters60/5677484
caaaatt

SEQ ID NO: 151116 - DNA, 7 bp, Unknown
  misc_feature (1)..( 7): Result.004 file - promoters60/5680986
caaaatt

SEQ ID NO: 151117 - DNA, 8 bp, Unknown
  misc_feature (1)..( 8): Result.004 file - promoters60/5680986
attttaga

SEQ ID NO: 151118 - DNA, 8 bp, Unknown
  misc_feature (1)..( 8): Result.004 file - promoters60/5680986
ttttcaga

SEQ ID NO: 151119 - DNA, 8 bp, Unknown
  misc_feature (1)..( 8): Result.004 file - promoters60/5680986
attctaga

SEQ ID NO: 151120 - DNA, 8 bp, Unknown
  misc_feature (1)..( 8): Result.004 file - promoters60/5681068
ttttcacc

SEQ ID NO: 151121 - DNA, 6 bp, Unknown
  misc_feature (1)..( 6): Result.004 file - promoters60/5681068
cgtgga

SEQ ID NO: 151122 - DNA, 6 bp, Unknown
  misc_feature (1)..( 6): Result.004 file - promoters60/5681068
cgtgga

SEQ ID NO: 151123 - DNA, 7 bp, Unknown
  misc_feature (1)..( 7): Result.004 file - promoters60/5681068
gctaaaa

SEQ ID NO: 151124 - DNA, 7 bp, Unknown
  misc_feature (1)..( 7): Result.004 file - promoters60/5681068
gctgaaa

SEQ ID NO: 151125 - DNA, 7 bp, Unknown
  misc_feature (1)..( 7): Result.004 file - promoters60/5681068
tctgaaa

SEQ ID NO: 151126 - DNA, 6 bp, Unknown
  misc_feature (1)..( 6): Result.004 file - promoters60/5681068
attcaa

SEQ ID NO: 151127 - DNA, 6 bp, Unknown
  misc_feature (1)..( 6): Result.004 file - promoters60/5681068
attcaa

SEQ ID NO: 151128 - DNA, 9 bp, Unknown
  misc_feature (1)..( 9): Result.004 file - promoters60/5681068
tttggattt

SEQ ID NO: 151129 - DNA, 9 bp, Unknown
  misc_feature (1)..( 9): Result.004 file - promoters60/5681068
ttttgattt

SEQ ID NO: 151130 - DNA, 8 bp, Unknown
  misc_feature (1)..( 8): Result.004 file - promoters60/5681068
cacaccgt

SEQ ID NO: 151131 - DNA, 8 bp, Unknown
  misc_feature (1)..( 8): Result.004 file - promoters60/5681068
cacatcgt

SEQ ID NO: 151132 - DNA, 7 bp, Unknown
  misc_feature (1)..( 7): Result.004 file - promoters60/5681068
gtggatt

SEQ ID NO: 151133 - DNA, 7 bp, Unknown
  misc_feature (1)..( 7): Result.004 file - promoters60/5681068
gtgaatt

SEQ ID NO: 151134 - DNA, 6 bp, Unknown
  misc_feature (1)..( 6): Result.004 file - promoters60/5681068
ccgttg

SEQ ID NO: 151135 - DNA, 6 bp, Unknown
  misc_feature (1)..( 6): Result.004 file - promoters60/5681068
ccgttg

SEQ ID NO: 151136 - DNA, 6 bp, Unknown
  misc_feature (1)..( 6): Result.004 file - promoters60/5681068
atcgta

SEQ ID NO: 151137 - DNA, 6 bp, Unknown
  misc_feature (1)..( 6): Result.004 file - promoters60/5681068
atcgta

SEQ ID NO: 151138 - DNA, 6 bp, Unknown
  misc_feature (1)..( 6): Result.004 file - promoters60/5681068
agtcga

SEQ ID NO: 151139 - DNA, 6 bp, Unknown
  misc_feature (1)..( 6): Result.004 file - promoters60/5681068
agtcga

SEQ ID NO: 151140 - DNA, 9 bp, Unknown
  misc_feature (1)..( 9): Result.004 file - promoters60/5681068
gtgtcctct

SEQ ID NO: 151141 - DNA, 9 bp, Unknown
  misc_feature (1)..( 9): Result.004 file - promoters60/5681068
gtgtgctct

SEQ ID NO: 151142 - DNA, 6 bp, Unknown
  misc_feature (1)..( 6): Result.004 file - promoters60/5681068
aaccgt

SEQ ID NO: 151143 - DNA, 6 bp, Unknown
  misc_feature (1)..( 6): Result.004 file - promoters60/5681068
aaccgt

SEQ ID NO: 151144 - DNA, 7 bp, Unknown
  misc_feature (1)..( 7): Result.004 file - promoters60/5681068
aatacaa

SEQ ID NO: 151145 - DNA, 7 bp, Unknown
  misc_feature (1)..( 7): Result.004 file - promoters60/5681068
aatgcaa

SEQ ID NO: 151146 - DNA, 7 bp, Unknown
  misc_feature (1)..( 7): Result.004 file - promoters60/5681068
agatagg

SEQ ID NO: 151147 - DNA, 7 bp, Unknown
  misc_feature (1)..( 7): Result.004 file - promoters60/5681068
agaaagg

SEQ ID NO: 151148 - DNA, 7 bp, Unknown
  misc_feature (1)..( 7): Result.004 file - promoters60/5681068
ttgaaga

SEQ ID NO: 151149 - DNA, 7 bp, Unknown
  misc_feature (1)..( 7): Result.004 file - promoters60/5681068
ttgcaga

SEQ ID NO: 151150 - DNA, 7 bp, Unknown
  misc_feature (1)..( 7): Result.004 file - promoters60/5681068
cgtggat

SEQ ID NO: 151151 - DNA, 7 bp, Unknown
  misc_feature (1)..( 7): Result.004 file - promoters60/5681068
cgtggat

SEQ ID NO: 151152 - DNA, 7 bp, Unknown
  misc_feature (1)..( 7): Result.004 file - promoters60/5681068
catcgag

SEQ ID NO: 151153 - DNA, 7 bp, Unknown
  misc_feature (1)..( 7): Result.004 file - promoters60/5681068
cattgag

SEQ ID NO: 151154 - DNA, 6 bp, Unknown
  misc_feature (1)..( 6): Result.004 file - promoters60/5681068
atcgga

SEQ ID NO: 151155 - DNA, 6 bp, Unknown
  misc_feature (1)..( 6): Result.004 file - promoters60/5681068
atcgga

SEQ ID NO: 151156 - DNA, 8 bp, Unknown
  misc_feature (1)..( 8): Result.004 file - promoters60/5681068
gtaagttt

SEQ ID NO: 151157 - DNA, 8 bp, Unknown
  misc_feature (1)..( 8): Result.004 file - promoters60/5681068
gtacgttt

SEQ ID NO: 151158 - DNA, 7 bp, Unknown
  misc_feature (1)..( 7): Result.004 file - promoters60/5681068
ctacaca

SEQ ID NO: 151159 - DNA, 7 bp, Unknown
  misc_feature (1)..( 7): Result.004 file - promoters60/5681157
ctaaaca

SEQ ID NO: 151160 - DNA, 6 bp, Unknown
  misc_feature (1)..( 6): Result.004 file - promoters60/5681157
acacaa

SEQ ID NO: 151161 - DNA, 6 bp, Unknown
  misc_feature (1)..( 6): Result.004 file - promoters60/5681157
acacaa

SEQ ID NO: 151162 - DNA, 10 bp, Unknown
  misc_feature (1)..( 10): Result.004 file - promoters60/5681157
accttaaaaa

SEQ ID NO: 151163 - DNA, 10 bp, Unknown
  misc_feature (1)..( 10): Result.004 file - promoters60/5681157
catttaaaat

SEQ ID NO: 151164 - DNA, 10 bp, Unknown
  misc_feature (1)..( 10): Result.004 file - promoters60/5681157
accttaaaaa

SEQ ID NO: 151165 - DNA, 8 bp, Unknown
  misc_feature (1)..( 8): Result.004 file - promoters60/5681157
ctacaaaa

SEQ ID NO: 151166 - DNA, 8 bp, Unknown
  misc_feature (1)..( 8): Result.004 file - promoters60/5681157
ctagaaaa

SEQ ID NO: 151167 - DNA, 7 bp, Unknown
  misc_feature (1)..( 7): Result.004 file - promoters60/5681157
aaataaa

SEQ ID NO: 151168 - DNA, 7 bp, Unknown
  misc_feature (1)..( 7): Result.004 file - promoters60/5681157
aaataac

SEQ ID NO: 151169 - DNA, 8 bp, Unknown
  misc_feature (1)..( 8): Result.004 file - promoters60/5681157
aaattaaa

SEQ ID NO: 151170 - DNA, 6 bp, Unknown
  misc_feature (1)..( 6): Result.004 file - promoters60/5681157
ttaaaa

SEQ ID NO: 151171 - DNA, 6 bp, Unknown
  misc_feature (1)..( 6): Result.004 file - promoters60/5681157
ttaaaa

SEQ ID NO: 151172 - DNA, 6 bp, Unknown
  misc_feature (1)..( 6): Result.004 file - promoters60/5681157
ttaaaa

SEQ ID NO: 151173 - DNA, 8 bp, Unknown
  misc_feature (1)..( 8): Result.004 file - promoters60/5681157
aaaaccat

SEQ ID NO: 151174 - DNA, 8 bp, Unknown
  misc_feature (1)..( 8): Result.004 file - promoters60/5681157
taaaccat

SEQ ID NO: 151175 - DNA, 8 bp, Unknown
  misc_feature (1)..( 8): Result.004 file - promoters60/5681157
taaaccta

SEQ ID NO: 151176 - DNA, 12 bp, Unknown
  misc_feature (1)..( 12): Result.004 file - promoters60/5681157
ataaaccaaaaa

SEQ ID NO: 151177 - DNA, 12 bp, Unknown
  misc_feature (1)..( 12): Result.004 file - promoters60/5681157
accattcaaaaa

SEQ ID NO: 151178 - DNA, 12 bp, Unknown
  misc_feature (1)..( 12): Result.004 file - promoters60/5681157
ataaacctaaat

SEQ ID NO: 151179 - DNA, 7 bp, Unknown
  misc_feature (1)..( 7): Result.004 file - promoters60/5681157
tcaaatt

SEQ ID NO: 151180 - DNA, 7 bp, Unknown
  misc_feature (1)..( 7): Result.004 file - promoters60/5681157
tcaaatt

SEQ ID NO: 151181 - DNA, 9 bp, Unknown
  misc_feature (1)..( 9): Result.004 file - promoters60/5681157
attaccaat

SEQ ID NO: 151182 - DNA, 9 bp, Unknown
  misc_feature (1)..( 9): Result.004 file - promoters60/5681157
attagcaat

SEQ ID NO: 151183 - DNA, 6 bp, Unknown
  misc_feature (1)..( 6): Result.004 file - promoters60/5681157
ggatcc

SEQ ID NO: 151184 - DNA, 6 bp, Unknown
  misc_feature (1)..( 6): Result.004 file - promoters60/5681157
ggatcc

SEQ ID NO: 151185 - DNA, 7 bp, Unknown
  misc_feature (1)..( 7): Result.004 file - promoters60/5681157
tataaat

SEQ ID NO: 151186 - DNA, 7 bp, Unknown
  misc_feature (1)..( 7): Result.004 file - promoters60/5681157
tattaat

SEQ ID NO: 151187 - DNA, 7 bp, Unknown
  misc_feature (1)..( 7): Result.004 file - promoters60/5681157
ttggaaa

SEQ ID NO: 151188 - DNA, 7 bp, Unknown
  misc_feature (1)..( 7): Result.004 file - promoters60/5681157
ttgtaaa

SEQ ID NO: 151189 - DNA, 6 bp, Unknown
  misc_feature (1)..( 6): Result.004 file - promoters60/5681157
aaataa

SEQ ID NO: 151190 - DNA, 6 bp, Unknown
  misc_feature (1)..( 6): Result.004 file - promoters60/5681157
aaataa

SEQ ID NO: 151191 - DNA, 6 bp, Unknown
  misc_feature (1)..( 6): Result.004 file - promoters60/5681157
ttaaaa

SEQ ID NO: 151192 - DNA, 6 bp, Unknown
  misc_feature (1)..( 6): Result.004 file - promoters60/5681157
ttaaaa

SEQ ID NO: 151193 - DNA, 7 bp, Unknown
  misc_feature (1)..( 7): Result.004 file - promoters60/5681157
aaagcct

SEQ ID NO: 151194 - DNA, 7 bp, Unknown
  misc_feature (1)..( 7): Result.004 file - promoters60/5681157
aaaacct

SEQ ID NO: 151195 - DNA, 6 bp, Unknown
  misc_feature (1)..( 6): Result.004 file - promoters60/5681157
ttaaaa

SEQ ID NO: 151196 - DNA, 6 bp, Unknown
  misc_feature (1)..( 6): Result.004 file - promoters60/5681157
ttaaaa

SEQ ID NO: 151197 - DNA, 6 bp, Unknown
  misc_feature (1)..( 6): Result.004 file - promoters60/5681157
ttaaaa

SEQ ID NO: 151198 - DNA, 7 bp, Unknown
  misc_feature (1)..( 7): Result.004 file - promoters60/5681157
aaaccta

SEQ ID NO: 151199 - DNA, 7 bp, Unknown
  misc_feature (1)..( 7): Result.004 file - promoters60/5681157
aaatcta

SEQ ID NO: 151200 - DNA, 9 bp, Unknown
  misc_feature (1)..( 9): Result.004 file - promoters60/5681157
aaaatatga

SEQ ID NO: 151201 - DNA, 9 bp, Unknown
  misc_feature (1)..( 9): Result.004 file - promoters60/5681157
aaaataaac

SEQ ID NO: 151202 - DNA, 9 bp, Unknown
  misc_feature (1)..( 9): Result.004 file - promoters60/5681157
aaattaaac

SEQ ID NO: 151203 - DNA, 6 bp, Unknown
  misc_feature (1)..( 6): Result.004 file - promoters60/5681157
ccaaaa

SEQ ID NO: 151204 - DNA, 6 bp, Unknown
  misc_feature (1)..( 6): Result.004 file - promoters60/5681157
ccaaaa

SEQ ID NO: 151205 - DNA, 6 bp, Unknown
  misc_feature (1)..( 6): Result.004 file - promoters60/5681157
ccaaaa

SEQ ID NO: 151206 - DNA, 6 bp, Unknown
  misc_feature (1)..( 6): Result.004 file - promoters60/5681157
ccaaaa

SEQ ID NO: 151207 - DNA, 7 bp, Unknown
  misc_feature (1)..( 7): Result.004 file - promoters60/5681157
aaattca

SEQ ID NO: 151208 - DNA, 7 bp, Unknown
  misc_feature (1)..( 7): Result.004 file - promoters60/5681157
aaaatca

SEQ ID NO: 151209 - DNA, 7 bp, Unknown
  misc_feature (1)..( 7): Result.004 file - promoters60/5681157
tcataaa

SEQ ID NO: 151210 - DNA, 7 bp, Unknown
  misc_feature (1)..( 7): Result.004 file - promoters60/5681157
tcataaa

SEQ ID NO: 151211 - DNA, 10 bp, Unknown
  misc_feature (1)..( 10): Result.004 file - promoters60/5681157
caataattca

SEQ ID NO: 151212 - DNA, 10 bp, Unknown
  misc_feature (1)..( 10): Result.004 file - promoters60/5681157
caaaaattca

SEQ ID NO: 151213 - DNA, 10 bp, Unknown
  misc_feature (1)..( 10): Result.004 file - promoters60/5681157
aatgtattat

SEQ ID NO: 151214 - DNA, 10 bp, Unknown
  misc_feature (1)..( 10): Result.004 file - promoters60/5681157
tttgtaatat

SEQ ID NO: 151215 - DNA, 10 bp, Unknown
  misc_feature (1)..( 10): Result.004 file - promoters60/5681157
tttttaaaaa

SEQ ID NO: 151216 - DNA, 7 bp, Unknown
  misc_feature (1)..( 7): Result.004 file - promoters60/5681157
aattggt

SEQ ID NO: 151217 - DNA, 7 bp, Unknown
  misc_feature (1)..( 7): Result.004 file - promoters60/5681157
aattggt

SEQ ID NO: 151218 - DNA, 6 bp, Unknown
  misc_feature (1)..( 6): Result.004 file - promoters60/5681157
atatga

SEQ ID NO: 151219 - DNA, 6 bp, Unknown
  misc_feature (1)..( 6): Result.004 file - promoters60/5681157
atatga

SEQ ID NO: 151220 - DNA, 15 bp, Unknown
  misc_feature (1)..( 15): Result.004 file - promoters60/5681157
ttttttttgttttcc

SEQ ID NO: 151221 - DNA, 15 bp, Unknown
  misc_feature (1)..( 15): Result.004 file - promoters60/5681157
ttttctttcttttcc

SEQ ID NO: 151222 - DNA, 7 bp, Unknown
  misc_feature (1)..( 7): Result.004 file - promoters60/5681157
acacaat

SEQ ID NO: 151223 - DNA, 7 bp, Unknown
  misc_feature (1)..( 7): Result.004 file - promoters60/5681157
acacaat

SEQ ID NO: 151224 - DNA, 7 bp, Unknown
  misc_feature (1)..( 7): Result.004 file - promoters60/5681157
caaaaat

SEQ ID NO: 151225 - DNA, 7 bp, Unknown
  misc_feature (1)..( 7): Result.004 file - promoters60/5681157
caataat

SEQ ID NO: 151226 - DNA, 6 bp, Unknown
  misc_feature (1)..( 6): Result.004 file - promoters60/5681157
gttttt

SEQ ID NO: 151227 - DNA, 6 bp, Unknown
  misc_feature (1)..( 6): Result.004 file - promoters60/5681157
gttttt

SEQ ID NO: 151228 - DNA, 7 bp, Unknown
  misc_feature (1)..( 7): Result.004 file - promoters60/5681157
tattatt

SEQ ID NO: 151229 - DNA, 7 bp, Unknown
  misc_feature (1)..( 7): Result.004 file - promoters60/5681157
tattatt

SEQ ID NO: 151230 - DNA, 9 bp, Unknown
  misc_feature (1)..( 9): Result.004 file - promoters60/5681157
tcatatttt

SEQ ID NO: 151231 - DNA, 9 bp, Unknown
  misc_feature (1)..( 9): Result.004 file - promoters60/5681157
tcatacttt

SEQ ID NO: 151232 - DNA, 8 bp, Unknown
  misc_feature (1)..( 8): Result.004 file - promoters60/5681157
gttacatc

SEQ ID NO: 151233 - DNA, 8 bp, Unknown
  misc_feature (1)..( 8): Result.004 file - promoters60/5753942
gttaaatc

SEQ ID NO: 151234 - DNA, 9 bp, Unknown
  misc_feature (1)..( 9): Result.004 file - promoters60/5753942
acaattgta

SEQ ID NO: 151235 - DNA, 9 bp, Unknown
  misc_feature (1)..( 9): Result.004 file - promoters60/5753942
tacattgta

SEQ ID NO: 151236 - DNA, 9 bp, Unknown
  misc_feature (1)..( 9): Result.004 file - promoters60/5753942
caaattgta

SEQ ID NO: 151237 - DNA, 9 bp, Unknown
  misc_feature (1)..( 9): Result.004 file - promoters60/5753942
taccttgtt

SEQ ID NO: 151238 - DNA, 9 bp, Unknown
  misc_feature (1)..( 9): Result.004 file - promoters60/5753942
caaacaaaa

SEQ ID NO: 151239 - DNA, 9 bp, Unknown
  misc_feature (1)..( 9): Result.004 file - promoters60/5753942
gaaacaaag

SEQ ID NO: 151240 - DNA, 9 bp, Unknown
  misc_feature (1)..( 9): Result.004 file - promoters60/5753942
taaagaaaa

SEQ ID NO: 151241 - DNA, 9 bp, Unknown
  misc_feature (1)..( 9): Result.004 file - promoters60/5753942
caatcaaat

SEQ ID NO: 151242 - DNA, 9 bp, Unknown
  misc_feature (1)..( 9): Result.004 file - promoters60/5753942
caaccaaca

SEQ ID NO: 151243 - DNA, 8 bp, Unknown
  misc_feature (1)..( 8): Result.004 file - promoters60/5753942
tttcaggg

SEQ ID NO: 151244 - DNA, 8 bp, Unknown
  misc_feature (1)..( 8): Result.004 file - promoters60/5753942
ttttaggc

SEQ ID NO: 151245 - DNA, 8 bp, Unknown
  misc_feature (1)..( 8): Result.004 file - promoters60/5753942
atttgggc

SEQ ID NO: 151246 - DNA, 8 bp, Unknown
  misc_feature (1)..( 8): Result.004 file - promoters60/5753942
atttggat

SEQ ID NO: 151247 - DNA, 8 bp, Unknown
  misc_feature (1)..( 8): Result.004 file - promoters60/5753942
aatttggt

SEQ ID NO: 151248 - DNA, 8 bp, Unknown
  misc_feature (1)..( 8): Result.004 file - promoters60/5753942
tatttgga

SEQ ID NO: 151249 - DNA, 8 bp, Unknown
  misc_feature (1)..( 8): Result.004 file - promoters60/5753942
aatttggg

SEQ ID NO: 151250 - DNA, 9 bp, Unknown
  misc_feature (1)..( 9): Result.004 file - promoters60/5753942
attttaggc

SEQ ID NO: 151251 - DNA, 11 bp, Unknown
  misc_feature (1)..( 11): Result.004 file - promoters60/5753942
tttgtgttttt

SEQ ID NO: 151252 - DNA, 11 bp, Unknown
  misc_feature (1)..( 11): Result.004 file - promoters60/5753942
gatgtcttttt

SEQ ID NO: 151253 - DNA, 11 bp, Unknown
  misc_feature (1)..( 11): Result.004 file - promoters60/5753942
tttgggttcct

SEQ ID NO: 151254 - DNA, 11 bp, Unknown
  misc_feature (1)..( 11): Result.004 file - promoters60/5754134
tttggggttaa

SEQ ID NO: 151255 - DNA, 12 bp, Unknown
  misc_feature (1)..( 12): Result.004 file - promoters60/5754134
gcaatctggatg

SEQ ID NO: 151256 - DNA, 12 bp, Unknown
  misc_feature (1)..( 12): Result.004 file - promoters60/5754134
tgggcctgcatg

SEQ ID NO: 151257 - DNA, 12 bp, Unknown
  misc_feature (1)..( 12): Result.004 file - promoters60/5754134
gaaatatggata

SEQ ID NO: 151258 - DNA, 12 bp, Unknown
  misc_feature (1)..( 12): Result.004 file - promoters60/5754134
gaggtcttgatt

SEQ ID NO: 151259 - DNA, 12 bp, Unknown
  misc_feature (1)..( 12): Result.004 file - promoters60/5754265
gaaatatgacac

SEQ ID NO: 151260 - DNA, 12 bp, Unknown
  misc_feature (1)..( 12): Result.004 file - promoters60/5754265
tttaattagtcc

SEQ ID NO: 151261 - DNA, 12 bp, Unknown
  misc_feature (1)..( 12): Result.004 file - promoters60/5754265
gttatttatttt

SEQ ID NO: 151262 - DNA, 12 bp, Unknown
  misc_feature (1)..( 12): Result.004 file - promoters60/5754265
tttaatcaatca

SEQ ID NO: 151263 - DNA, 13 bp, Unknown
  misc_feature (1)..( 13): Result.004 file - promoters60/5754265
ctaaatataaacc

SEQ ID NO: 151264 - DNA, 13 bp, Unknown
  misc_feature (1)..( 13): Result.004 file - promoters60/5754265
agagatttactca

SEQ ID NO: 151265 - DNA, 13 bp, Unknown
  misc_feature (1)..( 13): Result.004 file - promoters60/5754265
gaataactttatc

SEQ ID NO: 151266 - DNA, 13 bp, Unknown
  misc_feature (1)..( 13): Result.004 file - promoters60/5754265
acctaacttttga

SEQ ID NO: 151267 - DNA, 13 bp, Unknown
  misc_feature (1)..( 13): Result.004 file - promoters60/5754265
caatcacttcatc

SEQ ID NO: 151268 - DNA, 13 bp, Unknown
  misc_feature (1)..( 13): Result.004 file - promoters60/5754265
atataactctgca

SEQ ID NO: 151269 - DNA, 13 bp, Unknown
  misc_feature (1)..( 13): Result.004 file - promoters60/5754269
caaacacacattt

SEQ ID NO: 151270 - DNA, 7 bp, Unknown
  misc_feature (1)..( 7): Result.004 file - promoters60/5754269
aatttaa

SEQ ID NO: 151271 - DNA, 7 bp, Unknown
  misc_feature (1)..( 7): Result.004 file - promoters60/5754269
aatttac

SEQ ID NO: 151272 - DNA, 7 bp, Unknown
  misc_feature (1)..( 7): Result.004 file - promoters60/5754269
aatttac

SEQ ID NO: 151273 - DNA, 9 bp, Unknown
  misc_feature (1)..( 9): Result.004 file - promoters60/5754269
aaatgttgc

SEQ ID NO: 151274 - DNA, 9 bp, Unknown
  misc_feature (1)..( 9): Result.004 file - promoters60/5754269
aaatgtgaa

SEQ ID NO: 151275 - DNA, 9 bp, Unknown
  misc_feature (1)..( 9): Result.004 file - promoters60/5754273
caatgtgaa

SEQ ID NO: 151276 - DNA, 11 bp, Unknown
  misc_feature (1)..( 11): Result.004 file - promoters60/5754273
ttagactatat

SEQ ID NO: 151277 - DNA, 11 bp, Unknown
  misc_feature (1)..( 11): Result.004 file - promoters60/5754273
ttaaactaatt

SEQ ID NO: 151278 - DNA, 11 bp, Unknown
  misc_feature (1)..( 11): Result.004 file - promoters60/5754273
aacaactaatt

SEQ ID NO: 151279 - DNA, 11 bp, Unknown
  misc_feature (1)..( 11): Result.004 file - promoters60/5754273
aagaactaaac

SEQ ID NO: 151280 - DNA, 12 bp, Unknown
  misc_feature (1)..( 12): Result.004 file - promoters60/5754273
agagatctaggg

SEQ ID NO: 151281 - DNA, 12 bp, Unknown
  misc_feature (1)..( 12): Result.004 file - promoters60/5754273
cagagacatcaa

SEQ ID NO: 151282 - DNA, 13 bp, Unknown
  misc_feature (1)..( 13): Result.004 file - promoters60/5754273
taggcccaacaaa

SEQ ID NO: 151283 - DNA, 13 bp, Unknown
  misc_feature (1)..( 13): Result.004 file - promoters60/5754273
aaggcccaaaact

SEQ ID NO: 151284 - DNA, 13 bp, Unknown
  misc_feature (1)..( 13): Result.004 file - promoters60/5754273
atggcccagtaaa

SEQ ID NO: 151285 - DNA, 13 bp, Unknown
  misc_feature (1)..( 13): Result.004 file - promoters60/5754273
aaagcccaaaact

SEQ ID NO: 151286 - DNA, 13 bp, Unknown
  misc_feature (1)..( 13): Result.004 file - promoters60/5754273
tcggcccaccggc

SEQ ID NO: 151287 - DNA, 13 bp, Unknown
  misc_feature (1)..( 13): Result.004 file - promoters60/5754273
aaagcccattata

SEQ ID NO: 151288 - DNA, 13 bp, Unknown
  misc_feature (1)..( 13): Result.004 file - promoters60/5754273
aaagcccattaaa

SEQ ID NO: 151289 - DNA, 13 bp, Unknown
  misc_feature (1)..( 13): Result.004 file - promoters60/5754273
aataaaaattcaa

SEQ ID NO: 151290 - DNA, 13 bp, Unknown
  misc_feature (1)..( 13): Result.004 file - promoters60/5754273
tgaaaaaatagtt

SEQ ID NO: 151291 - DNA, 13 bp, Unknown
  misc_feature (1)..( 13): Result.004 file - promoters60/5754273
caaaaaaattgtg

SEQ ID NO: 151292 - DNA, 14 bp, Unknown
  misc_feature (1)..( 14): Result.004 file - promoters60/5754273
ttcataaaatacaa

SEQ ID NO: 151293 - DNA, 13 bp, Unknown
  misc_feature (1)..( 13): Result.004 file - promoters60/5754273
cttaaagatatta

SEQ ID NO: 151294 - DNA, 14 bp, Unknown
  misc_feature (1)..( 14): Result.004 file - promoters60/5754273
tcaaacaaatacat

SEQ ID NO: 151295 - DNA, 12 bp, Unknown
  misc_feature (1)..( 12): Result.004 file - promoters60/5754273
ttcaaaaactga

SEQ ID NO: 151296 - DNA, 12 bp, Unknown
  misc_feature (1)..( 12): Result.004 file - promoters60/5754273
ttcaaaaaaatt

SEQ ID NO: 151297 - DNA, 12 bp, Unknown
  misc_feature (1)..( 12): Result.004 file - promoters60/5754273
cataaaatacaa

SEQ ID NO: 151298 - DNA, 12 bp, Unknown
  misc_feature (1)..( 12): Result.004 file - promoters60/5754273
atgaaaaaatag

SEQ ID NO: 151299 - DNA, 13 bp, Unknown
  misc_feature (1)..( 13): Result.004 file - promoters60/5754273
cttaaagatatta

SEQ ID NO: 151300 - DNA, 13 bp, Unknown
  misc_feature (1)..( 13): Result.004 file - promoters60/5754276
gtcaaacaaatac

SEQ ID NO: 151301 - DNA, 9 bp, Unknown
  misc_feature (1)..( 9): Result.004 file - promoters60/5754276
aattgatga

SEQ ID NO: 151302 - DNA, 9 bp, Unknown
  misc_feature (1)..( 9): Result.004 file - promoters60/5754276
atttggtga

SEQ ID NO: 151303 - DNA, 9 bp, Unknown
  misc_feature (1)..( 9): Result.004 file - promoters60/5754276
aatcgatct

SEQ ID NO: 151304 - DNA, 7 bp, Unknown
  misc_feature (1)..( 7): Result.004 file - promoters60/5754276
ataaatc

SEQ ID NO: 151305 - DNA, 7 bp, Unknown
  misc_feature (1)..( 7): Result.004 file - promoters60/5754276
atatatc

SEQ ID NO: 151306 - DNA, 8 bp, Unknown
  misc_feature (1)..( 8): Result.004 file - promoters60/5754276
atgaataa

SEQ ID NO: 151307 - DNA, 8 bp, Unknown
  misc_feature (1)..( 8): Result.004 file - promoters60/5754276
atgcataa

SEQ ID NO: 151308 - DNA, 7 bp, Unknown
  misc_feature (1)..( 7): Result.004 file - promoters60/5754276
ctaattg

SEQ ID NO: 151309 - DNA, 7 bp, Unknown
  misc_feature (1)..( 7): Result.004 file - promoters60/5754276
ctatttg

SEQ ID NO: 151310 - DNA, 6 bp, Unknown
  misc_feature (1)..( 6): Result.004 file - promoters60/5754276
tagcta

SEQ ID NO: 151311 - DNA, 6 bp, Unknown
  misc_feature (1)..( 6): Result.004 file - promoters60/5754276
tagcta

SEQ ID NO: 151312 - DNA, 7 bp, Unknown
  misc_feature (1)..( 7): Result.004 file - promoters60/5754276
tcaattt

SEQ ID NO: 151313 - DNA, 7 bp, Unknown
  misc_feature (1)..( 7): Result.004 file - promoters60/5754276
tcagttt

SEQ ID NO: 151314 - DNA, 6 bp, Unknown
  misc_feature (1)..( 6): Result.004 file - promoters60/5754276
atctcg

SEQ ID NO: 151315 - DNA, 6 bp, Unknown
  misc_feature (1)..( 6): Result.004 file - promoters60/5754276
atctcg

SEQ ID NO: 151316 - DNA, 6 bp, Unknown
  misc_feature (1)..( 6): Result.004 file - promoters60/5754276
ctaaat

SEQ ID NO: 151317 - DNA, 6 bp, Unknown
  misc_feature (1)..( 6): Result.004 file - promoters60/5754276
ctaaat

SEQ ID NO: 151318 - DNA, 9 bp, Unknown
  misc_feature (1)..( 9): Result.004 file - promoters60/5754276
aattaaaaa

SEQ ID NO: 151319 - DNA, 9 bp, Unknown
  misc_feature (1)..( 9): Result.004 file - promoters60/5754276
aattgaaaa

SEQ ID NO: 151320 - DNA, 9 bp, Unknown
  misc_feature (1)..( 9): Result.004 file - promoters60/5754276
cttttgtat

SEQ ID NO: 151321 - DNA, 9 bp, Unknown
  misc_feature (1)..( 9): Result.004 file - promoters60/5754276
cttttttat

SEQ ID NO: 151322 - DNA, 6 bp, Unknown
  misc_feature (1)..( 6): Result.004 file - promoters60/5754276
aaaaga

SEQ ID NO: 151323 - DNA, 6 bp, Unknown
  misc_feature (1)..( 6): Result.004 file - promoters60/5754276
aaaaga

SEQ ID NO: 151324 - DNA, 6 bp, Unknown
  misc_feature (1)..( 6): Result.004 file - promoters60/5754276
aataat

SEQ ID NO: 151325 - DNA, 6 bp, Unknown
  misc_feature (1)..( 6): Result.004 file - promoters60/5754276
aataat

SEQ ID NO: 151326 - DNA, 8 bp, Unknown
  misc_feature (1)..( 8): Result.004 file - promoters60/5754276
aaacatgt

SEQ ID NO: 151327 - DNA, 8 bp, Unknown
  misc_feature (1)..( 8): Result.004 file - promoters60/5754276
aaacatgt

SEQ ID NO: 151328 - DNA, 9 bp, Unknown
  misc_feature (1)..( 9): Result.004 file - promoters60/5754276
tttatttga

SEQ ID NO: 151329 - DNA, 9 bp, Unknown
  misc_feature (1)..( 9): Result.004 file - promoters60/5754276
tttgtttca

SEQ ID NO: 151330 - DNA, 9 bp, Unknown
  misc_feature (1)..( 9): Result.004 file - promoters60/5754276
tctatttgt

SEQ ID NO: 151331 - DNA, 6 bp, Unknown
  misc_feature (1)..( 6): Result.004 file - promoters60/5754276
actatt

SEQ ID NO: 151332 - DNA, 6 bp, Unknown
  misc_feature (1)..( 6): Result.004 file - promoters60/5754276
actatt

SEQ ID NO: 151333 - DNA, 8 bp, Unknown
  misc_feature (1)..( 8): Result.004 file - promoters60/5754276
tcttttat

SEQ ID NO: 151334 - DNA, 8 bp, Unknown
  misc_feature (1)..( 8): Result.004 file - promoters60/5754276
tctcttat

SEQ ID NO: 151335 - DNA, 6 bp, Unknown
  misc_feature (1)..( 6): Result.004 file - promoters60/5754276
tttgta

SEQ ID NO: 151336 - DNA, 6 bp, Unknown
  misc_feature (1)..( 6): Result.004 file - promoters60/5754276
tttgta

SEQ ID NO: 151337 - DNA, 6 bp, Unknown
  misc_feature (1)..( 6): Result.004 file - promoters60/5754276
tcactc

SEQ ID NO: 151338 - DNA, 6 bp, Unknown
  misc_feature (1)..( 6): Result.004 file - promoters60/5754280
tcactc

SEQ ID NO: 151339 - DNA, 11 bp, Unknown
  misc_feature (1)..( 11): Result.004 file - promoters60/5754280
cgtatatataa

SEQ ID NO: 151340 - DNA, 11 bp, Unknown
  misc_feature (1)..( 11): Result.004 file - promoters60/5754280
tttatatagat

SEQ ID NO: 151341 - DNA, 11 bp, Unknown
  misc_feature (1)..( 11): Result.004 file - promoters60/5754280
gttaaatagca

SEQ ID NO: 151342 - DNA, 11 bp, Unknown
  misc_feature (1)..( 11): Result.004 file - promoters60/5754280
aataaaaagca

SEQ ID NO: 151343 - DNA, 11 bp, Unknown
  misc_feature (1)..( 11): Result.004 file - promoters60/5754280
tttaaattgaa

SEQ ID NO: 151344 - DNA, 11 bp, Unknown
  misc_feature (1)..( 11): Result.004 file - promoters60/5754280
gttaaaatcgt

SEQ ID NO: 151345 - DNA, 11 bp, Unknown
  misc_feature (1)..( 11): Result.004 file - promoters60/5754419
aatataaaggt

SEQ ID NO: 151346 - DNA, 14 bp, Unknown
  misc_feature (1)..( 14): Result.004 file - promoters60/5754419
tctcagtgattttg

SEQ ID NO: 151347 - DNA, 14 bp, Unknown
  misc_feature (1)..( 14): Result.004 file - promoters60/5754419
atacaatgatattg

SEQ ID NO: 151348 - DNA, 14 bp, Unknown
  misc_feature (1)..( 14): Result.004 file - promoters60/5754419
ttgtaataataact

SEQ ID NO: 151349 - DNA, 14 bp, Unknown
  misc_feature (1)..( 14): Result.004 file - promoters60/5754419
aaataattatacag

SEQ ID NO: 151350 - DNA, 14 bp, Unknown
  misc_feature (1)..( 14): Result.004 file - promoters60/5754419
ataaaatgttatgc

SEQ ID NO: 151351 - DNA, 14 bp, Unknown
  misc_feature (1)..( 14): Result.004 file - promoters60/5754419
cgttattaataaat

SEQ ID NO: 151352 - DNA, 9 bp, Unknown
  misc_feature (1)..( 9): Result.004 file - promoters60/5754419
tgttctctc

SEQ ID NO: 151353 - DNA, 9 bp, Unknown
  misc_feature (1)..( 9): Result.004 file - promoters60/5754419
agctctctc

SEQ ID NO: 151354 - DNA, 9 bp, Unknown
  misc_feature (1)..( 9): Result.004 file - promoters60/5754419
gtttctctc

SEQ ID NO: 151355 - DNA, 9 bp, Unknown
  misc_feature (1)..( 9): Result.004 file - promoters60/5754419
ctttctctt

SEQ ID NO: 151356 - DNA, 9 bp, Unknown
  misc_feature (1)..( 9): Result.004 file - promoters60/5754419
agcgctctg

SEQ ID NO: 151357 - DNA, 9 bp, Unknown
  misc_feature (1)..( 9): Result.004 file - promoters60/5754419
atttgtctt

SEQ ID NO: 151358 - DNA, 10 bp, Unknown
  misc_feature (1)..( 10): Result.004 file - promoters60/5754419
aaataattat

SEQ ID NO: 151359 - DNA, 10 bp, Unknown
  misc_feature (1)..( 10): Result.004 file - promoters60/5754419
aaataagtaa

SEQ ID NO: 151360 - DNA, 10 bp, Unknown
  misc_feature (1)..( 10): Result.004 file - promoters60/5754419
aaaaaaaagt

SEQ ID NO: 151361 - DNA, 10 bp, Unknown
  misc_feature (1)..( 10): Result.004 file - promoters60/5754419
aaatgtttgc

SEQ ID NO: 151362 - DNA, 10 bp, Unknown
  misc_feature (1)..( 10): Result.004 file - promoters60/5754461
caatgttctt

SEQ ID NO: 151363 - DNA, 7 bp, Unknown
  misc_feature (1)..( 7): Result.004 file - promoters60/5754461
gaattca

SEQ ID NO: 151364 - DNA, 7 bp, Unknown
  misc_feature (1)..( 7): Result.004 file - promoters60/5754461
gaattct

SEQ ID NO: 151365 - DNA, 7 bp, Unknown
  misc_feature (1)..( 7): Result.004 file - promoters60/5754461
gaaatca

SEQ ID NO: 151366 - DNA, 7 bp, Unknown
  misc_feature (1)..( 7): Result.004 file - promoters60/5754461
aaattca

SEQ ID NO: 151367 - DNA, 12 bp, Unknown
  misc_feature (1)..( 12): Result.004 file - promoters60/5754461
cccaaaataatt

SEQ ID NO: 151368 - DNA, 12 bp, Unknown
  misc_feature (1)..( 12): Result.004 file - promoters60/5754461
aataaaataaac

SEQ ID NO: 151369 - DNA, 12 bp, Unknown
  misc_feature (1)..( 12): Result.004 file - promoters60/5754461
cccaaactaacc

SEQ ID NO: 151370 - DNA, 12 bp, Unknown
  misc_feature (1)..( 12): Result.004 file - promoters60/5755107
agaaaattaatt

SEQ ID NO: 151371 - DNA, 7 bp, Unknown
  misc_feature (1)..( 7): Result.004 file - promoters60/5755107
atgtttc

SEQ ID NO: 151372 - DNA, 7 bp, Unknown
  misc_feature (1)..( 7): Result.004 file - promoters60/5755107
gtgtttc

SEQ ID NO: 151373 - DNA, 7 bp, Unknown
  misc_feature (1)..( 7): Result.004 file - promoters60/5755107
gtgttta

SEQ ID NO: 151374 - DNA, 7 bp, Unknown
  misc_feature (1)..( 7): Result.004 file - promoters60/5755107
ggttttg

SEQ ID NO: 151375 - DNA, 7 bp, Unknown
  misc_feature (1)..( 7): Result.004 file - promoters60/5755107
ggtttta

SEQ ID NO: 151376 - DNA, 7 bp, Unknown
  misc_feature (1)..( 7): Result.004 file - promoters60/5755107
tgttttg

SEQ ID NO: 151377 - DNA, 6 bp, Unknown
  misc_feature (1)..( 6): Result.004 file - promoters60/5755107
attgga

SEQ ID NO: 151378 - DNA, 6 bp, Unknown
  misc_feature (1)..( 6): Result.004 file - promoters60/5755107
attgga

SEQ ID NO: 151379 - DNA, 6 bp, Unknown
  misc_feature (1)..( 6): Result.004 file - promoters60/5755107
attgga

SEQ ID NO: 151380 - DNA, 11 bp, Unknown
  misc_feature (1)..( 11): Result.004 file - promoters60/5755107
acaattcagcc

SEQ ID NO: 151381 - DNA, 11 bp, Unknown
  misc_feature (1)..( 11): Result.004 file - promoters60/5755107
acaattaagcc

SEQ ID NO: 151382 - DNA, 11 bp, Unknown
  misc_feature (1)..( 11): Result.004 file - promoters60/5755107
ggaatgaagat

SEQ ID NO: 151383 - DNA, 7 bp, Unknown
  misc_feature (1)..( 7): Result.004 file - promoters60/5755107
tttgata

SEQ ID NO: 151384 - DNA, 7 bp, Unknown
  misc_feature (1)..( 7): Result.004 file - promoters60/5755107
tttcata

SEQ ID NO: 151385 - DNA, 7 bp, Unknown
  misc_feature (1)..( 7): Result.004 file - promoters60/5755107
tttcatt

SEQ ID NO: 151386 - DNA, 7 bp, Unknown
  misc_feature (1)..( 7): Result.004 file - promoters60/5755107
aaacaat

SEQ ID NO: 151387 - DNA, 7 bp, Unknown
  misc_feature (1)..( 7): Result.004 file - promoters60/5755107
aaagaat

SEQ ID NO: 151388 - DNA, 7 bp, Unknown
  misc_feature (1)..( 7): Result.004 file - promoters60/5755846
aaataat

SEQ ID NO: 151389 - DNA, 10 bp, Unknown
  misc_feature (1)..( 10): Result.004 file - promoters60/5755846
ctttgatcaa

SEQ ID NO: 151390 - DNA, 10 bp, Unknown
  misc_feature (1)..( 10): Result.004 file - promoters60/5755846
attttatcaa

SEQ ID NO: 151391 - DNA, 10 bp, Unknown
  misc_feature (1)..( 10): Result.004 file - promoters60/5755846
atttgatctc

SEQ ID NO: 151392 - DNA, 10 bp, Unknown
  misc_feature (1)..( 10): Result.004 file - promoters60/5755846
gtatgatcaa

SEQ ID NO: 151393 - DNA, 10 bp, Unknown
  misc_feature (1)..( 10): Result.004 file - promoters60/5755846
attgtatgat

SEQ ID NO: 151394 - DNA, 9 bp, Unknown
  misc_feature (1)..( 9): Result.004 file - promoters60/5755846
aattttgat

SEQ ID NO: 151395 - DNA, 9 bp, Unknown
  misc_feature (1)..( 9): Result.004 file - promoters60/5755846
ttgtttgat

SEQ ID NO: 151396 - DNA, 9 bp, Unknown
  misc_feature (1)..( 9): Result.004 file - promoters60/5755846
aatgttgaa

SEQ ID NO: 151397 - DNA, 9 bp, Unknown
  misc_feature (1)..( 9): Result.004 file - promoters60/5755846
aatggtgat

SEQ ID NO: 151398 - DNA, 13 bp, Unknown
  misc_feature (1)..( 13): Result.004 file - promoters60/5755846
ctctaaaacaaaa

SEQ ID NO: 151399 - DNA, 13 bp, Unknown
  misc_feature (1)..( 13): Result.004 file - promoters60/5755846
tgtccaaacaaag

SEQ ID NO: 151400 - DNA, 14 bp, Unknown
  misc_feature (1)..( 14): Result.004 file - promoters60/5755846
tgacattacataat

SEQ ID NO: 151401 - DNA, 14 bp, Unknown
  misc_feature (1)..( 14): Result.004 file - promoters60/5755846
ctctgaaacatatg

SEQ ID NO: 151402 - DNA, 14 bp, Unknown
  misc_feature (1)..( 14): Result.004 file - promoters60/5755846
ttcttaaagaataa

SEQ ID NO: 151403 - DNA, 15 bp, Unknown
  misc_feature (1)..( 15): Result.004 file - promoters60/5755846
taaaatttatggttt

SEQ ID NO: 151404 - DNA, 15 bp, Unknown
  misc_feature (1)..( 15): Result.004 file - promoters60/5755846
taaagttttgtgttt

SEQ ID NO: 151405 - DNA, 16 bp, Unknown
  misc_feature (1)..( 16): Result.004 file - promoters60/5755846
ataagctttctgtttc

SEQ ID NO: 151406 - DNA, 16 bp, Unknown
  misc_feature (1)..( 16): Result.004 file - promoters60/5755846
aatttttttttgttta

SEQ ID NO: 151407 - DNA, 9 bp, Unknown
  misc_feature (1)..( 9): Result.004 file - promoters60/5755846
aaatataat

SEQ ID NO: 151408 - DNA, 9 bp, Unknown
  misc_feature (1)..( 9): Result.004 file - promoters60/5755846
aaatttaaa

SEQ ID NO: 151409 - DNA, 9 bp, Unknown
  misc_feature (1)..( 9): Result.004 file - promoters60/5755846
gactttaaa

SEQ ID NO: 151410 - DNA, 9 bp, Unknown
  misc_feature (1)..( 9): Result.004 file - promoters60/5755846
taatttttt

SEQ ID NO: 151411 - DNA, 9 bp, Unknown
  misc_feature (1)..( 9): Result.004 file - promoters60/5755846
ttattgttt

SEQ ID NO: 151412 - DNA, 11 bp, Unknown
  misc_feature (1)..( 11): Result.004 file - promoters60/5755846
ttttgtatgta

SEQ ID NO: 151413 - DNA, 11 bp, Unknown
  misc_feature (1)..( 11): Result.004 file - promoters60/5755846
atttgtatagt

SEQ ID NO: 151414 - DNA, 11 bp, Unknown
  misc_feature (1)..( 11): Result.004 file - promoters60/5755846
ttttgttgttg

SEQ ID NO: 151415 - DNA, 11 bp, Unknown
  misc_feature (1)..( 11): Result.004 file - promoters60/5755846
ctttgttgttg

SEQ ID NO: 151416 - DNA, 11 bp, Unknown
  misc_feature (1)..( 11): Result.004 file - promoters60/5755846
ggtttaacata

SEQ ID NO: 151417 - DNA, 11 bp, Unknown
  misc_feature (1)..( 11): Result.004 file - promoters60/5755846
tgtttaatttt

SEQ ID NO: 151418 - DNA, 11 bp, Unknown
  misc_feature (1)..( 11): Result.004 file - promoters60/5755846
attttactttt

SEQ ID NO: 151419 - DNA, 11 bp, Unknown
  misc_feature (1)..( 11): Result.004 file - promoters60/5756166
cttttcaatat

SEQ ID NO: 151420 - DNA, 9 bp, Unknown
  misc_feature (1)..( 9): Result.004 file - promoters60/5756166
aaattgtaa

SEQ ID NO: 151421 - DNA, 9 bp, Unknown
  misc_feature (1)..( 9): Result.004 file - promoters60/5756166
aaagtgttt

SEQ ID NO: 151422 - DNA, 9 bp, Unknown
  misc_feature (1)..( 9): Result.004 file - promoters60/5756166
acattttaa

SEQ ID NO: 151423 - DNA, 9 bp, Unknown
  misc_feature (1)..( 9): Result.004 file - promoters60/5756166
ctagttttt

SEQ ID NO: 151424 - DNA, 13 bp, Unknown
  misc_feature (1)..( 13): Result.004 file - promoters60/5756166
gttacaatgttta

SEQ ID NO: 151425 - DNA, 13 bp, Unknown
  misc_feature (1)..( 13): Result.004 file - promoters60/5756166
gttacaacgttta

SEQ ID NO: 151426 - DNA, 13 bp, Unknown
  misc_feature (1)..( 13): Result.004 file - promoters60/5756166
gatacaatggtaa

SEQ ID NO: 151427 - DNA, 13 bp, Unknown
  misc_feature (1)..( 13): Result.004 file - promoters60/5756166
attaaaatttatt

SEQ ID NO: 151428 - DNA, 8 bp, Unknown
  misc_feature (1)..( 8): Result.004 file - promoters60/5756166
tttcattc

SEQ ID NO: 151429 - DNA, 8 bp, Unknown
  misc_feature (1)..( 8): Result.004 file - promoters60/5756166
tttaattt

SEQ ID NO: 151430 - DNA, 8 bp, Unknown
  misc_feature (1)..( 8): Result.004 file - promoters60/5756166
attcattt

SEQ ID NO: 151431 - DNA, 9 bp, Unknown
  misc_feature (1)..( 9): Result.004 file - promoters60/5756166
tttcaattt

SEQ ID NO: 151432 - DNA, 10 bp, Unknown
  misc_feature (1)..( 10): Result.004 file - promoters60/5756166
attcatttta

SEQ ID NO: 151433 - DNA, 10 bp, Unknown
  misc_feature (1)..( 10): Result.004 file - promoters60/5756166
tttaatttta

SEQ ID NO: 151434 - DNA, 10 bp, Unknown
  misc_feature (1)..( 10): Result.004 file - promoters60/5756166
attcattttt

SEQ ID NO: 151435 - DNA, 10 bp, Unknown
  misc_feature (1)..( 10): Result.004 file - promoters60/5756166
tttcaatttg

SEQ ID NO: 151436 - DNA, 10 bp, Unknown
  misc_feature (1)..( 10): Result.004 file - promoters60/5756166
ctctctaaaa

SEQ ID NO: 151437 - DNA, 10 bp, Unknown
  misc_feature (1)..( 10): Result.004 file - promoters60/5756166
tcttcttaaa

SEQ ID NO: 151438 - DNA, 10 bp, Unknown
  misc_feature (1)..( 10): Result.004 file - promoters60/5756166
tcttgttaat

SEQ ID NO: 151439 - DNA, 10 bp, Unknown
  misc_feature (1)..( 10): Result.004 file - promoters60/5756489
acctcttaat

SEQ ID NO: 151440 - DNA, 6 bp, Unknown
  misc_feature (1)..( 6): Result.004 file - promoters60/5756489
ttcaaa

SEQ ID NO: 151441 - DNA, 6 bp, Unknown
  misc_feature (1)..( 6): Result.004 file - promoters60/5756489
ttcaaa

SEQ ID NO: 151442 - DNA, 8 bp, Unknown
  misc_feature (1)..( 8): Result.004 file - promoters60/5756489
gttgattt

SEQ ID NO: 151443 - DNA, 8 bp, Unknown
  misc_feature (1)..( 8): Result.004 file - promoters60/5756489
gttcattt

SEQ ID NO: 151444 - DNA, 8 bp, Unknown
  misc_feature (1)..( 8): Result.004 file - promoters60/5756489
ctcttccc

SEQ ID NO: 151445 - DNA, 8 bp, Unknown
  misc_feature (1)..( 8): Result.004 file - promoters60/5756489
ctcatccc

SEQ ID NO: 151446 - DNA, 6 bp, Unknown
  misc_feature (1)..( 6): Result.004 file - promoters60/5756489
actaat

SEQ ID NO: 151447 - DNA, 6 bp, Unknown
  misc_feature (1)..( 6): Result.004 file - promoters60/5756489
actaat

SEQ ID NO: 151448 - DNA, 6 bp, Unknown
  misc_feature (1)..( 6): Result.004 file - promoters60/5756489
atttac

SEQ ID NO: 151449 - DNA, 6 bp, Unknown
  misc_feature (1)..( 6): Result.004 file - promoters60/5756489
atttac

SEQ ID NO: 151450 - DNA, 6 bp, Unknown
  misc_feature (1)..( 6): Result.004 file - promoters60/5756489
gttatc

SEQ ID NO: 151451 - DNA, 6 bp, Unknown
  misc_feature (1)..( 6): Result.004 file - promoters60/5756489
gttatc

SEQ ID NO: 151452 - DNA, 7 bp, Unknown
  misc_feature (1)..( 7): Result.004 file - promoters60/5756489
attgtaa

SEQ ID NO: 151453 - DNA, 7 bp, Unknown
  misc_feature (1)..( 7): Result.004 file - promoters60/5756489
attttaa

SEQ ID NO: 151454 - DNA, 6 bp, Unknown
  misc_feature (1)..( 6): Result.004 file - promoters60/5756489
tgtaat

SEQ ID NO: 151455 - DNA, 6 bp, Unknown
  misc_feature (1)..( 6): Result.004 file - promoters60/5756489
tgtaat

SEQ ID NO: 151456 - DNA, 6 bp, Unknown
  misc_feature (1)..( 6): Result.004 file - promoters60/5756489
atacaa

SEQ ID NO: 151457 - DNA, 6 bp, Unknown
  misc_feature (1)..( 6): Result.004 file - promoters60/5756489
atacaa

SEQ ID NO: 151458 - DNA, 6 bp, Unknown
  misc_feature (1)..( 6): Result.004 file - promoters60/5756489
tttaca

SEQ ID NO: 151459 - DNA, 6 bp, Unknown
  misc_feature (1)..( 6): Result.004 file - promoters60/5756489
tttaca

SEQ ID NO: 151460 - DNA, 7 bp, Unknown
  misc_feature (1)..( 7): Result.004 file - promoters60/5756489
aaactct

SEQ ID NO: 151461 - DNA, 7 bp, Unknown
  misc_feature (1)..( 7): Result.004 file - promoters60/5756489
aaaatct

SEQ ID NO: 151462 - DNA, 7 bp, Unknown
  misc_feature (1)..( 7): Result.004 file - promoters60/5756489
actaaac

SEQ ID NO: 151463 - DNA, 7 bp, Unknown
  misc_feature (1)..( 7): Result.004 file - promoters60/5756489
actaaac

SEQ ID NO: 151464 - DNA, 7 bp, Unknown
  misc_feature (1)..( 7): Result.004 file - promoters60/5756489
ccaaata

SEQ ID NO: 151465 - DNA, 7 bp, Unknown
  misc_feature (1)..( 7): Result.004 file - promoters60/5756489
ccaaata

SEQ ID NO: 151466 - DNA, 6 bp, Unknown
  misc_feature (1)..( 6): Result.004 file - promoters60/5756489
ttattc

SEQ ID NO: 151467 - DNA, 6 bp, Unknown
  misc_feature (1)..( 6): Result.004 file - promoters60/5758021
ttattc

SEQ ID NO: 151468 - DNA, 12 bp, Unknown
  misc_feature (1)..( 12): Result.004 file - promoters60/5758021
tcttatgatttg

SEQ ID NO: 151469 - DNA, 12 bp, Unknown
  misc_feature (1)..( 12): Result.004 file - promoters60/5758021
tcttaggattca

SEQ ID NO: 151470 - DNA, 12 bp, Unknown
  misc_feature (1)..( 12): Result.004 file - promoters60/5758021
ttccatgttttt

SEQ ID NO: 151471 - DNA, 12 bp, Unknown
  misc_feature (1)..( 12): Result.004 file - promoters60/5758021
gtctatgctttg

SEQ ID NO: 151472 - DNA, 10 bp, Unknown
  misc_feature (1)..( 10): Result.004 file - promoters60/5758021
gttcaaaaaa

SEQ ID NO: 151473 - DNA, 10 bp, Unknown
  misc_feature (1)..( 10): Result.004 file - promoters60/5758021
attcaaaaag

SEQ ID NO: 151474 - DNA, 11 bp, Unknown
  misc_feature (1)..( 11): Result.004 file - promoters60/5758021
gttgaaagaaa

SEQ ID NO: 151475 - DNA, 11 bp, Unknown
  misc_feature (1)..( 11): Result.004 file - promoters60/5758021
ttttaaaaaaa

SEQ ID NO: 151476 - DNA, 7 bp, Unknown
  misc_feature (1)..( 7): Result.004 file - promoters60/5758021
atgggcc

SEQ ID NO: 151477 - DNA, 7 bp, Unknown
  misc_feature (1)..( 7): Result.004 file - promoters60/5758021
atgggcc

SEQ ID NO: 151478 - DNA, 7 bp, Unknown
  misc_feature (1)..( 7): Result.004 file - promoters60/5758021
ttgggcc

SEQ ID NO: 151479 - DNA, 7 bp, Unknown
  misc_feature (1)..( 7): Result.004 file - promoters60/5758021
ttgggcc

SEQ ID NO: 151480 - DNA, 11 bp, Unknown
  misc_feature (1)..( 11): Result.004 file - promoters60/5758021
atcattttttt

SEQ ID NO: 151481 - DNA, 11 bp, Unknown
  misc_feature (1)..( 11): Result.004 file - promoters60/5758021
aaaatttttct

SEQ ID NO: 151482 - DNA, 11 bp, Unknown
  misc_feature (1)..( 11): Result.004 file - promoters60/5758021
agaattttttt

SEQ ID NO: 151483 - DNA, 11 bp, Unknown
  misc_feature (1)..( 11): Result.004 file - promoters60/5759305
aaaatttgttt

SEQ ID NO: 151484 - DNA, 6 bp, Unknown
  misc_feature (1)..( 6): Result.004 file - promoters60/5759305
aatact

SEQ ID NO: 151485 - DNA, 6 bp, Unknown
  misc_feature (1)..( 6): Result.004 file - promoters60/5759305
aatact

SEQ ID NO: 151486 - DNA, 8 bp, Unknown
  misc_feature (1)..( 8): Result.004 file - promoters60/5759305
atatataa

SEQ ID NO: 151487 - DNA, 8 bp, Unknown
  misc_feature (1)..( 8): Result.004 file - promoters60/5759305
atagatat

SEQ ID NO: 151488 - DNA, 8 bp, Unknown
  misc_feature (1)..( 8): Result.004 file - promoters60/5759305
ttatataa

SEQ ID NO: 151489 - DNA, 11 bp, Unknown
  misc_feature (1)..( 11): Result.004 file - promoters60/5759305
tttgtttgttt

SEQ ID NO: 151490 - DNA, 11 bp, Unknown
  misc_feature (1)..( 11): Result.004 file - promoters60/5759305
tttctttattt

SEQ ID NO: 151491 - DNA, 7 bp, Unknown
  misc_feature (1)..( 7): Result.004 file - promoters60/5759305
attatca

SEQ ID NO: 151492 - DNA, 7 bp, Unknown
  misc_feature (1)..( 7): Result.004 file - promoters60/5759305
attctca

SEQ ID NO: 151493 - DNA, 7 bp, Unknown
  misc_feature (1)..( 7): Result.004 file - promoters60/5759305
tagaaaa

SEQ ID NO: 151494 - DNA, 7 bp, Unknown
  misc_feature (1)..( 7): Result.004 file - promoters60/5759305
tagaaaa

SEQ ID NO: 151495 - DNA, 7 bp, Unknown
  misc_feature (1)..( 7): Result.004 file - promoters60/5759305
atgtatg

SEQ ID NO: 151496 - DNA, 7 bp, Unknown
  misc_feature (1)..( 7): Result.004 file - promoters60/5759305
atggatg

SEQ ID NO: 151497 - DNA, 12 bp, Unknown
  misc_feature (1)..( 12): Result.004 file - promoters60/5759305
ttttgcaatttt

SEQ ID NO: 151498 - DNA, 12 bp, Unknown
  misc_feature (1)..( 12): Result.004 file - promoters60/5759305
taaggcaaattt

SEQ ID NO: 151499 - DNA, 12 bp, Unknown
  misc_feature (1)..( 12): Result.004 file - promoters60/5759305
taagccaaacgc

SEQ ID NO: 151500 - DNA, 8 bp, Unknown
  misc_feature (1)..( 8): Result.004 file - promoters60/5759305
tattgaaa

SEQ ID NO: 151501 - DNA, 8 bp, Unknown
  misc_feature (1)..( 8): Result.004 file - promoters60/5759305
tattaaaa

SEQ ID NO: 151502 - DNA, 10 bp, Unknown
  misc_feature (1)..( 10): Result.004 file - promoters60/5759305
tttatacaat

SEQ ID NO: 151503 - DNA, 10 bp, Unknown
  misc_feature (1)..( 10): Result.004 file - promoters60/5759305
tttatataat

SEQ ID NO: 151504 - DNA, 6 bp, Unknown
  misc_feature (1)..( 6): Result.004 file - promoters60/5759305
agaaaa

SEQ ID NO: 151505 - DNA, 6 bp, Unknown
  misc_feature (1)..( 6): Result.004 file - promoters60/5759305
agaaaa

SEQ ID NO: 151506 - DNA, 8 bp, Unknown
  misc_feature (1)..( 8): Result.004 file - promoters60/5759305
aaataata

SEQ ID NO: 151507 - DNA, 8 bp, Unknown
  misc_feature (1)..( 8): Result.004 file - promoters60/5759305
aaaaaata

SEQ ID NO: 151508 - DNA, 6 bp, Unknown
  misc_feature (1)..( 6): Result.004 file - promoters60/5759305
ctaaac

SEQ ID NO: 151509 - DNA, 6 bp, Unknown
  misc_feature (1)..( 6): Result.004 file - promoters60/5759305
ctaaac

SEQ ID NO: 151510 - DNA, 6 bp, Unknown
  misc_feature (1)..( 6): Result.004 file - promoters60/5759305
caaaat

SEQ ID NO: 151511 - DNA, 6 bp, Unknown
  misc_feature (1)..( 6): Result.004 file - promoters60/5759305
caaaat

SEQ ID NO: 151512 - DNA, 6 bp, Unknown
  misc_feature (1)..( 6): Result.004 file - promoters60/5759305
ccatac

SEQ ID NO: 151513 - DNA, 6 bp, Unknown
  misc_feature (1)..( 6): Result.004 file - promoters60/5759305
ccatac

SEQ ID NO: 151514 - DNA, 6 bp, Unknown
  misc_feature (1)..( 6): Result.004 file - promoters60/5759305
cacgtg

SEQ ID NO: 151515 - DNA, 6 bp, Unknown
  misc_feature (1)..( 6): Result.004 file - promoters60/5759305
cacgtg

SEQ ID NO: 151516 - DNA, 8 bp, Unknown
  misc_feature (1)..( 8): Result.004 file - promoters60/5759305
atgtcagc

SEQ ID NO: 151517 - DNA, 8 bp, Unknown
  misc_feature (1)..( 8): Result.004 file - promoters60/5759305
atgccagc

SEQ ID NO: 151518 - DNA, 7 bp, Unknown
  misc_feature (1)..( 7): Result.004 file - promoters60/5759305
gtgggat

SEQ ID NO: 151519 - DNA, 7 bp, Unknown
  misc_feature (1)..( 7): Result.004 file - promoters60/5759305
gtgagat

SEQ ID NO: 151520 - DNA, 7 bp, Unknown
  misc_feature (1)..( 7): Result.004 file - promoters60/5759305
gaagaga

SEQ ID NO: 151521 - DNA, 7 bp, Unknown
  misc_feature (1)..( 7): Result.004 file - promoters60/5773091
gaagaga

SEQ ID NO: 151522 - DNA, 9 bp, Unknown
  misc_feature (1)..( 9): Result.004 file - promoters60/5773091
atttgttag

SEQ ID NO: 151523 - DNA, 9 bp, Unknown
  misc_feature (1)..( 9): Result.004 file - promoters60/5773091
gtttgttgt

SEQ ID NO: 151524 - DNA, 9 bp, Unknown
  misc_feature (1)..( 9): Result.004 file - promoters60/5773091
ttttgttgt

SEQ ID NO: 151525 - DNA, 9 bp, Unknown
  misc_feature (1)..( 9): Result.004 file - promoters60/5773091
ttttgttcc

SEQ ID NO: 151526 - DNA, 10 bp, Unknown
  misc_feature (1)..( 10): Result.004 file - promoters60/5773091
tttatgtatt

SEQ ID NO: 151527 - DNA, 10 bp, Unknown
  misc_feature (1)..( 10): Result.004 file - promoters60/5773091
gaattgttcc

SEQ ID NO: 151528 - DNA, 12 bp, Unknown
  misc_feature (1)..( 12): Result.004 file - promoters60/5773091
atatatacttag

SEQ ID NO: 151529 - DNA, 12 bp, Unknown
  misc_feature (1)..( 12): Result.004 file - promoters60/5773091
ttatatagataa

SEQ ID NO: 151530 - DNA, 12 bp, Unknown
  misc_feature (1)..( 12): Result.004 file - promoters60/5773091
atataaagataa

SEQ ID NO: 151531 - DNA, 12 bp, Unknown
  misc_feature (1)..( 12): Result.004 file - promoters60/5773091
ctatataaaagc

SEQ ID NO: 151532 - DNA, 12 bp, Unknown
  misc_feature (1)..( 12): Result.004 file - promoters60/5773091
ctatttaaagct

SEQ ID NO: 151533 - DNA, 12 bp, Unknown
  misc_feature (1)..( 12): Result.004 file - promoters60/5773759
aattttaaattc

SEQ ID NO: 151534 - DNA, 10 bp, Unknown
  misc_feature (1)..( 10): Result.004 file - promoters60/5773759
ctttatttag

SEQ ID NO: 151535 - DNA, 10 bp, Unknown
  misc_feature (1)..( 10): Result.004 file - promoters60/5773759
ctttttttta

SEQ ID NO: 151536 - DNA, 10 bp, Unknown
  misc_feature (1)..( 10): Result.004 file - promoters60/5773759
acatatttag

SEQ ID NO: 151537 - DNA, 8 bp, Unknown
  misc_feature (1)..( 8): Result.004 file - promoters60/5773759
tttcgcat

SEQ ID NO: 151538 - DNA, 8 bp, Unknown
  misc_feature (1)..( 8): Result.004 file - promoters60/5773759
aatcgcat

SEQ ID NO: 151539 - DNA, 8 bp, Unknown
  misc_feature (1)..( 8): Result.004 file - promoters60/5773759
aatggcaa

SEQ ID NO: 151540 - DNA, 9 bp, Unknown
  misc_feature (1)..( 9): Result.004 file - promoters60/5773759
gtattttat

SEQ ID NO: 151541 - DNA, 9 bp, Unknown
  misc_feature (1)..( 9): Result.004 file - promoters60/5773759
aaattttaa

SEQ ID NO: 151542 - DNA, 9 bp, Unknown
  misc_feature (1)..( 9): Result.004 file - promoters60/5773759
aaactttaa

SEQ ID NO: 151543 - DNA, 12 bp, Unknown
  misc_feature (1)..( 12): Result.004 file - promoters60/5773759
tttaacaataag

SEQ ID NO: 151544 - DNA, 12 bp, Unknown
  misc_feature (1)..( 12): Result.004 file - promoters60/5773759
cttagcaataaa

SEQ ID NO: 151545 - DNA, 12 bp, Unknown
  misc_feature (1)..( 12): Result.004 file - promoters60/5773772
tttagcaaaaag

SEQ ID NO: 151546 - DNA, 8 bp, Unknown
  misc_feature (1)..( 8): Result.004 file - promoters60/5773772
gatttttt

SEQ ID NO: 151547 - DNA, 8 bp, Unknown
  misc_feature (1)..( 8): Result.004 file - promoters60/5773772
gatctttt

SEQ ID NO: 151548 - DNA, 8 bp, Unknown
  misc_feature (1)..( 8): Result.004 file - promoters60/5773772
agtttttt

SEQ ID NO: 151549 - DNA, 8 bp, Unknown
  misc_feature (1)..( 8): Result.004 file - promoters60/5773772
gatcttat

SEQ ID NO: 151550 - DNA, 9 bp, Unknown
  misc_feature (1)..( 9): Result.004 file - promoters60/5773772
aatcataaa

SEQ ID NO: 151551 - DNA, 9 bp, Unknown
  misc_feature (1)..( 9): Result.004 file - promoters60/5773772
aattatatt

SEQ ID NO: 151552 - DNA, 9 bp, Unknown
  misc_feature (1)..( 9): Result.004 file - promoters60/5773772
ctttacatt

SEQ ID NO: 151553 - DNA, 6 bp, Unknown
  misc_feature (1)..( 6): Result.004 file - promoters60/5773772
tacatt

SEQ ID NO: 151554 - DNA, 6 bp, Unknown
  misc_feature (1)..( 6): Result.004 file - promoters60/5773772
attttt

SEQ ID NO: 151555 - DNA, 6 bp, Unknown
  misc_feature (1)..( 6): Result.004 file - promoters60/5773772
attttt

SEQ ID NO: 151556 - DNA, 6 bp, Unknown
  misc_feature (1)..( 6): Result.004 file - promoters60/5773772
attttt

SEQ ID NO: 151557 - DNA, 6 bp, Unknown
  misc_feature (1)..( 6): Result.004 file - promoters60/5773772
attttt

SEQ ID NO: 151558 - DNA, 11 bp, Unknown
  misc_feature (1)..( 11): Result.004 file - promoters60/5773772
ttgattgagta

SEQ ID NO: 151559 - DNA, 11 bp, Unknown
  misc_feature (1)..( 11): Result.004 file - promoters60/5773772
ttgattcacat

SEQ ID NO: 151560 - DNA, 11 bp, Unknown
  misc_feature (1)..( 11): Result.004 file - promoters60/5773772
ttgattttcat

SEQ ID NO: 151561 - DNA, 11 bp, Unknown
  misc_feature (1)..( 11): Result.004 file - promoters60/5774545
ttgatacacat

SEQ ID NO: 151562 - DNA, 8 bp, Unknown
  misc_feature (1)..( 8): Result.004 file - promoters60/5774545
tctttact

SEQ ID NO: 151563 - DNA, 8 bp, Unknown
  misc_feature (1)..( 8): Result.004 file - promoters60/5774545
tcttcact

SEQ ID NO: 151564 - DNA, 6 bp, Unknown
  misc_feature (1)..( 6): Result.004 file - promoters60/5774545
tctaat

SEQ ID NO: 151565 - DNA, 6 bp, Unknown
  misc_feature (1)..( 6): Result.004 file - promoters60/5774545
tctaat

SEQ ID NO: 151566 - DNA, 6 bp, Unknown
  misc_feature (1)..( 6): Result.004 file - promoters60/5774545
acaagt

SEQ ID NO: 151567 - DNA, 6 bp, Unknown
  misc_feature (1)..( 6): Result.004 file - promoters60/5774545
acaagt

SEQ ID NO: 151568 - DNA, 7 bp, Unknown
  misc_feature (1)..( 7): Result.004 file - promoters60/5774545
aattcgc

SEQ ID NO: 151569 - DNA, 7 bp, Unknown
  misc_feature (1)..( 7): Result.004 file - promoters60/5774545
aatccgc

SEQ ID NO: 151570 - DNA, 10 bp, Unknown
  misc_feature (1)..( 10): Result.004 file - promoters60/5774545
tgatcttgat

SEQ ID NO: 151571 - DNA, 10 bp, Unknown
  misc_feature (1)..( 10): Result.004 file - promoters60/5774545
tgagcttgat

SEQ ID NO: 151572 - DNA, 6 bp, Unknown
  misc_feature (1)..( 6): Result.004 file - promoters60/5774545
tcaaaa

SEQ ID NO: 151573 - DNA, 6 bp, Unknown
  misc_feature (1)..( 6): Result.004 file - promoters60/5774545
tcaaaa

SEQ ID NO: 151574 - DNA, 6 bp, Unknown
  misc_feature (1)..( 6): Result.004 file - promoters60/5774545
aaaacc

SEQ ID NO: 151575 - DNA, 6 bp, Unknown
  misc_feature (1)..( 6): Result.004 file - promoters60/5774545
aaaacc

SEQ ID NO: 151576 - DNA, 8 bp, Unknown
  misc_feature (1)..( 8): Result.004 file - promoters60/5774545
tattatat

SEQ ID NO: 151577 - DNA, 8 bp, Unknown
  misc_feature (1)..( 8): Result.004 file - promoters60/5774545
tatgataa

SEQ ID NO: 151578 - DNA, 8 bp, Unknown
  misc_feature (1)..( 8): Result.004 file - promoters60/5774545
ggttatat

SEQ ID NO: 151579 - DNA, 8 bp, Unknown
  misc_feature (1)..( 8): Result.004 file - promoters60/5774545
tttataaa

SEQ ID NO: 151580 - DNA, 8 bp, Unknown
  misc_feature (1)..( 8): Result.004 file - promoters60/5774545
tttctaag

SEQ ID NO: 151581 - DNA, 8 bp, Unknown
  misc_feature (1)..( 8): Result.004 file - promoters60/5774545
aatataaa

SEQ ID NO: 151582 - DNA, 8 bp, Unknown
  misc_feature (1)..( 8): Result.004 file - promoters60/5774545
tctacgtc

SEQ ID NO: 151583 - DNA, 8 bp, Unknown
  misc_feature (1)..( 8): Result.004 file - promoters60/5774545
tctccgtc

SEQ ID NO: 151584 - DNA, 7 bp, Unknown
  misc_feature (1)..( 7): Result.004 file - promoters60/5774545
tcagcac

SEQ ID NO: 151585 - DNA, 7 bp, Unknown
  misc_feature (1)..( 7): Result.004 file - promoters60/5774545
tcaccac

SEQ ID NO: 151586 - DNA, 7 bp, Unknown
  misc_feature (1)..( 7): Result.004 file - promoters60/5774545
aatgtat

SEQ ID NO: 151587 - DNA, 7 bp, Unknown
  misc_feature (1)..( 7): Result.004 file - promoters60/5774545
aatttat

SEQ ID NO: 151588 - DNA, 6 bp, Unknown
  misc_feature (1)..( 6): Result.004 file - promoters60/5774545
tgtctt

SEQ ID NO: 151589 - DNA, 6 bp, Unknown
  misc_feature (1)..( 6): Result.004 file - promoters60/5774545
tgtctt

SEQ ID NO: 151590 - DNA, 8 bp, Unknown
  misc_feature (1)..( 8): Result.004 file - promoters60/5774545
atcagtgt

SEQ ID NO: 151591 - DNA, 8 bp, Unknown
  misc_feature (1)..( 8): Result.004 file - promoters60/5776417
atcaatgt

SEQ ID NO: 151592 - DNA, 12 bp, Unknown
  misc_feature (1)..( 12): Result.004 file - promoters60/5776417
ctttagttttgt

SEQ ID NO: 151593 - DNA, 12 bp, Unknown
  misc_feature (1)..( 12): Result.004 file - promoters60/5776417
tgttagttcaaa

SEQ ID NO: 151594 - DNA, 12 bp, Unknown
  misc_feature (1)..( 12): Result.004 file - promoters60/5776417
ttttacttttaa

SEQ ID NO: 151595 - DNA, 12 bp, Unknown
  misc_feature (1)..( 12): Result.004 file - promoters60/5776417
ttttatttttgt

SEQ ID NO: 151596 - DNA, 12 bp, Unknown
  misc_feature (1)..( 12): Result.004 file - promoters60/5776417
tttttcttgagt

SEQ ID NO: 151597 - DNA, 12 bp, Unknown
  misc_feature (1)..( 12): Result.004 file - promoters60/5776417
ttgttgttggtt

SEQ ID NO: 151598 - DNA, 12 bp, Unknown
  misc_feature (1)..( 12): Result.004 file - promoters60/5776417
ggtttgttgttg

SEQ ID NO: 151599 - DNA, 11 bp, Unknown
  misc_feature (1)..( 11): Result.004 file - promoters60/5776417
tttagttttgt

SEQ ID NO: 151600 - DNA, 11 bp, Unknown
  misc_feature (1)..( 11): Result.004 file - promoters60/5776417
aaaagtttttg

SEQ ID NO: 151601 - DNA, 11 bp, Unknown
  misc_feature (1)..( 11): Result.004 file - promoters60/5776417
tttacttttaa

SEQ ID NO: 151602 - DNA, 11 bp, Unknown
  misc_feature (1)..( 11): Result.004 file - promoters60/5776417
tttatttttgt

SEQ ID NO: 151603 - DNA, 11 bp, Unknown
  misc_feature (1)..( 11): Result.004 file - promoters60/5776417
tagggtttttt

SEQ ID NO: 151604 - DNA, 12 bp, Unknown
  misc_feature (1)..( 12): Result.004 file - promoters60/5776417
gtttgttgttgg

SEQ ID NO: 151605 - DNA, 13 bp, Unknown
  misc_feature (1)..( 13): Result.004 file - promoters60/5776417
tttagttttgtaa

SEQ ID NO: 151606 - DNA, 13 bp, Unknown
  misc_feature (1)..( 13): Result.004 file - promoters60/5776417
aaagtttttgtaa

SEQ ID NO: 151607 - DNA, 13 bp, Unknown
  misc_feature (1)..( 13): Result.004 file - promoters60/5776417
tttatttttgttg

SEQ ID NO: 151608 - DNA, 13 bp, Unknown
  misc_feature (1)..( 13): Result.004 file - promoters60/5776417
gggttttttcttg

SEQ ID NO: 151609 - DNA, 13 bp, Unknown
  misc_feature (1)..( 13): Result.004 file - promoters60/5776417
gggtttgttgttg

SEQ ID NO: 151610 - DNA, 13 bp, Unknown
  misc_feature (1)..( 13): Result.004 file - promoters60/5776425
caaatttttactt

SEQ ID NO: 151611 - DNA, 13 bp, Unknown
  misc_feature (1)..( 13): Result.004 file - promoters60/5776425
ctaaaatagtaaa

SEQ ID NO: 151612 - DNA, 13 bp, Unknown
  misc_feature (1)..( 13): Result.004 file - promoters60/5776425
aaataattgtata

SEQ ID NO: 151613 - DNA, 13 bp, Unknown
  misc_feature (1)..( 13): Result.004 file - promoters60/5776425
tcatatttgtata

SEQ ID NO: 151614 - DNA, 13 bp, Unknown
  misc_feature (1)..( 13): Result.004 file - promoters60/5776425
aaagaattgaaca

SEQ ID NO: 151615 - DNA, 10 bp, Unknown
  misc_feature (1)..( 10): Result.004 file - promoters60/5776425
gaaaaagata

SEQ ID NO: 151616 - DNA, 10 bp, Unknown
  misc_feature (1)..( 10): Result.004 file - promoters60/5776425
gaaatagatt

SEQ ID NO: 151617 - DNA, 10 bp, Unknown
  misc_feature (1)..( 10): Result.004 file - promoters60/5776425
ttagtagatt

SEQ ID NO: 151618 - DNA, 10 bp, Unknown
  misc_feature (1)..( 10): Result.004 file - promoters60/5776425
tatataaatt

SEQ ID NO: 151619 - DNA, 10 bp, Unknown
  misc_feature (1)..( 10): Result.004 file - promoters60/5776425
ttactaaaat

SEQ ID NO: 151620 - DNA, 10 bp, Unknown
  misc_feature (1)..( 10): Result.004 file - promoters60/5776425
ttattaattt

SEQ ID NO: 151621 - DNA, 11 bp, Unknown
  misc_feature (1)..( 11): Result.004 file - promoters60/5776425
gaactgaaaga

SEQ ID NO: 151622 - DNA, 11 bp, Unknown
  misc_feature (1)..( 11): Result.004 file - promoters60/5776545
ttgtataaatt

SEQ ID NO: 151623 - DNA, 9 bp, Unknown
  misc_feature (1)..( 9): Result.004 file - promoters60/5776545
cttgtattt

SEQ ID NO: 151624 - DNA, 9 bp, Unknown
  misc_feature (1)..( 9): Result.004 file - promoters60/5776545
tttgtatta

SEQ ID NO: 151625 - DNA, 9 bp, Unknown
  misc_feature (1)..( 9): Result.004 file - promoters60/5776545
tttttattt

SEQ ID NO: 151626 - DNA, 9 bp, Unknown
  misc_feature (1)..( 9): Result.004 file - promoters60/5776545
tttttactt

SEQ ID NO: 151627 - DNA, 9 bp, Unknown
  misc_feature (1)..( 9): Result.004 file - promoters60/5776545
ttttttttt

SEQ ID NO: 151628 - DNA, 9 bp, Unknown
  misc_feature (1)..( 9): Result.004 file - promoters60/5776545
tttttataa

SEQ ID NO: 151629 - DNA, 20 bp, Unknown
  misc_feature (1)..( 20): Result.004 file - promoters60/5776545
cacgttagcaaagcagctat

SEQ ID NO: 151630 - DNA, 20 bp, Unknown
  misc_feature (1)..( 20): Result.004 file - promoters60/5776545
taagatagcaacacgagatt

SEQ ID NO: 151631 - DNA, 20 bp, Unknown
  misc_feature (1)..( 20): Result.004 file - promoters60/5776545
acttttaacaaaacaattca

SEQ ID NO: 151632 - DNA, 21 bp, Unknown
  misc_feature (1)..( 21): Result.004 file - promoters60/5776545
ggttcaaacgaaaccaaaact

SEQ ID NO: 151633 - DNA, 21 bp, Unknown
  misc_feature (1)..( 21): Result.004 file - promoters60/5776545
ctttttacagttttgtattat

SEQ ID NO: 151634 - DNA, 21 bp, Unknown
  misc_feature (1)..( 21): Result.004 file - promoters60/5776545
acaaagaacttaatttttttt

SEQ ID NO: 151635 - DNA, 21 bp, Unknown
  misc_feature (1)..( 21): Result.004 file - promoters60/5776545
atttttataactaattgaacc

SEQ ID NO: 151636 - DNA, 11 bp, Unknown
  misc_feature (1)..( 11): Result.004 file - promoters60/5776545
taaataattaa

SEQ ID NO: 151637 - DNA, 11 bp, Unknown
  misc_feature (1)..( 11): Result.004 file - promoters60/5776545
gaaataacaaa

SEQ ID NO: 151638 - DNA, 11 bp, Unknown
  misc_feature (1)..( 11): Result.004 file - promoters60/5776545
aaaataaattg

SEQ ID NO: 151639 - DNA, 11 bp, Unknown
  misc_feature (1)..( 11): Result.004 file - promoters60/5776545
caaaaaaaatt

SEQ ID NO: 151640 - DNA, 11 bp, Unknown
  misc_feature (1)..( 11): Result.004 file - promoters60/5776545
caaaaatactt

SEQ ID NO: 151641 - DNA, 11 bp, Unknown
  misc_feature (1)..( 11): Result.004 file - promoters60/5776545
caaaacattga

SEQ ID NO: 151642 - DNA, 11 bp, Unknown
  misc_feature (1)..( 11): Result.004 file - promoters60/5776545
gacataaattt

SEQ ID NO: 151643 - DNA, 11 bp, Unknown
  misc_feature (1)..( 11): Result.004 file - promoters60/5776545
tgataaaataa

SEQ ID NO: 151644 - DNA, 11 bp, Unknown
  misc_feature (1)..( 11): Result.004 file - promoters60/5776545
ttcaaaaatac

SEQ ID NO: 151645 - DNA, 11 bp, Unknown
  misc_feature (1)..( 11): Result.004 file - promoters60/5776545
tctagaaataa

SEQ ID NO: 151646 - DNA, 11 bp, Unknown
  misc_feature (1)..( 11): Result.004 file - promoters60/5776545
aaaaaaaatta

SEQ ID NO: 151647 - DNA, 11 bp, Unknown
  misc_feature (1)..( 11): Result.004 file - promoters60/5776545
tataaaaattt

SEQ ID NO: 151648 - DNA, 12 bp, Unknown
  misc_feature (1)..( 12): Result.004 file - promoters60/5776545
ctcaaaacattg

SEQ ID NO: 151649 - DNA, 13 bp, Unknown
  misc_feature (1)..( 13): Result.004 file - promoters60/5776545
ccttgattaattt

SEQ ID NO: 151650 - DNA, 13 bp, Unknown
  misc_feature (1)..( 13): Result.004 file - promoters60/5776545
atgtaatttattt

SEQ ID NO: 151651 - DNA, 13 bp, Unknown
  misc_feature (1)..( 13): Result.004 file - promoters60/5776545
gtttgattaaaat

SEQ ID NO: 151652 - DNA, 13 bp, Unknown
  misc_feature (1)..( 13): Result.004 file - promoters60/5776545
aagttattaatga

SEQ ID NO: 151653 - DNA, 13 bp, Unknown
  misc_feature (1)..( 13): Result.004 file - promoters60/5776545
gtgaaatatatgc

SEQ ID NO: 151654 - DNA, 13 bp, Unknown
  misc_feature (1)..( 13): Result.004 file - promoters60/5776545
aacctatatataa

SEQ ID NO: 151655 - DNA, 13 bp, Unknown
  misc_feature (1)..( 13): Result.004 file - promoters60/5776545
gttggatagcttc

SEQ ID NO: 151656 - DNA, 10 bp, Unknown
  misc_feature (1)..( 10): Result.004 file - promoters60/5776545
ctttttaaag

SEQ ID NO: 151657 - DNA, 10 bp, Unknown
  misc_feature (1)..( 10): Result.004 file - promoters60/5776545
cttattaaag

SEQ ID NO: 151658 - DNA, 10 bp, Unknown
  misc_feature (1)..( 10): Result.004 file - promoters60/5776545
acttttaaca

SEQ ID NO: 151659 - DNA, 10 bp, Unknown
  misc_feature (1)..( 10): Result.004 file - promoters60/5776545
aattttaaaa

SEQ ID NO: 151660 - DNA, 10 bp, Unknown
  misc_feature (1)..( 10): Result.004 file - promoters60/5776545
ctttttacag

SEQ ID NO: 151661 - DNA, 10 bp, Unknown
  misc_feature (1)..( 10): Result.004 file - promoters50/1006957
atttttataa

SEQ ID NO: 151662 - DNA, 10 bp, Unknown
  misc_feature (1)..( 10): Result.004 file - promoters50/1006957
caaagtagag

SEQ ID NO: 151663 - DNA, 10 bp, Unknown
  misc_feature (1)..( 10): Result.004 file - promoters50/1006957
caaactaggc

SEQ ID NO: 151664 - DNA, 10 bp, Unknown
  misc_feature (1)..( 10): Result.004 file - promoters50/1006957
aaaacaaggc

SEQ ID NO: 151665 - DNA, 8 bp, Unknown
  misc_feature (1)..( 8): Result.004 file - promoters50/1006957
aaaaggaa

SEQ ID NO: 151666 - DNA, 8 bp, Unknown
  misc_feature (1)..( 8): Result.004 file - promoters50/1006957
gaaaggag

SEQ ID NO: 151667 - DNA, 8 bp, Unknown
  misc_feature (1)..( 8): Result.004 file - promoters50/1006965
gaaaagag

SEQ ID NO: 151668 - DNA, 9 bp, Unknown
  misc_feature (1)..( 9): Result.004 file - promoters50/1006965
cttgaagat

SEQ ID NO: 151669 - DNA, 9 bp, Unknown
  misc_feature (1)..( 9): Result.004 file - promoters50/1006965
cttggagat

SEQ ID NO: 151670 - DNA, 9 bp, Unknown
  misc_feature (1)..( 9): Result.004 file - promoters50/1006965
cgtgaagat

SEQ ID NO: 151671 - DNA, 7 bp, Unknown
  misc_feature (1)..( 7): Result.004 file - promoters50/1006965
caaaatc

SEQ ID NO: 151672 - DNA, 7 bp, Unknown
  misc_feature (1)..( 7): Result.004 file - promoters50/1006965
aaaaatc

SEQ ID NO: 151673 - DNA, 7 bp, Unknown
  misc_feature (1)..( 7): Result.004 file - promoters50/1007014
aaaaata

SEQ ID NO: 151674 - DNA, 10 bp, Unknown
  misc_feature (1)..( 10): Result.004 file - promoters50/1007014
gctaaacaag

SEQ ID NO: 151675 - DNA, 10 bp, Unknown
  misc_feature (1)..( 10): Result.004 file - promoters50/1007014
actaaaaaag

SEQ ID NO: 151676 - DNA, 10 bp, Unknown
  misc_feature (1)..( 10): Result.004 file - promoters50/1007030
acttaaaatt

SEQ ID NO: 151677 - DNA, 15 bp, Unknown
  misc_feature (1)..( 15): Result.004 file - promoters50/1007030
gggaagataaacata

SEQ ID NO: 151678 - DNA, 15 bp, Unknown
  misc_feature (1)..( 15): Result.004 file - promoters50/1007030
tcgaaaatatacagt

SEQ ID NO: 151679 - DNA, 15 bp, Unknown
  misc_feature (1)..( 15): Result.004 file - promoters50/1007030
tataaagtatttaaa

SEQ ID NO: 151680 - DNA, 15 bp, Unknown
  misc_feature (1)..( 15): Result.004 file - promoters50/1007030
tcgataatgaagaga

SEQ ID NO: 151681 - DNA, 15 bp, Unknown
  misc_feature (1)..( 15): Result.004 file - promoters50/1007030
tatattatatagagt

SEQ ID NO: 151682 - DNA, 15 bp, Unknown
  misc_feature (1)..( 15): Result.004 file - promoters50/1007030
aagaatttataaatt

SEQ ID NO: 151683 - DNA, 15 bp, Unknown
  misc_feature (1)..( 15): Result.004 file - promoters50/1007030
atccttatctagatt

SEQ ID NO: 151684 - DNA, 13 bp, Unknown
  misc_feature (1)..( 13): Result.004 file - promoters50/1007030
atcaaataataaa

SEQ ID NO: 151685 - DNA, 13 bp, Unknown
  misc_feature (1)..( 13): Result.004 file - promoters50/1007030
attttataatata

SEQ ID NO: 151686 - DNA, 13 bp, Unknown
  misc_feature (1)..( 13): Result.004 file - promoters50/1007030
tataaatagtaaa

SEQ ID NO: 151687 - DNA, 13 bp, Unknown
  misc_feature (1)..( 13): Result.004 file - promoters50/1007030
atcaaataatata

SEQ ID NO: 151688 - DNA, 13 bp, Unknown
  misc_feature (1)..( 13): Result.004 file - promoters50/1007030
ttgagatagtact

SEQ ID NO: 151689 - DNA, 13 bp, Unknown
  misc_feature (1)..( 13): Result.004 file - promoters50/1007030
aaaggataaaata

SEQ ID NO: 151690 - DNA, 13 bp, Unknown
  misc_feature (1)..( 13): Result.004 file - promoters50/1007030
aataaatagcggg

SEQ ID NO: 151691 - DNA, 13 bp, Unknown
  misc_feature (1)..( 13): Result.004 file - promoters50/1007030
tataaataattat

SEQ ID NO: 151692 - DNA, 13 bp, Unknown
  misc_feature (1)..( 13): Result.004 file - promoters50/1007030
tataaatagtaaa

SEQ ID NO: 151693 - DNA, 13 bp, Unknown
  misc_feature (1)..( 13): Result.004 file - promoters50/1007030
ttgagatagtact

SEQ ID NO: 151694 - DNA, 13 bp, Unknown
  misc_feature (1)..( 13): Result.004 file - promoters50/1007030
tataaaaagttta

SEQ ID NO: 151695 - DNA, 13 bp, Unknown
  misc_feature (1)..( 13): Result.004 file - promoters50/1007030
tatgaaaaggata

SEQ ID NO: 151696 - DNA, 10 bp, Unknown
  misc_feature (1)..( 10): Result.004 file - promoters50/1007030
aatctgcttc

SEQ ID NO: 151697 - DNA, 10 bp, Unknown
  misc_feature (1)..( 10): Result.004 file - promoters50/1007030
aatctgatgt

SEQ ID NO: 151698 - DNA, 10 bp, Unknown
  misc_feature (1)..( 10): Result.004 file - promoters50/1007030
aatcttcttc

SEQ ID NO: 151699 - DNA, 10 bp, Unknown
  misc_feature (1)..( 10): Result.004 file - promoters50/1007030
aatttgaaaa

SEQ ID NO: 151700 - DNA, 10 bp, Unknown
  misc_feature (1)..( 10): Result.004 file - promoters50/1007030
agtttaaaaa

SEQ ID NO: 151701 - DNA, 10 bp, Unknown
  misc_feature (1)..( 10): Result.004 file - promoters50/1007030
aaaaaaagaa

SEQ ID NO: 151702 - DNA, 12 bp, Unknown
  misc_feature (1)..( 12): Result.004 file - promoters50/1007030
tattcacattta

SEQ ID NO: 151703 - DNA, 12 bp, Unknown
  misc_feature (1)..( 12): Result.004 file - promoters50/1007030
ttatcaaattta

SEQ ID NO: 151704 - DNA, 12 bp, Unknown
  misc_feature (1)..( 12): Result.004 file - promoters50/1007030
ttatgaaacaga

SEQ ID NO: 151705 - DNA, 12 bp, Unknown
  misc_feature (1)..( 12): Result.004 file - promoters50/1007030
gttcaaaaatta

SEQ ID NO: 151706 - DNA, 12 bp, Unknown
  misc_feature (1)..( 12): Result.004 file - promoters50/1007030
caaaaaaaatac

SEQ ID NO: 151707 - DNA, 12 bp, Unknown
  misc_feature (1)..( 12): Result.004 file - promoters50/1007030
gacgaaaaatgt

SEQ ID NO: 151708 - DNA, 10 bp, Unknown
  misc_feature (1)..( 10): Result.004 file - promoters50/1007030
cttctttgca

SEQ ID NO: 151709 - DNA, 10 bp, Unknown
  misc_feature (1)..( 10): Result.004 file - promoters50/1007030
cttttttaaa

SEQ ID NO: 151710 - DNA, 10 bp, Unknown
  misc_feature (1)..( 10): Result.004 file - promoters50/1007030
ctttataaaa

SEQ ID NO: 151711 - DNA, 10 bp, Unknown
  misc_feature (1)..( 10): Result.004 file - promoters50/1007030
atttgttacc

SEQ ID NO: 151712 - DNA, 10 bp, Unknown
  misc_feature (1)..( 10): Result.004 file - promoters50/1007030
atttgtatcg

SEQ ID NO: 151713 - DNA, 9 bp, Unknown
  misc_feature (1)..( 9): Result.004 file - promoters50/1007030
agtataaaa

SEQ ID NO: 151714 - DNA, 10 bp, Unknown
  misc_feature (1)..( 10): Result.004 file - promoters50/1007030
actaaaataa

SEQ ID NO: 151715 - DNA, 10 bp, Unknown
  misc_feature (1)..( 10): Result.004 file - promoters50/1007030
ttagaaataa

SEQ ID NO: 151716 - DNA, 10 bp, Unknown
  misc_feature (1)..( 10): Result.004 file - promoters50/1007030
aaaaaaatac

SEQ ID NO: 151717 - DNA, 10 bp, Unknown
  misc_feature (1)..( 10): Result.004 file - promoters50/1007030
gtcaaagtaa

SEQ ID NO: 151718 - DNA, 10 bp, Unknown
  misc_feature (1)..( 10): Result.004 file - promoters50/1007030
actaaaatat

SEQ ID NO: 151719 - DNA, 10 bp, Unknown
  misc_feature (1)..( 10): Result.004 file - promoters50/1007030
tcaaaaatta

SEQ ID NO: 151720 - DNA, 8 bp, Unknown
  misc_feature (1)..( 8): Result.004 file - promoters50/1007030
taaaaaaa

SEQ ID NO: 151721 - DNA, 8 bp, Unknown
  misc_feature (1)..( 8): Result.004 file - promoters50/1007030
aaaaaaaa

SEQ ID NO: 151722 - DNA, 8 bp, Unknown
  misc_feature (1)..( 8): Result.004 file - promoters50/1007030
taaaaaac

SEQ ID NO: 151723 - DNA, 8 bp, Unknown
  misc_feature (1)..( 8): Result.004 file - promoters50/1007030
taaaaatt

SEQ ID NO: 151724 - DNA, 8 bp, Unknown
  misc_feature (1)..( 8): Result.004 file - promoters50/1007030
aaaatatt

SEQ ID NO: 151725 - DNA, 8 bp, Unknown
  misc_feature (1)..( 8): Result.004 file - promoters50/1007058
caaaaatt

SEQ ID NO: 151726 - DNA, 8 bp, Unknown
  misc_feature (1)..( 8): Result.004 file - promoters50/1007058
ggtttgat

SEQ ID NO: 151727 - DNA, 8 bp, Unknown
  misc_feature (1)..( 8): Result.004 file - promoters50/1007058
ggtatgat

SEQ ID NO: 151728 - DNA, 8 bp, Unknown
  misc_feature (1)..( 8): Result.004 file - promoters50/1007092
tgtatgaa

SEQ ID NO: 151729 - DNA, 9 bp, Unknown
  misc_feature (1)..( 9): Result.004 file - promoters50/1007092
atatctttt

SEQ ID NO: 151730 - DNA, 9 bp, Unknown
  misc_feature (1)..( 9): Result.004 file - promoters50/1007092
atatttttt

SEQ ID NO: 151731 - DNA, 9 bp, Unknown
  misc_feature (1)..( 9): Result.004 file - promoters50/1007092
aagtttttg

SEQ ID NO: 151732 - DNA, 8 bp, Unknown
  misc_feature (1)..( 8): Result.004 file - promoters50/1007092
aattgatc

SEQ ID NO: 151733 - DNA, 8 bp, Unknown
  misc_feature (1)..( 8): Result.004 file - promoters50/1007092
aattgatt

SEQ ID NO: 151734 - DNA, 8 bp, Unknown
  misc_feature (1)..( 8): Result.004 file - promoters50/1007139
gattcatt

SEQ ID NO: 151735 - DNA, 11 bp, Unknown
  misc_feature (1)..( 11): Result.004 file - promoters50/1007139
cccccacaaaa

SEQ ID NO: 151736 - DNA, 11 bp, Unknown
  misc_feature (1)..( 11): Result.004 file - promoters50/1007139
ttttaacaaaa

SEQ ID NO: 151737 - DNA, 11 bp, Unknown
  misc_feature (1)..( 11): Result.004 file - promoters50/1007139
gtataataaag

SEQ ID NO: 151738 - DNA, 12 bp, Unknown
  misc_feature (1)..( 12): Result.004 file - promoters50/1007139
tttcaaccaaaa

SEQ ID NO: 151739 - DNA, 9 bp, Unknown
  misc_feature (1)..( 9): Result.004 file - promoters50/1007139
aaagttcaa

SEQ ID NO: 151740 - DNA, 9 bp, Unknown
  misc_feature (1)..( 9): Result.004 file - promoters50/1007139
aaagttttg

SEQ ID NO: 151741 - DNA, 9 bp, Unknown
  misc_feature (1)..( 9): Result.004 file - promoters50/1007139
caagatcat

SEQ ID NO: 151742 - DNA, 9 bp, Unknown
  misc_feature (1)..( 9): Result.004 file - promoters50/1007139
caagttttg

SEQ ID NO: 151743 - DNA, 10 bp, Unknown
  misc_feature (1)..( 10): Result.004 file - promoters50/1007139
taatttatca

SEQ ID NO: 151744 - DNA, 10 bp, Unknown
  misc_feature (1)..( 10): Result.004 file - promoters50/1007139
aaatatatgt

SEQ ID NO: 151745 - DNA, 11 bp, Unknown
  misc_feature (1)..( 11): Result.004 file - promoters50/1007139
ttgatatatac

SEQ ID NO: 151746 - DNA, 11 bp, Unknown
  misc_feature (1)..( 11): Result.004 file - promoters50/1007152
gaattatatgt

SEQ ID NO: 151747 - DNA, 10 bp, Unknown
  misc_feature (1)..( 10): Result.004 file - promoters50/1007152
attttgattt

SEQ ID NO: 151748 - DNA, 10 bp, Unknown
  misc_feature (1)..( 10): Result.004 file - promoters50/1007152
attttgatta

SEQ ID NO: 151749 - DNA, 10 bp, Unknown
  misc_feature (1)..( 10): Result.004 file - promoters50/1007152
aaattgattt

SEQ ID NO: 151750 - DNA, 10 bp, Unknown
  misc_feature (1)..( 10): Result.004 file - promoters50/1007152
atttttattg

SEQ ID NO: 151751 - DNA, 10 bp, Unknown
  misc_feature (1)..( 10): Result.004 file - promoters50/1007152
gttttgacta

SEQ ID NO: 151752 - DNA, 10 bp, Unknown
  misc_feature (1)..( 10): Result.004 file - promoters50/1007152
cttttgaagt

SEQ ID NO: 151753 - DNA, 10 bp, Unknown
  misc_feature (1)..( 10): Result.004 file - promoters50/1007152
cctttgacca

SEQ ID NO: 151754 - DNA, 11 bp, Unknown
  misc_feature (1)..( 11): Result.004 file - promoters50/1007152
atctctaaacc

SEQ ID NO: 151755 - DNA, 11 bp, Unknown
  misc_feature (1)..( 11): Result.004 file - promoters50/1007152
gtctttaaacg

SEQ ID NO: 151756 - DNA, 11 bp, Unknown
  misc_feature (1)..( 11): Result.004 file - promoters50/1007152
tgcttcaaaca

SEQ ID NO: 151757 - DNA, 11 bp, Unknown
  misc_feature (1)..( 11): Result.004 file - promoters50/1007152
tatttcaaaaa

SEQ ID NO: 151758 - DNA, 11 bp, Unknown
  misc_feature (1)..( 11): Result.004 file - promoters50/1007152
tcttctaaaat

SEQ ID NO: 151759 - DNA, 12 bp, Unknown
  misc_feature (1)..( 12): Result.004 file - promoters50/1007152
atttcacaaatt

SEQ ID NO: 151760 - DNA, 13 bp, Unknown
  misc_feature (1)..( 13): Result.004 file - promoters50/1007152
tcatcttcaaaat

SEQ ID NO: 151761 - DNA, 10 bp, Unknown
  misc_feature (1)..( 10): Result.004 file - promoters50/1007152
gcttcaaaca

SEQ ID NO: 151762 - DNA, 10 bp, Unknown
  misc_feature (1)..( 10): Result.004 file - promoters50/1007152
tcttcaaaat

SEQ ID NO: 151763 - DNA, 10 bp, Unknown
  misc_feature (1)..( 10): Result.004 file - promoters50/1007152
tctttaaacg

SEQ ID NO: 151764 - DNA, 10 bp, Unknown
  misc_feature (1)..( 10): Result.004 file - promoters50/1007152
atttcaaaaa

SEQ ID NO: 151765 - DNA, 11 bp, Unknown
  misc_feature (1)..( 11): Result.004 file - promoters50/1007152
tcttctaaaat

SEQ ID NO: 151766 - DNA, 12 bp, Unknown
  misc_feature (1)..( 12): Result.004 file - promoters50/1007187
atttcacaaatt

SEQ ID NO: 151767 - DNA, 6 bp, Unknown
  misc_feature (1)..( 6): Result.004 file - promoters50/1007187
aatttt

SEQ ID NO: 151768 - DNA, 6 bp, Unknown
  misc_feature (1)..( 6): Result.004 file - promoters50/1007187
aatttt

SEQ ID NO: 151769 - DNA, 6 bp, Unknown
  misc_feature (1)..( 6): Result.004 file - promoters50/1007187
aatttt

SEQ ID NO: 151770 - DNA, 9 bp, Unknown
  misc_feature (1)..( 9): Result.004 file - promoters50/1007187
aatttattt

SEQ ID NO: 151771 - DNA, 9 bp, Unknown
  misc_feature (1)..( 9): Result.004 file - promoters50/1007187
aatttattt

SEQ ID NO: 151772 - DNA, 9 bp, Unknown
  misc_feature (1)..( 9): Result.004 file - promoters50/1007187
gatttatta

SEQ ID NO: 151773 - DNA, 9 bp, Unknown
  misc_feature (1)..( 9): Result.004 file - promoters50/1007187
aatattgca

SEQ ID NO: 151774 - DNA, 9 bp, Unknown
  misc_feature (1)..( 9): Result.004 file - promoters50/1007187
aatattttt

SEQ ID NO: 151775 - DNA, 9 bp, Unknown
  misc_feature (1)..( 9): Result.004 file - promoters50/1007187
aattttttt

SEQ ID NO: 151776 - DNA, 9 bp, Unknown
  misc_feature (1)..( 9): Result.004 file - promoters50/1007187
tgttaatct

SEQ ID NO: 151777 - DNA, 9 bp, Unknown
  misc_feature (1)..( 9): Result.004 file - promoters50/1007187
acttaatct

SEQ ID NO: 151778 - DNA, 9 bp, Unknown
  misc_feature (1)..( 9): Result.004 file - promoters50/1007187
tgttaatag

SEQ ID NO: 151779 - DNA, 7 bp, Unknown
  misc_feature (1)..( 7): Result.004 file - promoters50/1007187
tttttct

SEQ ID NO: 151780 - DNA, 7 bp, Unknown
  misc_feature (1)..( 7): Result.004 file - promoters50/1007187
tttttct

SEQ ID NO: 151781 - DNA, 7 bp, Unknown
  misc_feature (1)..( 7): Result.004 file - promoters50/1007258
gttttct

SEQ ID NO: 151782 - DNA, 8 bp, Unknown
  misc_feature (1)..( 8): Result.004 file - promoters50/1007258
atttattt

SEQ ID NO: 151783 - DNA, 8 bp, Unknown
  misc_feature (1)..( 8): Result.004 file - promoters50/1007258
attaatta

SEQ ID NO: 151784 - DNA, 8 bp, Unknown
  misc_feature (1)..( 8): Result.004 file - promoters50/1007258
cttaatta

SEQ ID NO: 151785 - DNA, 7 bp, Unknown
  misc_feature (1)..( 7): Result.004 file - promoters50/1007258
atttact

SEQ ID NO: 151786 - DNA, 7 bp, Unknown
  misc_feature (1)..( 7): Result.004 file - promoters50/1007258
atttaca

SEQ ID NO: 151787 - DNA, 7 bp, Unknown
  misc_feature (1)..( 7): Result.004 file - promoters50/1007258
ttttaca

SEQ ID NO: 151788 - DNA, 7 bp, Unknown
  misc_feature (1)..( 7): Result.004 file - promoters50/1007258
atttaat

SEQ ID NO: 151789 - DNA, 7 bp, Unknown
  misc_feature (1)..( 7): Result.004 file - promoters50/1007258
gtttaat

SEQ ID NO: 151790 - DNA, 7 bp, Unknown
  misc_feature (1)..( 7): Result.004 file - promoters50/1007258
gtttaac

SEQ ID NO: 151791 - DNA, 11 bp, Unknown
  misc_feature (1)..( 11): Result.004 file - promoters50/1007258
tctctaactaa

SEQ ID NO: 151792 - DNA, 11 bp, Unknown
  misc_feature (1)..( 11): Result.004 file - promoters50/1007258
gttctaagtaa

SEQ ID NO: 151793 - DNA, 11 bp, Unknown
  misc_feature (1)..( 11): Result.004 file - promoters50/1007258
gttttaaaatg

SEQ ID NO: 151794 - DNA, 7 bp, Unknown
  misc_feature (1)..( 7): Result.004 file - promoters50/1007258
tttttgt

SEQ ID NO: 151795 - DNA, 7 bp, Unknown
  misc_feature (1)..( 7): Result.004 file - promoters50/1007258
cttttgt

SEQ ID NO: 151796 - DNA, 7 bp, Unknown
  misc_feature (1)..( 7): Result.004 file - promoters50/1007258
tttttga

SEQ ID NO: 151797 - DNA, 7 bp, Unknown
  misc_feature (1)..( 7): Result.004 file - promoters50/1007258
gttttaa

SEQ ID NO: 151798 - DNA, 7 bp, Unknown
  misc_feature (1)..( 7): Result.004 file - promoters50/1007258
tttttaa

SEQ ID NO: 151799 - DNA, 8 bp, Unknown
  misc_feature (1)..( 8): Result.004 file - promoters50/1007258
tttgttag

SEQ ID NO: 151800 - DNA, 10 bp, Unknown
  misc_feature (1)..( 10): Result.004 file - promoters50/1007258
ttatattttt

SEQ ID NO: 151801 - DNA, 10 bp, Unknown
  misc_feature (1)..( 10): Result.004 file - promoters50/1007258
ttcgattttt

SEQ ID NO: 151802 - DNA, 10 bp, Unknown
  misc_feature (1)..( 10): Result.004 file - promoters50/1007258
ttacattttc

SEQ ID NO: 151803 - DNA, 8 bp, Unknown
  misc_feature (1)..( 8): Result.004 file - promoters50/1007258
ttttgtca

SEQ ID NO: 151804 - DNA, 8 bp, Unknown
  misc_feature (1)..( 8): Result.004 file - promoters50/1007258
ttttgttt

SEQ ID NO: 151805 - DNA, 8 bp, Unknown
  misc_feature (1)..( 8): Result.004 file - promoters50/1007269
ttttggtt

SEQ ID NO: 151806 - DNA, 13 bp, Unknown
  misc_feature (1)..( 13): Result.004 file - promoters50/1007269
gaaacgttttata

SEQ ID NO: 151807 - DNA, 13 bp, Unknown
  misc_feature (1)..( 13): Result.004 file - promoters50/1007269
tattcgttttgta

SEQ ID NO: 151808 - DNA, 13 bp, Unknown
  misc_feature (1)..( 13): Result.004 file - promoters50/1007269
taaaagtttaaaa

SEQ ID NO: 151809 - DNA, 13 bp, Unknown
  misc_feature (1)..( 13): Result.004 file - promoters50/1007269
tatttgttttctc

SEQ ID NO: 151810 - DNA, 13 bp, Unknown
  misc_feature (1)..( 13): Result.004 file - promoters50/1007269
atattgtcttctt

SEQ ID NO: 151811 - DNA, 13 bp, Unknown
  misc_feature (1)..( 13): Result.004 file - promoters50/1007269
aagacgtcatctt

SEQ ID NO: 151812 - DNA, 13 bp, Unknown
  misc_feature (1)..( 13): Result.004 file - promoters50/1007269
aaaatttgaaacg

SEQ ID NO: 151813 - DNA, 13 bp, Unknown
  misc_feature (1)..( 13): Result.004 file - promoters50/1007269
tgcagctgatacg

SEQ ID NO: 151814 - DNA, 13 bp, Unknown
  misc_feature (1)..( 13): Result.004 file - promoters50/1007269
cttcttttaaaat

SEQ ID NO: 151815 - DNA, 13 bp, Unknown
  misc_feature (1)..( 13): Result.004 file - promoters50/1007269
aaaagtttaaaat

SEQ ID NO: 151816 - DNA, 13 bp, Unknown
  misc_feature (1)..( 13): Result.004 file - promoters50/1007269
taaatcttaaaac

SEQ ID NO: 151817 - DNA, 13 bp, Unknown
  misc_feature (1)..( 13): Result.004 file - promoters50/1007269
taaattttggtta

SEQ ID NO: 151818 - DNA, 11 bp, Unknown
  misc_feature (1)..( 11): Result.004 file - promoters50/1007269
taaattttctc

SEQ ID NO: 151819 - DNA, 11 bp, Unknown
  misc_feature (1)..( 11): Result.004 file - promoters50/1007269
cttattatctt

SEQ ID NO: 151820 - DNA, 11 bp, Unknown
  misc_feature (1)..( 11): Result.004 file - promoters50/1007269
aaggttttcta

SEQ ID NO: 151821 - DNA, 11 bp, Unknown
  misc_feature (1)..( 11): Result.004 file - promoters50/1007269
cttagtattta

SEQ ID NO: 151822 - DNA, 11 bp, Unknown
  misc_feature (1)..( 11): Result.004 file - promoters50/1007269
gtttctttcta

SEQ ID NO: 151823 - DNA, 11 bp, Unknown
  misc_feature (1)..( 11): Result.004 file - promoters50/1007269
cttaggattaa

SEQ ID NO: 151824 - DNA, 9 bp, Unknown
  misc_feature (1)..( 9): Result.004 file - promoters50/1007269
aaaaaagat

SEQ ID NO: 151825 - DNA, 9 bp, Unknown
  misc_feature (1)..( 9): Result.004 file - promoters50/1007269
gaaaaagtc

SEQ ID NO: 151826 - DNA, 10 bp, Unknown
  misc_feature (1)..( 10): Result.004 file - promoters50/1007269
taaaatagat

SEQ ID NO: 151827 - DNA, 10 bp, Unknown
  misc_feature (1)..( 10): Result.004 file - promoters50/1007269
ttaaacagtt

SEQ ID NO: 151828 - DNA, 10 bp, Unknown
  misc_feature (1)..( 10): Result.004 file - promoters50/1007269
gttaatagac

SEQ ID NO: 151829 - DNA, 10 bp, Unknown
  misc_feature (1)..( 10): Result.004 file - promoters50/1007273
aacaaaagtc

SEQ ID NO: 151830 - DNA, 11 bp, Unknown
  misc_feature (1)..( 11): Result.004 file - promoters50/1007273
tggaaaagaaa

SEQ ID NO: 151831 - DNA, 11 bp, Unknown
  misc_feature (1)..( 11): Result.004 file - promoters50/1007273
tctaaaagatt

SEQ ID NO: 151832 - DNA, 11 bp, Unknown
  misc_feature (1)..( 11): Result.004 file - promoters50/1007273
cggagaagata

SEQ ID NO: 151833 - DNA, 11 bp, Unknown
  misc_feature (1)..( 11): Result.004 file - promoters50/1007273
tatcaaacaaa

SEQ ID NO: 151834 - DNA, 11 bp, Unknown
  misc_feature (1)..( 11): Result.004 file - promoters50/1007273
ggataaagatg

SEQ ID NO: 151835 - DNA, 11 bp, Unknown
  misc_feature (1)..( 11): Result.004 file - promoters50/1007273
ggataaacatg

SEQ ID NO: 151836 - DNA, 8 bp, Unknown
  misc_feature (1)..( 8): Result.004 file - promoters50/1007273
cttaaatg

SEQ ID NO: 151837 - DNA, 8 bp, Unknown
  misc_feature (1)..( 8): Result.004 file - promoters50/1007273
cttgaatc

SEQ ID NO: 151838 - DNA, 8 bp, Unknown
  misc_feature (1)..( 8): Result.004 file - promoters50/1007273
cttaaaat

SEQ ID NO: 151839 - DNA, 8 bp, Unknown
  misc_feature (1)..( 8): Result.004 file - promoters50/1007273
attggatc

SEQ ID NO: 151840 - DNA, 8 bp, Unknown
  misc_feature (1)..( 8): Result.004 file - promoters50/1007273
attggatc

SEQ ID NO: 151841 - DNA, 8 bp, Unknown
  misc_feature (1)..( 8): Result.004 file - promoters50/1007286
tttgtatc

SEQ ID NO: 151842 - DNA, 8 bp, Unknown
  misc_feature (1)..( 8): Result.004 file - promoters50/1007286
attttgtt

SEQ ID NO: 151843 - DNA, 8 bp, Unknown
  misc_feature (1)..( 8): Result.004 file - promoters50/1007286
gttttgta

SEQ ID NO: 151844 - DNA, 8 bp, Unknown
  misc_feature (1)..( 8): Result.004 file - promoters50/1007286
attttgtt

SEQ ID NO: 151845 - DNA, 14 bp, Unknown
  misc_feature (1)..( 14): Result.004 file - promoters50/1007286
aactgattgacacg

SEQ ID NO: 151846 - DNA, 14 bp, Unknown
  misc_feature (1)..( 14): Result.004 file - promoters50/1007286
aactcattttctta

SEQ ID NO: 151847 - DNA, 14 bp, Unknown
  misc_feature (1)..( 14): Result.004 file - promoters50/1007286
ctctctttttatta

SEQ ID NO: 151848 - DNA, 8 bp, Unknown
  misc_feature (1)..( 8): Result.004 file - promoters50/1007286
aattaata

SEQ ID NO: 151849 - DNA, 8 bp, Unknown
  misc_feature (1)..( 8): Result.004 file - promoters50/1007286
gatttata

SEQ ID NO: 151850 - DNA, 8 bp, Unknown
  misc_feature (1)..( 8): Result.004 file - promoters50/1007289
tttttatt

SEQ ID NO: 151851 - DNA, 12 bp, Unknown
  misc_feature (1)..( 12): Result.004 file - promoters50/1007289
ttcaatgataat

SEQ ID NO: 151852 - DNA, 12 bp, Unknown
  misc_feature (1)..( 12): Result.004 file - promoters50/1007289
aataattataaa

SEQ ID NO: 151853 - DNA, 12 bp, Unknown
  misc_feature (1)..( 12): Result.004 file - promoters50/1007289
ttcaatgactca

SEQ ID NO: 151854 - DNA, 12 bp, Unknown
  misc_feature (1)..( 12): Result.004 file - promoters50/1007289
gtgaattattcc

SEQ ID NO: 151855 - DNA, 12 bp, Unknown
  misc_feature (1)..( 12): Result.004 file - promoters50/1007289
ctatattataac

SEQ ID NO: 151856 - DNA, 12 bp, Unknown
  misc_feature (1)..( 12): Result.004 file - promoters50/1007289
tcaaataataaa

SEQ ID NO: 151857 - DNA, 12 bp, Unknown
  misc_feature (1)..( 12): Result.004 file - promoters50/1007289
atgaaatatgtc

SEQ ID NO: 151858 - DNA, 9 bp, Unknown
  misc_feature (1)..( 9): Result.004 file - promoters50/1007289
gataatacc

SEQ ID NO: 151859 - DNA, 9 bp, Unknown
  misc_feature (1)..( 9): Result.004 file - promoters50/1007289
aataatata

SEQ ID NO: 151860 - DNA, 9 bp, Unknown
  misc_feature (1)..( 9): Result.004 file - promoters50/1007289
tatattata

SEQ ID NO: 151861 - DNA, 9 bp, Unknown
  misc_feature (1)..( 9): Result.004 file - promoters50/1007289
tattttata

SEQ ID NO: 151862 - DNA, 9 bp, Unknown
  misc_feature (1)..( 9): Result.004 file - promoters50/1007289
aattatata

SEQ ID NO: 151863 - DNA, 9 bp, Unknown
  misc_feature (1)..( 9): Result.004 file - promoters50/1007289
aataataaa

SEQ ID NO: 151864 - DNA, 15 bp, Unknown
  misc_feature (1)..( 15): Result.004 file - promoters50/1007289
tatatcaatttgttt

SEQ ID NO: 151865 - DNA, 15 bp, Unknown
  misc_feature (1)..( 15): Result.004 file - promoters50/1007289
ccaatcaattttaaa

SEQ ID NO: 151866 - DNA, 14 bp, Unknown
  misc_feature (1)..( 14): Result.004 file - promoters50/1007289
ttaccaatttgtta

SEQ ID NO: 151867 - DNA, 15 bp, Unknown
  misc_feature (1)..( 15): Result.004 file - promoters50/1007289
tataacaacaaaaat

SEQ ID NO: 151868 - DNA, 15 bp, Unknown
  misc_feature (1)..( 15): Result.004 file - promoters50/1007289
atatttactttttta

SEQ ID NO: 151869 - DNA, 7 bp, Unknown
  misc_feature (1)..( 7): Result.004 file - promoters50/1007289
ttttttt

SEQ ID NO: 151870 - DNA, 15 bp, Unknown
  misc_feature (1)..( 15): Result.004 file - promoters50/1007289
gctgctaatttttgg

SEQ ID NO: 151871 - DNA, 10 bp, Unknown
  misc_feature (1)..( 10): Result.004 file - promoters50/1007289
ggatttgtat

SEQ ID NO: 151872 - DNA, 11 bp, Unknown
  misc_feature (1)..( 11): Result.004 file - promoters50/1007289
tattcaatgat

SEQ ID NO: 151873 - DNA, 11 bp, Unknown
  misc_feature (1)..( 11): Result.004 file - promoters50/1007289
tattccatgca

SEQ ID NO: 151874 - DNA, 11 bp, Unknown
  misc_feature (1)..( 11): Result.004 file - promoters50/1007289
acttcaatgac

SEQ ID NO: 151875 - DNA, 11 bp, Unknown
  misc_feature (1)..( 11): Result.004 file - promoters50/1007289
aattaaataaa

SEQ ID NO: 151876 - DNA, 11 bp, Unknown
  misc_feature (1)..( 11): Result.004 file - promoters50/1007289
atataaataat

SEQ ID NO: 151877 - DNA, 11 bp, Unknown
  misc_feature (1)..( 11): Result.004 file - promoters50/1007289
catcaaataat

SEQ ID NO: 151878 - DNA, 9 bp, Unknown
  misc_feature (1)..( 9): Result.004 file - promoters50/1007289
cgataaagc

SEQ ID NO: 151879 - DNA, 9 bp, Unknown
  misc_feature (1)..( 9): Result.004 file - promoters50/1007289
aaataaagt

SEQ ID NO: 151880 - DNA, 9 bp, Unknown
  misc_feature (1)..( 9): Result.004 file - promoters50/1007289
ctaaaaaaa

SEQ ID NO: 151881 - DNA, 9 bp, Unknown
  misc_feature (1)..( 9): Result.004 file - promoters50/1007289
aaataaacc

SEQ ID NO: 151882 - DNA, 9 bp, Unknown
  misc_feature (1)..( 9): Result.004 file - promoters50/1007289
aaaaaaaaa

SEQ ID NO: 151883 - DNA, 9 bp, Unknown
  misc_feature (1)..( 9): Result.004 file - promoters50/1007289
taattaagt

SEQ ID NO: 151884 - DNA, 9 bp, Unknown
  misc_feature (1)..( 9): Result.004 file - promoters50/1007289
aatcataaa

SEQ ID NO: 151885 - DNA, 9 bp, Unknown
  misc_feature (1)..( 9): Result.004 file - promoters50/1007289
aatcagaaa

SEQ ID NO: 151886 - DNA, 9 bp, Unknown
  misc_feature (1)..( 9): Result.004 file - promoters50/1007289
aattatata

SEQ ID NO: 151887 - DNA, 9 bp, Unknown
  misc_feature (1)..( 9): Result.004 file - promoters50/1007289
aattatttt

SEQ ID NO: 151888 - DNA, 9 bp, Unknown
  misc_feature (1)..( 9): Result.004 file - promoters50/1007289
tattttata

SEQ ID NO: 151889 - DNA, 9 bp, Unknown
  misc_feature (1)..( 9): Result.004 file - promoters50/1007370
aataataaa

SEQ ID NO: 151890 - DNA, 12 bp, Unknown
  misc_feature (1)..( 12): Result.004 file - promoters50/1007370
caacaatgtaca

SEQ ID NO: 151891 - DNA, 12 bp, Unknown
  misc_feature (1)..( 12): Result.004 file - promoters50/1007370
caataatttaca

SEQ ID NO: 151892 - DNA, 12 bp, Unknown
  misc_feature (1)..( 12): Result.004 file - promoters50/1007370
tgaaaatttata

SEQ ID NO: 151893 - DNA, 12 bp, Unknown
  misc_feature (1)..( 12): Result.004 file - promoters50/1007370
aaatcatttttt

SEQ ID NO: 151894 - DNA, 12 bp, Unknown
  misc_feature (1)..( 12): Result.004 file - promoters50/1007370
gcttaattcatt

SEQ ID NO: 151895 - DNA, 12 bp, Unknown
  misc_feature (1)..( 12): Result.004 file - promoters50/1007554
taatcattaacc

SEQ ID NO: 151896 - DNA, 9 bp, Unknown
  misc_feature (1)..( 9): Result.004 file - promoters50/1007554
ttttacaaa

SEQ ID NO: 151897 - DNA, 9 bp, Unknown
  misc_feature (1)..( 9): Result.004 file - promoters50/1007554
tttcacaat

SEQ ID NO: 151898 - DNA, 9 bp, Unknown
  misc_feature (1)..( 9): Result.004 file - promoters50/1007554
gaatacaaa

SEQ ID NO: 151899 - DNA, 9 bp, Unknown
  misc_feature (1)..( 9): Result.004 file - promoters50/1007554
cgttaaaaa

SEQ ID NO: 151900 - DNA, 9 bp, Unknown
  misc_feature (1)..( 9): Result.004 file - promoters50/1007554
tatcacaag

SEQ ID NO: 151901 - DNA, 9 bp, Unknown
  misc_feature (1)..( 9): Result.004 file - promoters50/1007554
tataacaat

SEQ ID NO: 151902 - DNA, 11 bp, Unknown
  misc_feature (1)..( 11): Result.004 file - promoters50/1007554
tataattttaa

SEQ ID NO: 151903 - DNA, 11 bp, Unknown
  misc_feature (1)..( 11): Result.004 file - promoters50/1007554
tttaattttat

SEQ ID NO: 151904 - DNA, 11 bp, Unknown
  misc_feature (1)..( 11): Result.004 file - promoters50/1007554
tttgattgaat

SEQ ID NO: 151905 - DNA, 11 bp, Unknown
  misc_feature (1)..( 11): Result.004 file - promoters50/1007554
aatgagtgata

SEQ ID NO: 151906 - DNA, 11 bp, Unknown
  misc_feature (1)..( 11): Result.004 file - promoters50/1007554
tggctttttat

SEQ ID NO: 151907 - DNA, 11 bp, Unknown
  misc_feature (1)..( 11): Result.004 file - promoters50/1007554
agcatttttaa

SEQ ID NO: 151908 - DNA, 8 bp, Unknown
  misc_feature (1)..( 8): Result.004 file - promoters50/1007554
aaattatt

SEQ ID NO: 151909 - DNA, 8 bp, Unknown
  misc_feature (1)..( 8): Result.004 file - promoters50/1007554
aaaatata

SEQ ID NO: 151910 - DNA, 8 bp, Unknown
  misc_feature (1)..( 8): Result.004 file - promoters50/1007554
aaaattgt

SEQ ID NO: 151911 - DNA, 8 bp, Unknown
  misc_feature (1)..( 8): Result.004 file - promoters50/1007554
taattatt

SEQ ID NO: 151912 - DNA, 8 bp, Unknown
  misc_feature (1)..( 8): Result.004 file - promoters50/1007554
aaattaat

SEQ ID NO: 151913 - DNA, 8 bp, Unknown
  misc_feature (1)..( 8): Result.004 file - promoters50/1007554
aaaataaa

SEQ ID NO: 151914 - DNA, 13 bp, Unknown
  misc_feature (1)..( 13): Result.004 file - promoters50/1007554
tcatataattatc

SEQ ID NO: 151915 - DNA, 13 bp, Unknown
  misc_feature (1)..( 13): Result.004 file - promoters50/1007554
atatataataaat

SEQ ID NO: 151916 - DNA, 13 bp, Unknown
  misc_feature (1)..( 13): Result.004 file - promoters50/1007554
tcatataacaatt

SEQ ID NO: 151917 - DNA, 13 bp, Unknown
  misc_feature (1)..( 13): Result.004 file - promoters50/1007554
tttaataacaaat

SEQ ID NO: 151918 - DNA, 13 bp, Unknown
  misc_feature (1)..( 13): Result.004 file - promoters50/1007554
aattattatactt

SEQ ID NO: 151919 - DNA, 13 bp, Unknown
  misc_feature (1)..( 13): Result.004 file - promoters50/1007576
aaaaataaataga

SEQ ID NO: 151920 - DNA, 10 bp, Unknown
  misc_feature (1)..( 10): Result.004 file - promoters50/1007576
ctggaatatg

SEQ ID NO: 151921 - DNA, 10 bp, Unknown
  misc_feature (1)..( 10): Result.004 file - promoters50/1007576
ctggaaaatg

SEQ ID NO: 151922 - DNA, 10 bp, Unknown
  misc_feature (1)..( 10): Result.004 file - promoters50/1007639
agggaaaagg

SEQ ID NO: 151923 - DNA, 17 bp, Unknown
  misc_feature (1)..( 17): Result.004 file - promoters50/1007639
taattgacaaaaacaaa

SEQ ID NO: 151924 - DNA, 17 bp, Unknown
  misc_feature (1)..( 17): Result.004 file - promoters50/1007639
tcacagaggaaaacata

SEQ ID NO: 151925 - DNA, 17 bp, Unknown
  misc_feature (1)..( 17): Result.004 file - promoters50/1007639
ctatgatttaaaatata

SEQ ID NO: 151926 - DNA, 17 bp, Unknown
  misc_feature (1)..( 17): Result.004 file - promoters50/1007639
ttgaagtgaaaattatg

SEQ ID NO: 151927 - DNA, 17 bp, Unknown
  misc_feature (1)..( 17): Result.004 file - promoters50/1007639
tattatttcaaatgaca

SEQ ID NO: 151928 - DNA, 17 bp, Unknown
  misc_feature (1)..( 17): Result.004 file - promoters50/1007639
tattacagtatatcatt

SEQ ID NO: 151929 - DNA, 10 bp, Unknown
  misc_feature (1)..( 10): Result.004 file - promoters50/1007639
atacagactt

SEQ ID NO: 151930 - DNA, 10 bp, Unknown
  misc_feature (1)..( 10): Result.004 file - promoters50/1007639
atacaaactt

SEQ ID NO: 151931 - DNA, 10 bp, Unknown
  misc_feature (1)..( 10): Result.004 file - promoters50/1007639
ataaaaaagc

SEQ ID NO: 151932 - DNA, 10 bp, Unknown
  misc_feature (1)..( 10): Result.004 file - promoters50/1007639
ataaaaacac

SEQ ID NO: 151933 - DNA, 10 bp, Unknown
  misc_feature (1)..( 10): Result.004 file - promoters50/1007639
ctgaaaacaa

SEQ ID NO: 151934 - DNA, 10 bp, Unknown
  misc_feature (1)..( 10): Result.004 file - promoters50/1007639
aacaaaacaa

SEQ ID NO: 151935 - DNA, 10 bp, Unknown
  misc_feature (1)..( 10): Result.004 file - promoters50/1007639
agaaaaacaa

SEQ ID NO: 151936 - DNA, 10 bp, Unknown
  misc_feature (1)..( 10): Result.004 file - promoters50/1007639
gtaacaacaa

SEQ ID NO: 151937 - DNA, 16 bp, Unknown
  misc_feature (1)..( 16): Result.004 file - promoters50/1007639
ttatagaaatataaat

SEQ ID NO: 151938 - DNA, 16 bp, Unknown
  misc_feature (1)..( 16): Result.004 file - promoters50/1007639
aacaataaatatcttt

SEQ ID NO: 151939 - DNA, 16 bp, Unknown
  misc_feature (1)..( 16): Result.004 file - promoters50/1007639
aaacagagatataaat

SEQ ID NO: 151940 - DNA, 16 bp, Unknown
  misc_feature (1)..( 16): Result.004 file - promoters50/1007639
agtggttcatataagt

SEQ ID NO: 151941 - DNA, 16 bp, Unknown
  misc_feature (1)..( 16): Result.004 file - promoters50/1007639
ttgcagagaatgtata

SEQ ID NO: 151942 - DNA, 16 bp, Unknown
  misc_feature (1)..( 16): Result.004 file - promoters50/1007639
ttgctgagcttattta

SEQ ID NO: 151943 - DNA, 13 bp, Unknown
  misc_feature (1)..( 13): Result.004 file - promoters50/1007639
agcgttttctgtt

SEQ ID NO: 151944 - DNA, 13 bp, Unknown
  misc_feature (1)..( 13): Result.004 file - promoters50/1007639
tttgttttctaac

SEQ ID NO: 151945 - DNA, 13 bp, Unknown
  misc_feature (1)..( 13): Result.004 file - promoters50/1007639
agaatttttgtag

SEQ ID NO: 151946 - DNA, 13 bp, Unknown
  misc_feature (1)..( 13): Result.004 file - promoters50/1007639
tgtttttgctgat

SEQ ID NO: 151947 - DNA, 13 bp, Unknown
  misc_feature (1)..( 13): Result.004 file - promoters50/1007639
agagtttgtattc

SEQ ID NO: 151948 - DNA, 13 bp, Unknown
  misc_feature (1)..( 13): Result.004 file - promoters50/1007639
aatatttgagcgg

SEQ ID NO: 151949 - DNA, 10 bp, Unknown
  misc_feature (1)..( 10): Result.004 file - promoters50/1007639
tgtttggtac

SEQ ID NO: 151950 - DNA, 10 bp, Unknown
  misc_feature (1)..( 10): Result.004 file - promoters50/1007639
agttttgtat

SEQ ID NO: 151951 - DNA, 10 bp, Unknown
  misc_feature (1)..( 10): Result.004 file - promoters50/1007639
atttttgtag

SEQ ID NO: 151952 - DNA, 10 bp, Unknown
  misc_feature (1)..( 10): Result.004 file - promoters50/1007639
tgtttgatta

SEQ ID NO: 151953 - DNA, 10 bp, Unknown
  misc_feature (1)..( 10): Result.004 file - promoters50/1007639
agattgaaga

SEQ ID NO: 151954 - DNA, 10 bp, Unknown
  misc_feature (1)..( 10): Result.004 file - promoters50/1007639
aagatgaaga

SEQ ID NO: 151955 - DNA, 14 bp, Unknown
  misc_feature (1)..( 14): Result.004 file - promoters50/1007639
ataacattggtgtc

SEQ ID NO: 151956 - DNA, 14 bp, Unknown
  misc_feature (1)..( 14): Result.004 file - promoters50/1007639
atatcattcttttg

SEQ ID NO: 151957 - DNA, 14 bp, Unknown
  misc_feature (1)..( 14): Result.004 file - promoters50/1007639
ctatgatttaaaat

SEQ ID NO: 151958 - DNA, 14 bp, Unknown
  misc_feature (1)..( 14): Result.004 file - promoters50/1007639
tgatgattttcatt

SEQ ID NO: 151959 - DNA, 14 bp, Unknown
  misc_feature (1)..( 14): Result.004 file - promoters50/1007639
ttattatttcaaat

SEQ ID NO: 151960 - DNA, 14 bp, Unknown
  misc_feature (1)..( 14): Result.004 file - promoters50/1007639
gagtcattcgaata

SEQ ID NO: 151961 - DNA, 10 bp, Unknown
  misc_feature (1)..( 10): Result.004 file - promoters50/1007639
agaaacaatg

SEQ ID NO: 151962 - DNA, 10 bp, Unknown
  misc_feature (1)..( 10): Result.004 file - promoters50/1007639
aaaaacaaag

SEQ ID NO: 151963 - DNA, 10 bp, Unknown
  misc_feature (1)..( 10): Result.004 file - promoters50/1007639
caaaacaatt

SEQ ID NO: 151964 - DNA, 10 bp, Unknown
  misc_feature (1)..( 10): Result.004 file - promoters50/1007639
gaaaacaaat

SEQ ID NO: 151965 - DNA, 10 bp, Unknown
  misc_feature (1)..( 10): Result.004 file - promoters50/1007639
aaaaacacaa

SEQ ID NO: 151966 - DNA, 10 bp, Unknown
  misc_feature (1)..( 10): Result.004 file - promoters50/1007675
ggtaacaaca

SEQ ID NO: 151967 - DNA, 12 bp, Unknown
  misc_feature (1)..( 12): Result.004 file - promoters50/1007675
tacaaagggata

SEQ ID NO: 151968 - DNA, 12 bp, Unknown
  misc_feature (1)..( 12): Result.004 file - promoters50/1007675
aataaatggaaa

SEQ ID NO: 151969 - DNA, 12 bp, Unknown
  misc_feature (1)..( 12): Result.004 file - promoters50/1007675
tatatatgtgat

SEQ ID NO: 151970 - DNA, 12 bp, Unknown
  misc_feature (1)..( 12): Result.004 file - promoters50/1007675
aatatatgtaaa

SEQ ID NO: 151971 - DNA, 9 bp, Unknown
  misc_feature (1)..( 9): Result.004 file - promoters50/1007675
taaagaaag

SEQ ID NO: 151972 - DNA, 9 bp, Unknown
  misc_feature (1)..( 9): Result.004 file - promoters50/1007675
aaaaaaaaa

SEQ ID NO: 151973 - DNA, 9 bp, Unknown
  misc_feature (1)..( 9): Result.004 file - promoters50/1007675
cctagaaag

SEQ ID NO: 151974 - DNA, 9 bp, Unknown
  misc_feature (1)..( 9): Result.004 file - promoters50/1007675
taaaaaaaa

SEQ ID NO: 151975 - DNA, 9 bp, Unknown
  misc_feature (1)..( 9): Result.004 file - promoters50/1007675
aaaacaaaa

SEQ ID NO: 151976 - DNA, 10 bp, Unknown
  misc_feature (1)..( 10): Result.004 file - promoters50/1007675
ctataaagaa

SEQ ID NO: 151977 - DNA, 10 bp, Unknown
  misc_feature (1)..( 10): Result.004 file - promoters50/1007675
ctagaaagtc

SEQ ID NO: 151978 - DNA, 10 bp, Unknown
  misc_feature (1)..( 10): Result.004 file - promoters50/1007675
ttaaaaaaaa

SEQ ID NO: 151979 - DNA, 10 bp, Unknown
  misc_feature (1)..( 10): Result.004 file - promoters50/1007675
acaaaaaaaa

SEQ ID NO: 151980 - DNA, 9 bp, Unknown
  misc_feature (1)..( 9): Result.004 file - promoters50/1007675
tttataaaa

SEQ ID NO: 151981 - DNA, 9 bp, Unknown
  misc_feature (1)..( 9): Result.004 file - promoters50/1007675
catataaat

SEQ ID NO: 151982 - DNA, 9 bp, Unknown
  misc_feature (1)..( 9): Result.004 file - promoters50/1007675
tatataaag

SEQ ID NO: 151983 - DNA, 9 bp, Unknown
  misc_feature (1)..( 9): Result.004 file - promoters50/1007731
tctataaaa

SEQ ID NO: 151984 - DNA, 6 bp, Unknown
  misc_feature (1)..( 6): Result.004 file - promoters50/1007731
atttac

SEQ ID NO: 151985 - DNA, 6 bp, Unknown
  misc_feature (1)..( 6): Result.004 file - promoters50/1007731
atttac

SEQ ID NO: 151986 - DNA, 6 bp, Unknown
  misc_feature (1)..( 6): Result.004 file - promoters50/1007756
atttac

SEQ ID NO: 151987 - DNA, 13 bp, Unknown
  misc_feature (1)..( 13): Result.004 file - promoters50/1007756
aaccggttaaatc

SEQ ID NO: 151988 - DNA, 13 bp, Unknown
  misc_feature (1)..( 13): Result.004 file - promoters50/1007756
aacctgtttgttg

SEQ ID NO: 151989 - DNA, 13 bp, Unknown
  misc_feature (1)..( 13): Result.004 file - promoters50/1007773
actctgtttcttg

SEQ ID NO: 151990 - DNA, 8 bp, Unknown
  misc_feature (1)..( 8): Result.004 file - promoters50/1007773
gaaagagg

SEQ ID NO: 151991 - DNA, 8 bp, Unknown
  misc_feature (1)..( 8): Result.004 file - promoters50/1007773
gaaaaagg

SEQ ID NO: 151992 - DNA, 8 bp, Unknown
  misc_feature (1)..( 8): Result.004 file - promoters50/1007791
gaaaaacc

SEQ ID NO: 151993 - DNA, 9 bp, Unknown
  misc_feature (1)..( 9): Result.004 file - promoters50/1007791
attgtttat

SEQ ID NO: 151994 - DNA, 9 bp, Unknown
  misc_feature (1)..( 9): Result.004 file - promoters50/1007791
ggtgtgtat

SEQ ID NO: 151995 - DNA, 9 bp, Unknown
  misc_feature (1)..( 9): Result.004 file - promoters50/1007791
attcttttg

SEQ ID NO: 151996 - DNA, 9 bp, Unknown
  misc_feature (1)..( 9): Result.004 file - promoters50/1007791
aagctttct

SEQ ID NO: 151997 - DNA, 9 bp, Unknown
  misc_feature (1)..( 9): Result.004 file - promoters50/1007791
ttgctttct

SEQ ID NO: 151998 - DNA, 9 bp, Unknown
  misc_feature (1)..( 9): Result.004 file - promoters50/1007791
ttggtttag

SEQ ID NO: 151999 - DNA, 10 bp, Unknown
  misc_feature (1)..( 10): Result.004 file - promoters50/1007791
caaagttctt

SEQ ID NO: 152000 - DNA, 10 bp, Unknown
  misc_feature (1)..( 10): Result.004 file - promoters50/1007791
caatgttgaa

SEQ ID NO: 152001 - DNA, 10 bp, Unknown
  misc_feature (1)..( 10): Result.004 file - promoters50/1007791
ttatggtgaa

SEQ ID NO: 152002 - DNA, 10 bp, Unknown
  misc_feature (1)..( 10): Result.004 file - promoters50/1007791
aacaactttt

SEQ ID NO: 152003 - DNA, 10 bp, Unknown
  misc_feature (1)..( 10): Result.004 file - promoters50/1007791
aacacctttt

SEQ ID NO: 152004 - DNA, 10 bp, Unknown
  misc_feature (1)..( 10): Result.004 file - promoters50/1007791
tacaactcca

SEQ ID NO: 152005 - DNA, 7 bp, Unknown
  misc_feature (1)..( 7): Result.004 file - promoters50/1007791
aaagttt

SEQ ID NO: 152006 - DNA, 7 bp, Unknown
  misc_feature (1)..( 7): Result.004 file - promoters50/1007791
aaagttt

SEQ ID NO: 152007 - DNA, 7 bp, Unknown
  misc_feature (1)..( 7): Result.004 file - promoters50/1007791
aaaggtt

SEQ ID NO: 152008 - DNA, 8 bp, Unknown
  misc_feature (1)..( 8): Result.004 file - promoters50/1007791
gttttgtg

SEQ ID NO: 152009 - DNA, 8 bp, Unknown
  misc_feature (1)..( 8): Result.004 file - promoters50/1007791
cttttgta

SEQ ID NO: 152010 - DNA, 8 bp, Unknown
  misc_feature (1)..( 8): Result.004 file - promoters50/1007795
gtttagtg

SEQ ID NO: 152011 - DNA, 12 bp, Unknown
  misc_feature (1)..( 12): Result.004 file - promoters50/1007795
actatttaaaag

SEQ ID NO: 152012 - DNA, 12 bp, Unknown
  misc_feature (1)..( 12): Result.004 file - promoters50/1007795
catatataaatt

SEQ ID NO: 152013 - DNA, 12 bp, Unknown
  misc_feature (1)..( 12): Result.004 file - promoters50/1007795
actttttttttt

SEQ ID NO: 152014 - DNA, 12 bp, Unknown
  misc_feature (1)..( 12): Result.004 file - promoters50/1007795
ttcatattaatt

SEQ ID NO: 152015 - DNA, 12 bp, Unknown
  misc_feature (1)..( 12): Result.004 file - promoters50/1007795
tctttttgttgt

SEQ ID NO: 152016 - DNA, 12 bp, Unknown
  misc_feature (1)..( 12): Result.004 file - promoters50/1007795
tattcatatttg

SEQ ID NO: 152017 - DNA, 11 bp, Unknown
  misc_feature (1)..( 11): Result.004 file - promoters50/1007795
tataaattttt

SEQ ID NO: 152018 - DNA, 11 bp, Unknown
  misc_feature (1)..( 11): Result.004 file - promoters50/1007795
atcaaatttat

SEQ ID NO: 152019 - DNA, 11 bp, Unknown
  misc_feature (1)..( 11): Result.004 file - promoters50/1007795
taaaaatttgg

SEQ ID NO: 152020 - DNA, 11 bp, Unknown
  misc_feature (1)..( 11): Result.004 file - promoters50/1007795
tgtaaattttg

SEQ ID NO: 152021 - DNA, 11 bp, Unknown
  misc_feature (1)..( 11): Result.004 file - promoters50/1007795
taaaaataaac

SEQ ID NO: 152022 - DNA, 11 bp, Unknown
  misc_feature (1)..( 11): Result.004 file - promoters50/1007795
agaaaattcaa

SEQ ID NO: 152023 - DNA, 11 bp, Unknown
  misc_feature (1)..( 11): Result.004 file - promoters50/1007795
gaaaaaaaaga

SEQ ID NO: 152024 - DNA, 8 bp, Unknown
  misc_feature (1)..( 8): Result.004 file - promoters50/1007795
aaaataaa

SEQ ID NO: 152025 - DNA, 8 bp, Unknown
  misc_feature (1)..( 8): Result.004 file - promoters50/1007795
taaataaa

SEQ ID NO: 152026 - DNA, 8 bp, Unknown
  misc_feature (1)..( 8): Result.004 file - promoters50/1007795
aaaatatg

SEQ ID NO: 152027 - DNA, 9 bp, Unknown
  misc_feature (1)..( 9): Result.004 file - promoters50/1007795
ataatgaaa

SEQ ID NO: 152028 - DNA, 9 bp, Unknown
  misc_feature (1)..( 9): Result.004 file - promoters50/1007795
aaaaatact

SEQ ID NO: 152029 - DNA, 9 bp, Unknown
  misc_feature (1)..( 9): Result.004 file - promoters50/1007795
aaaaataaa

SEQ ID NO: 152030 - DNA, 9 bp, Unknown
  misc_feature (1)..( 9): Result.004 file - promoters50/1007795
taaaagaaa

SEQ ID NO: 152031 - DNA, 13 bp, Unknown
  misc_feature (1)..( 13): Result.004 file - promoters50/1007795
tatattgattttc

SEQ ID NO: 152032 - DNA, 13 bp, Unknown
  misc_feature (1)..( 13): Result.004 file - promoters50/1007795
gtatttgatttga

SEQ ID NO: 152033 - DNA, 13 bp, Unknown
  misc_feature (1)..( 13): Result.004 file - promoters50/1007795
tatatttatttgg

SEQ ID NO: 152034 - DNA, 13 bp, Unknown
  misc_feature (1)..( 13): Result.004 file - promoters50/1007795
catgatgattttg

SEQ ID NO: 152035 - DNA, 13 bp, Unknown
  misc_feature (1)..( 13): Result.004 file - promoters50/1007795
gaagaacattttg

SEQ ID NO: 152036 - DNA, 13 bp, Unknown
  misc_feature (1)..( 13): Result.004 file - promoters50/1007795
gtttatgatttat

SEQ ID NO: 152037 - DNA, 13 bp, Unknown
  misc_feature (1)..( 13): Result.004 file - promoters50/1007795
gtgataaaatagt

SEQ ID NO: 152038 - DNA, 13 bp, Unknown
  misc_feature (1)..( 13): Result.004 file - promoters50/1007795
gatttaaaatgtt

SEQ ID NO: 152039 - DNA, 13 bp, Unknown
  misc_feature (1)..( 13): Result.004 file - promoters50/1007795
ttcataaaaaaaa

SEQ ID NO: 152040 - DNA, 13 bp, Unknown
  misc_feature (1)..( 13): Result.004 file - promoters50/1007795
tatttacaatgtt

SEQ ID NO: 152041 - DNA, 13 bp, Unknown
  misc_feature (1)..( 13): Result.004 file - promoters50/1007795
tgattaacatttg

SEQ ID NO: 152042 - DNA, 13 bp, Unknown
  misc_feature (1)..( 13): Result.004 file - promoters50/1007795
tatttatttggat

SEQ ID NO: 152043 - DNA, 16 bp, Unknown
  misc_feature (1)..( 16): Result.004 file - promoters50/1007795
aaatttatattgattt

SEQ ID NO: 152044 - DNA, 16 bp, Unknown
  misc_feature (1)..( 16): Result.004 file - promoters50/1007795
agttttgtattatcaa

SEQ ID NO: 152045 - DNA, 16 bp, Unknown
  misc_feature (1)..( 16): Result.004 file - promoters50/1007795
gatactatatttattt

SEQ ID NO: 152046 - DNA, 16 bp, Unknown
  misc_feature (1)..( 16): Result.004 file - promoters50/1007795
tatcataaatttattt

SEQ ID NO: 152047 - DNA, 16 bp, Unknown
  misc_feature (1)..( 16): Result.004 file - promoters50/1007795
agtttggtatttgatt

SEQ ID NO: 152048 - DNA, 16 bp, Unknown
  misc_feature (1)..( 16): Result.004 file - promoters50/1007795
attttggtcaaaggcc

SEQ ID NO: 152049 - DNA, 16 bp, Unknown
  misc_feature (1)..( 16): Result.004 file - promoters50/1007795
cgtttatgatttatcg

SEQ ID NO: 152050 - DNA, 14 bp, Unknown
  misc_feature (1)..( 14): Result.004 file - promoters50/1007795
actaattttattta

SEQ ID NO: 152051 - DNA, 14 bp, Unknown
  misc_feature (1)..( 14): Result.004 file - promoters50/1007795
attaatttgtttta

SEQ ID NO: 152052 - DNA, 14 bp, Unknown
  misc_feature (1)..( 14): Result.004 file - promoters50/1007795
ttaaatttacgctc

SEQ ID NO: 152053 - DNA, 14 bp, Unknown
  misc_feature (1)..( 14): Result.004 file - promoters50/1007795
ataaatttatttat

SEQ ID NO: 152054 - DNA, 14 bp, Unknown
  misc_feature (1)..( 14): Result.004 file - promoters50/1007795
attgattttctaaa

SEQ ID NO: 152055 - DNA, 14 bp, Unknown
  misc_feature (1)..( 14): Result.004 file - promoters50/1007795
cttaattcttttta

SEQ ID NO: 152056 - DNA, 14 bp, Unknown
  misc_feature (1)..( 14): Result.004 file - promoters50/1007795
ataaatatgaatcg

SEQ ID NO: 152057 - DNA, 10 bp, Unknown
  misc_feature (1)..( 10): Result.004 file - promoters50/1007795
aactaatttt

SEQ ID NO: 152058 - DNA, 10 bp, Unknown
  misc_feature (1)..( 10): Result.004 file - promoters50/1007795
tgtaaatttt

SEQ ID NO: 152059 - DNA, 10 bp, Unknown
  misc_feature (1)..( 10): Result.004 file - promoters50/1007795
taaaaatttg

SEQ ID NO: 152060 - DNA, 10 bp, Unknown
  misc_feature (1)..( 10): Result.004 file - promoters50/1007795
taaaaataaa

SEQ ID NO: 152061 - DNA, 10 bp, Unknown
  misc_feature (1)..( 10): Result.004 file - promoters50/1007795
agaaaattca

SEQ ID NO: 152062 - DNA, 10 bp, Unknown
  misc_feature (1)..( 10): Result.004 file - promoters50/1007795
gaaaaaaaag

SEQ ID NO: 152063 - DNA, 11 bp, Unknown
  misc_feature (1)..( 11): Result.004 file - promoters50/1007795
aaaatatcaaa

SEQ ID NO: 152064 - DNA, 11 bp, Unknown
  misc_feature (1)..( 11): Result.004 file - promoters50/1007795
aaaatacttac

SEQ ID NO: 152065 - DNA, 11 bp, Unknown
  misc_feature (1)..( 11): Result.004 file - promoters50/1007795
aaaatatgaaa

SEQ ID NO: 152066 - DNA, 11 bp, Unknown
  misc_feature (1)..( 11): Result.004 file - promoters50/1007795
aaaataaacta

SEQ ID NO: 152067 - DNA, 11 bp, Unknown
  misc_feature (1)..( 11): Result.004 file - promoters50/1007795
aaaaaaaagac

SEQ ID NO: 152068 - DNA, 11 bp, Unknown
  misc_feature (1)..( 11): Result.004 file - promoters50/1007795
aaaagaaagaa

SEQ ID NO: 152069 - DNA, 14 bp, Unknown
  misc_feature (1)..( 14): Result.004 file - promoters50/1007795
atttaaaatgttag

SEQ ID NO: 152070 - DNA, 14 bp, Unknown
  misc_feature (1)..( 14): Result.004 file - promoters50/1007795
ttgtataattttat

SEQ ID NO: 152071 - DNA, 14 bp, Unknown
  misc_feature (1)..( 14): Result.004 file - promoters50/1007795
atttacaatgttgc

SEQ ID NO: 152072 - DNA, 14 bp, Unknown
  misc_feature (1)..( 14): Result.004 file - promoters50/1007795
aaagttgattaaca

SEQ ID NO: 152073 - DNA, 14 bp, Unknown
  misc_feature (1)..( 14): Result.004 file - promoters50/1007795
tacgtttatgattt

SEQ ID NO: 152074 - DNA, 14 bp, Unknown
  misc_feature (1)..( 14): Result.004 file - promoters50/1007802
atactatatttatt

SEQ ID NO: 152075 - DNA, 13 bp, Unknown
  misc_feature (1)..( 13): Result.004 file - promoters50/1007802
gataaaatttgat

SEQ ID NO: 152076 - DNA, 13 bp, Unknown
  misc_feature (1)..( 13): Result.004 file - promoters50/1007802
gatataatttata

SEQ ID NO: 152077 - DNA, 13 bp, Unknown
  misc_feature (1)..( 13): Result.004 file - promoters50/1007802
tgagaaatttccc

SEQ ID NO: 152078 - DNA, 13 bp, Unknown
  misc_feature (1)..( 13): Result.004 file - promoters50/1007802
gaattaatttgtg

SEQ ID NO: 152079 - DNA, 13 bp, Unknown
  misc_feature (1)..( 13): Result.004 file - promoters50/1007802
gtcaaaatgtgtg

SEQ ID NO: 152080 - DNA, 13 bp, Unknown
  misc_feature (1)..( 13): Result.004 file - promoters50/1007831
tccttacttttgt

SEQ ID NO: 152081 - DNA, 12 bp, Unknown
  misc_feature (1)..( 12): Result.004 file - promoters50/1007831
cttaaataattg

SEQ ID NO: 152082 - DNA, 12 bp, Unknown
  misc_feature (1)..( 12): Result.004 file - promoters50/1007831
gttatatataaa

SEQ ID NO: 152083 - DNA, 12 bp, Unknown
  misc_feature (1)..( 12): Result.004 file - promoters50/1007831
tttaaataatta

SEQ ID NO: 152084 - DNA, 12 bp, Unknown
  misc_feature (1)..( 12): Result.004 file - promoters50/1007831
aaaaaataattg

SEQ ID NO: 152085 - DNA, 12 bp, Unknown
  misc_feature (1)..( 12): Result.004 file - promoters50/1007831
gctatatatttt

SEQ ID NO: 152086 - DNA, 12 bp, Unknown
  misc_feature (1)..( 12): Result.004 file - promoters50/1007831
tttcaatttttt

SEQ ID NO: 152087 - DNA, 14 bp, Unknown
  misc_feature (1)..( 14): Result.004 file - promoters50/1007831
cttattcattttag

SEQ ID NO: 152088 - DNA, 14 bp, Unknown
  misc_feature (1)..( 14): Result.004 file - promoters50/1007831
ctttttcattttta

SEQ ID NO: 152089 - DNA, 14 bp, Unknown
  misc_feature (1)..( 14): Result.004 file - promoters50/1007831
tacgaccattttcg

SEQ ID NO: 152090 - DNA, 14 bp, Unknown
  misc_feature (1)..( 14): Result.004 file - promoters50/1007831
agtggagattatcg

SEQ ID NO: 152091 - DNA, 14 bp, Unknown
  misc_feature (1)..( 14): Result.004 file - promoters50/1007831
catatacattttgt

SEQ ID NO: 152092 - DNA, 14 bp, Unknown
  misc_feature (1)..( 14): Result.004 file - promoters50/1007831
aactttctttttaa

SEQ ID NO: 152093 - DNA, 14 bp, Unknown
  misc_feature (1)..( 14): Result.004 file - promoters50/1007831
gaaactctcttctc

SEQ ID NO: 152094 - DNA, 12 bp, Unknown
  misc_feature (1)..( 12): Result.004 file - promoters50/1007831
ctttaaagatgc

SEQ ID NO: 152095 - DNA, 12 bp, Unknown
  misc_feature (1)..( 12): Result.004 file - promoters50/1007831
cataaaagatcg

SEQ ID NO: 152096 - DNA, 12 bp, Unknown
  misc_feature (1)..( 12): Result.004 file - promoters50/1007831
catacaagaaaa

SEQ ID NO: 152097 - DNA, 12 bp, Unknown
  misc_feature (1)..( 12): Result.004 file - promoters50/1007831
attacaaaaaaa

SEQ ID NO: 152098 - DNA, 12 bp, Unknown
  misc_feature (1)..( 12): Result.004 file - promoters50/1007831
ccttaaaaatgg

SEQ ID NO: 152099 - DNA, 12 bp, Unknown
  misc_feature (1)..( 12): Result.004 file - promoters50/1007967
ttaacaaaagtc

SEQ ID NO: 152100 - DNA, 11 bp, Unknown
  misc_feature (1)..( 11): Result.004 file - promoters50/1007967
ttaatttcaac

SEQ ID NO: 152101 - DNA, 11 bp, Unknown
  misc_feature (1)..( 11): Result.004 file - promoters50/1007967
aaaatttgaac

SEQ ID NO: 152102 - DNA, 11 bp, Unknown
  misc_feature (1)..( 11): Result.004 file - promoters50/1007967
tcaatttcaca

SEQ ID NO: 152103 - DNA, 11 bp, Unknown
  misc_feature (1)..( 11): Result.004 file - promoters50/1007967
acaatgtgaaa

SEQ ID NO: 152104 - DNA, 11 bp, Unknown
  misc_feature (1)..( 11): Result.004 file - promoters50/1007967
aaaattttaaa

SEQ ID NO: 152105 - DNA, 11 bp, Unknown
  misc_feature (1)..( 11): Result.004 file - promoters50/1008070
gcaatatgatt

SEQ ID NO: 152106 - DNA, 11 bp, Unknown
  misc_feature (1)..( 11): Result.004 file - promoters50/1008070
ccactatataa

SEQ ID NO: 152107 - DNA, 11 bp, Unknown
  misc_feature (1)..( 11): Result.004 file - promoters50/1008070
cttttatatat

SEQ ID NO: 152108 - DNA, 11 bp, Unknown
  misc_feature (1)..( 11): Result.004 file - promoters50/1008070
cacatatatat

SEQ ID NO: 152109 - DNA, 11 bp, Unknown
  misc_feature (1)..( 11): Result.004 file - promoters50/1008070
gtgagatataa

SEQ ID NO: 152110 - DNA, 11 bp, Unknown
  misc_feature (1)..( 11): Result.004 file - promoters50/1008070
ccattatatat

SEQ ID NO: 152111 - DNA, 11 bp, Unknown
  misc_feature (1)..( 11): Result.004 file - promoters50/1008070
tgtttatatca

SEQ ID NO: 152112 - DNA, 11 bp, Unknown
  misc_feature (1)..( 11): Result.004 file - promoters50/1008070
cctttatattc

SEQ ID NO: 152113 - DNA, 14 bp, Unknown
  misc_feature (1)..( 14): Result.004 file - promoters50/1008070
tattgcatttttaa

SEQ ID NO: 152114 - DNA, 14 bp, Unknown
  misc_feature (1)..( 14): Result.004 file - promoters50/1008070
atttgaattttcct

SEQ ID NO: 152115 - DNA, 14 bp, Unknown
  misc_feature (1)..( 14): Result.004 file - promoters50/1008070
catttcatatgttt

SEQ ID NO: 152116 - DNA, 14 bp, Unknown
  misc_feature (1)..( 14): Result.004 file - promoters50/1008070
tttttaatttgtgt

SEQ ID NO: 152117 - DNA, 14 bp, Unknown
  misc_feature (1)..( 14): Result.004 file - promoters50/1008070
ccattactttactc

SEQ ID NO: 152118 - DNA, 14 bp, Unknown
  misc_feature (1)..( 14): Result.004 file - promoters50/1008070
tttttagtttgtgt

SEQ ID NO: 152119 - DNA, 14 bp, Unknown
  misc_feature (1)..( 14): Result.004 file - promoters50/1008070
caacaactatacaa

SEQ ID NO: 152120 - DNA, 11 bp, Unknown
  misc_feature (1)..( 11): Result.004 file - promoters50/1008070
taaaaataatc

SEQ ID NO: 152121 - DNA, 11 bp, Unknown
  misc_feature (1)..( 11): Result.004 file - promoters50/1008070
caaaattaaaa

SEQ ID NO: 152122 - DNA, 11 bp, Unknown
  misc_feature (1)..( 11): Result.004 file - promoters50/1008070
taaatataaag

SEQ ID NO: 152123 - DNA, 11 bp, Unknown
  misc_feature (1)..( 11): Result.004 file - promoters50/1008070
caaatatttga

SEQ ID NO: 152124 - DNA, 11 bp, Unknown
  misc_feature (1)..( 11): Result.004 file - promoters50/1008070
gggatatgaag

SEQ ID NO: 152125 - DNA, 11 bp, Unknown
  misc_feature (1)..( 11): Result.004 file - promoters50/1008070
acaacatttat

SEQ ID NO: 152126 - DNA, 11 bp, Unknown
  misc_feature (1)..( 11): Result.004 file - promoters50/1008070
ttaatataaac

SEQ ID NO: 152127 - DNA, 9 bp, Unknown
  misc_feature (1)..( 9): Result.004 file - promoters50/1008070
caaaataaa

SEQ ID NO: 152128 - DNA, 9 bp, Unknown
  misc_feature (1)..( 9): Result.004 file - promoters50/1008070
gaaaaaaaa

SEQ ID NO: 152129 - DNA, 9 bp, Unknown
  misc_feature (1)..( 9): Result.004 file - promoters50/1008070
taaaaaaaa

SEQ ID NO: 152130 - DNA, 9 bp, Unknown
  misc_feature (1)..( 9): Result.004 file - promoters50/1008070
caaaattga

SEQ ID NO: 152131 - DNA, 9 bp, Unknown
  misc_feature (1)..( 9): Result.004 file - promoters50/1008070
gaaaatatt

SEQ ID NO: 152132 - DNA, 9 bp, Unknown
  misc_feature (1)..( 9): Result.004 file - promoters50/1008070
taaaaaaaa

SEQ ID NO: 152133 - DNA, 9 bp, Unknown
  misc_feature (1)..( 9): Result.004 file - promoters50/1008070
aaactgaac

SEQ ID NO: 152134 - DNA, 9 bp, Unknown
  misc_feature (1)..( 9): Result.004 file - promoters50/1008070
taactgatt

SEQ ID NO: 152135 - DNA, 9 bp, Unknown
  misc_feature (1)..( 9): Result.004 file - promoters50/1008070
aaaatgaaa

SEQ ID NO: 152136 - DNA, 9 bp, Unknown
  misc_feature (1)..( 9): Result.004 file - promoters50/1008070
aaactcatt

SEQ ID NO: 152137 - DNA, 9 bp, Unknown
  misc_feature (1)..( 9): Result.004 file - promoters50/1008070
ggactaatt

SEQ ID NO: 152138 - DNA, 9 bp, Unknown
  misc_feature (1)..( 9): Result.004 file - promoters50/1008109
tcaatcaaa

SEQ ID NO: 152139 - DNA, 14 bp, Unknown
  misc_feature (1)..( 14): Result.004 file - promoters50/1008109
tcttaataatgttt

SEQ ID NO: 152140 - DNA, 14 bp, Unknown
  misc_feature (1)..( 14): Result.004 file - promoters50/1008109
atttcataatgaaa

SEQ ID NO: 152141 - DNA, 14 bp, Unknown
  misc_feature (1)..( 14): Result.004 file - promoters50/1008109
gtttcaaaattaaa

SEQ ID NO: 152142 - DNA, 14 bp, Unknown
  misc_feature (1)..( 14): Result.004 file - promoters50/1008109
gtttcatgtccttt

SEQ ID NO: 152143 - DNA, 14 bp, Unknown
  misc_feature (1)..( 14): Result.004 file - promoters50/1008148
ctcgctaaataaaa

SEQ ID NO: 152144 - DNA, 12 bp, Unknown
  misc_feature (1)..( 12): Result.004 file - promoters50/1008148
taaatataaata

SEQ ID NO: 152145 - DNA, 12 bp, Unknown
  misc_feature (1)..( 12): Result.004 file - promoters50/1008148
agaataaaaatt

SEQ ID NO: 152146 - DNA, 12 bp, Unknown
  misc_feature (1)..( 12): Result.004 file - promoters50/1008148
tcgttattaata

SEQ ID NO: 152147 - DNA, 12 bp, Unknown
  misc_feature (1)..( 12): Result.004 file - promoters50/1008148
cttataaaaaaa

SEQ ID NO: 152148 - DNA, 12 bp, Unknown
  misc_feature (1)..( 12): Result.004 file - promoters50/1008148
tacataataatg

SEQ ID NO: 152149 - DNA, 12 bp, Unknown
  misc_feature (1)..( 12): Result.004 file - promoters50/1008148
tgaataattaaa

SEQ ID NO: 152150 - DNA, 12 bp, Unknown
  misc_feature (1)..( 12): Result.004 file - promoters50/1008183
tgagtaaattga

SEQ ID NO: 152151 - DNA, 8 bp, Unknown
  misc_feature (1)..( 8): Result.004 file - promoters50/1008183
ctttcact

SEQ ID NO: 152152 - DNA, 8 bp, Unknown
  misc_feature (1)..( 8): Result.004 file - promoters50/1008183
ctttcagg

SEQ ID NO: 152153 - DNA, 8 bp, Unknown
  misc_feature (1)..( 8): Result.004 file - promoters50/1008218
ttttaagg

SEQ ID NO: 152154 - DNA, 13 bp, Unknown
  misc_feature (1)..( 13): Result.004 file - promoters50/1008218
aattaatgtattt

SEQ ID NO: 152155 - DNA, 13 bp, Unknown
  misc_feature (1)..( 13): Result.004 file - promoters50/1008218
gacaaatgtatgg

SEQ ID NO: 152156 - DNA, 13 bp, Unknown
  misc_feature (1)..( 13): Result.004 file - promoters50/1008218
atttattgttgcg

SEQ ID NO: 152157 - DNA, 13 bp, Unknown
  misc_feature (1)..( 13): Result.004 file - promoters50/1008218
aagttttgtgttt

SEQ ID NO: 152158 - DNA, 13 bp, Unknown
  misc_feature (1)..( 13): Result.004 file - promoters50/1008218
attttatgtttca

SEQ ID NO: 152159 - DNA, 13 bp, Unknown
  misc_feature (1)..( 13): Result.004 file - promoters50/1008218
attatatgtaaac

SEQ ID NO: 152160 - DNA, 10 bp, Unknown
  misc_feature (1)..( 10): Result.004 file - promoters50/1008218
aggttcatat

SEQ ID NO: 152161 - DNA, 10 bp, Unknown
  misc_feature (1)..( 10): Result.004 file - promoters50/1008218
tggttcatta

SEQ ID NO: 152162 - DNA, 10 bp, Unknown
  misc_feature (1)..( 10): Result.004 file - promoters50/1008218
gtgttaatag

SEQ ID NO: 152163 - DNA, 10 bp, Unknown
  misc_feature (1)..( 10): Result.004 file - promoters50/1008218
aggttcagaa

SEQ ID NO: 152164 - DNA, 10 bp, Unknown
  misc_feature (1)..( 10): Result.004 file - promoters50/1008218
tatttaatag

SEQ ID NO: 152165 - DNA, 10 bp, Unknown
  misc_feature (1)..( 10): Result.004 file - promoters50/1008226
ttgtttagac

SEQ ID NO: 152166 - DNA, 13 bp, Unknown
  misc_feature (1)..( 13): Result.004 file - promoters50/1008226
ttaaaaacagaaa

SEQ ID NO: 152167 - DNA, 13 bp, Unknown
  misc_feature (1)..( 13): Result.004 file - promoters50/1008226
ccaaaaaccgtga

SEQ ID NO: 152168 - DNA, 13 bp, Unknown
  misc_feature (1)..( 13): Result.004 file - promoters50/1008226
aaaaaaacaaaaa

SEQ ID NO: 152169 - DNA, 13 bp, Unknown
  misc_feature (1)..( 13): Result.004 file - promoters50/1008226
ttaaaaaaatata

SEQ ID NO: 152170 - DNA, 13 bp, Unknown
  misc_feature (1)..( 13): Result.004 file - promoters50/1008226
ttaaaaagtaaat

SEQ ID NO: 152171 - DNA, 13 bp, Unknown
  misc_feature (1)..( 13): Result.004 file - promoters50/1008226
ttacaaagcccta

SEQ ID NO: 152172 - DNA, 12 bp, Unknown
  misc_feature (1)..( 12): Result.004 file - promoters50/1008226
aaaaacagaaat

SEQ ID NO: 152173 - DNA, 12 bp, Unknown
  misc_feature (1)..( 12): Result.004 file - promoters50/1008226
atccacagaaaa

SEQ ID NO: 152174 - DNA, 12 bp, Unknown
  misc_feature (1)..( 12): Result.004 file - promoters50/1008226
aaaaacaaaaaa

SEQ ID NO: 152175 - DNA, 12 bp, Unknown
  misc_feature (1)..( 12): Result.004 file - promoters50/1008226
ttctttaaaaaa

SEQ ID NO: 152176 - DNA, 12 bp, Unknown
  misc_feature (1)..( 12): Result.004 file - promoters50/1008226
gatgttaaaaag

SEQ ID NO: 152177 - DNA, 12 bp, Unknown
  misc_feature (1)..( 12): Result.004 file - promoters50/1008226
taaattacaaag

SEQ ID NO: 152178 - DNA, 12 bp, Unknown
  misc_feature (1)..( 12): Result.004 file - promoters50/1008226
aataaatattgt

SEQ ID NO: 152179 - DNA, 12 bp, Unknown
  misc_feature (1)..( 12): Result.004 file - promoters50/1008226
aatacatatttg

SEQ ID NO: 152180 - DNA, 12 bp, Unknown
  misc_feature (1)..( 12): Result.004 file - promoters50/1008226
aattaataagcc

SEQ ID NO: 152181 - DNA, 12 bp, Unknown
  misc_feature (1)..( 12): Result.004 file - promoters50/1008226
aacacatatctc

SEQ ID NO: 152182 - DNA, 12 bp, Unknown
  misc_feature (1)..( 12): Result.004 file - promoters50/1008226
ttctcatgtctc

SEQ ID NO: 152183 - DNA, 12 bp, Unknown
  misc_feature (1)..( 12): Result.004 file - promoters50/1008226
aaaaagtaaatt

SEQ ID NO: 152184 - DNA, 12 bp, Unknown
  misc_feature (1)..( 12): Result.004 file - promoters50/1008319
caaaagtttggt

SEQ ID NO: 152185 - DNA, 10 bp, Unknown
  misc_feature (1)..( 10): Result.004 file - promoters50/1008319
caaagacaaa

SEQ ID NO: 152186 - DNA, 10 bp, Unknown
  misc_feature (1)..( 10): Result.004 file - promoters50/1008319
taaaaacatt

SEQ ID NO: 152187 - DNA, 10 bp, Unknown
  misc_feature (1)..( 10): Result.004 file - promoters50/1008319
aaaaaaccgt

SEQ ID NO: 152188 - DNA, 10 bp, Unknown
  misc_feature (1)..( 10): Result.004 file - promoters50/1008319
taaaaaatcc

SEQ ID NO: 152189 - DNA, 10 bp, Unknown
  misc_feature (1)..( 10): Result.004 file - promoters50/1008319
gaagaacaaa

SEQ ID NO: 152190 - DNA, 10 bp, Unknown
  misc_feature (1)..( 10): Result.004 file - promoters50/1008319
caaaaaaggg

SEQ ID NO: 152191 - DNA, 10 bp, Unknown
  misc_feature (1)..( 10): Result.004 file - promoters50/1008319
tttttatttt

SEQ ID NO: 152192 - DNA, 10 bp, Unknown
  misc_feature (1)..( 10): Result.004 file - promoters50/1008319
tttatattga

SEQ ID NO: 152193 - DNA, 10 bp, Unknown
  misc_feature (1)..( 10): Result.004 file - promoters50/1008319
attttgtttt

SEQ ID NO: 152194 - DNA, 10 bp, Unknown
  misc_feature (1)..( 10): Result.004 file - promoters50/1008319
cttaaattcc

SEQ ID NO: 152195 - DNA, 10 bp, Unknown
  misc_feature (1)..( 10): Result.004 file - promoters50/1008319
tctaaaatct

SEQ ID NO: 152196 - DNA, 10 bp, Unknown
  misc_feature (1)..( 10): Result.004 file - promoters50/1008324
tgtttgttct

SEQ ID NO: 152197 - DNA, 12 bp, Unknown
  misc_feature (1)..( 12): Result.004 file - promoters50/1008324
gatatgttcgcg

SEQ ID NO: 152198 - DNA, 12 bp, Unknown
  misc_feature (1)..( 12): Result.004 file - promoters50/1008324
gatatgttttgg

SEQ ID NO: 152199 - DNA, 12 bp, Unknown
  misc_feature (1)..( 12): Result.004 file - promoters50/1008324
gatatgataatg

SEQ ID NO: 152200 - DNA, 12 bp, Unknown
  misc_feature (1)..( 12): Result.004 file - promoters50/1008334
tctatgctttgg

SEQ ID NO: 152201 - DNA, 9 bp, Unknown
  misc_feature (1)..( 9): Result.004 file - promoters50/1008334
tttaagagt

SEQ ID NO: 152202 - DNA, 9 bp, Unknown
  misc_feature (1)..( 9): Result.004 file - promoters50/1008334
tacaagagt

SEQ ID NO: 152203 - DNA, 9 bp, Unknown
  misc_feature (1)..( 9): Result.004 file - promoters50/1008397
tttcagaga

SEQ ID NO: 152204 - DNA, 7 bp, Unknown
  misc_feature (1)..( 7): Result.004 file - promoters50/1008397
gctttta

SEQ ID NO: 152205 - DNA, 7 bp, Unknown
  misc_feature (1)..( 7): Result.004 file - promoters50/1008397
gcttttc

SEQ ID NO: 152206 - DNA, 7 bp, Unknown
  misc_feature (1)..( 7): Result.004 file - promoters50/1008397
actttta

SEQ ID NO: 152207 - DNA, 9 bp, Unknown
  misc_feature (1)..( 9): Result.004 file - promoters50/1008397
gaatcttat

SEQ ID NO: 152208 - DNA, 9 bp, Unknown
  misc_feature (1)..( 9): Result.004 file - promoters50/1008397
gaatattaa

SEQ ID NO: 152209 - DNA, 9 bp, Unknown
  misc_feature (1)..( 9): Result.004 file - promoters50/1008397
gaagcttaa

SEQ ID NO: 152210 - DNA, 9 bp, Unknown
  misc_feature (1)..( 9): Result.004 file - promoters50/1008397
tgataataa

SEQ ID NO: 152211 - DNA, 8 bp, Unknown
  misc_feature (1)..( 8): Result.004 file - promoters50/1008397
ttatcaaa

SEQ ID NO: 152212 - DNA, 8 bp, Unknown
  misc_feature (1)..( 8): Result.004 file - promoters50/1008397
ttatcaaa

SEQ ID NO: 152213 - DNA, 8 bp, Unknown
  misc_feature (1)..( 8): Result.004 file - promoters50/1008397
gtatcaat

SEQ ID NO: 152214 - DNA, 10 bp, Unknown
  misc_feature (1)..( 10): Result.004 file - promoters50/1008397
caataatgag

SEQ ID NO: 152215 - DNA, 10 bp, Unknown
  misc_feature (1)..( 10): Result.004 file - promoters50/1008397
caaaaatttg

SEQ ID NO: 152216 - DNA, 10 bp, Unknown
  misc_feature (1)..( 10): Result.004 file - promoters50/1008425
ataaaatttt

SEQ ID NO: 152217 - DNA, 8 bp, Unknown
  misc_feature (1)..( 8): Result.004 file - promoters50/1008425
cttctgaa

SEQ ID NO: 152218 - DNA, 8 bp, Unknown
  misc_feature (1)..( 8): Result.004 file - promoters50/1008425
cttttgaa

SEQ ID NO: 152219 - DNA, 8 bp, Unknown
  misc_feature (1)..( 8): Result.004 file - promoters50/1008425
attttgag

SEQ ID NO: 152220 - DNA, 10 bp, Unknown
  misc_feature (1)..( 10): Result.004 file - promoters50/1008425
caaatacatt

SEQ ID NO: 152221 - DNA, 10 bp, Unknown
  misc_feature (1)..( 10): Result.004 file - promoters50/1008425
taaatacatt

SEQ ID NO: 152222 - DNA, 10 bp, Unknown
  misc_feature (1)..( 10): Result.004 file - promoters50/1008432
caaaaacaac

SEQ ID NO: 152223 - DNA, 12 bp, Unknown
  misc_feature (1)..( 12): Result.004 file - promoters50/1008432
gcaaaaggtata

SEQ ID NO: 152224 - DNA, 12 bp, Unknown
  misc_feature (1)..( 12): Result.004 file - promoters50/1008432
gtaaatggtttt

SEQ ID NO: 152225 - DNA, 12 bp, Unknown
  misc_feature (1)..( 12): Result.004 file - promoters50/1008432
cgaaaaggatcg

SEQ ID NO: 152226 - DNA, 12 bp, Unknown
  misc_feature (1)..( 12): Result.004 file - promoters50/1008432
gcaaaagcaaaa

SEQ ID NO: 152227 - DNA, 12 bp, Unknown
  misc_feature (1)..( 12): Result.004 file - promoters50/1008432
tataattgttag

SEQ ID NO: 152228 - DNA, 9 bp, Unknown
  misc_feature (1)..( 9): Result.004 file - promoters50/1008432
gatgatttg

SEQ ID NO: 152229 - DNA, 12 bp, Unknown
  misc_feature (1)..( 12): Result.004 file - promoters50/1008432
ttatatgttttt

SEQ ID NO: 152230 - DNA, 15 bp, Unknown
  misc_feature (1)..( 15): Result.004 file - promoters50/1008432
gattgttttaataaa

SEQ ID NO: 152231 - DNA, 15 bp, Unknown
  misc_feature (1)..( 15): Result.004 file - promoters50/1008432
tatttttttttcaaa

SEQ ID NO: 152232 - DNA, 15 bp, Unknown
  misc_feature (1)..( 15): Result.004 file - promoters50/1008432
accggttttattaaa

SEQ ID NO: 152233 - DNA, 15 bp, Unknown
  misc_feature (1)..( 15): Result.004 file - promoters50/1008432
catttttatcccttc

SEQ ID NO: 152234 - DNA, 15 bp, Unknown
  misc_feature (1)..( 15): Result.004 file - promoters50/1008432
tattttaaaaataaa

SEQ ID NO: 152235 - DNA, 15 bp, Unknown
  misc_feature (1)..( 15): Result.004 file - promoters50/1008432
aattaaagcccacga

SEQ ID NO: 152236 - DNA, 13 bp, Unknown
  misc_feature (1)..( 13): Result.004 file - promoters50/1008432
ttttaataaaaat

SEQ ID NO: 152237 - DNA, 13 bp, Unknown
  misc_feature (1)..( 13): Result.004 file - promoters50/1008432
agtcgataaaatt

SEQ ID NO: 152238 - DNA, 13 bp, Unknown
  misc_feature (1)..( 13): Result.004 file - promoters50/1008432
atataattaaagc

SEQ ID NO: 152239 - DNA, 13 bp, Unknown
  misc_feature (1)..( 13): Result.004 file - promoters50/1008432
gtattttaaaaat

SEQ ID NO: 152240 - DNA, 13 bp, Unknown
  misc_feature (1)..( 13): Result.004 file - promoters50/1008432
gttttattaaatg

SEQ ID NO: 152241 - DNA, 13 bp, Unknown
  misc_feature (1)..( 13): Result.004 file - promoters50/1008432
tttttatcccttc

SEQ ID NO: 152242 - DNA, 13 bp, Unknown
  misc_feature (1)..( 13): Result.004 file - promoters50/1008443
tttttttcaaagg

SEQ ID NO: 152243 - DNA, 12 bp, Unknown
  misc_feature (1)..( 12): Result.004 file - promoters50/1008443
gataaatattca

SEQ ID NO: 152244 - DNA, 12 bp, Unknown
  misc_feature (1)..( 12): Result.004 file - promoters50/1008443
ataaaaaatttt

SEQ ID NO: 152245 - DNA, 12 bp, Unknown
  misc_feature (1)..( 12): Result.004 file - promoters50/1008443
atataaaatggt

SEQ ID NO: 152246 - DNA, 12 bp, Unknown
  misc_feature (1)..( 12): Result.004 file - promoters50/1008443
attccaaatttt

SEQ ID NO: 152247 - DNA, 12 bp, Unknown
  misc_feature (1)..( 12): Result.004 file - promoters50/1008443
agaaaaaaaaaa

SEQ ID NO: 152248 - DNA, 12 bp, Unknown
  misc_feature (1)..( 12): Result.004 file - promoters50/1008443
agaagaaacaaa

SEQ ID NO: 152249 - DNA, 11 bp, Unknown
  misc_feature (1)..( 11): Result.004 file - promoters50/1008443
tattcaactat

SEQ ID NO: 152250 - DNA, 11 bp, Unknown
  misc_feature (1)..( 11): Result.004 file - promoters50/1008443
aattcaaaaag

SEQ ID NO: 152251 - DNA, 11 bp, Unknown
  misc_feature (1)..( 11): Result.004 file - promoters50/1008443
tgttcaaaaaa

SEQ ID NO: 152252 - DNA, 11 bp, Unknown
  misc_feature (1)..( 11): Result.004 file - promoters50/1008443
aaaaaaaaaaa

SEQ ID NO: 152253 - DNA, 11 bp, Unknown
  misc_feature (1)..( 11): Result.004 file - promoters50/1008443
tctataaaaaa

SEQ ID NO: 152254 - DNA, 11 bp, Unknown
  misc_feature (1)..( 11): Result.004 file - promoters50/1008487
aattccaaatt

SEQ ID NO: 152255 - DNA, 7 bp, Unknown
  misc_feature (1)..( 7): Result.004 file - promoters50/1008487
caattac

SEQ ID NO: 152256 - DNA, 7 bp, Unknown
  misc_feature (1)..( 7): Result.004 file - promoters50/1008487
caattac

SEQ ID NO: 152257 - DNA, 7 bp, Unknown
  misc_feature (1)..( 7): Result.004 file - promoters50/1008491
aaattac

SEQ ID NO: 152258 - DNA, 9 bp, Unknown
  misc_feature (1)..( 9): Result.004 file - promoters50/1008491
gaaataaaa

SEQ ID NO: 152259 - DNA, 9 bp, Unknown
  misc_feature (1)..( 9): Result.004 file - promoters50/1008491
aaaatcaaa

SEQ ID NO: 152260 - DNA, 9 bp, Unknown
  misc_feature (1)..( 9): Result.004 file - promoters50/1008491
taaatactc

SEQ ID NO: 152261 - DNA, 8 bp, Unknown
  misc_feature (1)..( 8): Result.004 file - promoters50/1008491
aaaaactt

SEQ ID NO: 152262 - DNA, 8 bp, Unknown
  misc_feature (1)..( 8): Result.004 file - promoters50/1008491
tcaaactt

SEQ ID NO: 152263 - DNA, 9 bp, Unknown
  misc_feature (1)..( 9): Result.004 file - promoters50/1008534
taaatactc

SEQ ID NO: 152264 - DNA, 13 bp, Unknown
  misc_feature (1)..( 13): Result.004 file - promoters50/1008534
ggttttgagagag

SEQ ID NO: 152265 - DNA, 13 bp, Unknown
  misc_feature (1)..( 13): Result.004 file - promoters50/1008534
cattttgagaact

SEQ ID NO: 152266 - DNA, 13 bp, Unknown
  misc_feature (1)..( 13): Result.004 file - promoters50/1008534
aattttggttttg

SEQ ID NO: 152267 - DNA, 13 bp, Unknown
  misc_feature (1)..( 13): Result.004 file - promoters50/1008534
tattctgaatagt

SEQ ID NO: 152268 - DNA, 13 bp, Unknown
  misc_feature (1)..( 13): Result.004 file - promoters50/1008534
tttcttggttcaa

SEQ ID NO: 152269 - DNA, 13 bp, Unknown
  misc_feature (1)..( 13): Result.004 file - promoters50/1008573
aatcttgtttttg

SEQ ID NO: 152270 - DNA, 14 bp, Unknown
  misc_feature (1)..( 14): Result.004 file - promoters50/1008573
ttttcttttcatat

SEQ ID NO: 152271 - DNA, 14 bp, Unknown
  misc_feature (1)..( 14): Result.004 file - promoters50/1008573
ctgatttttaataa

SEQ ID NO: 152272 - DNA, 14 bp, Unknown
  misc_feature (1)..( 14): Result.004 file - promoters50/1008573
tttttttttcacta

SEQ ID NO: 152273 - DNA, 14 bp, Unknown
  misc_feature (1)..( 14): Result.004 file - promoters50/1008573
gaggcaattcatat

SEQ ID NO: 152274 - DNA, 14 bp, Unknown
  misc_feature (1)..( 14): Result.004 file - promoters50/1008573
ttacaatttcactc

SEQ ID NO: 152275 - DNA, 14 bp, Unknown
  misc_feature (1)..( 14): Result.004 file - promoters50/1008573
ttgaactttctaaa

SEQ ID NO: 152276 - DNA, 14 bp, Unknown
  misc_feature (1)..( 14): Result.004 file - promoters50/1008573
tcttattttatgta

SEQ ID NO: 152277 - DNA, 11 bp, Unknown
  misc_feature (1)..( 11): Result.004 file - promoters50/1008573
ctgattttgta

SEQ ID NO: 152278 - DNA, 11 bp, Unknown
  misc_feature (1)..( 11): Result.004 file - promoters50/1008573
cttattatgtt

SEQ ID NO: 152279 - DNA, 11 bp, Unknown
  misc_feature (1)..( 11): Result.004 file - promoters50/1008573
tgtattgtgtt

SEQ ID NO: 152280 - DNA, 11 bp, Unknown
  misc_feature (1)..( 11): Result.004 file - promoters50/1008573
gagattgtgag

SEQ ID NO: 152281 - DNA, 11 bp, Unknown
  misc_feature (1)..( 11): Result.004 file - promoters50/1008573
tgtataatgtt

SEQ ID NO: 152282 - DNA, 11 bp, Unknown
  misc_feature (1)..( 11): Result.004 file - promoters50/1008573
aatattaatat

SEQ ID NO: 152283 - DNA, 12 bp, Unknown
  misc_feature (1)..( 12): Result.004 file - promoters50/1008573
gttatcaatcag

SEQ ID NO: 152284 - DNA, 15 bp, Unknown
  misc_feature (1)..( 15): Result.004 file - promoters50/1008573
ttcctaattttgcat

SEQ ID NO: 152285 - DNA, 15 bp, Unknown
  misc_feature (1)..( 15): Result.004 file - promoters50/1008573
accaaaatattgtta

SEQ ID NO: 152286 - DNA, 15 bp, Unknown
  misc_feature (1)..( 15): Result.004 file - promoters50/1008573
tttaaaatatatttt

SEQ ID NO: 152287 - DNA, 15 bp, Unknown
  misc_feature (1)..( 15): Result.004 file - promoters50/1008573
ttatgtatattgtta

SEQ ID NO: 152288 - DNA, 15 bp, Unknown
  misc_feature (1)..( 15): Result.004 file - promoters50/1008573
ttataaatgtatttc

SEQ ID NO: 152289 - DNA, 15 bp, Unknown
  misc_feature (1)..( 15): Result.004 file - promoters50/1008673
tttacaatggaagtt

SEQ ID NO: 152290 - DNA, 11 bp, Unknown
  misc_feature (1)..( 11): Result.004 file - promoters50/1008673
tgtttttaatg

SEQ ID NO: 152291 - DNA, 11 bp, Unknown
  misc_feature (1)..( 11): Result.004 file - promoters50/1008673
attttttaatt

SEQ ID NO: 152292 - DNA, 11 bp, Unknown
  misc_feature (1)..( 11): Result.004 file - promoters50/1008673
tgtttttgttc

SEQ ID NO: 152293 - DNA, 11 bp, Unknown
  misc_feature (1)..( 11): Result.004 file - promoters50/1008673
tatttttttct

SEQ ID NO: 152294 - DNA, 11 bp, Unknown
  misc_feature (1)..( 11): Result.004 file - promoters50/1008732
atgttttattt

SEQ ID NO: 152295 - DNA, 10 bp, Unknown
  misc_feature (1)..( 10): Result.004 file - promoters50/1008732
tatagatgta

SEQ ID NO: 152296 - DNA, 10 bp, Unknown
  misc_feature (1)..( 10): Result.004 file - promoters50/1008732
aataaatgac

SEQ ID NO: 152297 - DNA, 10 bp, Unknown
  misc_feature (1)..( 10): Result.004 file - promoters50/1008732
aaaaaaaaaa

SEQ ID NO: 152298 - DNA, 10 bp, Unknown
  misc_feature (1)..( 10): Result.004 file - promoters50/1008732
gaaaaataaa

SEQ ID NO: 152299 - DNA, 10 bp, Unknown
  misc_feature (1)..( 10): Result.004 file - promoters50/1008732
ttaaaatatt

SEQ ID NO: 152300 - DNA, 10 bp, Unknown
  misc_feature (1)..( 10): Result.004 file - promoters50/1008732
agataataaa

SEQ ID NO: 152301 - DNA, 12 bp, Unknown
  misc_feature (1)..( 12): Result.004 file - promoters50/1008732
taaagtaattta

SEQ ID NO: 152302 - DNA, 12 bp, Unknown
  misc_feature (1)..( 12): Result.004 file - promoters50/1008732
aacagtagtttc

SEQ ID NO: 152303 - DNA, 12 bp, Unknown
  misc_feature (1)..( 12): Result.004 file - promoters50/1008732
aaaaataaacta

SEQ ID NO: 152304 - DNA, 12 bp, Unknown
  misc_feature (1)..( 12): Result.004 file - promoters50/1008732
ttgttgagtttc

SEQ ID NO: 152305 - DNA, 12 bp, Unknown
  misc_feature (1)..( 12): Result.004 file - promoters50/1008732
gaaaaaaaaaaa

SEQ ID NO: 152306 - DNA, 12 bp, Unknown
  misc_feature (1)..( 12): Result.004 file - promoters50/1008732
taaaatattcga

SEQ ID NO: 152307 - DNA, 12 bp, Unknown
  misc_feature (1)..( 12): Result.004 file - promoters50/1008759
gataataaataa

SEQ ID NO: 152308 - DNA, 8 bp, Unknown
  misc_feature (1)..( 8): Result.004 file - promoters50/1008759
atcatttt

SEQ ID NO: 152309 - DNA, 8 bp, Unknown
  misc_feature (1)..( 8): Result.004 file - promoters50/1008759
atcctttg

SEQ ID NO: 152310 - DNA, 8 bp, Unknown
  misc_feature (1)..( 8): Result.004 file - promoters50/1008769
tacatttt

SEQ ID NO: 152311 - DNA, 9 bp, Unknown
  misc_feature (1)..( 9): Result.004 file - promoters50/1008769
ataaagtca

SEQ ID NO: 152312 - DNA, 9 bp, Unknown
  misc_feature (1)..( 9): Result.004 file - promoters50/1008769
gtaaactca

SEQ ID NO: 152313 - DNA, 9 bp, Unknown
  misc_feature (1)..( 9): Result.004 file - promoters50/1008769
gtacactat

SEQ ID NO: 152314 - DNA, 11 bp, Unknown
  misc_feature (1)..( 11): Result.004 file - promoters50/1008769
atgaatttttt

SEQ ID NO: 152315 - DNA, 11 bp, Unknown
  misc_feature (1)..( 11): Result.004 file - promoters50/1008769
atgaatcttta

SEQ ID NO: 152316 - DNA, 9 bp, Unknown
  misc_feature (1)..( 9): Result.004 file - promoters50/1008769
ttctttttt

SEQ ID NO: 152317 - DNA, 7 bp, Unknown
  misc_feature (1)..( 7): Result.004 file - promoters50/1008769
aattttt

SEQ ID NO: 152318 - DNA, 7 bp, Unknown
  misc_feature (1)..( 7): Result.004 file - promoters50/1008769
tattttt

SEQ ID NO: 152319 - DNA, 7 bp, Unknown
  misc_feature (1)..( 7): Result.004 file - promoters50/1008769
aattttg

SEQ ID NO: 152320 - DNA, 10 bp, Unknown
  misc_feature (1)..( 10): Result.004 file - promoters50/1008769
aaagaacact

SEQ ID NO: 152321 - DNA, 10 bp, Unknown
  misc_feature (1)..( 10): Result.004 file - promoters50/1008769
taagtacact

SEQ ID NO: 152322 - DNA, 10 bp, Unknown
  misc_feature (1)..( 10): Result.004 file - promoters50/1008769
ttggtaaact

SEQ ID NO: 152323 - DNA, 10 bp, Unknown
  misc_feature (1)..( 10): Result.004 file - promoters50/1008769
taagtaatgt

SEQ ID NO: 152324 - DNA, 8 bp, Unknown
  misc_feature (1)..( 8): Result.004 file - promoters50/1008769
atggttta

SEQ ID NO: 152325 - DNA, 8 bp, Unknown
  misc_feature (1)..( 8): Result.004 file - promoters50/1008769
atgttttc

SEQ ID NO: 152326 - DNA, 8 bp, Unknown
  misc_feature (1)..( 8): Result.004 file - promoters50/1008787
ctggttta

SEQ ID NO: 152327 - DNA, 11 bp, Unknown
  misc_feature (1)..( 11): Result.004 file - promoters50/1008787
gcatacaaata

SEQ ID NO: 152328 - DNA, 11 bp, Unknown
  misc_feature (1)..( 11): Result.004 file - promoters50/1008787
gcatacagata

SEQ ID NO: 152329 - DNA, 11 bp, Unknown
  misc_feature (1)..( 11): Result.004 file - promoters50/1008787
caaaaagaata

SEQ ID NO: 152330 - DNA, 11 bp, Unknown
  misc_feature (1)..( 11): Result.004 file - promoters50/1008787
caatacaaata

SEQ ID NO: 152331 - DNA, 11 bp, Unknown
  misc_feature (1)..( 11): Result.004 file - promoters50/1008787
acataaagatt

SEQ ID NO: 152332 - DNA, 11 bp, Unknown
  misc_feature (1)..( 11): Result.004 file - promoters50/1008791
gtttaaaaatt

SEQ ID NO: 152333 - DNA, 11 bp, Unknown
  misc_feature (1)..( 11): Result.004 file - promoters50/1008791
taagggtagaa

SEQ ID NO: 152334 - DNA, 11 bp, Unknown
  misc_feature (1)..( 11): Result.004 file - promoters50/1008791
taacggtagaa

SEQ ID NO: 152335 - DNA, 11 bp, Unknown
  misc_feature (1)..( 11): Result.004 file - promoters50/1008791
aaagggttgta

SEQ ID NO: 152336 - DNA, 11 bp, Unknown
  misc_feature (1)..( 11): Result.004 file - promoters50/1008791
taaccgtaata

SEQ ID NO: 152337 - DNA, 10 bp, Unknown
  misc_feature (1)..( 10): Result.004 file - promoters50/1008791
aactcataac

SEQ ID NO: 152338 - DNA, 10 bp, Unknown
  misc_feature (1)..( 10): Result.004 file - promoters50/1008791
aacccatctc

SEQ ID NO: 152339 - DNA, 10 bp, Unknown
  misc_feature (1)..( 10): Result.004 file - promoters50/1008808
tccccctctc

SEQ ID NO: 152340 - DNA, 11 bp, Unknown
  misc_feature (1)..( 11): Result.004 file - promoters50/1008808
gcctatggtta

SEQ ID NO: 152341 - DNA, 11 bp, Unknown
  misc_feature (1)..( 11): Result.004 file - promoters50/1008808
agaaatgatta

SEQ ID NO: 152342 - DNA, 11 bp, Unknown
  misc_feature (1)..( 11): Result.004 file - promoters50/1008808
ttaaaggatta

SEQ ID NO: 152343 - DNA, 11 bp, Unknown
  misc_feature (1)..( 11): Result.004 file - promoters50/1008808
gaaaaagatgg

SEQ ID NO: 152344 - DNA, 11 bp, Unknown
  misc_feature (1)..( 11): Result.004 file - promoters50/1008808
aaaaatgtgaa

SEQ ID NO: 152345 - DNA, 11 bp, Unknown
  misc_feature (1)..( 11): Result.004 file - promoters50/1008813
ggacaagctgg

SEQ ID NO: 152346 - DNA, 6 bp, Unknown
  misc_feature (1)..( 6): Result.004 file - promoters50/1008813
ttcaaa

SEQ ID NO: 152347 - DNA, 6 bp, Unknown
  misc_feature (1)..( 6): Result.004 file - promoters50/1008813
ttcaaa

SEQ ID NO: 152348 - DNA, 6 bp, Unknown
  misc_feature (1)..( 6): Result.004 file - promoters50/1008813
ttcaaa

SEQ ID NO: 152349 - DNA, 10 bp, Unknown
  misc_feature (1)..( 10): Result.004 file - promoters50/1008813
aaaaaattat

SEQ ID NO: 152350 - DNA, 10 bp, Unknown
  misc_feature (1)..( 10): Result.004 file - promoters50/1008813
aaaaaaatat

SEQ ID NO: 152351 - DNA, 10 bp, Unknown
  misc_feature (1)..( 10): Result.004 file - promoters50/1008816
tcaaatatat

SEQ ID NO: 152352 - DNA, 13 bp, Unknown
  misc_feature (1)..( 13): Result.004 file - promoters50/1008816
cgaataaaaaaaa

SEQ ID NO: 152353 - DNA, 13 bp, Unknown
  misc_feature (1)..( 13): Result.004 file - promoters50/1008816
cgattaataaaaa

SEQ ID NO: 152354 - DNA, 13 bp, Unknown
  misc_feature (1)..( 13): Result.004 file - promoters50/1008816
atatttatatagt

SEQ ID NO: 152355 - DNA, 10 bp, Unknown
  misc_feature (1)..( 10): Result.004 file - promoters50/1008816
atattttctt

SEQ ID NO: 152356 - DNA, 10 bp, Unknown
  misc_feature (1)..( 10): Result.004 file - promoters50/1008816
atatttttta

SEQ ID NO: 152357 - DNA, 10 bp, Unknown
  misc_feature (1)..( 10): Result.004 file - promoters50/1008836
caatttgtta

SEQ ID NO: 152358 - DNA, 11 bp, Unknown
  misc_feature (1)..( 11): Result.004 file - promoters50/1008836
atatttttatg

SEQ ID NO: 152359 - DNA, 11 bp, Unknown
  misc_feature (1)..( 11): Result.004 file - promoters50/1008836
atatttttata

SEQ ID NO: 152360 - DNA, 11 bp, Unknown
  misc_feature (1)..( 11): Result.004 file - promoters50/1008836
gaaattttatg

SEQ ID NO: 152361 - DNA, 11 bp, Unknown
  misc_feature (1)..( 11): Result.004 file - promoters50/1008836
acatttttttc

SEQ ID NO: 152362 - DNA, 11 bp, Unknown
  misc_feature (1)..( 11): Result.004 file - promoters50/1008836
ttttttttaac

SEQ ID NO: 152363 - DNA, 11 bp, Unknown
  misc_feature (1)..( 11): Result.004 file - promoters50/1008836
caaattttatt

SEQ ID NO: 152364 - DNA, 11 bp, Unknown
  misc_feature (1)..( 11): Result.004 file - promoters50/1008836
ttattttttgg

SEQ ID NO: 152365 - DNA, 13 bp, Unknown
  misc_feature (1)..( 13): Result.004 file - promoters50/1008836
ttcaaaagattta

SEQ ID NO: 152366 - DNA, 13 bp, Unknown
  misc_feature (1)..( 13): Result.004 file - promoters50/1008836
atcaaaaaaagaa

SEQ ID NO: 152367 - DNA, 13 bp, Unknown
  misc_feature (1)..( 13): Result.004 file - promoters50/1008836
aacaaaagaaaaa

SEQ ID NO: 152368 - DNA, 13 bp, Unknown
  misc_feature (1)..( 13): Result.004 file - promoters50/1008836
aggaaaaaaaaaa

SEQ ID NO: 152369 - DNA, 13 bp, Unknown
  misc_feature (1)..( 13): Result.004 file - promoters50/1008836
aacaatagaggtt

SEQ ID NO: 152370 - DNA, 13 bp, Unknown
  misc_feature (1)..( 13): Result.004 file - promoters50/1008836
tgtcaaacatata

SEQ ID NO: 152371 - DNA, 12 bp, Unknown
  misc_feature (1)..( 12): Result.004 file - promoters50/1008836
caaaagatttat

SEQ ID NO: 152372 - DNA, 12 bp, Unknown
  misc_feature (1)..( 12): Result.004 file - promoters50/1008836
aaaaagaattta

SEQ ID NO: 152373 - DNA, 12 bp, Unknown
  misc_feature (1)..( 12): Result.004 file - promoters50/1008836
caaaagaaaaaa

SEQ ID NO: 152374 - DNA, 12 bp, Unknown
  misc_feature (1)..( 12): Result.004 file - promoters50/1008836
gaaaaattcaac

SEQ ID NO: 152375 - DNA, 12 bp, Unknown
  misc_feature (1)..( 12): Result.004 file - promoters50/1008836
gaaaaaaaaaat

SEQ ID NO: 152376 - DNA, 12 bp, Unknown
  misc_feature (1)..( 12): Result.004 file - promoters50/1008836
tcaaacatatac

SEQ ID NO: 152377 - DNA, 11 bp, Unknown
  misc_feature (1)..( 11): Result.004 file - promoters50/1008836
gactaattaaa

SEQ ID NO: 152378 - DNA, 11 bp, Unknown
  misc_feature (1)..( 11): Result.004 file - promoters50/1008836
attaaatgaaa

SEQ ID NO: 152379 - DNA, 11 bp, Unknown
  misc_feature (1)..( 11): Result.004 file - promoters50/1008836
taaaaattaat

SEQ ID NO: 152380 - DNA, 11 bp, Unknown
  misc_feature (1)..( 11): Result.004 file - promoters50/1008836
ttgtaaataat

SEQ ID NO: 152381 - DNA, 11 bp, Unknown
  misc_feature (1)..( 11): Result.004 file - promoters50/1008836
cttaaatttag

SEQ ID NO: 152382 - DNA, 11 bp, Unknown
  misc_feature (1)..( 11): Result.004 file - promoters50/1008836
tgtgaatctaa

SEQ ID NO: 152383 - DNA, 11 bp, Unknown
  misc_feature (1)..( 11): Result.004 file - promoters50/1008836
atataaatata

SEQ ID NO: 152384 - DNA, 17 bp, Unknown
  misc_feature (1)..( 17): Result.004 file - promoters50/1008836
aaatttttaaacattgt

SEQ ID NO: 152385 - DNA, 17 bp, Unknown
  misc_feature (1)..( 17): Result.004 file - promoters50/1008836
aaagtaaaaaacatctt

SEQ ID NO: 152386 - DNA, 17 bp, Unknown
  misc_feature (1)..( 17): Result.004 file - promoters50/1008836
aaatttttaaatatttt

SEQ ID NO: 152387 - DNA, 17 bp, Unknown
  misc_feature (1)..( 17): Result.004 file - promoters50/1008836
cttgttttaatgcgatt

SEQ ID NO: 152388 - DNA, 17 bp, Unknown
  misc_feature (1)..( 17): Result.004 file - promoters50/1008836
ttagtcatcaatattct

SEQ ID NO: 152389 - DNA, 17 bp, Unknown
  misc_feature (1)..( 17): Result.004 file - promoters50/1008836
acatgaagatatattta

SEQ ID NO: 152390 - DNA, 17 bp, Unknown
  misc_feature (1)..( 17): Result.004 file - promoters50/1008836
gtcattttattcataac

SEQ ID NO: 152391 - DNA, 17 bp, Unknown
  misc_feature (1)..( 17): Result.004 file - promoters50/1008836
ttcatattatccatata

SEQ ID NO: 152392 - DNA, 11 bp, Unknown
  misc_feature (1)..( 11): Result.004 file - promoters50/1008836
acattgtccat

SEQ ID NO: 152393 - DNA, 11 bp, Unknown
  misc_feature (1)..( 11): Result.004 file - promoters50/1008836
taattatccaa

SEQ ID NO: 152394 - DNA, 11 bp, Unknown
  misc_feature (1)..( 11): Result.004 file - promoters50/1008836
atattatccat

SEQ ID NO: 152395 - DNA, 11 bp, Unknown
  misc_feature (1)..( 11): Result.004 file - promoters50/1008836
gatatgtacat

SEQ ID NO: 152396 - DNA, 11 bp, Unknown
  misc_feature (1)..( 11): Result.004 file - promoters50/1008836
taaatattttt

SEQ ID NO: 152397 - DNA, 11 bp, Unknown
  misc_feature (1)..( 11): Result.004 file - promoters50/1008836
cgattttaatg

SEQ ID NO: 152398 - DNA, 11 bp, Unknown
  misc_feature (1)..( 11): Result.004 file - promoters50/1008836
tcaatattctt

SEQ ID NO: 152399 - DNA, 11 bp, Unknown
  misc_feature (1)..( 11): Result.004 file - promoters50/1008836
tcattttattc

SEQ ID NO: 152400 - DNA, 9 bp, Unknown
  misc_feature (1)..( 9): Result.004 file - promoters50/1008836
tccaaattg

SEQ ID NO: 152401 - DNA, 9 bp, Unknown
  misc_feature (1)..( 9): Result.004 file - promoters50/1008836
tccaaataa

SEQ ID NO: 152402 - DNA, 9 bp, Unknown
  misc_feature (1)..( 9): Result.004 file - promoters50/1008836
aacaaatta

SEQ ID NO: 152403 - DNA, 9 bp, Unknown
  misc_feature (1)..( 9): Result.004 file - promoters50/1008836
gacaaatat

SEQ ID NO: 152404 - DNA, 9 bp, Unknown
  misc_feature (1)..( 9): Result.004 file - promoters50/1008836
tacatattg

SEQ ID NO: 152405 - DNA, 9 bp, Unknown
  misc_feature (1)..( 9): Result.004 file - promoters50/1008836
aggaaatta

SEQ ID NO: 152406 - DNA, 8 bp, Unknown
  misc_feature (1)..( 8): Result.004 file - promoters50/1008836
gttataaa

SEQ ID NO: 152407 - DNA, 8 bp, Unknown
  misc_feature (1)..( 8): Result.004 file - promoters50/1008836
tatataaa

SEQ ID NO: 152408 - DNA, 8 bp, Unknown
  misc_feature (1)..( 8): Result.004 file - promoters50/1008836
tatataaa

SEQ ID NO: 152409 - DNA, 8 bp, Unknown
  misc_feature (1)..( 8): Result.004 file - promoters50/1008836
tttataaa

SEQ ID NO: 152410 - DNA, 8 bp, Unknown
  misc_feature (1)..( 8): Result.004 file - promoters50/1008836
tatataaa

SEQ ID NO: 152411 - DNA, 8 bp, Unknown
  misc_feature (1)..( 8): Result.004 file - promoters50/1008836
tttatatc

SEQ ID NO: 152412 - DNA, 8 bp, Unknown
  misc_feature (1)..( 8): Result.004 file - promoters50/1008836
gctataaa

SEQ ID NO: 152413 - DNA, 14 bp, Unknown
  misc_feature (1)..( 14): Result.004 file - promoters50/1008836
taaatctgaaaata

SEQ ID NO: 152414 - DNA, 14 bp, Unknown
  misc_feature (1)..( 14): Result.004 file - promoters50/1008836
taaatttgaaaaga

SEQ ID NO: 152415 - DNA, 14 bp, Unknown
  misc_feature (1)..( 14): Result.004 file - promoters50/1008836
ctctgtagaagata

SEQ ID NO: 152416 - DNA, 14 bp, Unknown
  misc_feature (1)..( 14): Result.004 file - promoters50/1008836
cttctttgcaaatt

SEQ ID NO: 152417 - DNA, 14 bp, Unknown
  misc_feature (1)..( 14): Result.004 file - promoters50/1008836
tgtttttgaactta

SEQ ID NO: 152418 - DNA, 14 bp, Unknown
  misc_feature (1)..( 14): Result.004 file - promoters50/1008836
agtttttgatattg

SEQ ID NO: 152419 - DNA, 10 bp, Unknown
  misc_feature (1)..( 10): Result.004 file - promoters50/1008836
atttatatga

SEQ ID NO: 152420 - DNA, 10 bp, Unknown
  misc_feature (1)..( 10): Result.004 file - promoters50/1008836
atttttattt

SEQ ID NO: 152421 - DNA, 10 bp, Unknown
  misc_feature (1)..( 10): Result.004 file - promoters50/1008836
cgtttcattg

SEQ ID NO: 152422 - DNA, 10 bp, Unknown
  misc_feature (1)..( 10): Result.004 file - promoters50/1008836
atttttttca

SEQ ID NO: 152423 - DNA, 10 bp, Unknown
  misc_feature (1)..( 10): Result.004 file - promoters50/1008836
cttttttttt

SEQ ID NO: 152424 - DNA, 10 bp, Unknown
  misc_feature (1)..( 10): Result.004 file - promoters50/1008836
tgtttcaaat

SEQ ID NO: 152425 - DNA, 10 bp, Unknown
  misc_feature (1)..( 10): Result.004 file - promoters50/1008836
agtttaaaaa

SEQ ID NO: 152426 - DNA, 10 bp, Unknown
  misc_feature (1)..( 10): Result.004 file - promoters50/1008836
tagtaaaaaa

SEQ ID NO: 152427 - DNA, 10 bp, Unknown
  misc_feature (1)..( 10): Result.004 file - promoters50/1008836
aaagaaaaaa

SEQ ID NO: 152428 - DNA, 10 bp, Unknown
  misc_feature (1)..( 10): Result.004 file - promoters50/1008836
ttttaacaaa

SEQ ID NO: 152429 - DNA, 10 bp, Unknown
  misc_feature (1)..( 10): Result.004 file - promoters50/1008836
tctgaaaaac

SEQ ID NO: 152430 - DNA, 10 bp, Unknown
  misc_feature (1)..( 10): Result.004 file - promoters50/1008836
gtttaaaaaa

SEQ ID NO: 152431 - DNA, 10 bp, Unknown
  misc_feature (1)..( 10): Result.004 file - promoters50/1008836
ttttaacatc

SEQ ID NO: 152432 - DNA, 11 bp, Unknown
  misc_feature (1)..( 11): Result.004 file - promoters50/1008836
cttttaaagtt

SEQ ID NO: 152433 - DNA, 11 bp, Unknown
  misc_feature (1)..( 11): Result.004 file - promoters50/1008836
agtttaaaaaa

SEQ ID NO: 152434 - DNA, 11 bp, Unknown
  misc_feature (1)..( 11): Result.004 file - promoters50/1008836
attttaacatc

SEQ ID NO: 152435 - DNA, 11 bp, Unknown
  misc_feature (1)..( 11): Result.004 file - promoters50/1008836
gtttcaaatag

SEQ ID NO: 152436 - DNA, 11 bp, Unknown
  misc_feature (1)..( 11): Result.004 file - promoters50/1008836
gtttcattgac

SEQ ID NO: 152437 - DNA, 11 bp, Unknown
  misc_feature (1)..( 11): Result.004 file - promoters50/1008889
tttttaacaaa

SEQ ID NO: 152438 - DNA, 8 bp, Unknown
  misc_feature (1)..( 8): Result.004 file - promoters50/1008889
atttgttt

SEQ ID NO: 152439 - DNA, 8 bp, Unknown
  misc_feature (1)..( 8): Result.004 file - promoters50/1008889
attttttt

SEQ ID NO: 152440 - DNA, 8 bp, Unknown
  misc_feature (1)..( 8): Result.004 file - promoters50/1008889
atttttag

SEQ ID NO: 152441 - DNA, 8 bp, Unknown
  misc_feature (1)..( 8): Result.004 file - promoters50/1008889
aaaattaa

SEQ ID NO: 152442 - DNA, 8 bp, Unknown
  misc_feature (1)..( 8): Result.004 file - promoters50/1008889
taaattat

SEQ ID NO: 152443 - DNA, 8 bp, Unknown
  misc_feature (1)..( 8): Result.004 file - promoters50/1009030
taaaatat

SEQ ID NO: 152444 - DNA, 11 bp, Unknown
  misc_feature (1)..( 11): Result.004 file - promoters50/1009030
gctcatgtata

SEQ ID NO: 152445 - DNA, 11 bp, Unknown
  misc_feature (1)..( 11): Result.004 file - promoters50/1009030
aatcatgtggg

SEQ ID NO: 152446 - DNA, 11 bp, Unknown
  misc_feature (1)..( 11): Result.004 file - promoters50/1009030
tctcttgtaat

SEQ ID NO: 152447 - DNA, 11 bp, Unknown
  misc_feature (1)..( 11): Result.004 file - promoters50/1009030
gctgatgtttg

SEQ ID NO: 152448 - DNA, 11 bp, Unknown
  misc_feature (1)..( 11): Result.004 file - promoters50/1009030
aaaattgtaat

SEQ ID NO: 152449 - DNA, 11 bp, Unknown
  misc_feature (1)..( 11): Result.004 file - promoters50/1009030
actcttggaat

SEQ ID NO: 152450 - DNA, 17 bp, Unknown
  misc_feature (1)..( 17): Result.004 file - promoters50/1009030
taatacctaaataataa

SEQ ID NO: 152451 - DNA, 17 bp, Unknown
  misc_feature (1)..( 17): Result.004 file - promoters50/1009030
atttatgtaattaaatc

SEQ ID NO: 152452 - DNA, 17 bp, Unknown
  misc_feature (1)..( 17): Result.004 file - promoters50/1009030
atgggcctgaatcatat

SEQ ID NO: 152453 - DNA, 17 bp, Unknown
  misc_feature (1)..( 17): Result.004 file - promoters50/1009030
ttgggccagaacacggt

SEQ ID NO: 152454 - DNA, 17 bp, Unknown
  misc_feature (1)..( 17): Result.004 file - promoters50/1009030
ttgggccaagccgtatt

SEQ ID NO: 152455 - DNA, 17 bp, Unknown
  misc_feature (1)..( 17): Result.004 file - promoters50/1009053
gtaaagtgaagtcatat

SEQ ID NO: 152456 - DNA, 11 bp, Unknown
  misc_feature (1)..( 11): Result.004 file - promoters50/1009053
tatattaaata

SEQ ID NO: 152457 - DNA, 11 bp, Unknown
  misc_feature (1)..( 11): Result.004 file - promoters50/1009053
tatattttttt

SEQ ID NO: 152458 - DNA, 11 bp, Unknown
  misc_feature (1)..( 11): Result.004 file - promoters50/1009053
gatattttttt

SEQ ID NO: 152459 - DNA, 12 bp, Unknown
  misc_feature (1)..( 12): Result.004 file - promoters50/1009053
atgttttcaata

SEQ ID NO: 152460 - DNA, 12 bp, Unknown
  misc_feature (1)..( 12): Result.004 file - promoters50/1009053
atttttttaata

SEQ ID NO: 152461 - DNA, 12 bp, Unknown
  misc_feature (1)..( 12): Result.004 file - promoters50/1009068
atattttttttt

SEQ ID NO: 152462 - DNA, 12 bp, Unknown
  misc_feature (1)..( 12): Result.004 file - promoters50/1009068
aaaaattcttga

SEQ ID NO: 152463 - DNA, 12 bp, Unknown
  misc_feature (1)..( 12): Result.004 file - promoters50/1009068
aaagatttttga

SEQ ID NO: 152464 - DNA, 12 bp, Unknown
  misc_feature (1)..( 12): Result.004 file - promoters50/1009068
aaaaatgaagaa

SEQ ID NO: 152465 - DNA, 8 bp, Unknown
  misc_feature (1)..( 8): Result.004 file - promoters50/1009068
aaaaccaa

SEQ ID NO: 152466 - DNA, 8 bp, Unknown
  misc_feature (1)..( 8): Result.004 file - promoters50/1009068
aaaagcaa

SEQ ID NO: 152467 - DNA, 8 bp, Unknown
  misc_feature (1)..( 8): Result.004 file - promoters50/1009068
aaaaccca

SEQ ID NO: 152468 - DNA, 11 bp, Unknown
  misc_feature (1)..( 11): Result.004 file - promoters50/1009068
aaattatgcaa

SEQ ID NO: 152469 - DNA, 11 bp, Unknown
  misc_feature (1)..( 11): Result.004 file - promoters50/1009068
aaactatacaa

SEQ ID NO: 152470 - DNA, 11 bp, Unknown
  misc_feature (1)..( 11): Result.004 file - promoters50/1009086
gaaaaatacaa

SEQ ID NO: 152471 - DNA, 7 bp, Unknown
  misc_feature (1)..( 7): Result.004 file - promoters50/1009086
aaaattg

SEQ ID NO: 152472 - DNA, 7 bp, Unknown
  misc_feature (1)..( 7): Result.004 file - promoters50/1009086
caaattg

SEQ ID NO: 152473 - DNA, 8 bp, Unknown
  misc_feature (1)..( 8): Result.004 file - promoters50/1009086
caaacttg

SEQ ID NO: 152474 - DNA, 8 bp, Unknown
  misc_feature (1)..( 8): Result.004 file - promoters50/1009086
acatattg

SEQ ID NO: 152475 - DNA, 13 bp, Unknown
  misc_feature (1)..( 13): Result.004 file - promoters50/1009086
cataaatttgata

SEQ ID NO: 152476 - DNA, 13 bp, Unknown
  misc_feature (1)..( 13): Result.004 file - promoters50/1009086
aaagaatatgatg

SEQ ID NO: 152477 - DNA, 13 bp, Unknown
  misc_feature (1)..( 13): Result.004 file - promoters50/1009086
aatagatttgagg

SEQ ID NO: 152478 - DNA, 13 bp, Unknown
  misc_feature (1)..( 13): Result.004 file - promoters50/1009086
aataaaattgata

SEQ ID NO: 152479 - DNA, 13 bp, Unknown
  misc_feature (1)..( 13): Result.004 file - promoters50/1009086
aataaactctgta

SEQ ID NO: 152480 - DNA, 10 bp, Unknown
  misc_feature (1)..( 10): Result.004 file - promoters50/1009086
ataaaacaaa

SEQ ID NO: 152481 - DNA, 10 bp, Unknown
  misc_feature (1)..( 10): Result.004 file - promoters50/1009086
ataagacatg

SEQ ID NO: 152482 - DNA, 10 bp, Unknown
  misc_feature (1)..( 10): Result.004 file - promoters50/1009086
gtaacacaaa

SEQ ID NO: 152483 - DNA, 10 bp, Unknown
  misc_feature (1)..( 10): Result.004 file - promoters50/1009112
atacaacaat

SEQ ID NO: 152484 - DNA, 15 bp, Unknown
  misc_feature (1)..( 15): Result.004 file - promoters50/1009112
tataaaaacaatttt

SEQ ID NO: 152485 - DNA, 15 bp, Unknown
  misc_feature (1)..( 15): Result.004 file - promoters50/1009112
tataaactaattatg

SEQ ID NO: 152486 - DNA, 15 bp, Unknown
  misc_feature (1)..( 15): Result.004 file - promoters50/1009112
cataaaccaataatg

SEQ ID NO: 152487 - DNA, 8 bp, Unknown
  misc_feature (1)..( 8): Result.004 file - promoters50/1009112
taactaaa

SEQ ID NO: 152488 - DNA, 8 bp, Unknown
  misc_feature (1)..( 8): Result.004 file - promoters50/1009112
taactaaa

SEQ ID NO: 152489 - DNA, 8 bp, Unknown
  misc_feature (1)..( 8): Result.004 file - promoters50/1009112
ctactaaa

SEQ ID NO: 152490 - DNA, 10 bp, Unknown
  misc_feature (1)..( 10): Result.004 file - promoters50/1009112
attttattta

SEQ ID NO: 152491 - DNA, 10 bp, Unknown
  misc_feature (1)..( 10): Result.004 file - promoters50/1009112
gtttcattgt

SEQ ID NO: 152492 - DNA, 10 bp, Unknown
  misc_feature (1)..( 10): Result.004 file - promoters50/1009112
atttcattta

SEQ ID NO: 152493 - DNA, 10 bp, Unknown
  misc_feature (1)..( 10): Result.004 file - promoters50/1009112
ttaaaaaact

SEQ ID NO: 152494 - DNA, 10 bp, Unknown
  misc_feature (1)..( 10): Result.004 file - promoters50/1009112
ttaaaacgta

SEQ ID NO: 152495 - DNA, 10 bp, Unknown
  misc_feature (1)..( 10): Result.004 file - promoters50/1009112
ataaaatgta

SEQ ID NO: 152496 - DNA, 12 bp, Unknown
  misc_feature (1)..( 12): Result.004 file - promoters50/1009112
gagaaataaaaa

SEQ ID NO: 152497 - DNA, 12 bp, Unknown
  misc_feature (1)..( 12): Result.004 file - promoters50/1009112
gttaaattaaaa

SEQ ID NO: 152498 - DNA, 12 bp, Unknown
  misc_feature (1)..( 12): Result.004 file - promoters50/1009112
gttagatttaga

SEQ ID NO: 152499 - DNA, 8 bp, Unknown
  misc_feature (1)..( 8): Result.004 file - promoters50/1009112
aattaaat

SEQ ID NO: 152500 - DNA, 8 bp, Unknown
  misc_feature (1)..( 8): Result.004 file - promoters50/1009112
aataaaac

SEQ ID NO: 152501 - DNA, 8 bp, Unknown
  misc_feature (1)..( 8): Result.004 file - promoters50/1009112
actaaaac

SEQ ID NO: 152502 - DNA, 9 bp, Unknown
  misc_feature (1)..( 9): Result.004 file - promoters50/1009112
tttttaaaa

SEQ ID NO: 152503 - DNA, 9 bp, Unknown
  misc_feature (1)..( 9): Result.004 file - promoters50/1009112
atttcaaag

SEQ ID NO: 152504 - DNA, 9 bp, Unknown
  misc_feature (1)..( 9): Result.004 file - promoters50/1009112
ttttgaaat

SEQ ID NO: 152505 - DNA, 9 bp, Unknown
  misc_feature (1)..( 9): Result.004 file - promoters50/1009112
acttgtaat

SEQ ID NO: 152506 - DNA, 14 bp, Unknown
  misc_feature (1)..( 14): Result.004 file - promoters50/1009112
taaaaacaataata

SEQ ID NO: 152507 - DNA, 14 bp, Unknown
  misc_feature (1)..( 14): Result.004 file - promoters50/1009112
ataaaccaataatg

SEQ ID NO: 152508 - DNA, 14 bp, Unknown
  misc_feature (1)..( 14): Result.004 file - promoters50/1009112
ataaactaattatg

SEQ ID NO: 152509 - DNA, 8 bp, Unknown
  misc_feature (1)..( 8): Result.004 file - promoters50/1009112
gataataa

SEQ ID NO: 152510 - DNA, 8 bp, Unknown
  misc_feature (1)..( 8): Result.004 file - promoters50/1009112
aatattaa

SEQ ID NO: 152511 - DNA, 8 bp, Unknown
  misc_feature (1)..( 8): Result.004 file - promoters50/1009112
attattat

SEQ ID NO: 152512 - DNA, 9 bp, Unknown
  misc_feature (1)..( 9): Result.004 file - promoters50/1009112
aaaactgta

SEQ ID NO: 152513 - DNA, 9 bp, Unknown
  misc_feature (1)..( 9): Result.004 file - promoters50/1009112
taaaatgta

SEQ ID NO: 152514 - DNA, 9 bp, Unknown
  misc_feature (1)..( 9): Result.004 file - promoters50/1009112
taaaacgta

SEQ ID NO: 152515 - DNA, 8 bp, Unknown
  misc_feature (1)..( 8): Result.004 file - promoters50/1009112
gaaaatta

SEQ ID NO: 152516 - DNA, 8 bp, Unknown
  misc_feature (1)..( 8): Result.004 file - promoters50/1009112
gaagattt

SEQ ID NO: 152517 - DNA, 9 bp, Unknown
  misc_feature (1)..( 9): Result.004 file - promoters50/1009136
acagagtta

SEQ ID NO: 152518 - DNA, 11 bp, Unknown
  misc_feature (1)..( 11): Result.004 file - promoters50/1009136
cattttcaatt

SEQ ID NO: 152519 - DNA, 11 bp, Unknown
  misc_feature (1)..( 11): Result.004 file - promoters50/1009136
ttgattcaatg

SEQ ID NO: 152520 - DNA, 11 bp, Unknown
  misc_feature (1)..( 11): Result.004 file - promoters50/1009136
tgattttaatt

SEQ ID NO: 152521 - DNA, 11 bp, Unknown
  misc_feature (1)..( 11): Result.004 file - promoters50/1009136
ataattcaact

SEQ ID NO: 152522 - DNA, 11 bp, Unknown
  misc_feature (1)..( 11): Result.004 file - promoters50/1009136
ataaatcaaga

SEQ ID NO: 152523 - DNA, 11 bp, Unknown
  misc_feature (1)..( 11): Result.004 file - promoters50/1009136
aactttaaata

SEQ ID NO: 152524 - DNA, 10 bp, Unknown
  misc_feature (1)..( 10): Result.004 file - promoters50/1009136
aatttttata

SEQ ID NO: 152525 - DNA, 10 bp, Unknown
  misc_feature (1)..( 10): Result.004 file - promoters50/1009136
catttatata

SEQ ID NO: 152526 - DNA, 10 bp, Unknown
  misc_feature (1)..( 10): Result.004 file - promoters50/1009136
gatttttagt

SEQ ID NO: 152527 - DNA, 10 bp, Unknown
  misc_feature (1)..( 10): Result.004 file - promoters50/1009136
aatttatata

SEQ ID NO: 152528 - DNA, 10 bp, Unknown
  misc_feature (1)..( 10): Result.004 file - promoters50/1009136
actttaaata

SEQ ID NO: 152529 - DNA, 10 bp, Unknown
  misc_feature (1)..( 10): Result.004 file - promoters50/1009136
gattttaatt

SEQ ID NO: 152530 - DNA, 10 bp, Unknown
  misc_feature (1)..( 10): Result.004 file - promoters50/1009136
ttatagatat

SEQ ID NO: 152531 - DNA, 10 bp, Unknown
  misc_feature (1)..( 10): Result.004 file - promoters50/1009136
atataaataa

SEQ ID NO: 152532 - DNA, 10 bp, Unknown
  misc_feature (1)..( 10): Result.004 file - promoters50/1009136
atataattca

SEQ ID NO: 152533 - DNA, 10 bp, Unknown
  misc_feature (1)..( 10): Result.004 file - promoters50/1009136
caaaaaataa

SEQ ID NO: 152534 - DNA, 10 bp, Unknown
  misc_feature (1)..( 10): Result.004 file - promoters50/1009136
ctttaaatac

SEQ ID NO: 152535 - DNA, 10 bp, Unknown
  misc_feature (1)..( 10): Result.004 file - promoters50/1009136
attttaatta

SEQ ID NO: 152536 - DNA, 15 bp, Unknown
  misc_feature (1)..( 15): Result.004 file - promoters50/1009136
ttaatcataattaac

SEQ ID NO: 152537 - DNA, 15 bp, Unknown
  misc_feature (1)..( 15): Result.004 file - promoters50/1009136
tcaattatattcata

SEQ ID NO: 152538 - DNA, 15 bp, Unknown
  misc_feature (1)..( 15): Result.004 file - promoters50/1009136
gtaaacatggctaca

SEQ ID NO: 152539 - DNA, 15 bp, Unknown
  misc_feature (1)..( 15): Result.004 file - promoters50/1009136
gtaaacatgaaagag

SEQ ID NO: 152540 - DNA, 15 bp, Unknown
  misc_feature (1)..( 15): Result.004 file - promoters50/1009136
aatttcatttatatc

SEQ ID NO: 152541 - DNA, 15 bp, Unknown
  misc_feature (1)..( 15): Result.004 file - promoters50/1009136
aaataattttccttt

SEQ ID NO: 152542 - DNA, 11 bp, Unknown
  misc_feature (1)..( 11): Result.004 file - promoters50/1009136
attatgttata

SEQ ID NO: 152543 - DNA, 11 bp, Unknown
  misc_feature (1)..( 11): Result.004 file - promoters50/1009136
tatattttagg

SEQ ID NO: 152544 - DNA, 11 bp, Unknown
  misc_feature (1)..( 11): Result.004 file - promoters50/1009136
aaaattatagg

SEQ ID NO: 152545 - DNA, 11 bp, Unknown
  misc_feature (1)..( 11): Result.004 file - promoters50/1009136
tagattctagc

SEQ ID NO: 152546 - DNA, 11 bp, Unknown
  misc_feature (1)..( 11): Result.004 file - promoters50/1009136
aaaaatatatc

SEQ ID NO: 152547 - DNA, 11 bp, Unknown
  misc_feature (1)..( 11): Result.004 file - promoters50/1009136
actaaaataac

SEQ ID NO: 152548 - DNA, 11 bp, Unknown
  misc_feature (1)..( 11): Result.004 file - promoters50/1009136
gaattatactt

SEQ ID NO: 152549 - DNA, 11 bp, Unknown
  misc_feature (1)..( 11): Result.004 file - promoters50/1009136
gaaatataaat

SEQ ID NO: 152550 - DNA, 11 bp, Unknown
  misc_feature (1)..( 11): Result.004 file - promoters50/1009136
taattatgtta

SEQ ID NO: 152551 - DNA, 11 bp, Unknown
  misc_feature (1)..( 11): Result.004 file - promoters50/1009136
ggtatataatt

SEQ ID NO: 152552 - DNA, 11 bp, Unknown
  misc_feature (1)..( 11): Result.004 file - promoters50/1009136
aaaaaataatt

SEQ ID NO: 152553 - DNA, 11 bp, Unknown
  misc_feature (1)..( 11): Result.004 file - promoters50/1009136
taaatacaatt

SEQ ID NO: 152554 - DNA, 13 bp, Unknown
  misc_feature (1)..( 13): Result.004 file - promoters50/1009136
ccaaattagacat

SEQ ID NO: 152555 - DNA, 13 bp, Unknown
  misc_feature (1)..( 13): Result.004 file - promoters50/1009136
aaaaattatagga

SEQ ID NO: 152556 - DNA, 13 bp, Unknown
  misc_feature (1)..( 13): Result.004 file - promoters50/1009136
ccacattagttgt

SEQ ID NO: 152557 - DNA, 13 bp, Unknown
  misc_feature (1)..( 13): Result.004 file - promoters50/1009136
gaaaaatatatca

SEQ ID NO: 152558 - DNA, 13 bp, Unknown
  misc_feature (1)..( 13): Result.004 file - promoters50/1009136
cagaaataaatca

SEQ ID NO: 152559 - DNA, 13 bp, Unknown
  misc_feature (1)..( 13): Result.004 file - promoters50/1009136
ctaaaataactca

SEQ ID NO: 152560 - DNA, 14 bp, Unknown
  misc_feature (1)..( 14): Result.004 file - promoters50/1009136
catctatatatatc

SEQ ID NO: 152561 - DNA, 14 bp, Unknown
  misc_feature (1)..( 14): Result.004 file - promoters50/1009136
tccttatttatacc

SEQ ID NO: 152562 - DNA, 14 bp, Unknown
  misc_feature (1)..( 14): Result.004 file - promoters50/1009136
tcagtataaataag

SEQ ID NO: 152563 - DNA, 14 bp, Unknown
  misc_feature (1)..( 14): Result.004 file - promoters50/1009136
catttatatgtatc

SEQ ID NO: 152564 - DNA, 14 bp, Unknown
  misc_feature (1)..( 14): Result.004 file - promoters50/1009136
tacttatattaatt

SEQ ID NO: 152565 - DNA, 14 bp, Unknown
  misc_feature (1)..( 14): Result.004 file - promoters50/1009142
cccctataaaagga

SEQ ID NO: 152566 - DNA, 13 bp, Unknown
  misc_feature (1)..( 13): Result.004 file - promoters50/1009142
ggaagtgaatggc

SEQ ID NO: 152567 - DNA, 13 bp, Unknown
  misc_feature (1)..( 13): Result.004 file - promoters50/1009142
aaaagtaaatcat

SEQ ID NO: 152568 - DNA, 13 bp, Unknown
  misc_feature (1)..( 13): Result.004 file - promoters50/1009142
ggcagtgaacggc

SEQ ID NO: 152569 - DNA, 13 bp, Unknown
  misc_feature (1)..( 13): Result.004 file - promoters50/1009142
taaagtgaagtca

SEQ ID NO: 152570 - DNA, 13 bp, Unknown
  misc_feature (1)..( 13): Result.004 file - promoters50/1009142
aaaagagaagaaa

SEQ ID NO: 152571 - DNA, 13 bp, Unknown
  misc_feature (1)..( 13): Result.004 file - promoters50/1009142
aaaagtattagtg

SEQ ID NO: 152572 - DNA, 13 bp, Unknown
  misc_feature (1)..( 13): Result.004 file - promoters50/1009142
aaaagagagtttg

SEQ ID NO: 152573 - DNA, 17 bp, Unknown
  misc_feature (1)..( 17): Result.004 file - promoters50/1009142
ataatgctaagacgagt

SEQ ID NO: 152574 - DNA, 17 bp, Unknown
  misc_feature (1)..( 17): Result.004 file - promoters50/1009142
tgtatggtaagacaaaa

SEQ ID NO: 152575 - DNA, 17 bp, Unknown
  misc_feature (1)..( 17): Result.004 file - promoters50/1009142
ataccaagaagaaaaaa

SEQ ID NO: 152576 - DNA, 17 bp, Unknown
  misc_feature (1)..( 17): Result.004 file - promoters50/1009142
tatatgtaaacaaaggt

SEQ ID NO: 152577 - DNA, 17 bp, Unknown
  misc_feature (1)..( 17): Result.004 file - promoters50/1009142
tgtatggttggttcatt

SEQ ID NO: 152578 - DNA, 17 bp, Unknown
  misc_feature (1)..( 17): Result.004 file - promoters50/1009142
agtttccaacgaagccg

SEQ ID NO: 152579 - DNA, 14 bp, Unknown
  misc_feature (1)..( 14): Result.004 file - promoters50/1009142
atcgttttttgtgc

SEQ ID NO: 152580 - DNA, 14 bp, Unknown
  misc_feature (1)..( 14): Result.004 file - promoters50/1009142
gtatctttttgtgc

SEQ ID NO: 152581 - DNA, 14 bp, Unknown
  misc_feature (1)..( 14): Result.004 file - promoters50/1009142
actgaattttgttt

SEQ ID NO: 152582 - DNA, 14 bp, Unknown
  misc_feature (1)..( 14): Result.004 file - promoters50/1009142
gctaaattatgtta

SEQ ID NO: 152583 - DNA, 14 bp, Unknown
  misc_feature (1)..( 14): Result.004 file - promoters50/1009142
tcacctttttaaat

SEQ ID NO: 152584 - DNA, 14 bp, Unknown
  misc_feature (1)..( 14): Result.004 file - promoters50/1009142
atagaaatatgttt

SEQ ID NO: 152585 - DNA, 14 bp, Unknown
  misc_feature (1)..( 14): Result.004 file - promoters50/1009169
gctaagttatcaaa

SEQ ID NO: 152586 - DNA, 7 bp, Unknown
  misc_feature (1)..( 7): Result.004 file - promoters50/1009169
gtataaa

SEQ ID NO: 152587 - DNA, 7 bp, Unknown
  misc_feature (1)..( 7): Result.004 file - promoters50/1009169
atataaa

SEQ ID NO: 152588 - DNA, 7 bp, Unknown
  misc_feature (1)..( 7): Result.004 file - promoters50/1009207
atatacc

SEQ ID NO: 152589 - DNA, 7 bp, Unknown
  misc_feature (1)..( 7): Result.004 file - promoters50/1009207
gatcaat

SEQ ID NO: 152590 - DNA, 7 bp, Unknown
  misc_feature (1)..( 7): Result.004 file - promoters50/1009207
tatcaat

SEQ ID NO: 152591 - DNA, 7 bp, Unknown
  misc_feature (1)..( 7): Result.004 file - promoters50/1009207
tataaat

SEQ ID NO: 152592 - DNA, 10 bp, Unknown
  misc_feature (1)..( 10): Result.004 file - promoters50/1009207
taaaacacca

SEQ ID NO: 152593 - DNA, 10 bp, Unknown
  misc_feature (1)..( 10): Result.004 file - promoters50/1009207
taaaacatta

SEQ ID NO: 152594 - DNA, 10 bp, Unknown
  misc_feature (1)..( 10): Result.004 file - promoters50/1009207
gaaaaaatta

SEQ ID NO: 152595 - DNA, 10 bp, Unknown
  misc_feature (1)..( 10): Result.004 file - promoters50/1009207
caaaatgata

SEQ ID NO: 152596 - DNA, 10 bp, Unknown
  misc_feature (1)..( 10): Result.004 file - promoters50/1009207
aaaaattata

SEQ ID NO: 152597 - DNA, 11 bp, Unknown
  misc_feature (1)..( 11): Result.004 file - promoters50/1009211
aaaacattact

SEQ ID NO: 152598 - DNA, 10 bp, Unknown
  misc_feature (1)..( 10): Result.004 file - promoters50/1009211
tactttaata

SEQ ID NO: 152599 - DNA, 10 bp, Unknown
  misc_feature (1)..( 10): Result.004 file - promoters50/1009211
tactataaat

SEQ ID NO: 152600 - DNA, 10 bp, Unknown
  misc_feature (1)..( 10): Result.004 file - promoters50/1009211
cactataaaa

SEQ ID NO: 152601 - DNA, 10 bp, Unknown
  misc_feature (1)..( 10): Result.004 file - promoters50/1009211
gccttaaata

SEQ ID NO: 152602 - DNA, 11 bp, Unknown
  misc_feature (1)..( 11): Result.004 file - promoters50/1009211
atttatgaatc

SEQ ID NO: 152603 - DNA, 11 bp, Unknown
  misc_feature (1)..( 11): Result.004 file - promoters50/1009211
ctttataaaac

SEQ ID NO: 152604 - DNA, 13 bp, Unknown
  misc_feature (1)..( 13): Result.004 file - promoters50/1009211
cttcagattcagg

SEQ ID NO: 152605 - DNA, 13 bp, Unknown
  misc_feature (1)..( 13): Result.004 file - promoters50/1009211
caaaagaatcagt

SEQ ID NO: 152606 - DNA, 13 bp, Unknown
  misc_feature (1)..( 13): Result.004 file - promoters50/1009211
aaactgaaccagt

SEQ ID NO: 152607 - DNA, 13 bp, Unknown
  misc_feature (1)..( 13): Result.004 file - promoters50/1009211
tcaaataattctc

SEQ ID NO: 152608 - DNA, 13 bp, Unknown
  misc_feature (1)..( 13): Result.004 file - promoters50/1009211
tcaattaatcttt

SEQ ID NO: 152609 - DNA, 13 bp, Unknown
  misc_feature (1)..( 13): Result.004 file - promoters50/1009258
caaaacaattcaa

SEQ ID NO: 152610 - DNA, 13 bp, Unknown
  misc_feature (1)..( 13): Result.004 file - promoters50/1009258
tgattattctctc

SEQ ID NO: 152611 - DNA, 13 bp, Unknown
  misc_feature (1)..( 13): Result.004 file - promoters50/1009258
tgtgtcgtctctc

SEQ ID NO: 152612 - DNA, 13 bp, Unknown
  misc_feature (1)..( 13): Result.004 file - promoters50/1009276
tgataattctcta

SEQ ID NO: 152613 - DNA, 8 bp, Unknown
  misc_feature (1)..( 8): Result.004 file - promoters50/1009276
caaaaata

SEQ ID NO: 152614 - DNA, 8 bp, Unknown
  misc_feature (1)..( 8): Result.004 file - promoters50/1009276
caataatt

SEQ ID NO: 152615 - DNA, 8 bp, Unknown
  misc_feature (1)..( 8): Result.004 file - promoters50/1009276
aaaagata

SEQ ID NO: 152616 - DNA, 9 bp, Unknown
  misc_feature (1)..( 9): Result.004 file - promoters50/1009276
atttacaca

SEQ ID NO: 152617 - DNA, 9 bp, Unknown
  misc_feature (1)..( 9): Result.004 file - promoters50/1009276
atttaccaa

SEQ ID NO: 152618 - DNA, 9 bp, Unknown
  misc_feature (1)..( 9): Result.004 file - promoters50/1009276
cttttccaa

SEQ ID NO: 152619 - DNA, 7 bp, Unknown
  misc_feature (1)..( 7): Result.004 file - promoters50/1009276
ttcaaat

SEQ ID NO: 152620 - DNA, 7 bp, Unknown
  misc_feature (1)..( 7): Result.004 file - promoters50/1009276
ttcaaaa

SEQ ID NO: 152621 - DNA, 7 bp, Unknown
  misc_feature (1)..( 7): Result.004 file - promoters50/1009276
gtcaaaa

SEQ ID NO: 152622 - DNA, 9 bp, Unknown
  misc_feature (1)..( 9): Result.004 file - promoters50/1009276
aaatttgac

SEQ ID NO: 152623 - DNA, 9 bp, Unknown
  misc_feature (1)..( 9): Result.004 file - promoters50/1009276
aaaattgac

SEQ ID NO: 152624 - DNA, 9 bp, Unknown
  misc_feature (1)..( 9): Result.004 file - promoters50/1009335
taaattgat

SEQ ID NO: 152625 - DNA, 9 bp, Unknown
  misc_feature (1)..( 9): Result.004 file - promoters50/1009335
tatgattct

SEQ ID NO: 152626 - DNA, 9 bp, Unknown
  misc_feature (1)..( 9): Result.004 file - promoters50/1009335
tatgaatct

SEQ ID NO: 152627 - DNA, 9 bp, Unknown
  misc_feature (1)..( 9): Result.004 file - promoters50/1009335
gatgattgt

SEQ ID NO: 152628 - DNA, 11 bp, Unknown
  misc_feature (1)..( 11): Result.004 file - promoters50/1009335
acctttaacca

SEQ ID NO: 152629 - DNA, 11 bp, Unknown
  misc_feature (1)..( 11): Result.004 file - promoters50/1009335
acctttgacca

SEQ ID NO: 152630 - DNA, 11 bp, Unknown
  misc_feature (1)..( 11): Result.004 file - promoters50/1009335
cacttcaactt

SEQ ID NO: 152631 - DNA, 11 bp, Unknown
  misc_feature (1)..( 11): Result.004 file - promoters50/1009335
tctgttgaccg

SEQ ID NO: 152632 - DNA, 8 bp, Unknown
  misc_feature (1)..( 8): Result.004 file - promoters50/1009335
agtaaatg

SEQ ID NO: 152633 - DNA, 8 bp, Unknown
  misc_feature (1)..( 8): Result.004 file - promoters50/1009335
attaaatg

SEQ ID NO: 152634 - DNA, 8 bp, Unknown
  misc_feature (1)..( 8): Result.004 file - promoters50/1009335
agtaaatc

SEQ ID NO: 152635 - DNA, 10 bp, Unknown
  misc_feature (1)..( 10): Result.004 file - promoters50/1009335
tataggttct

SEQ ID NO: 152636 - DNA, 10 bp, Unknown
  misc_feature (1)..( 10): Result.004 file - promoters50/1009335
tataagttaa

SEQ ID NO: 152637 - DNA, 10 bp, Unknown
  misc_feature (1)..( 10): Result.004 file - promoters50/1009335
tattagttaa

SEQ ID NO: 152638 - DNA, 12 bp, Unknown
  misc_feature (1)..( 12): Result.004 file - promoters50/1009335
cttcttagagga

SEQ ID NO: 152639 - DNA, 12 bp, Unknown
  misc_feature (1)..( 12): Result.004 file - promoters50/1009335
cttattagttaa

SEQ ID NO: 152640 - DNA, 12 bp, Unknown
  misc_feature (1)..( 12): Result.004 file - promoters50/1009354
aatataagttaa

SEQ ID NO: 152641 - DNA, 7 bp, Unknown
  misc_feature (1)..( 7): Result.004 file - promoters50/1009354
gattcta

SEQ ID NO: 152642 - DNA, 7 bp, Unknown
  misc_feature (1)..( 7): Result.004 file - promoters50/1009354
gattctt

SEQ ID NO: 152643 - DNA, 7 bp, Unknown
  misc_feature (1)..( 7): Result.004 file - promoters50/1009354
gatactt

SEQ ID NO: 152644 - DNA, 8 bp, Unknown
  misc_feature (1)..( 8): Result.004 file - promoters50/1009354
taagaaat

SEQ ID NO: 152645 - DNA, 8 bp, Unknown
  misc_feature (1)..( 8): Result.004 file - promoters50/1009354
taagaact

SEQ ID NO: 152646 - DNA, 8 bp, Unknown
  misc_feature (1)..( 8): Result.004 file - promoters50/1009426
gaagaact

SEQ ID NO: 152647 - DNA, 9 bp, Unknown
  misc_feature (1)..( 9): Result.004 file - promoters50/1009426
ctattatta

SEQ ID NO: 152648 - DNA, 9 bp, Unknown
  misc_feature (1)..( 9): Result.004 file - promoters50/1009426
ctattattt

SEQ ID NO: 152649 - DNA, 9 bp, Unknown
  misc_feature (1)..( 9): Result.004 file - promoters50/1009426
ttattgtta

SEQ ID NO: 152650 - DNA, 7 bp, Unknown
  misc_feature (1)..( 7): Result.004 file - promoters50/1009426
tctcttg

SEQ ID NO: 152651 - DNA, 7 bp, Unknown
  misc_feature (1)..( 7): Result.004 file - promoters50/1009426
tctcttg

SEQ ID NO: 152652 - DNA, 7 bp, Unknown
  misc_feature (1)..( 7): Result.004 file - promoters50/1009426
tcttttg

SEQ ID NO: 152653 - DNA, 10 bp, Unknown
  misc_feature (1)..( 10): Result.004 file - promoters50/1009426
tttctatata

SEQ ID NO: 152654 - DNA, 10 bp, Unknown
  misc_feature (1)..( 10): Result.004 file - promoters50/1009426
cttctatata

SEQ ID NO: 152655 - DNA, 10 bp, Unknown
  misc_feature (1)..( 10): Result.004 file - promoters50/1009430
tttctatata

SEQ ID NO: 152656 - DNA, 10 bp, Unknown
  misc_feature (1)..( 10): Result.004 file - promoters50/1009430
gataatttta

SEQ ID NO: 152657 - DNA, 10 bp, Unknown
  misc_feature (1)..( 10): Result.004 file - promoters50/1009430
aatatttttc

SEQ ID NO: 152658 - DNA, 10 bp, Unknown
  misc_feature (1)..( 10): Result.004 file - promoters50/1009430
aatattttat

SEQ ID NO: 152659 - DNA, 10 bp, Unknown
  misc_feature (1)..( 10): Result.004 file - promoters50/1009430
aatatgttaa

SEQ ID NO: 152660 - DNA, 10 bp, Unknown
  misc_feature (1)..( 10): Result.004 file - promoters50/1009430
attttatata

SEQ ID NO: 152661 - DNA, 10 bp, Unknown
  misc_feature (1)..( 10): Result.004 file - promoters50/1009430
ctcttaaata

SEQ ID NO: 152662 - DNA, 10 bp, Unknown
  misc_feature (1)..( 10): Result.004 file - promoters50/1009430
ctctgaaaca

SEQ ID NO: 152663 - DNA, 10 bp, Unknown
  misc_feature (1)..( 10): Result.004 file - promoters50/1009430
agcttgaatc

SEQ ID NO: 152664 - DNA, 10 bp, Unknown
  misc_feature (1)..( 10): Result.004 file - promoters50/1009430
agacaatttt

SEQ ID NO: 152665 - DNA, 10 bp, Unknown
  misc_feature (1)..( 10): Result.004 file - promoters50/1009430
agaaaatttc

SEQ ID NO: 152666 - DNA, 10 bp, Unknown
  misc_feature (1)..( 10): Result.004 file - promoters50/1009430
tcaaagttct

SEQ ID NO: 152667 - DNA, 10 bp, Unknown
  misc_feature (1)..( 10): Result.004 file - promoters50/1009430
aaaaaattcc

SEQ ID NO: 152668 - DNA, 12 bp, Unknown
  misc_feature (1)..( 12): Result.004 file - promoters50/1009430
taatagttatgt

SEQ ID NO: 152669 - DNA, 12 bp, Unknown
  misc_feature (1)..( 12): Result.004 file - promoters50/1009430
ttataattatgt

SEQ ID NO: 152670 - DNA, 12 bp, Unknown
  misc_feature (1)..( 12): Result.004 file - promoters50/1009430
aaataattatac

SEQ ID NO: 152671 - DNA, 12 bp, Unknown
  misc_feature (1)..( 12): Result.004 file - promoters50/1009437
ttaaaatctcta

SEQ ID NO: 152672 - DNA, 7 bp, Unknown
  misc_feature (1)..( 7): Result.004 file - promoters50/1009437
ctagaag

SEQ ID NO: 152673 - DNA, 7 bp, Unknown
  misc_feature (1)..( 7): Result.004 file - promoters50/1009437
ctagaat

SEQ ID NO: 152674 - DNA, 7 bp, Unknown
  misc_feature (1)..( 7): Result.004 file - promoters50/1009437
ctataat

SEQ ID NO: 152675 - DNA, 8 bp, Unknown
  misc_feature (1)..( 8): Result.004 file - promoters50/1009437
gttggttt

SEQ ID NO: 152676 - DNA, 8 bp, Unknown
  misc_feature (1)..( 8): Result.004 file - promoters50/1009437
tttgattt

SEQ ID NO: 152677 - DNA, 8 bp, Unknown
  misc_feature (1)..( 8): Result.004 file - promoters50/1009437
ttttattt

SEQ ID NO: 152678 - DNA, 7 bp, Unknown
  misc_feature (1)..( 7): Result.004 file - promoters50/1009437
gtttttt

SEQ ID NO: 152679 - DNA, 7 bp, Unknown
  misc_feature (1)..( 7): Result.004 file - promoters50/1009437
ctttttt

SEQ ID NO: 152680 - DNA, 7 bp, Unknown
  misc_feature (1)..( 7): Result.004 file - promoters50/1009437
cttcttt

SEQ ID NO: 152681 - DNA, 7 bp, Unknown
  misc_feature (1)..( 7): Result.004 file - promoters50/1009437
tttctta

SEQ ID NO: 152682 - DNA, 7 bp, Unknown
  misc_feature (1)..( 7): Result.004 file - promoters50/1009437
tttcttt

SEQ ID NO: 152683 - DNA, 7 bp, Unknown
  misc_feature (1)..( 7): Result.004 file - promoters50/1009520
cttcttt

SEQ ID NO: 152684 - DNA, 10 bp, Unknown
  misc_feature (1)..( 10): Result.004 file - promoters50/1009520
aaatatataa

SEQ ID NO: 152685 - DNA, 10 bp, Unknown
  misc_feature (1)..( 10): Result.004 file - promoters50/1009520
gcatatatta

SEQ ID NO: 152686 - DNA, 10 bp, Unknown
  misc_feature (1)..( 10): Result.004 file - promoters50/1009520
taatataaag

SEQ ID NO: 152687 - DNA, 10 bp, Unknown
  misc_feature (1)..( 10): Result.004 file - promoters50/1009520
gtatatatat

SEQ ID NO: 152688 - DNA, 10 bp, Unknown
  misc_feature (1)..( 10): Result.004 file - promoters50/1009520
tcttatataa

SEQ ID NO: 152689 - DNA, 10 bp, Unknown
  misc_feature (1)..( 10): Result.004 file - promoters50/1009528
tcttctattt

SEQ ID NO: 152690 - DNA, 9 bp, Unknown
  misc_feature (1)..( 9): Result.004 file - promoters50/1009528
gtttatttg

SEQ ID NO: 152691 - DNA, 9 bp, Unknown
  misc_feature (1)..( 9): Result.004 file - promoters50/1009528
gtttatccc

SEQ ID NO: 152692 - DNA, 9 bp, Unknown
  misc_feature (1)..( 9): Result.004 file - promoters50/1009528
ctttaaccc

SEQ ID NO: 152693 - DNA, 6 bp, Unknown
  misc_feature (1)..( 6): Result.004 file - promoters50/1009528
acatac

SEQ ID NO: 152694 - DNA, 6 bp, Unknown
  misc_feature (1)..( 6): Result.004 file - promoters50/1009528
acatac

SEQ ID NO: 152695 - DNA, 6 bp, Unknown
  misc_feature (1)..( 6): Result.004 file - promoters50/1009616
acatac

SEQ ID NO: 152696 - DNA, 13 bp, Unknown
  misc_feature (1)..( 13): Result.004 file - promoters50/1009616
aaagtataaacac

SEQ ID NO: 152697 - DNA, 13 bp, Unknown
  misc_feature (1)..( 13): Result.004 file - promoters50/1009616
aaagtctaataca

SEQ ID NO: 152698 - DNA, 14 bp, Unknown
  misc_feature (1)..( 14): Result.004 file - promoters50/1009616
tatatattaacaca

SEQ ID NO: 152699 - DNA, 14 bp, Unknown
  misc_feature (1)..( 14): Result.004 file - promoters50/1009616
aaaatctacgcata

SEQ ID NO: 152700 - DNA, 14 bp, Unknown
  misc_feature (1)..( 14): Result.004 file - promoters50/1009616
caaatatacaaaaa

SEQ ID NO: 152701 - DNA, 14 bp, Unknown
  misc_feature (1)..( 14): Result.004 file - promoters50/1009616
caaatatgtttctt

SEQ ID NO: 152702 - DNA, 20 bp, Unknown
  misc_feature (1)..( 20): Result.004 file - promoters50/1009616
acactaaaatagtttttttt

SEQ ID NO: 152703 - DNA, 20 bp, Unknown
  misc_feature (1)..( 20): Result.004 file - promoters50/1009616
acacttaaaaagtctttttt

SEQ ID NO: 152704 - DNA, 20 bp, Unknown
  misc_feature (1)..( 20): Result.004 file - promoters50/1009616
tgagatcaaaagtgaaaaca

SEQ ID NO: 152705 - DNA, 20 bp, Unknown
  misc_feature (1)..( 20): Result.004 file - promoters50/1009616
aaaattaaaaagaatacaaa

SEQ ID NO: 152706 - DNA, 20 bp, Unknown
  misc_feature (1)..( 20): Result.004 file - promoters50/1009616
aagcccatattatcttttaa

SEQ ID NO: 152707 - DNA, 20 bp, Unknown
  misc_feature (1)..( 20): Result.004 file - promoters50/1009616
atatataaaaatttttctgt

SEQ ID NO: 152708 - DNA, 20 bp, Unknown
  misc_feature (1)..( 20): Result.004 file - promoters50/1009616
caaccaaaataaaccgaggt

SEQ ID NO: 152709 - DNA, 10 bp, Unknown
  misc_feature (1)..( 10): Result.004 file - promoters50/1009616
ttaaacaaaa

SEQ ID NO: 152710 - DNA, 10 bp, Unknown
  misc_feature (1)..( 10): Result.004 file - promoters50/1009616
ctaaacaaaa

SEQ ID NO: 152711 - DNA, 10 bp, Unknown
  misc_feature (1)..( 10): Result.004 file - promoters50/1009616
gtaaccaaat

SEQ ID NO: 152712 - DNA, 10 bp, Unknown
  misc_feature (1)..( 10): Result.004 file - promoters50/1009616
ctagacagag

SEQ ID NO: 152713 - DNA, 10 bp, Unknown
  misc_feature (1)..( 10): Result.004 file - promoters50/1009616
atagacacaa

SEQ ID NO: 152714 - DNA, 10 bp, Unknown
  misc_feature (1)..( 10): Result.004 file - promoters50/1009616
tcaaacacta

SEQ ID NO: 152715 - DNA, 11 bp, Unknown
  misc_feature (1)..( 11): Result.004 file - promoters50/1009616
ttaatattttt

SEQ ID NO: 152716 - DNA, 11 bp, Unknown
  misc_feature (1)..( 11): Result.004 file - promoters50/1009616
ttactattttt

SEQ ID NO: 152717 - DNA, 11 bp, Unknown
  misc_feature (1)..( 11): Result.004 file - promoters50/1009616
gtaataattta

SEQ ID NO: 152718 - DNA, 11 bp, Unknown
  misc_feature (1)..( 11): Result.004 file - promoters50/1009616
ttaatgtttgc

SEQ ID NO: 152719 - DNA, 11 bp, Unknown
  misc_feature (1)..( 11): Result.004 file - promoters50/1009616
ctaataacaac

SEQ ID NO: 152720 - DNA, 11 bp, Unknown
  misc_feature (1)..( 11): Result.004 file - promoters50/1009654
gtaataacaga

SEQ ID NO: 152721 - DNA, 8 bp, Unknown
  misc_feature (1)..( 8): Result.004 file - promoters50/1009654
actaaatc

SEQ ID NO: 152722 - DNA, 8 bp, Unknown
  misc_feature (1)..( 8): Result.004 file - promoters50/1009654
aataaatc

SEQ ID NO: 152723 - DNA, 8 bp, Unknown
  misc_feature (1)..( 8): Result.004 file - promoters50/1009654
aataaata

SEQ ID NO: 152724 - DNA, 7 bp, Unknown
  misc_feature (1)..( 7): Result.004 file - promoters50/1009654
aactaag

SEQ ID NO: 152725 - DNA, 7 bp, Unknown
  misc_feature (1)..( 7): Result.004 file - promoters50/1009654
aactaaa

SEQ ID NO: 152726 - DNA, 7 bp, Unknown
  misc_feature (1)..( 7): Result.004 file - promoters50/1009654
gactaaa

SEQ ID NO: 152727 - DNA, 7 bp, Unknown
  misc_feature (1)..( 7): Result.004 file - promoters50/1009654
taaaaga

SEQ ID NO: 152728 - DNA, 7 bp, Unknown
  misc_feature (1)..( 7): Result.004 file - promoters50/1009654
taaaagg

SEQ ID NO: 152729 - DNA, 7 bp, Unknown
  misc_feature (1)..( 7): Result.004 file - promoters50/1009654
aaaaaga

SEQ ID NO: 152730 - DNA, 9 bp, Unknown
  misc_feature (1)..( 9): Result.004 file - promoters50/1009654
aaaaaagaa

SEQ ID NO: 152731 - DNA, 9 bp, Unknown
  misc_feature (1)..( 9): Result.004 file - promoters50/1009654
aaaaaaaga

SEQ ID NO: 152732 - DNA, 10 bp, Unknown
  misc_feature (1)..( 10): Result.004 file - promoters50/1009654
aaagaaagaa

SEQ ID NO: 152733 - DNA, 8 bp, Unknown
  misc_feature (1)..( 8): Result.004 file - promoters50/1009654
atttgaat

SEQ ID NO: 152734 - DNA, 8 bp, Unknown
  misc_feature (1)..( 8): Result.004 file - promoters50/1009654
atttaaat

SEQ ID NO: 152735 - DNA, 8 bp, Unknown
  misc_feature (1)..( 8): Result.004 file - promoters50/1009654
atttgaat

SEQ ID NO: 152736 - DNA, 6 bp, Unknown
  misc_feature (1)..( 6): Result.004 file - promoters50/1009654
aaattt

SEQ ID NO: 152737 - DNA, 6 bp, Unknown
  misc_feature (1)..( 6): Result.004 file - promoters50/1009654
aaattt

SEQ ID NO: 152738 - DNA, 6 bp, Unknown
  misc_feature (1)..( 6): Result.004 file - promoters50/1009654
aaattt

SEQ ID NO: 152739 - DNA, 8 bp, Unknown
  misc_feature (1)..( 8): Result.004 file - promoters50/1009654
ggactaat

SEQ ID NO: 152740 - DNA, 8 bp, Unknown
  misc_feature (1)..( 8): Result.004 file - promoters50/1009654
ggactaaa

SEQ ID NO: 152741 - DNA, 8 bp, Unknown
  misc_feature (1)..( 8): Result.004 file - promoters50/1009654
caactaaa

SEQ ID NO: 152742 - DNA, 7 bp, Unknown
  misc_feature (1)..( 7): Result.004 file - promoters50/1009654
ataaaag

SEQ ID NO: 152743 - DNA, 7 bp, Unknown
  misc_feature (1)..( 7): Result.004 file - promoters50/1009654
atataag

SEQ ID NO: 152744 - DNA, 7 bp, Unknown
  misc_feature (1)..( 7): Result.004 file - promoters50/1009686
ataaaag

SEQ ID NO: 152745 - DNA, 8 bp, Unknown
  misc_feature (1)..( 8): Result.004 file - promoters50/1009686
attcagtt

SEQ ID NO: 152746 - DNA, 8 bp, Unknown
  misc_feature (1)..( 8): Result.004 file - promoters50/1009686
attaagtc

SEQ ID NO: 152747 - DNA, 8 bp, Unknown
  misc_feature (1)..( 8): Result.004 file - promoters50/1009693
gttaagtc

SEQ ID NO: 152748 - DNA, 14 bp, Unknown
  misc_feature (1)..( 14): Result.004 file - promoters50/1009693
atttgaaaaaacaa

SEQ ID NO: 152749 - DNA, 14 bp, Unknown
  misc_feature (1)..( 14): Result.004 file - promoters50/1009693
acaccaaaaaacaa

SEQ ID NO: 152750 - DNA, 14 bp, Unknown
  misc_feature (1)..( 14): Result.004 file - promoters50/1009693
tcatatcaaaccaa

SEQ ID NO: 152751 - DNA, 14 bp, Unknown
  misc_feature (1)..( 14): Result.004 file - promoters50/1009693
ttttcaaaaaagtt

SEQ ID NO: 152752 - DNA, 14 bp, Unknown
  misc_feature (1)..( 14): Result.004 file - promoters50/1009693
atatgagaaaatta

SEQ ID NO: 152753 - DNA, 14 bp, Unknown
  misc_feature (1)..( 14): Result.004 file - promoters50/1009693
ttttccaaattgta

SEQ ID NO: 152754 - DNA, 14 bp, Unknown
  misc_feature (1)..( 14): Result.004 file - promoters50/1009693
cgtaaataaatagt

SEQ ID NO: 152755 - DNA, 12 bp, Unknown
  misc_feature (1)..( 12): Result.004 file - promoters50/1009693
aaagtcatattt

SEQ ID NO: 152756 - DNA, 12 bp, Unknown
  misc_feature (1)..( 12): Result.004 file - promoters50/1009693
caagtaatatca

SEQ ID NO: 152757 - DNA, 12 bp, Unknown
  misc_feature (1)..( 12): Result.004 file - promoters50/1009693
taagacattttt

SEQ ID NO: 152758 - DNA, 12 bp, Unknown
  misc_feature (1)..( 12): Result.004 file - promoters50/1009693
tttttcatatta

SEQ ID NO: 152759 - DNA, 12 bp, Unknown
  misc_feature (1)..( 12): Result.004 file - promoters50/1009693
caaaaaatctca

SEQ ID NO: 152760 - DNA, 12 bp, Unknown
  misc_feature (1)..( 12): Result.004 file - promoters50/1009693
caagaaatcaga

SEQ ID NO: 152761 - DNA, 12 bp, Unknown
  misc_feature (1)..( 12): Result.004 file - promoters50/1009693
caagaaaatcct

SEQ ID NO: 152762 - DNA, 8 bp, Unknown
  misc_feature (1)..( 8): Result.004 file - promoters50/1009693
aaatttga

SEQ ID NO: 152763 - DNA, 8 bp, Unknown
  misc_feature (1)..( 8): Result.004 file - promoters50/1009693
gaatttgt

SEQ ID NO: 152764 - DNA, 8 bp, Unknown
  misc_feature (1)..( 8): Result.004 file - promoters50/1009693
taattttt

SEQ ID NO: 152765 - DNA, 8 bp, Unknown
  misc_feature (1)..( 8): Result.004 file - promoters50/1009693
aaagttgt

SEQ ID NO: 152766 - DNA, 9 bp, Unknown
  misc_feature (1)..( 9): Result.004 file - promoters50/1009693
aaatgtttt

SEQ ID NO: 152767 - DNA, 9 bp, Unknown
  misc_feature (1)..( 9): Result.004 file - promoters50/1009693
aaatgttgg

SEQ ID NO: 152768 - DNA, 15 bp, Unknown
  misc_feature (1)..( 15): Result.004 file - promoters50/1009693
aattaaatgttttat

SEQ ID NO: 152769 - DNA, 15 bp, Unknown
  misc_feature (1)..( 15): Result.004 file - promoters50/1009693
gatttgatgtcttat

SEQ ID NO: 152770 - DNA, 15 bp, Unknown
  misc_feature (1)..( 15): Result.004 file - promoters50/1009693
aattaaatatttata

SEQ ID NO: 152771 - DNA, 15 bp, Unknown
  misc_feature (1)..( 15): Result.004 file - promoters50/1009693
tattaaatataaaat

SEQ ID NO: 152772 - DNA, 15 bp, Unknown
  misc_feature (1)..( 15): Result.004 file - promoters50/1009693
gtgaaaataatataa

SEQ ID NO: 152773 - DNA, 15 bp, Unknown
  misc_feature (1)..( 15): Result.004 file - promoters50/1009693
agatccgtattaacc

SEQ ID NO: 152774 - DNA, 11 bp, Unknown
  misc_feature (1)..( 11): Result.004 file - promoters50/1009693
ctaaattttat

SEQ ID NO: 152775 - DNA, 11 bp, Unknown
  misc_feature (1)..( 11): Result.004 file - promoters50/1009693
ataaattattt

SEQ ID NO: 152776 - DNA, 11 bp, Unknown
  misc_feature (1)..( 11): Result.004 file - promoters50/1009693
ttaaattatta

SEQ ID NO: 152777 - DNA, 11 bp, Unknown
  misc_feature (1)..( 11): Result.004 file - promoters50/1009693
atatatttgac

SEQ ID NO: 152778 - DNA, 11 bp, Unknown
  misc_feature (1)..( 11): Result.004 file - promoters50/1009693
taaaattagat

SEQ ID NO: 152779 - DNA, 11 bp, Unknown
  misc_feature (1)..( 11): Result.004 file - promoters50/1009693
tgaaatcattt

SEQ ID NO: 152780 - DNA, 11 bp, Unknown
  misc_feature (1)..( 11): Result.004 file - promoters50/1009693
aaaaaaactaa

SEQ ID NO: 152781 - DNA, 11 bp, Unknown
  misc_feature (1)..( 11): Result.004 file - promoters50/1009693
tgtgaaaataa

SEQ ID NO: 152782 - DNA, 11 bp, Unknown
  misc_feature (1)..( 11): Result.004 file - promoters50/1009693
caagaaaatcc

SEQ ID NO: 152783 - DNA, 11 bp, Unknown
  misc_feature (1)..( 11): Result.004 file - promoters50/1009693
aaacaaattaa

SEQ ID NO: 152784 - DNA, 11 bp, Unknown
  misc_feature (1)..( 11): Result.004 file - promoters50/1009693
tcaaaaaatct

SEQ ID NO: 152785 - DNA, 11 bp, Unknown
  misc_feature (1)..( 11): Result.004 file - promoters50/1009752
caagaaatcag

SEQ ID NO: 152786 - DNA, 7 bp, Unknown
  misc_feature (1)..( 7): Result.004 file - promoters50/1009752
taaaaat

SEQ ID NO: 152787 - DNA, 7 bp, Unknown
  misc_feature (1)..( 7): Result.004 file - promoters50/1009752
taacaat

SEQ ID NO: 152788 - DNA, 7 bp, Unknown
  misc_feature (1)..( 7): Result.004 file - promoters50/1009754
taacaac

SEQ ID NO: 152789 - DNA, 8 bp, Unknown
  misc_feature (1)..( 8): Result.004 file - promoters50/1009754
agataaat

SEQ ID NO: 152790 - DNA, 8 bp, Unknown
  misc_feature (1)..( 8): Result.004 file - promoters50/1009754
agataatt

SEQ ID NO: 152791 - DNA, 8 bp, Unknown
  misc_feature (1)..( 8): Result.004 file - promoters50/1009780
agacaatt

SEQ ID NO: 152792 - DNA, 11 bp, Unknown
  misc_feature (1)..( 11): Result.004 file - promoters50/1009780
tttttagaaaa

SEQ ID NO: 152793 - DNA, 11 bp, Unknown
  misc_feature (1)..( 11): Result.004 file - promoters50/1009780
ttttcagataa

SEQ ID NO: 152794 - DNA, 12 bp, Unknown
  misc_feature (1)..( 12): Result.004 file - promoters50/1009780
tttgttataaaa

SEQ ID NO: 152795 - DNA, 11 bp, Unknown
  misc_feature (1)..( 11): Result.004 file - promoters50/1009780
tgaaaaatgtt

SEQ ID NO: 152796 - DNA, 11 bp, Unknown
  misc_feature (1)..( 11): Result.004 file - promoters50/1009780
gataaaacgtt

SEQ ID NO: 152797 - DNA, 11 bp, Unknown
  misc_feature (1)..( 11): Result.004 file - promoters50/1009780
tgataaataat

SEQ ID NO: 152798 - DNA, 7 bp, Unknown
  misc_feature (1)..( 7): Result.004 file - promoters50/1009780
ttcaaat

SEQ ID NO: 152799 - DNA, 7 bp, Unknown
  misc_feature (1)..( 7): Result.004 file - promoters50/1009780
ttctaat

SEQ ID NO: 152800 - DNA, 7 bp, Unknown
  misc_feature (1)..( 7): Result.004 file - promoters50/1009822
ttttaaa

SEQ ID NO: 152801 - DNA, 7 bp, Unknown
  misc_feature (1)..( 7): Result.004 file - promoters50/1009822
cttttct

SEQ ID NO: 152802 - DNA, 7 bp, Unknown
  misc_feature (1)..( 7): Result.004 file - promoters50/1009822
cttctct

SEQ ID NO: 152803 - DNA, 7 bp, Unknown
  misc_feature (1)..( 7): Result.004 file - promoters50/1009822
cttctcc

SEQ ID NO: 152804 - DNA, 6 bp, Unknown
  misc_feature (1)..( 6): Result.004 file - promoters50/1009822
ttctca

SEQ ID NO: 152805 - DNA, 6 bp, Unknown
  misc_feature (1)..( 6): Result.004 file - promoters50/1009822
ttctca

SEQ ID NO: 152806 - DNA, 6 bp, Unknown
  misc_feature (1)..( 6): Result.004 file - promoters50/1009822
ttctca

SEQ ID NO: 152807 - DNA, 8 bp, Unknown
  misc_feature (1)..( 8): Result.004 file - promoters50/1009822
attctcca

SEQ ID NO: 152808 - DNA, 8 bp, Unknown
  misc_feature (1)..( 8): Result.004 file - promoters50/1009822
cttctcca

SEQ ID NO: 152809 - DNA, 8 bp, Unknown
  misc_feature (1)..( 8): Result.004 file - promoters50/1009854
cttctcta

SEQ ID NO: 152810 - DNA, 10 bp, Unknown
  misc_feature (1)..( 10): Result.004 file - promoters50/1009854
aaataaaaca

SEQ ID NO: 152811 - DNA, 10 bp, Unknown
  misc_feature (1)..( 10): Result.004 file - promoters50/1009854
aaagaaaaca

SEQ ID NO: 152812 - DNA, 10 bp, Unknown
  misc_feature (1)..( 10): Result.004 file - promoters50/1009854
aaagaaagaa

SEQ ID NO: 152813 - DNA, 10 bp, Unknown
  misc_feature (1)..( 10): Result.004 file - promoters50/1009854
tcataaaaaa

SEQ ID NO: 152814 - DNA, 10 bp, Unknown
  misc_feature (1)..( 10): Result.004 file - promoters50/1009854
gaagaaatga

SEQ ID NO: 152815 - DNA, 13 bp, Unknown
  misc_feature (1)..( 13): Result.004 file - promoters50/1009854
ttcattaacaaat

SEQ ID NO: 152816 - DNA, 13 bp, Unknown
  misc_feature (1)..( 13): Result.004 file - promoters50/1009854
aaaaagaaccaat

SEQ ID NO: 152817 - DNA, 13 bp, Unknown
  misc_feature (1)..( 13): Result.004 file - promoters50/1009854
attcataaaaaaa

SEQ ID NO: 152818 - DNA, 13 bp, Unknown
  misc_feature (1)..( 13): Result.004 file - promoters50/1009854
tgacagaaaaaag

SEQ ID NO: 152819 - DNA, 13 bp, Unknown
  misc_feature (1)..( 13): Result.004 file - promoters50/1009854
tgagagaagaaat

SEQ ID NO: 152820 - DNA, 11 bp, Unknown
  misc_feature (1)..( 11): Result.004 file - promoters50/1009854
aaaacatatct

SEQ ID NO: 152821 - DNA, 11 bp, Unknown
  misc_feature (1)..( 11): Result.004 file - promoters50/1009854
taaatatattt

SEQ ID NO: 152822 - DNA, 11 bp, Unknown
  misc_feature (1)..( 11): Result.004 file - promoters50/1009854
aaaaaatagtc

SEQ ID NO: 152823 - DNA, 11 bp, Unknown
  misc_feature (1)..( 11): Result.004 file - promoters50/1009854
aaaaaagaata

SEQ ID NO: 152824 - DNA, 11 bp, Unknown
  misc_feature (1)..( 11): Result.004 file - promoters50/1009861
ccaatagattt

SEQ ID NO: 152825 - DNA, 8 bp, Unknown
  misc_feature (1)..( 8): Result.004 file - promoters50/1009861
attataat

SEQ ID NO: 152826 - DNA, 8 bp, Unknown
  misc_feature (1)..( 8): Result.004 file - promoters50/1009861
attttaat

SEQ ID NO: 152827 - DNA, 8 bp, Unknown
  misc_feature (1)..( 8): Result.004 file - promoters50/1009861
tttataag

SEQ ID NO: 152828 - DNA, 8 bp, Unknown
  misc_feature (1)..( 8): Result.004 file - promoters50/1009861
cttttaat

SEQ ID NO: 152829 - DNA, 13 bp, Unknown
  misc_feature (1)..( 13): Result.004 file - promoters50/1009861
cattatacatatt

SEQ ID NO: 152830 - DNA, 13 bp, Unknown
  misc_feature (1)..( 13): Result.004 file - promoters50/1009861
agctatatatacc

SEQ ID NO: 152831 - DNA, 13 bp, Unknown
  misc_feature (1)..( 13): Result.004 file - promoters50/1009861
cattatacgttta

SEQ ID NO: 152832 - DNA, 13 bp, Unknown
  misc_feature (1)..( 13): Result.004 file - promoters50/1009861
cgttttacttatt

SEQ ID NO: 152833 - DNA, 10 bp, Unknown
  misc_feature (1)..( 10): Result.004 file - promoters50/1009861
acataattaa

SEQ ID NO: 152834 - DNA, 10 bp, Unknown
  misc_feature (1)..( 10): Result.004 file - promoters50/1009861
ttttaattaa

SEQ ID NO: 152835 - DNA, 10 bp, Unknown
  misc_feature (1)..( 10): Result.004 file - promoters50/1009861
gaataaataa

SEQ ID NO: 152836 - DNA, 10 bp, Unknown
  misc_feature (1)..( 10): Result.004 file - promoters50/1009861
ttttcattca

SEQ ID NO: 152837 - DNA, 10 bp, Unknown
  misc_feature (1)..( 10): Result.004 file - promoters50/1009861
gaaaaataag

SEQ ID NO: 152838 - DNA, 10 bp, Unknown
  misc_feature (1)..( 10): Result.004 file - promoters50/1009861
caaaaatagc

SEQ ID NO: 152839 - DNA, 10 bp, Unknown
  misc_feature (1)..( 10): Result.004 file - promoters50/1009861
taaaaaaaag

SEQ ID NO: 152840 - DNA, 10 bp, Unknown
  misc_feature (1)..( 10): Result.004 file - promoters50/1009875
taataaatcg

SEQ ID NO: 152841 - DNA, 9 bp, Unknown
  misc_feature (1)..( 9): Result.004 file - promoters50/1009875
tttcaaaaa

SEQ ID NO: 152842 - DNA, 9 bp, Unknown
  misc_feature (1)..( 9): Result.004 file - promoters50/1009875
tttcaagga

SEQ ID NO: 152843 - DNA, 9 bp, Unknown
  misc_feature (1)..( 9): Result.004 file - promoters50/1009875
ttttaaaaa

SEQ ID NO: 152844 - DNA, 9 bp, Unknown
  misc_feature (1)..( 9): Result.004 file - promoters50/1009875
attcaaact

SEQ ID NO: 152845 - DNA, 9 bp, Unknown
  misc_feature (1)..( 9): Result.004 file - promoters50/1009875
attcaacat

SEQ ID NO: 152846 - DNA, 9 bp, Unknown
  misc_feature (1)..( 9): Result.004 file - promoters50/1009875
tttcatcat

SEQ ID NO: 152847 - DNA, 13 bp, Unknown
  misc_feature (1)..( 13): Result.004 file - promoters50/1009875
aagcaagaaaaag

SEQ ID NO: 152848 - DNA, 13 bp, Unknown
  misc_feature (1)..( 13): Result.004 file - promoters50/1009875
aagcaataaaagt

SEQ ID NO: 152849 - DNA, 13 bp, Unknown
  misc_feature (1)..( 13): Result.004 file - promoters50/1009875
cgacaacaaaaag

SEQ ID NO: 152850 - DNA, 10 bp, Unknown
  misc_feature (1)..( 10): Result.004 file - promoters50/1009875
caagaaaaag

SEQ ID NO: 152851 - DNA, 10 bp, Unknown
  misc_feature (1)..( 10): Result.004 file - promoters50/1009875
cgtcaaaaag

SEQ ID NO: 152852 - DNA, 10 bp, Unknown
  misc_feature (1)..( 10): Result.004 file - promoters50/1009875
caacaaaaag

SEQ ID NO: 152853 - DNA, 10 bp, Unknown
  misc_feature (1)..( 10): Result.004 file - promoters50/1009875
agggtctaaa

SEQ ID NO: 152854 - DNA, 10 bp, Unknown
  misc_feature (1)..( 10): Result.004 file - promoters50/1009875
aacgtcaaaa

SEQ ID NO: 152855 - DNA, 10 bp, Unknown
  misc_feature (1)..( 10): Result.004 file - promoters50/1009875
aacgacaaca

SEQ ID NO: 152856 - DNA, 9 bp, Unknown
  misc_feature (1)..( 9): Result.004 file - promoters50/1009875
ctttatttt

SEQ ID NO: 152857 - DNA, 9 bp, Unknown
  misc_feature (1)..( 9): Result.004 file - promoters50/1009875
cattatttt

SEQ ID NO: 152858 - DNA, 9 bp, Unknown
  misc_feature (1)..( 9): Result.004 file - promoters50/1009910
catgattaa

SEQ ID NO: 152859 - DNA, 12 bp, Unknown
  misc_feature (1)..( 12): Result.004 file - promoters50/1009910
ctaattatcaaa

SEQ ID NO: 152860 - DNA, 12 bp, Unknown
  misc_feature (1)..( 12): Result.004 file - promoters50/1009910
ctaatttttaca

SEQ ID NO: 152861 - DNA, 12 bp, Unknown
  misc_feature (1)..( 12): Result.004 file - promoters50/1009910
ataattttgctg

SEQ ID NO: 152862 - DNA, 13 bp, Unknown
  misc_feature (1)..( 13): Result.004 file - promoters50/1009910
tagaatttttttc

SEQ ID NO: 152863 - DNA, 13 bp, Unknown
  misc_feature (1)..( 13): Result.004 file - promoters50/1009910
atagatttttttt

SEQ ID NO: 152864 - DNA, 13 bp, Unknown
  misc_feature (1)..( 13): Result.004 file - promoters50/1009910
atagcttttcaat

SEQ ID NO: 152865 - DNA, 9 bp, Unknown
  misc_feature (1)..( 9): Result.004 file - promoters50/1009910
caattatta

SEQ ID NO: 152866 - DNA, 9 bp, Unknown
  misc_feature (1)..( 9): Result.004 file - promoters50/1009910
taattttta

SEQ ID NO: 152867 - DNA, 9 bp, Unknown
  misc_feature (1)..( 9): Result.004 file - promoters50/1009910
caaatatac

SEQ ID NO: 152868 - DNA, 9 bp, Unknown
  misc_feature (1)..( 9): Result.004 file - promoters50/1009910
gaatttttt

SEQ ID NO: 152869 - DNA, 9 bp, Unknown
  misc_feature (1)..( 9): Result.004 file - promoters50/1009910
taattttgc

SEQ ID NO: 152870 - DNA, 9 bp, Unknown
  misc_feature (1)..( 9): Result.004 file - promoters50/1009910
agatttttt

SEQ ID NO: 152871 - DNA, 14 bp, Unknown
  misc_feature (1)..( 14): Result.004 file - promoters50/1009910
tttaaaaaagacaa

SEQ ID NO: 152872 - DNA, 14 bp, Unknown
  misc_feature (1)..( 14): Result.004 file - promoters50/1009910
cttaaaaagtagtt

SEQ ID NO: 152873 - DNA, 14 bp, Unknown
  misc_feature (1)..( 14): Result.004 file - promoters50/1009910
cctaaaaatagaaa

SEQ ID NO: 152874 - DNA, 14 bp, Unknown
  misc_feature (1)..( 14): Result.004 file - promoters50/1009910
cttaaagaactgtt

SEQ ID NO: 152875 - DNA, 15 bp, Unknown
  misc_feature (1)..( 15): Result.004 file - promoters50/1009910
tatgaaaattagata

SEQ ID NO: 152876 - DNA, 15 bp, Unknown
  misc_feature (1)..( 15): Result.004 file - promoters50/1009910
agtcaaaattaaata

SEQ ID NO: 152877 - DNA, 15 bp, Unknown
  misc_feature (1)..( 15): Result.004 file - promoters50/1009910
gttacataattcctt

SEQ ID NO: 152878 - DNA, 11 bp, Unknown
  misc_feature (1)..( 11): Result.004 file - promoters50/1009910
caataaaatca

SEQ ID NO: 152879 - DNA, 11 bp, Unknown
  misc_feature (1)..( 11): Result.004 file - promoters50/1009910
caataacaaat

SEQ ID NO: 152880 - DNA, 12 bp, Unknown
  misc_feature (1)..( 12): Result.004 file - promoters50/1009910
aaattaaataac

SEQ ID NO: 152881 - DNA, 12 bp, Unknown
  misc_feature (1)..( 12): Result.004 file - promoters50/1009910
aaaatcacacaa

SEQ ID NO: 152882 - DNA, 12 bp, Unknown
  misc_feature (1)..( 12): Result.004 file - promoters50/1009910
aaaattagatat

SEQ ID NO: 152883 - DNA, 12 bp, Unknown
  misc_feature (1)..( 12): Result.004 file - promoters50/1009910
ttagttacataa

SEQ ID NO: 152884 - DNA, 11 bp, Unknown
  misc_feature (1)..( 11): Result.004 file - promoters50/1009910
tatttaaatga

SEQ ID NO: 152885 - DNA, 11 bp, Unknown
  misc_feature (1)..( 11): Result.004 file - promoters50/1009910
ttttttaatca

SEQ ID NO: 152886 - DNA, 11 bp, Unknown
  misc_feature (1)..( 11): Result.004 file - promoters50/1009910
tagttatatga

SEQ ID NO: 152887 - DNA, 11 bp, Unknown
  misc_feature (1)..( 11): Result.004 file - promoters50/1009910
aattgaaaagg

SEQ ID NO: 152888 - DNA, 11 bp, Unknown
  misc_feature (1)..( 11): Result.004 file - promoters50/1009910
tatttgacttc

SEQ ID NO: 152889 - DNA, 11 bp, Unknown
  misc_feature (1)..( 11): Result.004 file - promoters50/1009910
gttttgacatt

SEQ ID NO: 152890 - DNA, 11 bp, Unknown
  misc_feature (1)..( 11): Result.004 file - promoters50/1009910
aatttaaaatt

SEQ ID NO: 152891 - DNA, 14 bp, Unknown
  misc_feature (1)..( 14): Result.004 file - promoters50/1009910
aataaaatcattag

SEQ ID NO: 152892 - DNA, 14 bp, Unknown
  misc_feature (1)..( 14): Result.004 file - promoters50/1009910
ctgaaaatcacaca

SEQ ID NO: 152893 - DNA, 14 bp, Unknown
  misc_feature (1)..( 14): Result.004 file - promoters50/1009910
aattaaataaccaa

SEQ ID NO: 152894 - DNA, 14 bp, Unknown
  misc_feature (1)..( 14): Result.004 file - promoters50/1009910
aataacaaatgttc

SEQ ID NO: 152895 - DNA, 14 bp, Unknown
  misc_feature (1)..( 14): Result.004 file - promoters50/1009910
atgaaaattagata

SEQ ID NO: 152896 - DNA, 14 bp, Unknown
  misc_feature (1)..( 14): Result.004 file - promoters50/1009930
agttacataattcc

SEQ ID NO: 152897 - DNA, 9 bp, Unknown
  misc_feature (1)..( 9): Result.004 file - promoters50/1009930
ccatttctg

SEQ ID NO: 152898 - DNA, 9 bp, Unknown
  misc_feature (1)..( 9): Result.004 file - promoters50/1009930
tcatatctg

SEQ ID NO: 152899 - DNA, 9 bp, Unknown
  misc_feature (1)..( 9): Result.004 file - promoters50/1009930
tcatattta

SEQ ID NO: 152900 - DNA, 8 bp, Unknown
  misc_feature (1)..( 8): Result.004 file - promoters50/1009930
tttaaatt

SEQ ID NO: 152901 - DNA, 8 bp, Unknown
  misc_feature (1)..( 8): Result.004 file - promoters50/1009930
tttacatt

SEQ ID NO: 152902 - DNA, 8 bp, Unknown
  misc_feature (1)..( 8): Result.004 file - promoters50/1009930
tttcaatc

SEQ ID NO: 152903 - DNA, 7 bp, Unknown
  misc_feature (1)..( 7): Result.004 file - promoters50/1009930
taacact

SEQ ID NO: 152904 - DNA, 7 bp, Unknown
  misc_feature (1)..( 7): Result.004 file - promoters50/1009930
aaacact

SEQ ID NO: 152905 - DNA, 7 bp, Unknown
  misc_feature (1)..( 7): Result.004 file - promoters50/1009930
aaacact

SEQ ID NO: 152906 - DNA, 9 bp, Unknown
  misc_feature (1)..( 9): Result.004 file - promoters50/1009930
aatttattt

SEQ ID NO: 152907 - DNA, 9 bp, Unknown
  misc_feature (1)..( 9): Result.004 file - promoters50/1009930
ttcttattt

SEQ ID NO: 152908 - DNA, 9 bp, Unknown
  misc_feature (1)..( 9): Result.004 file - promoters50/1009930
aatctattg

SEQ ID NO: 152909 - DNA, 9 bp, Unknown
  misc_feature (1)..( 9): Result.004 file - promoters50/1009930
ttacattag

SEQ ID NO: 152910 - DNA, 9 bp, Unknown
  misc_feature (1)..( 9): Result.004 file - promoters50/1009930
taacattag

SEQ ID NO: 152911 - DNA, 9 bp, Unknown
  misc_feature (1)..( 9): Result.004 file - promoters50/1009930
ttatatttt

SEQ ID NO: 152912 - DNA, 8 bp, Unknown
  misc_feature (1)..( 8): Result.004 file - promoters50/1009930
ttatgatc

SEQ ID NO: 152913 - DNA, 8 bp, Unknown
  misc_feature (1)..( 8): Result.004 file - promoters50/1009930
ttatgaac

SEQ ID NO: 152914 - DNA, 8 bp, Unknown
  misc_feature (1)..( 8): Result.004 file - promoters50/1009930
atatcatc

SEQ ID NO: 152915 - DNA, 9 bp, Unknown
  misc_feature (1)..( 9): Result.004 file - promoters50/1009930
caaataatt

SEQ ID NO: 152916 - DNA, 9 bp, Unknown
  misc_feature (1)..( 9): Result.004 file - promoters50/1009930
caaataatt

SEQ ID NO: 152917 - DNA, 9 bp, Unknown
  misc_feature (1)..( 9): Result.004 file - promoters50/1009941
tcaataata

SEQ ID NO: 152918 - DNA, 11 bp, Unknown
  misc_feature (1)..( 11): Result.004 file - promoters50/1009941
aaaattctcaa

SEQ ID NO: 152919 - DNA, 11 bp, Unknown
  misc_feature (1)..( 11): Result.004 file - promoters50/1009941
gcaattctgac

SEQ ID NO: 152920 - DNA, 12 bp, Unknown
  misc_feature (1)..( 12): Result.004 file - promoters50/1009941
gaaagttcatca

SEQ ID NO: 152921 - DNA, 12 bp, Unknown
  misc_feature (1)..( 12): Result.004 file - promoters50/1009941
tttcattgtcaa

SEQ ID NO: 152922 - DNA, 12 bp, Unknown
  misc_feature (1)..( 12): Result.004 file - promoters50/1009941
aaaaattatcac

SEQ ID NO: 152923 - DNA, 12 bp, Unknown
  misc_feature (1)..( 12): Result.004 file - promoters50/1009955
tgtggttatcaa

SEQ ID NO: 152924 - DNA, 7 bp, Unknown
  misc_feature (1)..( 7): Result.004 file - promoters50/1009955
tggaaag

SEQ ID NO: 152925 - DNA, 7 bp, Unknown
  misc_feature (1)..( 7): Result.004 file - promoters50/1009955
tggcaag

SEQ ID NO: 152926 - DNA, 7 bp, Unknown
  misc_feature (1)..( 7): Result.004 file - promoters50/1009955
cggaaag

SEQ ID NO: 152927 - DNA, 6 bp, Unknown
  misc_feature (1)..( 6): Result.004 file - promoters50/1009955
cttctg

SEQ ID NO: 152928 - DNA, 6 bp, Unknown
  misc_feature (1)..( 6): Result.004 file - promoters50/1009955
cttctg

SEQ ID NO: 152929 - DNA, 6 bp, Unknown
  misc_feature (1)..( 6): Result.004 file - promoters50/1009999
cttctg

SEQ ID NO: 152930 - DNA, 11 bp, Unknown
  misc_feature (1)..( 11): Result.004 file - promoters50/1009999
aattgtttgtt

SEQ ID NO: 152931 - DNA, 11 bp, Unknown
  misc_feature (1)..( 11): Result.004 file - promoters50/1009999
atttgtttagt

SEQ ID NO: 152932 - DNA, 11 bp, Unknown
  misc_feature (1)..( 11): Result.004 file - promoters50/1009999
gattgttagtt

SEQ ID NO: 152933 - DNA, 11 bp, Unknown
  misc_feature (1)..( 11): Result.004 file - promoters50/1009999
tattcttttat

SEQ ID NO: 152934 - DNA, 11 bp, Unknown
  misc_feature (1)..( 11): Result.004 file - promoters50/1009999
aattatttttc

SEQ ID NO: 152935 - DNA, 12 bp, Unknown
  misc_feature (1)..( 12): Result.004 file - promoters50/1009999
aaatgtatagta

SEQ ID NO: 152936 - DNA, 17 bp, Unknown
  misc_feature (1)..( 17): Result.004 file - promoters50/1009999
gagataaaaagattgat

SEQ ID NO: 152937 - DNA, 17 bp, Unknown
  misc_feature (1)..( 17): Result.004 file - promoters50/1009999
ttggtcaaaagaaaata

SEQ ID NO: 152938 - DNA, 17 bp, Unknown
  misc_feature (1)..( 17): Result.004 file - promoters50/1009999
aagaaaaaaagaaaaaa

SEQ ID NO: 152939 - DNA, 17 bp, Unknown
  misc_feature (1)..( 17): Result.004 file - promoters50/1009999
caagtttaaagaaaaaa

SEQ ID NO: 152940 - DNA, 17 bp, Unknown
  misc_feature (1)..( 17): Result.004 file - promoters50/1009999
tcacaaaaaataatatt

SEQ ID NO: 152941 - DNA, 17 bp, Unknown
  misc_feature (1)..( 17): Result.004 file - promoters50/1009999
aaggaaaaaaggttcaa

SEQ ID NO: 152942 - DNA, 13 bp, Unknown
  misc_feature (1)..( 13): Result.004 file - promoters50/1009999
cttgtacaaagta

SEQ ID NO: 152943 - DNA, 13 bp, Unknown
  misc_feature (1)..( 13): Result.004 file - promoters50/1009999
ttcgtaaaaattt

SEQ ID NO: 152944 - DNA, 13 bp, Unknown
  misc_feature (1)..( 13): Result.004 file - promoters50/1009999
ggtctaaatattt

SEQ ID NO: 152945 - DNA, 13 bp, Unknown
  misc_feature (1)..( 13): Result.004 file - promoters50/1009999
gtactaaatgtat

SEQ ID NO: 152946 - DNA, 13 bp, Unknown
  misc_feature (1)..( 13): Result.004 file - promoters50/1009999
agttctaatattt

SEQ ID NO: 152947 - DNA, 13 bp, Unknown
  misc_feature (1)..( 13): Result.004 file - promoters50/1009999
ggtctgaatatga

SEQ ID NO: 152948 - DNA, 13 bp, Unknown
  misc_feature (1)..( 13): Result.004 file - promoters50/1009999
atacgaaagattg

SEQ ID NO: 152949 - DNA, 13 bp, Unknown
  misc_feature (1)..( 13): Result.004 file - promoters50/1009999
gaaacaaagattt

SEQ ID NO: 152950 - DNA, 13 bp, Unknown
  misc_feature (1)..( 13): Result.004 file - promoters50/1009999
agataaaaagatt

SEQ ID NO: 152951 - DNA, 13 bp, Unknown
  misc_feature (1)..( 13): Result.004 file - promoters50/1009999
ttataaaacaatt

SEQ ID NO: 152952 - DNA, 13 bp, Unknown
  misc_feature (1)..( 13): Result.004 file - promoters50/1009999
aaagaaaaaaaga

SEQ ID NO: 152953 - DNA, 13 bp, Unknown
  misc_feature (1)..( 13): Result.004 file - promoters50/1009999
aaagaaaaaatgt

SEQ ID NO: 152954 - DNA, 13 bp, Unknown
  misc_feature (1)..( 13): Result.004 file - promoters50/1009999
tcacaaaaaataa

SEQ ID NO: 152955 - DNA, 13 bp, Unknown
  misc_feature (1)..( 13): Result.004 file - promoters50/1009999
gaaggaaaaaagg

SEQ ID NO: 152956 - DNA, 13 bp, Unknown
  misc_feature (1)..( 13): Result.004 file - promoters50/1009999
aaagtaattgttt

SEQ ID NO: 152957 - DNA, 13 bp, Unknown
  misc_feature (1)..( 13): Result.004 file - promoters50/1009999
gtactaaatgtat

SEQ ID NO: 152958 - DNA, 13 bp, Unknown
  misc_feature (1)..( 13): Result.004 file - promoters50/1009999
gcctttattcttt

SEQ ID NO: 152959 - DNA, 13 bp, Unknown
  misc_feature (1)..( 13): Result.004 file - promoters50/1009999
tacacaattattt

SEQ ID NO: 152960 - DNA, 13 bp, Unknown
  misc_feature (1)..( 13): Result.004 file - promoters50/1009999
ggtctaaatattt

SEQ ID NO: 152961 - DNA, 13 bp, Unknown
  misc_feature (1)..( 13): Result.004 file - promoters50/1009999
ggtctgaatatga

SEQ ID NO: 152962 - DNA, 13 bp, Unknown
  misc_feature (1)..( 13): Result.004 file - promoters50/1009999
aaactgatagaat

SEQ ID NO: 152963 - DNA, 13 bp, Unknown
  misc_feature (1)..( 13): Result.004 file - promoters50/1009999
tcatcgatcgaaa

SEQ ID NO: 152964 - DNA, 13 bp, Unknown
  misc_feature (1)..( 13): Result.004 file - promoters50/1009999
aaattgagagatt

SEQ ID NO: 152965 - DNA, 13 bp, Unknown
  misc_feature (1)..( 13): Result.004 file - promoters50/1009999
cggtagatattta

SEQ ID NO: 152966 - DNA, 13 bp, Unknown
  misc_feature (1)..( 13): Result.004 file - promoters50/1009999
gggcagatactta

SEQ ID NO: 152967 - DNA, 13 bp, Unknown
  misc_feature (1)..( 13): Result.004 file - promoters50/1010019
ttggggagagacc

SEQ ID NO: 152968 - DNA, 7 bp, Unknown
  misc_feature (1)..( 7): Result.004 file - promoters50/1010019
caagaac

SEQ ID NO: 152969 - DNA, 7 bp, Unknown
  misc_feature (1)..( 7): Result.004 file - promoters50/1010019
caaaaac

SEQ ID NO: 152970 - DNA, 7 bp, Unknown
  misc_feature (1)..( 7): Result.004 file - promoters50/1010025
caaaaag

SEQ ID NO: 152971 - DNA, 8 bp, Unknown
  misc_feature (1)..( 8): Result.004 file - promoters50/1010025
atattttc

SEQ ID NO: 152972 - DNA, 8 bp, Unknown
  misc_feature (1)..( 8): Result.004 file - promoters50/1010025
atatcttc

SEQ ID NO: 152973 - DNA, 8 bp, Unknown
  misc_feature (1)..( 8): Result.004 file - promoters50/1010025
ttatcttt

SEQ ID NO: 152974 - DNA, 8 bp, Unknown
  misc_feature (1)..( 8): Result.004 file - promoters50/1010025
atatttca

SEQ ID NO: 152975 - DNA, 8 bp, Unknown
  misc_feature (1)..( 8): Result.004 file - promoters50/1010055
atatcttc

SEQ ID NO: 152976 - DNA, 10 bp, Unknown
  misc_feature (1)..( 10): Result.004 file - promoters50/1010055
aaacaaacgt

SEQ ID NO: 152977 - DNA, 10 bp, Unknown
  misc_feature (1)..( 10): Result.004 file - promoters50/1010055
aaacaaatgt

SEQ ID NO: 152978 - DNA, 10 bp, Unknown
  misc_feature (1)..( 10): Result.004 file - promoters50/1010055
aaaaaaagaa

SEQ ID NO: 152979 - DNA, 10 bp, Unknown
  misc_feature (1)..( 10): Result.004 file - promoters50/1010055
aaacaaatta

SEQ ID NO: 152980 - DNA, 10 bp, Unknown
  misc_feature (1)..( 10): Result.004 file - promoters50/1010055
aaaaaaaaga

SEQ ID NO: 152981 - DNA, 10 bp, Unknown
  misc_feature (1)..( 10): Result.004 file - promoters50/1010055
taactaattt

SEQ ID NO: 152982 - DNA, 10 bp, Unknown
  misc_feature (1)..( 10): Result.004 file - promoters50/1010055
taactgattt

SEQ ID NO: 152983 - DNA, 11 bp, Unknown
  misc_feature (1)..( 11): Result.004 file - promoters50/1010055
atattattagt

SEQ ID NO: 152984 - DNA, 11 bp, Unknown
  misc_feature (1)..( 11): Result.004 file - promoters50/1010055
ttattatattg

SEQ ID NO: 152985 - DNA, 11 bp, Unknown
  misc_feature (1)..( 11): Result.004 file - promoters50/1010055
atataattatt

SEQ ID NO: 152986 - DNA, 11 bp, Unknown
  misc_feature (1)..( 11): Result.004 file - promoters50/1010055
aaattatttac

SEQ ID NO: 152987 - DNA, 11 bp, Unknown
  misc_feature (1)..( 11): Result.004 file - promoters50/1010055
taatgattttg

SEQ ID NO: 152988 - DNA, 11 bp, Unknown
  misc_feature (1)..( 11): Result.004 file - promoters50/1010055
taattcttttc

SEQ ID NO: 152989 - DNA, 11 bp, Unknown
  misc_feature (1)..( 11): Result.004 file - promoters50/1010055
ttatcatttta

SEQ ID NO: 152990 - DNA, 10 bp, Unknown
  misc_feature (1)..( 10): Result.004 file - promoters50/1010055
actacatatt

SEQ ID NO: 152991 - DNA, 10 bp, Unknown
  misc_feature (1)..( 10): Result.004 file - promoters50/1010055
taaacatatt

SEQ ID NO: 152992 - DNA, 10 bp, Unknown
  misc_feature (1)..( 10): Result.004 file - promoters50/1010055
tcaacatata

SEQ ID NO: 152993 - DNA, 10 bp, Unknown
  misc_feature (1)..( 10): Result.004 file - promoters50/1010055
caaaaataag

SEQ ID NO: 152994 - DNA, 10 bp, Unknown
  misc_feature (1)..( 10): Result.004 file - promoters50/1010055
agtaaataat

SEQ ID NO: 152995 - DNA, 10 bp, Unknown
  misc_feature (1)..( 10): Result.004 file - promoters50/1010055
caaaaaaggt

SEQ ID NO: 152996 - DNA, 10 bp, Unknown
  misc_feature (1)..( 10): Result.004 file - promoters50/1010055
aaaatattaa

SEQ ID NO: 152997 - DNA, 10 bp, Unknown
  misc_feature (1)..( 10): Result.004 file - promoters50/1010055
caaagattta

SEQ ID NO: 152998 - DNA, 10 bp, Unknown
  misc_feature (1)..( 10): Result.004 file - promoters50/1010055
taaataataa

SEQ ID NO: 152999 - DNA, 10 bp, Unknown
  misc_feature (1)..( 10): Result.004 file - promoters50/1010055
aaaataagat

SEQ ID NO: 153000 - DNA, 10 bp, Unknown
  misc_feature (1)..( 10): Result.004 file - promoters50/1010055
taaacatatt

SEQ ID NO: 153001 - DNA, 10 bp, Unknown
  misc_feature (1)..( 10): Result.004 file - promoters50/1010055
ttaacaaaaa

SEQ ID NO: 153002 - DNA, 13 bp, Unknown
  misc_feature (1)..( 13): Result.004 file - promoters50/1010055
aatatttcatttc

SEQ ID NO: 153003 - DNA, 13 bp, Unknown
  misc_feature (1)..( 13): Result.004 file - promoters50/1010055
agtatatcacaaa

SEQ ID NO: 153004 - DNA, 13 bp, Unknown
  misc_feature (1)..( 13): Result.004 file - promoters50/1010055
tctttttcttttc

SEQ ID NO: 153005 - DNA, 13 bp, Unknown
  misc_feature (1)..( 13): Result.004 file - promoters50/1010055
agaatttttagta

SEQ ID NO: 153006 - DNA, 13 bp, Unknown
  misc_feature (1)..( 13): Result.004 file - promoters50/1010055
tttatttccttca

SEQ ID NO: 153007 - DNA, 13 bp, Unknown
  misc_feature (1)..( 13): Result.004 file - promoters50/1010055
tttatttcggtaa

SEQ ID NO: 153008 - DNA, 13 bp, Unknown
  misc_feature (1)..( 13): Result.004 file - promoters50/1010065
tggatttttggtg

SEQ ID NO: 153009 - DNA, 9 bp, Unknown
  misc_feature (1)..( 9): Result.004 file - promoters50/1010065
taaacatgc

SEQ ID NO: 153010 - DNA, 9 bp, Unknown
  misc_feature (1)..( 9): Result.004 file - promoters50/1010065
taaacaaat

SEQ ID NO: 153011 - DNA, 9 bp, Unknown
  misc_feature (1)..( 9): Result.004 file - promoters50/1010065
taaaaaaat

SEQ ID NO: 153012 - DNA, 8 bp, Unknown
  misc_feature (1)..( 8): Result.004 file - promoters50/1010065
attattta

SEQ ID NO: 153013 - DNA, 8 bp, Unknown
  misc_feature (1)..( 8): Result.004 file - promoters50/1010065
atttttta

SEQ ID NO: 153014 - DNA, 8 bp, Unknown
  misc_feature (1)..( 8): Result.004 file - promoters50/1010065
attttttt

SEQ ID NO: 153015 - DNA, 9 bp, Unknown
  misc_feature (1)..( 9): Result.004 file - promoters50/1010065
tatataaac

SEQ ID NO: 153016 - DNA, 9 bp, Unknown
  misc_feature (1)..( 9): Result.004 file - promoters50/1010065
tataaaaaa

SEQ ID NO: 153017 - DNA, 9 bp, Unknown
  misc_feature (1)..( 9): Result.004 file - promoters50/1010065
taaacaaat

SEQ ID NO: 153018 - DNA, 10 bp, Unknown
  misc_feature (1)..( 10): Result.004 file - promoters50/1010065
atacaaaaca

SEQ ID NO: 153019 - DNA, 10 bp, Unknown
  misc_feature (1)..( 10): Result.004 file - promoters50/1010065
acacaaaaca

SEQ ID NO: 153020 - DNA, 10 bp, Unknown
  misc_feature (1)..( 10): Result.004 file - promoters50/1010065
acacaaacaa

SEQ ID NO: 153021 - DNA, 8 bp, Unknown
  misc_feature (1)..( 8): Result.004 file - promoters50/1010065
tttaaaaa

SEQ ID NO: 153022 - DNA, 8 bp, Unknown
  misc_feature (1)..( 8): Result.004 file - promoters50/1010065
attacaaa

SEQ ID NO: 153023 - DNA, 8 bp, Unknown
  misc_feature (1)..( 8): Result.004 file - promoters50/1010068
attacaac

SEQ ID NO: 153024 - DNA, 10 bp, Unknown
  misc_feature (1)..( 10): Result.004 file - promoters50/1010068
gattaggcgt

SEQ ID NO: 153025 - DNA, 10 bp, Unknown
  misc_feature (1)..( 10): Result.004 file - promoters50/1010068
tattcggcta

SEQ ID NO: 153026 - DNA, 10 bp, Unknown
  misc_feature (1)..( 10): Result.004 file - promoters50/1010094
tattctgcta

SEQ ID NO: 153027 - DNA, 16 bp, Unknown
  misc_feature (1)..( 16): Result.004 file - promoters50/1010094
tacatacagatccacg

SEQ ID NO: 153028 - DNA, 16 bp, Unknown
  misc_feature (1)..( 16): Result.004 file - promoters50/1010094
aagatagagatagtca

SEQ ID NO: 153029 - DNA, 16 bp, Unknown
  misc_feature (1)..( 16): Result.004 file - promoters50/1010094
cacaaacaagaaaaac

SEQ ID NO: 153030 - DNA, 16 bp, Unknown
  misc_feature (1)..( 16): Result.004 file - promoters50/1010094
tagatagacaaaacaa

SEQ ID NO: 153031 - DNA, 16 bp, Unknown
  misc_feature (1)..( 16): Result.004 file - promoters50/1010094
aacatagacgaaacaa

SEQ ID NO: 153032 - DNA, 16 bp, Unknown
  misc_feature (1)..( 16): Result.004 file - promoters50/1010094
cacaaaacatccttaa

SEQ ID NO: 153033 - DNA, 16 bp, Unknown
  misc_feature (1)..( 16): Result.004 file - promoters50/1010094
atcataaaagttttat

SEQ ID NO: 153034 - DNA, 12 bp, Unknown
  misc_feature (1)..( 12): Result.004 file - promoters50/1010094
ttggttttgaga

SEQ ID NO: 153035 - DNA, 12 bp, Unknown
  misc_feature (1)..( 12): Result.004 file - promoters50/1010094
ctctttttgata

SEQ ID NO: 153036 - DNA, 12 bp, Unknown
  misc_feature (1)..( 12): Result.004 file - promoters50/1010094
gaatttttgcga

SEQ ID NO: 153037 - DNA, 12 bp, Unknown
  misc_feature (1)..( 12): Result.004 file - promoters50/1010094
ataattttatat

SEQ ID NO: 153038 - DNA, 12 bp, Unknown
  misc_feature (1)..( 12): Result.004 file - promoters50/1010094
gaacttttaatc

SEQ ID NO: 153039 - DNA, 12 bp, Unknown
  misc_feature (1)..( 12): Result.004 file - promoters50/1010094
aaacatttgaac

SEQ ID NO: 153040 - DNA, 12 bp, Unknown
  misc_feature (1)..( 12): Result.004 file - promoters50/1010094
taacatatgact

SEQ ID NO: 153041 - DNA, 12 bp, Unknown
  misc_feature (1)..( 12): Result.004 file - promoters50/1010094
ttagatatgata

SEQ ID NO: 153042 - DNA, 8 bp, Unknown
  misc_feature (1)..( 8): Result.004 file - promoters50/1010094
ataataaa

SEQ ID NO: 153043 - DNA, 8 bp, Unknown
  misc_feature (1)..( 8): Result.004 file - promoters50/1010094
atactaaa

SEQ ID NO: 153044 - DNA, 8 bp, Unknown
  misc_feature (1)..( 8): Result.004 file - promoters50/1010094
gtaataat

SEQ ID NO: 153045 - DNA, 8 bp, Unknown
  misc_feature (1)..( 8): Result.004 file - promoters50/1010094
ttacgaaa

SEQ ID NO: 153046 - DNA, 8 bp, Unknown
  misc_feature (1)..( 8): Result.004 file - promoters50/1010094
ctaccaaa

SEQ ID NO: 153047 - DNA, 8 bp, Unknown
  misc_feature (1)..( 8): Result.004 file - promoters50/1010094
ataataat

SEQ ID NO: 153048 - DNA, 10 bp, Unknown
  misc_feature (1)..( 10): Result.004 file - promoters50/1010094
taacgtttgg

SEQ ID NO: 153049 - DNA, 10 bp, Unknown
  misc_feature (1)..( 10): Result.004 file - promoters50/1010094
gaacttttaa

SEQ ID NO: 153050 - DNA, 10 bp, Unknown
  misc_feature (1)..( 10): Result.004 file - promoters50/1010094
aaacatttga

SEQ ID NO: 153051 - DNA, 10 bp, Unknown
  misc_feature (1)..( 10): Result.004 file - promoters50/1010094
gaatttttgc

SEQ ID NO: 153052 - DNA, 10 bp, Unknown
  misc_feature (1)..( 10): Result.004 file - promoters50/1010094
taacatatga

SEQ ID NO: 153053 - DNA, 10 bp, Unknown
  misc_feature (1)..( 10): Result.004 file - promoters50/1010094
ttagatatga

SEQ ID NO: 153054 - DNA, 10 bp, Unknown
  misc_feature (1)..( 10): Result.004 file - promoters50/1010094
taattttata

SEQ ID NO: 153055 - DNA, 12 bp, Unknown
  misc_feature (1)..( 12): Result.004 file - promoters50/1010094
aaaaattaaaac

SEQ ID NO: 153056 - DNA, 12 bp, Unknown
  misc_feature (1)..( 12): Result.004 file - promoters50/1010094
caaacttataag

SEQ ID NO: 153057 - DNA, 12 bp, Unknown
  misc_feature (1)..( 12): Result.004 file - promoters50/1010094
aacaattaaata

SEQ ID NO: 153058 - DNA, 12 bp, Unknown
  misc_feature (1)..( 12): Result.004 file - promoters50/1010094
caaacttgtcaa

SEQ ID NO: 153059 - DNA, 12 bp, Unknown
  misc_feature (1)..( 12): Result.004 file - promoters50/1010094
attcgttacata

SEQ ID NO: 153060 - DNA, 12 bp, Unknown
  misc_feature (1)..( 12): Result.004 file - promoters50/1010094
ttttgttccatt

SEQ ID NO: 153061 - DNA, 9 bp, Unknown
  misc_feature (1)..( 9): Result.004 file - promoters50/1010094
gatatgatt

SEQ ID NO: 153062 - DNA, 9 bp, Unknown
  misc_feature (1)..( 9): Result.004 file - promoters50/1010094
catatgaaa

SEQ ID NO: 153063 - DNA, 9 bp, Unknown
  misc_feature (1)..( 9): Result.004 file - promoters50/1010094
tgtataatt

SEQ ID NO: 153064 - DNA, 9 bp, Unknown
  misc_feature (1)..( 9): Result.004 file - promoters50/1010094
gatatgata

SEQ ID NO: 153065 - DNA, 9 bp, Unknown
  misc_feature (1)..( 9): Result.004 file - promoters50/1010094
gttatcaaa

SEQ ID NO: 153066 - DNA, 9 bp, Unknown
  misc_feature (1)..( 9): Result.004 file - promoters50/1010094
catatgact

SEQ ID NO: 153067 - DNA, 11 bp, Unknown
  misc_feature (1)..( 11): Result.004 file - promoters50/1010094
tagtcaaacga

SEQ ID NO: 153068 - DNA, 11 bp, Unknown
  misc_feature (1)..( 11): Result.004 file - promoters50/1010094
tagacaaaaca

SEQ ID NO: 153069 - DNA, 11 bp, Unknown
  misc_feature (1)..( 11): Result.004 file - promoters50/1010094
tccacaaaaca

SEQ ID NO: 153070 - DNA, 11 bp, Unknown
  misc_feature (1)..( 11): Result.004 file - promoters50/1010094
gagaaaaaaca

SEQ ID NO: 153071 - DNA, 11 bp, Unknown
  misc_feature (1)..( 11): Result.004 file - promoters50/1010094
ttcacaaacaa

SEQ ID NO: 153072 - DNA, 11 bp, Unknown
  misc_feature (1)..( 11): Result.004 file - promoters50/1010094
ttatcaaaacc

SEQ ID NO: 153073 - DNA, 13 bp, Unknown
  misc_feature (1)..( 13): Result.004 file - promoters50/1010094
tagtcaaacgatt

SEQ ID NO: 153074 - DNA, 13 bp, Unknown
  misc_feature (1)..( 13): Result.004 file - promoters50/1010094
agacaaaacaatt

SEQ ID NO: 153075 - DNA, 13 bp, Unknown
  misc_feature (1)..( 13): Result.004 file - promoters50/1010094
ccacaaaacatcc

SEQ ID NO: 153076 - DNA, 13 bp, Unknown
  misc_feature (1)..( 13): Result.004 file - promoters50/1010094
ttcacaaacaaga

SEQ ID NO: 153077 - DNA, 13 bp, Unknown
  misc_feature (1)..( 13): Result.004 file - promoters50/1010094
agaaaaaacatag

SEQ ID NO: 153078 - DNA, 13 bp, Unknown
  misc_feature (1)..( 13): Result.004 file - promoters50/1010115
tatcaaaaccgtt

SEQ ID NO: 153079 - DNA, 10 bp, Unknown
  misc_feature (1)..( 10): Result.004 file - promoters50/1010115
atttaaagct

SEQ ID NO: 153080 - DNA, 10 bp, Unknown
  misc_feature (1)..( 10): Result.004 file - promoters50/1010115
ttttcaagtt

SEQ ID NO: 153081 - DNA, 10 bp, Unknown
  misc_feature (1)..( 10): Result.004 file - promoters50/1010115
attgaaagat

SEQ ID NO: 153082 - DNA, 11 bp, Unknown
  misc_feature (1)..( 11): Result.004 file - promoters50/1010115
ggtctcacgtt

SEQ ID NO: 153083 - DNA, 11 bp, Unknown
  misc_feature (1)..( 11): Result.004 file - promoters50/1010115
ttttccaaagt

SEQ ID NO: 153084 - DNA, 11 bp, Unknown
  misc_feature (1)..( 11): Result.004 file - promoters50/1010115
aagtccaaata

SEQ ID NO: 153085 - DNA, 12 bp, Unknown
  misc_feature (1)..( 12): Result.004 file - promoters50/1010115
ttgagattacta

SEQ ID NO: 153086 - DNA, 12 bp, Unknown
  misc_feature (1)..( 12): Result.004 file - promoters50/1010115
tcgagaatacat

SEQ ID NO: 153087 - DNA, 12 bp, Unknown
  misc_feature (1)..( 12): Result.004 file - promoters50/1010115
tcgataattgat

SEQ ID NO: 153088 - DNA, 12 bp, Unknown
  misc_feature (1)..( 12): Result.004 file - promoters50/1010115
tgtataatttac

SEQ ID NO: 153089 - DNA, 12 bp, Unknown
  misc_feature (1)..( 12): Result.004 file - promoters50/1010115
tgaataatttgc

SEQ ID NO: 153090 - DNA, 12 bp, Unknown
  misc_feature (1)..( 12): Result.004 file - promoters50/1010163
ctaaaaatacat

SEQ ID NO: 153091 - DNA, 7 bp, Unknown
  misc_feature (1)..( 7): Result.004 file - promoters50/1010163
gagaaac

SEQ ID NO: 153092 - DNA, 7 bp, Unknown
  misc_feature (1)..( 7): Result.004 file - promoters50/1010163
cagaaac

SEQ ID NO: 153093 - DNA, 7 bp, Unknown
  misc_feature (1)..( 7): Result.004 file - promoters50/1010170
gagcaac

SEQ ID NO: 153094 - DNA, 12 bp, Unknown
  misc_feature (1)..( 12): Result.004 file - promoters50/1010170
aaagtttcctct

SEQ ID NO: 153095 - DNA, 12 bp, Unknown
  misc_feature (1)..( 12): Result.004 file - promoters50/1010170
aaattttcttct

SEQ ID NO: 153096 - DNA, 12 bp, Unknown
  misc_feature (1)..( 12): Result.004 file - promoters50/1010170
agattatctttc

SEQ ID NO: 153097 - DNA, 8 bp, Unknown
  misc_feature (1)..( 8): Result.004 file - promoters50/1010170
tttgaata

SEQ ID NO: 153098 - DNA, 8 bp, Unknown
  misc_feature (1)..( 8): Result.004 file - promoters50/1010170
tttgcata

SEQ ID NO: 153099 - DNA, 8 bp, Unknown
  misc_feature (1)..( 8): Result.004 file - promoters50/1010201
tttgcatg

SEQ ID NO: 153100 - DNA, 9 bp, Unknown
  misc_feature (1)..( 9): Result.004 file - promoters50/1010201
gactaagat

SEQ ID NO: 153101 - DNA, 9 bp, Unknown
  misc_feature (1)..( 9): Result.004 file - promoters50/1010201
tgctaagat

SEQ ID NO: 153102 - DNA, 9 bp, Unknown
  misc_feature (1)..( 9): Result.004 file - promoters50/1010201
gaccaagaa

SEQ ID NO: 153103 - DNA, 9 bp, Unknown
  misc_feature (1)..( 9): Result.004 file - promoters50/1010201
ttcaaaaaa

SEQ ID NO: 153104 - DNA, 9 bp, Unknown
  misc_feature (1)..( 9): Result.004 file - promoters50/1010201
ttcaaaatt

SEQ ID NO: 153105 - DNA, 9 bp, Unknown
  misc_feature (1)..( 9): Result.004 file - promoters50/1010209
accaaaatc

SEQ ID NO: 153106 - DNA, 11 bp, Unknown
  misc_feature (1)..( 11): Result.004 file - promoters50/1010209
cacacacatgc

SEQ ID NO: 153107 - DNA, 11 bp, Unknown
  misc_feature (1)..( 11): Result.004 file - promoters50/1010209
gcaacaaatgc

SEQ ID NO: 153108 - DNA, 11 bp, Unknown
  misc_feature (1)..( 11): Result.004 file - promoters50/1010209
cacacccatac

SEQ ID NO: 153109 - DNA, 13 bp, Unknown
  misc_feature (1)..( 13): Result.004 file - promoters50/1010209
taggaaatgtatt

SEQ ID NO: 153110 - DNA, 13 bp, Unknown
  misc_feature (1)..( 13): Result.004 file - promoters50/1010209
aaataaatttatt

SEQ ID NO: 153111 - DNA, 13 bp, Unknown
  misc_feature (1)..( 13): Result.004 file - promoters50/1010346
aaacaaattaggg

SEQ ID NO: 153112 - DNA, 10 bp, Unknown
  misc_feature (1)..( 10): Result.004 file - promoters50/1010346
tataaaaaat

SEQ ID NO: 153113 - DNA, 10 bp, Unknown
  misc_feature (1)..( 10): Result.004 file - promoters50/1010346
ggaaaaaaat

SEQ ID NO: 153114 - DNA, 10 bp, Unknown
  misc_feature (1)..( 10): Result.004 file - promoters50/1010346
tatacaaaag

SEQ ID NO: 153115 - DNA, 10 bp, Unknown
  misc_feature (1)..( 10): Result.004 file - promoters50/1010346
agtaagaaag

SEQ ID NO: 153116 - DNA, 10 bp, Unknown
  misc_feature (1)..( 10): Result.004 file - promoters50/1010346
gccaaaaaag

SEQ ID NO: 153117 - DNA, 10 bp, Unknown
  misc_feature (1)..( 10): Result.004 file - promoters50/1010346
tcaacaaaat

SEQ ID NO: 153118 - DNA, 11 bp, Unknown
  misc_feature (1)..( 11): Result.004 file - promoters50/1010346
atttatattga

SEQ ID NO: 153119 - DNA, 11 bp, Unknown
  misc_feature (1)..( 11): Result.004 file - promoters50/1010346
ctttttatttt

SEQ ID NO: 153120 - DNA, 11 bp, Unknown
  misc_feature (1)..( 11): Result.004 file - promoters50/1010346
tcttaaattcc

SEQ ID NO: 153121 - DNA, 11 bp, Unknown
  misc_feature (1)..( 11): Result.004 file - promoters50/1010346
taataacttat

SEQ ID NO: 153122 - DNA, 11 bp, Unknown
  misc_feature (1)..( 11): Result.004 file - promoters50/1010346
ctttttaccag

SEQ ID NO: 153123 - DNA, 11 bp, Unknown
  misc_feature (1)..( 11): Result.004 file - promoters50/1010346
atttgtacgtc

SEQ ID NO: 153124 - DNA, 11 bp, Unknown
  misc_feature (1)..( 11): Result.004 file - promoters50/1010346
gattttgtttt

SEQ ID NO: 153125 - DNA, 9 bp, Unknown
  misc_feature (1)..( 9): Result.004 file - promoters50/1010346
aaaaaccgt

SEQ ID NO: 153126 - DNA, 9 bp, Unknown
  misc_feature (1)..( 9): Result.004 file - promoters50/1010346
aaaaacatt

SEQ ID NO: 153127 - DNA, 9 bp, Unknown
  misc_feature (1)..( 9): Result.004 file - promoters50/1010346
aaaaaaggg

SEQ ID NO: 153128 - DNA, 9 bp, Unknown
  misc_feature (1)..( 9): Result.004 file - promoters50/1010346
aagaacaaa

SEQ ID NO: 153129 - DNA, 9 bp, Unknown
  misc_feature (1)..( 9): Result.004 file - promoters50/1010346
aaaaaaagt

SEQ ID NO: 153130 - DNA, 9 bp, Unknown
  misc_feature (1)..( 9): Result.004 file - promoters50/1010357
aaaaaaata

SEQ ID NO: 153131 - DNA, 11 bp, Unknown
  misc_feature (1)..( 11): Result.004 file - promoters50/1010357
ttttatatttt

SEQ ID NO: 153132 - DNA, 11 bp, Unknown
  misc_feature (1)..( 11): Result.004 file - promoters50/1010357
ttttatgtttg

SEQ ID NO: 153133 - DNA, 11 bp, Unknown
  misc_feature (1)..( 11): Result.004 file - promoters50/1010357
gtttgtattta

SEQ ID NO: 153134 - DNA, 11 bp, Unknown
  misc_feature (1)..( 11): Result.004 file - promoters50/1010357
acatatataaa

SEQ ID NO: 153135 - DNA, 9 bp, Unknown
  misc_feature (1)..( 9): Result.004 file - promoters50/1010357
agtgacttc

SEQ ID NO: 153136 - DNA, 9 bp, Unknown
  misc_feature (1)..( 9): Result.004 file - promoters50/1010357
cgtgaattc

SEQ ID NO: 153137 - DNA, 9 bp, Unknown
  misc_feature (1)..( 9): Result.004 file - promoters50/1010357
cgtgaacat

SEQ ID NO: 153138 - DNA, 7 bp, Unknown
  misc_feature (1)..( 7): Result.004 file - promoters50/1010357
ttaaaaa

SEQ ID NO: 153139 - DNA, 7 bp, Unknown
  misc_feature (1)..( 7): Result.004 file - promoters50/1010357
ataaaaa

SEQ ID NO: 153140 - DNA, 7 bp, Unknown
  misc_feature (1)..( 7): Result.004 file - promoters50/1010367
ataaaat

SEQ ID NO: 153141 - DNA, 10 bp, Unknown
  misc_feature (1)..( 10): Result.004 file - promoters50/1010367
atttatttcg

SEQ ID NO: 153142 - DNA, 10 bp, Unknown
  misc_feature (1)..( 10): Result.004 file - promoters50/1010367
atttatgtcg

SEQ ID NO: 153143 - DNA, 10 bp, Unknown
  misc_feature (1)..( 10): Result.004 file - promoters50/1010367
ttttattcta

SEQ ID NO: 153144 - DNA, 10 bp, Unknown
  misc_feature (1)..( 10): Result.004 file - promoters50/1010367
ttttcttttc

SEQ ID NO: 153145 - DNA, 10 bp, Unknown
  misc_feature (1)..( 10): Result.004 file - promoters50/1010367
atttatggac

SEQ ID NO: 153146 - DNA, 10 bp, Unknown
  misc_feature (1)..( 10): Result.004 file - promoters50/1010367
atttttggtg

SEQ ID NO: 153147 - DNA, 10 bp, Unknown
  misc_feature (1)..( 10): Result.004 file - promoters50/1010367
aaagacaaac

SEQ ID NO: 153148 - DNA, 10 bp, Unknown
  misc_feature (1)..( 10): Result.004 file - promoters50/1010367
attaacaaac

SEQ ID NO: 153149 - DNA, 10 bp, Unknown
  misc_feature (1)..( 10): Result.004 file - promoters50/1010367
atttacaaac

SEQ ID NO: 153150 - DNA, 10 bp, Unknown
  misc_feature (1)..( 10): Result.004 file - promoters50/1010367
agttaaaaaa

SEQ ID NO: 153151 - DNA, 10 bp, Unknown
  misc_feature (1)..( 10): Result.004 file - promoters50/1010367
atttaaaatc

SEQ ID NO: 153152 - DNA, 10 bp, Unknown
  misc_feature (1)..( 10): Result.004 file - promoters50/1010367
gtttaaatta

SEQ ID NO: 153153 - DNA, 9 bp, Unknown
  misc_feature (1)..( 9): Result.004 file - promoters50/1010367
cccaaaaat

SEQ ID NO: 153154 - DNA, 9 bp, Unknown
  misc_feature (1)..( 9): Result.004 file - promoters50/1010367
tacaaaaaa

SEQ ID NO: 153155 - DNA, 9 bp, Unknown
  misc_feature (1)..( 9): Result.004 file - promoters50/1010367
cccaaaatt

SEQ ID NO: 153156 - DNA, 9 bp, Unknown
  misc_feature (1)..( 9): Result.004 file - promoters50/1010367
aacaaaaaa

SEQ ID NO: 153157 - DNA, 9 bp, Unknown
  misc_feature (1)..( 9): Result.004 file - promoters50/1010367
tacaaaact

SEQ ID NO: 153158 - DNA, 10 bp, Unknown
  misc_feature (1)..( 10): Result.004 file - promoters50/1010367
ttaaaataaa

SEQ ID NO: 153159 - DNA, 10 bp, Unknown
  misc_feature (1)..( 10): Result.004 file - promoters50/1010367
tccaaaattc

SEQ ID NO: 153160 - DNA, 16 bp, Unknown
  misc_feature (1)..( 16): Result.004 file - promoters50/1010367
agaccaatcacaacat

SEQ ID NO: 153161 - DNA, 16 bp, Unknown
  misc_feature (1)..( 16): Result.004 file - promoters50/1010367
aaaccaatgtttattt

SEQ ID NO: 153162 - DNA, 16 bp, Unknown
  misc_feature (1)..( 16): Result.004 file - promoters50/1010367
aaaacaagggacaagt

SEQ ID NO: 153163 - DNA, 16 bp, Unknown
  misc_feature (1)..( 16): Result.004 file - promoters50/1010367
ccaacaacaaaaaaag

SEQ ID NO: 153164 - DNA, 16 bp, Unknown
  misc_feature (1)..( 16): Result.004 file - promoters50/1010367
cccacaaaacgacgac

SEQ ID NO: 153165 - DNA, 16 bp, Unknown
  misc_feature (1)..( 16): Result.004 file - promoters50/1010367
caaccaactatccaaa

SEQ ID NO: 153166 - DNA, 9 bp, Unknown
  misc_feature (1)..( 9): Result.004 file - promoters50/1010367
caaaaacag

SEQ ID NO: 153167 - DNA, 9 bp, Unknown
  misc_feature (1)..( 9): Result.004 file - promoters50/1010367
caaaaaact

SEQ ID NO: 153168 - DNA, 9 bp, Unknown
  misc_feature (1)..( 9): Result.004 file - promoters50/1010367
caaaaatta

SEQ ID NO: 153169 - DNA, 9 bp, Unknown
  misc_feature (1)..( 9): Result.004 file - promoters50/1010367
aaaatatta

SEQ ID NO: 153170 - DNA, 9 bp, Unknown
  misc_feature (1)..( 9): Result.004 file - promoters50/1010367
caaagattt

SEQ ID NO: 153171 - DNA, 10 bp, Unknown
  misc_feature (1)..( 10): Result.004 file - promoters50/1010367
caataaaatt

SEQ ID NO: 153172 - DNA, 14 bp, Unknown
  misc_feature (1)..( 14): Result.004 file - promoters50/1010367
aatcacaacattgc

SEQ ID NO: 153173 - DNA, 14 bp, Unknown
  misc_feature (1)..( 14): Result.004 file - promoters50/1010367
gccaacaacaaaaa

SEQ ID NO: 153174 - DNA, 14 bp, Unknown
  misc_feature (1)..( 14): Result.004 file - promoters50/1010367
ctatccaaaattaa

SEQ ID NO: 153175 - DNA, 14 bp, Unknown
  misc_feature (1)..( 14): Result.004 file - promoters50/1010367
aacgacaaaacaag

SEQ ID NO: 153176 - DNA, 14 bp, Unknown
  misc_feature (1)..( 14): Result.004 file - promoters50/1010367
aacgaccataatta

SEQ ID NO: 153177 - DNA, 14 bp, Unknown
  misc_feature (1)..( 14): Result.004 file - promoters50/1010367
aacgacgacgttta

SEQ ID NO: 153178 - DNA, 10 bp, Unknown
  misc_feature (1)..( 10): Result.004 file - promoters50/1010367
caaaaataag

SEQ ID NO: 153179 - DNA, 10 bp, Unknown
  misc_feature (1)..( 10): Result.004 file - promoters50/1010367
tgaaaatatt

SEQ ID NO: 153180 - DNA, 10 bp, Unknown
  misc_feature (1)..( 10): Result.004 file - promoters50/1010367
ataaagtata

SEQ ID NO: 153181 - DNA, 10 bp, Unknown
  misc_feature (1)..( 10): Result.004 file - promoters50/1010367
taaaaattaa

SEQ ID NO: 153182 - DNA, 10 bp, Unknown
  misc_feature (1)..( 10): Result.004 file - promoters50/1010367
ccaaaattca

SEQ ID NO: 153183 - DNA, 10 bp, Unknown
  misc_feature (1)..( 10): Result.004 file - promoters50/1010367
ccaaaattga

SEQ ID NO: 153184 - DNA, 9 bp, Unknown
  misc_feature (1)..( 9): Result.004 file - promoters50/1010367
caaaaatta

SEQ ID NO: 153185 - DNA, 9 bp, Unknown
  misc_feature (1)..( 9): Result.004 file - promoters50/1010367
taaaaatta

SEQ ID NO: 153186 - DNA, 9 bp, Unknown
  misc_feature (1)..( 9): Result.004 file - promoters50/1010367
caaaaaact

SEQ ID NO: 153187 - DNA, 9 bp, Unknown
  misc_feature (1)..( 9): Result.004 file - promoters50/1010367
aaaatatta

SEQ ID NO: 153188 - DNA, 9 bp, Unknown
  misc_feature (1)..( 9): Result.004 file - promoters50/1010367
ccaaaattc

SEQ ID NO: 153189 - DNA, 9 bp, Unknown
  misc_feature (1)..( 9): Result.004 file - promoters50/1010367
ccaaaattg

SEQ ID NO: 153190 - DNA, 11 bp, Unknown
  misc_feature (1)..( 11): Result.004 file - promoters50/1010367
ataatgaatta

SEQ ID NO: 153191 - DNA, 11 bp, Unknown
  misc_feature (1)..( 11): Result.004 file - promoters50/1010367
taaataaattt

SEQ ID NO: 153192 - DNA, 11 bp, Unknown
  misc_feature (1)..( 11): Result.004 file - promoters50/1010367
aaagtgaattt

SEQ ID NO: 153193 - DNA, 11 bp, Unknown
  misc_feature (1)..( 11): Result.004 file - promoters50/1010367
aaaatgaaaaa

SEQ ID NO: 153194 - DNA, 11 bp, Unknown
  misc_feature (1)..( 11): Result.004 file - promoters50/1010367
taaattaatta

SEQ ID NO: 153195 - DNA, 11 bp, Unknown
  misc_feature (1)..( 11): Result.004 file - promoters50/1010367
taactgatttt

SEQ ID NO: 153196 - DNA, 11 bp, Unknown
  misc_feature (1)..( 11): Result.004 file - promoters50/1010373
caaattattta

SEQ ID NO: 153197 - DNA, 11 bp, Unknown
  misc_feature (1)..( 11): Result.004 file - promoters50/1010373
ttaatttacaa

SEQ ID NO: 153198 - DNA, 11 bp, Unknown
  misc_feature (1)..( 11): Result.004 file - promoters50/1010373
ttaattagatt

SEQ ID NO: 153199 - DNA, 11 bp, Unknown
  misc_feature (1)..( 11): Result.004 file - promoters50/1010373
ataatttacat

SEQ ID NO: 153200 - DNA, 11 bp, Unknown
  misc_feature (1)..( 11): Result.004 file - promoters50/1010373
ataaattacaa

SEQ ID NO: 153201 - DNA, 11 bp, Unknown
  misc_feature (1)..( 11): Result.004 file - promoters50/1010373
ttaaaatctta

SEQ ID NO: 153202 - DNA, 11 bp, Unknown
  misc_feature (1)..( 11): Result.004 file - promoters50/1010411
aaaatatacag

SEQ ID NO: 153203 - DNA, 8 bp, Unknown
  misc_feature (1)..( 8): Result.004 file - promoters50/1010411
aataattg

SEQ ID NO: 153204 - DNA, 8 bp, Unknown
  misc_feature (1)..( 8): Result.004 file - promoters50/1010411
aattattt

SEQ ID NO: 153205 - DNA, 8 bp, Unknown
  misc_feature (1)..( 8): Result.004 file - promoters50/1010411
catacttg

SEQ ID NO: 153206 - DNA, 9 bp, Unknown
  misc_feature (1)..( 9): Result.004 file - promoters50/1010411
tatgtttgc

SEQ ID NO: 153207 - DNA, 9 bp, Unknown
  misc_feature (1)..( 9): Result.004 file - promoters50/1010411
tatattttt

SEQ ID NO: 153208 - DNA, 9 bp, Unknown
  misc_feature (1)..( 9): Result.004 file - promoters50/1010411
ggtgtttgc

SEQ ID NO: 153209 - DNA, 8 bp, Unknown
  misc_feature (1)..( 8): Result.004 file - promoters50/1010411
aaaatgag

SEQ ID NO: 153210 - DNA, 8 bp, Unknown
  misc_feature (1)..( 8): Result.004 file - promoters50/1010411
aaagtgaa

SEQ ID NO: 153211 - DNA, 8 bp, Unknown
  misc_feature (1)..( 8): Result.004 file - promoters50/1010411
gaagagaa

SEQ ID NO: 153212 - DNA, 10 bp, Unknown
  misc_feature (1)..( 10): Result.004 file - promoters50/1010411
gtaatcgatg

SEQ ID NO: 153213 - DNA, 10 bp, Unknown
  misc_feature (1)..( 10): Result.004 file - promoters50/1010411
gtaattgatg

SEQ ID NO: 153214 - DNA, 10 bp, Unknown
  misc_feature (1)..( 10): Result.004 file - promoters50/1010411
ggacttgatg

SEQ ID NO: 153215 - DNA, 12 bp, Unknown
  misc_feature (1)..( 12): Result.004 file - promoters50/1010411
tagaattactaa

SEQ ID NO: 153216 - DNA, 12 bp, Unknown
  misc_feature (1)..( 12): Result.004 file - promoters50/1010411
tagatttattaa

SEQ ID NO: 153217 - DNA, 12 bp, Unknown
  misc_feature (1)..( 12): Result.004 file - promoters50/1010411
gctacttattct

SEQ ID NO: 153218 - DNA, 8 bp, Unknown
  misc_feature (1)..( 8): Result.004 file - promoters50/1010411
aattttaa

SEQ ID NO: 153219 - DNA, 8 bp, Unknown
  misc_feature (1)..( 8): Result.004 file - promoters50/1010411
aatttttt

SEQ ID NO: 153220 - DNA, 9 bp, Unknown
  misc_feature (1)..( 9): Result.004 file - promoters50/1010411
tattctttt

SEQ ID NO: 153221 - DNA, 12 bp, Unknown
  misc_feature (1)..( 12): Result.004 file - promoters50/1010411
tttttctaaaat

SEQ ID NO: 153222 - DNA, 12 bp, Unknown
  misc_feature (1)..( 12): Result.004 file - promoters50/1010411
gttttctacaat

SEQ ID NO: 153223 - DNA, 12 bp, Unknown
  misc_feature (1)..( 12): Result.004 file - promoters50/1010418
gttttctgcaca

SEQ ID NO: 153224 - DNA, 11 bp, Unknown
  misc_feature (1)..( 11): Result.004 file - promoters50/1010418
ccagaagagaa

SEQ ID NO: 153225 - DNA, 11 bp, Unknown
  misc_feature (1)..( 11): Result.004 file - promoters50/1010418
ccaaaagaaat

SEQ ID NO: 153226 - DNA, 11 bp, Unknown
  misc_feature (1)..( 11): Result.004 file - promoters50/1010418
tgggaagtgaa

SEQ ID NO: 153227 - DNA, 8 bp, Unknown
  misc_feature (1)..( 8): Result.004 file - promoters50/1010418
ggatagat

SEQ ID NO: 153228 - DNA, 8 bp, Unknown
  misc_feature (1)..( 8): Result.004 file - promoters50/1010418
ggaaagaa

SEQ ID NO: 153229 - DNA, 8 bp, Unknown
  misc_feature (1)..( 8): Result.004 file - promoters50/1010418
tgaaagaa

SEQ ID NO: 153230 - DNA, 7 bp, Unknown
  misc_feature (1)..( 7): Result.004 file - promoters50/1010418
gagtgat

SEQ ID NO: 153231 - DNA, 7 bp, Unknown
  misc_feature (1)..( 7): Result.004 file - promoters50/1010418
tagtgat

SEQ ID NO: 153232 - DNA, 7 bp, Unknown
  misc_feature (1)..( 7): Result.004 file - promoters50/1010418
tagcgat

SEQ ID NO: 153233 - DNA, 8 bp, Unknown
  misc_feature (1)..( 8): Result.004 file - promoters50/1010418
ggcctaaa

SEQ ID NO: 153234 - DNA, 8 bp, Unknown
  misc_feature (1)..( 8): Result.004 file - promoters50/1010418
ggcctaat

SEQ ID NO: 153235 - DNA, 8 bp, Unknown
  misc_feature (1)..( 8): Result.004 file - promoters50/1010425
ggcctaat

SEQ ID NO: 153236 - DNA, 11 bp, Unknown
  misc_feature (1)..( 11): Result.004 file - promoters50/1010425
gaagaaataca

SEQ ID NO: 153237 - DNA, 11 bp, Unknown
  misc_feature (1)..( 11): Result.004 file - promoters50/1010425
aatgaaaaaca

SEQ ID NO: 153238 - DNA, 11 bp, Unknown
  misc_feature (1)..( 11): Result.004 file - promoters50/1010425
taggaaaaatt

SEQ ID NO: 153239 - DNA, 11 bp, Unknown
  misc_feature (1)..( 11): Result.004 file - promoters50/1010425
aatgagaaagt

SEQ ID NO: 153240 - DNA, 10 bp, Unknown
  misc_feature (1)..( 10): Result.004 file - promoters50/1010425
actaatcagg

SEQ ID NO: 153241 - DNA, 10 bp, Unknown
  misc_feature (1)..( 10): Result.004 file - promoters50/1010425
cgaaattagg

SEQ ID NO: 153242 - DNA, 10 bp, Unknown
  misc_feature (1)..( 10): Result.004 file - promoters50/1010425
taaaattaaa

SEQ ID NO: 153243 - DNA, 10 bp, Unknown
  misc_feature (1)..( 10): Result.004 file - promoters50/1010429
taaaatttta

SEQ ID NO: 153244 - DNA, 10 bp, Unknown
  misc_feature (1)..( 10): Result.004 file - promoters50/1010429
gttatttatt

SEQ ID NO: 153245 - DNA, 10 bp, Unknown
  misc_feature (1)..( 10): Result.004 file - promoters50/1010429
gttattaatt

SEQ ID NO: 153246 - DNA, 10 bp, Unknown
  misc_feature (1)..( 10): Result.004 file - promoters50/1010429
taattttatt

SEQ ID NO: 153247 - DNA, 10 bp, Unknown
  misc_feature (1)..( 10): Result.004 file - promoters50/1010429
gttttttaat

SEQ ID NO: 153248 - DNA, 10 bp, Unknown
  misc_feature (1)..( 10): Result.004 file - promoters50/1010429
tttgtttaac

SEQ ID NO: 153249 - DNA, 10 bp, Unknown
  misc_feature (1)..( 10): Result.004 file - promoters50/1010429
tgcattaatg

SEQ ID NO: 153250 - DNA, 10 bp, Unknown
  misc_feature (1)..( 10): Result.004 file - promoters50/1010429
ctctttaatt

SEQ ID NO: 153251 - DNA, 14 bp, Unknown
  misc_feature (1)..( 14): Result.004 file - promoters50/1010429
tcaagcttatacaa

SEQ ID NO: 153252 - DNA, 14 bp, Unknown
  misc_feature (1)..( 14): Result.004 file - promoters50/1010429
aagcaattatacaa

SEQ ID NO: 153253 - DNA, 14 bp, Unknown
  misc_feature (1)..( 14): Result.004 file - promoters50/1010429
aattattcatacaa

SEQ ID NO: 153254 - DNA, 14 bp, Unknown
  misc_feature (1)..( 14): Result.004 file - promoters50/1010429
aaaaaatgatagca

SEQ ID NO: 153255 - DNA, 14 bp, Unknown
  misc_feature (1)..( 14): Result.004 file - promoters50/1010429
aaaaaatgataaga

SEQ ID NO: 153256 - DNA, 14 bp, Unknown
  misc_feature (1)..( 14): Result.004 file - promoters50/1010429
tgtcaactaaaaaa

SEQ ID NO: 153257 - DNA, 12 bp, Unknown
  misc_feature (1)..( 12): Result.004 file - promoters50/1010429
ttatacaaatcc

SEQ ID NO: 153258 - DNA, 12 bp, Unknown
  misc_feature (1)..( 12): Result.004 file - promoters50/1010429
aaatataaataa

SEQ ID NO: 153259 - DNA, 12 bp, Unknown
  misc_feature (1)..( 12): Result.004 file - promoters50/1010429
ttatataaacat

SEQ ID NO: 153260 - DNA, 12 bp, Unknown
  misc_feature (1)..( 12): Result.004 file - promoters50/1010429
gtatataaatag

SEQ ID NO: 153261 - DNA, 12 bp, Unknown
  misc_feature (1)..( 12): Result.004 file - promoters50/1010429
ttaagtaaaatc

SEQ ID NO: 153262 - DNA, 12 bp, Unknown
  misc_feature (1)..( 12): Result.004 file - promoters50/1010429
ttctataaaata

SEQ ID NO: 153263 - DNA, 12 bp, Unknown
  misc_feature (1)..( 12): Result.004 file - promoters50/1010429
tagtataaataa

SEQ ID NO: 153264 - DNA, 12 bp, Unknown
  misc_feature (1)..( 12): Result.004 file - promoters50/1010431
ttatatatagaa

SEQ ID NO: 153265 - DNA, 11 bp, Unknown
  misc_feature (1)..( 11): Result.004 file - promoters50/1010431
aattaaattta

SEQ ID NO: 153266 - DNA, 11 bp, Unknown
  misc_feature (1)..( 11): Result.004 file - promoters50/1010431
aattcaatttt

SEQ ID NO: 153267 - DNA, 11 bp, Unknown
  misc_feature (1)..( 11): Result.004 file - promoters50/1010431
tggtaaactta

SEQ ID NO: 153268 - DNA, 11 bp, Unknown
  misc_feature (1)..( 11): Result.004 file - promoters50/1010431
ttgtagactgg

SEQ ID NO: 153269 - DNA, 11 bp, Unknown
  misc_feature (1)..( 11): Result.004 file - promoters50/1010431
gcataatcttt

SEQ ID NO: 153270 - DNA, 11 bp, Unknown
  misc_feature (1)..( 11): Result.004 file - promoters50/1010491
tgttaaacttg

SEQ ID NO: 153271 - DNA, 11 bp, Unknown
  misc_feature (1)..( 11): Result.004 file - promoters50/1010491
aataaagaaaa

SEQ ID NO: 153272 - DNA, 11 bp, Unknown
  misc_feature (1)..( 11): Result.004 file - promoters50/1010491
taagaagtaaa

SEQ ID NO: 153273 - DNA, 11 bp, Unknown
  misc_feature (1)..( 11): Result.004 file - promoters50/1010491
tttaaagaaat

SEQ ID NO: 153274 - DNA, 11 bp, Unknown
  misc_feature (1)..( 11): Result.004 file - promoters50/1010491
gataaagaagt

SEQ ID NO: 153275 - DNA, 11 bp, Unknown
  misc_feature (1)..( 11): Result.004 file - promoters50/1010491
ttttaagttat

SEQ ID NO: 153276 - DNA, 11 bp, Unknown
  misc_feature (1)..( 11): Result.004 file - promoters50/1010491
tcttaagtcag

SEQ ID NO: 153277 - DNA, 10 bp, Unknown
  misc_feature (1)..( 10): Result.004 file - promoters50/1010491
catgctttta

SEQ ID NO: 153278 - DNA, 10 bp, Unknown
  misc_feature (1)..( 10): Result.004 file - promoters50/1010491
gatgtttttt

SEQ ID NO: 153279 - DNA, 10 bp, Unknown
  misc_feature (1)..( 10): Result.004 file - promoters50/1010491
tatgcatttt

SEQ ID NO: 153280 - DNA, 10 bp, Unknown
  misc_feature (1)..( 10): Result.004 file - promoters50/1010491
catgtttaat

SEQ ID NO: 153281 - DNA, 10 bp, Unknown
  misc_feature (1)..( 10): Result.004 file - promoters50/1010491
atgtcatttt

SEQ ID NO: 153282 - DNA, 10 bp, Unknown
  misc_feature (1)..( 10): Result.004 file - promoters50/1010524
catgttgcat

SEQ ID NO: 153283 - DNA, 9 bp, Unknown
  misc_feature (1)..( 9): Result.004 file - promoters50/1010524
acaaacata

SEQ ID NO: 153284 - DNA, 9 bp, Unknown
  misc_feature (1)..( 9): Result.004 file - promoters50/1010524
acaaacgtt

SEQ ID NO: 153285 - DNA, 9 bp, Unknown
  misc_feature (1)..( 9): Result.004 file - promoters50/1010524
tcaagcgtt

SEQ ID NO: 153286 - DNA, 8 bp, Unknown
  misc_feature (1)..( 8): Result.004 file - promoters50/1010524
gaacaaat

SEQ ID NO: 153287 - DNA, 8 bp, Unknown
  misc_feature (1)..( 8): Result.004 file - promoters50/1010524
taactaat

SEQ ID NO: 153288 - DNA, 8 bp, Unknown
  misc_feature (1)..( 8): Result.004 file - promoters50/1010524
taacaaag

SEQ ID NO: 153289 - DNA, 8 bp, Unknown
  misc_feature (1)..( 8): Result.004 file - promoters50/1010524
gaataaaa

SEQ ID NO: 153290 - DNA, 10 bp, Unknown
  misc_feature (1)..( 10): Result.004 file - promoters50/1010524
tattttgaaa

SEQ ID NO: 153291 - DNA, 10 bp, Unknown
  misc_feature (1)..( 10): Result.004 file - promoters50/1010524
ccttttgaaa

SEQ ID NO: 153292 - DNA, 10 bp, Unknown
  misc_feature (1)..( 10): Result.004 file - promoters50/1010524
tattttgttg

SEQ ID NO: 153293 - DNA, 10 bp, Unknown
  misc_feature (1)..( 10): Result.004 file - promoters50/1010524
ggttttgaat

SEQ ID NO: 153294 - DNA, 7 bp, Unknown
  misc_feature (1)..( 7): Result.004 file - promoters50/1010524
atatttt

SEQ ID NO: 153295 - DNA, 7 bp, Unknown
  misc_feature (1)..( 7): Result.004 file - promoters50/1010524
atattta

SEQ ID NO: 153296 - DNA, 7 bp, Unknown
  misc_feature (1)..( 7): Result.004 file - promoters50/1010524
atatttt

SEQ ID NO: 153297 - DNA, 7 bp, Unknown
  misc_feature (1)..( 7): Result.004 file - promoters50/1010524
aaaatta

SEQ ID NO: 153298 - DNA, 7 bp, Unknown
  misc_feature (1)..( 7): Result.004 file - promoters50/1010524
aaaattt

SEQ ID NO: 153299 - DNA, 7 bp, Unknown
  misc_feature (1)..( 7): Result.004 file - promoters50/1010524
aaacttt

SEQ ID NO: 153300 - DNA, 7 bp, Unknown
  misc_feature (1)..( 7): Result.004 file - promoters50/1010524
tacttgc

SEQ ID NO: 153301 - DNA, 7 bp, Unknown
  misc_feature (1)..( 7): Result.004 file - promoters50/1010524
tacttgt

SEQ ID NO: 153302 - DNA, 7 bp, Unknown
  misc_feature (1)..( 7): Result.004 file - promoters50/1010524
gacttgt

SEQ ID NO: 153303 - DNA, 11 bp, Unknown
  misc_feature (1)..( 11): Result.004 file - promoters50/1010524
taatatatcat

SEQ ID NO: 153304 - DNA, 11 bp, Unknown
  misc_feature (1)..( 11): Result.004 file - promoters50/1010524
aaatttatcat

SEQ ID NO: 153305 - DNA, 11 bp, Unknown
  misc_feature (1)..( 11): Result.004 file - promoters50/1010536
aaacttatttt

SEQ ID NO: 153306 - DNA, 9 bp, Unknown
  misc_feature (1)..( 9): Result.004 file - promoters50/1010536
tcacataga

SEQ ID NO: 153307 - DNA, 9 bp, Unknown
  misc_feature (1)..( 9): Result.004 file - promoters50/1010536
acacatacc

SEQ ID NO: 153308 - DNA, 9 bp, Unknown
  misc_feature (1)..( 9): Result.004 file - promoters50/1010536
tcaaataga

SEQ ID NO: 153309 - DNA, 9 bp, Unknown
  misc_feature (1)..( 9): Result.004 file - promoters50/1010562
taaaatagg

SEQ ID NO: 153310 - DNA, 10 bp, Unknown
  misc_feature (1)..( 10): Result.004 file - promoters50/1010562
gatatctttc

SEQ ID NO: 153311 - DNA, 10 bp, Unknown
  misc_feature (1)..( 10): Result.004 file - promoters50/1010562
tccatcattc

SEQ ID NO: 153312 - DNA, 10 bp, Unknown
  misc_feature (1)..( 10): Result.004 file - promoters50/1010562
tttatttttt

SEQ ID NO: 153313 - DNA, 10 bp, Unknown
  misc_feature (1)..( 10): Result.004 file - promoters50/1010562
cctattttta

SEQ ID NO: 153314 - DNA, 10 bp, Unknown
  misc_feature (1)..( 10): Result.004 file - promoters50/1010562
gatatattta

SEQ ID NO: 153315 - DNA, 10 bp, Unknown
  misc_feature (1)..( 10): Result.004 file - promoters50/1010562
ctgattgtta

SEQ ID NO: 153316 - DNA, 10 bp, Unknown
  misc_feature (1)..( 10): Result.004 file - promoters50/1010562
actaaagaag

SEQ ID NO: 153317 - DNA, 10 bp, Unknown
  misc_feature (1)..( 10): Result.004 file - promoters50/1010562
gctatagaaa

SEQ ID NO: 153318 - DNA, 10 bp, Unknown
  misc_feature (1)..( 10): Result.004 file - promoters50/1010562
caaaaataag

SEQ ID NO: 153319 - DNA, 10 bp, Unknown
  misc_feature (1)..( 10): Result.004 file - promoters50/1010562
actaaagaaa

SEQ ID NO: 153320 - DNA, 11 bp, Unknown
  misc_feature (1)..( 11): Result.004 file - promoters50/1010571
aggaaattaaa

SEQ ID NO: 153321 - DNA, 41 bp, Unknown; identical to SEQ ID NO: 100565
  misc_feature (1)..( 41): Result.004 file - promoters50/1010571

SEQ ID NO: 153322 - DNA, 41 bp, Unknown; identical to SEQ ID NO: 100566
  misc_feature (1)..( 41): Result.004 file - promoters50/1010571

SEQ ID NO: 153323 - DNA, 41 bp, Unknown
  misc_feature (1)..( 41): Result.004 file - promoters50/1010571
acgccattggtagcaaggtataaatttaatagcaatctgaa

SEQ ID NO: 153324 - DNA, 41 bp, Unknown
  misc_feature (1)..( 41): Result.004 file - promoters50/1010571
cacgtttttggtgttacaaataatttagaaagaaggtggat

SEQ ID NO: 153325 - DNA, 41 bp, Unknown
  misc_feature (1)..( 41): Result.004 file - promoters50/1010571
tcgtcgctggcttctagaaccatttttttattctgaaaaca

SEQ ID NO: 153326 - DNA, 41 bp, Unknown
  misc_feature (1)..( 41): Result.004 file - promoters50/1010594
cgtgtactcacttccattatcgatcgaatcatcaatttaat

SEQ ID NO: 153327 - DNA, 10 bp, Unknown
  misc_feature (1)..( 10): Result.004 file - promoters50/1010594
aaattgaaac

SEQ ID NO: 153328 - DNA, 10 bp, Unknown
  misc_feature (1)..( 10): Result.004 file - promoters50/1010594
cgtttgaaac

SEQ ID NO: 153329 - DNA, 10 bp, Unknown
  misc_feature (1)..( 10): Result.004 file - promoters50/1010625
aaaatgaatg

SEQ ID NO: 153330 - DNA, 9 bp, Unknown
  misc_feature (1)..( 9): Result.004 file - promoters50/1010625
tttcttttc

SEQ ID NO: 153331 - DNA, 9 bp, Unknown
  misc_feature (1)..( 9): Result.004 file - promoters50/1010625
gagcttttc

SEQ ID NO: 153332 - DNA, 9 bp, Unknown
  misc_feature (1)..( 9): Result.004 file - promoters50/1010625
tttattttt

SEQ ID NO: 153333 - DNA, 9 bp, Unknown
  misc_feature (1)..( 9): Result.004 file - promoters50/1010625
attatttaa

SEQ ID NO: 153334 - DNA, 12 bp, Unknown
  misc_feature (1)..( 12): Result.004 file - promoters50/1010625
gaaatctaaatc

SEQ ID NO: 153335 - DNA, 12 bp, Unknown
  misc_feature (1)..( 12): Result.004 file - promoters50/1010625
aaaatataaacg

SEQ ID NO: 153336 - DNA, 12 bp, Unknown
  misc_feature (1)..( 12): Result.004 file - promoters50/1010625
cttttcttaatc

SEQ ID NO: 153337 - DNA, 12 bp, Unknown
  misc_feature (1)..( 12): Result.004 file - promoters50/1010625
aaattatttttc

SEQ ID NO: 153338 - DNA, 7 bp, Unknown
  misc_feature (1)..( 7): Result.004 file - promoters50/1010625
tataaaa

SEQ ID NO: 153339 - DNA, 7 bp, Unknown
  misc_feature (1)..( 7): Result.004 file - promoters50/1010625
cataaaa

SEQ ID NO: 153340 - DNA, 7 bp, Unknown
  misc_feature (1)..( 7): Result.004 file - promoters50/1010625
catgaaa

SEQ ID NO: 153341 - DNA, 9 bp, Unknown
  misc_feature (1)..( 9): Result.004 file - promoters50/1010625
ataaagttt

SEQ ID NO: 153342 - DNA, 9 bp, Unknown
  misc_feature (1)..( 9): Result.004 file - promoters50/1010625
ataaacttt

SEQ ID NO: 153343 - DNA, 9 bp, Unknown
  misc_feature (1)..( 9): Result.004 file - promoters50/1010625
tgaaacttc

SEQ ID NO: 153344 - DNA, 8 bp, Unknown
  misc_feature (1)..( 8): Result.004 file - promoters50/1010625
agtgaaat

SEQ ID NO: 153345 - DNA, 8 bp, Unknown
  misc_feature (1)..( 8): Result.004 file - promoters50/1010625
catgaaat

SEQ ID NO: 153346 - DNA, 8 bp, Unknown
  misc_feature (1)..( 8): Result.004 file - promoters50/1010677
cataaaac

SEQ ID NO: 153347 - DNA, 11 bp, Unknown
  misc_feature (1)..( 11): Result.004 file - promoters50/1010677
tttgctttttt

SEQ ID NO: 153348 - DNA, 11 bp, Unknown
  misc_feature (1)..( 11): Result.004 file - promoters50/1010677
ttttcttttat

SEQ ID NO: 153349 - DNA, 11 bp, Unknown
  misc_feature (1)..( 11): Result.004 file - promoters50/1010693
gtgtctgttat

SEQ ID NO: 153350 - DNA, 12 bp, Unknown
  misc_feature (1)..( 12): Result.004 file - promoters50/1010693
ttttcattcatt

SEQ ID NO: 153351 - DNA, 12 bp, Unknown
  misc_feature (1)..( 12): Result.004 file - promoters50/1010693
attttatttgaa

SEQ ID NO: 153352 - DNA, 12 bp, Unknown
  misc_feature (1)..( 12): Result.004 file - promoters50/1010693
ttttaattaaaa

SEQ ID NO: 153353 - DNA, 12 bp, Unknown
  misc_feature (1)..( 12): Result.004 file - promoters50/1010693
ctttaatttttt

SEQ ID NO: 153354 - DNA, 12 bp, Unknown
  misc_feature (1)..( 12): Result.004 file - promoters50/1010693
aataaataacta

SEQ ID NO: 153355 - DNA, 12 bp, Unknown
  misc_feature (1)..( 12): Result.004 file - promoters50/1010693
aaaaaatatata

SEQ ID NO: 153356 - DNA, 17 bp, Unknown
  misc_feature (1)..( 17): Result.004 file - promoters50/1010693
ttttaattttaataaat

SEQ ID NO: 153357 - DNA, 17 bp, Unknown
  misc_feature (1)..( 17): Result.004 file - promoters50/1010693
gaaggtttttaaaagac

SEQ ID NO: 153358 - DNA, 17 bp, Unknown
  misc_feature (1)..( 17): Result.004 file - promoters50/1010693
cacggcttttaattttg

SEQ ID NO: 153359 - DNA, 17 bp, Unknown
  misc_feature (1)..( 17): Result.004 file - promoters50/1010693
tttattttttataagaa

SEQ ID NO: 153360 - DNA, 17 bp, Unknown
  misc_feature (1)..( 17): Result.004 file - promoters50/1010693
tcatttatttactttct

SEQ ID NO: 153361 - DNA, 17 bp, Unknown
  misc_feature (1)..( 17): Result.004 file - promoters50/1010693
acattgatataaaaaaa

SEQ ID NO: 153362 - DNA, 10 bp, Unknown
  misc_feature (1)..( 10): Result.004 file - promoters50/1010693
aaaactaaaa

SEQ ID NO: 153363 - DNA, 10 bp, Unknown
  misc_feature (1)..( 10): Result.004 file - promoters50/1010693
caaattaaaa

SEQ ID NO: 153364 - DNA, 10 bp, Unknown
  misc_feature (1)..( 10): Result.004 file - promoters50/1010693
gaaacaaaaa

SEQ ID NO: 153365 - DNA, 10 bp, Unknown
  misc_feature (1)..( 10): Result.004 file - promoters50/1010693
aaaattactt

SEQ ID NO: 153366 - DNA, 11 bp, Unknown
  misc_feature (1)..( 11): Result.004 file - promoters50/1010693
taatatttgtt

SEQ ID NO: 153367 - DNA, 11 bp, Unknown
  misc_feature (1)..( 11): Result.004 file - promoters50/1010710
ggaaacacaaa

SEQ ID NO: 153368 - DNA, 9 bp, Unknown
  misc_feature (1)..( 9): Result.004 file - promoters50/1010710
tattattac

SEQ ID NO: 153369 - DNA, 9 bp, Unknown
  misc_feature (1)..( 9): Result.004 file - promoters50/1010710
aattatttt

SEQ ID NO: 153370 - DNA, 9 bp, Unknown
  misc_feature (1)..( 9): Result.004 file - promoters50/1010747
aatgatttt

SEQ ID NO: 153371 - DNA, 11 bp, Unknown
  misc_feature (1)..( 11): Result.004 file - promoters50/1010747
ctttggaatag

SEQ ID NO: 153372 - DNA, 11 bp, Unknown
  misc_feature (1)..( 11): Result.004 file - promoters50/1010747
ctttggaataa

SEQ ID NO: 153373 - DNA, 11 bp, Unknown
  misc_feature (1)..( 11): Result.004 file - promoters50/1010747
aaaaagaataa

SEQ ID NO: 153374 - DNA, 9 bp, Unknown
  misc_feature (1)..( 9): Result.004 file - promoters50/1010747
aatgattga

SEQ ID NO: 153375 - DNA, 9 bp, Unknown
  misc_feature (1)..( 9): Result.004 file - promoters50/1010747
gatgatttg

SEQ ID NO: 153376 - DNA, 9 bp, Unknown
  misc_feature (1)..( 9): Result.004 file - promoters50/1010747
gataatttg

SEQ ID NO: 153377 - DNA, 9 bp, Unknown
  misc_feature (1)..( 9): Result.004 file - promoters50/1010747
tatatttta

SEQ ID NO: 153378 - DNA, 14 bp, Unknown
  misc_feature (1)..( 14): Result.004 file - promoters50/1010747
tgttatttacaaat

SEQ ID NO: 153379 - DNA, 14 bp, Unknown
  misc_feature (1)..( 14): Result.004 file - promoters50/1010747
aaataactacaaat

SEQ ID NO: 153380 - DNA, 14 bp, Unknown
  misc_feature (1)..( 14): Result.004 file - promoters50/1010747
aaaaaactaaaaag

SEQ ID NO: 153381 - DNA, 10 bp, Unknown
  misc_feature (1)..( 10): Result.004 file - promoters50/1010747
aaaatttatt

SEQ ID NO: 153382 - DNA, 10 bp, Unknown
  misc_feature (1)..( 10): Result.004 file - promoters50/1010747
ataattgatt

SEQ ID NO: 153383 - DNA, 10 bp, Unknown
  misc_feature (1)..( 10): Result.004 file - promoters50/1010747
aaaaattatt

SEQ ID NO: 153384 - DNA, 10 bp, Unknown
  misc_feature (1)..( 10): Result.004 file - promoters50/1010747
taaaatttat

SEQ ID NO: 153385 - DNA, 10 bp, Unknown
  misc_feature (1)..( 10): Result.004 file - promoters50/1010747
caaaattctc

SEQ ID NO: 153386 - DNA, 10 bp, Unknown
  misc_feature (1)..( 10): Result.004 file - promoters50/1010747
aaaaattatt

SEQ ID NO: 153387 - DNA, 9 bp, Unknown
  misc_feature (1)..( 9): Result.004 file - promoters50/1010747
tatttaaca

SEQ ID NO: 153388 - DNA, 9 bp, Unknown
  misc_feature (1)..( 9): Result.004 file - promoters50/1010747
tatttagaa

SEQ ID NO: 153389 - DNA, 9 bp, Unknown
  misc_feature (1)..( 9): Result.004 file - promoters50/1010770
gattttgaa

SEQ ID NO: 153390 - DNA, 11 bp, Unknown
  misc_feature (1)..( 11): Result.004 file - promoters50/1010770
cattaaattaa

SEQ ID NO: 153391 - DNA, 11 bp, Unknown
  misc_feature (1)..( 11): Result.004 file - promoters50/1010770
ttctaaatttc

SEQ ID NO: 153392 - DNA, 11 bp, Unknown
  misc_feature (1)..( 11): Result.004 file - promoters50/1010770
aattaaattgt

SEQ ID NO: 153393 - DNA, 11 bp, Unknown
  misc_feature (1)..( 11): Result.004 file - promoters50/1010770
ccagaaatttg

SEQ ID NO: 153394 - DNA, 11 bp, Unknown
  misc_feature (1)..( 11): Result.004 file - promoters50/1010770
aaagaaagtgt

SEQ ID NO: 153395 - DNA, 11 bp, Unknown
  misc_feature (1)..( 11): Result.004 file - promoters50/1010770
aattaaaatta

SEQ ID NO: 153396 - DNA, 11 bp, Unknown
  misc_feature (1)..( 11): Result.004 file - promoters50/1010770
tgagaaattga

SEQ ID NO: 153397 - DNA, 14 bp, Unknown
  misc_feature (1)..( 14): Result.004 file - promoters50/1010770
acttgtctacataa

SEQ ID NO: 153398 - DNA, 14 bp, Unknown
  misc_feature (1)..( 14): Result.004 file - promoters50/1010770
ttttgtttacgtgt

SEQ ID NO: 153399 - DNA, 14 bp, Unknown
  misc_feature (1)..( 14): Result.004 file - promoters50/1010770
ttttctttatcttt

SEQ ID NO: 153400 - DNA, 14 bp, Unknown
  misc_feature (1)..( 14): Result.004 file - promoters50/1010770
aattctttactttg

SEQ ID NO: 153401 - DNA, 14 bp, Unknown
  misc_feature (1)..( 14): Result.004 file - promoters50/1010770
atttgttgttgacg

SEQ ID NO: 153402 - DNA, 14 bp, Unknown
  misc_feature (1)..( 14): Result.004 file - promoters50/1010815
aatttgatacattg

SEQ ID NO: 153403 - DNA, 11 bp, Unknown
  misc_feature (1)..( 11): Result.004 file - promoters50/1010815
ctatatataaa

SEQ ID NO: 153404 - DNA, 11 bp, Unknown
  misc_feature (1)..( 11): Result.004 file - promoters50/1010815
gtatataaaga

SEQ ID NO: 153405 - DNA, 11 bp, Unknown
  misc_feature (1)..( 11): Result.004 file - promoters50/1010815
ctatatttata

SEQ ID NO: 153406 - DNA, 11 bp, Unknown
  misc_feature (1)..( 11): Result.004 file - promoters50/1010815
ccatataaaac

SEQ ID NO: 153407 - DNA, 11 bp, Unknown
  misc_feature (1)..( 11): Result.004 file - promoters50/1010815
ccatataaatt

SEQ ID NO: 153408 - DNA, 11 bp, Unknown
  misc_feature (1)..( 11): Result.004 file - promoters50/1010819
cactataaatt

SEQ ID NO: 153409 - DNA, 13 bp, Unknown
  misc_feature (1)..( 13): Result.004 file - promoters50/1010819
atcaccaagaatg

SEQ ID NO: 153410 - DNA, 13 bp, Unknown
  misc_feature (1)..( 13): Result.004 file - promoters50/1010819
tagtaaaagaatc

SEQ ID NO: 153411 - DNA, 13 bp, Unknown
  misc_feature (1)..( 13): Result.004 file - promoters50/1010819
ttctaaaagcatc

SEQ ID NO: 153412 - DNA, 13 bp, Unknown
  misc_feature (1)..( 13): Result.004 file - promoters50/1010819
aattaaaaaaatt

SEQ ID NO: 153413 - DNA, 13 bp, Unknown
  misc_feature (1)..( 13): Result.004 file - promoters50/1010819
ttctaaaatctta

SEQ ID NO: 153414 - DNA, 13 bp, Unknown
  misc_feature (1)..( 13): Result.004 file - promoters50/1010819
gtctaaattgggt

SEQ ID NO: 153415 - DNA, 13 bp, Unknown
  misc_feature (1)..( 13): Result.004 file - promoters50/1010819
taaagatagcatc

SEQ ID NO: 153416 - DNA, 13 bp, Unknown
  misc_feature (1)..( 13): Result.004 file - promoters50/1010836
ttctaaaataata

SEQ ID NO: 153417 - DNA, 13 bp, Unknown
  misc_feature (1)..( 13): Result.004 file - promoters50/1010836
gacttcaattgaa

SEQ ID NO: 153418 - DNA, 13 bp, Unknown
  misc_feature (1)..( 13): Result.004 file - promoters50/1010836
aaaatcaattgaa

SEQ ID NO: 153419 - DNA, 13 bp, Unknown
  misc_feature (1)..( 13): Result.004 file - promoters50/1010836
gaaagcaatcgaa

SEQ ID NO: 153420 - DNA, 13 bp, Unknown
  misc_feature (1)..( 13): Result.004 file - promoters50/1010836
aaaataaatagat

SEQ ID NO: 153421 - DNA, 13 bp, Unknown
  misc_feature (1)..( 13): Result.004 file - promoters50/1010836
agagtaaagagag

SEQ ID NO: 153422 - DNA, 13 bp, Unknown
  misc_feature (1)..( 13): Result.004 file - promoters50/1010836
ggaaaaaatacag

SEQ ID NO: 153423 - DNA, 9 bp, Unknown
  misc_feature (1)..( 9): Result.004 file - promoters50/1010836
tgaaaaatc

SEQ ID NO: 153424 - DNA, 9 bp, Unknown
  misc_feature (1)..( 9): Result.004 file - promoters50/1010836
cgaataata

SEQ ID NO: 153425 - DNA, 9 bp, Unknown
  misc_feature (1)..( 9): Result.004 file - promoters50/1010836
ggaaaaaat

SEQ ID NO: 153426 - DNA, 9 bp, Unknown
  misc_feature (1)..( 9): Result.004 file - promoters50/1010836
ccaaaaatc

SEQ ID NO: 153427 - DNA, 9 bp, Unknown
  misc_feature (1)..( 9): Result.004 file - promoters50/1010836
ataaatatc

SEQ ID NO: 153428 - DNA, 9 bp, Unknown
  misc_feature (1)..( 9): Result.004 file - promoters50/1010902
ggaaaagag

SEQ ID NO: 153429 - DNA, 8 bp, Unknown
  misc_feature (1)..( 8): Result.004 file - promoters50/1010902
aatgaatt

SEQ ID NO: 153430 - DNA, 8 bp, Unknown
  misc_feature (1)..( 8): Result.004 file - promoters50/1010902
gatggatt

SEQ ID NO: 153431 - DNA, 8 bp, Unknown
  misc_feature (1)..( 8): Result.004 file - promoters50/1010902
aataaatt

SEQ ID NO: 153432 - DNA, 8 bp, Unknown
  misc_feature (1)..( 8): Result.004 file - promoters50/1010902
atgcaaac

SEQ ID NO: 153433 - DNA, 8 bp, Unknown
  misc_feature (1)..( 8): Result.004 file - promoters50/1010902
atgaaaaa

SEQ ID NO: 153434 - DNA, 8 bp, Unknown
  misc_feature (1)..( 8): Result.004 file - promoters50/1010902
tggaaaaa

SEQ ID NO: 153435 - DNA, 8 bp, Unknown
  misc_feature (1)..( 8): Result.004 file - promoters50/1010902
aaaaaaca

SEQ ID NO: 153436 - DNA, 8 bp, Unknown
  misc_feature (1)..( 8): Result.004 file - promoters50/1010902
taaacaca

SEQ ID NO: 153437 - DNA, 8 bp, Unknown
  misc_feature (1)..( 8): Result.004 file - promoters50/1010971
taatcact

SEQ ID NO: 153438 - DNA, 8 bp, Unknown
  misc_feature (1)..( 8): Result.004 file - promoters50/1010971
tattatta

SEQ ID NO: 153439 - DNA, 8 bp, Unknown
  misc_feature (1)..( 8): Result.004 file - promoters50/1010971
tgttatta

SEQ ID NO: 153440 - DNA, 8 bp, Unknown
  misc_feature (1)..( 8): Result.004 file - promoters50/1010971
tatcattt

SEQ ID NO: 153441 - DNA, 8 bp, Unknown
  misc_feature (1)..( 8): Result.004 file - promoters50/1010971
ttttcaat

SEQ ID NO: 153442 - DNA, 8 bp, Unknown
  misc_feature (1)..( 8): Result.004 file - promoters50/1010971
ttttcatt

SEQ ID NO: 153443 - DNA, 8 bp, Unknown
  misc_feature (1)..( 8): Result.004 file - promoters50/1010971
gtttgatt

SEQ ID NO: 153444 - DNA, 9 bp, Unknown
  misc_feature (1)..( 9): Result.004 file - promoters50/1010971
aattaaatc

SEQ ID NO: 153445 - DNA, 9 bp, Unknown
  misc_feature (1)..( 9): Result.004 file - promoters50/1010971
tcttatatc

SEQ ID NO: 153446 - DNA, 9 bp, Unknown
  misc_feature (1)..( 9): Result.004 file - promoters50/1010971
aattaaaaa

SEQ ID NO: 153447 - DNA, 9 bp, Unknown
  misc_feature (1)..( 9): Result.004 file - promoters50/1010971
aatttaatt

SEQ ID NO: 153448 - DNA, 8 bp, Unknown
  misc_feature (1)..( 8): Result.004 file - promoters50/1010971
cctccttg

SEQ ID NO: 153449 - DNA, 8 bp, Unknown
  misc_feature (1)..( 8): Result.004 file - promoters50/1010971
tatccttg

SEQ ID NO: 153450 - DNA, 8 bp, Unknown
  misc_feature (1)..( 8): Result.004 file - promoters50/1010971
cctccttc

SEQ ID NO: 153451 - DNA, 13 bp, Unknown
  misc_feature (1)..( 13): Result.004 file - promoters50/1010971
aataatttgaacc

SEQ ID NO: 153452 - DNA, 13 bp, Unknown
  misc_feature (1)..( 13): Result.004 file - promoters50/1010971
aatcatttgaagc

SEQ ID NO: 153453 - DNA, 13 bp, Unknown
  misc_feature (1)..( 13): Result.004 file - promoters50/1010971
tcccatttggctt

SEQ ID NO: 153454 - DNA, 13 bp, Unknown
  misc_feature (1)..( 13): Result.004 file - promoters50/1010971
ttctcgttgaagc

SEQ ID NO: 153455 - DNA, 8 bp, Unknown
  misc_feature (1)..( 8): Result.004 file - promoters50/1010971
cttttttt

SEQ ID NO: 153456 - DNA, 8 bp, Unknown
  misc_feature (1)..( 8): Result.004 file - promoters50/1010971
atttgttt

SEQ ID NO: 153457 - DNA, 8 bp, Unknown
  misc_feature (1)..( 8): Result.004 file - promoters50/1010971
atttgtat

SEQ ID NO: 153458 - DNA, 8 bp, Unknown
  misc_feature (1)..( 8): Result.004 file - promoters50/1010971
tctccttt

SEQ ID NO: 153459 - DNA, 8 bp, Unknown
  misc_feature (1)..( 8): Result.004 file - promoters50/1010971
tgtccttt

SEQ ID NO: 153460 - DNA, 8 bp, Unknown
  misc_feature (1)..( 8): Result.004 file - promoters50/1010971
tctccttc

SEQ ID NO: 153461 - DNA, 13 bp, Unknown
  misc_feature (1)..( 13): Result.004 file - promoters50/1010971
atcaaaacctcct

SEQ ID NO: 153462 - DNA, 13 bp, Unknown
  misc_feature (1)..( 13): Result.004 file - promoters50/1010971
atcataacctagt

SEQ ID NO: 153463 - DNA, 13 bp, Unknown
  misc_feature (1)..( 13): Result.004 file - promoters50/1010993
tacaaaatctcct

SEQ ID NO: 153464 - DNA, 14 bp, Unknown
  misc_feature (1)..( 14): Result.004 file - promoters50/1010993
cactgccacaaata

SEQ ID NO: 153465 - DNA, 14 bp, Unknown
  misc_feature (1)..( 14): Result.004 file - promoters50/1010993
tttcttcacaaaat

SEQ ID NO: 153466 - DNA, 14 bp, Unknown
  misc_feature (1)..( 14): Result.004 file - promoters50/1010993
taatagtacagata

SEQ ID NO: 153467 - DNA, 14 bp, Unknown
  misc_feature (1)..( 14): Result.004 file - promoters50/1010993
tttattcccaattc

SEQ ID NO: 153468 - DNA, 15 bp, Unknown
  misc_feature (1)..( 15): Result.004 file - promoters50/1010993
gaaacacacacaatg

SEQ ID NO: 153469 - DNA, 15 bp, Unknown
  misc_feature (1)..( 15): Result.004 file - promoters50/1010993
taacagcacaatcct

SEQ ID NO: 153470 - DNA, 11 bp, Unknown
  misc_feature (1)..( 11): Result.004 file - promoters50/1010993
tattaaaaaga

SEQ ID NO: 153471 - DNA, 11 bp, Unknown
  misc_feature (1)..( 11): Result.004 file - promoters50/1010993
ttataaaaaac

SEQ ID NO: 153472 - DNA, 11 bp, Unknown
  misc_feature (1)..( 11): Result.004 file - promoters50/1010993
atttaaaagag

SEQ ID NO: 153473 - DNA, 11 bp, Unknown
  misc_feature (1)..( 11): Result.004 file - promoters50/1010993
gaggaaacaac

SEQ ID NO: 153474 - DNA, 11 bp, Unknown
  misc_feature (1)..( 11): Result.004 file - promoters50/1010993
tattaaccaca

SEQ ID NO: 153475 - DNA, 11 bp, Unknown
  misc_feature (1)..( 11): Result.004 file - promoters50/1010993
aattagaagtt

SEQ ID NO: 153476 - DNA, 11 bp, Unknown
  misc_feature (1)..( 11): Result.004 file - promoters50/1010993
tatagatttta

SEQ ID NO: 153477 - DNA, 11 bp, Unknown
  misc_feature (1)..( 11): Result.004 file - promoters50/1010993
tatagaatttg

SEQ ID NO: 153478 - DNA, 11 bp, Unknown
  misc_feature (1)..( 11): Result.004 file - promoters50/1010993
ccggaatttta

SEQ ID NO: 153479 - DNA, 11 bp, Unknown
  misc_feature (1)..( 11): Result.004 file - promoters50/1010993
tgtagatttct

SEQ ID NO: 153480 - DNA, 11 bp, Unknown
  misc_feature (1)..( 11): Result.004 file - promoters50/1010993
atgacaatttg

SEQ ID NO: 153481 - DNA, 11 bp, Unknown
  misc_feature (1)..( 11): Result.004 file - promoters50/1010993
aataaaatacc

SEQ ID NO: 153482 - DNA, 11 bp, Unknown
  misc_feature (1)..( 11): Result.004 file - promoters50/1010993
attaacataat

SEQ ID NO: 153483 - DNA, 11 bp, Unknown
  misc_feature (1)..( 11): Result.004 file - promoters50/1010993
attaacaattt

SEQ ID NO: 153484 - DNA, 11 bp, Unknown
  misc_feature (1)..( 11): Result.004 file - promoters50/1010993
attgacaaaat

SEQ ID NO: 153485 - DNA, 11 bp, Unknown
  misc_feature (1)..( 11): Result.004 file - promoters50/1010993
tatgagaaaac

SEQ ID NO: 153486 - DNA, 11 bp, Unknown
  misc_feature (1)..( 11): Result.004 file - promoters50/1010993
aaagagaaagg

SEQ ID NO: 153487 - DNA, 11 bp, Unknown
  misc_feature (1)..( 11): Result.004 file - promoters50/1011036
aatgtgaactt

SEQ ID NO: 153488 - DNA, 9 bp, Unknown
  misc_feature (1)..( 9): Result.004 file - promoters50/1011036
aatttgttc

SEQ ID NO: 153489 - DNA, 9 bp, Unknown
  misc_feature (1)..( 9): Result.004 file - promoters50/1011036
ttttttttc

SEQ ID NO: 153490 - DNA, 9 bp, Unknown
  misc_feature (1)..( 9): Result.004 file - promoters50/1011036
aatttgttt

SEQ ID NO: 153491 - DNA, 9 bp, Unknown
  misc_feature (1)..( 9): Result.004 file - promoters50/1011036
taatttgtt

SEQ ID NO: 153492 - DNA, 9 bp, Unknown
  misc_feature (1)..( 9): Result.004 file - promoters50/1011036
taatttcaa

SEQ ID NO: 153493 - DNA, 9 bp, Unknown
  misc_feature (1)..( 9): Result.004 file - promoters50/1011036
aaatttgtt

SEQ ID NO: 153494 - DNA, 7 bp, Unknown
  misc_feature (1)..( 7): Result.004 file - promoters50/1011036
agagaaa

SEQ ID NO: 153495 - DNA, 7 bp, Unknown
  misc_feature (1)..( 7): Result.004 file - promoters50/1011036
agaaaaa

SEQ ID NO: 153496 - DNA, 7 bp, Unknown
  misc_feature (1)..( 7): Result.004 file - promoters50/1011036
tgaaaaa

SEQ ID NO: 153497 - DNA, 8 bp, Unknown
  misc_feature (1)..( 8): Result.004 file - promoters50/1011036
attctttg

SEQ ID NO: 153498 - DNA, 8 bp, Unknown
  misc_feature (1)..( 8): Result.004 file - promoters50/1011036
attttttt

SEQ ID NO: 153499 - DNA, 8 bp, Unknown
  misc_feature (1)..( 8): Result.004 file - promoters50/1011041
gttttttt

SEQ ID NO: 153500 - DNA, 11 bp, Unknown
  misc_feature (1)..( 11): Result.004 file - promoters50/1011041
atttagaaaga

SEQ ID NO: 153501 - DNA, 11 bp, Unknown
  misc_feature (1)..( 11): Result.004 file - promoters50/1011041
tcgaagaaagc

SEQ ID NO: 153502 - DNA, 11 bp, Unknown
  misc_feature (1)..( 11): Result.004 file - promoters50/1011041
tttaagaaagt

SEQ ID NO: 153503 - DNA, 11 bp, Unknown
  misc_feature (1)..( 11): Result.004 file - promoters50/1011041
aagaagaaaat

SEQ ID NO: 153504 - DNA, 11 bp, Unknown
  misc_feature (1)..( 11): Result.004 file - promoters50/1011041
gcacagatgaa

SEQ ID NO: 153505 - DNA, 11 bp, Unknown
  misc_feature (1)..( 11): Result.004 file - promoters50/1011041
tttgagaaatg

SEQ ID NO: 153506 - DNA, 17 bp, Unknown
  misc_feature (1)..( 17): Result.004 file - promoters50/1011041
ttataaaaattgaaact

SEQ ID NO: 153507 - DNA, 17 bp, Unknown
  misc_feature (1)..( 17): Result.004 file - promoters50/1011041
agaagcaaatcgaagaa

SEQ ID NO: 153508 - DNA, 17 bp, Unknown
  misc_feature (1)..( 17): Result.004 file - promoters50/1011041
tatataaaatattttaa

SEQ ID NO: 153509 - DNA, 17 bp, Unknown
  misc_feature (1)..( 17): Result.004 file - promoters50/1011041
acagatgaatttaaagc

SEQ ID NO: 153510 - DNA, 17 bp, Unknown
  misc_feature (1)..( 17): Result.004 file - promoters50/1011041
aaatgtattttgatact

SEQ ID NO: 153511 - DNA, 17 bp, Unknown
  misc_feature (1)..( 17): Result.004 file - promoters50/1011041
attaaccaatattcaga

SEQ ID NO: 153512 - DNA, 17 bp, Unknown
  misc_feature (1)..( 17): Result.004 file - promoters50/1011085
agaagaaaatcccgaga

SEQ ID NO: 153513 - DNA, 9 bp, Unknown
  misc_feature (1)..( 9): Result.004 file - promoters50/1011085
tgaaagaat

SEQ ID NO: 153514 - DNA, 9 bp, Unknown
  misc_feature (1)..( 9): Result.004 file - promoters50/1011085
ccaaagaaa

SEQ ID NO: 153515 - DNA, 9 bp, Unknown
  misc_feature (1)..( 9): Result.004 file - promoters50/1011085
tgaaaaaat

SEQ ID NO: 153516 - DNA, 8 bp, Unknown
  misc_feature (1)..( 8): Result.004 file - promoters50/1011085
gatgtatt

SEQ ID NO: 153517 - DNA, 8 bp, Unknown
  misc_feature (1)..( 8): Result.004 file - promoters50/1011085
gatatata

SEQ ID NO: 153518 - DNA, 8 bp, Unknown
  misc_feature (1)..( 8): Result.004 file - promoters50/1011108
tatggatt

SEQ ID NO: 153519 - DNA, 8 bp, Unknown
  misc_feature (1)..( 8): Result.004 file - promoters50/1011108
tatctttt

SEQ ID NO: 153520 - DNA, 8 bp, Unknown
  misc_feature (1)..( 8): Result.004 file - promoters50/1011108
tatttttt

SEQ ID NO: 153521 - DNA, 8 bp, Unknown
  misc_feature (1)..( 8): Result.004 file - promoters50/1011108
gattgttt

SEQ ID NO: 153522 - DNA, 9 bp, Unknown
  misc_feature (1)..( 9): Result.004 file - promoters50/1011108
ttttgattc

SEQ ID NO: 153523 - DNA, 9 bp, Unknown
  misc_feature (1)..( 9): Result.004 file - promoters50/1011108
ttttaattg

SEQ ID NO: 153524 - DNA, 9 bp, Unknown
  misc_feature (1)..( 9): Result.004 file - promoters50/1011212
gtttgcttc

SEQ ID NO: 153525 - DNA, 13 bp, Unknown
  misc_feature (1)..( 13): Result.004 file - promoters50/1011212
acattctttctta

SEQ ID NO: 153526 - DNA, 13 bp, Unknown
  misc_feature (1)..( 13): Result.004 file - promoters50/1011212
tacatctatctta

SEQ ID NO: 153527 - DNA, 13 bp, Unknown
  misc_feature (1)..( 13): Result.004 file - promoters50/1011212
acattctttaaaa

SEQ ID NO: 153528 - DNA, 7 bp, Unknown
  misc_feature (1)..( 7): Result.004 file - promoters50/1011212
taatttt

SEQ ID NO: 153529 - DNA, 7 bp, Unknown
  misc_feature (1)..( 7): Result.004 file - promoters50/1011212
aaatttt

SEQ ID NO: 153530 - DNA, 7 bp, Unknown
  misc_feature (1)..( 7): Result.004 file - promoters50/1011250
taatttc

SEQ ID NO: 153531 - DNA, 9 bp, Unknown
  misc_feature (1)..( 9): Result.004 file - promoters50/1011250
cataaacca

SEQ ID NO: 153532 - DNA, 9 bp, Unknown
  misc_feature (1)..( 9): Result.004 file - promoters50/1011250
tatatacca

SEQ ID NO: 153533 - DNA, 9 bp, Unknown
  misc_feature (1)..( 9): Result.004 file - promoters50/1011250
cataaataa

SEQ ID NO: 153534 - DNA, 9 bp, Unknown
  misc_feature (1)..( 9): Result.004 file - promoters50/1011250
attaaccaa

SEQ ID NO: 153535 - DNA, 9 bp, Unknown
  misc_feature (1)..( 9): Result.004 file - promoters50/1011250
cttaaccaa

SEQ ID NO: 153536 - DNA, 9 bp, Unknown
  misc_feature (1)..( 9): Result.004 file - promoters50/1011250
attcacctc

SEQ ID NO: 153537 - DNA, 12 bp, Unknown
  misc_feature (1)..( 12): Result.004 file - promoters50/1011250
ttactaaaatta

SEQ ID NO: 153538 - DNA, 12 bp, Unknown
  misc_feature (1)..( 12): Result.004 file - promoters50/1011250
aatagaaattta

SEQ ID NO: 153539 - DNA, 12 bp, Unknown
  misc_feature (1)..( 12): Result.004 file - promoters50/1011250
accctaaattta

SEQ ID NO: 153540 - DNA, 12 bp, Unknown
  misc_feature (1)..( 12): Result.004 file - promoters50/1011250
ttactaaaatat

SEQ ID NO: 153541 - DNA, 7 bp, Unknown
  misc_feature (1)..( 7): Result.004 file - promoters50/1011250
gttgatt

SEQ ID NO: 153542 - DNA, 7 bp, Unknown
  misc_feature (1)..( 7): Result.004 file - promoters50/1011250
tttgatt

SEQ ID NO: 153543 - DNA, 7 bp, Unknown
  misc_feature (1)..( 7): Result.004 file - promoters50/1011250
ttttatt

SEQ ID NO: 153544 - DNA, 9 bp, Unknown
  misc_feature (1)..( 9): Result.004 file - promoters50/1011250
ttcaatgaa

SEQ ID NO: 153545 - DNA, 9 bp, Unknown
  misc_feature (1)..( 9): Result.004 file - promoters50/1011250
attaatgaa

SEQ ID NO: 153546 - DNA, 9 bp, Unknown
  misc_feature (1)..( 9): Result.004 file - promoters50/1011250
attactgat

SEQ ID NO: 153547 - DNA, 7 bp, Unknown
  misc_feature (1)..( 7): Result.004 file - promoters50/1011250
taattaa

SEQ ID NO: 153548 - DNA, 7 bp, Unknown
  misc_feature (1)..( 7): Result.004 file - promoters50/1011250
aaattaa

SEQ ID NO: 153549 - DNA, 7 bp, Unknown
  misc_feature (1)..( 7): Result.004 file - promoters50/1011258
taattat

SEQ ID NO: 153550 - DNA, 13 bp, Unknown
  misc_feature (1)..( 13): Result.004 file - promoters50/1011258
cagaaaagaagac

SEQ ID NO: 153551 - DNA, 13 bp, Unknown
  misc_feature (1)..( 13): Result.004 file - promoters50/1011258
cagaaaccctttc

SEQ ID NO: 153552 - DNA, 13 bp, Unknown
  misc_feature (1)..( 13): Result.004 file - promoters50/1011258
cagaaaagaaaaa

SEQ ID NO: 153553 - DNA, 13 bp, Unknown
  misc_feature (1)..( 13): Result.004 file - promoters50/1011258
accaaaagacaaa

SEQ ID NO: 153554 - DNA, 12 bp, Unknown
  misc_feature (1)..( 12): Result.004 file - promoters50/1011258
cctttcttgttt

SEQ ID NO: 153555 - DNA, 12 bp, Unknown
  misc_feature (1)..( 12): Result.004 file - promoters50/1011258
actttcttcttt

SEQ ID NO: 153556 - DNA, 12 bp, Unknown
  misc_feature (1)..( 12): Result.004 file - promoters50/1011258
cctttccttctt

SEQ ID NO: 153557 - DNA, 12 bp, Unknown
  misc_feature (1)..( 12): Result.004 file - promoters50/1011303
tcttcccttatc

SEQ ID NO: 153558 - DNA, 9 bp, Unknown
  misc_feature (1)..( 9): Result.004 file - promoters50/1011303
tcataaact

SEQ ID NO: 153559 - DNA, 9 bp, Unknown
  misc_feature (1)..( 9): Result.004 file - promoters50/1011303
tcaaaaact

SEQ ID NO: 153560 - DNA, 9 bp, Unknown
  misc_feature (1)..( 9): Result.004 file - promoters50/1011303
ttatatact

SEQ ID NO: 153561 - DNA, 9 bp, Unknown
  misc_feature (1)..( 9): Result.004 file - promoters50/1011303
tcaaaaatt

SEQ ID NO: 153562 - DNA, 9 bp, Unknown
  misc_feature (1)..( 9): Result.004 file - promoters50/1011303
gtataaaca

SEQ ID NO: 153563 - DNA, 9 bp, Unknown
  misc_feature (1)..( 9): Result.004 file - promoters50/1011337
acaacaaca

SEQ ID NO: 153564 - DNA, 8 bp, Unknown
  misc_feature (1)..( 8): Result.004 file - promoters50/1011337
gtctaata

SEQ ID NO: 153565 - DNA, 8 bp, Unknown
  misc_feature (1)..( 8): Result.004 file - promoters50/1011337
gtctaaat

SEQ ID NO: 153566 - DNA, 8 bp, Unknown
  misc_feature (1)..( 8): Result.004 file - promoters50/1011337
gtctaatt

SEQ ID NO: 153567 - DNA, 8 bp, Unknown
  misc_feature (1)..( 8): Result.004 file - promoters50/1011358
cactaatt

SEQ ID NO: 153568 - DNA, 11 bp, Unknown
  misc_feature (1)..( 11): Result.004 file - promoters50/1011358
tgattcttcga

SEQ ID NO: 153569 - DNA, 11 bp, Unknown
  misc_feature (1)..( 11): Result.004 file - promoters50/1011358
cgatacttgtc

SEQ ID NO: 153570 - DNA, 11 bp, Unknown
  misc_feature (1)..( 11): Result.004 file - promoters50/1011358
cgaaactggtc

SEQ ID NO: 153571 - DNA, 10 bp, Unknown
  misc_feature (1)..( 10): Result.004 file - promoters50/1011358
aagaactaga

SEQ ID NO: 153572 - DNA, 10 bp, Unknown
  misc_feature (1)..( 10): Result.004 file - promoters50/1011358
aagaactcat

SEQ ID NO: 153573 - DNA, 10 bp, Unknown
  misc_feature (1)..( 10): Result.004 file - promoters50/1011358
atgaagtcat

SEQ ID NO: 153574 - DNA, 12 bp, Unknown
  misc_feature (1)..( 12): Result.004 file - promoters50/1011358
aataatgatgat

SEQ ID NO: 153575 - DNA, 12 bp, Unknown
  misc_feature (1)..( 12): Result.004 file - promoters50/1011358
ttaaatgaagat

SEQ ID NO: 153576 - DNA, 12 bp, Unknown
  misc_feature (1)..( 12): Result.004 file - promoters50/1011358
ttacatgaacag

SEQ ID NO: 153577 - DNA, 12 bp, Unknown
  misc_feature (1)..( 12): Result.004 file - promoters50/1011358
gtacctgattac

SEQ ID NO: 153578 - DNA, 10 bp, Unknown
  misc_feature (1)..( 10): Result.004 file - promoters50/1011358
tgtggtccat

SEQ ID NO: 153579 - DNA, 10 bp, Unknown
  misc_feature (1)..( 10): Result.004 file - promoters50/1011358
agtgatccaa

SEQ ID NO: 153580 - DNA, 10 bp, Unknown
  misc_feature (1)..( 10): Result.004 file - promoters50/1011358
tgtggttcat

SEQ ID NO: 153581 - DNA, 9 bp, Unknown
  misc_feature (1)..( 9): Result.004 file - promoters50/1011358
aaacaaaaa

SEQ ID NO: 153582 - DNA, 9 bp, Unknown
  misc_feature (1)..( 9): Result.004 file - promoters50/1011358
aaagaaaaa

SEQ ID NO: 153583 - DNA, 9 bp, Unknown
  misc_feature (1)..( 9): Result.004 file - promoters50/1011485
aaagaaacc

SEQ ID NO: 153584 - DNA, 8 bp, Unknown
  misc_feature (1)..( 8): Result.004 file - promoters50/1011485
tcaaattt

SEQ ID NO: 153585 - DNA, 8 bp, Unknown
  misc_feature (1)..( 8): Result.004 file - promoters50/1011485
tcaaatca

SEQ ID NO: 153586 - DNA, 8 bp, Unknown
  misc_feature (1)..( 8): Result.004 file - promoters50/1011512
acaaatca

SEQ ID NO: 153587 - DNA, 8 bp, Unknown
  misc_feature (1)..( 8): Result.004 file - promoters50/1011512
gaaaaaaa

SEQ ID NO: 153588 - DNA, 8 bp, Unknown
  misc_feature (1)..( 8): Result.004 file - promoters50/1011512
gaaaaaat

SEQ ID NO: 153589 - DNA, 9 bp, Unknown
  misc_feature (1)..( 9): Result.004 file - promoters50/1011512
aaaacaaaa

SEQ ID NO: 153590 - DNA, 9 bp, Unknown
  misc_feature (1)..( 9): Result.004 file - promoters50/1011512
acagataac

SEQ ID NO: 153591 - DNA, 9 bp, Unknown
  misc_feature (1)..( 9): Result.004 file - promoters50/1011512
acaaataaa

SEQ ID NO: 153592 - DNA, 10 bp, Unknown
  misc_feature (1)..( 10): Result.004 file - promoters50/1011512
ttaaatgaat

SEQ ID NO: 153593 - DNA, 10 bp, Unknown
  misc_feature (1)..( 10): Result.004 file - promoters50/1011512
gaaaaaaaca

SEQ ID NO: 153594 - DNA, 10 bp, Unknown
  misc_feature (1)..( 10): Result.004 file - promoters50/1011512
ccacaaaaca

SEQ ID NO: 153595 - DNA, 10 bp, Unknown
  misc_feature (1)..( 10): Result.004 file - promoters50/1011516
aaagaaaaaa

SEQ ID NO: 153596 - DNA, 8 bp, Unknown
  misc_feature (1)..( 8): Result.004 file - promoters50/1011516
caatgaga

SEQ ID NO: 153597 - DNA, 8 bp, Unknown
  misc_feature (1)..( 8): Result.004 file - promoters50/1011516
gaatcaga

SEQ ID NO: 153598 - DNA, 8 bp, Unknown
  misc_feature (1)..( 8): Result.004 file - promoters50/1011516
caaagaga

SEQ ID NO: 153599 - DNA, 10 bp, Unknown
  misc_feature (1)..( 10): Result.004 file - promoters50/1011516
ttatcttagt

SEQ ID NO: 153600 - DNA, 10 bp, Unknown
  misc_feature (1)..( 10): Result.004 file - promoters50/1011516
ctatattaat

SEQ ID NO: 153601 - DNA, 10 bp, Unknown
  misc_feature (1)..( 10): Result.004 file - promoters50/1011556
ctataataat

SEQ ID NO: 153602 - DNA, 12 bp, Unknown
  misc_feature (1)..( 12): Result.004 file - promoters50/1011556
atttaattctca

SEQ ID NO: 153603 - DNA, 12 bp, Unknown
  misc_feature (1)..( 12): Result.004 file - promoters50/1011556
aattatttcgtt

SEQ ID NO: 153604 - DNA, 12 bp, Unknown
  misc_feature (1)..( 12): Result.004 file - promoters50/1011556
gtttgattagta

SEQ ID NO: 153605 - DNA, 12 bp, Unknown
  misc_feature (1)..( 12): Result.004 file - promoters50/1011556
gtataattcttt

SEQ ID NO: 153606 - DNA, 12 bp, Unknown
  misc_feature (1)..( 12): Result.004 file - promoters50/1011556
gtatcattctca

SEQ ID NO: 153607 - DNA, 12 bp, Unknown
  misc_feature (1)..( 12): Result.004 file - promoters50/1011560
ttttgatttgat

SEQ ID NO: 153608 - DNA, 10 bp, Unknown
  misc_feature (1)..( 10): Result.004 file - promoters50/1011560
gcttaccttc

SEQ ID NO: 153609 - DNA, 10 bp, Unknown
  misc_feature (1)..( 10): Result.004 file - promoters50/1011560
acttgcctca

SEQ ID NO: 153610 - DNA, 10 bp, Unknown
  misc_feature (1)..( 10): Result.004 file - promoters50/1011560
ttttgtctct

SEQ ID NO: 153611 - DNA, 10 bp, Unknown
  misc_feature (1)..( 10): Result.004 file - promoters50/1011560
acttgcacct

SEQ ID NO: 153612 - DNA, 10 bp, Unknown
  misc_feature (1)..( 10): Result.004 file - promoters50/1011585
tcctgtttct

SEQ ID NO: 153613 - DNA, 9 bp, Unknown
  misc_feature (1)..( 9): Result.004 file - promoters50/1011585
aaataaaac

SEQ ID NO: 153614 - DNA, 9 bp, Unknown
  misc_feature (1)..( 9): Result.004 file - promoters50/1011585
caatgaaac

SEQ ID NO: 153615 - DNA, 10 bp, Unknown
  misc_feature (1)..( 10): Result.004 file - promoters50/1011707
aaatcgaacc

SEQ ID NO: 153616 - DNA, 7 bp, Unknown
  misc_feature (1)..( 7): Result.004 file - promoters50/1011707
tttcttc

SEQ ID NO: 153617 - DNA, 7 bp, Unknown
  misc_feature (1)..( 7): Result.004 file - promoters50/1011707
tttctta

SEQ ID NO: 153618 - DNA, 7 bp, Unknown
  misc_feature (1)..( 7): Result.004 file - promoters50/1011707
gttcttc

SEQ ID NO: 153619 - DNA, 8 bp, Unknown
  misc_feature (1)..( 8): Result.004 file - promoters50/1011707
agtctgtc

SEQ ID NO: 153620 - DNA, 8 bp, Unknown
  misc_feature (1)..( 8): Result.004 file - promoters50/1011707
agtgtgtg

SEQ ID NO: 153621 - DNA, 8 bp, Unknown
  misc_feature (1)..( 8): Result.004 file - promoters50/1011780
cctgtgtg

SEQ ID NO: 153622 - DNA, 10 bp, Unknown
  misc_feature (1)..( 10): Result.004 file - promoters50/1011780
tcttggttgg

SEQ ID NO: 153623 - DNA, 10 bp, Unknown
  misc_feature (1)..( 10): Result.004 file - promoters50/1011780
gattgtttgt

SEQ ID NO: 153624 - DNA, 10 bp, Unknown
  misc_feature (1)..( 10): Result.004 file - promoters50/1011780
aattttttgg

SEQ ID NO: 153625 - DNA, 10 bp, Unknown
  misc_feature (1)..( 10): Result.004 file - promoters50/1011780
aatttttctg

SEQ ID NO: 153626 - DNA, 10 bp, Unknown
  misc_feature (1)..( 10): Result.004 file - promoters50/1011780
ttgtgtttga

SEQ ID NO: 153627 - DNA, 10 bp, Unknown
  misc_feature (1)..( 10): Result.004 file - promoters50/1011780
tatcgtttgt

SEQ ID NO: 153628 - DNA, 10 bp, Unknown
  misc_feature (1)..( 10): Result.004 file - promoters50/1011780
atgtgttttg

SEQ ID NO: 153629 - DNA, 15 bp, Unknown
  misc_feature (1)..( 15): Result.004 file - promoters50/1011780
tgaatctgctaatgt

SEQ ID NO: 153630 - DNA, 15 bp, Unknown
  misc_feature (1)..( 15): Result.004 file - promoters50/1011780
caattttgctaaaaa

SEQ ID NO: 153631 - DNA, 15 bp, Unknown
  misc_feature (1)..( 15): Result.004 file - promoters50/1011780
tgtttttgctgatgt

SEQ ID NO: 153632 - DNA, 15 bp, Unknown
  misc_feature (1)..( 15): Result.004 file - promoters50/1011780
accctttgatgattg

SEQ ID NO: 153633 - DNA, 15 bp, Unknown
  misc_feature (1)..( 15): Result.004 file - promoters50/1011780
ttattttgctaccga

SEQ ID NO: 153634 - DNA, 15 bp, Unknown
  misc_feature (1)..( 15): Result.004 file - promoters50/1011780
ttattttccaattcc

SEQ ID NO: 153635 - DNA, 11 bp, Unknown
  misc_feature (1)..( 11): Result.004 file - promoters50/1011780
ttacaaaaaaa

SEQ ID NO: 153636 - DNA, 11 bp, Unknown
  misc_feature (1)..( 11): Result.004 file - promoters50/1011780
tgacataaatt

SEQ ID NO: 153637 - DNA, 11 bp, Unknown
  misc_feature (1)..( 11): Result.004 file - promoters50/1011780
tttcaaaaata

SEQ ID NO: 153638 - DNA, 11 bp, Unknown
  misc_feature (1)..( 11): Result.004 file - promoters50/1011780
taaaataaatt

SEQ ID NO: 153639 - DNA, 11 bp, Unknown
  misc_feature (1)..( 11): Result.004 file - promoters50/1011780
tgacatatcta

SEQ ID NO: 153640 - DNA, 11 bp, Unknown
  misc_feature (1)..( 11): Result.004 file - promoters50/1011862
cttcaaaatta

SEQ ID NO: 153641 - DNA, 8 bp, Unknown
  misc_feature (1)..( 8): Result.004 file - promoters50/1011862
ctaaaaaa

SEQ ID NO: 153642 - DNA, 8 bp, Unknown
  misc_feature (1)..( 8): Result.004 file - promoters50/1011862
ctaaaaag

SEQ ID NO: 153643 - DNA, 8 bp, Unknown
  misc_feature (1)..( 8): Result.004 file - promoters50/1011862
ataaaaac

SEQ ID NO: 153644 - DNA, 9 bp, Unknown
  misc_feature (1)..( 9): Result.004 file - promoters50/1011862
ctaacaaac

SEQ ID NO: 153645 - DNA, 10 bp, Unknown
  misc_feature (1)..( 10): Result.004 file - promoters50/1011862
tggttacatt

SEQ ID NO: 153646 - DNA, 10 bp, Unknown
  misc_feature (1)..( 10): Result.004 file - promoters50/1011862
cagtttcatt

SEQ ID NO: 153647 - DNA, 10 bp, Unknown
  misc_feature (1)..( 10): Result.004 file - promoters50/1011862
cagattcgag

SEQ ID NO: 153648 - DNA, 10 bp, Unknown
  misc_feature (1)..( 10): Result.004 file - promoters50/1011862
caattttgta

SEQ ID NO: 153649 - DNA, 10 bp, Unknown
  misc_feature (1)..( 10): Result.004 file - promoters50/1011862
caattttgtt

SEQ ID NO: 153650 - DNA, 10 bp, Unknown
  misc_feature (1)..( 10): Result.004 file - promoters50/1011862
ggatttagtt

SEQ ID NO: 153651 - DNA, 9 bp, Unknown
  misc_feature (1)..( 9): Result.004 file - promoters50/1011862
gagaaagaa

SEQ ID NO: 153652 - DNA, 9 bp, Unknown
  misc_feature (1)..( 9): Result.004 file - promoters50/1011862
gagaaatga

SEQ ID NO: 153653 - DNA, 9 bp, Unknown
  misc_feature (1)..( 9): Result.004 file - promoters50/1011862
gaggaagaa

SEQ ID NO: 153654 - DNA, 10 bp, Unknown
  misc_feature (1)..( 10): Result.004 file - promoters50/1011862
aatcggttat

SEQ ID NO: 153655 - DNA, 10 bp, Unknown
  misc_feature (1)..( 10): Result.004 file - promoters50/1011862
tttcgtttat

SEQ ID NO: 153656 - DNA, 10 bp, Unknown
  misc_feature (1)..( 10): Result.004 file - promoters50/1011900
ttttgttgtt

SEQ ID NO: 153657 - DNA, 10 bp, Unknown
  misc_feature (1)..( 10): Result.004 file - promoters50/1011900
ttcatatctc

SEQ ID NO: 153658 - DNA, 10 bp, Unknown
  misc_feature (1)..( 10): Result.004 file - promoters50/1011900
accatatcca

SEQ ID NO: 153659 - DNA, 10 bp, Unknown
  misc_feature (1)..( 10): Result.004 file - promoters50/1011900
ggcatatcaa

SEQ ID NO: 153660 - DNA, 10 bp, Unknown
  misc_feature (1)..( 10): Result.004 file - promoters50/1011900
ccaatagcaa

SEQ ID NO: 153661 - DNA, 10 bp, Unknown
  misc_feature (1)..( 10): Result.004 file - promoters50/1011900
accttatcca

SEQ ID NO: 153662 - DNA, 10 bp, Unknown
  misc_feature (1)..( 10): Result.004 file - promoters50/1011923
tctatatccc

SEQ ID NO: 153663 - DNA, 15 bp, Unknown
  misc_feature (1)..( 15): Result.004 file - promoters50/1011923
taatcttcatgttgt

SEQ ID NO: 153664 - DNA, 15 bp, Unknown
  misc_feature (1)..( 15): Result.004 file - promoters50/1011923
atatgttcatgttct

SEQ ID NO: 153665 - DNA, 15 bp, Unknown
  misc_feature (1)..( 15): Result.004 file - promoters50/1011923
ggatcttcatgactc

SEQ ID NO: 153666 - DNA, 15 bp, Unknown
  misc_feature (1)..( 15): Result.004 file - promoters50/1011923
ttaaccacattttgt

SEQ ID NO: 153667 - DNA, 15 bp, Unknown
  misc_feature (1)..( 15): Result.004 file - promoters50/1011923
cgtttgtcaagttaa

SEQ ID NO: 153668 - DNA, 15 bp, Unknown
  misc_feature (1)..( 15): Result.004 file - promoters50/1011923
aacaactcatgtttt

SEQ ID NO: 153669 - DNA, 15 bp, Unknown
  misc_feature (1)..( 15): Result.004 file - promoters50/1011923
ttagccacattttgt

SEQ ID NO: 153670 - DNA, 14 bp, Unknown
  misc_feature (1)..( 14): Result.004 file - promoters50/1011923
tcattgtttaattt

SEQ ID NO: 153671 - DNA, 14 bp, Unknown
  misc_feature (1)..( 14): Result.004 file - promoters50/1011923
tcattttttaattt

SEQ ID NO: 153672 - DNA, 14 bp, Unknown
  misc_feature (1)..( 14): Result.004 file - promoters50/1011923
attaattgttattt

SEQ ID NO: 153673 - DNA, 14 bp, Unknown
  misc_feature (1)..( 14): Result.004 file - promoters50/1011923
tggaaagttaatta

SEQ ID NO: 153674 - DNA, 14 bp, Unknown
  misc_feature (1)..( 14): Result.004 file - promoters50/1011923
cgccgtttgaattt

SEQ ID NO: 153675 - DNA, 14 bp, Unknown
  misc_feature (1)..( 14): Result.004 file - promoters50/1011972
tattctgctaattt

SEQ ID NO: 153676 - DNA, 12 bp, Unknown
  misc_feature (1)..( 12): Result.004 file - promoters50/1011972
agtgtttcatat

SEQ ID NO: 153677 - DNA, 12 bp, Unknown
  misc_feature (1)..( 12): Result.004 file - promoters50/1011972
gccgtttgataa

SEQ ID NO: 153678 - DNA, 12 bp, Unknown
  misc_feature (1)..( 12): Result.004 file - promoters50/1011972
agtttttgatat

SEQ ID NO: 153679 - DNA, 12 bp, Unknown
  misc_feature (1)..( 12): Result.004 file - promoters50/1011972
attcttttatac

SEQ ID NO: 153680 - DNA, 12 bp, Unknown
  misc_feature (1)..( 12): Result.004 file - promoters50/1011972
tcattttgacat

SEQ ID NO: 153681 - DNA, 12 bp, Unknown
  misc_feature (1)..( 12): Result.004 file - promoters50/1011972
ggattttgctat

SEQ ID NO: 153682 - DNA, 13 bp, Unknown
  misc_feature (1)..( 13): Result.004 file - promoters50/1011972
agtaagatatttt

SEQ ID NO: 153683 - DNA, 13 bp, Unknown
  misc_feature (1)..( 13): Result.004 file - promoters50/1011972
tgaactctatttt

SEQ ID NO: 153684 - DNA, 13 bp, Unknown
  misc_feature (1)..( 13): Result.004 file - promoters50/1011972
aaaaatatattta

SEQ ID NO: 153685 - DNA, 13 bp, Unknown
  misc_feature (1)..( 13): Result.004 file - promoters50/1011972
tataaaatacttt

SEQ ID NO: 153686 - DNA, 13 bp, Unknown
  misc_feature (1)..( 13): Result.004 file - promoters50/1011972
aaaaaaatacatt

SEQ ID NO: 153687 - DNA, 13 bp, Unknown
  misc_feature (1)..( 13): Result.004 file - promoters50/1011972
ccaaaattacaaa

SEQ ID NO: 153688 - DNA, 14 bp, Unknown
  misc_feature (1)..( 14): Result.004 file - promoters50/1011972
tgactaattaacta

SEQ ID NO: 153689 - DNA, 14 bp, Unknown
  misc_feature (1)..( 14): Result.004 file - promoters50/1011972
atcctaatcaacaa

SEQ ID NO: 153690 - DNA, 14 bp, Unknown
  misc_feature (1)..( 14): Result.004 file - promoters50/1011972
aaactaattttagc

SEQ ID NO: 153691 - DNA, 14 bp, Unknown
  misc_feature (1)..( 14): Result.004 file - promoters50/1011972
ttagtcatcaatat

SEQ ID NO: 153692 - DNA, 14 bp, Unknown
  misc_feature (1)..( 14): Result.004 file - promoters50/1011972
atcttaatttcata

SEQ ID NO: 153693 - DNA, 14 bp, Unknown
  misc_feature (1)..( 14): Result.004 file - promoters50/1011972
catattatccatat

SEQ ID NO: 153694 - DNA, 10 bp, Unknown
  misc_feature (1)..( 10): Result.004 file - promoters50/1011972
atcttcatat

SEQ ID NO: 153695 - DNA, 10 bp, Unknown
  misc_feature (1)..( 10): Result.004 file - promoters50/1011972
atctacatat

SEQ ID NO: 153696 - DNA, 10 bp, Unknown
  misc_feature (1)..( 10): Result.004 file - promoters50/1011972
tactatataa

SEQ ID NO: 153697 - DNA, 10 bp, Unknown
  misc_feature (1)..( 10): Result.004 file - promoters50/1011972
aactataaat

SEQ ID NO: 153698 - DNA, 10 bp, Unknown
  misc_feature (1)..( 10): Result.004 file - promoters50/1011972
tcgtatatat

SEQ ID NO: 153699 - DNA, 10 bp, Unknown
  misc_feature (1)..( 10): Result.004 file - promoters50/1011972
atctataaaa

SEQ ID NO: 153700 - DNA, 12 bp, Unknown
  misc_feature (1)..( 12): Result.004 file - promoters50/1011972
ttcatataaata

SEQ ID NO: 153701 - DNA, 12 bp, Unknown
  misc_feature (1)..( 12): Result.004 file - promoters50/1011972
actatataaact

SEQ ID NO: 153702 - DNA, 12 bp, Unknown
  misc_feature (1)..( 12): Result.004 file - promoters50/1011972
taactataaata

SEQ ID NO: 153703 - DNA, 12 bp, Unknown
  misc_feature (1)..( 12): Result.004 file - promoters50/1011972
tatatataaata

SEQ ID NO: 153704 - DNA, 12 bp, Unknown
  misc_feature (1)..( 12): Result.004 file - promoters50/1011972
tctacatatcca

SEQ ID NO: 153705 - DNA, 12 bp, Unknown
  misc_feature (1)..( 12): Result.004 file - promoters50/1012052
aatctataaaaa

SEQ ID NO: 153706 - DNA, 14 bp, Unknown
  misc_feature (1)..( 14): Result.004 file - promoters50/1012052
aaaacatttgattt

SEQ ID NO: 153707 - DNA, 14 bp, Unknown
  misc_feature (1)..( 14): Result.004 file - promoters50/1012052
ttgggttttgtttt

SEQ ID NO: 153708 - DNA, 14 bp, Unknown
  misc_feature (1)..( 14): Result.004 file - promoters50/1012060
aaaaaattagatcg

SEQ ID NO: 153709 - DNA, 7 bp, Unknown
  misc_feature (1)..( 7): Result.004 file - promoters50/1012060
cttgttt

SEQ ID NO: 153710 - DNA, 7 bp, Unknown
  misc_feature (1)..( 7): Result.004 file - promoters50/1012060
cttcttt

SEQ ID NO: 153711 - DNA, 7 bp, Unknown
  misc_feature (1)..( 7): Result.004 file - promoters50/1012060
ctttttt

SEQ ID NO: 153712 - DNA, 7 bp, Unknown
  misc_feature (1)..( 7): Result.004 file - promoters50/1012060
tttcttt

SEQ ID NO: 153713 - DNA, 8 bp, Unknown
  misc_feature (1)..( 8): Result.004 file - promoters50/1012060
tttgattt

SEQ ID NO: 153714 - DNA, 8 bp, Unknown
  misc_feature (1)..( 8): Result.004 file - promoters50/1012060
tttgatgc

SEQ ID NO: 153715 - DNA, 8 bp, Unknown
  misc_feature (1)..( 8): Result.004 file - promoters50/1012060
attggttt

SEQ ID NO: 153716 - DNA, 8 bp, Unknown
  misc_feature (1)..( 8): Result.004 file - promoters50/1012060
gttggttt

SEQ ID NO: 153717 - DNA, 11 bp, Unknown
  misc_feature (1)..( 11): Result.004 file - promoters50/1012060
tatttgtttct

SEQ ID NO: 153718 - DNA, 11 bp, Unknown
  misc_feature (1)..( 11): Result.004 file - promoters50/1012060
gacaagtttct

SEQ ID NO: 153719 - DNA, 11 bp, Unknown
  misc_feature (1)..( 11): Result.004 file - promoters50/1012060
gaccagtttcc

SEQ ID NO: 153720 - DNA, 11 bp, Unknown
  misc_feature (1)..( 11): Result.004 file - promoters50/1012074
atacagtttaa

SEQ ID NO: 153721 - DNA, 12 bp, Unknown
  misc_feature (1)..( 12): Result.004 file - promoters50/1012074
ttttaataagag

SEQ ID NO: 153722 - DNA, 12 bp, Unknown
  misc_feature (1)..( 12): Result.004 file - promoters50/1012074
tttcaataaccg

SEQ ID NO: 153723 - DNA, 12 bp, Unknown
  misc_feature (1)..( 12): Result.004 file - promoters50/1012074
gtctaaaaagta

SEQ ID NO: 153724 - DNA, 12 bp, Unknown
  misc_feature (1)..( 12): Result.004 file - promoters50/1012074
actcaatatcaa

SEQ ID NO: 153725 - DNA, 12 bp, Unknown
  misc_feature (1)..( 12): Result.004 file - promoters50/1012074
agttaatttcat

SEQ ID NO: 153726 - DNA, 12 bp, Unknown
  misc_feature (1)..( 12): Result.004 file - promoters50/1012078
atctagaaattc

SEQ ID NO: 153727 - DNA, 15 bp, Unknown
  misc_feature (1)..( 15): Result.004 file - promoters50/1012078
tcgttatgatttctt

SEQ ID NO: 153728 - DNA, 15 bp, Unknown
  misc_feature (1)..( 15): Result.004 file - promoters50/1012078
gtgttataatttttt

SEQ ID NO: 153729 - DNA, 15 bp, Unknown
  misc_feature (1)..( 15): Result.004 file - promoters50/1012078
agtttatgcttttaa

SEQ ID NO: 153730 - DNA, 15 bp, Unknown
  misc_feature (1)..( 15): Result.004 file - promoters50/1012078
ttgttatgctggatc

SEQ ID NO: 153731 - DNA, 15 bp, Unknown
  misc_feature (1)..( 15): Result.004 file - promoters50/1012078
tcgctattccaccat

SEQ ID NO: 153732 - DNA, 15 bp, Unknown
  misc_feature (1)..( 15): Result.004 file - promoters50/1012078
gggttacaatttttt

SEQ ID NO: 153733 - DNA, 12 bp, Unknown
  misc_feature (1)..( 12): Result.004 file - promoters50/1012078
atatgagatagt

SEQ ID NO: 153734 - DNA, 12 bp, Unknown
  misc_feature (1)..( 12): Result.004 file - promoters50/1012078
tattgatataat

SEQ ID NO: 153735 - DNA, 12 bp, Unknown
  misc_feature (1)..( 12): Result.004 file - promoters50/1012078
atgtgatattaa

SEQ ID NO: 153736 - DNA, 12 bp, Unknown
  misc_feature (1)..( 12): Result.004 file - promoters50/1012078
tcttgttatgtt

SEQ ID NO: 153737 - DNA, 12 bp, Unknown
  misc_feature (1)..( 12): Result.004 file - promoters50/1012078
acttgtttcaat

SEQ ID NO: 153738 - DNA, 12 bp, Unknown
  misc_feature (1)..( 12): Result.004 file - promoters50/1012088
ttttgttttata

SEQ ID NO: 153739 - DNA, 9 bp, Unknown
  misc_feature (1)..( 9): Result.004 file - promoters50/1012088
atggtttaa

SEQ ID NO: 153740 - DNA, 9 bp, Unknown
  misc_feature (1)..( 9): Result.004 file - promoters50/1012088
atggttttg

SEQ ID NO: 153741 - DNA, 9 bp, Unknown
  misc_feature (1)..( 9): Result.004 file - promoters50/1012088
atgatttat

SEQ ID NO: 153742 - DNA, 7 bp, Unknown
  misc_feature (1)..( 7): Result.004 file - promoters50/1012088
gatctat

SEQ ID NO: 153743 - DNA, 14 bp, Unknown
  misc_feature (1)..( 14): Result.004 file - promoters50/1012088
atgtaacaatgaag

SEQ ID NO: 153744 - DNA, 14 bp, Unknown
  misc_feature (1)..( 14): Result.004 file - promoters50/1012088
ctgtttctatgaag

SEQ ID NO: 153745 - DNA, 14 bp, Unknown
  misc_feature (1)..( 14): Result.004 file - promoters50/1012088
ttttttctatgaac

SEQ ID NO: 153746 - DNA, 14 bp, Unknown
  misc_feature (1)..( 14): Result.004 file - promoters50/1012088
ttttttttattttt

SEQ ID NO: 153747 - DNA, 9 bp, Unknown
  misc_feature (1)..( 9): Result.004 file - promoters50/1012088
aaaatatat

SEQ ID NO: 153748 - DNA, 9 bp, Unknown
  misc_feature (1)..( 9): Result.004 file - promoters50/1012088
aaaatttat

SEQ ID NO: 153749 - DNA, 9 bp, Unknown
  misc_feature (1)..( 9): Result.004 file - promoters50/1012088
aaaagataa

SEQ ID NO: 153750 - DNA, 9 bp, Unknown
  misc_feature (1)..( 9): Result.004 file - promoters50/1012088
aaagtttat

SEQ ID NO: 153751 - DNA, 12 bp, Unknown
  misc_feature (1)..( 12): Result.004 file - promoters50/1012088
ccaacaaaaatc

SEQ ID NO: 153752 - DNA, 12 bp, Unknown
  misc_feature (1)..( 12): Result.004 file - promoters50/1012088
aaattaaagatc

SEQ ID NO: 153753 - DNA, 12 bp, Unknown
  misc_feature (1)..( 12): Result.004 file - promoters50/1012088
cttagaaaaatg

SEQ ID NO: 153754 - DNA, 12 bp, Unknown
  misc_feature (1)..( 12): Result.004 file - promoters50/1012088
ccaccaaagatt

SEQ ID NO: 153755 - DNA, 12 bp, Unknown
  misc_feature (1)..( 12): Result.004 file - promoters50/1012088
tagataaacctt

SEQ ID NO: 153756 - DNA, 10 bp, Unknown
  misc_feature (1)..( 10): Result.004 file - promoters50/1012088
aaaatatata

SEQ ID NO: 153757 - DNA, 10 bp, Unknown
  misc_feature (1)..( 10): Result.004 file - promoters50/1012088
ttaatgtatt

SEQ ID NO: 153758 - DNA, 10 bp, Unknown
  misc_feature (1)..( 10): Result.004 file - promoters50/1012088
gtgatatata

SEQ ID NO: 153759 - DNA, 10 bp, Unknown
  misc_feature (1)..( 10): Result.004 file - promoters50/1012088
aaaatataca

SEQ ID NO: 153760 - DNA, 12 bp, Unknown
  misc_feature (1)..( 12): Result.004 file - promoters50/1012088
ggtttaataaaa

SEQ ID NO: 153761 - DNA, 12 bp, Unknown
  misc_feature (1)..( 12): Result.004 file - promoters50/1012088
tatttaaaaaaa

SEQ ID NO: 153762 - DNA, 10 bp, Unknown
  misc_feature (1)..( 10): Result.004 file - promoters50/1012088
tttaaaaaaa

SEQ ID NO: 153763 - DNA, 12 bp, Unknown
  misc_feature (1)..( 12): Result.004 file - promoters50/1012088
cctttgaaaagc

SEQ ID NO: 153764 - DNA, 12 bp, Unknown
  misc_feature (1)..( 12): Result.004 file - promoters50/1012088
tatttcaaaatt

SEQ ID NO: 153765 - DNA, 13 bp, Unknown
  misc_feature (1)..( 13): Result.004 file - promoters50/1012088
ttttgtattcgag

SEQ ID NO: 153766 - DNA, 13 bp, Unknown
  misc_feature (1)..( 13): Result.004 file - promoters50/1012088
aacagtattcata

SEQ ID NO: 153767 - DNA, 13 bp, Unknown
  misc_feature (1)..( 13): Result.004 file - promoters50/1012088
ttttttatttttt

SEQ ID NO: 153768 - DNA, 13 bp, Unknown
  misc_feature (1)..( 13): Result.004 file - promoters50/1012088
gtttctatgaagc

SEQ ID NO: 153769 - DNA, 13 bp, Unknown
  misc_feature (1)..( 13): Result.004 file - promoters50/1012110
ccaaatattaata

SEQ ID NO: 153770 - DNA, 11 bp, Unknown
  misc_feature (1)..( 11): Result.004 file - promoters50/1012110
ccagaattaag

SEQ ID NO: 153771 - DNA, 11 bp, Unknown
  misc_feature (1)..( 11): Result.004 file - promoters50/1012110
ccataattagt

SEQ ID NO: 153772 - DNA, 11 bp, Unknown
  misc_feature (1)..( 11): Result.004 file - promoters50/1012110
atgtaattaag

SEQ ID NO: 153773 - DNA, 11 bp, Unknown
  misc_feature (1)..( 11): Result.004 file - promoters50/1012110
aaatacttaag

SEQ ID NO: 153774 - DNA, 10 bp, Unknown
  misc_feature (1)..( 10): Result.004 file - promoters50/1012110
tgtaaaaata

SEQ ID NO: 153775 - DNA, 10 bp, Unknown
  misc_feature (1)..( 10): Result.004 file - promoters50/1012110
agtaaaatta

SEQ ID NO: 153776 - DNA, 11 bp, Unknown
  misc_feature (1)..( 11): Result.004 file - promoters50/1012110
cttaagaatag

SEQ ID NO: 153777 - DNA, 11 bp, Unknown
  misc_feature (1)..( 11): Result.004 file - promoters50/1012110
tgtaaataaaa

SEQ ID NO: 153778 - DNA, 11 bp, Unknown
  misc_feature (1)..( 11): Result.004 file - promoters50/1012118
ggtacataatt

SEQ ID NO: 153779 - DNA, 8 bp, Unknown
  misc_feature (1)..( 8): Result.004 file - promoters50/1012118
aatgattc

SEQ ID NO: 153780 - DNA, 8 bp, Unknown
  misc_feature (1)..( 8): Result.004 file - promoters50/1012118
aattattt

SEQ ID NO: 153781 - DNA, 8 bp, Unknown
  misc_feature (1)..( 8): Result.004 file - promoters50/1012118
catttttt

SEQ ID NO: 153782 - DNA, 8 bp, Unknown
  misc_feature (1)..( 8): Result.004 file - promoters50/1012118
aatttttt

SEQ ID NO: 153783 - DNA, 11 bp, Unknown
  misc_feature (1)..( 11): Result.004 file - promoters50/1012118
aaaatattccg

SEQ ID NO: 153784 - DNA, 11 bp, Unknown
  misc_feature (1)..( 11): Result.004 file - promoters50/1012118
ccaataatccg

SEQ ID NO: 153785 - DNA, 11 bp, Unknown
  misc_feature (1)..( 11): Result.004 file - promoters50/1012118
tgaaaaattag

SEQ ID NO: 153786 - DNA, 11 bp, Unknown
  misc_feature (1)..( 11): Result.004 file - promoters50/1012118
tgaaaaaaaac

SEQ ID NO: 153787 - DNA, 8 bp, Unknown
  misc_feature (1)..( 8): Result.004 file - promoters50/1012118
aatattcc

SEQ ID NO: 153788 - DNA, 8 bp, Unknown
  misc_feature (1)..( 8): Result.004 file - promoters50/1012118
gatattcg

SEQ ID NO: 153789 - DNA, 8 bp, Unknown
  misc_feature (1)..( 8): Result.004 file - promoters50/1012118
gatattaa

SEQ ID NO: 153790 - DNA, 8 bp, Unknown
  misc_feature (1)..( 8): Result.004 file - promoters50/1012128
gttattcg

SEQ ID NO: 153791 - DNA, 17 bp, Unknown
  misc_feature (1)..( 17): Result.004 file - promoters50/1012128
gttcaaatcccacagtt

SEQ ID NO: 153792 - DNA, 17 bp, Unknown
  misc_feature (1)..( 17): Result.004 file - promoters50/1012128
tgtcaaattccacggtt

SEQ ID NO: 153793 - DNA, 17 bp, Unknown
  misc_feature (1)..( 17): Result.004 file - promoters50/1012128
tttcaaaatgtgttcat

SEQ ID NO: 153794 - DNA, 17 bp, Unknown
  misc_feature (1)..( 17): Result.004 file - promoters50/1012128
gatcaaatccgagccgg

SEQ ID NO: 153795 - DNA, 17 bp, Unknown
  misc_feature (1)..( 17): Result.004 file - promoters50/1012128
tgggccagaacacggta

SEQ ID NO: 153796 - DNA, 17 bp, Unknown
  misc_feature (1)..( 17): Result.004 file - promoters50/1012128
gattaaacaaacgacag

SEQ ID NO: 153797 - DNA, 9 bp, Unknown
  misc_feature (1)..( 9): Result.004 file - promoters50/1012128
aagaagaat

SEQ ID NO: 153798 - DNA, 9 bp, Unknown
  misc_feature (1)..( 9): Result.004 file - promoters50/1012128
aagcagaaa

SEQ ID NO: 153799 - DNA, 9 bp, Unknown
  misc_feature (1)..( 9): Result.004 file - promoters50/1012128
ttgaaaaat

SEQ ID NO: 153800 - DNA, 9 bp, Unknown
  misc_feature (1)..( 9): Result.004 file - promoters50/1012128
aagaagtgt

SEQ ID NO: 153801 - DNA, 9 bp, Unknown
  misc_feature (1)..( 9): Result.004 file - promoters50/1012128
tagacgaaa

SEQ ID NO: 153802 - DNA, 9 bp, Unknown
  misc_feature (1)..( 9): Result.004 file - promoters50/1012128
attcaaaat

SEQ ID NO: 153803 - DNA, 15 bp, Unknown
  misc_feature (1)..( 15): Result.004 file - promoters50/1012128
aggcccatttaagcc

SEQ ID NO: 153804 - DNA, 15 bp, Unknown
  misc_feature (1)..( 15): Result.004 file - promoters50/1012128
tactatatttaattt

SEQ ID NO: 153805 - DNA, 15 bp, Unknown
  misc_feature (1)..( 15): Result.004 file - promoters50/1012128
aagcccattaaagta

SEQ ID NO: 153806 - DNA, 15 bp, Unknown
  misc_feature (1)..( 15): Result.004 file - promoters50/1012128
ctgcccatttgattt

SEQ ID NO: 153807 - DNA, 15 bp, Unknown
  misc_feature (1)..( 15): Result.004 file - promoters50/1012128
tttgttatttatata

SEQ ID NO: 153808 - DNA, 15 bp, Unknown
  misc_feature (1)..( 15): Result.004 file - promoters50/1012128
aagcccaaagaataa

SEQ ID NO: 153809 - DNA, 16 bp, Unknown
  misc_feature (1)..( 16): Result.004 file - promoters50/1012128
caatatgtgcaacaag

SEQ ID NO: 153810 - DNA, 16 bp, Unknown
  misc_feature (1)..( 16): Result.004 file - promoters50/1012128
taatatgtaaaattaa

SEQ ID NO: 153811 - DNA, 16 bp, Unknown
  misc_feature (1)..( 16): Result.004 file - promoters50/1012128
tgatattataggaaga

SEQ ID NO: 153812 - DNA, 16 bp, Unknown
  misc_feature (1)..( 16): Result.004 file - promoters50/1012128
tgagattactaacact

SEQ ID NO: 153813 - DNA, 16 bp, Unknown
  misc_feature (1)..( 16): Result.004 file - promoters50/1012128
atttatgaaaaaaaaa

SEQ ID NO: 153814 - DNA, 16 bp, Unknown
  misc_feature (1)..( 16): Result.004 file - promoters50/1012132
gaaaaagaaaaaaaaa

SEQ ID NO: 153815 - DNA, 9 bp, Unknown
  misc_feature (1)..( 9): Result.004 file - promoters50/1012132
gaaagttag

SEQ ID NO: 153816 - DNA, 9 bp, Unknown
  misc_feature (1)..( 9): Result.004 file - promoters50/1012132
caaatttag

SEQ ID NO: 153817 - DNA, 9 bp, Unknown
  misc_feature (1)..( 9): Result.004 file - promoters50/1012132
gaaacttaa

SEQ ID NO: 153818 - DNA, 9 bp, Unknown
  misc_feature (1)..( 9): Result.004 file - promoters50/1012132
cttcaaaaa

SEQ ID NO: 153819 - DNA, 9 bp, Unknown
  misc_feature (1)..( 9): Result.004 file - promoters50/1012132
tttcaaatg

SEQ ID NO: 153820 - DNA, 9 bp, Unknown
  misc_feature (1)..( 9): Result.004 file - promoters50/1012132
tttcacatg

SEQ ID NO: 153821 - DNA, 11 bp, Unknown
  misc_feature (1)..( 11): Result.004 file - promoters50/1012132
tttatataaac

SEQ ID NO: 153822 - DNA, 11 bp, Unknown
  misc_feature (1)..( 11): Result.004 file - promoters50/1012132
ttaaaataaac

SEQ ID NO: 153823 - DNA, 11 bp, Unknown
  misc_feature (1)..( 11): Result.004 file - promoters50/1012132
ttacaataaat

SEQ ID NO: 153824 - DNA, 12 bp, Unknown
  misc_feature (1)..( 12): Result.004 file - promoters50/1012132
ctcttgaaattt

SEQ ID NO: 153825 - DNA, 12 bp, Unknown
  misc_feature (1)..( 12): Result.004 file - promoters50/1012132
aaaaataaattt

SEQ ID NO: 153826 - DNA, 12 bp, Unknown
  misc_feature (1)..( 12): Result.004 file - promoters50/1012132
aaaaataaattt

SEQ ID NO: 153827 - DNA, 12 bp, Unknown
  misc_feature (1)..( 12): Result.004 file - promoters50/1012132
gaaattttcgaa

SEQ ID NO: 153828 - DNA, 12 bp, Unknown
  misc_feature (1)..( 12): Result.004 file - promoters50/1012132
tttattttcgaa

SEQ ID NO: 153829 - DNA, 12 bp, Unknown
  misc_feature (1)..( 12): Result.004 file - promoters50/1012132
ttaatttgtcat

SEQ ID NO: 153830 - DNA, 10 bp, Unknown
  misc_feature (1)..( 10): Result.004 file - promoters50/1012132
aaaaactctg

SEQ ID NO: 153831 - DNA, 10 bp, Unknown
  misc_feature (1)..( 10): Result.004 file - promoters50/1012132
aaaaaatcta

SEQ ID NO: 153832 - DNA, 10 bp, Unknown
  misc_feature (1)..( 10): Result.004 file - promoters50/1012132
tccaaatcta

SEQ ID NO: 153833 - DNA, 8 bp, Unknown
  misc_feature (1)..( 8): Result.004 file - promoters50/1012132
gacttcat

SEQ ID NO: 153834 - DNA, 8 bp, Unknown
  misc_feature (1)..( 8): Result.004 file - promoters50/1012132
ttcttcat

SEQ ID NO: 153835 - DNA, 8 bp, Unknown
  misc_feature (1)..( 8): Result.004 file - promoters50/1012132
ttcttcat

SEQ ID NO: 153836 - DNA, 12 bp, Unknown
  misc_feature (1)..( 12): Result.004 file - promoters50/1012132
gtttttaacttt

SEQ ID NO: 153837 - DNA, 12 bp, Unknown
  misc_feature (1)..( 12): Result.004 file - promoters50/1012132
atttttaacttg

SEQ ID NO: 153838 - DNA, 12 bp, Unknown
  misc_feature (1)..( 12): Result.004 file - promoters50/1012132
aaaaataaattt

SEQ ID NO: 153839 - DNA, 12 bp, Unknown
  misc_feature (1)..( 12): Result.004 file - promoters50/1012132
aaaaataaattt

SEQ ID NO: 153840 - DNA, 8 bp, Unknown
  misc_feature (1)..( 8): Result.004 file - promoters50/1012132
tttatata

SEQ ID NO: 153841 - DNA, 8 bp, Unknown
  misc_feature (1)..( 8): Result.004 file - promoters50/1012132
tttatata

SEQ ID NO: 153842 - DNA, 8 bp, Unknown
  misc_feature (1)..( 8): Result.004 file - promoters50/1012132
tttatata

SEQ ID NO: 153843 - DNA, 13 bp, Unknown
  misc_feature (1)..( 13): Result.004 file - promoters50/1012132
ttaactttatata

SEQ ID NO: 153844 - DNA, 13 bp, Unknown
  misc_feature (1)..( 13): Result.004 file - promoters50/1012132
taaattttatata

SEQ ID NO: 153845 - DNA, 13 bp, Unknown
  misc_feature (1)..( 13): Result.004 file - promoters50/1012132
ataaatttatttt

SEQ ID NO: 153846 - DNA, 11 bp, Unknown
  misc_feature (1)..( 11): Result.004 file - promoters50/1012132
atatataacca

SEQ ID NO: 153847 - DNA, 11 bp, Unknown
  misc_feature (1)..( 11): Result.004 file - promoters50/1012132
ataaatactaa

SEQ ID NO: 153848 - DNA, 11 bp, Unknown
  misc_feature (1)..( 11): Result.004 file - promoters50/1012194
gtaaatagtaa

SEQ ID NO: 153849 - DNA, 9 bp, Unknown
  misc_feature (1)..( 9): Result.004 file - promoters50/1012194
taaaaaata

SEQ ID NO: 153850 - DNA, 9 bp, Unknown
  misc_feature (1)..( 9): Result.004 file - promoters50/1012194
taaaaaaaa

SEQ ID NO: 153851 - DNA, 9 bp, Unknown
  misc_feature (1)..( 9): Result.004 file - promoters50/1012194
caaataata

SEQ ID NO: 153852 - DNA, 9 bp, Unknown
  misc_feature (1)..( 9): Result.004 file - promoters50/1012194
taaatatat

SEQ ID NO: 153853 - DNA, 10 bp, Unknown
  misc_feature (1)..( 10): Result.004 file - promoters50/1012194
atagtttatg

SEQ ID NO: 153854 - DNA, 10 bp, Unknown
  misc_feature (1)..( 10): Result.004 file - promoters50/1012194
atatttttct

SEQ ID NO: 153855 - DNA, 10 bp, Unknown
  misc_feature (1)..( 10): Result.004 file - promoters50/1012194
ggatttatct

SEQ ID NO: 153856 - DNA, 10 bp, Unknown
  misc_feature (1)..( 10): Result.004 file - promoters50/1012194
atatataaat

SEQ ID NO: 153857 - DNA, 9 bp, Unknown
  misc_feature (1)..( 9): Result.004 file - promoters50/1012194
ttactaatt

SEQ ID NO: 153858 - DNA, 9 bp, Unknown
  misc_feature (1)..( 9): Result.004 file - promoters50/1012194
ttacttatt

SEQ ID NO: 153859 - DNA, 9 bp, Unknown
  misc_feature (1)..( 9): Result.004 file - promoters50/1012194
ttagtgtcg

SEQ ID NO: 153860 - DNA, 9 bp, Unknown
  misc_feature (1)..( 9): Result.004 file - promoters50/1012205
ttaattatg

SEQ ID NO: 153861 - DNA, 9 bp, Unknown
  misc_feature (1)..( 9): Result.004 file - promoters50/1012205
attataaaa

SEQ ID NO: 153862 - DNA, 9 bp, Unknown
  misc_feature (1)..( 9): Result.004 file - promoters50/1012205
attaaaaaa

SEQ ID NO: 153863 - DNA, 9 bp, Unknown
  misc_feature (1)..( 9): Result.004 file - promoters50/1012205
aatataaat

SEQ ID NO: 153864 - DNA, 9 bp, Unknown
  misc_feature (1)..( 9): Result.004 file - promoters50/1012205
atgacaaaa

SEQ ID NO: 153865 - DNA, 9 bp, Unknown
  misc_feature (1)..( 9): Result.004 file - promoters50/1012205
atgtcaaaa

SEQ ID NO: 153866 - DNA, 9 bp, Unknown
  misc_feature (1)..( 9): Result.004 file - promoters50/1012205
gggacaaat

SEQ ID NO: 153867 - DNA, 8 bp, Unknown
  misc_feature (1)..( 8): Result.004 file - promoters50/1012205
gtttaatt

SEQ ID NO: 153868 - DNA, 8 bp, Unknown
  misc_feature (1)..( 8): Result.004 file - promoters50/1012205
gttttatt

SEQ ID NO: 153869 - DNA, 8 bp, Unknown
  misc_feature (1)..( 8): Result.004 file - promoters50/1012205
tttttatt

SEQ ID NO: 153870 - DNA, 7 bp, Unknown
  misc_feature (1)..( 7): Result.004 file - promoters50/1012205
taagaaa

SEQ ID NO: 153871 - DNA, 7 bp, Unknown
  misc_feature (1)..( 7): Result.004 file - promoters50/1012205
taataaa

SEQ ID NO: 153872 - DNA, 7 bp, Unknown
  misc_feature (1)..( 7): Result.004 file - promoters50/1012205
aaataaa

SEQ ID NO: 153873 - DNA, 9 bp, Unknown
  misc_feature (1)..( 9): Result.004 file - promoters50/1012205
ttatcgtaa

SEQ ID NO: 153874 - DNA, 9 bp, Unknown
  misc_feature (1)..( 9): Result.004 file - promoters50/1012205
ttaccgtag

SEQ ID NO: 153875 - DNA, 9 bp, Unknown
  misc_feature (1)..( 9): Result.004 file - promoters50/1012205
atactgtag

SEQ ID NO: 153876 - DNA, 9 bp, Unknown
  misc_feature (1)..( 9): Result.004 file - promoters50/1012205
agtttttat

SEQ ID NO: 153877 - DNA, 9 bp, Unknown
  misc_feature (1)..( 9): Result.004 file - promoters50/1012205
agtttatat

SEQ ID NO: 153878 - DNA, 9 bp, Unknown
  misc_feature (1)..( 9): Result.004 file - promoters50/1012205
agtttaaaa

SEQ ID NO: 153879 - DNA, 8 bp, Unknown
  misc_feature (1)..( 8): Result.004 file - promoters50/1012205
aaatttag

SEQ ID NO: 153880 - DNA, 8 bp, Unknown
  misc_feature (1)..( 8): Result.004 file - promoters50/1012205
aaatttga

SEQ ID NO: 153881 - DNA, 8 bp, Unknown
  misc_feature (1)..( 8): Result.004 file - promoters50/1012205
gaatttga

SEQ ID NO: 153882 - DNA, 9 bp, Unknown
  misc_feature (1)..( 9): Result.004 file - promoters50/1012205
aaactttat

SEQ ID NO: 153883 - DNA, 9 bp, Unknown
  misc_feature (1)..( 9): Result.004 file - promoters50/1012205
aaattttat

SEQ ID NO: 153884 - DNA, 9 bp, Unknown
  misc_feature (1)..( 9): Result.004 file - promoters50/1012205
ttgttttat

SEQ ID NO: 153885 - DNA, 8 bp, Unknown
  misc_feature (1)..( 8): Result.004 file - promoters50/1012205
aaaactaa

SEQ ID NO: 153886 - DNA, 8 bp, Unknown
  misc_feature (1)..( 8): Result.004 file - promoters50/1012205
aaaagtaa

SEQ ID NO: 153887 - DNA, 8 bp, Unknown
  misc_feature (1)..( 8): Result.004 file - promoters50/1012219
taaactaa

SEQ ID NO: 153888 - DNA, 7 bp, Unknown
  misc_feature (1)..( 7): Result.004 file - promoters50/1012219
aaataaa

SEQ ID NO: 153889 - DNA, 7 bp, Unknown
  misc_feature (1)..( 7): Result.004 file - promoters50/1012219
aaacaaa

SEQ ID NO: 153890 - DNA, 7 bp, Unknown
  misc_feature (1)..( 7): Result.004 file - promoters50/1012219
aaagaaa

SEQ ID NO: 153891 - DNA, 9 bp, Unknown
  misc_feature (1)..( 9): Result.004 file - promoters50/1012219
aaaattatc

SEQ ID NO: 153892 - DNA, 9 bp, Unknown
  misc_feature (1)..( 9): Result.004 file - promoters50/1012219
aaatttatt

SEQ ID NO: 153893 - DNA, 9 bp, Unknown
  misc_feature (1)..( 9): Result.004 file - promoters50/1012219
gcattttct

SEQ ID NO: 153894 - DNA, 8 bp, Unknown
  misc_feature (1)..( 8): Result.004 file - promoters50/1012219
gatggatt

SEQ ID NO: 153895 - DNA, 8 bp, Unknown
  misc_feature (1)..( 8): Result.004 file - promoters50/1012219
catgtatt

SEQ ID NO: 153896 - DNA, 8 bp, Unknown
  misc_feature (1)..( 8): Result.004 file - promoters50/1012219
catctata

SEQ ID NO: 153897 - DNA, 11 bp, Unknown
  misc_feature (1)..( 11): Result.004 file - promoters50/1012219
agatttcgata

SEQ ID NO: 153898 - DNA, 11 bp, Unknown
  misc_feature (1)..( 11): Result.004 file - promoters50/1012219
agatttggatt

SEQ ID NO: 153899 - DNA, 11 bp, Unknown
  misc_feature (1)..( 11): Result.004 file - promoters50/1012219
caatatggatt

SEQ ID NO: 153900 - DNA, 11 bp, Unknown
  misc_feature (1)..( 11): Result.004 file - promoters50/1012219
atagaattttg

SEQ ID NO: 153901 - DNA, 11 bp, Unknown
  misc_feature (1)..( 11): Result.004 file - promoters50/1012219
ataaaatataa

SEQ ID NO: 153902 - DNA, 11 bp, Unknown
  misc_feature (1)..( 11): Result.004 file - promoters50/1012219
tcaaaattata

SEQ ID NO: 153903 - DNA, 8 bp, Unknown
  misc_feature (1)..( 8): Result.004 file - promoters50/1012219
ttattata

SEQ ID NO: 153904 - DNA, 8 bp, Unknown
  misc_feature (1)..( 8): Result.004 file - promoters50/1012219
aaattata

SEQ ID NO: 153905 - DNA, 8 bp, Unknown
  misc_feature (1)..( 8): Result.004 file - promoters50/1012245
aaaatata

SEQ ID NO: 153906 - DNA, 7 bp, Unknown
  misc_feature (1)..( 7): Result.004 file - promoters50/1012245
ttttggt

SEQ ID NO: 153907 - DNA, 7 bp, Unknown
  misc_feature (1)..( 7): Result.004 file - promoters50/1012245
ttttggt

SEQ ID NO: 153908 - DNA, 7 bp, Unknown
  misc_feature (1)..( 7): Result.004 file - promoters50/1012311
gtttggt

SEQ ID NO: 153909 - DNA, 10 bp, Unknown
  misc_feature (1)..( 10): Result.004 file - promoters50/1012311
cttgtctgat

SEQ ID NO: 153910 - DNA, 10 bp, Unknown
  misc_feature (1)..( 10): Result.004 file - promoters50/1012311
cttgtcatat

SEQ ID NO: 153911 - DNA, 10 bp, Unknown
  misc_feature (1)..( 10): Result.004 file - promoters50/1012311
gttgtccgat

SEQ ID NO: 153912 - DNA, 10 bp, Unknown
  misc_feature (1)..( 10): Result.004 file - promoters50/1012311
attgttatag

SEQ ID NO: 153913 - DNA, 9 bp, Unknown
  misc_feature (1)..( 9): Result.004 file - promoters50/1012311
atgtctcag

SEQ ID NO: 153914 - DNA, 9 bp, Unknown
  misc_feature (1)..( 9): Result.004 file - promoters50/1012311
ttgtatcag

SEQ ID NO: 153915 - DNA, 9 bp, Unknown
  misc_feature (1)..( 9): Result.004 file - promoters50/1012311
atgtttcaa

SEQ ID NO: 153916 - DNA, 9 bp, Unknown
  misc_feature (1)..( 9): Result.004 file - promoters50/1012311
atgtctcag

SEQ ID NO: 153917 - DNA, 38 bp, Unknown
  misc_feature (1)..( 38): Result.004 file - promoters50/1012311
atttatacccacatgatcatgtcttctaaccacaagtt

SEQ ID NO: 153918 - DNA, 38 bp, Unknown
  misc_feature (1)..( 38): Result.004 file - promoters50/1012311
attcatactcacatggtcatgtcttctcagttctcacc

SEQ ID NO: 153919 - DNA, 38 bp, Unknown
  misc_feature (1)..( 38): Result.004 file - promoters50/1012311
attcatacccacatgatcttgtcttctcaccataagtt

SEQ ID NO: 153920 - DNA, 38 bp, Unknown; identical to SEQ ID NO: 153917
  misc_feature (1)..( 38): Result.004 file - promoters50/1012311

SEQ ID NO: 153921 - DNA, 38 bp, Unknown
  misc_feature (1)..( 38): Result.004 file - promoters50/1012311
ctcacatggtcatgtcttctcagttctcaccatgtatg

SEQ ID NO: 153922 - DNA, 38 bp, Unknown; identical to SEQ ID NO: 153919
  misc_feature (1)..( 38): Result.004 file - promoters50/1012311

SEQ ID NO: 153923 - DNA, 17 bp, Unknown
  misc_feature (1)..( 17): Result.004 file - promoters50/1012311
tatagtccactagttga

SEQ ID NO: 153924 - DNA, 17 bp, Unknown
  misc_feature (1)..( 17): Result.004 file - promoters50/1012311
tttaatccacaagttga

SEQ ID NO: 153925 - DNA, 17 bp, Unknown
  misc_feature (1)..( 17): Result.004 file - promoters50/1012311
tatagtccacaagttga

SEQ ID NO: 153926 - DNA, 15 bp, Unknown
  misc_feature (1)..( 15): Result.004 file - promoters50/1012311
gacataattgattac

SEQ ID NO: 153927 - DNA, 15 bp, Unknown
  misc_feature (1)..( 15): Result.004 file - promoters50/1012311
aataagattgattgc

SEQ ID NO: 153928 - DNA, 15 bp, Unknown
  misc_feature (1)..( 15): Result.004 file - promoters50/1012311
gacataattgattac

SEQ ID NO: 153929 - DNA, 15 bp, Unknown
  misc_feature (1)..( 15): Result.004 file - promoters50/1012311
aacttgggaccatag

SEQ ID NO: 153930 - DNA, 15 bp, Unknown
  misc_feature (1)..( 15): Result.004 file - promoters50/1012311
aacttgggaccctta

SEQ ID NO: 153931 - DNA, 15 bp, Unknown
  misc_feature (1)..( 15): Result.004 file - promoters50/1012311
aacttgggaccctta

SEQ ID NO: 153932 - DNA, 35 bp, Unknown
  misc_feature (1)..( 35): Result.004 file - promoters50/1012311
aacctaatagtttctccttctatataatgaaacaa

SEQ ID NO: 153933 - DNA, 35 bp, Unknown
  misc_feature (1)..( 35): Result.004 file - promoters50/1012311
acaataatagtttctccttatatataatgaaacaa

SEQ ID NO: 153934 - DNA, 35 bp, Unknown; identical to SEQ ID NO: 153932
  misc_feature (1)..( 35): Result.004 file - promoters50/1012311

SEQ ID NO: 153935 - DNA, 13 bp, Unknown
  misc_feature (1)..( 13): Result.004 file - promoters50/1012311
tatcaacagcctc

SEQ ID NO: 153936 - DNA, 13 bp, Unknown
  misc_feature (1)..( 13): Result.004 file - promoters50/1012311
catcaacagcctc

SEQ ID NO: 153937 - DNA, 13 bp, Unknown
  misc_feature (1)..( 13): Result.004 file - promoters50/1012311
catcaaagggttt

SEQ ID NO: 153938 - DNA, 16 bp, Unknown
  misc_feature (1)..( 16): Result.004 file - promoters50/1012311
attcttcaataatgtc

SEQ ID NO: 153939 - DNA, 16 bp, Unknown
  misc_feature (1)..( 16): Result.004 file - promoters50/1012311
tttcttcaataatgtc

SEQ ID NO: 153940 - DNA, 16 bp, Unknown
  misc_feature (1)..( 16): Result.004 file - promoters50/1012311
atgtttcaagaaacac

SEQ ID NO: 153941 - DNA, 27 bp, Unknown
  misc_feature (1)..( 27): Result.004 file - promoters50/1012311
tcttgtcatataaatgtccatatagga

SEQ ID NO: 153942 - DNA, 27 bp, Unknown
  misc_feature (1)..( 27): Result.004 file - promoters50/1012311
tcttgtcatataaacgtccgtatagga

SEQ ID NO: 153943 - DNA, 27 bp, Unknown
  misc_feature (1)..( 27): Result.004 file - promoters50/1012311
tcgtgacatatgaacgttcttattaca

SEQ ID NO: 153944 - DNA, 10 bp, Unknown
  misc_feature (1)..( 10): Result.004 file - promoters50/1012311
atatatattt

SEQ ID NO: 153945 - DNA, 10 bp, Unknown
  misc_feature (1)..( 10): Result.004 file - promoters50/1012311
atatatgttt

SEQ ID NO: 153946 - DNA, 10 bp, Unknown
  misc_feature (1)..( 10): Result.004 file - promoters50/1012311
taataagttg

SEQ ID NO: 153947 - DNA, 8 bp, Unknown
  misc_feature (1)..( 8): Result.004 file - promoters50/1012311
ataagttg

SEQ ID NO: 153948 - DNA, 8 bp, Unknown
  misc_feature (1)..( 8): Result.004 file - promoters50/1012311
aaaagttg

SEQ ID NO: 153949 - DNA, 8 bp, Unknown
  misc_feature (1)..( 8): Result.004 file - promoters50/1012349
atatgttt

SEQ ID NO: 153950 - DNA, 12 bp, Unknown
  misc_feature (1)..( 12): Result.004 file - promoters50/1012349
tatctttaaaat

SEQ ID NO: 153951 - DNA, 12 bp, Unknown
  misc_feature (1)..( 12): Result.004 file - promoters50/1012349
ctactttaaccc

SEQ ID NO: 153952 - DNA, 12 bp, Unknown
  misc_feature (1)..( 12): Result.004 file - promoters50/1012349
ctactataaatc

SEQ ID NO: 153953 - DNA, 12 bp, Unknown
  misc_feature (1)..( 12): Result.004 file - promoters50/1012349
gagatataaata

SEQ ID NO: 153954 - DNA, 12 bp, Unknown
  misc_feature (1)..( 12): Result.004 file - promoters50/1012349
cccatatatata

SEQ ID NO: 153955 - DNA, 12 bp, Unknown
  misc_feature (1)..( 12): Result.004 file - promoters50/1012349
gagctatataag

SEQ ID NO: 153956 - DNA, 14 bp, Unknown
  misc_feature (1)..( 14): Result.004 file - promoters50/1012349
caaacgtttaggag

SEQ ID NO: 153957 - DNA, 14 bp, Unknown
  misc_feature (1)..( 14): Result.004 file - promoters50/1012349
taaaagtttgttat

SEQ ID NO: 153958 - DNA, 14 bp, Unknown
  misc_feature (1)..( 14): Result.004 file - promoters50/1012349
catacgtttttttt

SEQ ID NO: 153959 - DNA, 14 bp, Unknown
  misc_feature (1)..( 14): Result.004 file - promoters50/1012349
aacacgcttacgaa

SEQ ID NO: 153960 - DNA, 14 bp, Unknown
  misc_feature (1)..( 14): Result.004 file - promoters50/1012349
tttacatttgtctg

SEQ ID NO: 153961 - DNA, 14 bp, Unknown
  misc_feature (1)..( 14): Result.004 file - promoters50/1012388
taaaagtttgatat

SEQ ID NO: 153962 - DNA, 12 bp, Unknown
  misc_feature (1)..( 12): Result.004 file - promoters50/1012388
tgggagtgtaag

SEQ ID NO: 153963 - DNA, 12 bp, Unknown
  misc_feature (1)..( 12): Result.004 file - promoters50/1012388
aaaaagtttaaa

SEQ ID NO: 153964 - DNA, 12 bp, Unknown
  misc_feature (1)..( 12): Result.004 file - promoters50/1012388
tttgagtgtatc

SEQ ID NO: 153965 - DNA, 12 bp, Unknown
  misc_feature (1)..( 12): Result.004 file - promoters50/1012388
aaaaaatttgaa

SEQ ID NO: 153966 - DNA, 12 bp, Unknown
  misc_feature (1)..( 12): Result.004 file - promoters50/1012388
ccatcgtttaat

SEQ ID NO: 153967 - DNA, 12 bp, Unknown
  misc_feature (1)..( 12): Result.004 file - promoters50/1012397
tccaaataaaaa

SEQ ID NO: 153968 - DNA, 12 bp, Unknown
  misc_feature (1)..( 12): Result.004 file - promoters50/1012397
ttaatttattta

SEQ ID NO: 153969 - DNA, 12 bp, Unknown
  misc_feature (1)..( 12): Result.004 file - promoters50/1012397
gtaatttgtctg

SEQ ID NO: 153970 - DNA, 12 bp, Unknown
  misc_feature (1)..( 12): Result.004 file - promoters50/1012397
ataatttaatgc

SEQ ID NO: 153971 - DNA, 12 bp, Unknown
  misc_feature (1)..( 12): Result.004 file - promoters50/1012397
ttaattcattgt

SEQ ID NO: 153972 - DNA, 12 bp, Unknown
  misc_feature (1)..( 12): Result.004 file - promoters50/1012397
aaaatttattta

SEQ ID NO: 153973 - DNA, 12 bp, Unknown
  misc_feature (1)..( 12): Result.004 file - promoters50/1012397
tgaatccatcag

SEQ ID NO: 153974 - DNA, 13 bp, Unknown
  misc_feature (1)..( 13): Result.004 file - promoters50/1012397
aatttatttaatt

SEQ ID NO: 153975 - DNA, 13 bp, Unknown
  misc_feature (1)..( 13): Result.004 file - promoters50/1012397
ctgttacttagct

SEQ ID NO: 153976 - DNA, 13 bp, Unknown
  misc_feature (1)..( 13): Result.004 file - promoters50/1012397
aatcaattgaatc

SEQ ID NO: 153977 - DNA, 13 bp, Unknown
  misc_feature (1)..( 13): Result.004 file - promoters50/1012397
cgcttaattcatt

SEQ ID NO: 153978 - DNA, 13 bp, Unknown
  misc_feature (1)..( 13): Result.004 file - promoters50/1012397
aatttatttatat

SEQ ID NO: 153979 - DNA, 13 bp, Unknown
  misc_feature (1)..( 13): Result.004 file - promoters50/1012397
aatttaatgcatc

SEQ ID NO: 153980 - DNA, 16 bp, Unknown
  misc_feature (1)..( 16): Result.004 file - promoters50/1012397
aatttatcttcttttg

SEQ ID NO: 153981 - DNA, 16 bp, Unknown
  misc_feature (1)..( 16): Result.004 file - promoters50/1012397
catttctctgggttag

SEQ ID NO: 153982 - DNA, 16 bp, Unknown
  misc_feature (1)..( 16): Result.004 file - promoters50/1012397
aatttattttccaatt

SEQ ID NO: 153983 - DNA, 16 bp, Unknown
  misc_feature (1)..( 16): Result.004 file - promoters50/1012397
attttctctcctttat

SEQ ID NO: 153984 - DNA, 16 bp, Unknown
  misc_feature (1)..( 16): Result.004 file - promoters50/1012397
gaattattttgctacc

SEQ ID NO: 153985 - DNA, 16 bp, Unknown
  misc_feature (1)..( 16): Result.004 file - promoters50/1012397
aatttcttgagacgga

SEQ ID NO: 153986 - DNA, 13 bp, Unknown
  misc_feature (1)..( 13): Result.004 file - promoters50/1012397
tacttttccaatt

SEQ ID NO: 153987 - DNA, 8 bp, Unknown
  misc_feature (1)..( 8): Result.004 file - promoters50/1012397
taaacaag

SEQ ID NO: 153988 - DNA, 8 bp, Unknown
  misc_feature (1)..( 8): Result.004 file - promoters50/1012397
aaaataag

SEQ ID NO: 153989 - DNA, 8 bp, Unknown
  misc_feature (1)..( 8): Result.004 file - promoters50/1012397
taaccaaa

SEQ ID NO: 153990 - DNA, 8 bp, Unknown
  misc_feature (1)..( 8): Result.004 file - promoters50/1012397
aaaataaa

SEQ ID NO: 153991 - DNA, 8 bp, Unknown
  misc_feature (1)..( 8): Result.004 file - promoters50/1012397
aaactaaa

SEQ ID NO: 153992 - DNA, 8 bp, Unknown
  misc_feature (1)..( 8): Result.004 file - promoters50/1012397
ttaccaaa

SEQ ID NO: 153993 - DNA, 8 bp, Unknown
  misc_feature (1)..( 8): Result.004 file - promoters50/1012397
aattaaac

SEQ ID NO: 153994 - DNA, 8 bp, Unknown
  misc_feature (1)..( 8): Result.004 file - promoters50/1012397
aattaaag

SEQ ID NO: 153995 - DNA, 8 bp, Unknown
  misc_feature (1)..( 8): Result.004 file - promoters50/1012397
cattaaat

SEQ ID NO: 153996 - DNA, 8 bp, Unknown
  misc_feature (1)..( 8): Result.004 file - promoters50/1012397
cattatta

SEQ ID NO: 153997 - DNA, 8 bp, Unknown
  misc_feature (1)..( 8): Result.004 file - promoters50/1012397
aattaatc

SEQ ID NO: 153998 - DNA, 8 bp, Unknown
  misc_feature (1)..( 8): Result.004 file - promoters50/1012403
aattaacc

SEQ ID NO: 153999 - DNA, 11 bp, Unknown
  misc_feature (1)..( 11): Result.004 file - promoters50/1012403
tgtttcttttg

SEQ ID NO: 154000 - DNA, 11 bp, Unknown
  misc_feature (1)..( 11): Result.004 file - promoters50/1012403
aattttttttt

SEQ ID NO: 154001 - DNA, 11 bp, Unknown
  misc_feature (1)..( 11): Result.004 file - promoters50/1012403
tgtgtcttcct

SEQ ID NO: 154002 - DNA, 11 bp, Unknown
  misc_feature (1)..( 11): Result.004 file - promoters50/1012403
agttttattat

SEQ ID NO: 154003 - DNA, 11 bp, Unknown
  misc_feature (1)..( 11): Result.004 file - promoters50/1012403
atcattagtat

SEQ ID NO: 154004 - DNA, 9 bp, Unknown
  misc_feature (1)..( 9): Result.004 file - promoters50/1012403
tgtattcta

SEQ ID NO: 154005 - DNA, 11 bp, Unknown
  misc_feature (1)..( 11): Result.004 file - promoters50/1012403
gtttggttcaa

SEQ ID NO: 154006 - DNA, 11 bp, Unknown
  misc_feature (1)..( 11): Result.004 file - promoters50/1012403
tttttgttaga

SEQ ID NO: 154007 - DNA, 11 bp, Unknown
  misc_feature (1)..( 11): Result.004 file - promoters50/1012403
gtattgtttca

SEQ ID NO: 154008 - DNA, 11 bp, Unknown
  misc_feature (1)..( 11): Result.004 file - promoters50/1012403
tttttgttttc

SEQ ID NO: 154009 - DNA, 11 bp, Unknown
  misc_feature (1)..( 11): Result.004 file - promoters50/1012403
cttttattaaa

SEQ ID NO: 154010 - DNA, 11 bp, Unknown
  misc_feature (1)..( 11): Result.004 file - promoters50/1012403
cttttacaaaa

SEQ ID NO: 154011 - DNA, 10 bp, Unknown
  misc_feature (1)..( 10): Result.004 file - promoters50/1012403
agtaagaaaa

SEQ ID NO: 154012 - DNA, 10 bp, Unknown
  misc_feature (1)..( 10): Result.004 file - promoters50/1012403
tgtatgaaaa

SEQ ID NO: 154013 - DNA, 10 bp, Unknown
  misc_feature (1)..( 10): Result.004 file - promoters50/1012403
tttaaaaaaa

SEQ ID NO: 154014 - DNA, 10 bp, Unknown
  misc_feature (1)..( 10): Result.004 file - promoters50/1012403
aaaaagaaaa

SEQ ID NO: 154015 - DNA, 10 bp, Unknown
  misc_feature (1)..( 10): Result.004 file - promoters50/1012403
tgtttgatat

SEQ ID NO: 154016 - DNA, 10 bp, Unknown
  misc_feature (1)..( 10): Result.004 file - promoters50/1012403
tgtgtctttt

SEQ ID NO: 154017 - DNA, 9 bp, Unknown
  misc_feature (1)..( 9): Result.004 file - promoters50/1012403
gttttttaa

SEQ ID NO: 154018 - DNA, 9 bp, Unknown
  misc_feature (1)..( 9): Result.004 file - promoters50/1012403
ttttattat

SEQ ID NO: 154019 - DNA, 9 bp, Unknown
  misc_feature (1)..( 9): Result.004 file - promoters50/1012403
atttattac

SEQ ID NO: 154020 - DNA, 9 bp, Unknown
  misc_feature (1)..( 9): Result.004 file - promoters50/1012403
gtgtatttc

SEQ ID NO: 154021 - DNA, 9 bp, Unknown
  misc_feature (1)..( 9): Result.004 file - promoters50/1012403
tttttttaa

SEQ ID NO: 154022 - DNA, 9 bp, Unknown
  misc_feature (1)..( 9): Result.004 file - promoters50/1012403
cattagtat

SEQ ID NO: 154023 - DNA, 11 bp, Unknown
  misc_feature (1)..( 11): Result.004 file - promoters50/1012403
aatagaaaagt

SEQ ID NO: 154024 - DNA, 11 bp, Unknown
  misc_feature (1)..( 11): Result.004 file - promoters50/1012403
ttcagaaaata

SEQ ID NO: 154025 - DNA, 11 bp, Unknown
  misc_feature (1)..( 11): Result.004 file - promoters50/1012403
tttaggaaact

SEQ ID NO: 154026 - DNA, 11 bp, Unknown
  misc_feature (1)..( 11): Result.004 file - promoters50/1012403
actagaaaact

SEQ ID NO: 154027 - DNA, 11 bp, Unknown
  misc_feature (1)..( 11): Result.004 file - promoters50/1012403
ttttggattta

SEQ ID NO: 154028 - DNA, 11 bp, Unknown
  misc_feature (1)..( 11): Result.004 file - promoters50/1012403
tacagaagata

SEQ ID NO: 154029 - DNA, 12 bp, Unknown
  misc_feature (1)..( 12): Result.004 file - promoters50/1012403
tttggttcaatt

SEQ ID NO: 154030 - DNA, 12 bp, Unknown
  misc_feature (1)..( 12): Result.004 file - promoters50/1012403
acctgttgaatc

SEQ ID NO: 154031 - DNA, 12 bp, Unknown
  misc_feature (1)..( 12): Result.004 file - promoters50/1012403
attgtttcataa

SEQ ID NO: 154032 - DNA, 12 bp, Unknown
  misc_feature (1)..( 12): Result.004 file - promoters50/1012403
ggtttttcgatt

SEQ ID NO: 154033 - DNA, 12 bp, Unknown
  misc_feature (1)..( 12): Result.004 file - promoters50/1012403
tagctttgaatt

SEQ ID NO: 154034 - DNA, 12 bp, Unknown
  misc_feature (1)..( 12): Result.004 file - promoters50/1012403
attttttgttag

SEQ ID NO: 154035 - DNA, 13 bp, Unknown
  misc_feature (1)..( 13): Result.004 file - promoters50/1012403
tttgaaatttctc

SEQ ID NO: 154036 - DNA, 13 bp, Unknown
  misc_feature (1)..( 13): Result.004 file - promoters50/1012403
tttgtaatcaata

SEQ ID NO: 154037 - DNA, 13 bp, Unknown
  misc_feature (1)..( 13): Result.004 file - promoters50/1012403
actgaaattttag

SEQ ID NO: 154038 - DNA, 13 bp, Unknown
  misc_feature (1)..( 13): Result.004 file - promoters50/1012403
tttaaaatcaact

SEQ ID NO: 154039 - DNA, 13 bp, Unknown
  misc_feature (1)..( 13): Result.004 file - promoters50/1012403
gataaaataaaat

SEQ ID NO: 154040 - DNA, 13 bp, Unknown
  misc_feature (1)..( 13): Result.004 file - promoters50/1012407
ctacaaatcttag

SEQ ID NO: 154041 - DNA, 17 bp, Unknown
  misc_feature (1)..( 17): Result.004 file - promoters50/1012407
caattttgatgacaatt

SEQ ID NO: 154042 - DNA, 17 bp, Unknown
  misc_feature (1)..( 17): Result.004 file - promoters50/1012407
taattttaataatttat

SEQ ID NO: 154043 - DNA, 17 bp, Unknown
  misc_feature (1)..( 17): Result.004 file - promoters50/1012407
caattttgctaaaaatc

SEQ ID NO: 154044 - DNA, 17 bp, Unknown
  misc_feature (1)..( 17): Result.004 file - promoters50/1012407
tcattgtaacaaaaagt

SEQ ID NO: 154045 - DNA, 17 bp, Unknown
  misc_feature (1)..( 17): Result.004 file - promoters50/1012407
agattttaatattttat

SEQ ID NO: 154046 - DNA, 17 bp, Unknown
  misc_feature (1)..( 17): Result.004 file - promoters50/1012442
tgattttgattgattga

SEQ ID NO: 154047 - DNA, 14 bp, Unknown
  misc_feature (1)..( 14): Result.004 file - promoters50/1012442
ctaaaatttacata

SEQ ID NO: 154048 - DNA, 14 bp, Unknown
  misc_feature (1)..( 14): Result.004 file - promoters50/1012442
ataagattcacata

SEQ ID NO: 154049 - DNA, 14 bp, Unknown
  misc_feature (1)..( 14): Result.004 file - promoters50/1012442
ttaagattaattaa

SEQ ID NO: 154050 - DNA, 14 bp, Unknown
  misc_feature (1)..( 14): Result.004 file - promoters50/1012442
ataagaagtctgaa

SEQ ID NO: 154051 - DNA, 8 bp, Unknown
  misc_feature (1)..( 8): Result.004 file - promoters50/1012442
aagaaatt

SEQ ID NO: 154052 - DNA, 8 bp, Unknown
  misc_feature (1)..( 8): Result.004 file - promoters50/1012442
aagatatt

SEQ ID NO: 154053 - DNA, 8 bp, Unknown
  misc_feature (1)..( 8): Result.004 file - promoters50/1012442
aagaaaaa

SEQ ID NO: 154054 - DNA, 7 bp, Unknown
  misc_feature (1)..( 7): Result.004 file - promoters50/1012442
agatatt

SEQ ID NO: 154055 - DNA, 7 bp, Unknown
  misc_feature (1)..( 7): Result.004 file - promoters50/1012442
agatatc

SEQ ID NO: 154056 - DNA, 7 bp, Unknown
  misc_feature (1)..( 7): Result.004 file - promoters50/1012442
atatata

SEQ ID NO: 154057 - DNA, 7 bp, Unknown
  misc_feature (1)..( 7): Result.004 file - promoters50/1012442
caataag

SEQ ID NO: 154058 - DNA, 7 bp, Unknown
  misc_feature (1)..( 7): Result.004 file - promoters50/1012442
aaataag

SEQ ID NO: 154059 - DNA, 8 bp, Unknown
  misc_feature (1)..( 8): Result.004 file - promoters50/1012442
aaactaag

SEQ ID NO: 154060 - DNA, 7 bp, Unknown
  misc_feature (1)..( 7): Result.004 file - promoters50/1012442
tttttaa

SEQ ID NO: 154061 - DNA, 7 bp, Unknown
  misc_feature (1)..( 7): Result.004 file - promoters50/1012442
tttttaa

SEQ ID NO: 154062 - DNA, 7 bp, Unknown
  misc_feature (1)..( 7): Result.004 file - promoters50/1012442
tttttag

SEQ ID NO: 154063 - DNA, 12 bp, Unknown
  misc_feature (1)..( 12): Result.004 file - promoters50/1012442
aaacacaataca

SEQ ID NO: 154064 - DNA, 12 bp, Unknown
  misc_feature (1)..( 12): Result.004 file - promoters50/1012442
aaaaacaaaaca

SEQ ID NO: 154065 - DNA, 12 bp, Unknown
  misc_feature (1)..( 12): Result.004 file - promoters50/1012561
caaaacattaag

SEQ ID NO: 154066 - DNA, 8 bp, Unknown
  misc_feature (1)..( 8): Result.004 file - promoters50/1012561
aaaacaaa

SEQ ID NO: 154067 - DNA, 8 bp, Unknown
  misc_feature (1)..( 8): Result.004 file - promoters50/1012561
gaaataaa

SEQ ID NO: 154068 - DNA, 8 bp, Unknown
  misc_feature (1)..( 8): Result.004 file - promoters50/1012561
gaagtaat

SEQ ID NO: 154069 - DNA, 8 bp, Unknown
  misc_feature (1)..( 8): Result.004 file - promoters50/1012561
tgagtaat

SEQ ID NO: 154070 - DNA, 11 bp, Unknown
  misc_feature (1)..( 11): Result.004 file - promoters50/1012561
aatttttgtgt

SEQ ID NO: 154071 - DNA, 11 bp, Unknown
  misc_feature (1)..( 11): Result.004 file - promoters50/1012561
cattattgttt

SEQ ID NO: 154072 - DNA, 11 bp, Unknown
  misc_feature (1)..( 11): Result.004 file - promoters50/1012561
cgtatttgtgc

SEQ ID NO: 154073 - DNA, 11 bp, Unknown
  misc_feature (1)..( 11): Result.004 file - promoters50/1012561
tgttactgttt

SEQ ID NO: 154074 - DNA, 11 bp, Unknown
  misc_feature (1)..( 11): Result.004 file - promoters50/1012561
actttttaaat

SEQ ID NO: 154075 - DNA, 10 bp, Unknown
  misc_feature (1)..( 10): Result.004 file - promoters50/1012561
atcatttctt

SEQ ID NO: 154076 - DNA, 10 bp, Unknown
  misc_feature (1)..( 10): Result.004 file - promoters50/1012561
atcttttttt

SEQ ID NO: 154077 - DNA, 10 bp, Unknown
  misc_feature (1)..( 10): Result.004 file - promoters50/1012561
ttcattttta

SEQ ID NO: 154078 - DNA, 10 bp, Unknown
  misc_feature (1)..( 10): Result.004 file - promoters50/1012561
cacttttttt

SEQ ID NO: 154079 - DNA, 10 bp, Unknown
  misc_feature (1)..( 10): Result.004 file - promoters50/1012561
tttctttttt

SEQ ID NO: 154080 - DNA, 10 bp, Unknown
  misc_feature (1)..( 10): Result.004 file - promoters50/1012561
tttctttttc

SEQ ID NO: 154081 - DNA, 11 bp, Unknown
  misc_feature (1)..( 11): Result.004 file - promoters50/1012561
tttttttattt

SEQ ID NO: 154082 - DNA, 11 bp, Unknown
  misc_feature (1)..( 11): Result.004 file - promoters50/1012561
aatcttttttt

SEQ ID NO: 154083 - DNA, 10 bp, Unknown
  misc_feature (1)..( 10): Result.004 file - promoters50/1012561
caataattga

SEQ ID NO: 154084 - DNA, 10 bp, Unknown
  misc_feature (1)..( 10): Result.004 file - promoters50/1012561
aaataattat

SEQ ID NO: 154085 - DNA, 10 bp, Unknown
  misc_feature (1)..( 10): Result.004 file - promoters50/1012561
caaaaattat

SEQ ID NO: 154086 - DNA, 10 bp, Unknown
  misc_feature (1)..( 10): Result.004 file - promoters50/1012568
aaaaaattat

SEQ ID NO: 154087 - DNA, 9 bp, Unknown
  misc_feature (1)..( 9): Result.004 file - promoters50/1012568
attcttctt

SEQ ID NO: 154088 - DNA, 9 bp, Unknown
  misc_feature (1)..( 9): Result.004 file - promoters50/1012568
atttttctt

SEQ ID NO: 154089 - DNA, 9 bp, Unknown
  misc_feature (1)..( 9): Result.004 file - promoters50/1012568
attcttttt

SEQ ID NO: 154090 - DNA, 9 bp, Unknown
  misc_feature (1)..( 9): Result.004 file - promoters50/1012568
tttaatttt

SEQ ID NO: 154091 - DNA, 9 bp, Unknown
  misc_feature (1)..( 9): Result.004 file - promoters50/1012568
tttgatttc

SEQ ID NO: 154092 - DNA, 9 bp, Unknown
  misc_feature (1)..( 9): Result.004 file - promoters50/1012568
tataatttt

SEQ ID NO: 154093 - DNA, 6 bp, Unknown
  misc_feature (1)..( 6): Result.004 file - promoters50/1012568
ttttta

SEQ ID NO: 154094 - DNA, 6 bp, Unknown
  misc_feature (1)..( 6): Result.004 file - promoters50/1012568
ttttta

SEQ ID NO: 154095 - DNA, 6 bp, Unknown
  misc_feature (1)..( 6): Result.004 file - promoters50/1012568
ttttta

SEQ ID NO: 154096 - DNA, 7 bp, Unknown
  misc_feature (1)..( 7): Result.004 file - promoters50/1012568
tttagta

SEQ ID NO: 154097 - DNA, 7 bp, Unknown
  misc_feature (1)..( 7): Result.004 file - promoters50/1012568
ttttgta

SEQ ID NO: 154098 - DNA, 7 bp, Unknown
  misc_feature (1)..( 7): Result.004 file - promoters50/1012580
tttagta

SEQ ID NO: 154099 - DNA, 6 bp, Unknown
  misc_feature (1)..( 6): Result.004 file - promoters50/1012580
cttata

SEQ ID NO: 154100 - DNA, 6 bp, Unknown
  misc_feature (1)..( 6): Result.004 file - promoters50/1012580
cttata

SEQ ID NO: 154101 - DNA, 6 bp, Unknown
  misc_feature (1)..( 6): Result.004 file - promoters50/1012620
cttata

SEQ ID NO: 154102 - DNA, 11 bp, Unknown
  misc_feature (1)..( 11): Result.004 file - promoters50/1012620
ataatttgagt

SEQ ID NO: 154103 - DNA, 11 bp, Unknown
  misc_feature (1)..( 11): Result.004 file - promoters50/1012620
caaatgtgatt

SEQ ID NO: 154104 - DNA, 11 bp, Unknown
  misc_feature (1)..( 11): Result.004 file - promoters50/1012620
atatttttagt

SEQ ID NO: 154105 - DNA, 10 bp, Unknown
  misc_feature (1)..( 10): Result.004 file - promoters50/1012620
aatatataca

SEQ ID NO: 154106 - DNA, 10 bp, Unknown
  misc_feature (1)..( 10): Result.004 file - promoters50/1012620
aatttatcaa

SEQ ID NO: 154107 - DNA, 10 bp, Unknown
  misc_feature (1)..( 10): Result.004 file - promoters50/1012620
agtttatttt

SEQ ID NO: 154108 - DNA, 11 bp, Unknown
  misc_feature (1)..( 11): Result.004 file - promoters50/1012620
agagaaaggat

SEQ ID NO: 154109 - DNA, 11 bp, Unknown
  misc_feature (1)..( 11): Result.004 file - promoters50/1012620
agaaaaattgt

SEQ ID NO: 154110 - DNA, 11 bp, Unknown
  misc_feature (1)..( 11): Result.004 file - promoters50/1012620
aaacaaagatt

SEQ ID NO: 154111 - DNA, 9 bp, Unknown
  misc_feature (1)..( 9): Result.004 file - promoters50/1012620
atctataaa

SEQ ID NO: 154112 - DNA, 9 bp, Unknown
  misc_feature (1)..( 9): Result.004 file - promoters50/1012620
atatataaa

SEQ ID NO: 154113 - DNA, 9 bp, Unknown
  misc_feature (1)..( 9): Result.004 file - promoters50/1012620
ccttataaa

SEQ ID NO: 154114 - DNA, 9 bp, Unknown
  misc_feature (1)..( 9): Result.004 file - promoters50/1012620
ccttttaaa

SEQ ID NO: 154115 - DNA, 8 bp, Unknown
  misc_feature (1)..( 8): Result.004 file - promoters50/1012620
aggaggaa

SEQ ID NO: 154116 - DNA, 8 bp, Unknown
  misc_feature (1)..( 8): Result.004 file - promoters50/1012620
tggaggat

SEQ ID NO: 154117 - DNA, 8 bp, Unknown
  misc_feature (1)..( 8): Result.004 file - promoters50/1012620
aggaggaa

SEQ ID NO: 154118 - DNA, 9 bp, Unknown
  misc_feature (1)..( 9): Result.004 file - promoters50/1012620
taatgaaat

SEQ ID NO: 154119 - DNA, 9 bp, Unknown
  misc_feature (1)..( 9): Result.004 file - promoters50/1012620
agatgaaat

SEQ ID NO: 154120 - DNA, 9 bp, Unknown
  misc_feature (1)..( 9): Result.004 file - promoters50/1012620
taattaaaa

SEQ ID NO: 154121 - DNA, 8 bp, Unknown
  misc_feature (1)..( 8): Result.004 file - promoters50/1012620
gttacaaa

SEQ ID NO: 154122 - DNA, 8 bp, Unknown
  misc_feature (1)..( 8): Result.004 file - promoters50/1012620
gttacaac

SEQ ID NO: 154123 - DNA, 8 bp, Unknown
  misc_feature (1)..( 8): Result.004 file - promoters50/1012659
gttataac

SEQ ID NO: 154124 - DNA, 10 bp, Unknown
  misc_feature (1)..( 10): Result.004 file - promoters50/1012659
aataaagaat

SEQ ID NO: 154125 - DNA, 10 bp, Unknown
  misc_feature (1)..( 10): Result.004 file - promoters50/1012659
ttgaaaaaat

SEQ ID NO: 154126 - DNA, 10 bp, Unknown
  misc_feature (1)..( 10): Result.004 file - promoters50/1012659
ttgacaaaat

SEQ ID NO: 154127 - DNA, 10 bp, Unknown
  misc_feature (1)..( 10): Result.004 file - promoters50/1012659
atgaataaac

SEQ ID NO: 154128 - DNA, 11 bp, Unknown
  misc_feature (1)..( 11): Result.004 file - promoters50/1012659
tcactttgaag

SEQ ID NO: 154129 - DNA, 11 bp, Unknown
  misc_feature (1)..( 11): Result.004 file - promoters50/1012659
aaactttgttt

SEQ ID NO: 154130 - DNA, 11 bp, Unknown
  misc_feature (1)..( 11): Result.004 file - promoters50/1012659
tcattttcaca

SEQ ID NO: 154131 - DNA, 11 bp, Unknown
  misc_feature (1)..( 11): Result.004 file - promoters50/1012659
attctttaaag

SEQ ID NO: 154132 - DNA, 10 bp, Unknown
  misc_feature (1)..( 10): Result.004 file - promoters50/1012659
tttgtttaac

SEQ ID NO: 154133 - DNA, 10 bp, Unknown
  misc_feature (1)..( 10): Result.004 file - promoters50/1012659
tttgttgcta

SEQ ID NO: 154134 - DNA, 10 bp, Unknown
  misc_feature (1)..( 10): Result.004 file - promoters50/1012659
tttctttatc

SEQ ID NO: 154135 - DNA, 10 bp, Unknown
  misc_feature (1)..( 10): Result.004 file - promoters50/1012720
gtacttcatc

SEQ ID NO: 154136 - DNA, 11 bp, Unknown
  misc_feature (1)..( 11): Result.004 file - promoters50/1012720
aaatgtcgaaa

SEQ ID NO: 154137 - DNA, 11 bp, Unknown
  misc_feature (1)..( 11): Result.004 file - promoters50/1012720
aaatgttttgc

SEQ ID NO: 154138 - DNA, 11 bp, Unknown
  misc_feature (1)..( 11): Result.004 file - promoters50/1012720
aaacgttaaaa

SEQ ID NO: 154139 - DNA, 11 bp, Unknown
  misc_feature (1)..( 11): Result.004 file - promoters50/1012720
caattttttgt

SEQ ID NO: 154140 - DNA, 11 bp, Unknown
  misc_feature (1)..( 11): Result.004 file - promoters50/1012720
agatttgttgg

SEQ ID NO: 154141 - DNA, 11 bp, Unknown
  misc_feature (1)..( 11): Result.004 file - promoters50/1012720
tactttcttgt

SEQ ID NO: 154142 - DNA, 9 bp, Unknown
  misc_feature (1)..( 9): Result.004 file - promoters50/1012720
ttttaaaat

SEQ ID NO: 154143 - DNA, 9 bp, Unknown
  misc_feature (1)..( 9): Result.004 file - promoters50/1012720
tgttaaaag

SEQ ID NO: 154144 - DNA, 9 bp, Unknown
  misc_feature (1)..( 9): Result.004 file - promoters50/1012720
cgttaaaac

SEQ ID NO: 154145 - DNA, 9 bp, Unknown
  misc_feature (1)..( 9): Result.004 file - promoters50/1012720
ggttacaat

SEQ ID NO: 154146 - DNA, 9 bp, Unknown
  misc_feature (1)..( 9): Result.004 file - promoters50/1012720
tgtgaaatg

SEQ ID NO: 154147 - DNA, 9 bp, Unknown
  misc_feature (1)..( 9): Result.004 file - promoters50/1012720
tgtgaatct

SEQ ID NO: 154148 - DNA, 13 bp, Unknown
  misc_feature (1)..( 13): Result.004 file - promoters50/1012720
ttttgttaatatc

SEQ ID NO: 154149 - DNA, 13 bp, Unknown
  misc_feature (1)..( 13): Result.004 file - promoters50/1012720
ggttgctaaataa

SEQ ID NO: 154150 - DNA, 13 bp, Unknown
  misc_feature (1)..( 13): Result.004 file - promoters50/1012720
tcttgttatgttt

SEQ ID NO: 154151 - DNA, 13 bp, Unknown
  misc_feature (1)..( 13): Result.004 file - promoters50/1012720
ggaccatattttt

SEQ ID NO: 154152 - DNA, 13 bp, Unknown
  misc_feature (1)..( 13): Result.004 file - promoters50/1012720
aattattattatc

SEQ ID NO: 154153 - DNA, 13 bp, Unknown
  misc_feature (1)..( 13): Result.004 file - promoters50/1012757
aattattcaatac

SEQ ID NO: 154154 - DNA, 10 bp, Unknown
  misc_feature (1)..( 10): Result.004 file - promoters50/1012757
tataatatgt

SEQ ID NO: 154155 - DNA, 10 bp, Unknown
  misc_feature (1)..( 10): Result.004 file - promoters50/1012757
aataataaaa

SEQ ID NO: 154156 - DNA, 10 bp, Unknown
  misc_feature (1)..( 10): Result.004 file - promoters50/1012757
tttaatattt

SEQ ID NO: 154157 - DNA, 10 bp, Unknown
  misc_feature (1)..( 10): Result.004 file - promoters50/1012757
tttcataatt

SEQ ID NO: 154158 - DNA, 10 bp, Unknown
  misc_feature (1)..( 10): Result.004 file - promoters50/1012757
cataagaaaa

SEQ ID NO: 154159 - DNA, 10 bp, Unknown
  misc_feature (1)..( 10): Result.004 file - promoters50/1012757
aaaaatatta

SEQ ID NO: 154160 - DNA, 12 bp, Unknown
  misc_feature (1)..( 12): Result.004 file - promoters50/1012757
ataaattaatgc

SEQ ID NO: 154161 - DNA, 12 bp, Unknown
  misc_feature (1)..( 12): Result.004 file - promoters50/1012757
atatattaatgt

SEQ ID NO: 154162 - DNA, 12 bp, Unknown
  misc_feature (1)..( 12): Result.004 file - promoters50/1012757
ccatattaataa

SEQ ID NO: 154163 - DNA, 12 bp, Unknown
  misc_feature (1)..( 12): Result.004 file - promoters50/1012757
aagttttaatgt

SEQ ID NO: 154164 - DNA, 12 bp, Unknown
  misc_feature (1)..( 12): Result.004 file - promoters50/1012757
taaaattaatat

SEQ ID NO: 154165 - DNA, 12 bp, Unknown
  misc_feature (1)..( 12): Result.004 file - promoters50/1012761
tttggttattgt

SEQ ID NO: 154166 - DNA, 9 bp, Unknown
  misc_feature (1)..( 9): Result.004 file - promoters50/1012761
taaaaaaaa

SEQ ID NO: 154167 - DNA, 9 bp, Unknown
  misc_feature (1)..( 9): Result.004 file - promoters50/1012761
taaaaaaag

SEQ ID NO: 154168 - DNA, 9 bp, Unknown
  misc_feature (1)..( 9): Result.004 file - promoters50/1012761
caaaagaca

SEQ ID NO: 154169 - DNA, 7 bp, Unknown
  misc_feature (1)..( 7): Result.004 file - promoters50/1012761
aaaaaaa

SEQ ID NO: 154170 - DNA, 7 bp, Unknown
  misc_feature (1)..( 7): Result.004 file - promoters50/1012761
aaataaa

SEQ ID NO: 154171 - DNA, 7 bp, Unknown
  misc_feature (1)..( 7): Result.004 file - promoters50/1012761
aaataag

SEQ ID NO: 154172 - DNA, 7 bp, Unknown
  misc_feature (1)..( 7): Result.004 file - promoters50/1012761
aaagaaa

SEQ ID NO: 154173 - DNA, 7 bp, Unknown
  misc_feature (1)..( 7): Result.004 file - promoters50/1012761
aaagaaa

SEQ ID NO: 154174 - DNA, 7 bp, Unknown
  misc_feature (1)..( 7): Result.004 file - promoters50/1012761
caagaaa

SEQ ID NO: 154175 - DNA, 7 bp, Unknown
  misc_feature (1)..( 7): Result.004 file - promoters50/1012761
gatttga

SEQ ID NO: 154176 - DNA, 7 bp, Unknown
  misc_feature (1)..( 7): Result.004 file - promoters50/1012761
gatttga

SEQ ID NO: 154177 - DNA, 7 bp, Unknown
  misc_feature (1)..( 7): Result.004 file - promoters50/1012761
gatttgg

SEQ ID NO: 154178 - DNA, 9 bp, Unknown
  misc_feature (1)..( 9): Result.004 file - promoters50/1012761
aaacgaaga

SEQ ID NO: 154179 - DNA, 9 bp, Unknown
  misc_feature (1)..( 9): Result.004 file - promoters50/1012761
taaccaaga

SEQ ID NO: 154180 - DNA, 9 bp, Unknown
  misc_feature (1)..( 9): Result.004 file - promoters50/1012791
taaccagaa

SEQ ID NO: 154181 - DNA, 8 bp, Unknown
  misc_feature (1)..( 8): Result.004 file - promoters50/1012791
aaacaaaa

SEQ ID NO: 154182 - DNA, 8 bp, Unknown
  misc_feature (1)..( 8): Result.004 file - promoters50/1012791
aaacaatt

SEQ ID NO: 154183 - DNA, 8 bp, Unknown
  misc_feature (1)..( 8): Result.004 file - promoters50/1012791
aaacaaaa

SEQ ID NO: 154184 - DNA, 8 bp, Unknown
  misc_feature (1)..( 8): Result.004 file - promoters50/1012791
atacacag

SEQ ID NO: 154185 - DNA, 8 bp, Unknown
  misc_feature (1)..( 8): Result.004 file - promoters50/1012791
aataaaca

SEQ ID NO: 154186 - DNA, 8 bp, Unknown
  misc_feature (1)..( 8): Result.004 file - promoters50/1012791
aattaacg

SEQ ID NO: 154187 - DNA, 8 bp, Unknown
  misc_feature (1)..( 8): Result.004 file - promoters50/1012791
catacaca

SEQ ID NO: 154188 - DNA, 10 bp, Unknown
  misc_feature (1)..( 10): Result.004 file - promoters50/1012791
tttctatatt

SEQ ID NO: 154189 - DNA, 10 bp, Unknown
  misc_feature (1)..( 10): Result.004 file - promoters50/1012791
tttttatatt

SEQ ID NO: 154190 - DNA, 10 bp, Unknown
  misc_feature (1)..( 10): Result.004 file - promoters50/1012791
cttttatcat

SEQ ID NO: 154191 - DNA, 10 bp, Unknown
  misc_feature (1)..( 10): Result.004 file - promoters50/1012791
attctttttt

SEQ ID NO: 154192 - DNA, 11 bp, Unknown
  misc_feature (1)..( 11): Result.004 file - promoters50/1012791
acaaaataaat

SEQ ID NO: 154193 - DNA, 11 bp, Unknown
  misc_feature (1)..( 11): Result.004 file - promoters50/1012791
caaaaacaaat

SEQ ID NO: 154194 - DNA, 11 bp, Unknown
  misc_feature (1)..( 11): Result.004 file - promoters50/1012791
acaaaatggat

SEQ ID NO: 154195 - DNA, 11 bp, Unknown
  misc_feature (1)..( 11): Result.004 file - promoters50/1012791
taaaaacaatt

SEQ ID NO: 154196 - DNA, 9 bp, Unknown
  misc_feature (1)..( 9): Result.004 file - promoters50/1012791
ttcttttat

SEQ ID NO: 154197 - DNA, 9 bp, Unknown
  misc_feature (1)..( 9): Result.004 file - promoters50/1012791
ttctttttt

SEQ ID NO: 154198 - DNA, 9 bp, Unknown
  misc_feature (1)..( 9): Result.004 file - promoters50/1012791
ttctttttt

SEQ ID NO: 154199 - DNA, 9 bp, Unknown
  misc_feature (1)..( 9): Result.004 file - promoters50/1012791
ttttaaaaa

SEQ ID NO: 154200 - DNA, 9 bp, Unknown
  misc_feature (1)..( 9): Result.004 file - promoters50/1012791
ctttacaaa

SEQ ID NO: 154201 - DNA, 9 bp, Unknown
  misc_feature (1)..( 9): Result.004 file - promoters50/1012791
ttttaaagc

SEQ ID NO: 154202 - DNA, 9 bp, Unknown
  misc_feature (1)..( 9): Result.004 file - promoters50/1012791
ttttttttc

SEQ ID NO: 154203 - DNA, 9 bp, Unknown
  misc_feature (1)..( 9): Result.004 file - promoters50/1012791
tttgttttc

SEQ ID NO: 154204 - DNA, 9 bp, Unknown
  misc_feature (1)..( 9): Result.004 file - promoters50/1012791
tttattttt

SEQ ID NO: 154205 - DNA, 8 bp, Unknown
  misc_feature (1)..( 8): Result.004 file - promoters50/1012791
aaaaatga

SEQ ID NO: 154206 - DNA, 8 bp, Unknown
  misc_feature (1)..( 8): Result.004 file - promoters50/1012791
gaaaatga

SEQ ID NO: 154207 - DNA, 8 bp, Unknown
  misc_feature (1)..( 8): Result.004 file - promoters50/1012795
gaaaataa

SEQ ID NO: 154208 - DNA, 8 bp, Unknown
  misc_feature (1)..( 8): Result.004 file - promoters50/1012795
acatgaaa

SEQ ID NO: 154209 - DNA, 8 bp, Unknown
  misc_feature (1)..( 8): Result.004 file - promoters50/1012795
ttatgaaa

SEQ ID NO: 154210 - DNA, 8 bp, Unknown
  misc_feature (1)..( 8): Result.004 file - promoters50/1012795
ttaagaat

SEQ ID NO: 154211 - DNA, 8 bp, Unknown
  misc_feature (1)..( 8): Result.004 file - promoters50/1012795
tttggtac

SEQ ID NO: 154212 - DNA, 8 bp, Unknown
  misc_feature (1)..( 8): Result.004 file - promoters50/1012795
tttggtta

SEQ ID NO: 154213 - DNA, 8 bp, Unknown
  misc_feature (1)..( 8): Result.004 file - promoters50/1012803
tttagtta

SEQ ID NO: 154214 - DNA, 8 bp, Unknown
  misc_feature (1)..( 8): Result.004 file - promoters50/1012803
caagaaaa

SEQ ID NO: 154215 - DNA, 8 bp, Unknown
  misc_feature (1)..( 8): Result.004 file - promoters50/1012803
gaagaaaa

SEQ ID NO: 154216 - DNA, 8 bp, Unknown
  misc_feature (1)..( 8): Result.004 file - promoters50/1012803
caagaaag

SEQ ID NO: 154217 - DNA, 8 bp, Unknown
  misc_feature (1)..( 8): Result.004 file - promoters50/1012803
tgagaaaa

SEQ ID NO: 154218 - DNA, 7 bp, Unknown
  misc_feature (1)..( 7): Result.004 file - promoters50/1012803
tataata

SEQ ID NO: 154219 - DNA, 7 bp, Unknown
  misc_feature (1)..( 7): Result.004 file - promoters50/1012803
cataata

SEQ ID NO: 154220 - DNA, 7 bp, Unknown
  misc_feature (1)..( 7): Result.004 file - promoters50/1012803
cataatt

SEQ ID NO: 154221 - DNA, 7 bp, Unknown
  misc_feature (1)..( 7): Result.004 file - promoters50/1012803
aaataaa

SEQ ID NO: 154222 - DNA, 7 bp, Unknown
  misc_feature (1)..( 7): Result.004 file - promoters50/1012803
aaataat

SEQ ID NO: 154223 - DNA, 7 bp, Unknown
  misc_feature (1)..( 7): Result.004 file - promoters50/1012803
aaataaa

SEQ ID NO: 154224 - DNA, 8 bp, Unknown
  misc_feature (1)..( 8): Result.004 file - promoters50/1012803
cacgaagc

SEQ ID NO: 154225 - DNA, 8 bp, Unknown
  misc_feature (1)..( 8): Result.004 file - promoters50/1012803
cacaaagt

SEQ ID NO: 154226 - DNA, 8 bp, Unknown
  misc_feature (1)..( 8): Result.004 file - promoters50/1012803
gacacagt

SEQ ID NO: 154227 - DNA, 10 bp, Unknown
  misc_feature (1)..( 10): Result.004 file - promoters50/1012803
taatagtaaa

SEQ ID NO: 154228 - DNA, 10 bp, Unknown
  misc_feature (1)..( 10): Result.004 file - promoters50/1012803
ggatattaaa

SEQ ID NO: 154229 - DNA, 10 bp, Unknown
  misc_feature (1)..( 10): Result.004 file - promoters50/1012811
ggatattgtt

SEQ ID NO: 154230 - DNA, 8 bp, Unknown
  misc_feature (1)..( 8): Result.004 file - promoters50/1012811
tgttgatt

SEQ ID NO: 154231 - DNA, 8 bp, Unknown
  misc_feature (1)..( 8): Result.004 file - promoters50/1012811
gtttgatt

SEQ ID NO: 154232 - DNA, 8 bp, Unknown
  misc_feature (1)..( 8): Result.004 file - promoters50/1012811
tgtggatt

SEQ ID NO: 154233 - DNA, 7 bp, Unknown
  misc_feature (1)..( 7): Result.004 file - promoters50/1012811
aaattaa

SEQ ID NO: 154234 - DNA, 7 bp, Unknown
  misc_feature (1)..( 7): Result.004 file - promoters50/1012811
aaattag

SEQ ID NO: 154235 - DNA, 7 bp, Unknown
  misc_feature (1)..( 7): Result.004 file - promoters50/1012811
aaactaa

SEQ ID NO: 154236 - DNA, 8 bp, Unknown
  misc_feature (1)..( 8): Result.004 file - promoters50/1012811
aattcaca

SEQ ID NO: 154237 - DNA, 8 bp, Unknown
  misc_feature (1)..( 8): Result.004 file - promoters50/1012811
aattcata

SEQ ID NO: 154238 - DNA, 8 bp, Unknown
  misc_feature (1)..( 8): Result.004 file - promoters50/1012811
aattgaca

SEQ ID NO: 154239 - DNA, 10 bp, Unknown
  misc_feature (1)..( 10): Result.004 file - promoters50/1012811
caaaataaaa

SEQ ID NO: 154240 - DNA, 10 bp, Unknown
  misc_feature (1)..( 10): Result.004 file - promoters50/1012811
aaaaacaaaa

SEQ ID NO: 154241 - DNA, 10 bp, Unknown
  misc_feature (1)..( 10): Result.004 file - promoters50/1012811
taaaaaaaac

SEQ ID NO: 154242 - DNA, 10 bp, Unknown
  misc_feature (1)..( 10): Result.004 file - promoters50/1012811
tttaacaact

SEQ ID NO: 154243 - DNA, 9 bp, Unknown
  misc_feature (1)..( 9): Result.004 file - promoters50/1012811
aaaagaaag

SEQ ID NO: 154244 - DNA, 9 bp, Unknown
  misc_feature (1)..( 9): Result.004 file - promoters50/1012811
aaaataaat

SEQ ID NO: 154245 - DNA, 9 bp, Unknown
  misc_feature (1)..( 9): Result.004 file - promoters50/1012811
atcataaat

SEQ ID NO: 154246 - DNA, 9 bp, Unknown
  misc_feature (1)..( 9): Result.004 file - promoters50/1012811
tttttatta

SEQ ID NO: 154247 - DNA, 9 bp, Unknown
  misc_feature (1)..( 9): Result.004 file - promoters50/1012811
attttattc

SEQ ID NO: 154248 - DNA, 9 bp, Unknown
  misc_feature (1)..( 9): Result.004 file - promoters50/1012811
gttttgtta

SEQ ID NO: 154249 - DNA, 9 bp, Unknown
  misc_feature (1)..( 9): Result.004 file - promoters50/1012811
gttttgggc

SEQ ID NO: 154250 - DNA, 8 bp, Unknown
  misc_feature (1)..( 8): Result.004 file - promoters50/1012811
agttgtaa

SEQ ID NO: 154251 - DNA, 8 bp, Unknown
  misc_feature (1)..( 8): Result.004 file - promoters50/1012811
tgttttaa

SEQ ID NO: 154252 - DNA, 8 bp, Unknown
  misc_feature (1)..( 8): Result.004 file - promoters50/1012811
ttttttaa

SEQ ID NO: 154253 - DNA, 8 bp, Unknown
  misc_feature (1)..( 8): Result.004 file - promoters50/1012811
ttttttaa

SEQ ID NO: 154254 - DNA, 10 bp, Unknown
  misc_feature (1)..( 10): Result.004 file - promoters50/1012811
aatactataa

SEQ ID NO: 154255 - DNA, 10 bp, Unknown
  misc_feature (1)..( 10): Result.004 file - promoters50/1012811
aatagtatat

SEQ ID NO: 154256 - DNA, 10 bp, Unknown
  misc_feature (1)..( 10): Result.004 file - promoters50/1012811
atgagtgtat

SEQ ID NO: 154257 - DNA, 7 bp, Unknown
  misc_feature (1)..( 7): Result.004 file - promoters50/1012811
aaaaaat

SEQ ID NO: 154258 - DNA, 7 bp, Unknown
  misc_feature (1)..( 7): Result.004 file - promoters50/1012811
aaaaaac

SEQ ID NO: 154259 - DNA, 7 bp, Unknown
  misc_feature (1)..( 7): Result.004 file - promoters50/1012811
aaaaaca

SEQ ID NO: 154260 - DNA, 7 bp, Unknown
  misc_feature (1)..( 7): Result.004 file - promoters50/1012811
attcaaa

SEQ ID NO: 154261 - DNA, 7 bp, Unknown
  misc_feature (1)..( 7): Result.004 file - promoters50/1012811
atttaaa

SEQ ID NO: 154262 - DNA, 7 bp, Unknown
  misc_feature (1)..( 7): Result.004 file - promoters50/1012811
atttaac

SEQ ID NO: 154263 - DNA, 9 bp, Unknown
  misc_feature (1)..( 9): Result.004 file - promoters50/1012811
tgattaaat

SEQ ID NO: 154264 - DNA, 9 bp, Unknown
  misc_feature (1)..( 9): Result.004 file - promoters50/1012811
gtatttaat

SEQ ID NO: 154265 - DNA, 9 bp, Unknown
  misc_feature (1)..( 9): Result.004 file - promoters50/1012835
gtatataaa

SEQ ID NO: 154266 - DNA, 8 bp, Unknown
  misc_feature (1)..( 8): Result.004 file - promoters50/1012835
cttacagt

SEQ ID NO: 154267 - DNA, 8 bp, Unknown
  misc_feature (1)..( 8): Result.004 file - promoters50/1012835
cttacaca

SEQ ID NO: 154268 - DNA, 8 bp, Unknown
  misc_feature (1)..( 8): Result.004 file - promoters50/1012883
attaaaca

SEQ ID NO: 154269 - DNA, 10 bp, Unknown
  misc_feature (1)..( 10): Result.004 file - promoters50/1012883
ttacaaaaag

SEQ ID NO: 154270 - DNA, 10 bp, Unknown
  misc_feature (1)..( 10): Result.004 file - promoters50/1012883
ttataaaaca

SEQ ID NO: 154271 - DNA, 10 bp, Unknown
  misc_feature (1)..( 10): Result.004 file - promoters50/1012883
ttagaaaaaa

SEQ ID NO: 154272 - DNA, 10 bp, Unknown
  misc_feature (1)..( 10): Result.004 file - promoters50/1012883
ttacaatgac

SEQ ID NO: 154273 - DNA, 10 bp, Unknown
  misc_feature (1)..( 10): Result.004 file - promoters50/1012883
aaggaaaaaa

SEQ ID NO: 154274 - DNA, 10 bp, Unknown
  misc_feature (1)..( 10): Result.004 file - promoters50/1012883
acccaaaaaa

SEQ ID NO: 154275 - DNA, 10 bp, Unknown
  misc_feature (1)..( 10): Result.004 file - promoters50/1012883
gtagatattt

SEQ ID NO: 154276 - DNA, 10 bp, Unknown
  misc_feature (1)..( 10): Result.004 file - promoters50/1012883
gtatatatta

SEQ ID NO: 154277 - DNA, 11 bp, Unknown
  misc_feature (1)..( 11): Result.004 file - promoters50/1012883
gcagatactta

SEQ ID NO: 154278 - DNA, 12 bp, Unknown
  misc_feature (1)..( 12): Result.004 file - promoters50/1012883
atgaataaattg

SEQ ID NO: 154279 - DNA, 12 bp, Unknown
  misc_feature (1)..( 12): Result.004 file - promoters50/1012883
tacgaaaaaatg

SEQ ID NO: 154280 - DNA, 12 bp, Unknown
  misc_feature (1)..( 12): Result.004 file - promoters50/1012906
ggtcttaaattc

SEQ ID NO: 154281 - DNA, 15 bp, Unknown
  misc_feature (1)..( 15): Result.004 file - promoters50/1012906
aaaaaaatgtttgat

SEQ ID NO: 154282 - DNA, 15 bp, Unknown
  misc_feature (1)..( 15): Result.004 file - promoters50/1012906
acacgaatatttttg

SEQ ID NO: 154283 - DNA, 15 bp, Unknown
  misc_feature (1)..( 15): Result.004 file - promoters50/1012906
aaaaacatgttggta

SEQ ID NO: 154284 - DNA, 15 bp, Unknown
  misc_feature (1)..( 15): Result.004 file - promoters50/1012906
taaaatatatttaat

SEQ ID NO: 154285 - DNA, 15 bp, Unknown
  misc_feature (1)..( 15): Result.004 file - promoters50/1012906
attgacatattttta

SEQ ID NO: 154286 - DNA, 15 bp, Unknown
  misc_feature (1)..( 15): Result.004 file - promoters50/1012906
aggaacatgggacat

SEQ ID NO: 154287 - DNA, 15 bp, Unknown
  misc_feature (1)..( 15): Result.004 file - promoters50/1012906
agttaaaaaatcttg

SEQ ID NO: 154288 - DNA, 15 bp, Unknown
  misc_feature (1)..( 15): Result.004 file - promoters50/1012906
agcatcttaattttg

SEQ ID NO: 154289 - DNA, 15 bp, Unknown
  misc_feature (1)..( 15): Result.004 file - promoters50/1012906
agtaaaaaaatcttg

SEQ ID NO: 154290 - DNA, 15 bp, Unknown
  misc_feature (1)..( 15): Result.004 file - promoters50/1012906
tgctttctaatttat

SEQ ID NO: 154291 - DNA, 15 bp, Unknown
  misc_feature (1)..( 15): Result.004 file - promoters50/1012906
aaccacttaacttta

SEQ ID NO: 154292 - DNA, 15 bp, Unknown
  misc_feature (1)..( 15): Result.004 file - promoters50/1012906
tttaaaaaaaaaaag

SEQ ID NO: 154293 - DNA, 15 bp, Unknown
  misc_feature (1)..( 15): Result.004 file - promoters50/1012906
agcaagtaaattcgg

SEQ ID NO: 154294 - DNA, 12 bp, Unknown
  misc_feature (1)..( 12): Result.004 file - promoters50/1012906
tatctgaaatat

SEQ ID NO: 154295 - DNA, 12 bp, Unknown
  misc_feature (1)..( 12): Result.004 file - promoters50/1012906
gaattgatataa

SEQ ID NO: 154296 - DNA, 12 bp, Unknown
  misc_feature (1)..( 12): Result.004 file - promoters50/1012906
gaatttataaat

SEQ ID NO: 154297 - DNA, 12 bp, Unknown
  misc_feature (1)..( 12): Result.004 file - promoters50/1012906
taatggatttaa

SEQ ID NO: 154298 - DNA, 12 bp, Unknown
  misc_feature (1)..( 12): Result.004 file - promoters50/1012906
ttatttatttct

SEQ ID NO: 154299 - DNA, 12 bp, Unknown
  misc_feature (1)..( 12): Result.004 file - promoters50/1012906
taatgtatcaga

SEQ ID NO: 154300 - DNA, 12 bp, Unknown
  misc_feature (1)..( 12): Result.004 file - promoters50/1012906
taacatatctat

SEQ ID NO: 154301 - DNA, 10 bp, Unknown
  misc_feature (1)..( 10): Result.004 file - promoters50/1012906
aaaaaatgtt

SEQ ID NO: 154302 - DNA, 10 bp, Unknown
  misc_feature (1)..( 10): Result.004 file - promoters50/1012906
ataaaatgca

SEQ ID NO: 154303 - DNA, 11 bp, Unknown
  misc_feature (1)..( 11): Result.004 file - promoters50/1012906
aaaaacatgtt

SEQ ID NO: 154304 - DNA, 11 bp, Unknown
  misc_feature (1)..( 11): Result.004 file - promoters50/1012906
tgaaaaattaa

SEQ ID NO: 154305 - DNA, 11 bp, Unknown
  misc_feature (1)..( 11): Result.004 file - promoters50/1012906
taaatcataca

SEQ ID NO: 154306 - DNA, 11 bp, Unknown
  misc_feature (1)..( 11): Result.004 file - promoters50/1012906
aggaacatggg

SEQ ID NO: 154307 - DNA, 23 bp, Unknown
  misc_feature (1)..( 23): Result.004 file - promoters50/1012906
tctgaaatattataatacattta

SEQ ID NO: 154308 - DNA, 23 bp, Unknown
  misc_feature (1)..( 23): Result.004 file - promoters50/1012906
attgacatatttttataaatagt

SEQ ID NO: 154309 - DNA, 23 bp, Unknown
  misc_feature (1)..( 23): Result.004 file - promoters50/1012906
gatgaaaaattaaaatatattta

SEQ ID NO: 154310 - DNA, 23 bp, Unknown
  misc_feature (1)..( 23): Result.004 file - promoters50/1012906
tttgacttattaacagaaaaaaa

SEQ ID NO: 154311 - DNA, 23 bp, Unknown
  misc_feature (1)..( 23): Result.004 file - promoters50/1012906
tttcacttctccattttctaaag

SEQ ID NO: 154312 - DNA, 23 bp, Unknown
  misc_feature (1)..( 23): Result.004 file - promoters50/1012906
cgctaataaaaacatgttggtat

SEQ ID NO: 154313 - DNA, 23 bp, Unknown
  misc_feature (1)..( 23): Result.004 file - promoters50/1012906
atggaaatggtcctataaggtcc

SEQ ID NO: 154314 - DNA, 21 bp, Unknown
  misc_feature (1)..( 21): Result.004 file - promoters50/1012906
tgaaatattataatacattta

SEQ ID NO: 154315 - DNA, 21 bp, Unknown
  misc_feature (1)..( 21): Result.004 file - promoters50/1012906
catatttttataaatagtaaa

SEQ ID NO: 154316 - DNA, 21 bp, Unknown
  misc_feature (1)..( 21): Result.004 file - promoters50/1012906
tgaaaaattaaaatatattta

SEQ ID NO: 154317 - DNA, 21 bp, Unknown
  misc_feature (1)..( 21): Result.004 file - promoters50/1012906
aatcatacacgaatatttttg

SEQ ID NO: 154318 - DNA, 21 bp, Unknown
  misc_feature (1)..( 21): Result.004 file - promoters50/1012906
ctccattttctaaagaattac

SEQ ID NO: 154319 - DNA, 21 bp, Unknown
  misc_feature (1)..( 21): Result.004 file - promoters50/1012906
gtcgctaataaaaacatgttg

SEQ ID NO: 154320 - DNA, 21 bp, Unknown
  misc_feature (1)..( 21): Result.004 file - promoters50/1012906
gtcgaaatggaaatggtccta

SEQ ID NO: 154321 - DNA, 11 bp, Unknown
  misc_feature (1)..( 11): Result.004 file - promoters50/1012906
atattataata

SEQ ID NO: 154322 - DNA, 11 bp, Unknown
  misc_feature (1)..( 11): Result.004 file - promoters50/1012906
aatttataaat

SEQ ID NO: 154323 - DNA, 11 bp, Unknown
  misc_feature (1)..( 11): Result.004 file - promoters50/1012906
ttcttataaat

SEQ ID NO: 154324 - DNA, 12 bp, Unknown
  misc_feature (1)..( 12): Result.004 file - promoters50/1012906
gaattgatataa

SEQ ID NO: 154325 - DNA, 12 bp, Unknown
  misc_feature (1)..( 12): Result.004 file - promoters50/1012906
gaagtgaagaga

SEQ ID NO: 154326 - DNA, 12 bp, Unknown
  misc_feature (1)..( 12): Result.004 file - promoters50/1012906
taatggatttaa

SEQ ID NO: 154327 - DNA, 15 bp, Unknown
  misc_feature (1)..( 15): Result.004 file - promoters50/1012906
ttagaattagaaaat

SEQ ID NO: 154328 - DNA, 15 bp, Unknown
  misc_feature (1)..( 15): Result.004 file - promoters50/1012906
aaagaatttataaat

SEQ ID NO: 154329 - DNA, 15 bp, Unknown
  misc_feature (1)..( 15): Result.004 file - promoters50/1012906
attgaattgatataa

SEQ ID NO: 154330 - DNA, 15 bp, Unknown
  misc_feature (1)..( 15): Result.004 file - promoters50/1012906
gtggaagtgaagaga

SEQ ID NO: 154331 - DNA, 15 bp, Unknown
  misc_feature (1)..( 15): Result.004 file - promoters50/1012906
taataatggatttaa

SEQ ID NO: 154332 - DNA, 15 bp, Unknown
  misc_feature (1)..( 15): Result.004 file - promoters50/1012906
gaagaatctgatgtt

SEQ ID NO: 154333 - DNA, 15 bp, Unknown
  misc_feature (1)..( 15): Result.004 file - promoters50/1012906
gaacaatctgcaata

SEQ ID NO: 154334 - DNA, 13 bp, Unknown
  misc_feature (1)..( 13): Result.004 file - promoters50/1012906
gtttaaatactag

SEQ ID NO: 154335 - DNA, 13 bp, Unknown
  misc_feature (1)..( 13): Result.004 file - promoters50/1012906
atataaatatttt

SEQ ID NO: 154336 - DNA, 13 bp, Unknown
  misc_feature (1)..( 13): Result.004 file - promoters50/1012906
ttttgaattcatt

SEQ ID NO: 154337 - DNA, 13 bp, Unknown
  misc_feature (1)..( 13): Result.004 file - promoters50/1012906
atataaatggata

SEQ ID NO: 154338 - DNA, 13 bp, Unknown
  misc_feature (1)..( 13): Result.004 file - promoters50/1012906
ttttgtatttatt

SEQ ID NO: 154339 - DNA, 13 bp, Unknown
  misc_feature (1)..( 13): Result.004 file - promoters50/1012943
tattgacttcgag

SEQ ID NO: 154340 - DNA, 17 bp, Unknown
  misc_feature (1)..( 17): Result.004 file - promoters50/1012943
actcatgatcccatttt

SEQ ID NO: 154341 - DNA, 17 bp, Unknown
  misc_feature (1)..( 17): Result.004 file - promoters50/1012943
caaaatgttccaatttt

SEQ ID NO: 154342 - DNA, 17 bp, Unknown
  misc_feature (1)..( 17): Result.004 file - promoters50/1012943
aaaaatgttgttgaaga

SEQ ID NO: 154343 - DNA, 17 bp, Unknown
  misc_feature (1)..( 17): Result.004 file - promoters50/1012943
gaaagtgttcttcacgg

SEQ ID NO: 154344 - DNA, 17 bp, Unknown
  misc_feature (1)..( 17): Result.004 file - promoters50/1012943
acatgggttcaaatcaa

SEQ ID NO: 154345 - DNA, 17 bp, Unknown
  misc_feature (1)..( 17): Result.004 file - promoters50/1012943
aaaaatttatatgattt

SEQ ID NO: 154346 - DNA, 17 bp, Unknown
  misc_feature (1)..( 17): Result.004 file - promoters50/1012943
caaaaagtttcaatggc

SEQ ID NO: 154347 - DNA, 17 bp, Unknown
  misc_feature (1)..( 17): Result.004 file - promoters50/1012947
gtaaataatccaggtca

SEQ ID NO: 154348 - DNA, 7 bp, Unknown
  misc_feature (1)..( 7): Result.004 file - promoters50/1012947
ccaaaag

SEQ ID NO: 154349 - DNA, 7 bp, Unknown
  misc_feature (1)..( 7): Result.004 file - promoters50/1012947
acaaaag

SEQ ID NO: 154350 - DNA, 7 bp, Unknown
  misc_feature (1)..( 7): Result.004 file - promoters50/1012947
acaaaaa

SEQ ID NO: 154351 - DNA, 7 bp, Unknown
  misc_feature (1)..( 7): Result.004 file - promoters50/1012947
aactatt

SEQ ID NO: 154352 - DNA, 7 bp, Unknown
  misc_feature (1)..( 7): Result.004 file - promoters50/1012947
aaccatt

SEQ ID NO: 154353 - DNA, 7 bp, Unknown
  misc_feature (1)..( 7): Result.004 file - promoters50/1012947
cactatt

SEQ ID NO: 154354 - DNA, 11 bp, Unknown
  misc_feature (1)..( 11): Result.004 file - promoters50/1012947
tactattaaag

SEQ ID NO: 154355 - DNA, 11 bp, Unknown
  misc_feature (1)..( 11): Result.004 file - promoters50/1012947
agttattaatc

SEQ ID NO: 154356 - DNA, 11 bp, Unknown
  misc_feature (1)..( 11): Result.004 file - promoters50/1012955
agtgattcatc

SEQ ID NO: 154357 - DNA, 11 bp, Unknown
  misc_feature (1)..( 11): Result.004 file - promoters50/1012955
aaaattaagtt

SEQ ID NO: 154358 - DNA, 11 bp, Unknown
  misc_feature (1)..( 11): Result.004 file - promoters50/1012955
ttaataaagtt

SEQ ID NO: 154359 - DNA, 11 bp, Unknown
  misc_feature (1)..( 11): Result.004 file - promoters50/1012955
tttatttagtt

SEQ ID NO: 154360 - DNA, 11 bp, Unknown
  misc_feature (1)..( 11): Result.004 file - promoters50/1012955
ttaattaattc

SEQ ID NO: 154361 - DNA, 12 bp, Unknown
  misc_feature (1)..( 12): Result.004 file - promoters50/1012955
tatattttaata

SEQ ID NO: 154362 - DNA, 12 bp, Unknown
  misc_feature (1)..( 12): Result.004 file - promoters50/1012955
tatatcttataa

SEQ ID NO: 154363 - DNA, 12 bp, Unknown
  misc_feature (1)..( 12): Result.004 file - promoters50/1012955
gctttcttatac

SEQ ID NO: 154364 - DNA, 12 bp, Unknown
  misc_feature (1)..( 12): Result.004 file - promoters50/1012964
gacttcatatac

SEQ ID NO: 154365 - DNA, 10 bp, Unknown
  misc_feature (1)..( 10): Result.004 file - promoters50/1012964
taacaagaat

SEQ ID NO: 154366 - DNA, 10 bp, Unknown
  misc_feature (1)..( 10): Result.004 file - promoters50/1012964
taacaaatac

SEQ ID NO: 154367 - DNA, 10 bp, Unknown
  misc_feature (1)..( 10): Result.004 file - promoters50/1012964
caacatgaat

SEQ ID NO: 154368 - DNA, 9 bp, Unknown
  misc_feature (1)..( 9): Result.004 file - promoters50/1012964
gttctaaaa

SEQ ID NO: 154369 - DNA, 9 bp, Unknown
  misc_feature (1)..( 9): Result.004 file - promoters50/1012964
tatctcaaa

SEQ ID NO: 154370 - DNA, 9 bp, Unknown
  misc_feature (1)..( 9): Result.004 file - promoters50/1012984
tatctcata

SEQ ID NO: 154371 - DNA, 9 bp, Unknown
  misc_feature (1)..( 9): Result.004 file - promoters50/1012984
atttgtgaa

SEQ ID NO: 154372 - DNA, 9 bp, Unknown
  misc_feature (1)..( 9): Result.004 file - promoters50/1012984
gtttttgaa

SEQ ID NO: 154373 - DNA, 9 bp, Unknown
  misc_feature (1)..( 9): Result.004 file - promoters50/1012984
atttgttaa

SEQ ID NO: 154374 - DNA, 9 bp, Unknown
  misc_feature (1)..( 9): Result.004 file - promoters50/1012984
ttttatgag

SEQ ID NO: 154375 - DNA, 8 bp, Unknown
  misc_feature (1)..( 8): Result.004 file - promoters50/1012984
ttataaat

SEQ ID NO: 154376 - DNA, 8 bp, Unknown
  misc_feature (1)..( 8): Result.004 file - promoters50/1012984
atataaaa

SEQ ID NO: 154377 - DNA, 8 bp, Unknown
  misc_feature (1)..( 8): Result.004 file - promoters50/1012984
cgataaaa

SEQ ID NO: 154378 - DNA, 8 bp, Unknown
  misc_feature (1)..( 8): Result.004 file - promoters50/1012984
atacaaaa

SEQ ID NO: 154379 - DNA, 13 bp, Unknown
  misc_feature (1)..( 13): Result.004 file - promoters50/1012984
tattagtttataa

SEQ ID NO: 154380 - DNA, 13 bp, Unknown
  misc_feature (1)..( 13): Result.004 file - promoters50/1012984
tattattttatga

SEQ ID NO: 154381 - DNA, 13 bp, Unknown
  misc_feature (1)..( 13): Result.004 file - promoters50/1012984
aagcggtttgtga

SEQ ID NO: 154382 - DNA, 13 bp, Unknown
  misc_feature (1)..( 13): Result.004 file - promoters50/1012988
acttaatttgtta

SEQ ID NO: 154383 - DNA, 8 bp, Unknown
  misc_feature (1)..( 8): Result.004 file - promoters50/1012988
taaatcga

SEQ ID NO: 154384 - DNA, 8 bp, Unknown
  misc_feature (1)..( 8): Result.004 file - promoters50/1012988
caaatcga

SEQ ID NO: 154385 - DNA, 8 bp, Unknown
  misc_feature (1)..( 8): Result.004 file - promoters50/1012988
caaatctg

SEQ ID NO: 154386 - DNA, 9 bp, Unknown
  misc_feature (1)..( 9): Result.004 file - promoters50/1012988
tttaaatta

SEQ ID NO: 154387 - DNA, 9 bp, Unknown
  misc_feature (1)..( 9): Result.004 file - promoters50/1012988
tttaaaccg

SEQ ID NO: 154388 - DNA, 9 bp, Unknown
  misc_feature (1)..( 9): Result.004 file - promoters50/1012988
cttaacccg

SEQ ID NO: 154389 - DNA, 9 bp, Unknown
  misc_feature (1)..( 9): Result.004 file - promoters50/1012988
attgatcaa

SEQ ID NO: 154390 - DNA, 9 bp, Unknown
  misc_feature (1)..( 9): Result.004 file - promoters50/1012988
attcatcag

SEQ ID NO: 154391 - DNA, 9 bp, Unknown
  misc_feature (1)..( 9): Result.004 file - promoters50/1012998
gttcctcag

SEQ ID NO: 154392 - DNA, 9 bp, Unknown
  misc_feature (1)..( 9): Result.004 file - promoters50/1012998
gtaaataag

SEQ ID NO: 154393 - DNA, 9 bp, Unknown
  misc_feature (1)..( 9): Result.004 file - promoters50/1012998
taaaagaag

SEQ ID NO: 154394 - DNA, 9 bp, Unknown
  misc_feature (1)..( 9): Result.004 file - promoters50/1012998
taaaagaat

SEQ ID NO: 154395 - DNA, 12 bp, Unknown
  misc_feature (1)..( 12): Result.004 file - promoters50/1012998
cactctctctct

SEQ ID NO: 154396 - DNA, 12 bp, Unknown
  misc_feature (1)..( 12): Result.004 file - promoters50/1012998
cactttctctct

SEQ ID NO: 154397 - DNA, 12 bp, Unknown
  misc_feature (1)..( 12): Result.004 file - promoters50/1012998
aactttctagca

SEQ ID NO: 154398 - DNA, 8 bp, Unknown
  misc_feature (1)..( 8): Result.004 file - promoters50/1012998
ttttaatt

SEQ ID NO: 154399 - DNA, 8 bp, Unknown
  misc_feature (1)..( 8): Result.004 file - promoters50/1012998
ttttaact

SEQ ID NO: 154400 - DNA, 8 bp, Unknown
  misc_feature (1)..( 8): Result.004 file - promoters50/1012998
atttaatt

SEQ ID NO: 154401 - DNA, 8 bp, Unknown
  misc_feature (1)..( 8): Result.004 file - promoters50/1012998
aaaaaaaa

SEQ ID NO: 154402 - DNA, 8 bp, Unknown
  misc_feature (1)..( 8): Result.004 file - promoters50/1012998
aaaagaaa

SEQ ID NO: 154403 - DNA, 8 bp, Unknown
  misc_feature (1)..( 8): Result.004 file - promoters50/1012998
aaaaacat

SEQ ID NO: 154404 - DNA, 11 bp, Unknown
  misc_feature (1)..( 11): Result.004 file - promoters50/1012998
aataagtatct

SEQ ID NO: 154405 - DNA, 11 bp, Unknown
  misc_feature (1)..( 11): Result.004 file - promoters50/1012998
taaaagaatct

SEQ ID NO: 154406 - DNA, 11 bp, Unknown
  misc_feature (1)..( 11): Result.004 file - promoters50/1012998
taaaagaagaa

SEQ ID NO: 154407 - DNA, 8 bp, Unknown
  misc_feature (1)..( 8): Result.004 file - promoters50/1012998
tatatata

SEQ ID NO: 154408 - DNA, 8 bp, Unknown
  misc_feature (1)..( 8): Result.004 file - promoters50/1012998
tataaata

SEQ ID NO: 154409 - DNA, 8 bp, Unknown
  misc_feature (1)..( 8): Result.004 file - promoters50/1013013
tataaatc

SEQ ID NO: 154410 - DNA, 13 bp, Unknown
  misc_feature (1)..( 13): Result.004 file - promoters50/1013013
agttattaatcac

SEQ ID NO: 154411 - DNA, 13 bp, Unknown
  misc_feature (1)..( 13): Result.004 file - promoters50/1013013
ataatttaatcac

SEQ ID NO: 154412 - DNA, 13 bp, Unknown
  misc_feature (1)..( 13): Result.004 file - promoters50/1013013
agtgattcatctt

SEQ ID NO: 154413 - DNA, 9 bp, Unknown
  misc_feature (1)..( 9): Result.004 file - promoters50/1013013
tttattaaa

SEQ ID NO: 154414 - DNA, 9 bp, Unknown
  misc_feature (1)..( 9): Result.004 file - promoters50/1013013
actatgaaa

SEQ ID NO: 154415 - DNA, 9 bp, Unknown
  misc_feature (1)..( 9): Result.004 file - promoters50/1013013
ttttttaaa

SEQ ID NO: 154416 - DNA, 12 bp, Unknown
  misc_feature (1)..( 12): Result.004 file - promoters50/1013013
aaaagttttatt

SEQ ID NO: 154417 - DNA, 12 bp, Unknown
  misc_feature (1)..( 12): Result.004 file - promoters50/1013013
aaaagttcatct

SEQ ID NO: 154418 - DNA, 12 bp, Unknown
  misc_feature (1)..( 12): Result.004 file - promoters50/1013013
caaacttcatct

SEQ ID NO: 154419 - DNA, 8 bp, Unknown
  misc_feature (1)..( 8): Result.004 file - promoters50/1013013
ctttctta

SEQ ID NO: 154420 - DNA, 8 bp, Unknown
  misc_feature (1)..( 8): Result.004 file - promoters50/1013013
ttttttta

SEQ ID NO: 154421 - DNA, 9 bp, Unknown
  misc_feature (1)..( 9): Result.004 file - promoters50/1013016
attgttttt

SEQ ID NO: 154422 - DNA, 8 bp, Unknown
  misc_feature (1)..( 8): Result.004 file - promoters50/1013016
agaaatga

SEQ ID NO: 154423 - DNA, 8 bp, Unknown
  misc_feature (1)..( 8): Result.004 file - promoters50/1013016
tgaattga

SEQ ID NO: 154424 - DNA, 8 bp, Unknown
  misc_feature (1)..( 8): Result.004 file - promoters50/1013016
agacatgg

SEQ ID NO: 154425 - DNA, 10 bp, Unknown
  misc_feature (1)..( 10): Result.004 file - promoters50/1013016
gatgaatccg

SEQ ID NO: 154426 - DNA, 10 bp, Unknown
  misc_feature (1)..( 10): Result.004 file - promoters50/1013016
gatcaattga

SEQ ID NO: 154427 - DNA, 10 bp, Unknown
  misc_feature (1)..( 10): Result.004 file - promoters50/1013016
tttcatttga

SEQ ID NO: 154428 - DNA, 13 bp, Unknown
  misc_feature (1)..( 13): Result.004 file - promoters50/1013016
ttagagattctat

SEQ ID NO: 154429 - DNA, 13 bp, Unknown
  misc_feature (1)..( 13): Result.004 file - promoters50/1013016
aaagacattatat

SEQ ID NO: 154430 - DNA, 13 bp, Unknown
  misc_feature (1)..( 13): Result.004 file - promoters50/1013016
aaaaacaaaacaa

SEQ ID NO: 154431 - DNA, 8 bp, Unknown
  misc_feature (1)..( 8): Result.004 file - promoters50/1013016
gaacagaa

SEQ ID NO: 154432 - DNA, 8 bp, Unknown
  misc_feature (1)..( 8): Result.004 file - promoters50/1013016
acacagaa

SEQ ID NO: 154433 - DNA, 8 bp, Unknown
  misc_feature (1)..( 8): Result.004 file - promoters50/1013016
gaaaagat

SEQ ID NO: 154434 - DNA, 8 bp, Unknown
  misc_feature (1)..( 8): Result.004 file - promoters50/1013016
ttccaata

SEQ ID NO: 154435 - DNA, 8 bp, Unknown
  misc_feature (1)..( 8): Result.004 file - promoters50/1013016
ttctaatc

SEQ ID NO: 154436 - DNA, 8 bp, Unknown
  misc_feature (1)..( 8): Result.004 file - promoters50/1013128
ttcaaata

SEQ ID NO: 154437 - DNA, 26 bp, Unknown
  misc_feature (1)..( 26): Result.004 file - promoters50/1013128
atagtttgataaatatgtaaaaatca

SEQ ID NO: 154438 - DNA, 26 bp, Unknown
  misc_feature (1)..( 26): Result.004 file - promoters50/1013128
aagaattcataaacatggaatttgtg

SEQ ID NO: 154439 - DNA, 26 bp, Unknown
  misc_feature (1)..( 26): Result.004 file - promoters50/1013128
tatctctatttaatatgcaaaaatca

SEQ ID NO: 154440 - DNA, 26 bp, Unknown
  misc_feature (1)..( 26): Result.004 file - promoters50/1013128
gacgtttgataaaagaaaggtcaaga

SEQ ID NO: 154441 - DNA, 26 bp, Unknown
  misc_feature (1)..( 26): Result.004 file - promoters50/1013128
atcttttcaaaaaaaggtcttcacca

SEQ ID NO: 154442 - DNA, 26 bp, Unknown
  misc_feature (1)..( 26): Result.004 file - promoters50/1013128
gacttttgagtctatttcaatttttg

SEQ ID NO: 154443 - DNA, 26 bp, Unknown
  misc_feature (1)..( 26): Result.004 file - promoters50/1013128
aaaaaggataaaattagtgaactttt

SEQ ID NO: 154444 - DNA, 26 bp, Unknown
  misc_feature (1)..( 26): Result.004 file - promoters50/1013128
aatttgaatgaaactagataatcctc

SEQ ID NO: 154445 - DNA, 11 bp, Unknown
  misc_feature (1)..( 11): Result.004 file - promoters50/1013128
ctaaaataaag

SEQ ID NO: 154446 - DNA, 11 bp, Unknown
  misc_feature (1)..( 11): Result.004 file - promoters50/1013128
agaaaaaaaag

SEQ ID NO: 154447 - DNA, 11 bp, Unknown
  misc_feature (1)..( 11): Result.004 file - promoters50/1013128
aaaaaatagtt

SEQ ID NO: 154448 - DNA, 11 bp, Unknown
  misc_feature (1)..( 11): Result.004 file - promoters50/1013128
cgaaaataaac

SEQ ID NO: 154449 - DNA, 11 bp, Unknown
  misc_feature (1)..( 11): Result.004 file - promoters50/1013128
attaaataata

SEQ ID NO: 154450 - DNA, 11 bp, Unknown
  misc_feature (1)..( 11): Result.004 file - promoters50/1013128
ggaagagaaag

SEQ ID NO: 154451 - DNA, 11 bp, Unknown
  misc_feature (1)..( 11): Result.004 file - promoters50/1013131
tgaaaaaatgc

SEQ ID NO: 154452 - DNA, 11 bp, Unknown
  misc_feature (1)..( 11): Result.004 file - promoters50/1013131
attaataatcc

SEQ ID NO: 154453 - DNA, 11 bp, Unknown
  misc_feature (1)..( 11): Result.004 file - promoters50/1013131
ctccatagtcc

SEQ ID NO: 154454 - DNA, 11 bp, Unknown
  misc_feature (1)..( 11): Result.004 file - promoters50/1013131
taaaataatct

SEQ ID NO: 154455 - DNA, 11 bp, Unknown
  misc_feature (1)..( 11): Result.004 file - promoters50/1013131
gaaaatgatcg

SEQ ID NO: 154456 - DNA, 11 bp, Unknown
  misc_feature (1)..( 11): Result.004 file - promoters50/1013131
taaagtaattt

SEQ ID NO: 154457 - DNA, 10 bp, Unknown
  misc_feature (1)..( 10): Result.004 file - promoters50/1013131
tttatattta

SEQ ID NO: 154458 - DNA, 10 bp, Unknown
  misc_feature (1)..( 10): Result.004 file - promoters50/1013131
tttagatttt

SEQ ID NO: 154459 - DNA, 10 bp, Unknown
  misc_feature (1)..( 10): Result.004 file - promoters50/1013131
tttacatttt

SEQ ID NO: 154460 - DNA, 10 bp, Unknown
  misc_feature (1)..( 10): Result.004 file - promoters50/1013131
ggtattttta

SEQ ID NO: 154461 - DNA, 10 bp, Unknown
  misc_feature (1)..( 10): Result.004 file - promoters50/1013131
attaggttta

SEQ ID NO: 154462 - DNA, 9 bp, Unknown
  misc_feature (1)..( 9): Result.004 file - promoters50/1013131
aaattatat

SEQ ID NO: 154463 - DNA, 9 bp, Unknown
  misc_feature (1)..( 9): Result.004 file - promoters50/1013131
aaagtatta

SEQ ID NO: 154464 - DNA, 9 bp, Unknown
  misc_feature (1)..( 9): Result.004 file - promoters50/1013131
aaatcatac

SEQ ID NO: 154465 - DNA, 9 bp, Unknown
  misc_feature (1)..( 9): Result.004 file - promoters50/1013131
attttatta

SEQ ID NO: 154466 - DNA, 9 bp, Unknown
  misc_feature (1)..( 9): Result.004 file - promoters50/1013131
cttttaatt

SEQ ID NO: 154467 - DNA, 13 bp, Unknown
  misc_feature (1)..( 13): Result.004 file - promoters50/1013131
cgaataaattgta

SEQ ID NO: 154468 - DNA, 13 bp, Unknown
  misc_feature (1)..( 13): Result.004 file - promoters50/1013131
acaatgaatacca

SEQ ID NO: 154469 - DNA, 13 bp, Unknown
  misc_feature (1)..( 13): Result.004 file - promoters50/1013131
tgaacaaaagttt

SEQ ID NO: 154470 - DNA, 13 bp, Unknown
  misc_feature (1)..( 13): Result.004 file - promoters50/1013131
taaataaagtgta

SEQ ID NO: 154471 - DNA, 13 bp, Unknown
  misc_feature (1)..( 13): Result.004 file - promoters50/1013208
tgaatacttttaa

SEQ ID NO: 154472 - DNA, 13 bp, Unknown
  misc_feature (1)..( 13): Result.004 file - promoters50/1013208
ctttttttttagt

SEQ ID NO: 154473 - DNA, 13 bp, Unknown
  misc_feature (1)..( 13): Result.004 file - promoters50/1013208
atttttttctata

SEQ ID NO: 154474 - DNA, 13 bp, Unknown
  misc_feature (1)..( 13): Result.004 file - promoters50/1013208
cttcttttgtagt

SEQ ID NO: 154475 - DNA, 13 bp, Unknown
  misc_feature (1)..( 13): Result.004 file - promoters50/1013208
atttttacaagac

SEQ ID NO: 154476 - DNA, 13 bp, Unknown
  misc_feature (1)..( 13): Result.004 file - promoters50/1013208
ccccctatgtagt

SEQ ID NO: 154477 - DNA, 13 bp, Unknown
  misc_feature (1)..( 13): Result.004 file - promoters50/1013208
cttcttattgaat

SEQ ID NO: 154478 - DNA, 13 bp, Unknown
  misc_feature (1)..( 13): Result.004 file - promoters50/1013208
attattaggcctt

SEQ ID NO: 154479 - DNA, 14 bp, Unknown
  misc_feature (1)..( 14): Result.004 file - promoters50/1013208
gtataataaatctt

SEQ ID NO: 154480 - DNA, 14 bp, Unknown
  misc_feature (1)..( 14): Result.004 file - promoters50/1013208
ttttaaaaaacttt

SEQ ID NO: 154481 - DNA, 14 bp, Unknown
  misc_feature (1)..( 14): Result.004 file - promoters50/1013208
gtgacatatatctt

SEQ ID NO: 154482 - DNA, 14 bp, Unknown
  misc_feature (1)..( 14): Result.004 file - promoters50/1013208
aatccataaattaa

SEQ ID NO: 154483 - DNA, 14 bp, Unknown
  misc_feature (1)..( 14): Result.004 file - promoters50/1013208
ttttaaaaacgaac

SEQ ID NO: 154484 - DNA, 14 bp, Unknown
  misc_feature (1)..( 14): Result.004 file - promoters50/1013208
ggagtctctatctt

SEQ ID NO: 154485 - DNA, 12 bp, Unknown
  misc_feature (1)..( 12): Result.004 file - promoters50/1013208
tttttttttagt

SEQ ID NO: 154486 - DNA, 12 bp, Unknown
  misc_feature (1)..( 12): Result.004 file - promoters50/1013208
tatatttttaca

SEQ ID NO: 154487 - DNA, 13 bp, Unknown
  misc_feature (1)..( 13): Result.004 file - promoters50/1013208
cttcttttgtagt

SEQ ID NO: 154488 - DNA, 13 bp, Unknown
  misc_feature (1)..( 13): Result.004 file - promoters50/1013208
atttttttgacat

SEQ ID NO: 154489 - DNA, 13 bp, Unknown
  misc_feature (1)..( 13): Result.004 file - promoters50/1013208
ccccctatgtagt

SEQ ID NO: 154490 - DNA, 13 bp, Unknown
  misc_feature (1)..( 13): Result.004 file - promoters50/1013208
cttcttattgaat

SEQ ID NO: 154491 - DNA, 13 bp, Unknown
  misc_feature (1)..( 13): Result.004 file - promoters50/1013208
gacaattattagg

SEQ ID NO: 154492 - DNA, 11 bp, Unknown
  misc_feature (1)..( 11): Result.004 file - promoters50/1013208
tgttgagtttc

SEQ ID NO: 154493 - DNA, 11 bp, Unknown
  misc_feature (1)..( 11): Result.004 file - promoters50/1013208
acagtagtttc

SEQ ID NO: 154494 - DNA, 11 bp, Unknown
  misc_feature (1)..( 11): Result.004 file - promoters50/1013208
aaagtaattta

SEQ ID NO: 154495 - DNA, 11 bp, Unknown
  misc_feature (1)..( 11): Result.004 file - promoters50/1013208
aaaataaacta

SEQ ID NO: 154496 - DNA, 11 bp, Unknown
  misc_feature (1)..( 11): Result.004 file - promoters50/1013208
aaaatagcctg

SEQ ID NO: 154497 - DNA, 11 bp, Unknown
  misc_feature (1)..( 11): Result.004 file - promoters50/1013242
ataataaataa

SEQ ID NO: 154498 - DNA, 10 bp, Unknown
  misc_feature (1)..( 10): Result.004 file - promoters50/1013242
ttgtaaagat

SEQ ID NO: 154499 - DNA, 10 bp, Unknown
  misc_feature (1)..( 10): Result.004 file - promoters50/1013242
aaataaagag

SEQ ID NO: 154500 - DNA, 10 bp, Unknown
  misc_feature (1)..( 10): Result.004 file - promoters50/1013242
aaaaaaagat

SEQ ID NO: 154501 - DNA, 10 bp, Unknown
  misc_feature (1)..( 10): Result.004 file - promoters50/1013242
cagtagagaa

SEQ ID NO: 154502 - DNA, 10 bp, Unknown
  misc_feature (1)..( 10): Result.004 file - promoters50/1013242
tagtagaaat

SEQ ID NO: 154503 - DNA, 10 bp, Unknown
  misc_feature (1)..( 10): Result.004 file - promoters50/1013242
cagttgagat

SEQ ID NO: 154504 - DNA, 13 bp, Unknown
  misc_feature (1)..( 13): Result.004 file - promoters50/1013242
ggtataaaaagaa

SEQ ID NO: 154505 - DNA, 13 bp, Unknown
  misc_feature (1)..( 13): Result.004 file - promoters50/1013242
tatatcaaaattt

SEQ ID NO: 154506 - DNA, 13 bp, Unknown
  misc_feature (1)..( 13): Result.004 file - promoters50/1013242
ggtgtaatgagta

SEQ ID NO: 154507 - DNA, 13 bp, Unknown
  misc_feature (1)..( 13): Result.004 file - promoters50/1013242
tgtctcaaaatgt

SEQ ID NO: 154508 - DNA, 13 bp, Unknown
  misc_feature (1)..( 13): Result.004 file - promoters50/1013242
ctttccaaaatgt

SEQ ID NO: 154509 - DNA, 13 bp, Unknown
  misc_feature (1)..( 13): Result.004 file - promoters50/1013242
tgaggcaatatga

SEQ ID NO: 154510 - DNA, 11 bp, Unknown
  misc_feature (1)..( 11): Result.004 file - promoters50/1013242
aatccaaagct

SEQ ID NO: 154511 - DNA, 11 bp, Unknown
  misc_feature (1)..( 11): Result.004 file - promoters50/1013242
aatccagaaag

SEQ ID NO: 154512 - DNA, 11 bp, Unknown
  misc_feature (1)..( 11): Result.004 file - promoters50/1013242
tatccaagtta

SEQ ID NO: 154513 - DNA, 11 bp, Unknown
  misc_feature (1)..( 11): Result.004 file - promoters50/1013242
tatccaactta

SEQ ID NO: 154514 - DNA, 11 bp, Unknown
  misc_feature (1)..( 11): Result.004 file - promoters50/1013242
aatctaagatg

SEQ ID NO: 154515 - DNA, 11 bp, Unknown
  misc_feature (1)..( 11): Result.004 file - promoters50/1013274
tatccaacaaa

SEQ ID NO: 154516 - DNA, 9 bp, Unknown
  misc_feature (1)..( 9): Result.004 file - promoters50/1013274
actataaag

SEQ ID NO: 154517 - DNA, 9 bp, Unknown
  misc_feature (1)..( 9): Result.004 file - promoters50/1013274
aatattaag

SEQ ID NO: 154518 - DNA, 9 bp, Unknown
  misc_feature (1)..( 9): Result.004 file - promoters50/1013274
tctagaaaa

SEQ ID NO: 154519 - DNA, 9 bp, Unknown
  misc_feature (1)..( 9): Result.004 file - promoters50/1013274
aataataac

SEQ ID NO: 154520 - DNA, 9 bp, Unknown
  misc_feature (1)..( 9): Result.004 file - promoters50/1013274
ccgagaaaa

SEQ ID NO: 154521 - DNA, 9 bp, Unknown
  misc_feature (1)..( 9): Result.004 file - promoters50/1013274
aaaagaaaa

SEQ ID NO: 154522 - DNA, 18 bp, Unknown
  misc_feature (1)..( 18): Result.004 file - promoters50/1013274
cgctccatttcgtacatt

SEQ ID NO: 154523 - DNA, 18 bp, Unknown
  misc_feature (1)..( 18): Result.004 file - promoters50/1013274
gtgtccttttttgacgca

SEQ ID NO: 154524 - DNA, 18 bp, Unknown
  misc_feature (1)..( 18): Result.004 file - promoters50/1013274
attttctttttgatattt

SEQ ID NO: 154525 - DNA, 18 bp, Unknown
  misc_feature (1)..( 18): Result.004 file - promoters50/1013274
caaacgatttctgacgtt

SEQ ID NO: 154526 - DNA, 18 bp, Unknown
  misc_feature (1)..( 18): Result.004 file - promoters50/1013274
attttcatttgtatacca

SEQ ID NO: 154527 - DNA, 18 bp, Unknown
  misc_feature (1)..( 18): Result.004 file - promoters50/1013274
tatctattttagattttt

SEQ ID NO: 154528 - DNA, 18 bp, Unknown
  misc_feature (1)..( 18): Result.004 file - promoters50/1013274
cataccatttttgttcca

SEQ ID NO: 154529 - DNA, 18 bp, Unknown
  misc_feature (1)..( 18): Result.004 file - promoters50/1013274
taatatattcttgctgtt

SEQ ID NO: 154530 - DNA, 11 bp, Unknown
  misc_feature (1)..( 11): Result.004 file - promoters50/1013274
ctttgatcatt

SEQ ID NO: 154531 - DNA, 11 bp, Unknown
  misc_feature (1)..( 11): Result.004 file - promoters50/1013274
ttttgatattt

SEQ ID NO: 154532 - DNA, 11 bp, Unknown
  misc_feature (1)..( 11): Result.004 file - promoters50/1013274
gtttgattgtg

SEQ ID NO: 154533 - DNA, 11 bp, Unknown
  misc_feature (1)..( 11): Result.004 file - promoters50/1013274
atttgattttc

SEQ ID NO: 154534 - DNA, 12 bp, Unknown
  misc_feature (1)..( 12): Result.004 file - promoters50/1013274
tttctgacgttt

SEQ ID NO: 154535 - DNA, 13 bp, Unknown
  misc_feature (1)..( 13): Result.004 file - promoters50/1013274
attttagattttt

SEQ ID NO: 154536 - DNA, 13 bp, Unknown
  misc_feature (1)..( 13): Result.004 file - promoters50/1013274
atttttgttccat

SEQ ID NO: 154537 - DNA, 13 bp, Unknown
  misc_feature (1)..( 13): Result.004 file - promoters50/1013274
attcttgctgttc

SEQ ID NO: 154538 - DNA, 11 bp, Unknown
  misc_feature (1)..( 11): Result.004 file - promoters50/1013274
catttttcttt

SEQ ID NO: 154539 - DNA, 11 bp, Unknown
  misc_feature (1)..( 11): Result.004 file - promoters50/1013274
actttctctga

SEQ ID NO: 154540 - DNA, 11 bp, Unknown
  misc_feature (1)..( 11): Result.004 file - promoters50/1013274
catttttgttc

SEQ ID NO: 154541 - DNA, 11 bp, Unknown
  misc_feature (1)..( 11): Result.004 file - promoters50/1013274
gattttttttt

SEQ ID NO: 154542 - DNA, 11 bp, Unknown
  misc_feature (1)..( 11): Result.004 file - promoters50/1013274
cttttttgacg

SEQ ID NO: 154543 - DNA, 11 bp, Unknown
  misc_feature (1)..( 11): Result.004 file - promoters50/1013274
gatttctgacg

SEQ ID NO: 154544 - DNA, 11 bp, Unknown
  misc_feature (1)..( 11): Result.004 file - promoters50/1013274
tattcttgctg

SEQ ID NO: 154545 - DNA, 14 bp, Unknown
  misc_feature (1)..( 14): Result.004 file - promoters50/1013274
aactttaaatattg

SEQ ID NO: 154546 - DNA, 14 bp, Unknown
  misc_feature (1)..( 14): Result.004 file - promoters50/1013274
aacttgaaattctg

SEQ ID NO: 154547 - DNA, 14 bp, Unknown
  misc_feature (1)..( 14): Result.004 file - promoters50/1013274
ggctttaaccaacg

SEQ ID NO: 154548 - DNA, 14 bp, Unknown
  misc_feature (1)..( 14): Result.004 file - promoters50/1013274
aaaaagaaattaaa

SEQ ID NO: 154549 - DNA, 14 bp, Unknown
  misc_feature (1)..( 14): Result.004 file - promoters50/1013274
aaacccaagacatt

SEQ ID NO: 154550 - DNA, 14 bp, Unknown
  misc_feature (1)..( 14): Result.004 file - promoters50/1013274
aatataaagccata

SEQ ID NO: 154551 - DNA, 14 bp, Unknown
  misc_feature (1)..( 14): Result.004 file - promoters50/1013274
ttttttaacaattc

SEQ ID NO: 154552 - DNA, 11 bp, Unknown
  misc_feature (1)..( 11): Result.004 file - promoters50/1013274
aattttcactc

SEQ ID NO: 154553 - DNA, 11 bp, Unknown
  misc_feature (1)..( 11): Result.004 file - promoters50/1013274
gattttcattt

SEQ ID NO: 154554 - DNA, 11 bp, Unknown
  misc_feature (1)..( 11): Result.004 file - promoters50/1013274
ttgtttgattg

SEQ ID NO: 154555 - DNA, 11 bp, Unknown
  misc_feature (1)..( 11): Result.004 file - promoters50/1013274
taatatgattg

SEQ ID NO: 154556 - DNA, 11 bp, Unknown
  misc_feature (1)..( 11): Result.004 file - promoters50/1013274
tattttctttt

SEQ ID NO: 154557 - DNA, 11 bp, Unknown
  misc_feature (1)..( 11): Result.004 file - promoters50/1013274
tattttagatt

SEQ ID NO: 154558 - DNA, 13 bp, Unknown
  misc_feature (1)..( 13): Result.004 file - promoters50/1013274
ttatctatttttt

SEQ ID NO: 154559 - DNA, 13 bp, Unknown
  misc_feature (1)..( 13): Result.004 file - promoters50/1013274
ttatatatgtttc

SEQ ID NO: 154560 - DNA, 13 bp, Unknown
  misc_feature (1)..( 13): Result.004 file - promoters50/1013274
tgttctattaagg

SEQ ID NO: 154561 - DNA, 13 bp, Unknown
  misc_feature (1)..( 13): Result.004 file - promoters50/1013274
ttatctatttaac

SEQ ID NO: 154562 - DNA, 13 bp, Unknown
  misc_feature (1)..( 13): Result.004 file - promoters50/1013274
tgttccattttcg

SEQ ID NO: 154563 - DNA, 13 bp, Unknown
  misc_feature (1)..( 13): Result.004 file - promoters50/1013310
ttgtaaatgtttc

SEQ ID NO: 154564 - DNA, 8 bp, Unknown
  misc_feature (1)..( 8): Result.004 file - promoters50/1013310
taaatatt

SEQ ID NO: 154565 - DNA, 8 bp, Unknown
  misc_feature (1)..( 8): Result.004 file - promoters50/1013310
aaaatatc

SEQ ID NO: 154566 - DNA, 8 bp, Unknown
  misc_feature (1)..( 8): Result.004 file - promoters50/1013310
taaatata

SEQ ID NO: 154567 - DNA, 8 bp, Unknown
  misc_feature (1)..( 8): Result.004 file - promoters50/1013310
taaatagc

SEQ ID NO: 154568 - DNA, 8 bp, Unknown
  misc_feature (1)..( 8): Result.004 file - promoters50/1013314
acaatata

SEQ ID NO: 154569 - DNA, 13 bp, Unknown
  misc_feature (1)..( 13): Result.004 file - promoters50/1013314
ttgaaattttatg

SEQ ID NO: 154570 - DNA, 13 bp, Unknown
  misc_feature (1)..( 13): Result.004 file - promoters50/1013314
aaatatttttatg

SEQ ID NO: 154571 - DNA, 13 bp, Unknown
  misc_feature (1)..( 13): Result.004 file - promoters50/1013314
acatatttttata

SEQ ID NO: 154572 - DNA, 13 bp, Unknown
  misc_feature (1)..( 13): Result.004 file - promoters50/1013314
aaatatttttaat

SEQ ID NO: 154573 - DNA, 13 bp, Unknown
  misc_feature (1)..( 13): Result.004 file - promoters50/1013314
ctttttttttaac

SEQ ID NO: 154574 - DNA, 13 bp, Unknown
  misc_feature (1)..( 13): Result.004 file - promoters50/1013314
caacatttttttc

SEQ ID NO: 154575 - DNA, 14 bp, Unknown
  misc_feature (1)..( 14): Result.004 file - promoters50/1013314
aaatatttttattt

SEQ ID NO: 154576 - DNA, 14 bp, Unknown
  misc_feature (1)..( 14): Result.004 file - promoters50/1013314
taagatttatatga

SEQ ID NO: 154577 - DNA, 14 bp, Unknown
  misc_feature (1)..( 14): Result.004 file - promoters50/1013314
caacatttttttca

SEQ ID NO: 154578 - DNA, 14 bp, Unknown
  misc_feature (1)..( 14): Result.004 file - promoters50/1013314
gaaacttttttttt

SEQ ID NO: 154579 - DNA, 14 bp, Unknown
  misc_feature (1)..( 14): Result.004 file - promoters50/1013314
acatatttttataa

SEQ ID NO: 154580 - DNA, 14 bp, Unknown
  misc_feature (1)..( 14): Result.004 file - promoters50/1013314
aaatatttttaata

SEQ ID NO: 154581 - DNA, 14 bp, Unknown
  misc_feature (1)..( 14): Result.004 file - promoters50/1013314
agttaaagacttta

SEQ ID NO: 154582 - DNA, 14 bp, Unknown
  misc_feature (1)..( 14): Result.004 file - promoters50/1013314
aaaaaaagaattta

SEQ ID NO: 154583 - DNA, 14 bp, Unknown
  misc_feature (1)..( 14): Result.004 file - promoters50/1013314
cataagagaatttc

SEQ ID NO: 154584 - DNA, 14 bp, Unknown
  misc_feature (1)..( 14): Result.004 file - promoters50/1013314
ttcaaaagatttat

SEQ ID NO: 154585 - DNA, 14 bp, Unknown
  misc_feature (1)..( 14): Result.004 file - promoters50/1013314
gatttaagaatatt

SEQ ID NO: 154586 - DNA, 14 bp, Unknown
  misc_feature (1)..( 14): Result.004 file - promoters50/1013314
aaaaaaaaaataca

SEQ ID NO: 154587 - DNA, 12 bp, Unknown
  misc_feature (1)..( 12): Result.004 file - promoters50/1013314
ttaaatattttt

SEQ ID NO: 154588 - DNA, 12 bp, Unknown
  misc_feature (1)..( 12): Result.004 file - promoters50/1013314
ataattatccaa

SEQ ID NO: 154589 - DNA, 12 bp, Unknown
  misc_feature (1)..( 12): Result.004 file - promoters50/1013314
atcaatattctt

SEQ ID NO: 154590 - DNA, 12 bp, Unknown
  misc_feature (1)..( 12): Result.004 file - promoters50/1013314
aacattgtccat

SEQ ID NO: 154591 - DNA, 12 bp, Unknown
  misc_feature (1)..( 12): Result.004 file - promoters50/1013314
catattatccat

SEQ ID NO: 154592 - DNA, 12 bp, Unknown
  misc_feature (1)..( 12): Result.004 file - promoters50/1013314
ataattaaagcg

SEQ ID NO: 154593 - DNA, 12 bp, Unknown
  misc_feature (1)..( 12): Result.004 file - promoters50/1013314
ttttgaaatttt

SEQ ID NO: 154594 - DNA, 12 bp, Unknown
  misc_feature (1)..( 12): Result.004 file - promoters50/1013314
gactgacatttt

SEQ ID NO: 154595 - DNA, 12 bp, Unknown
  misc_feature (1)..( 12): Result.004 file - promoters50/1013314
ttttgatattgc

SEQ ID NO: 154596 - DNA, 12 bp, Unknown
  misc_feature (1)..( 12): Result.004 file - promoters50/1013314
attttaaataac

SEQ ID NO: 154597 - DNA, 12 bp, Unknown
  misc_feature (1)..( 12): Result.004 file - promoters50/1013314
tttagaaacttt

SEQ ID NO: 154598 - DNA, 12 bp, Unknown
  misc_feature (1)..( 12): Result.004 file - promoters50/1013341
gattgacatatt

SEQ ID NO: 154599 - DNA, 10 bp, Unknown
  misc_feature (1)..( 10): Result.004 file - promoters50/1013341
tgaattatcc

SEQ ID NO: 154600 - DNA, 10 bp, Unknown
  misc_feature (1)..( 10): Result.004 file - promoters50/1013341
aaaattattt

SEQ ID NO: 154601 - DNA, 10 bp, Unknown
  misc_feature (1)..( 10): Result.004 file - promoters50/1013341
atgattattg

SEQ ID NO: 154602 - DNA, 10 bp, Unknown
  misc_feature (1)..( 10): Result.004 file - promoters50/1013341
atgtttatat

SEQ ID NO: 154603 - DNA, 10 bp, Unknown
  misc_feature (1)..( 10): Result.004 file - promoters50/1013341
gagatcattt

SEQ ID NO: 154604 - DNA, 10 bp, Unknown
  misc_feature (1)..( 10): Result.004 file - promoters50/1013341
tacattgttt

SEQ ID NO: 154605 - DNA, 12 bp, Unknown
  misc_feature (1)..( 12): Result.004 file - promoters50/1013341
ttcttaaacctt

SEQ ID NO: 154606 - DNA, 12 bp, Unknown
  misc_feature (1)..( 12): Result.004 file - promoters50/1013341
catcaaaacctc

SEQ ID NO: 154607 - DNA, 12 bp, Unknown
  misc_feature (1)..( 12): Result.004 file - promoters50/1013341
ttcataaaccct

SEQ ID NO: 154608 - DNA, 12 bp, Unknown
  misc_feature (1)..( 12): Result.004 file - promoters50/1013341
taaatataccgc

SEQ ID NO: 154609 - DNA, 12 bp, Unknown
  misc_feature (1)..( 12): Result.004 file - promoters50/1013341
ggggtaaaactc

SEQ ID NO: 154610 - DNA, 12 bp, Unknown
  misc_feature (1)..( 12): Result.004 file - promoters50/1013427
ataaacaaactc

SEQ ID NO: 154611 - DNA, 16 bp, Unknown
  misc_feature (1)..( 16): Result.004 file - promoters50/1013427
ttctctttatattaag

SEQ ID NO: 154612 - DNA, 16 bp, Unknown
  misc_feature (1)..( 16): Result.004 file - promoters50/1013427
tcctatttaaatttta

SEQ ID NO: 154613 - DNA, 16 bp, Unknown
  misc_feature (1)..( 16): Result.004 file - promoters50/1013427
tttttcttatattaga

SEQ ID NO: 154614 - DNA, 16 bp, Unknown
  misc_feature (1)..( 16): Result.004 file - promoters50/1013427
ttgcgataatataaag

SEQ ID NO: 154615 - DNA, 16 bp, Unknown
  misc_feature (1)..( 16): Result.004 file - promoters50/1013427
cttcccctatataaag

SEQ ID NO: 154616 - DNA, 16 bp, Unknown
  misc_feature (1)..( 16): Result.004 file - promoters50/1013427
tcctatttaaaccaat

SEQ ID NO: 154617 - DNA, 16 bp, Unknown
  misc_feature (1)..( 16): Result.004 file - promoters50/1013427
tttattttaaagcttt

SEQ ID NO: 154618 - DNA, 10 bp, Unknown
  misc_feature (1)..( 10): Result.004 file - promoters50/1013427
ttcaatttca

SEQ ID NO: 154619 - DNA, 10 bp, Unknown
  misc_feature (1)..( 10): Result.004 file - promoters50/1013427
accaatatca

SEQ ID NO: 154620 - DNA, 10 bp, Unknown
  misc_feature (1)..( 10): Result.004 file - promoters50/1013427
ttctatttct

SEQ ID NO: 154621 - DNA, 10 bp, Unknown
  misc_feature (1)..( 10): Result.004 file - promoters50/1013427
ttctatttat

SEQ ID NO: 154622 - DNA, 10 bp, Unknown
  misc_feature (1)..( 10): Result.004 file - promoters50/1013427
aaaaatctca

SEQ ID NO: 154623 - DNA, 10 bp, Unknown
  misc_feature (1)..( 10): Result.004 file - promoters50/1013441
cccaataaag

SEQ ID NO: 154624 - DNA, 10 bp, Unknown
  misc_feature (1)..( 10): Result.004 file - promoters50/1013441
tgtaaatgag

SEQ ID NO: 154625 - DNA, 10 bp, Unknown
  misc_feature (1)..( 10): Result.004 file - promoters50/1013441
gataaaggag

SEQ ID NO: 154626 - DNA, 10 bp, Unknown
  misc_feature (1)..( 10): Result.004 file - promoters50/1013441
tgtcaatacc

SEQ ID NO: 154627 - DNA, 10 bp, Unknown
  misc_feature (1)..( 10): Result.004 file - promoters50/1013441
aaaaaaagag

SEQ ID NO: 154628 - DNA, 13 bp, Unknown
  misc_feature (1)..( 13): Result.004 file - promoters50/1013441
cttgcttttgtta

SEQ ID NO: 154629 - DNA, 13 bp, Unknown
  misc_feature (1)..( 13): Result.004 file - promoters50/1013441
attagatttttta

SEQ ID NO: 154630 - DNA, 13 bp, Unknown
  misc_feature (1)..( 13): Result.004 file - promoters50/1013441
ccagcgttttttt

SEQ ID NO: 154631 - DNA, 13 bp, Unknown
  misc_feature (1)..( 13): Result.004 file - promoters50/1013441
attcgatcttttt

SEQ ID NO: 154632 - DNA, 10 bp, Unknown
  misc_feature (1)..( 10): Result.004 file - promoters50/1013441
tgattttaat

SEQ ID NO: 154633 - DNA, 10 bp, Unknown
  misc_feature (1)..( 10): Result.004 file - promoters50/1013441
agattttgtg

SEQ ID NO: 154634 - DNA, 10 bp, Unknown
  misc_feature (1)..( 10): Result.004 file - promoters50/1013441
taattatgtg

SEQ ID NO: 154635 - DNA, 10 bp, Unknown
  misc_feature (1)..( 10): Result.004 file - promoters50/1013441
agatttctct

SEQ ID NO: 154636 - DNA, 8 bp, Unknown
  misc_feature (1)..( 8): Result.004 file - promoters50/1013441
aattatat

SEQ ID NO: 154637 - DNA, 8 bp, Unknown
  misc_feature (1)..( 8): Result.004 file - promoters50/1013441
cattttat

SEQ ID NO: 154638 - DNA, 8 bp, Unknown
  misc_feature (1)..( 8): Result.004 file - promoters50/1013441
cattttct

SEQ ID NO: 154639 - DNA, 8 bp, Unknown
  misc_feature (1)..( 8): Result.004 file - promoters50/1013529
aattctat

SEQ ID NO: 154640 - DNA, 11 bp, Unknown
  misc_feature (1)..( 11): Result.004 file - promoters50/1013529
gaagaagaaag

SEQ ID NO: 154641 - DNA, 11 bp, Unknown
  misc_feature (1)..( 11): Result.004 file - promoters50/1013529
aaagaataaaa

SEQ ID NO: 154642 - DNA, 11 bp, Unknown
  misc_feature (1)..( 11): Result.004 file - promoters50/1013529
aacatataaaa

SEQ ID NO: 154643 - DNA, 11 bp, Unknown
  misc_feature (1)..( 11): Result.004 file - promoters50/1013529
aaaaaatcaaa

SEQ ID NO: 154644 - DNA, 11 bp, Unknown
  misc_feature (1)..( 11): Result.004 file - promoters50/1013529
cgttaatcaaa

SEQ ID NO: 154645 - DNA, 11 bp, Unknown
  misc_feature (1)..( 11): Result.004 file - promoters50/1013529
tattaataaat

SEQ ID NO: 154646 - DNA, 11 bp, Unknown
  misc_feature (1)..( 11): Result.004 file - promoters50/1013611
ccaaaatctta

SEQ ID NO: 154647 - DNA, 9 bp, Unknown
  misc_feature (1)..( 9): Result.004 file - promoters50/1013611
ttttgttat

SEQ ID NO: 154648 - DNA, 9 bp, Unknown
  misc_feature (1)..( 9): Result.004 file - promoters50/1013611
atttattat

SEQ ID NO: 154649 - DNA, 9 bp, Unknown
  misc_feature (1)..( 9): Result.004 file - promoters50/1013611
gtttttttt

SEQ ID NO: 154650 - DNA, 10 bp, Unknown
  misc_feature (1)..( 10): Result.004 file - promoters50/1013611
ataaaacaaa

SEQ ID NO: 154651 - DNA, 10 bp, Unknown
  misc_feature (1)..( 10): Result.004 file - promoters50/1013611
caaaaacaaa

SEQ ID NO: 154652 - DNA, 10 bp, Unknown
  misc_feature (1)..( 10): Result.004 file - promoters50/1013611
ataatacagg

SEQ ID NO: 154653 - DNA, 6 bp, Unknown
  misc_feature (1)..( 6): Result.004 file - promoters50/1013611
aattag

SEQ ID NO: 154654 - DNA, 6 bp, Unknown
  misc_feature (1)..( 6): Result.004 file - promoters50/1013611
aattag

SEQ ID NO: 154655 - DNA, 6 bp, Unknown
  misc_feature (1)..( 6): Result.004 file - promoters50/1013611
aattag

SEQ ID NO: 154656 - DNA, 10 bp, Unknown
  misc_feature (1)..( 10): Result.004 file - promoters50/1013611
caacaaaacg

SEQ ID NO: 154657 - DNA, 10 bp, Unknown
  misc_feature (1)..( 10): Result.004 file - promoters50/1013611
caacaaaaaa

SEQ ID NO: 154658 - DNA, 11 bp, Unknown
  misc_feature (1)..( 11): Result.004 file - promoters50/1013629
taaccaaaaaa

SEQ ID NO: 154659 - DNA, 12 bp, Unknown
  misc_feature (1)..( 12): Result.004 file - promoters50/1013629
aatctgtttctt

SEQ ID NO: 154660 - DNA, 12 bp, Unknown
  misc_feature (1)..( 12): Result.004 file - promoters50/1013629
gtttggtttcta

SEQ ID NO: 154661 - DNA, 12 bp, Unknown
  misc_feature (1)..( 12): Result.004 file - promoters50/1013629
gacccgtttctt

SEQ ID NO: 154662 - DNA, 12 bp, Unknown
  misc_feature (1)..( 12): Result.004 file - promoters50/1013629
acacggtttctt

SEQ ID NO: 154663 - DNA, 12 bp, Unknown
  misc_feature (1)..( 12): Result.004 file - promoters50/1013629
aaacggttttgt

SEQ ID NO: 154664 - DNA, 12 bp, Unknown
  misc_feature (1)..( 12): Result.004 file - promoters50/1013629
aaatggttaatc

SEQ ID NO: 154665 - DNA, 12 bp, Unknown
  misc_feature (1)..( 12): Result.004 file - promoters50/1013629
acttttgttttt

SEQ ID NO: 154666 - DNA, 12 bp, Unknown
  misc_feature (1)..( 12): Result.004 file - promoters50/1013629
tcttttgtaaaa

SEQ ID NO: 154667 - DNA, 12 bp, Unknown
  misc_feature (1)..( 12): Result.004 file - promoters50/1013629
tattttctttat

SEQ ID NO: 154668 - DNA, 12 bp, Unknown
  misc_feature (1)..( 12): Result.004 file - promoters50/1013629
tctttttttttc

SEQ ID NO: 154669 - DNA, 12 bp, Unknown
  misc_feature (1)..( 12): Result.004 file - promoters50/1013629
ctatttcttttc

SEQ ID NO: 154670 - DNA, 12 bp, Unknown
  misc_feature (1)..( 12): Result.004 file - promoters50/1013641
ctaattctctaa

SEQ ID NO: 154671 - DNA, 16 bp, Unknown
  misc_feature (1)..( 16): Result.004 file - promoters50/1013641
ctattttgatttttgg

SEQ ID NO: 154672 - DNA, 16 bp, Unknown
  misc_feature (1)..( 16): Result.004 file - promoters50/1013641
acaatttgacttttca

SEQ ID NO: 154673 - DNA, 16 bp, Unknown
  misc_feature (1)..( 16): Result.004 file - promoters50/1013641
ctatattgacatgaat

SEQ ID NO: 154674 - DNA, 16 bp, Unknown
  misc_feature (1)..( 16): Result.004 file - promoters50/1013641
caaaaatgatatttag

SEQ ID NO: 154675 - DNA, 16 bp, Unknown
  misc_feature (1)..( 16): Result.004 file - promoters50/1013641
ttcaagtctcttatca

SEQ ID NO: 154676 - DNA, 16 bp, Unknown
  misc_feature (1)..( 16): Result.004 file - promoters50/1013641
attttaatacttttct

SEQ ID NO: 154677 - DNA, 11 bp, Unknown
  misc_feature (1)..( 11): Result.004 file - promoters50/1013641
acaaactaaag

SEQ ID NO: 154678 - DNA, 11 bp, Unknown
  misc_feature (1)..( 11): Result.004 file - promoters50/1013641
gcaaaataaca

SEQ ID NO: 154679 - DNA, 11 bp, Unknown
  misc_feature (1)..( 11): Result.004 file - promoters50/1013641
cgaaacaaaaa

SEQ ID NO: 154680 - DNA, 12 bp, Unknown
  misc_feature (1)..( 12): Result.004 file - promoters50/1013641
tgaataataaat

SEQ ID NO: 154681 - DNA, 12 bp, Unknown
  misc_feature (1)..( 12): Result.004 file - promoters50/1013641
tcaagaaccagc

SEQ ID NO: 154682 - DNA, 12 bp, Unknown
  misc_feature (1)..( 12): Result.004 file - promoters50/1013641
acaagaagagag

SEQ ID NO: 154683 - DNA, 12 bp, Unknown
  misc_feature (1)..( 12): Result.004 file - promoters50/1013641
acacaaagacac

SEQ ID NO: 154684 - DNA, 14 bp, Unknown
  misc_feature (1)..( 14): Result.004 file - promoters50/1013641
tcttttcttcgata

SEQ ID NO: 154685 - DNA, 14 bp, Unknown
  misc_feature (1)..( 14): Result.004 file - promoters50/1013641
cattttcttcttta

SEQ ID NO: 154686 - DNA, 14 bp, Unknown
  misc_feature (1)..( 14): Result.004 file - promoters50/1013641
tcttttcttttgag

SEQ ID NO: 154687 - DNA, 14 bp, Unknown
  misc_feature (1)..( 14): Result.004 file - promoters50/1013641
aagagtcttgtttt

SEQ ID NO: 154688 - DNA, 14 bp, Unknown
  misc_feature (1)..( 14): Result.004 file - promoters50/1013641
tcaccacttggttt

SEQ ID NO: 154689 - DNA, 14 bp, Unknown
  misc_feature (1)..( 14): Result.004 file - promoters50/1013641
gaagatctagttaa

SEQ ID NO: 154690 - DNA, 8 bp, Unknown
  misc_feature (1)..( 8): Result.004 file - promoters50/1013641
ctcttttc

SEQ ID NO: 154691 - DNA, 8 bp, Unknown
  misc_feature (1)..( 8): Result.004 file - promoters50/1013641
ttcttttg

SEQ ID NO: 154692 - DNA, 8 bp, Unknown
  misc_feature (1)..( 8): Result.004 file - promoters50/1013641
ctcatttg

SEQ ID NO: 154693 - DNA, 8 bp, Unknown
  misc_feature (1)..( 8): Result.004 file - promoters50/1013641
ttctttaa

SEQ ID NO: 154694 - DNA, 9 bp, Unknown
  misc_feature (1)..( 9): Result.004 file - promoters50/1013641
gtcttgttt

SEQ ID NO: 154695 - DNA, 9 bp, Unknown
  misc_feature (1)..( 9): Result.004 file - promoters50/1013645
cacttttgt

SEQ ID NO: 154696 - DNA, 9 bp, Unknown
  misc_feature (1)..( 9): Result.004 file - promoters50/1013645
cttgtatat

SEQ ID NO: 154697 - DNA, 9 bp, Unknown
  misc_feature (1)..( 9): Result.004 file - promoters50/1013645
aatgtctat

SEQ ID NO: 154698 - DNA, 9 bp, Unknown
  misc_feature (1)..( 9): Result.004 file - promoters50/1013665
cttttatag

SEQ ID NO: 154699 - DNA, 9 bp, Unknown
  misc_feature (1)..( 9): Result.004 file - promoters50/1013665
atatctttt

SEQ ID NO: 154700 - DNA, 9 bp, Unknown
  misc_feature (1)..( 9): Result.004 file - promoters50/1013665
atatttttt

SEQ ID NO: 154701 - DNA, 9 bp, Unknown
  misc_feature (1)..( 9): Result.004 file - promoters50/1013674
acattttta

SEQ ID NO: 154702 - DNA, 8 bp, Unknown
  misc_feature (1)..( 8): Result.004 file - promoters50/1013674
ttttgttt

SEQ ID NO: 154703 - DNA, 8 bp, Unknown
  misc_feature (1)..( 8): Result.004 file - promoters50/1013674
ttttgtgg

SEQ ID NO: 154704 - DNA, 8 bp, Unknown
  misc_feature (1)..( 8): Result.004 file - promoters50/1013674
atttattt

SEQ ID NO: 154705 - DNA, 12 bp, Unknown
  misc_feature (1)..( 12): Result.004 file - promoters50/1013674
tttttgtgtgta

SEQ ID NO: 154706 - DNA, 12 bp, Unknown
  misc_feature (1)..( 12): Result.004 file - promoters50/1013674
tttctgtttcaa

SEQ ID NO: 154707 - DNA, 12 bp, Unknown
  misc_feature (1)..( 12): Result.004 file - promoters50/1013674
tttttgttttgt

SEQ ID NO: 154708 - DNA, 8 bp, Unknown
  misc_feature (1)..( 8): Result.004 file - promoters50/1013674
ttaaaaat

SEQ ID NO: 154709 - DNA, 8 bp, Unknown
  misc_feature (1)..( 8): Result.004 file - promoters50/1013674
ttataaat

SEQ ID NO: 154710 - DNA, 8 bp, Unknown
  misc_feature (1)..( 8): Result.004 file - promoters50/1013674
acaaaaat

SEQ ID NO: 154711 - DNA, 8 bp, Unknown
  misc_feature (1)..( 8): Result.004 file - promoters50/1013674
attacaat

SEQ ID NO: 154712 - DNA, 8 bp, Unknown
  misc_feature (1)..( 8): Result.004 file - promoters50/1013674
cttataat

SEQ ID NO: 154713 - DNA, 8 bp, Unknown
  misc_feature (1)..( 8): Result.004 file - promoters50/1013674
cttaaaat

SEQ ID NO: 154714 - DNA, 7 bp, Unknown
  misc_feature (1)..( 7): Result.004 file - promoters50/1013674
aacaaaa

SEQ ID NO: 154715 - DNA, 7 bp, Unknown
  misc_feature (1)..( 7): Result.004 file - promoters50/1013674
aacaaaa

SEQ ID NO: 154716 - DNA, 7 bp, Unknown
  misc_feature (1)..( 7): Result.004 file - promoters50/1013678
gacaaaa

SEQ ID NO: 154717 - DNA, 6 bp, Unknown
  misc_feature (1)..( 6): Result.004 file - promoters50/1013678
caaatt

SEQ ID NO: 154718 - DNA, 6 bp, Unknown
  misc_feature (1)..( 6): Result.004 file - promoters50/1013678
caaatt

SEQ ID NO: 154719 - DNA, 6 bp, Unknown
  misc_feature (1)..( 6): Result.004 file - promoters50/1013678
caaatt

SEQ ID NO: 154720 - DNA, 8 bp, Unknown
  misc_feature (1)..( 8): Result.004 file - promoters50/1013678
aaacgatt

SEQ ID NO: 154721 - DNA, 8 bp, Unknown
  misc_feature (1)..( 8): Result.004 file - promoters50/1013678
aaactatt

SEQ ID NO: 154722 - DNA, 8 bp, Unknown
  misc_feature (1)..( 8): Result.004 file - promoters50/1013678
aaacgatt

SEQ ID NO: 154723 - DNA, 6 bp, Unknown
  misc_feature (1)..( 6): Result.004 file - promoters50/1013678
ttaaat

SEQ ID NO: 154724 - DNA, 6 bp, Unknown
  misc_feature (1)..( 6): Result.004 file - promoters50/1013678
ttaaat

SEQ ID NO: 154725 - DNA, 6 bp, Unknown
  misc_feature (1)..( 6): Result.004 file - promoters50/1013678
ttaaat

SEQ ID NO: 154726 - DNA, 11 bp, Unknown
  misc_feature (1)..( 11): Result.004 file - promoters50/1013678
agaatgggatt

SEQ ID NO: 154727 - DNA, 11 bp, Unknown
  misc_feature (1)..( 11): Result.004 file - promoters50/1013678
agaatgagatc

SEQ ID NO: 154728 - DNA, 11 bp, Unknown
  misc_feature (1)..( 11): Result.004 file - promoters50/1013678
tttttgagatc

SEQ ID NO: 154729 - DNA, 6 bp, Unknown
  misc_feature (1)..( 6): Result.004 file - promoters50/1013678
tagctt

SEQ ID NO: 154730 - DNA, 6 bp, Unknown
  misc_feature (1)..( 6): Result.004 file - promoters50/1013678
tagctt

SEQ ID NO: 154731 - DNA, 6 bp, Unknown
  misc_feature (1)..( 6): Result.004 file - promoters50/1013678
tagctt

SEQ ID NO: 154732 - DNA, 9 bp, Unknown
  misc_feature (1)..( 9): Result.004 file - promoters50/1013678
gcagagaag

SEQ ID NO: 154733 - DNA, 9 bp, Unknown
  misc_feature (1)..( 9): Result.004 file - promoters50/1013678
gcatagatt

SEQ ID NO: 154734 - DNA, 9 bp, Unknown
  misc_feature (1)..( 9): Result.004 file - promoters50/1013710
gaagagaag

SEQ ID NO: 154735 - DNA, 9 bp, Unknown
  misc_feature (1)..( 9): Result.004 file - promoters50/1013710
ataatgagt

SEQ ID NO: 154736 - DNA, 9 bp, Unknown
  misc_feature (1)..( 9): Result.004 file - promoters50/1013710
gtaatgata

SEQ ID NO: 154737 - DNA, 9 bp, Unknown
  misc_feature (1)..( 9): Result.004 file - promoters50/1013710
taaatcagt

SEQ ID NO: 154738 - DNA, 9 bp, Unknown
  misc_feature (1)..( 9): Result.004 file - promoters50/1013710
gtaatgtgt

SEQ ID NO: 154739 - DNA, 8 bp, Unknown
  misc_feature (1)..( 8): Result.004 file - promoters50/1013710
ctgatttg

SEQ ID NO: 154740 - DNA, 8 bp, Unknown
  misc_feature (1)..( 8): Result.004 file - promoters50/1013710
gtgatttg

SEQ ID NO: 154741 - DNA, 8 bp, Unknown
  misc_feature (1)..( 8): Result.004 file - promoters50/1013710
gtgtttta

SEQ ID NO: 154742 - DNA, 10 bp, Unknown
  misc_feature (1)..( 10): Result.004 file - promoters50/1013710
cttgattaac

SEQ ID NO: 154743 - DNA, 10 bp, Unknown
  misc_feature (1)..( 10): Result.004 file - promoters50/1013710
cttgaataac

SEQ ID NO: 154744 - DNA, 10 bp, Unknown
  misc_feature (1)..( 10): Result.004 file - promoters50/1013714
ttggataaac

SEQ ID NO: 154745 - DNA, 12 bp, Unknown
  misc_feature (1)..( 12): Result.004 file - promoters50/1013714
atatatatccgc

SEQ ID NO: 154746 - DNA, 12 bp, Unknown
  misc_feature (1)..( 12): Result.004 file - promoters50/1013714
ctatataatagt

SEQ ID NO: 154747 - DNA, 12 bp, Unknown
  misc_feature (1)..( 12): Result.004 file - promoters50/1013714
ctatataaatcc

SEQ ID NO: 154748 - DNA, 12 bp, Unknown
  misc_feature (1)..( 12): Result.004 file - promoters50/1013714
atatataccctt

SEQ ID NO: 154749 - DNA, 12 bp, Unknown
  misc_feature (1)..( 12): Result.004 file - promoters50/1013714
caatataatctc

SEQ ID NO: 154750 - DNA, 13 bp, Unknown
  misc_feature (1)..( 13): Result.004 file - promoters50/1013714
ccaatttataatc

SEQ ID NO: 154751 - DNA, 13 bp, Unknown
  misc_feature (1)..( 13): Result.004 file - promoters50/1013714
aatttttttaatc

SEQ ID NO: 154752 - DNA, 13 bp, Unknown
  misc_feature (1)..( 13): Result.004 file - promoters50/1013714
gtcattttttggt

SEQ ID NO: 154753 - DNA, 13 bp, Unknown
  misc_feature (1)..( 13): Result.004 file - promoters50/1013714
ataatttcttact

SEQ ID NO: 154754 - DNA, 13 bp, Unknown
  misc_feature (1)..( 13): Result.004 file - promoters50/1013714
atagtttcttttt

SEQ ID NO: 154755 - DNA, 11 bp, Unknown
  misc_feature (1)..( 11): Result.004 file - promoters50/1013714
gtcattttttg

SEQ ID NO: 154756 - DNA, 11 bp, Unknown
  misc_feature (1)..( 11): Result.004 file - promoters50/1013714
tgtattttttc

SEQ ID NO: 154757 - DNA, 11 bp, Unknown
  misc_feature (1)..( 11): Result.004 file - promoters50/1013714
tgaattttttt

SEQ ID NO: 154758 - DNA, 11 bp, Unknown
  misc_feature (1)..( 11): Result.004 file - promoters50/1013714
ataatttctta

SEQ ID NO: 154759 - DNA, 11 bp, Unknown
  misc_feature (1)..( 11): Result.004 file - promoters50/1013764
atagtttcttt

SEQ ID NO: 154760 - DNA, 10 bp, Unknown
  misc_feature (1)..( 10): Result.004 file - promoters50/1013764
tattatgtta

SEQ ID NO: 154761 - DNA, 10 bp, Unknown
  misc_feature (1)..( 10): Result.004 file - promoters50/1013764
tattgtgtct

SEQ ID NO: 154762 - DNA, 10 bp, Unknown
  misc_feature (1)..( 10): Result.004 file - promoters50/1013764
atttgtttct

SEQ ID NO: 154763 - DNA, 8 bp, Unknown
  misc_feature (1)..( 8): Result.004 file - promoters50/1013764
gaccgatc

SEQ ID NO: 154764 - DNA, 8 bp, Unknown
  misc_feature (1)..( 8): Result.004 file - promoters50/1013764
taccaatc

SEQ ID NO: 154765 - DNA, 8 bp, Unknown
  misc_feature (1)..( 8): Result.004 file - promoters50/1013764
taccaaat

SEQ ID NO: 154766 - DNA, 7 bp, Unknown
  misc_feature (1)..( 7): Result.004 file - promoters50/1013764
gtttcta

SEQ ID NO: 154767 - DNA, 7 bp, Unknown
  misc_feature (1)..( 7): Result.004 file - promoters50/1013764
gtttctt

SEQ ID NO: 154768 - DNA, 7 bp, Unknown
  misc_feature (1)..( 7): Result.004 file - promoters50/1013764
ctttcta

SEQ ID NO: 154769 - DNA, 8 bp, Unknown
  misc_feature (1)..( 8): Result.004 file - promoters50/1013764
tagtaata

SEQ ID NO: 154770 - DNA, 8 bp, Unknown
  misc_feature (1)..( 8): Result.004 file - promoters50/1013764
tagtaaaa

SEQ ID NO: 154771 - DNA, 8 bp, Unknown
  misc_feature (1)..( 8): Result.004 file - promoters50/1013764
taggaaaa

SEQ ID NO: 154772 - DNA, 7 bp, Unknown
  misc_feature (1)..( 7): Result.004 file - promoters50/1013764
atatctg

SEQ ID NO: 154773 - DNA, 7 bp, Unknown
  misc_feature (1)..( 7): Result.004 file - promoters50/1013764
atatctg

SEQ ID NO: 154774 - DNA, 7 bp, Unknown
  misc_feature (1)..( 7): Result.004 file - promoters50/1013764
gtatctg

SEQ ID NO: 154775 - DNA, 11 bp, Unknown
  misc_feature (1)..( 11): Result.004 file - promoters50/1013764
tgttgtttcct

SEQ ID NO: 154776 - DNA, 11 bp, Unknown
  misc_feature (1)..( 11): Result.004 file - promoters50/1013764
acttgtctcct

SEQ ID NO: 154777 - DNA, 11 bp, Unknown
  misc_feature (1)..( 11): Result.004 file - promoters50/1013764
actcgtcgttt

SEQ ID NO: 154778 - DNA, 9 bp, Unknown
  misc_feature (1)..( 9): Result.004 file - promoters50/1013764
cttattgat

SEQ ID NO: 154779 - DNA, 9 bp, Unknown
  misc_feature (1)..( 9): Result.004 file - promoters50/1013764
tttaatgat

SEQ ID NO: 154780 - DNA, 9 bp, Unknown
  misc_feature (1)..( 9): Result.004 file - promoters50/1013764
tttaatgtc

SEQ ID NO: 154781 - DNA, 7 bp, Unknown
  misc_feature (1)..( 7): Result.004 file - promoters50/1013764
aatggtg

SEQ ID NO: 154782 - DNA, 7 bp, Unknown
  misc_feature (1)..( 7): Result.004 file - promoters50/1013764
aatggtt

SEQ ID NO: 154783 - DNA, 7 bp, Unknown
  misc_feature (1)..( 7): Result.004 file - promoters50/1013772
aattgtt

SEQ ID NO: 154784 - DNA, 6 bp, Unknown
  misc_feature (1)..( 6): Result.004 file - promoters50/1013772
aagatt

SEQ ID NO: 154785 - DNA, 6 bp, Unknown
  misc_feature (1)..( 6): Result.004 file - promoters50/1013772
aagatt

SEQ ID NO: 154786 - DNA, 6 bp, Unknown
  misc_feature (1)..( 6): Result.004 file - promoters50/1013786
aagatt

SEQ ID NO: 154787 - DNA, 14 bp, Unknown
  misc_feature (1)..( 14): Result.004 file - promoters50/1013786
aagtttctaggaac

SEQ ID NO: 154788 - DNA, 14 bp, Unknown
  misc_feature (1)..( 14): Result.004 file - promoters50/1013786
ttaagtctagtaac

SEQ ID NO: 154789 - DNA, 14 bp, Unknown
  misc_feature (1)..( 14): Result.004 file - promoters50/1013786
ttgagtttaggccg

SEQ ID NO: 154790 - DNA, 14 bp, Unknown
  misc_feature (1)..( 14): Result.004 file - promoters50/1013786
ataagtttaacgaa

SEQ ID NO: 154791 - DNA, 14 bp, Unknown
  misc_feature (1)..( 14): Result.004 file - promoters50/1013786
ttgacttttgacga

SEQ ID NO: 154792 - DNA, 14 bp, Unknown
  misc_feature (1)..( 14): Result.004 file - promoters50/1013786
ttaactttgtactt

SEQ ID NO: 154793 - DNA, 14 bp, Unknown
  misc_feature (1)..( 14): Result.004 file - promoters50/1013786
ctaattttctaaat

SEQ ID NO: 154794 - DNA, 9 bp, Unknown
  misc_feature (1)..( 9): Result.004 file - promoters50/1013786
tcaagtttc

SEQ ID NO: 154795 - DNA, 9 bp, Unknown
  misc_feature (1)..( 9): Result.004 file - promoters50/1013786
ataagttta

SEQ ID NO: 154796 - DNA, 9 bp, Unknown
  misc_feature (1)..( 9): Result.004 file - promoters50/1013786
ttgagttta

SEQ ID NO: 154797 - DNA, 9 bp, Unknown
  misc_feature (1)..( 9): Result.004 file - promoters50/1013786
ttgactttt

SEQ ID NO: 154798 - DNA, 9 bp, Unknown
  misc_feature (1)..( 9): Result.004 file - promoters50/1013786
ttaactttg

SEQ ID NO: 154799 - DNA, 9 bp, Unknown
  misc_feature (1)..( 9): Result.004 file - promoters50/1013786
ctaattttc

SEQ ID NO: 154800 - DNA, 15 bp, Unknown
  misc_feature (1)..( 15): Result.004 file - promoters50/1013786
aaaatattaaccttg

SEQ ID NO: 154801 - DNA, 15 bp, Unknown
  misc_feature (1)..( 15): Result.004 file - promoters50/1013786
ataaagttaactttg

SEQ ID NO: 154802 - DNA, 15 bp, Unknown
  misc_feature (1)..( 15): Result.004 file - promoters50/1013786
ataaacttaacgaat

SEQ ID NO: 154803 - DNA, 15 bp, Unknown
  misc_feature (1)..( 15): Result.004 file - promoters50/1013786
tagtagataagttta

SEQ ID NO: 154804 - DNA, 15 bp, Unknown
  misc_feature (1)..( 15): Result.004 file - promoters50/1013786
acaattctaattttc

SEQ ID NO: 154805 - DNA, 15 bp, Unknown
  misc_feature (1)..( 15): Result.004 file - promoters50/1013792
tcatcgttaattttt

SEQ ID NO: 154806 - DNA, 13 bp, Unknown
  misc_feature (1)..( 13): Result.004 file - promoters50/1013792
tttttcatattag

SEQ ID NO: 154807 - DNA, 13 bp, Unknown
  misc_feature (1)..( 13): Result.004 file - promoters50/1013792
ttttgcataatag

SEQ ID NO: 154808 - DNA, 13 bp, Unknown
  misc_feature (1)..( 13): Result.004 file - promoters50/1013792
ttcttcatatcac

SEQ ID NO: 154809 - DNA, 11 bp, Unknown
  misc_feature (1)..( 11): Result.004 file - promoters50/1013792
gaacaaacaaa

SEQ ID NO: 154810 - DNA, 11 bp, Unknown
  misc_feature (1)..( 11): Result.004 file - promoters50/1013792
gaacaattaca

SEQ ID NO: 154811 - DNA, 11 bp, Unknown
  misc_feature (1)..( 11): Result.004 file - promoters50/1013796
aaacgattaca

SEQ ID NO: 154812 - DNA, 9 bp, Unknown
  misc_feature (1)..( 9): Result.004 file - promoters50/1013796
taagttcct

SEQ ID NO: 154813 - DNA, 9 bp, Unknown
  misc_feature (1)..( 9): Result.004 file - promoters50/1013796
taagttgtt

SEQ ID NO: 154814 - DNA, 9 bp, Unknown
  misc_feature (1)..( 9): Result.004 file - promoters50/1013796
aaagttgtt

SEQ ID NO: 154815 - DNA, 8 bp, Unknown
  misc_feature (1)..( 8): Result.004 file - promoters50/1013796
gttttaga

SEQ ID NO: 154816 - DNA, 8 bp, Unknown
  misc_feature (1)..( 8): Result.004 file - promoters50/1013796
gttataga

SEQ ID NO: 154817 - DNA, 8 bp, Unknown
  misc_feature (1)..( 8): Result.004 file - promoters50/1013796
tttttaga

SEQ ID NO: 154818 - DNA, 11 bp, Unknown
  misc_feature (1)..( 11): Result.004 file - promoters50/1013796
tgaataaaaaa

SEQ ID NO: 154819 - DNA, 11 bp, Unknown
  misc_feature (1)..( 11): Result.004 file - promoters50/1013796
aaaatcaaact

SEQ ID NO: 154820 - DNA, 11 bp, Unknown
  misc_feature (1)..( 11): Result.004 file - promoters50/1013796
tgaaaaaaaaa

SEQ ID NO: 154821 - DNA, 6 bp, Unknown
  misc_feature (1)..( 6): Result.004 file - promoters50/1013796
aagata

SEQ ID NO: 154822 - DNA, 6 bp, Unknown
  misc_feature (1)..( 6): Result.004 file - promoters50/1013796
aagata

SEQ ID NO: 154823 - DNA, 6 bp, Unknown
  misc_feature (1)..( 6): Result.004 file - promoters50/1013796
aagata

SEQ ID NO: 154824 - DNA, 10 bp, Unknown
  misc_feature (1)..( 10): Result.004 file - promoters50/1013796
tttataaatt

SEQ ID NO: 154825 - DNA, 10 bp, Unknown
  misc_feature (1)..( 10): Result.004 file - promoters50/1013796
tttttaaatt

SEQ ID NO: 154826 - DNA, 10 bp, Unknown
  misc_feature (1)..( 10): Result.004 file - promoters50/1013796
gttttaaaaa

SEQ ID NO: 154827 - DNA, 8 bp, Unknown
  misc_feature (1)..( 8): Result.004 file - promoters50/1013796
taaaccaa

SEQ ID NO: 154828 - DNA, 8 bp, Unknown
  misc_feature (1)..( 8): Result.004 file - promoters50/1013796
taaaacaa

SEQ ID NO: 154829 - DNA, 8 bp, Unknown
  misc_feature (1)..( 8): Result.004 file - promoters50/1013796
taaaccgg

SEQ ID NO: 154830 - DNA, 10 bp, Unknown
  misc_feature (1)..( 10): Result.004 file - promoters50/1013796
taaggttttt

SEQ ID NO: 154831 - DNA, 10 bp, Unknown
  misc_feature (1)..( 10): Result.004 file - promoters50/1013796
taaagttgtt

SEQ ID NO: 154832 - DNA, 10 bp, Unknown
  misc_feature (1)..( 10): Result.004 file - promoters50/1013796
ataagttgtt

SEQ ID NO: 154833 - DNA, 12 bp, Unknown
  misc_feature (1)..( 12): Result.004 file - promoters50/1013796
gaacataacaat

SEQ ID NO: 154834 - DNA, 12 bp, Unknown
  misc_feature (1)..( 12): Result.004 file - promoters50/1013796
cgttttaaaaat

SEQ ID NO: 154835 - DNA, 12 bp, Unknown
  misc_feature (1)..( 12): Result.004 file - promoters50/1013805
gtttttaaattt

SEQ ID NO: 154836 - DNA, 14 bp, Unknown
  misc_feature (1)..( 14): Result.004 file - promoters50/1013805
tgaacttagtctgt

SEQ ID NO: 154837 - DNA, 14 bp, Unknown
  misc_feature (1)..( 14): Result.004 file - promoters50/1013805
tttccttagtaaca

SEQ ID NO: 154838 - DNA, 14 bp, Unknown
  misc_feature (1)..( 14): Result.004 file - promoters50/1013805
tgagattactaaca

SEQ ID NO: 154839 - DNA, 14 bp, Unknown
  misc_feature (1)..( 14): Result.004 file - promoters50/1013805
aaagattactttgg

SEQ ID NO: 154840 - DNA, 14 bp, Unknown
  misc_feature (1)..( 14): Result.004 file - promoters50/1013805
ataaattattttct

SEQ ID NO: 154841 - DNA, 14 bp, Unknown
  misc_feature (1)..( 14): Result.004 file - promoters50/1013805
cttgcttaacactc

SEQ ID NO: 154842 - DNA, 14 bp, Unknown
  misc_feature (1)..( 14): Result.004 file - promoters50/1013805
ggagataactttat

SEQ ID NO: 154843 - DNA, 14 bp, Unknown
  misc_feature (1)..( 14): Result.004 file - promoters50/1013805
ggagattgagccag

SEQ ID NO: 154844 - DNA, 16 bp, Unknown
  misc_feature (1)..( 16): Result.004 file - promoters50/1013805
cttagtctgtaacatg

SEQ ID NO: 154845 - DNA, 16 bp, Unknown
  misc_feature (1)..( 16): Result.004 file - promoters50/1013805
tttccttagtaacagc

SEQ ID NO: 154846 - DNA, 16 bp, Unknown
  misc_feature (1)..( 16): Result.004 file - promoters50/1013805
tgagattactaacact

SEQ ID NO: 154847 - DNA, 16 bp, Unknown
  misc_feature (1)..( 16): Result.004 file - promoters50/1013805
aaagattactttggat

SEQ ID NO: 154848 - DNA, 16 bp, Unknown
  misc_feature (1)..( 16): Result.004 file - promoters50/1013805
ataaattattttcttt

SEQ ID NO: 154849 - DNA, 16 bp, Unknown
  misc_feature (1)..( 16): Result.004 file - promoters50/1013805
atgcttgcttaacact

SEQ ID NO: 154850 - DNA, 16 bp, Unknown
  misc_feature (1)..( 16): Result.004 file - promoters50/1013805
ggagataactttattt

SEQ ID NO: 154851 - DNA, 16 bp, Unknown
  misc_feature (1)..( 16): Result.004 file - promoters50/1013805
ggagattgagccagat

SEQ ID NO: 154852 - DNA, 12 bp, Unknown
  misc_feature (1)..( 12): Result.004 file - promoters50/1013805
tcgataattgat

SEQ ID NO: 154853 - DNA, 12 bp, Unknown
  misc_feature (1)..( 12): Result.004 file - promoters50/1013805
tgaataatttgc

SEQ ID NO: 154854 - DNA, 13 bp, Unknown
  misc_feature (1)..( 13): Result.004 file - promoters50/1013805
gtactaacttgtg

SEQ ID NO: 154855 - DNA, 13 bp, Unknown
  misc_feature (1)..( 13): Result.004 file - promoters50/1013805
gagataactttat

SEQ ID NO: 154856 - DNA, 13 bp, Unknown
  misc_feature (1)..( 13): Result.004 file - promoters50/1013805
gagattactaaca

SEQ ID NO: 154857 - DNA, 13 bp, Unknown
  misc_feature (1)..( 13): Result.004 file - promoters50/1013805
ctcttaaattatt

SEQ ID NO: 154858 - DNA, 12 bp, Unknown
  misc_feature (1)..( 12): Result.004 file - promoters50/1013805
tgagaaacctgt

SEQ ID NO: 154859 - DNA, 12 bp, Unknown
  misc_feature (1)..( 12): Result.004 file - promoters50/1013805
gtactaacttgt

SEQ ID NO: 154860 - DNA, 12 bp, Unknown
  misc_feature (1)..( 12): Result.004 file - promoters50/1013805
tgaataatttgc

SEQ ID NO: 154861 - DNA, 12 bp, Unknown
  misc_feature (1)..( 12): Result.004 file - promoters50/1013805
gagataacttta

SEQ ID NO: 154862 - DNA, 12 bp, Unknown
  misc_feature (1)..( 12): Result.004 file - promoters50/1013805
gagattactaac

SEQ ID NO: 154863 - DNA, 12 bp, Unknown
  misc_feature (1)..( 12): Result.004 file - promoters50/1013850
tcttaaattatt

SEQ ID NO: 154864 - DNA, 10 bp, Unknown
  misc_feature (1)..( 10): Result.004 file - promoters50/1013850
aaaatctttc

SEQ ID NO: 154865 - DNA, 10 bp, Unknown
  misc_feature (1)..( 10): Result.004 file - promoters50/1013850
taaattttta

SEQ ID NO: 154866 - DNA, 10 bp, Unknown
  misc_feature (1)..( 10): Result.004 file - promoters50/1013850
caaattctaa

SEQ ID NO: 154867 - DNA, 10 bp, Unknown
  misc_feature (1)..( 10): Result.004 file - promoters50/1013850
tgaattcttc

SEQ ID NO: 154868 - DNA, 10 bp, Unknown
  misc_feature (1)..( 10): Result.004 file - promoters50/1013878
attattttta

SEQ ID NO: 154869 - DNA, 11 bp, Unknown
  misc_feature (1)..( 11): Result.004 file - promoters50/1013878
gataatatgca

SEQ ID NO: 154870 - DNA, 11 bp, Unknown
  misc_feature (1)..( 11): Result.004 file - promoters50/1013878
aataatatata

SEQ ID NO: 154871 - DNA, 11 bp, Unknown
  misc_feature (1)..( 11): Result.004 file - promoters50/1013878
gttaagatgtg

SEQ ID NO: 154872 - DNA, 11 bp, Unknown
  misc_feature (1)..( 11): Result.004 file - promoters50/1013878
tgaaatatgtc

SEQ ID NO: 154873 - DNA, 11 bp, Unknown
  misc_feature (1)..( 11): Result.004 file - promoters50/1013878
caaaaaattgg

SEQ ID NO: 154874 - DNA, 11 bp, Unknown
  misc_feature (1)..( 11): Result.004 file - promoters50/1013878
gtttagaattt

SEQ ID NO: 154875 - DNA, 11 bp, Unknown
  misc_feature (1)..( 11): Result.004 file - promoters50/1013878
ttttataggtc

SEQ ID NO: 154876 - DNA, 15 bp, Unknown
  misc_feature (1)..( 15): Result.004 file - promoters50/1013878
tacaagagaaacttg

SEQ ID NO: 154877 - DNA, 15 bp, Unknown
  misc_feature (1)..( 15): Result.004 file - promoters50/1013878
tagaaataaaaattg

SEQ ID NO: 154878 - DNA, 15 bp, Unknown
  misc_feature (1)..( 15): Result.004 file - promoters50/1013878
agttttaaaaacttt

SEQ ID NO: 154879 - DNA, 15 bp, Unknown
  misc_feature (1)..( 15): Result.004 file - promoters50/1013878
agaaaaaaaaaatgg

SEQ ID NO: 154880 - DNA, 15 bp, Unknown
  misc_feature (1)..( 15): Result.004 file - promoters50/1013878
tgaaactcaaaattt

SEQ ID NO: 154881 - DNA, 15 bp, Unknown
  misc_feature (1)..( 15): Result.004 file - promoters50/1013878
aacaaaacaaaacga

SEQ ID NO: 154882 - DNA, 15 bp, Unknown
  misc_feature (1)..( 15): Result.004 file - promoters50/1013878
aagaagaaaaaaaac

SEQ ID NO: 154883 - DNA, 14 bp, Unknown
  misc_feature (1)..( 14): Result.004 file - promoters50/1013878
acaagagaaacttg

SEQ ID NO: 154884 - DNA, 14 bp, Unknown
  misc_feature (1)..( 14): Result.004 file - promoters50/1013878
agaagaaaaaaaac

SEQ ID NO: 154885 - DNA, 14 bp, Unknown
  misc_feature (1)..( 14): Result.004 file - promoters50/1013878
tttagaagaagtta

SEQ ID NO: 154886 - DNA, 14 bp, Unknown
  misc_feature (1)..( 14): Result.004 file - promoters50/1013878
gaaaaaaaaaatgg

SEQ ID NO: 154887 - DNA, 14 bp, Unknown
  misc_feature (1)..( 14): Result.004 file - promoters50/1013878
agtaaaaaaacaat

SEQ ID NO: 154888 - DNA, 14 bp, Unknown
  misc_feature (1)..( 14): Result.004 file - promoters50/1013878
gtaacaaaacaaaa

SEQ ID NO: 154889 - DNA, 12 bp, Unknown
  misc_feature (1)..( 12): Result.004 file - promoters50/1013878
gaatctaataca

SEQ ID NO: 154890 - DNA, 12 bp, Unknown
  misc_feature (1)..( 12): Result.004 file - promoters50/1013878
aaatataattaa

SEQ ID NO: 154891 - DNA, 13 bp, Unknown
  misc_feature (1)..( 13): Result.004 file - promoters50/1013878
aaattattttaat

SEQ ID NO: 154892 - DNA, 13 bp, Unknown
  misc_feature (1)..( 13): Result.004 file - promoters50/1013878
caaatattttatt

SEQ ID NO: 154893 - DNA, 13 bp, Unknown
  misc_feature (1)..( 13): Result.004 file - promoters50/1013878
catagataattaa

SEQ ID NO: 154894 - DNA, 13 bp, Unknown
  misc_feature (1)..( 13): Result.004 file - promoters50/1013878
ttgatttttttcg

SEQ ID NO: 154895 - DNA, 9 bp, Unknown
  misc_feature (1)..( 9): Result.004 file - promoters50/1013878
aaataaaaa

SEQ ID NO: 154896 - DNA, 9 bp, Unknown
  misc_feature (1)..( 9): Result.004 file - promoters50/1013878
aaacaaaac

SEQ ID NO: 154897 - DNA, 9 bp, Unknown
  misc_feature (1)..( 9): Result.004 file - promoters50/1013878
cagtaaaaa

SEQ ID NO: 154898 - DNA, 9 bp, Unknown
  misc_feature (1)..( 9): Result.004 file - promoters50/1013878
aaaaaaaaa

SEQ ID NO: 154899 - DNA, 9 bp, Unknown
  misc_feature (1)..( 9): Result.004 file - promoters50/1013878
agaaaaaaa

SEQ ID NO: 154900 - DNA, 9 bp, Unknown
  misc_feature (1)..( 9): Result.004 file - promoters50/1013893
ccaaaaaat

SEQ ID NO: 154901 - DNA, 12 bp, Unknown
  misc_feature (1)..( 12): Result.004 file - promoters50/1013893
aagaaaattgac

SEQ ID NO: 154902 - DNA, 12 bp, Unknown
  misc_feature (1)..( 12): Result.004 file - promoters50/1013893
aagaaatttgct

SEQ ID NO: 154903 - DNA, 12 bp, Unknown
  misc_feature (1)..( 12): Result.004 file - promoters50/1013893
gtcaaatttgtc

SEQ ID NO: 154904 - DNA, 12 bp, Unknown
  misc_feature (1)..( 12): Result.004 file - promoters50/1013893
aagaaaccaatt

SEQ ID NO: 154905 - DNA, 12 bp, Unknown
  misc_feature (1)..( 12): Result.004 file - promoters50/1013893
tatgaatctgct

SEQ ID NO: 154906 - DNA, 12 bp, Unknown
  misc_feature (1)..( 12): Result.004 file - promoters50/1013893
taacaatttttt

SEQ ID NO: 154907 - DNA, 14 bp, Unknown
  misc_feature (1)..( 14): Result.004 file - promoters50/1013893
taaggacatcgaaa

SEQ ID NO: 154908 - DNA, 14 bp, Unknown
  misc_feature (1)..( 14): Result.004 file - promoters50/1013893
taagaacattggat

SEQ ID NO: 154909 - DNA, 14 bp, Unknown
  misc_feature (1)..( 14): Result.004 file - promoters50/1013893
cacgaacatggatt

SEQ ID NO: 154910 - DNA, 14 bp, Unknown
  misc_feature (1)..( 14): Result.004 file - promoters50/1013893
aaagaagatgaaac

SEQ ID NO: 154911 - DNA, 14 bp, Unknown
  misc_feature (1)..( 14): Result.004 file - promoters50/1013893
gtagagcataagac

SEQ ID NO: 154912 - DNA, 14 bp, Unknown
  misc_feature (1)..( 14): Result.004 file - promoters50/1013904
agagaaaatttgat

SEQ ID NO: 154913 - DNA, 10 bp, Unknown
  misc_feature (1)..( 10): Result.004 file - promoters50/1013904
aatttaataa

SEQ ID NO: 154914 - DNA, 10 bp, Unknown
  misc_feature (1)..( 10): Result.004 file - promoters50/1013904
aatctaacaa

SEQ ID NO: 154915 - DNA, 10 bp, Unknown
  misc_feature (1)..( 10): Result.004 file - promoters50/1013904
gttttaatta

SEQ ID NO: 154916 - DNA, 10 bp, Unknown
  misc_feature (1)..( 10): Result.004 file - promoters50/1013904
attctaacta

SEQ ID NO: 154917 - DNA, 10 bp, Unknown
  misc_feature (1)..( 10): Result.004 file - promoters50/1013904
tttctaaaat

SEQ ID NO: 154918 - DNA, 10 bp, Unknown
  misc_feature (1)..( 10): Result.004 file - promoters50/1013904
tgtttgatta

SEQ ID NO: 154919 - DNA, 9 bp, Unknown
  misc_feature (1)..( 9): Result.004 file - promoters50/1013904
ttatattta

SEQ ID NO: 154920 - DNA, 9 bp, Unknown
  misc_feature (1)..( 9): Result.004 file - promoters50/1013904
caatatttg

SEQ ID NO: 154921 - DNA, 9 bp, Unknown
  misc_feature (1)..( 9): Result.004 file - promoters50/1013904
atatgtttc

SEQ ID NO: 154922 - DNA, 9 bp, Unknown
  misc_feature (1)..( 9): Result.004 file - promoters50/1013904
caatatgtg

SEQ ID NO: 154923 - DNA, 9 bp, Unknown
  misc_feature (1)..( 9): Result.004 file - promoters50/1013904
caaaattat

SEQ ID NO: 154924 - DNA, 9 bp, Unknown
  misc_feature (1)..( 9): Result.004 file - promoters50/1013907
caaacttat

SEQ ID NO: 154925 - DNA, 9 bp, Unknown
  misc_feature (1)..( 9): Result.004 file - promoters50/1013907
gaaagattg

SEQ ID NO: 154926 - DNA, 9 bp, Unknown
  misc_feature (1)..( 9): Result.004 file - promoters50/1013907
taaagcttg

SEQ ID NO: 154927 - DNA, 9 bp, Unknown
  misc_feature (1)..( 9): Result.004 file - promoters50/1013907
taaaaattt

SEQ ID NO: 154928 - DNA, 9 bp, Unknown
  misc_feature (1)..( 9): Result.004 file - promoters50/1013907
taaaaagga

SEQ ID NO: 154929 - DNA, 9 bp, Unknown
  misc_feature (1)..( 9): Result.004 file - promoters50/1013907
tcccactaa

SEQ ID NO: 154930 - DNA, 9 bp, Unknown
  misc_feature (1)..( 9): Result.004 file - promoters50/1013907
aaccattaa

SEQ ID NO: 154931 - DNA, 9 bp, Unknown
  misc_feature (1)..( 9): Result.004 file - promoters50/1013907
gtccattag

SEQ ID NO: 154932 - DNA, 9 bp, Unknown
  misc_feature (1)..( 9): Result.004 file - promoters50/1013907
aactattct

SEQ ID NO: 154933 - DNA, 10 bp, Unknown
  misc_feature (1)..( 10): Result.004 file - promoters50/1013907
attacaaaaa

SEQ ID NO: 154934 - DNA, 10 bp, Unknown
  misc_feature (1)..( 10): Result.004 file - promoters50/1013907
cttataaaac

SEQ ID NO: 154935 - DNA, 10 bp, Unknown
  misc_feature (1)..( 10): Result.004 file - promoters50/1013907
tttagaaaaa

SEQ ID NO: 154936 - DNA, 11 bp, Unknown
  misc_feature (1)..( 11): Result.004 file - promoters50/1013907
tttaagactct

SEQ ID NO: 154937 - DNA, 8 bp, Unknown
  misc_feature (1)..( 8): Result.004 file - promoters50/1013907
tttaaatg

SEQ ID NO: 154938 - DNA, 8 bp, Unknown
  misc_feature (1)..( 8): Result.004 file - promoters50/1013907
tttaaaat

SEQ ID NO: 154939 - DNA, 8 bp, Unknown
  misc_feature (1)..( 8): Result.004 file - promoters50/1013907
tttgaatt

SEQ ID NO: 154940 - DNA, 9 bp, Unknown
  misc_feature (1)..( 9): Result.004 file - promoters50/1013923
tttagaatc

SEQ ID NO: 154941 - DNA, 13 bp, Unknown
  misc_feature (1)..( 13): Result.004 file - promoters50/1013923
taagatttttgtt

SEQ ID NO: 154942 - DNA, 13 bp, Unknown
  misc_feature (1)..( 13): Result.004 file - promoters50/1013923
ggagactttgggt

SEQ ID NO: 154943 - DNA, 13 bp, Unknown
  misc_feature (1)..( 13): Result.004 file - promoters50/1013923
tagaatttttttc

SEQ ID NO: 154944 - DNA, 13 bp, Unknown
  misc_feature (1)..( 13): Result.004 file - promoters50/1013923
taacattttttaa

SEQ ID NO: 154945 - DNA, 13 bp, Unknown
  misc_feature (1)..( 13): Result.004 file - promoters50/1013923
aacaattttagtt

SEQ ID NO: 154946 - DNA, 13 bp, Unknown
  misc_feature (1)..( 13): Result.004 file - promoters50/1013923
tccaattttgggc

SEQ ID NO: 154947 - DNA, 14 bp, Unknown
  misc_feature (1)..( 14): Result.004 file - promoters50/1013923
taaactaatttaaa

SEQ ID NO: 154948 - DNA, 14 bp, Unknown
  misc_feature (1)..( 14): Result.004 file - promoters50/1013923
acatgtaatttttc

SEQ ID NO: 154949 - DNA, 15 bp, Unknown
  misc_feature (1)..( 15): Result.004 file - promoters50/1013923
acatttaactttatt

SEQ ID NO: 154950 - DNA, 16 bp, Unknown
  misc_feature (1)..( 16): Result.004 file - promoters50/1013923
ctttttaatatttcat

SEQ ID NO: 154951 - DNA, 16 bp, Unknown
  misc_feature (1)..( 16): Result.004 file - promoters50/1013923
aatgataatatcttga

SEQ ID NO: 154952 - DNA, 17 bp, Unknown
  misc_feature (1)..( 17): Result.004 file - promoters50/1013923
acacaaaactatataaa

SEQ ID NO: 154953 - DNA, 10 bp, Unknown
  misc_feature (1)..( 10): Result.004 file - promoters50/1013923
acattctcaa

SEQ ID NO: 154954 - DNA, 10 bp, Unknown
  misc_feature (1)..( 10): Result.004 file - promoters50/1013923
taattttcag

SEQ ID NO: 154955 - DNA, 10 bp, Unknown
  misc_feature (1)..( 10): Result.004 file - promoters50/1013923
catttcacaa

SEQ ID NO: 154956 - DNA, 10 bp, Unknown
  misc_feature (1)..( 10): Result.004 file - promoters50/1013923
catttctcat

SEQ ID NO: 154957 - DNA, 10 bp, Unknown
  misc_feature (1)..( 10): Result.004 file - promoters50/1013923
taactttatt

SEQ ID NO: 154958 - DNA, 10 bp, Unknown
  misc_feature (1)..( 10): Result.004 file - promoters50/1013923
aaactatata

SEQ ID NO: 154959 - DNA, 10 bp, Unknown
  misc_feature (1)..( 10): Result.004 file - promoters50/1013923
gataatggct

SEQ ID NO: 154960 - DNA, 10 bp, Unknown
  misc_feature (1)..( 10): Result.004 file - promoters50/1013923
gataattttc

SEQ ID NO: 154961 - DNA, 10 bp, Unknown
  misc_feature (1)..( 10): Result.004 file - promoters50/1013923
gataatatct

SEQ ID NO: 154962 - DNA, 10 bp, Unknown
  misc_feature (1)..( 10): Result.004 file - promoters50/1013923
cataatatta

SEQ ID NO: 154963 - DNA, 10 bp, Unknown
  misc_feature (1)..( 10): Result.004 file - promoters50/1013923
tttaatattt

SEQ ID NO: 154964 - DNA, 10 bp, Unknown
  misc_feature (1)..( 10): Result.004 file - promoters50/1013931
gataagatta

SEQ ID NO: 154965 - DNA, 9 bp, Unknown
  misc_feature (1)..( 9): Result.004 file - promoters50/1013931
gaaaaattg

SEQ ID NO: 154966 - DNA, 9 bp, Unknown
  misc_feature (1)..( 9): Result.004 file - promoters50/1013931
caaaacttg

SEQ ID NO: 154967 - DNA, 9 bp, Unknown
  misc_feature (1)..( 9): Result.004 file - promoters50/1013931
gaaatattt

SEQ ID NO: 154968 - DNA, 10 bp, Unknown
  misc_feature (1)..( 10): Result.004 file - promoters50/1013931
atctctgctt

SEQ ID NO: 154969 - DNA, 10 bp, Unknown
  misc_feature (1)..( 10): Result.004 file - promoters50/1013931
atctctcgtg

SEQ ID NO: 154970 - DNA, 10 bp, Unknown
  misc_feature (1)..( 10): Result.004 file - promoters50/1013931
ttctctggtg

SEQ ID NO: 154971 - DNA, 9 bp, Unknown
  misc_feature (1)..( 9): Result.004 file - promoters50/1013931
agaaacata

SEQ ID NO: 154972 - DNA, 9 bp, Unknown
  misc_feature (1)..( 9): Result.004 file - promoters50/1013931
agaagcata

SEQ ID NO: 154973 - DNA, 9 bp, Unknown
  misc_feature (1)..( 9): Result.004 file - promoters50/1013931
agaagcacc

SEQ ID NO: 154974 - DNA, 8 bp, Unknown
  misc_feature (1)..( 8): Result.004 file - promoters50/1013931
ttaaactt

SEQ ID NO: 154975 - DNA, 8 bp, Unknown
  misc_feature (1)..( 8): Result.004 file - promoters50/1013931
ttagactt

SEQ ID NO: 154976 - DNA, 8 bp, Unknown
  misc_feature (1)..( 8): Result.004 file - promoters50/1013931
atagactc

SEQ ID NO: 154977 - DNA, 8 bp, Unknown
  misc_feature (1)..( 8): Result.004 file - promoters50/1013931
tttgattt

SEQ ID NO: 154978 - DNA, 8 bp, Unknown
  misc_feature (1)..( 8): Result.004 file - promoters50/1013931
ttttattt

SEQ ID NO: 154979 - DNA, 8 bp, Unknown
  misc_feature (1)..( 8): Result.004 file - promoters50/1013931
atttattc

SEQ ID NO: 154980 - DNA, 11 bp, Unknown
  misc_feature (1)..( 11): Result.004 file - promoters50/1013931
aaagtttcata

SEQ ID NO: 154981 - DNA, 11 bp, Unknown
  misc_feature (1)..( 11): Result.004 file - promoters50/1013931
acagttccata

SEQ ID NO: 154982 - DNA, 11 bp, Unknown
  misc_feature (1)..( 11): Result.004 file - promoters50/1013931
aaaatttgcca

SEQ ID NO: 154983 - DNA, 8 bp, Unknown
  misc_feature (1)..( 8): Result.004 file - promoters50/1013931
tttgttca

SEQ ID NO: 154984 - DNA, 8 bp, Unknown
  misc_feature (1)..( 8): Result.004 file - promoters50/1013931
tttattca

SEQ ID NO: 154985 - DNA, 8 bp, Unknown
  misc_feature (1)..( 8): Result.004 file - promoters50/1013957
tttatttg

SEQ ID NO: 154986 - DNA, 10 bp, Unknown
  misc_feature (1)..( 10): Result.004 file - promoters50/1013957
ttattaatct

SEQ ID NO: 154987 - DNA, 10 bp, Unknown
  misc_feature (1)..( 10): Result.004 file - promoters50/1013957
atataaattg

SEQ ID NO: 154988 - DNA, 10 bp, Unknown
  misc_feature (1)..( 10): Result.004 file - promoters50/1013957
ataaaaatct

SEQ ID NO: 154989 - DNA, 10 bp, Unknown
  misc_feature (1)..( 10): Result.004 file - promoters50/1013957
gtaaaaattt

SEQ ID NO: 154990 - DNA, 10 bp, Unknown
  misc_feature (1)..( 10): Result.004 file - promoters50/1013957
ctaaatattt

SEQ ID NO: 154991 - DNA, 15 bp, Unknown
  misc_feature (1)..( 15): Result.004 file - promoters50/1013957
acgtaattatctaaa

SEQ ID NO: 154992 - DNA, 15 bp, Unknown
  misc_feature (1)..( 15): Result.004 file - promoters50/1013957
ggccacttagctaaa

SEQ ID NO: 154993 - DNA, 15 bp, Unknown
  misc_feature (1)..( 15): Result.004 file - promoters50/1013957
ttctggttatgtaat

SEQ ID NO: 154994 - DNA, 15 bp, Unknown
  misc_feature (1)..( 15): Result.004 file - promoters50/1013957
ttctcgttttgtttg

SEQ ID NO: 154995 - DNA, 15 bp, Unknown
  misc_feature (1)..( 15): Result.004 file - promoters50/1013957
gatagaatttgtttg

SEQ ID NO: 154996 - DNA, 12 bp, Unknown
  misc_feature (1)..( 12): Result.004 file - promoters50/1013957
tttctctgggta

SEQ ID NO: 154997 - DNA, 12 bp, Unknown
  misc_feature (1)..( 12): Result.004 file - promoters50/1013957
cttctctatggt

SEQ ID NO: 154998 - DNA, 12 bp, Unknown
  misc_feature (1)..( 12): Result.004 file - promoters50/1013957
cttttctttggt

SEQ ID NO: 154999 - DNA, 12 bp, Unknown
  misc_feature (1)..( 12): Result.004 file - promoters50/1013957
gttttgtttggg

SEQ ID NO: 155000 - DNA, 12 bp, Unknown
  misc_feature (1)..( 12): Result.004 file - promoters50/1014010
aatttgtttgtt

SEQ ID NO: 155001 - DNA, 13 bp, Unknown
  misc_feature (1)..( 13): Result.004 file - promoters50/1014010
ttaactttattgt

SEQ ID NO: 155002 - DNA, 13 bp, Unknown
  misc_feature (1)..( 13): Result.004 file - promoters50/1014010
ccaactttgacca

SEQ ID NO: 155003 - DNA, 13 bp, Unknown
  misc_feature (1)..( 13): Result.004 file - promoters50/1014010
tctactttcttgt

SEQ ID NO: 155004 - DNA, 13 bp, Unknown
  misc_feature (1)..( 13): Result.004 file - promoters50/1014010
aaaacgttaaaac

SEQ ID NO: 155005 - DNA, 13 bp, Unknown
  misc_feature (1)..( 13): Result.004 file - promoters50/1014010
ttaccttaaaaat

SEQ ID NO: 155006 - DNA, 13 bp, Unknown
  misc_feature (1)..( 13): Result.004 file - promoters50/1014010
aaaccttgtggtc

SEQ ID NO: 155007 - DNA, 9 bp, Unknown
  misc_feature (1)..( 9): Result.004 file - promoters50/1014010
gaacaaaaa

SEQ ID NO: 155008 - DNA, 9 bp, Unknown
  misc_feature (1)..( 9): Result.004 file - promoters50/1014010
aaaccaaac

SEQ ID NO: 155009 - DNA, 9 bp, Unknown
  misc_feature (1)..( 9): Result.004 file - promoters50/1014010
aaacgaaaa

SEQ ID NO: 155010 - DNA, 9 bp, Unknown
  misc_feature (1)..( 9): Result.004 file - promoters50/1014010
gaacaatta

SEQ ID NO: 155011 - DNA, 9 bp, Unknown
  misc_feature (1)..( 9): Result.004 file - promoters50/1014010
ctaccaaaa

SEQ ID NO: 155012 - DNA, 9 bp, Unknown
  misc_feature (1)..( 9): Result.004 file - promoters50/1014010
gaataataa

SEQ ID NO: 155013 - DNA, 9 bp, Unknown
  misc_feature (1)..( 9): Result.004 file - promoters50/1014010
aaataatta

SEQ ID NO: 155014 - DNA, 9 bp, Unknown
  misc_feature (1)..( 9): Result.004 file - promoters50/1014010
gaattaaac

SEQ ID NO: 155015 - DNA, 9 bp, Unknown
  misc_feature (1)..( 9): Result.004 file - promoters50/1014010
atattaaat

SEQ ID NO: 155016 - DNA, 9 bp, Unknown
  misc_feature (1)..( 9): Result.004 file - promoters50/1014010
tatttaaac

SEQ ID NO: 155017 - DNA, 9 bp, Unknown
  misc_feature (1)..( 9): Result.004 file - promoters50/1014010
ttataaaaa

SEQ ID NO: 155018 - DNA, 9 bp, Unknown
  misc_feature (1)..( 9): Result.004 file - promoters50/1014010
ctataaaac

SEQ ID NO: 155019 - DNA, 9 bp, Unknown
  misc_feature (1)..( 9): Result.004 file - promoters50/1014010
gtataaaat

SEQ ID NO: 155020 - DNA, 9 bp, Unknown
  misc_feature (1)..( 9): Result.004 file - promoters50/1014010
ctataaata

SEQ ID NO: 155021 - DNA, 12 bp, Unknown
  misc_feature (1)..( 12): Result.004 file - promoters50/1014010
aatttgaaatcc

SEQ ID NO: 155022 - DNA, 12 bp, Unknown
  misc_feature (1)..( 12): Result.004 file - promoters50/1014010
cattagaaaaaa

SEQ ID NO: 155023 - DNA, 12 bp, Unknown
  misc_feature (1)..( 12): Result.004 file - promoters50/1014010
aattagaataat

SEQ ID NO: 155024 - DNA, 12 bp, Unknown
  misc_feature (1)..( 12): Result.004 file - promoters50/1014010
ggttatatttac

SEQ ID NO: 155025 - DNA, 12 bp, Unknown
  misc_feature (1)..( 12): Result.004 file - promoters50/1014010
aataataattag

SEQ ID NO: 155026 - DNA, 12 bp, Unknown
  misc_feature (1)..( 12): Result.004 file - promoters50/1014010
aattattattat

SEQ ID NO: 155027 - DNA, 9 bp, Unknown
  misc_feature (1)..( 9): Result.004 file - promoters50/1014010
aaaaatttg

SEQ ID NO: 155028 - DNA, 9 bp, Unknown
  misc_feature (1)..( 9): Result.004 file - promoters50/1014010
caaaatttc

SEQ ID NO: 155029 - DNA, 10 bp, Unknown
  misc_feature (1)..( 10): Result.004 file - promoters50/1014010
aaataattat

SEQ ID NO: 155030 - DNA, 10 bp, Unknown
  misc_feature (1)..( 10): Result.004 file - promoters50/1014010
gttatattta

SEQ ID NO: 155031 - DNA, 10 bp, Unknown
  misc_feature (1)..( 10): Result.004 file - promoters50/1014010
cgaaaattat

SEQ ID NO: 155032 - DNA, 10 bp, Unknown
  misc_feature (1)..( 10): Result.004 file - promoters50/1014010
gaataataat

SEQ ID NO: 155033 - DNA, 10 bp, Unknown
  misc_feature (1)..( 10): Result.004 file - promoters50/1014010
atattttgtt

SEQ ID NO: 155034 - DNA, 10 bp, Unknown
  misc_feature (1)..( 10): Result.004 file - promoters50/1014010
atatttactg

SEQ ID NO: 155035 - DNA, 10 bp, Unknown
  misc_feature (1)..( 10): Result.004 file - promoters50/1014010
ataattagtt

SEQ ID NO: 155036 - DNA, 10 bp, Unknown
  misc_feature (1)..( 10): Result.004 file - promoters50/1014010
ataattataa

SEQ ID NO: 155037 - DNA, 10 bp, Unknown
  misc_feature (1)..( 10): Result.004 file - promoters50/1014010
aaaattatat

SEQ ID NO: 155038 - DNA, 10 bp, Unknown
  misc_feature (1)..( 10): Result.004 file - promoters50/1014010
tcaattatta

SEQ ID NO: 155039 - DNA, 12 bp, Unknown
  misc_feature (1)..( 12): Result.004 file - promoters50/1014010
tggttatattta

SEQ ID NO: 155040 - DNA, 12 bp, Unknown
  misc_feature (1)..( 12): Result.004 file - promoters50/1014010
aaattatataaa

SEQ ID NO: 155041 - DNA, 12 bp, Unknown
  misc_feature (1)..( 12): Result.004 file - promoters50/1014010
taattataatta

SEQ ID NO: 155042 - DNA, 12 bp, Unknown
  misc_feature (1)..( 12): Result.004 file - promoters50/1014010
gaataataatta

SEQ ID NO: 155043 - DNA, 12 bp, Unknown
  misc_feature (1)..( 12): Result.004 file - promoters50/1014010
gaacaattactg

SEQ ID NO: 155044 - DNA, 12 bp, Unknown
  misc_feature (1)..( 12): Result.004 file - promoters50/1014117
gaaaaataaaat

SEQ ID NO: 155045 - DNA, 7 bp, Unknown
  misc_feature (1)..( 7): Result.004 file - promoters50/1014117
tttgttc

SEQ ID NO: 155046 - DNA, 7 bp, Unknown
  misc_feature (1)..( 7): Result.004 file - promoters50/1014117
attgttc

SEQ ID NO: 155047 - DNA, 8 bp, Unknown
  misc_feature (1)..( 8): Result.004 file - promoters50/1014125
tttggttt

SEQ ID NO: 155048 - DNA, 15 bp, Unknown
  misc_feature (1)..( 15): Result.004 file - promoters50/1014125
aaactgtgaaactgt

SEQ ID NO: 155049 - DNA, 15 bp, Unknown
  misc_feature (1)..( 15): Result.004 file - promoters50/1014125
aaaatgtgaaatgta

SEQ ID NO: 155050 - DNA, 15 bp, Unknown
  misc_feature (1)..( 15): Result.004 file - promoters50/1014125
gctttgtgaaaaatc

SEQ ID NO: 155051 - DNA, 15 bp, Unknown
  misc_feature (1)..( 15): Result.004 file - promoters50/1014125
caatgtaaaaataat

SEQ ID NO: 155052 - DNA, 15 bp, Unknown
  misc_feature (1)..( 15): Result.004 file - promoters50/1014125
gttatgtgacaatag

SEQ ID NO: 155053 - DNA, 15 bp, Unknown
  misc_feature (1)..( 15): Result.004 file - promoters50/1014125
tgatagtttagaaca

SEQ ID NO: 155054 - DNA, 15 bp, Unknown
  misc_feature (1)..( 15): Result.004 file - promoters50/1014176
tacttgttagtgttc

SEQ ID NO: 155055 - DNA, 12 bp, Unknown
  misc_feature (1)..( 12): Result.004 file - promoters50/1014176
tgtaaattaatt

SEQ ID NO: 155056 - DNA, 12 bp, Unknown
  misc_feature (1)..( 12): Result.004 file - promoters50/1014176
attaaaataatc

SEQ ID NO: 155057 - DNA, 12 bp, Unknown
  misc_feature (1)..( 12): Result.004 file - promoters50/1014176
tacaaattcatt

SEQ ID NO: 155058 - DNA, 12 bp, Unknown
  misc_feature (1)..( 12): Result.004 file - promoters50/1014176
tgtaatttaacc

SEQ ID NO: 155059 - DNA, 12 bp, Unknown
  misc_feature (1)..( 12): Result.004 file - promoters50/1014176
ctttctttacta

SEQ ID NO: 155060 - DNA, 12 bp, Unknown
  misc_feature (1)..( 12): Result.004 file - promoters50/1014180
atttttttacaa

SEQ ID NO: 155061 - DNA, 9 bp, Unknown
  misc_feature (1)..( 9): Result.004 file - promoters50/1014180
ttttaacat

SEQ ID NO: 155062 - DNA, 9 bp, Unknown
  misc_feature (1)..( 9): Result.004 file - promoters50/1014180
ttttaatta

SEQ ID NO: 155063 - DNA, 9 bp, Unknown
  misc_feature (1)..( 9): Result.004 file - promoters50/1014180
tttgaacat

SEQ ID NO: 155064 - DNA, 9 bp, Unknown
  misc_feature (1)..( 9): Result.004 file - promoters50/1014180
tttgattag

SEQ ID NO: 155065 - DNA, 9 bp, Unknown
  misc_feature (1)..( 9): Result.004 file - promoters50/1014180
atttaattc

SEQ ID NO: 155066 - DNA, 9 bp, Unknown
  misc_feature (1)..( 9): Result.004 file - promoters50/1014180
aattaattg

SEQ ID NO: 155067 - DNA, 9 bp, Unknown
  misc_feature (1)..( 9): Result.004 file - promoters50/1014180
aattgatgt

SEQ ID NO: 155068 - DNA, 9 bp, Unknown
  misc_feature (1)..( 9): Result.004 file - promoters50/1014180
aattaatgg

SEQ ID NO: 155069 - DNA, 9 bp, Unknown
  misc_feature (1)..( 9): Result.004 file - promoters50/1014180
gtttgatta

SEQ ID NO: 155070 - DNA, 9 bp, Unknown
  misc_feature (1)..( 9): Result.004 file - promoters50/1014180
atttaattc

SEQ ID NO: 155071 - DNA, 9 bp, Unknown
  misc_feature (1)..( 9): Result.004 file - promoters50/1014180
aattaattg

SEQ ID NO: 155072 - DNA, 9 bp, Unknown
  misc_feature (1)..( 9): Result.004 file - promoters50/1014259
aattacttc

SEQ ID NO: 155073 - DNA, 8 bp, Unknown
  misc_feature (1)..( 8): Result.004 file - promoters50/1014259
ttgaaaac

SEQ ID NO: 155074 - DNA, 8 bp, Unknown
  misc_feature (1)..( 8): Result.004 file - promoters50/1014259
atgaaaat

SEQ ID NO: 155075 - DNA, 8 bp, Unknown
  misc_feature (1)..( 8): Result.004 file - promoters50/1014259
attaaaaa

SEQ ID NO: 155076 - DNA, 10 bp, Unknown
  misc_feature (1)..( 10): Result.004 file - promoters50/1014259
gtaatgacac

SEQ ID NO: 155077 - DNA, 10 bp, Unknown
  misc_feature (1)..( 10): Result.004 file - promoters50/1014259
caaataacaa

SEQ ID NO: 155078 - DNA, 10 bp, Unknown
  misc_feature (1)..( 10): Result.004 file - promoters50/1014259
gtaataacac

SEQ ID NO: 155079 - DNA, 10 bp, Unknown
  misc_feature (1)..( 10): Result.004 file - promoters50/1014259
tatataccaa

SEQ ID NO: 155080 - DNA, 8 bp, Unknown
  misc_feature (1)..( 8): Result.004 file - promoters50/1014259
aatttatc

SEQ ID NO: 155081 - DNA, 8 bp, Unknown
  misc_feature (1)..( 8): Result.004 file - promoters50/1014259
aatatata

SEQ ID NO: 155082 - DNA, 8 bp, Unknown
  misc_feature (1)..( 8): Result.004 file - promoters50/1014259
aatatata

SEQ ID NO: 155083 - DNA, 8 bp, Unknown
  misc_feature (1)..( 8): Result.004 file - promoters50/1014259
tatagata

SEQ ID NO: 155084 - DNA, 9 bp, Unknown
  misc_feature (1)..( 9): Result.004 file - promoters50/1014259
ttcgttttc

SEQ ID NO: 155085 - DNA, 9 bp, Unknown
  misc_feature (1)..( 9): Result.004 file - promoters50/1014259
aaagttttc

SEQ ID NO: 155086 - DNA, 9 bp, Unknown
  misc_feature (1)..( 9): Result.004 file - promoters50/1014259
ttcgttttg

SEQ ID NO: 155087 - DNA, 8 bp, Unknown
  misc_feature (1)..( 8): Result.004 file - promoters50/1014259
tctattta

SEQ ID NO: 155088 - DNA, 8 bp, Unknown
  misc_feature (1)..( 8): Result.004 file - promoters50/1014259
catattta

SEQ ID NO: 155089 - DNA, 8 bp, Unknown
  misc_feature (1)..( 8): Result.004 file - promoters50/1014259
tctgtttg

SEQ ID NO: 155090 - DNA, 8 bp, Unknown
  misc_feature (1)..( 8): Result.004 file - promoters50/1014259
attaaaaa

SEQ ID NO: 155091 - DNA, 8 bp, Unknown
  misc_feature (1)..( 8): Result.004 file - promoters50/1014259
tataaaaa

SEQ ID NO: 155092 - DNA, 8 bp, Unknown
  misc_feature (1)..( 8): Result.004 file - promoters50/1014259
tatgaaag

SEQ ID NO: 155093 - DNA, 15 bp, Unknown
  misc_feature (1)..( 15): Result.004 file - promoters50/1014259
taacaactaatgggc

SEQ ID NO: 155094 - DNA, 15 bp, Unknown
  misc_feature (1)..( 15): Result.004 file - promoters50/1014259
taaaaactaagaaac

SEQ ID NO: 155095 - DNA, 15 bp, Unknown
  misc_feature (1)..( 15): Result.004 file - promoters50/1014259
tcataactaatgggc

SEQ ID NO: 155096 - DNA, 10 bp, Unknown
  misc_feature (1)..( 10): Result.004 file - promoters50/1014259
acaataaaag

SEQ ID NO: 155097 - DNA, 10 bp, Unknown
  misc_feature (1)..( 10): Result.004 file - promoters50/1014259
acaaaaaaag

SEQ ID NO: 155098 - DNA, 10 bp, Unknown
  misc_feature (1)..( 10): Result.004 file - promoters50/1014387
aaactaaacc

SEQ ID NO: 155099 - DNA, 9 bp, Unknown
  misc_feature (1)..( 9): Result.004 file - promoters50/1014387
taaaatatc

SEQ ID NO: 155100 - DNA, 9 bp, Unknown
  misc_feature (1)..( 9): Result.004 file - promoters50/1014387
tgaaatatt

SEQ ID NO: 155101 - DNA, 9 bp, Unknown
  misc_feature (1)..( 9): Result.004 file - promoters50/1014387
aaaaatatt

SEQ ID NO: 155102 - DNA, 9 bp, Unknown
  misc_feature (1)..( 9): Result.004 file - promoters50/1014387
tgatatata

SEQ ID NO: 155103 - DNA, 9 bp, Unknown
  misc_feature (1)..( 9): Result.004 file - promoters50/1014387
tgatattcg

SEQ ID NO: 155104 - DNA, 9 bp, Unknown
  misc_feature (1)..( 9): Result.004 file - promoters50/1014406
agttatata

SEQ ID NO: 155105 - DNA, 14 bp, Unknown
  misc_feature (1)..( 14): Result.004 file - promoters50/1014406
aaaaataaataaaa

SEQ ID NO: 155106 - DNA, 14 bp, Unknown
  misc_feature (1)..( 14): Result.004 file - promoters50/1014406
aaaaaaaaaaaaaa

SEQ ID NO: 155107 - DNA, 14 bp, Unknown
  misc_feature (1)..( 14): Result.004 file - promoters50/1014406
gaaaatacataatt

SEQ ID NO: 155108 - DNA, 14 bp, Unknown
  misc_feature (1)..( 14): Result.004 file - promoters50/1014406
tcaattaaacctac

SEQ ID NO: 155109 - DNA, 14 bp, Unknown
  misc_feature (1)..( 14): Result.004 file - promoters50/1014406
caatttaaaaacaa

SEQ ID NO: 155110 - DNA, 14 bp, Unknown
  misc_feature (1)..( 14): Result.004 file - promoters50/1014452
ggttctaaaaaaca

SEQ ID NO: 155111 - DNA, 10 bp, Unknown
  misc_feature (1)..( 10): Result.004 file - promoters50/1014452
tatataaata

SEQ ID NO: 155112 - DNA, 10 bp, Unknown
  misc_feature (1)..( 10): Result.004 file - promoters50/1014452
actataaata

SEQ ID NO: 155113 - DNA, 10 bp, Unknown
  misc_feature (1)..( 10): Result.004 file - promoters50/1014452
actatatata

SEQ ID NO: 155114 - DNA, 10 bp, Unknown
  misc_feature (1)..( 10): Result.004 file - promoters50/1014452
tctataaaaa

SEQ ID NO: 155115 - DNA, 10 bp, Unknown
  misc_feature (1)..( 10): Result.004 file - promoters50/1014452
tatatacata

SEQ ID NO: 155116 - DNA, 10 bp, Unknown
  misc_feature (1)..( 10): Result.004 file - promoters50/1014452
tatataaata

SEQ ID NO: 155117 - DNA, 10 bp, Unknown
  misc_feature (1)..( 10): Result.004 file - promoters50/1014452
taaatatatg

SEQ ID NO: 155118 - DNA, 11 bp, Unknown
  misc_feature (1)..( 11): Result.004 file - promoters50/1014452
tcaatttttta

SEQ ID NO: 155119 - DNA, 11 bp, Unknown
  misc_feature (1)..( 11): Result.004 file - promoters50/1014452
tcaatctttaa

SEQ ID NO: 155120 - DNA, 12 bp, Unknown
  misc_feature (1)..( 12): Result.004 file - promoters50/1014452
gttattatttac

SEQ ID NO: 155121 - DNA, 12 bp, Unknown
  misc_feature (1)..( 12): Result.004 file - promoters50/1014452
aaatatatttat

SEQ ID NO: 155122 - DNA, 12 bp, Unknown
  misc_feature (1)..( 12): Result.004 file - promoters50/1014452
atagaaatttac

SEQ ID NO: 155123 - DNA, 12 bp, Unknown
  misc_feature (1)..( 12): Result.004 file - promoters50/1014452
accaaaattaca

SEQ ID NO: 155124 - DNA, 10 bp, Unknown
  misc_feature (1)..( 10): Result.004 file - promoters50/1014452
aattaaaaac

SEQ ID NO: 155125 - DNA, 10 bp, Unknown
  misc_feature (1)..( 10): Result.004 file - promoters50/1014452
aattgaaaac

SEQ ID NO: 155126 - DNA, 11 bp, Unknown
  misc_feature (1)..( 11): Result.004 file - promoters50/1014452
aactaaataac

SEQ ID NO: 155127 - DNA, 11 bp, Unknown
  misc_feature (1)..( 11): Result.004 file - promoters50/1014452
cattaaaaaaa

SEQ ID NO: 155128 - DNA, 11 bp, Unknown
  misc_feature (1)..( 11): Result.004 file - promoters50/1014452
aatagaagagt

SEQ ID NO: 155129 - DNA, 11 bp, Unknown
  misc_feature (1)..( 11): Result.004 file - promoters50/1014452
aactaaaaata

SEQ ID NO: 155130 - DNA, 26 bp, Unknown
  misc_feature (1)..( 26): Result.004 file - promoters50/1014452
aatactttatcgtccaatcaatcttt

SEQ ID NO: 155131 - DNA, 26 bp, Unknown
  misc_feature (1)..( 26): Result.004 file - promoters50/1014452
tcatcagtatcgtccaaacaatcatt

SEQ ID NO: 155132 - DNA, 26 bp, Unknown
  misc_feature (1)..( 26): Result.004 file - promoters50/1014452
atttctttttcgagaatacaaagaat

SEQ ID NO: 155133 - DNA, 26 bp, Unknown
  misc_feature (1)..( 26): Result.004 file - promoters50/1014452
ttgatcttacattccaatcgttccaa

SEQ ID NO: 155134 - DNA, 26 bp, Unknown
  misc_feature (1)..( 26): Result.004 file - promoters50/1014452
tatttttactcagtaaaaaaataatt

SEQ ID NO: 155135 - DNA, 26 bp, Unknown
  misc_feature (1)..( 26): Result.004 file - promoters50/1014452
atttgtttttctgaacttacaaatat

SEQ ID NO: 155136 - DNA, 26 bp, Unknown
  misc_feature (1)..( 26): Result.004 file - promoters50/1014452
caatgagtccattaattaaaattaag

SEQ ID NO: 155137 - DNA, 13 bp, Unknown
  misc_feature (1)..( 13): Result.004 file - promoters50/1014452
ctaaaaatatatt

SEQ ID NO: 155138 - DNA, 13 bp, Unknown
  misc_feature (1)..( 13): Result.004 file - promoters50/1014452
tataaaatacttt

SEQ ID NO: 155139 - DNA, 14 bp, Unknown
  misc_feature (1)..( 14): Result.004 file - promoters50/1014452
aataacaattgaag

SEQ ID NO: 155140 - DNA, 15 bp, Unknown
  misc_feature (1)..( 15): Result.004 file - promoters50/1014452
agtatataattttag

SEQ ID NO: 155141 - DNA, 15 bp, Unknown
  misc_feature (1)..( 15): Result.004 file - promoters50/1014452
tttatataattacga

SEQ ID NO: 155142 - DNA, 15 bp, Unknown
  misc_feature (1)..( 15): Result.004 file - promoters50/1014452
tcataatacttttcg

SEQ ID NO: 155143 - DNA, 15 bp, Unknown
  misc_feature (1)..( 15): Result.004 file - promoters50/1014452
tgaccaaaattacaa

SEQ ID NO: 155144 - DNA, 12 bp, Unknown
  misc_feature (1)..( 12): Result.004 file - promoters50/1014452
ggattttttctc

SEQ ID NO: 155145 - DNA, 12 bp, Unknown
  misc_feature (1)..( 12): Result.004 file - promoters50/1014452
caatttttactt

SEQ ID NO: 155146 - DNA, 12 bp, Unknown
  misc_feature (1)..( 12): Result.004 file - promoters50/1014452
taatatttactg

SEQ ID NO: 155147 - DNA, 12 bp, Unknown
  misc_feature (1)..( 12): Result.004 file - promoters50/1014452
caatattacaac

SEQ ID NO: 155148 - DNA, 12 bp, Unknown
  misc_feature (1)..( 12): Result.004 file - promoters50/1014452
tgatttgtactt

SEQ ID NO: 155149 - DNA, 12 bp, Unknown
  misc_feature (1)..( 12): Result.004 file - promoters50/1014452
caaaattggttg

SEQ ID NO: 155150 - DNA, 9 bp, Unknown
  misc_feature (1)..( 9): Result.004 file - promoters50/1014452
taactataa

SEQ ID NO: 155151 - DNA, 9 bp, Unknown
  misc_feature (1)..( 9): Result.004 file - promoters50/1014452
taaatatat

SEQ ID NO: 155152 - DNA, 9 bp, Unknown
  misc_feature (1)..( 9): Result.004 file - promoters50/1014452
actatatat

SEQ ID NO: 155153 - DNA, 9 bp, Unknown
  misc_feature (1)..( 9): Result.004 file - promoters50/1014452
gaaatctat

SEQ ID NO: 155154 - DNA, 9 bp, Unknown
  misc_feature (1)..( 9): Result.004 file - promoters50/1014452
tatatatac

SEQ ID NO: 155155 - DNA, 9 bp, Unknown
  misc_feature (1)..( 9): Result.004 file - promoters50/1014509
cgtatatat

SEQ ID NO: 155156 - DNA, 9 bp, Unknown
  misc_feature (1)..( 9): Result.004 file - promoters50/1014509
tttgatcaa

SEQ ID NO: 155157 - DNA, 9 bp, Unknown
  misc_feature (1)..( 9): Result.004 file - promoters50/1014509
ttttatctt

SEQ ID NO: 155158 - DNA, 9 bp, Unknown
  misc_feature (1)..( 9): Result.004 file - promoters50/1014525
atttagctt

SEQ ID NO: 155159 - DNA, 17 bp, Unknown
  misc_feature (1)..( 17): Result.004 file - promoters50/1014525
ttagatatatttaagtc

SEQ ID NO: 155160 - DNA, 17 bp, Unknown
  misc_feature (1)..( 17): Result.004 file - promoters50/1014525
ttatatatgtttatatg

SEQ ID NO: 155161 - DNA, 17 bp, Unknown
  misc_feature (1)..( 17): Result.004 file - promoters50/1014525
gctcagataattatttg

SEQ ID NO: 155162 - DNA, 17 bp, Unknown
  misc_feature (1)..( 17): Result.004 file - promoters50/1014525
tattttatttttaattc

SEQ ID NO: 155163 - DNA, 17 bp, Unknown
  misc_feature (1)..( 17): Result.004 file - promoters50/1014525
aattattcgttgataaa

SEQ ID NO: 155164 - DNA, 17 bp, Unknown
  misc_feature (1)..( 17): Result.004 file - promoters50/1014525
acaagttggttgagaaa

SEQ ID NO: 155165 - DNA, 17 bp, Unknown
  misc_feature (1)..( 17): Result.004 file - promoters50/1014525
ggaattaattttttcaa

SEQ ID NO: 155166 - DNA, 11 bp, Unknown
  misc_feature (1)..( 11): Result.004 file - promoters50/1014525
aaagtcataaa

SEQ ID NO: 155167 - DNA, 11 bp, Unknown
  misc_feature (1)..( 11): Result.004 file - promoters50/1014525
aaagtgataaa

SEQ ID NO: 155168 - DNA, 11 bp, Unknown
  misc_feature (1)..( 11): Result.004 file - promoters50/1014525
gaagtcagatt

SEQ ID NO: 155169 - DNA, 11 bp, Unknown
  misc_feature (1)..( 11): Result.004 file - promoters50/1014525
ctagtcatttc

SEQ ID NO: 155170 - DNA, 11 bp, Unknown
  misc_feature (1)..( 11): Result.004 file - promoters50/1014525
gtcgtcatata

SEQ ID NO: 155171 - DNA, 11 bp, Unknown
  misc_feature (1)..( 11): Result.004 file - promoters50/1014525
catttcatatg

SEQ ID NO: 155172 - DNA, 10 bp, Unknown
  misc_feature (1)..( 10): Result.004 file - promoters50/1014525
atatttatac

SEQ ID NO: 155173 - DNA, 10 bp, Unknown
  misc_feature (1)..( 10): Result.004 file - promoters50/1014525
gtatatatac

SEQ ID NO: 155174 - DNA, 10 bp, Unknown
  misc_feature (1)..( 10): Result.004 file - promoters50/1014525
ttatataaac

SEQ ID NO: 155175 - DNA, 10 bp, Unknown
  misc_feature (1)..( 10): Result.004 file - promoters50/1014525
gtatataaat

SEQ ID NO: 155176 - DNA, 10 bp, Unknown
  misc_feature (1)..( 10): Result.004 file - promoters50/1014525
ttatatatag

SEQ ID NO: 155177 - DNA, 10 bp, Unknown
  misc_feature (1)..( 10): Result.004 file - promoters50/1014525
atataaataa

SEQ ID NO: 155178 - DNA, 10 bp, Unknown
  misc_feature (1)..( 10): Result.004 file - promoters50/1014525
ctatatattt

SEQ ID NO: 155179 - DNA, 10 bp, Unknown
  misc_feature (1)..( 10): Result.004 file - promoters50/1014525
ttatacaaat

SEQ ID NO: 155180 - DNA, 10 bp, Unknown
  misc_feature (1)..( 10): Result.004 file - promoters50/1014525
aaatataaat

SEQ ID NO: 155181 - DNA, 10 bp, Unknown
  misc_feature (1)..( 10): Result.004 file - promoters50/1014525
ttatataaac

SEQ ID NO: 155182 - DNA, 10 bp, Unknown
  misc_feature (1)..( 10): Result.004 file - promoters50/1014525
gtatataaat

SEQ ID NO: 155183 - DNA, 10 bp, Unknown
  misc_feature (1)..( 10): Result.004 file - promoters50/1014525
ttatatatag

SEQ ID NO: 155184 - DNA, 10 bp, Unknown
  misc_feature (1)..( 10): Result.004 file - promoters50/1014525
ctatatattt

SEQ ID NO: 155185 - DNA, 10 bp, Unknown
  misc_feature (1)..( 10): Result.004 file - promoters50/1014525
tatttgaatg

SEQ ID NO: 155186 - DNA, 10 bp, Unknown
  misc_feature (1)..( 10): Result.004 file - promoters50/1014525
tatatgaatt

SEQ ID NO: 155187 - DNA, 10 bp, Unknown
  misc_feature (1)..( 10): Result.004 file - promoters50/1014525
gattttaata

SEQ ID NO: 155188 - DNA, 10 bp, Unknown
  misc_feature (1)..( 10): Result.004 file - promoters50/1014525
aataagaatg

SEQ ID NO: 155189 - DNA, 10 bp, Unknown
  misc_feature (1)..( 10): Result.004 file - promoters50/1014525
gatatgacat

SEQ ID NO: 155190 - DNA, 10 bp, Unknown
  misc_feature (1)..( 10): Result.004 file - promoters50/1014525
tctttttata

SEQ ID NO: 155191 - DNA, 10 bp, Unknown
  misc_feature (1)..( 10): Result.004 file - promoters50/1014525
ctatccaaaa

SEQ ID NO: 155192 - DNA, 10 bp, Unknown
  misc_feature (1)..( 10): Result.004 file - promoters50/1014525
atatacaaac

SEQ ID NO: 155193 - DNA, 10 bp, Unknown
  misc_feature (1)..( 10): Result.004 file - promoters50/1014525
atattcaacg

SEQ ID NO: 155194 - DNA, 10 bp, Unknown
  misc_feature (1)..( 10): Result.004 file - promoters50/1014525
aagaccaaaa

SEQ ID NO: 155195 - DNA, 10 bp, Unknown
  misc_feature (1)..( 10): Result.004 file - promoters50/1014525
ctatccatat

SEQ ID NO: 155196 - DNA, 10 bp, Unknown
  misc_feature (1)..( 10): Result.004 file - promoters50/1014525
acgtacaaac

SEQ ID NO: 155197 - DNA, 10 bp, Unknown
  misc_feature (1)..( 10): Result.004 file - promoters50/1014525
tttatatgac

SEQ ID NO: 155198 - DNA, 10 bp, Unknown
  misc_feature (1)..( 10): Result.004 file - promoters50/1014525
attatttgag

SEQ ID NO: 155199 - DNA, 11 bp, Unknown
  misc_feature (1)..( 11): Result.004 file - promoters50/1014525
gttgataaact

SEQ ID NO: 155200 - DNA, 11 bp, Unknown
  misc_feature (1)..( 11): Result.004 file - promoters50/1014525
gttgagaaatt

SEQ ID NO: 155201 - DNA, 11 bp, Unknown
  misc_feature (1)..( 11): Result.004 file - promoters50/1014525
attaatttttt

SEQ ID NO: 155202 - DNA, 11 bp, Unknown
  misc_feature (1)..( 11): Result.004 file - promoters50/1014573
tttaattcaag

SEQ ID NO: 155203 - DNA, 6 bp, Unknown
  misc_feature (1)..( 6): Result.004 file - promoters50/1014573
tttttt

SEQ ID NO: 155204 - DNA, 6 bp, Unknown
  misc_feature (1)..( 6): Result.004 file - promoters50/1014573
tttttt

SEQ ID NO: 155205 - DNA, 6 bp, Unknown
  misc_feature (1)..( 6): Result.004 file - promoters50/1014573
tttttt

SEQ ID NO: 155206 - DNA, 8 bp, Unknown
  misc_feature (1)..( 8): Result.004 file - promoters50/1014573
tagattta

SEQ ID NO: 155207 - DNA, 8 bp, Unknown
  misc_feature (1)..( 8): Result.004 file - promoters50/1014573
aagattta

SEQ ID NO: 155208 - DNA, 8 bp, Unknown
  misc_feature (1)..( 8): Result.004 file - promoters50/1014611
aagctttt

SEQ ID NO: 155209 - DNA, 7 bp, Unknown
  misc_feature (1)..( 7): Result.004 file - promoters50/1014611
aattgta

SEQ ID NO: 155210 - DNA, 7 bp, Unknown
  misc_feature (1)..( 7): Result.004 file - promoters50/1014611
aattgta

SEQ ID NO: 155211 - DNA, 7 bp, Unknown
  misc_feature (1)..( 7): Result.004 file - promoters50/1014611
aatggta

SEQ ID NO: 155212 - DNA, 8 bp, Unknown
  misc_feature (1)..( 8): Result.004 file - promoters50/1014611
caaaaata

SEQ ID NO: 155213 - DNA, 8 bp, Unknown
  misc_feature (1)..( 8): Result.004 file - promoters50/1014611
caaaaaaa

SEQ ID NO: 155214 - DNA, 8 bp, Unknown
  misc_feature (1)..( 8): Result.004 file - promoters50/1014611
aaaaaata

SEQ ID NO: 155215 - DNA, 9 bp, Unknown
  misc_feature (1)..( 9): Result.004 file - promoters50/1014611
gtaatattt

SEQ ID NO: 155216 - DNA, 9 bp, Unknown
  misc_feature (1)..( 9): Result.004 file - promoters50/1014611
gtaaaattt

SEQ ID NO: 155217 - DNA, 9 bp, Unknown
  misc_feature (1)..( 9): Result.004 file - promoters50/1014611
ataattttt

SEQ ID NO: 155218 - DNA, 7 bp, Unknown
  misc_feature (1)..( 7): Result.004 file - promoters50/1014611
gtatttt

SEQ ID NO: 155219 - DNA, 7 bp, Unknown
  misc_feature (1)..( 7): Result.004 file - promoters50/1014611
ttatttt

SEQ ID NO: 155220 - DNA, 7 bp, Unknown
  misc_feature (1)..( 7): Result.004 file - promoters50/1014611
ttatttc

SEQ ID NO: 155221 - DNA, 8 bp, Unknown
  misc_feature (1)..( 8): Result.004 file - promoters50/1014611
ataagtta

SEQ ID NO: 155222 - DNA, 8 bp, Unknown
  misc_feature (1)..( 8): Result.004 file - promoters50/1014611
ataaatta

SEQ ID NO: 155223 - DNA, 8 bp, Unknown
  misc_feature (1)..( 8): Result.004 file - promoters50/1014611
ttaaattt

SEQ ID NO: 155224 - DNA, 12 bp, Unknown
  misc_feature (1)..( 12): Result.004 file - promoters50/1014611
taatattataaa

SEQ ID NO: 155225 - DNA, 12 bp, Unknown
  misc_feature (1)..( 12): Result.004 file - promoters50/1014611
taattttaggat

SEQ ID NO: 155226 - DNA, 12 bp, Unknown
  misc_feature (1)..( 12): Result.004 file - promoters50/1014611
aaatatgtgata

SEQ ID NO: 155227 - DNA, 12 bp, Unknown
  misc_feature (1)..( 12): Result.004 file - promoters50/1014611
actttaaaccac

SEQ ID NO: 155228 - DNA, 12 bp, Unknown
  misc_feature (1)..( 12): Result.004 file - promoters50/1014611
aaattaaaacac

SEQ ID NO: 155229 - DNA, 12 bp, Unknown
  misc_feature (1)..( 12): Result.004 file - promoters50/1014611
aaatgaaaaaat

SEQ ID NO: 155230 - DNA, 9 bp, Unknown
  misc_feature (1)..( 9): Result.004 file - promoters50/1014611
aaaataaaa

SEQ ID NO: 155231 - DNA, 9 bp, Unknown
  misc_feature (1)..( 9): Result.004 file - promoters50/1014611
caaagaaaa

SEQ ID NO: 155232 - DNA, 9 bp, Unknown
  misc_feature (1)..( 9): Result.004 file - promoters50/1014611
caaaaaaaa

SEQ ID NO: 155233 - DNA, 13 bp, Unknown
  misc_feature (1)..( 13): Result.004 file - promoters50/1014611
ctttgattgtaag

SEQ ID NO: 155234 - DNA, 13 bp, Unknown
  misc_feature (1)..( 13): Result.004 file - promoters50/1014611
ctttgaaaaaaaa

SEQ ID NO: 155235 - DNA, 13 bp, Unknown
  misc_feature (1)..( 13): Result.004 file - promoters50/1014611
attttaaaaaaaa

SEQ ID NO: 155236 - DNA, 9 bp, Unknown
  misc_feature (1)..( 9): Result.004 file - promoters50/1014611
gcctattta

SEQ ID NO: 155237 - DNA, 9 bp, Unknown
  misc_feature (1)..( 9): Result.004 file - promoters50/1014611
gactaatta

SEQ ID NO: 155238 - DNA, 9 bp, Unknown
  misc_feature (1)..( 9): Result.004 file - promoters50/1014611
gcccattga

SEQ ID NO: 155239 - DNA, 9 bp, Unknown
  misc_feature (1)..( 9): Result.004 file - promoters50/1014611
aaaaaattt

SEQ ID NO: 155240 - DNA, 9 bp, Unknown
  misc_feature (1)..( 9): Result.004 file - promoters50/1014611
atcaaattt

SEQ ID NO: 155241 - DNA, 9 bp, Unknown
  misc_feature (1)..( 9): Result.004 file - promoters50/1014611
aaataattt

SEQ ID NO: 155242 - DNA, 7 bp, Unknown
  misc_feature (1)..( 7): Result.004 file - promoters50/1014611
tttgaaa

SEQ ID NO: 155243 - DNA, 7 bp, Unknown
  misc_feature (1)..( 7): Result.004 file - promoters50/1014611
tttgaac

SEQ ID NO: 155244 - DNA, 7 bp, Unknown
  misc_feature (1)..( 7): Result.004 file - promoters50/1014631
tttcaaa

SEQ ID NO: 155245 - DNA, 7 bp, Unknown
  misc_feature (1)..( 7): Result.004 file - promoters50/1014631
aaactct

SEQ ID NO: 155246 - DNA, 7 bp, Unknown
  misc_feature (1)..( 7): Result.004 file - promoters50/1014631
taactct

SEQ ID NO: 155247 - DNA, 8 bp, Unknown
  misc_feature (1)..( 8): Result.004 file - promoters50/1014631
gaatctct

SEQ ID NO: 155248 - DNA, 9 bp, Unknown
  misc_feature (1)..( 9): Result.004 file - promoters50/1014631
ttggtttct

SEQ ID NO: 155249 - DNA, 9 bp, Unknown
  misc_feature (1)..( 9): Result.004 file - promoters50/1014631
ttggtttca

SEQ ID NO: 155250 - DNA, 9 bp, Unknown
  misc_feature (1)..( 9): Result.004 file - promoters50/1014631
atgggttct

SEQ ID NO: 155251 - DNA, 9 bp, Unknown
  misc_feature (1)..( 9): Result.004 file - promoters50/1014631
ttccttaat

SEQ ID NO: 155252 - DNA, 9 bp, Unknown
  misc_feature (1)..( 9): Result.004 file - promoters50/1014631
ttccgtaaa

SEQ ID NO: 155253 - DNA, 9 bp, Unknown
  misc_feature (1)..( 9): Result.004 file - promoters50/1014631
gtcgttaac

SEQ ID NO: 155254 - DNA, 12 bp, Unknown
  misc_feature (1)..( 12): Result.004 file - promoters50/1014631
gattttgtctat

SEQ ID NO: 155255 - DNA, 12 bp, Unknown
  misc_feature (1)..( 12): Result.004 file - promoters50/1014631
gatgttgtttat

SEQ ID NO: 155256 - DNA, 12 bp, Unknown
  misc_feature (1)..( 12): Result.004 file - promoters50/1014649
tgagttattttc

SEQ ID NO: 155257 - DNA, 9 bp, Unknown
  misc_feature (1)..( 9): Result.004 file - promoters50/1014649
attctttac

SEQ ID NO: 155258 - DNA, 9 bp, Unknown
  misc_feature (1)..( 9): Result.004 file - promoters50/1014649
tttctctac

SEQ ID NO: 155259 - DNA, 9 bp, Unknown
  misc_feature (1)..( 9): Result.004 file - promoters50/1014649
attttttgg

SEQ ID NO: 155260 - DNA, 8 bp, Unknown
  misc_feature (1)..( 8): Result.004 file - promoters50/1014649
acatatgt

SEQ ID NO: 155261 - DNA, 8 bp, Unknown
  misc_feature (1)..( 8): Result.004 file - promoters50/1014649
acatctgt

SEQ ID NO: 155262 - DNA, 8 bp, Unknown
  misc_feature (1)..( 8): Result.004 file - promoters50/1014649
atatatat

SEQ ID NO: 155263 - DNA, 9 bp, Unknown
  misc_feature (1)..( 9): Result.004 file - promoters50/1014649
atttattta

SEQ ID NO: 155264 - DNA, 9 bp, Unknown
  misc_feature (1)..( 9): Result.004 file - promoters50/1014649
atttatttt

SEQ ID NO: 155265 - DNA, 9 bp, Unknown
  misc_feature (1)..( 9): Result.004 file - promoters50/1014649
attaaatta

SEQ ID NO: 155266 - DNA, 8 bp, Unknown
  misc_feature (1)..( 8): Result.004 file - promoters50/1014649
tctatttt

SEQ ID NO: 155267 - DNA, 8 bp, Unknown
  misc_feature (1)..( 8): Result.004 file - promoters50/1014649
tctttttt

SEQ ID NO: 155268 - DNA, 8 bp, Unknown
  misc_feature (1)..( 8): Result.004 file - promoters50/1014662
tcttttgt

SEQ ID NO: 155269 - DNA, 12 bp, Unknown
  misc_feature (1)..( 12): Result.004 file - promoters50/1014662
atataataaata

SEQ ID NO: 155270 - DNA, 12 bp, Unknown
  misc_feature (1)..( 12): Result.004 file - promoters50/1014662
ttattatacttc

SEQ ID NO: 155271 - DNA, 12 bp, Unknown
  misc_feature (1)..( 12): Result.004 file - promoters50/1014662
gtttaataacaa

SEQ ID NO: 155272 - DNA, 12 bp, Unknown
  misc_feature (1)..( 12): Result.004 file - promoters50/1014662
gcataaaaaata

SEQ ID NO: 155273 - DNA, 12 bp, Unknown
  misc_feature (1)..( 12): Result.004 file - promoters50/1014662
atataattatct

SEQ ID NO: 155274 - DNA, 12 bp, Unknown
  misc_feature (1)..( 12): Result.004 file - promoters50/1014662
atataacaattt

SEQ ID NO: 155275 - DNA, 12 bp, Unknown
  misc_feature (1)..( 12): Result.004 file - promoters50/1014662
atataataacat

SEQ ID NO: 155276 - DNA, 11 bp, Unknown
  misc_feature (1)..( 11): Result.004 file - promoters50/1014662
tcaatcaaaag

SEQ ID NO: 155277 - DNA, 11 bp, Unknown
  misc_feature (1)..( 11): Result.004 file - promoters50/1014662
ttgatccaaac

SEQ ID NO: 155278 - DNA, 11 bp, Unknown
  misc_feature (1)..( 11): Result.004 file - promoters50/1014662
caaatcaaatt

SEQ ID NO: 155279 - DNA, 11 bp, Unknown
  misc_feature (1)..( 11): Result.004 file - promoters50/1014662
tcaattaaaag

SEQ ID NO: 155280 - DNA, 11 bp, Unknown
  misc_feature (1)..( 11): Result.004 file - promoters50/1014662
attatcctaac

SEQ ID NO: 155281 - DNA, 11 bp, Unknown
  misc_feature (1)..( 11): Result.004 file - promoters50/1014662
cctttcaaata

SEQ ID NO: 155282 - DNA, 10 bp, Unknown
  misc_feature (1)..( 10): Result.004 file - promoters50/1014662
taaaaatgaa

SEQ ID NO: 155283 - DNA, 11 bp, Unknown
  misc_feature (1)..( 11): Result.004 file - promoters50/1014662
caaaaaaagaa

SEQ ID NO: 155284 - DNA, 11 bp, Unknown
  misc_feature (1)..( 11): Result.004 file - promoters50/1014662
ccaaaaatctt

SEQ ID NO: 155285 - DNA, 10 bp, Unknown
  misc_feature (1)..( 10): Result.004 file - promoters50/1014662
taaaaagtct

SEQ ID NO: 155286 - DNA, 11 bp, Unknown
  misc_feature (1)..( 11): Result.004 file - promoters50/1014662
cgaaaaagggt

SEQ ID NO: 155287 - DNA, 11 bp, Unknown
  misc_feature (1)..( 11): Result.004 file - promoters50/1014662
ccaagaatctg

SEQ ID NO: 155288 - DNA, 12 bp, Unknown
  misc_feature (1)..( 12): Result.004 file - promoters50/1014662
ttttatcacaag

SEQ ID NO: 155289 - DNA, 12 bp, Unknown
  misc_feature (1)..( 12): Result.004 file - promoters50/1014662
ttttgtcaacga

SEQ ID NO: 155290 - DNA, 12 bp, Unknown
  misc_feature (1)..( 12): Result.004 file - promoters50/1014662
gtataacaataa

SEQ ID NO: 155291 - DNA, 12 bp, Unknown
  misc_feature (1)..( 12): Result.004 file - promoters50/1014662
ctttatcctaag

SEQ ID NO: 155292 - DNA, 12 bp, Unknown
  misc_feature (1)..( 12): Result.004 file - promoters50/1014662
ttttgtatctaa

SEQ ID NO: 155293 - DNA, 12 bp, Unknown
  misc_feature (1)..( 12): Result.004 file - promoters50/1014662
cggtgtaaacga

SEQ ID NO: 155294 - DNA, 12 bp, Unknown
  misc_feature (1)..( 12): Result.004 file - promoters50/1014662
gggtgtaatgct

SEQ ID NO: 155295 - DNA, 14 bp, Unknown
  misc_feature (1)..( 14): Result.004 file - promoters50/1014662
actcataataaata

SEQ ID NO: 155296 - DNA, 14 bp, Unknown
  misc_feature (1)..( 14): Result.004 file - promoters50/1014662
acttataatgaatt

SEQ ID NO: 155297 - DNA, 14 bp, Unknown
  misc_feature (1)..( 14): Result.004 file - promoters50/1014662
tcatataatagtaa

SEQ ID NO: 155298 - DNA, 14 bp, Unknown
  misc_feature (1)..( 14): Result.004 file - promoters50/1014662
atttataatataat

SEQ ID NO: 155299 - DNA, 14 bp, Unknown
  misc_feature (1)..( 14): Result.004 file - promoters50/1014662
gaagatagtgaacc

SEQ ID NO: 155300 - DNA, 14 bp, Unknown
  misc_feature (1)..( 14): Result.004 file - promoters50/1014662
taaaataaggaatt

SEQ ID NO: 155301 - DNA, 12 bp, Unknown
  misc_feature (1)..( 12): Result.004 file - promoters50/1014662
tagaaattaata

SEQ ID NO: 155302 - DNA, 12 bp, Unknown
  misc_feature (1)..( 12): Result.004 file - promoters50/1014662
agataattaagt

SEQ ID NO: 155303 - DNA, 11 bp, Unknown
  misc_feature (1)..( 11): Result.004 file - promoters50/1014662
taaaatcaata

SEQ ID NO: 155304 - DNA, 11 bp, Unknown
  misc_feature (1)..( 11): Result.004 file - promoters50/1014662
tttaattatta

SEQ ID NO: 155305 - DNA, 12 bp, Unknown
  misc_feature (1)..( 12): Result.004 file - promoters50/1014662
ataacatcactt

SEQ ID NO: 155306 - DNA, 12 bp, Unknown
  misc_feature (1)..( 12): Result.004 file - promoters50/1014662
ggtacatcactg

SEQ ID NO: 155307 - DNA, 11 bp, Unknown
  misc_feature (1)..( 11): Result.004 file - promoters50/1014662
taattttgtat

SEQ ID NO: 155308 - DNA, 11 bp, Unknown
  misc_feature (1)..( 11): Result.004 file - promoters50/1014662
tgtttttgttt

SEQ ID NO: 155309 - DNA, 11 bp, Unknown
  misc_feature (1)..( 11): Result.004 file - promoters50/1014662
taaatttgttt

SEQ ID NO: 155310 - DNA, 11 bp, Unknown
  misc_feature (1)..( 11): Result.004 file - promoters50/1014662
tgactttgttg

SEQ ID NO: 155311 - DNA, 11 bp, Unknown
  misc_feature (1)..( 11): Result.004 file - promoters50/1014662
aaaatttgcta

SEQ ID NO: 155312 - DNA, 11 bp, Unknown
  misc_feature (1)..( 11): Result.004 file - promoters50/1014678
ctgatttattt

SEQ ID NO: 155313 - DNA, 8 bp, Unknown
  misc_feature (1)..( 8): Result.004 file - promoters50/1014678
aaaatcgt

SEQ ID NO: 155314 - DNA, 8 bp, Unknown
  misc_feature (1)..( 8): Result.004 file - promoters50/1014678
aaactcga

SEQ ID NO: 155315 - DNA, 8 bp, Unknown
  misc_feature (1)..( 8): Result.004 file - promoters50/1014678
gaacacga

SEQ ID NO: 155316 - DNA, 10 bp, Unknown
  misc_feature (1)..( 10): Result.004 file - promoters50/1014678
acaacacatc

SEQ ID NO: 155317 - DNA, 10 bp, Unknown
  misc_feature (1)..( 10): Result.004 file - promoters50/1014678
aaaacaaatc

SEQ ID NO: 155318 - DNA, 10 bp, Unknown
  misc_feature (1)..( 10): Result.004 file - promoters50/1014678
aaaacaaaat

SEQ ID NO: 155319 - DNA, 7 bp, Unknown
  misc_feature (1)..( 7): Result.004 file - promoters50/1014678
ttactgc

SEQ ID NO: 155320 - DNA, 7 bp, Unknown
  misc_feature (1)..( 7): Result.004 file - promoters50/1014678
ttaatgc

SEQ ID NO: 155321 - DNA, 7 bp, Unknown
  misc_feature (1)..( 7): Result.004 file - promoters50/1014681
ttaatga

SEQ ID NO: 155322 - DNA, 10 bp, Unknown
  misc_feature (1)..( 10): Result.004 file - promoters50/1014681
aattaaacat

SEQ ID NO: 155323 - DNA, 10 bp, Unknown
  misc_feature (1)..( 10): Result.004 file - promoters50/1014681
aggtaagcat

SEQ ID NO: 155324 - DNA, 10 bp, Unknown
  misc_feature (1)..( 10): Result.004 file - promoters50/1014681
aataaaacaa

SEQ ID NO: 155325 - DNA, 11 bp, Unknown
  misc_feature (1)..( 11): Result.004 file - promoters50/1014681
tagcgttgttg

SEQ ID NO: 155326 - DNA, 11 bp, Unknown
  misc_feature (1)..( 11): Result.004 file - promoters50/1014681
atatgttattg

SEQ ID NO: 155327 - DNA, 11 bp, Unknown
  misc_feature (1)..( 11): Result.004 file - promoters50/1014689
tatagttgaaa

SEQ ID NO: 155328 - DNA, 9 bp, Unknown
  misc_feature (1)..( 9): Result.004 file - promoters50/1014689
tgttcattc

SEQ ID NO: 155329 - DNA, 9 bp, Unknown
  misc_feature (1)..( 9): Result.004 file - promoters50/1014689
tcttcattt

SEQ ID NO: 155330 - DNA, 9 bp, Unknown
  misc_feature (1)..( 9): Result.004 file - promoters50/1014689
tgtacattt

SEQ ID NO: 155331 - DNA, 9 bp, Unknown
  misc_feature (1)..( 9): Result.004 file - promoters50/1014689
aaatcattt

SEQ ID NO: 155332 - DNA, 13 bp, Unknown
  misc_feature (1)..( 13): Result.004 file - promoters50/1014689
ctgagttagaagg

SEQ ID NO: 155333 - DNA, 13 bp, Unknown
  misc_feature (1)..( 13): Result.004 file - promoters50/1014689
ctgagctagtagg

SEQ ID NO: 155334 - DNA, 13 bp, Unknown
  misc_feature (1)..( 13): Result.004 file - promoters50/1014689
ctgatttataaga

SEQ ID NO: 155335 - DNA, 13 bp, Unknown
  misc_feature (1)..( 13): Result.004 file - promoters50/1014689
ctgaactaaatgt

SEQ ID NO: 155336 - DNA, 9 bp, Unknown
  misc_feature (1)..( 9): Result.004 file - promoters50/1014689
aaaaatgtt

SEQ ID NO: 155337 - DNA, 9 bp, Unknown
  misc_feature (1)..( 9): Result.004 file - promoters50/1014689
aaaaatgtt

SEQ ID NO: 155338 - DNA, 9 bp, Unknown
  misc_feature (1)..( 9): Result.004 file - promoters50/1014689
gacaatgtt

SEQ ID NO: 155339 - DNA, 9 bp, Unknown
  misc_feature (1)..( 9): Result.004 file - promoters50/1014693
acaaatgtg

SEQ ID NO: 155340 - DNA, 14 bp, Unknown
  misc_feature (1)..( 14): Result.004 file - promoters50/1014693
tttttgatagagaa

SEQ ID NO: 155341 - DNA, 14 bp, Unknown
  misc_feature (1)..( 14): Result.004 file - promoters50/1014693
ttttttataaagaa

SEQ ID NO: 155342 - DNA, 14 bp, Unknown
  misc_feature (1)..( 14): Result.004 file - promoters50/1014693
catcttaaaaaaaa

SEQ ID NO: 155343 - DNA, 14 bp, Unknown
  misc_feature (1)..( 14): Result.004 file - promoters50/1014693
gatataacaaagta

SEQ ID NO: 155344 - DNA, 14 bp, Unknown
  misc_feature (1)..( 14): Result.004 file - promoters50/1014693
ttttttagttacag

SEQ ID NO: 155345 - DNA, 14 bp, Unknown
  misc_feature (1)..( 14): Result.004 file - promoters50/1014693
tcgccaagaaatga

SEQ ID NO: 155346 - DNA, 11 bp, Unknown
  misc_feature (1)..( 11): Result.004 file - promoters50/1014693
agtgatttgtc

SEQ ID NO: 155347 - DNA, 11 bp, Unknown
  misc_feature (1)..( 11): Result.004 file - promoters50/1014693
cttgatttatc

SEQ ID NO: 155348 - DNA, 11 bp, Unknown
  misc_feature (1)..( 11): Result.004 file - promoters50/1014693
tttgagttgat

SEQ ID NO: 155349 - DNA, 11 bp, Unknown
  misc_feature (1)..( 11): Result.004 file - promoters50/1014693
cttaattatcc

SEQ ID NO: 155350 - DNA, 11 bp, Unknown
  misc_feature (1)..( 11): Result.004 file - promoters50/1014693
acggattaatc

SEQ ID NO: 155351 - DNA, 11 bp, Unknown
  misc_feature (1)..( 11): Result.004 file - promoters50/1014693
gacaagttgag

SEQ ID NO: 155352 - DNA, 17 bp, Unknown
  misc_feature (1)..( 17): Result.004 file - promoters50/1014693
gcagcttctcttggtta

SEQ ID NO: 155353 - DNA, 17 bp, Unknown
  misc_feature (1)..( 17): Result.004 file - promoters50/1014693
attacttttcttgaatc

SEQ ID NO: 155354 - DNA, 17 bp, Unknown
  misc_feature (1)..( 17): Result.004 file - promoters50/1014693
aaagctcctctctgcgc

SEQ ID NO: 155355 - DNA, 17 bp, Unknown
  misc_feature (1)..( 17): Result.004 file - promoters50/1014693
acgcgctttcttcaatc

SEQ ID NO: 155356 - DNA, 17 bp, Unknown
  misc_feature (1)..( 17): Result.004 file - promoters50/1014693
caatctaaaagcctctg

SEQ ID NO: 155357 - DNA, 17 bp, Unknown
  misc_feature (1)..( 17): Result.004 file - promoters50/1014748
tctttttttccaggttc

SEQ ID NO: 155358 - DNA, 11 bp, Unknown
  misc_feature (1)..( 11): Result.004 file - promoters50/1014748
taattaaaaca

SEQ ID NO: 155359 - DNA, 11 bp, Unknown
  misc_feature (1)..( 11): Result.004 file - promoters50/1014748
aaataaaaaca

SEQ ID NO: 155360 - DNA, 11 bp, Unknown
  misc_feature (1)..( 11): Result.004 file - promoters50/1014771
aaataatactt

SEQ ID NO: 155361 - DNA, 15 bp, Unknown
  misc_feature (1)..( 15): Result.004 file - promoters50/1014771
atttctattttgtag

SEQ ID NO: 155362 - DNA, 15 bp, Unknown
  misc_feature (1)..( 15): Result.004 file - promoters50/1014771
ttttctaaaagatta

SEQ ID NO: 155363 - DNA, 15 bp, Unknown
  misc_feature (1)..( 15): Result.004 file - promoters50/1014771
atttcaatttaatca

SEQ ID NO: 155364 - DNA, 15 bp, Unknown
  misc_feature (1)..( 15): Result.004 file - promoters50/1014771
atttttatgttttac

SEQ ID NO: 155365 - DNA, 15 bp, Unknown
  misc_feature (1)..( 15): Result.004 file - promoters50/1014771
atttgtctcaatttc

SEQ ID NO: 155366 - DNA, 15 bp, Unknown
  misc_feature (1)..( 15): Result.004 file - promoters50/1014771
caatcaatgtaatca

SEQ ID NO: 155367 - DNA, 13 bp, Unknown
  misc_feature (1)..( 13): Result.004 file - promoters50/1014771
taacaattaaaaa

SEQ ID NO: 155368 - DNA, 13 bp, Unknown
  misc_feature (1)..( 13): Result.004 file - promoters50/1014771
ctacaatttaaaa

SEQ ID NO: 155369 - DNA, 13 bp, Unknown
  misc_feature (1)..( 13): Result.004 file - promoters50/1014771
taacaacttaatt

SEQ ID NO: 155370 - DNA, 13 bp, Unknown
  misc_feature (1)..( 13): Result.004 file - promoters50/1014771
ttacaagcttctc

SEQ ID NO: 155371 - DNA, 13 bp, Unknown
  misc_feature (1)..( 13): Result.004 file - promoters50/1014771
ctataattgttct

SEQ ID NO: 155372 - DNA, 13 bp, Unknown
  misc_feature (1)..( 13): Result.004 file - promoters50/1014771
ctttaattgaacc

SEQ ID NO: 155373 - DNA, 11 bp, Unknown
  misc_feature (1)..( 11): Result.004 file - promoters50/1014771
acttaaaaatt

SEQ ID NO: 155374 - DNA, 11 bp, Unknown
  misc_feature (1)..( 11): Result.004 file - promoters50/1014771
ggctaaaaaac

SEQ ID NO: 155375 - DNA, 11 bp, Unknown
  misc_feature (1)..( 11): Result.004 file - promoters50/1014771
acttaaaaaca

SEQ ID NO: 155376 - DNA, 11 bp, Unknown
  misc_feature (1)..( 11): Result.004 file - promoters50/1014771
gttcaaaaaaa

SEQ ID NO: 155377 - DNA, 11 bp, Unknown
  misc_feature (1)..( 11): Result.004 file - promoters50/1014771
agaaaaaaaag

SEQ ID NO: 155378 - DNA, 11 bp, Unknown
  misc_feature (1)..( 11): Result.004 file - promoters50/1014771
acttaaaaagt

SEQ ID NO: 155379 - DNA, 9 bp, Unknown
  misc_feature (1)..( 9): Result.004 file - promoters50/1014771
tttttctta

SEQ ID NO: 155380 - DNA, 9 bp, Unknown
  misc_feature (1)..( 9): Result.004 file - promoters50/1014771
gtgttctta

SEQ ID NO: 155381 - DNA, 9 bp, Unknown
  misc_feature (1)..( 9): Result.004 file - promoters50/1014771
tttttcttc

SEQ ID NO: 155382 - DNA, 9 bp, Unknown
  misc_feature (1)..( 9): Result.004 file - promoters50/1014771
gatttattc

SEQ ID NO: 155383 - DNA, 9 bp, Unknown
  misc_feature (1)..( 9): Result.004 file - promoters50/1014771
tatttataa

SEQ ID NO: 155384 - DNA, 9 bp, Unknown
  misc_feature (1)..( 9): Result.004 file - promoters50/1014771
ttttttttt

SEQ ID NO: 155385 - DNA, 13 bp, Unknown
  misc_feature (1)..( 13): Result.004 file - promoters50/1014771
actttatttttgg

SEQ ID NO: 155386 - DNA, 13 bp, Unknown
  misc_feature (1)..( 13): Result.004 file - promoters50/1014771
ggtttgtttactt

SEQ ID NO: 155387 - DNA, 13 bp, Unknown
  misc_feature (1)..( 13): Result.004 file - promoters50/1014771
tctttttttttgg

SEQ ID NO: 155388 - DNA, 13 bp, Unknown
  misc_feature (1)..( 13): Result.004 file - promoters50/1014771
gatttggttttct

SEQ ID NO: 155389 - DNA, 13 bp, Unknown
  misc_feature (1)..( 13): Result.004 file - promoters50/1014771
ggttgattttgaa

SEQ ID NO: 155390 - DNA, 13 bp, Unknown
  misc_feature (1)..( 13): Result.004 file - promoters50/1014771
aattcttttgtaa

SEQ ID NO: 155391 - DNA, 11 bp, Unknown
  misc_feature (1)..( 11): Result.004 file - promoters50/1014771
gtcttgaattt

SEQ ID NO: 155392 - DNA, 11 bp, Unknown
  misc_feature (1)..( 11): Result.004 file - promoters50/1014771
tactttaattg

SEQ ID NO: 155393 - DNA, 11 bp, Unknown
  misc_feature (1)..( 11): Result.004 file - promoters50/1014771
cggttgatttt

SEQ ID NO: 155394 - DNA, 11 bp, Unknown
  misc_feature (1)..( 11): Result.004 file - promoters50/1014771
gatttgatttg

SEQ ID NO: 155395 - DNA, 11 bp, Unknown
  misc_feature (1)..( 11): Result.004 file - promoters50/1014771
tacgttacaag

SEQ ID NO: 155396 - DNA, 11 bp, Unknown
  misc_feature (1)..( 11): Result.004 file - promoters50/1014771
tcctataattg

SEQ ID NO: 155397 - DNA, 8 bp, Unknown
  misc_feature (1)..( 8): Result.004 file - promoters50/1014771
aagaaagg

SEQ ID NO: 155398 - DNA, 8 bp, Unknown
  misc_feature (1)..( 8): Result.004 file - promoters50/1014771
aagaaagc

SEQ ID NO: 155399 - DNA, 8 bp, Unknown
  misc_feature (1)..( 8): Result.004 file - promoters50/1014771
aaaaaaaa

SEQ ID NO: 155400 - DNA, 8 bp, Unknown
  misc_feature (1)..( 8): Result.004 file - promoters50/1014771
aaaaaacc

SEQ ID NO: 155401 - DNA, 8 bp, Unknown
  misc_feature (1)..( 8): Result.004 file - promoters50/1014771
aaaaaagt

SEQ ID NO: 155402 - DNA, 8 bp, Unknown
  misc_feature (1)..( 8): Result.004 file - promoters50/1014778
taaaaagt

SEQ ID NO: 155403 - DNA, 10 bp, Unknown
  misc_feature (1)..( 10): Result.004 file - promoters50/1014778
ggaatcgaag

SEQ ID NO: 155404 - DNA, 10 bp, Unknown
  misc_feature (1)..( 10): Result.004 file - promoters50/1014778
gctttcgaag

SEQ ID NO: 155405 - DNA, 10 bp, Unknown
  misc_feature (1)..( 10): Result.004 file - promoters50/1014778
aaaattgaaa

SEQ ID NO: 155406 - DNA, 10 bp, Unknown
  misc_feature (1)..( 10): Result.004 file - promoters50/1014778
aatttcgaat

SEQ ID NO: 155407 - DNA, 10 bp, Unknown
  misc_feature (1)..( 10): Result.004 file - promoters50/1014778
caaaatgaaa

SEQ ID NO: 155408 - DNA, 10 bp, Unknown
  misc_feature (1)..( 10): Result.004 file - promoters50/1014778
aaatttgatc

SEQ ID NO: 155409 - DNA, 12 bp, Unknown
  misc_feature (1)..( 12): Result.004 file - promoters50/1014778
ggcttatgaatc

SEQ ID NO: 155410 - DNA, 12 bp, Unknown
  misc_feature (1)..( 12): Result.004 file - promoters50/1014778
ggcttttgacct

SEQ ID NO: 155411 - DNA, 12 bp, Unknown
  misc_feature (1)..( 12): Result.004 file - promoters50/1014778
agattttgattc

SEQ ID NO: 155412 - DNA, 12 bp, Unknown
  misc_feature (1)..( 12): Result.004 file - promoters50/1014778
aggttttgaaag

SEQ ID NO: 155413 - DNA, 12 bp, Unknown
  misc_feature (1)..( 12): Result.004 file - promoters50/1014778
tatttttcattc

SEQ ID NO: 155414 - DNA, 12 bp, Unknown
  misc_feature (1)..( 12): Result.004 file - promoters50/1014815
tcattattctgt

SEQ ID NO: 155415 - DNA, 15 bp, Unknown
  misc_feature (1)..( 15): Result.004 file - promoters50/1014815
tagtgaagcatttaa

SEQ ID NO: 155416 - DNA, 15 bp, Unknown
  misc_feature (1)..( 15): Result.004 file - promoters50/1014815
tttgctagcttttaa

SEQ ID NO: 155417 - DNA, 15 bp, Unknown
  misc_feature (1)..( 15): Result.004 file - promoters50/1014815
gctaagcccatttaa

SEQ ID NO: 155418 - DNA, 15 bp, Unknown
  misc_feature (1)..( 15): Result.004 file - promoters50/1014815
tttcctatctttctc

SEQ ID NO: 155419 - DNA, 15 bp, Unknown
  misc_feature (1)..( 15): Result.004 file - promoters50/1014815
tttatgatcttgtaa

SEQ ID NO: 155420 - DNA, 15 bp, Unknown
  misc_feature (1)..( 15): Result.004 file - promoters50/1014815
tataataggttttta

SEQ ID NO: 155421 - DNA, 9 bp, Unknown
  misc_feature (1)..( 9): Result.004 file - promoters50/1014815
tctttaaac

SEQ ID NO: 155422 - DNA, 9 bp, Unknown
  misc_feature (1)..( 9): Result.004 file - promoters50/1014815
aatttaaat

SEQ ID NO: 155423 - DNA, 9 bp, Unknown
  misc_feature (1)..( 9): Result.004 file - promoters50/1014815
agtttaaat

SEQ ID NO: 155424 - DNA, 9 bp, Unknown
  misc_feature (1)..( 9): Result.004 file - promoters50/1014815
aagttaaat

SEQ ID NO: 155425 - DNA, 9 bp, Unknown
  misc_feature (1)..( 9): Result.004 file - promoters50/1014815
cattgaaag

SEQ ID NO: 155426 - DNA, 9 bp, Unknown
  misc_feature (1)..( 9): Result.004 file - promoters50/1014815
aattcaaaa

SEQ ID NO: 155427 - DNA, 9 bp, Unknown
  misc_feature (1)..( 9): Result.004 file - promoters50/1014815
aaaaaaaga

SEQ ID NO: 155428 - DNA, 9 bp, Unknown
  misc_feature (1)..( 9): Result.004 file - promoters50/1014815
taaaagaga

SEQ ID NO: 155429 - DNA, 10 bp, Unknown
  misc_feature (1)..( 10): Result.004 file - promoters50/1014815
aaaaacaagg

SEQ ID NO: 155430 - DNA, 10 bp, Unknown
  misc_feature (1)..( 10): Result.004 file - promoters50/1014815
tcaaacaata

SEQ ID NO: 155431 - DNA, 10 bp, Unknown
  misc_feature (1)..( 10): Result.004 file - promoters50/1014815
taaaagtaaa

SEQ ID NO: 155432 - DNA, 10 bp, Unknown
  misc_feature (1)..( 10): Result.004 file - promoters50/1014823
taaatgagta

SEQ ID NO: 155433 - DNA, 10 bp, Unknown
  misc_feature (1)..( 10): Result.004 file - promoters50/1014823
gacaaaaatt

SEQ ID NO: 155434 - DNA, 10 bp, Unknown
  misc_feature (1)..( 10): Result.004 file - promoters50/1014823
gacacaaatt

SEQ ID NO: 155435 - DNA, 10 bp, Unknown
  misc_feature (1)..( 10): Result.004 file - promoters50/1014823
aacaagaata

SEQ ID NO: 155436 - DNA, 10 bp, Unknown
  misc_feature (1)..( 10): Result.004 file - promoters50/1014823
cacagaaagc

SEQ ID NO: 155437 - DNA, 12 bp, Unknown
  misc_feature (1)..( 12): Result.004 file - promoters50/1014823
gagcaaagaaga

SEQ ID NO: 155438 - DNA, 12 bp, Unknown
  misc_feature (1)..( 12): Result.004 file - promoters50/1014823
gagcaaatccca

SEQ ID NO: 155439 - DNA, 12 bp, Unknown
  misc_feature (1)..( 12): Result.004 file - promoters50/1014823
aagcaaaaccca

SEQ ID NO: 155440 - DNA, 8 bp, Unknown
  misc_feature (1)..( 8): Result.004 file - promoters50/1014823
ttattttt

SEQ ID NO: 155441 - DNA, 8 bp, Unknown
  misc_feature (1)..( 8): Result.004 file - promoters50/1014823
ttattttg

SEQ ID NO: 155442 - DNA, 8 bp, Unknown
  misc_feature (1)..( 8): Result.004 file - promoters50/1014823
tcattttt

SEQ ID NO: 155443 - DNA, 9 bp, Unknown
  misc_feature (1)..( 9): Result.004 file - promoters50/1014823
tttaatttg

SEQ ID NO: 155444 - DNA, 9 bp, Unknown
  misc_feature (1)..( 9): Result.004 file - promoters50/1014823
cttaattat

SEQ ID NO: 155445 - DNA, 10 bp, Unknown
  misc_feature (1)..( 10): Result.004 file - promoters50/1014823
tttaaatttg

SEQ ID NO: 155446 - DNA, 9 bp, Unknown
  misc_feature (1)..( 9): Result.004 file - promoters50/1014823
gtttttgat

SEQ ID NO: 155447 - DNA, 9 bp, Unknown
  misc_feature (1)..( 9): Result.004 file - promoters50/1014823
tatttggat

SEQ ID NO: 155448 - DNA, 9 bp, Unknown
  misc_feature (1)..( 9): Result.004 file - promoters50/1014823
gtttttgac

SEQ ID NO: 155449 - DNA, 9 bp, Unknown
  misc_feature (1)..( 9): Result.004 file - promoters50/1014823
aattttgat

SEQ ID NO: 155450 - DNA, 8 bp, Unknown
  misc_feature (1)..( 8): Result.004 file - promoters50/1014823
ttaaaata

SEQ ID NO: 155451 - DNA, 8 bp, Unknown
  misc_feature (1)..( 8): Result.004 file - promoters50/1014823
ttagaatt

SEQ ID NO: 155452 - DNA, 8 bp, Unknown
  misc_feature (1)..( 8): Result.004 file - promoters50/1014823
ttataata

SEQ ID NO: 155453 - DNA, 10 bp, Unknown
  misc_feature (1)..( 10): Result.004 file - promoters50/1014823
agtttaatta

SEQ ID NO: 155454 - DNA, 10 bp, Unknown
  misc_feature (1)..( 10): Result.004 file - promoters50/1014823
attttcatta

SEQ ID NO: 155455 - DNA, 10 bp, Unknown
  misc_feature (1)..( 10): Result.004 file - promoters50/1014823
agtataatag

SEQ ID NO: 155456 - DNA, 9 bp, Unknown
  misc_feature (1)..( 9): Result.004 file - promoters50/1014823
ttctactaa

SEQ ID NO: 155457 - DNA, 9 bp, Unknown
  misc_feature (1)..( 9): Result.004 file - promoters50/1014823
ttcgacttg

SEQ ID NO: 155458 - DNA, 9 bp, Unknown
  misc_feature (1)..( 9): Result.004 file - promoters50/1014823
accgatttg

SEQ ID NO: 155459 - DNA, 8 bp, Unknown
  misc_feature (1)..( 8): Result.004 file - promoters50/1014823
acattttt

SEQ ID NO: 155460 - DNA, 8 bp, Unknown
  misc_feature (1)..( 8): Result.004 file - promoters50/1014823
acaatttt

SEQ ID NO: 155461 - DNA, 8 bp, Unknown
  misc_feature (1)..( 8): Result.004 file - promoters50/1014895
taaatttt

SEQ ID NO: 155462 - DNA, 12 bp, Unknown
  misc_feature (1)..( 12): Result.004 file - promoters50/1014895
taatagataact

SEQ ID NO: 155463 - DNA, 12 bp, Unknown
  misc_feature (1)..( 12): Result.004 file - promoters50/1014895
caatggatagtg

SEQ ID NO: 155464 - DNA, 12 bp, Unknown
  misc_feature (1)..( 12): Result.004 file - promoters50/1014895
gaatagatctgt

SEQ ID NO: 155465 - DNA, 12 bp, Unknown
  misc_feature (1)..( 12): Result.004 file - promoters50/1014895
accgggaaagtg

SEQ ID NO: 155466 - DNA, 12 bp, Unknown
  misc_feature (1)..( 12): Result.004 file - promoters50/1014907
aaattgtgagtt

SEQ ID NO: 155467 - DNA, 9 bp, Unknown
  misc_feature (1)..( 9): Result.004 file - promoters50/1014907
attttctag

SEQ ID NO: 155468 - DNA, 9 bp, Unknown
  misc_feature (1)..( 9): Result.004 file - promoters50/1014907
tatttttag

SEQ ID NO: 155469 - DNA, 9 bp, Unknown
  misc_feature (1)..( 9): Result.004 file - promoters50/1014907
cttttctaa

SEQ ID NO: 155470 - DNA, 9 bp, Unknown
  misc_feature (1)..( 9): Result.004 file - promoters50/1014907
tatatttac

SEQ ID NO: 155471 - DNA, 7 bp, Unknown
  misc_feature (1)..( 7): Result.004 file - promoters50/1014907
tatttta

SEQ ID NO: 155472 - DNA, 7 bp, Unknown
  misc_feature (1)..( 7): Result.004 file - promoters50/1014907
tatttta

SEQ ID NO: 155473 - DNA, 8 bp, Unknown
  misc_feature (1)..( 8): Result.004 file - promoters50/1014907
cattcttt

SEQ ID NO: 155474 - DNA, 8 bp, Unknown
  misc_feature (1)..( 8): Result.004 file - promoters50/1014907
aattatat

SEQ ID NO: 155475 - DNA, 9 bp, Unknown
  misc_feature (1)..( 9): Result.004 file - promoters50/1014907
catagtcca

SEQ ID NO: 155476 - DNA, 9 bp, Unknown
  misc_feature (1)..( 9): Result.004 file - promoters50/1014907
aataatcct

SEQ ID NO: 155477 - DNA, 9 bp, Unknown
  misc_feature (1)..( 9): Result.004 file - promoters50/1014907
tccaatcct

SEQ ID NO: 155478 - DNA, 9 bp, Unknown
  misc_feature (1)..( 9): Result.004 file - promoters50/1014907
aataatctc

SEQ ID NO: 155479 - DNA, 9 bp, Unknown
  misc_feature (1)..( 9): Result.004 file - promoters50/1014907
aaaatgatc

SEQ ID NO: 155480 - DNA, 9 bp, Unknown
  misc_feature (1)..( 9): Result.004 file - promoters50/1014907
aaaatgcga

SEQ ID NO: 155481 - DNA, 9 bp, Unknown
  misc_feature (1)..( 9): Result.004 file - promoters50/1014907
aaaataatc

SEQ ID NO: 155482 - DNA, 9 bp, Unknown
  misc_feature (1)..( 9): Result.004 file - promoters50/1014926
ttaataatc

SEQ ID NO: 155483 - DNA, 7 bp, Unknown
  misc_feature (1)..( 7): Result.004 file - promoters50/1014926
ccttcct

SEQ ID NO: 155484 - DNA, 7 bp, Unknown
  misc_feature (1)..( 7): Result.004 file - promoters50/1014926
ccttccc

SEQ ID NO: 155485 - DNA, 7 bp, Unknown
  misc_feature (1)..( 7): Result.004 file - promoters50/1014926
ctttctt

SEQ ID NO: 155486 - DNA, 12 bp, Unknown
  misc_feature (1)..( 12): Result.004 file - promoters50/1014926
ggttgttatagg

SEQ ID NO: 155487 - DNA, 12 bp, Unknown
  misc_feature (1)..( 12): Result.004 file - promoters50/1014926
cattgttaaagg

SEQ ID NO: 155488 - DNA, 12 bp, Unknown
  misc_feature (1)..( 12): Result.004 file - promoters50/1014926
ggttgttgttaa

SEQ ID NO: 155489 - DNA, 12 bp, Unknown
  misc_feature (1)..( 12): Result.004 file - promoters50/1014926
tatttttattta

SEQ ID NO: 155490 - DNA, 8 bp, Unknown
  misc_feature (1)..( 8): Result.004 file - promoters50/1014926
taataaat

SEQ ID NO: 155491 - DNA, 8 bp, Unknown
  misc_feature (1)..( 8): Result.004 file - promoters50/1014926
taagaaat

SEQ ID NO: 155492 - DNA, 8 bp, Unknown
  misc_feature (1)..( 8): Result.004 file - promoters50/1014926
aaataaaa

SEQ ID NO: 155493 - DNA, 7 bp, Unknown
  misc_feature (1)..( 7): Result.004 file - promoters50/1014926
aatgggc

SEQ ID NO: 155494 - DNA, 7 bp, Unknown
  misc_feature (1)..( 7): Result.004 file - promoters50/1014926
gatgggc

SEQ ID NO: 155495 - DNA, 7 bp, Unknown
  misc_feature (1)..( 7): Result.004 file - promoters50/1014926
gatgggg

SEQ ID NO: 155496 - DNA, 8 bp, Unknown
  misc_feature (1)..( 8): Result.004 file - promoters50/1014926
aaataaat

SEQ ID NO: 155497 - DNA, 8 bp, Unknown
  misc_feature (1)..( 8): Result.004 file - promoters50/1014926
aaataagg

SEQ ID NO: 155498 - DNA, 8 bp, Unknown
  misc_feature (1)..( 8): Result.004 file - promoters50/1014926
aaatgagg

SEQ ID NO: 155499 - DNA, 6 bp, Unknown
  misc_feature (1)..( 6): Result.004 file - promoters50/1014926
aagttg

SEQ ID NO: 155500 - DNA, 6 bp, Unknown
  misc_feature (1)..( 6): Result.004 file - promoters50/1014926
aagttg

SEQ ID NO: 155501 - DNA, 6 bp, Unknown
  misc_feature (1)..( 6): Result.004 file - promoters50/1014926
aagttg

SEQ ID NO: 155502 - DNA, 11 bp, Unknown
  misc_feature (1)..( 11): Result.004 file - promoters50/1014926
aaacctaaata

SEQ ID NO: 155503 - DNA, 11 bp, Unknown
  misc_feature (1)..( 11): Result.004 file - promoters50/1014926
ccgcctcaatc

SEQ ID NO: 155504 - DNA, 11 bp, Unknown
  misc_feature (1)..( 11): Result.004 file - promoters50/1014981
aaatctaaata

SEQ ID NO: 155505 - DNA, 8 bp, Unknown
  misc_feature (1)..( 8): Result.004 file - promoters50/1014981
ggaataaa

SEQ ID NO: 155506 - DNA, 8 bp, Unknown
  misc_feature (1)..( 8): Result.004 file - promoters50/1014981
ggaacaaa

SEQ ID NO: 155507 - DNA, 8 bp, Unknown
  misc_feature (1)..( 8): Result.004 file - promoters50/1014989
tgaataat

SEQ ID NO: 155508 - DNA, 8 bp, Unknown
  misc_feature (1)..( 8): Result.004 file - promoters50/1014989
ttttcaaa

SEQ ID NO: 155509 - DNA, 8 bp, Unknown
  misc_feature (1)..( 8): Result.004 file - promoters50/1014989
ttttgaaa

SEQ ID NO: 155510 - DNA, 8 bp, Unknown
  misc_feature (1)..( 8): Result.004 file - promoters50/1014989
atttaaaa

SEQ ID NO: 155511 - DNA, 8 bp, Unknown
  misc_feature (1)..( 8): Result.004 file - promoters50/1014989
ttttgatg

SEQ ID NO: 155512 - DNA, 10 bp, Unknown
  misc_feature (1)..( 10): Result.004 file - promoters50/1014989
caacttattt

SEQ ID NO: 155513 - DNA, 10 bp, Unknown
  misc_feature (1)..( 10): Result.004 file - promoters50/1014989
taacttattg

SEQ ID NO: 155514 - DNA, 10 bp, Unknown
  misc_feature (1)..( 10): Result.004 file - promoters50/1014989
caactaattt

SEQ ID NO: 155515 - DNA, 10 bp, Unknown
  misc_feature (1)..( 10): Result.004 file - promoters50/1014989
caacaaatca

SEQ ID NO: 155516 - DNA, 10 bp, Unknown
  misc_feature (1)..( 10): Result.004 file - promoters50/1014989
acattcaatg

SEQ ID NO: 155517 - DNA, 10 bp, Unknown
  misc_feature (1)..( 10): Result.004 file - promoters50/1014989
aaatttaata

SEQ ID NO: 155518 - DNA, 10 bp, Unknown
  misc_feature (1)..( 10): Result.004 file - promoters50/1014989
acatacaata

SEQ ID NO: 155519 - DNA, 10 bp, Unknown
  misc_feature (1)..( 10): Result.004 file - promoters50/1014989
cattttgata

SEQ ID NO: 155520 - DNA, 8 bp, Unknown
  misc_feature (1)..( 8): Result.004 file - promoters50/1014989
aatttttt

SEQ ID NO: 155521 - DNA, 8 bp, Unknown
  misc_feature (1)..( 8): Result.004 file - promoters50/1014989
aatattta

SEQ ID NO: 155522 - DNA, 7 bp, Unknown
  misc_feature (1)..( 7): Result.004 file - promoters50/1014989
atatttc

SEQ ID NO: 155523 - DNA, 8 bp, Unknown
  misc_feature (1)..( 8): Result.004 file - promoters50/1014989
cgtatttc

SEQ ID NO: 155524 - DNA, 7 bp, Unknown
  misc_feature (1)..( 7): Result.004 file - promoters50/1014989
atatttt

SEQ ID NO: 155525 - DNA, 10 bp, Unknown
  misc_feature (1)..( 10): Result.004 file - promoters50/1014989
acatgtatta

SEQ ID NO: 155526 - DNA, 10 bp, Unknown
  misc_feature (1)..( 10): Result.004 file - promoters50/1014989
acatgttagt

SEQ ID NO: 155527 - DNA, 10 bp, Unknown
  misc_feature (1)..( 10): Result.004 file - promoters50/1014989
tcatattaaa

SEQ ID NO: 155528 - DNA, 10 bp, Unknown
  misc_feature (1)..( 10): Result.004 file - promoters50/1014989
aattattaaa

SEQ ID NO: 155529 - DNA, 10 bp, Unknown
  misc_feature (1)..( 10): Result.004 file - promoters50/1014989
tcttattaca

SEQ ID NO: 155530 - DNA, 7 bp, Unknown
  misc_feature (1)..( 7): Result.004 file - promoters50/1014989
atatttc

SEQ ID NO: 155531 - DNA, 7 bp, Unknown
  misc_feature (1)..( 7): Result.004 file - promoters50/1014989
atatttt

SEQ ID NO: 155532 - DNA, 7 bp, Unknown
  misc_feature (1)..( 7): Result.004 file - promoters50/1014989
atattta

SEQ ID NO: 155533 - DNA, 7 bp, Unknown
  misc_feature (1)..( 7): Result.004 file - promoters50/1015014
gtatttc

SEQ ID NO: 155534 - DNA, 14 bp, Unknown
  misc_feature (1)..( 14): Result.004 file - promoters50/1015014
ggataaattgcata

SEQ ID NO: 155535 - DNA, 14 bp, Unknown
  misc_feature (1)..( 14): Result.004 file - promoters50/1015014
atgtaaatttatgg

SEQ ID NO: 155536 - DNA, 15 bp, Unknown
  misc_feature (1)..( 15): Result.004 file - promoters50/1015014
tgttaatatatagaa

SEQ ID NO: 155537 - DNA, 15 bp, Unknown
  misc_feature (1)..( 15): Result.004 file - promoters50/1015033
tatatatatatatat

SEQ ID NO: 155538 - DNA, 13 bp, Unknown
  misc_feature (1)..( 13): Result.004 file - promoters50/1015033
ttattaaaacctt

SEQ ID NO: 155539 - DNA, 13 bp, Unknown
  misc_feature (1)..( 13): Result.004 file - promoters50/1015033
ggggtaaaaccgg

SEQ ID NO: 155540 - DNA, 13 bp, Unknown
  misc_feature (1)..( 13): Result.004 file - promoters50/1015064
ttaataaaaactt

SEQ ID NO: 155541 - DNA, 13 bp, Unknown
  misc_feature (1)..( 13): Result.004 file - promoters50/1015064
tagttgattcgtt

SEQ ID NO: 155542 - DNA, 13 bp, Unknown
  misc_feature (1)..( 13): Result.004 file - promoters50/1015064
atttttatttgtt

SEQ ID NO: 155543 - DNA, 13 bp, Unknown
  misc_feature (1)..( 13): Result.004 file - promoters50/1015064
tagtttattcgag

SEQ ID NO: 155544 - DNA, 14 bp, Unknown
  misc_feature (1)..( 14): Result.004 file - promoters50/1015064
tgaaatgtttagtt

SEQ ID NO: 155545 - DNA, 8 bp, Unknown
  misc_feature (1)..( 8): Result.004 file - promoters50/1015064
tattaatg

SEQ ID NO: 155546 - DNA, 8 bp, Unknown
  misc_feature (1)..( 8): Result.004 file - promoters50/1015064
tattaata

SEQ ID NO: 155547 - DNA, 8 bp, Unknown
  misc_feature (1)..( 8): Result.004 file - promoters50/1015064
agttaatg

SEQ ID NO: 155548 - DNA, 8 bp, Unknown
  misc_feature (1)..( 8): Result.004 file - promoters50/1015064
ggttaatt

SEQ ID NO: 155549 - DNA, 7 bp, Unknown
  misc_feature (1)..( 7): Result.004 file - promoters50/1015064
aatatta

SEQ ID NO: 155550 - DNA, 7 bp, Unknown
  misc_feature (1)..( 7): Result.004 file - promoters50/1015064
aatattt

SEQ ID NO: 155551 - DNA, 7 bp, Unknown
  misc_feature (1)..( 7): Result.004 file - promoters50/1015064
aatgttt

SEQ ID NO: 155552 - DNA, 7 bp, Unknown
  misc_feature (1)..( 7): Result.004 file - promoters50/1015064
aatgttt

SEQ ID NO: 155553 - DNA, 8 bp, Unknown
  misc_feature (1)..( 8): Result.004 file - promoters50/1015064
tttagtgg

SEQ ID NO: 155554 - DNA, 8 bp, Unknown
  misc_feature (1)..( 8): Result.004 file - promoters50/1015064
tttagttt

SEQ ID NO: 155555 - DNA, 8 bp, Unknown
  misc_feature (1)..( 8): Result.004 file - promoters50/1015064
tttagtta

SEQ ID NO: 155556 - DNA, 8 bp, Unknown
  misc_feature (1)..( 8): Result.004 file - promoters50/1015064
cttatttt

SEQ ID NO: 155557 - DNA, 10 bp, Unknown
  misc_feature (1)..( 10): Result.004 file - promoters50/1015064
tgaagccaaa

SEQ ID NO: 155558 - DNA, 10 bp, Unknown
  misc_feature (1)..( 10): Result.004 file - promoters50/1015064
tgaaaccaac

SEQ ID NO: 155559 - DNA, 10 bp, Unknown
  misc_feature (1)..( 10): Result.004 file - promoters50/1015064
aagaacaaac

SEQ ID NO: 155560 - DNA, 7 bp, Unknown
  misc_feature (1)..( 7): Result.004 file - promoters50/1015064
tttcgat

SEQ ID NO: 155561 - DNA, 7 bp, Unknown
  misc_feature (1)..( 7): Result.004 file - promoters50/1015064
ttttgat

SEQ ID NO: 155562 - DNA, 7 bp, Unknown
  misc_feature (1)..( 7): Result.004 file - promoters50/1015064
ttttgat

SEQ ID NO: 155563 - DNA, 9 bp, Unknown
  misc_feature (1)..( 9): Result.004 file - promoters50/1015064
aatttattt

SEQ ID NO: 155564 - DNA, 9 bp, Unknown
  misc_feature (1)..( 9): Result.004 file - promoters50/1015064
aatatattt

SEQ ID NO: 155565 - DNA, 9 bp, Unknown
  misc_feature (1)..( 9): Result.004 file - promoters50/1015064
aatatattt

SEQ ID NO: 155566 - DNA, 11 bp, Unknown
  misc_feature (1)..( 11): Result.004 file - promoters50/1015064
tacgtaacatg

SEQ ID NO: 155567 - DNA, 11 bp, Unknown
  misc_feature (1)..( 11): Result.004 file - promoters50/1015064
tacgttacaat

SEQ ID NO: 155568 - DNA, 11 bp, Unknown
  misc_feature (1)..( 11): Result.004 file - promoters50/1015092
gtattaatatg

SEQ ID NO: 155569 - DNA, 9 bp, Unknown
  misc_feature (1)..( 9): Result.004 file - promoters50/1015092
ggtctaaat

SEQ ID NO: 155570 - DNA, 9 bp, Unknown
  misc_feature (1)..( 9): Result.004 file - promoters50/1015092
tgtcgaaaa

SEQ ID NO: 155571 - DNA, 10 bp, Unknown
  misc_feature (1)..( 10): Result.004 file - promoters50/1015092
tgtcgagaat

SEQ ID NO: 155572 - DNA, 10 bp, Unknown
  misc_feature (1)..( 10): Result.004 file - promoters50/1015116
tgtcaagatg

SEQ ID NO: 155573 - DNA, 8 bp, Unknown
  misc_feature (1)..( 8): Result.004 file - promoters50/1015116
atttatct

SEQ ID NO: 155574 - DNA, 8 bp, Unknown
  misc_feature (1)..( 8): Result.004 file - promoters50/1015116
atttgtct

SEQ ID NO: 155575 - DNA, 8 bp, Unknown
  misc_feature (1)..( 8): Result.004 file - promoters50/1015116
ttttgtca

SEQ ID NO: 155576 - DNA, 8 bp, Unknown
  misc_feature (1)..( 8): Result.004 file - promoters50/1015116
ttttgttg

SEQ ID NO: 155577 - DNA, 7 bp, Unknown
  misc_feature (1)..( 7): Result.004 file - promoters50/1015116
ttctttg

SEQ ID NO: 155578 - DNA, 7 bp, Unknown
  misc_feature (1)..( 7): Result.004 file - promoters50/1015116
ctctttg

SEQ ID NO: 155579 - DNA, 7 bp, Unknown
  misc_feature (1)..( 7): Result.004 file - promoters50/1015116
ttcattg

SEQ ID NO: 155580 - DNA, 9 bp, Unknown
  misc_feature (1)..( 9): Result.004 file - promoters50/1015116
aaatatata

SEQ ID NO: 155581 - DNA, 9 bp, Unknown
  misc_feature (1)..( 9): Result.004 file - promoters50/1015116
aaagatatg

SEQ ID NO: 155582 - DNA, 9 bp, Unknown
  misc_feature (1)..( 9): Result.004 file - promoters50/1015116
gtatttatt

SEQ ID NO: 155583 - DNA, 8 bp, Unknown
  misc_feature (1)..( 8): Result.004 file - promoters50/1015116
gtttgttg

SEQ ID NO: 155584 - DNA, 8 bp, Unknown
  misc_feature (1)..( 8): Result.004 file - promoters50/1015116
ttttgttg

SEQ ID NO: 155585 - DNA, 8 bp, Unknown
  misc_feature (1)..( 8): Result.004 file - promoters50/1015116
ttttgttt

SEQ ID NO: 155586 - DNA, 9 bp, Unknown
  misc_feature (1)..( 9): Result.004 file - promoters50/1015116
tctttgctt

SEQ ID NO: 155587 - DNA, 9 bp, Unknown
  misc_feature (1)..( 9): Result.004 file - promoters50/1015116
aatttactt

SEQ ID NO: 155588 - DNA, 9 bp, Unknown
  misc_feature (1)..( 9): Result.004 file - promoters50/1015116
aatatacta

SEQ ID NO: 155589 - DNA, 9 bp, Unknown
  misc_feature (1)..( 9): Result.004 file - promoters50/1015116
tttttattt

SEQ ID NO: 155590 - DNA, 9 bp, Unknown
  misc_feature (1)..( 9): Result.004 file - promoters50/1015116
tttttgttt

SEQ ID NO: 155591 - DNA, 9 bp, Unknown
  misc_feature (1)..( 9): Result.004 file - promoters50/1015167
attttgttg

SEQ ID NO: 155592 - DNA, 8 bp, Unknown
  misc_feature (1)..( 8): Result.004 file - promoters50/1015167
gaaacaat

SEQ ID NO: 155593 - DNA, 8 bp, Unknown
  misc_feature (1)..( 8): Result.004 file - promoters50/1015167
gaaaaaat

SEQ ID NO: 155594 - DNA, 8 bp, Unknown
  misc_feature (1)..( 8): Result.004 file - promoters50/1015167
gaaagaat

SEQ ID NO: 155595 - DNA, 8 bp, Unknown
  misc_feature (1)..( 8): Result.004 file - promoters50/1015167
tgaaatca

SEQ ID NO: 155596 - DNA, 8 bp, Unknown
  misc_feature (1)..( 8): Result.004 file - promoters50/1015167
tgagatca

SEQ ID NO: 155597 - DNA, 8 bp, Unknown
  misc_feature (1)..( 8): Result.004 file - promoters50/1015179
tgaaatgt

SEQ ID NO: 155598 - DNA, 12 bp, Unknown
  misc_feature (1)..( 12): Result.004 file - promoters50/1015179
aaactcttataa

SEQ ID NO: 155599 - DNA, 12 bp, Unknown
  misc_feature (1)..( 12): Result.004 file - promoters50/1015179
atactctttatc

SEQ ID NO: 155600 - DNA, 12 bp, Unknown
  misc_feature (1)..( 12): Result.004 file - promoters50/1015179
aaattcttataa

SEQ ID NO: 155601 - DNA, 12 bp, Unknown
  misc_feature (1)..( 12): Result.004 file - promoters50/1015179
tcatttttaaat

SEQ ID NO: 155602 - DNA, 12 bp, Unknown
  misc_feature (1)..( 12): Result.004 file - promoters50/1015179
aaaatcatgttt

SEQ ID NO: 155603 - DNA, 13 bp, Unknown
  misc_feature (1)..( 13): Result.004 file - promoters50/1015179
aaacttcaaaaac

SEQ ID NO: 155604 - DNA, 13 bp, Unknown
  misc_feature (1)..( 13): Result.004 file - promoters50/1015179
tatcttcaattta

SEQ ID NO: 155605 - DNA, 13 bp, Unknown
  misc_feature (1)..( 13): Result.004 file - promoters50/1015179
ccatttcattttt

SEQ ID NO: 155606 - DNA, 13 bp, Unknown
  misc_feature (1)..( 13): Result.004 file - promoters50/1015179
attcttataacaa

SEQ ID NO: 155607 - DNA, 13 bp, Unknown
  misc_feature (1)..( 13): Result.004 file - promoters50/1015179
caaaatcatgttt

SEQ ID NO: 155608 - DNA, 12 bp, Unknown
  misc_feature (1)..( 12): Result.004 file - promoters50/1015179
caacagaacaaa

SEQ ID NO: 155609 - DNA, 12 bp, Unknown
  misc_feature (1)..( 12): Result.004 file - promoters50/1015179
aaacagagctaa

SEQ ID NO: 155610 - DNA, 12 bp, Unknown
  misc_feature (1)..( 12): Result.004 file - promoters50/1015179
ttacatagccca

SEQ ID NO: 155611 - DNA, 12 bp, Unknown
  misc_feature (1)..( 12): Result.004 file - promoters50/1015179
gataataggcca

SEQ ID NO: 155612 - DNA, 12 bp, Unknown
  misc_feature (1)..( 12): Result.004 file - promoters50/1015179
aaagagataaaa

SEQ ID NO: 155613 - DNA, 11 bp, Unknown
  misc_feature (1)..( 11): Result.004 file - promoters50/1015179
tttgaatagtc

SEQ ID NO: 155614 - DNA, 11 bp, Unknown
  misc_feature (1)..( 11): Result.004 file - promoters50/1015179
tttgaaaagtc

SEQ ID NO: 155615 - DNA, 11 bp, Unknown
  misc_feature (1)..( 11): Result.004 file - promoters50/1015179
tttgaattcca

SEQ ID NO: 155616 - DNA, 12 bp, Unknown
  misc_feature (1)..( 12): Result.004 file - promoters50/1015179
tagtgaaaataa

SEQ ID NO: 155617 - DNA, 12 bp, Unknown
  misc_feature (1)..( 12): Result.004 file - promoters50/1015210
tttagaacaaga

SEQ ID NO: 155618 - DNA, 8 bp, Unknown
  misc_feature (1)..( 8): Result.004 file - promoters50/1015210
ttatcctt

SEQ ID NO: 155619 - DNA, 8 bp, Unknown
  misc_feature (1)..( 8): Result.004 file - promoters50/1015210
ttaaccta

SEQ ID NO: 155620 - DNA, 8 bp, Unknown
  misc_feature (1)..( 8): Result.004 file - promoters50/1015210
ttatcctt

SEQ ID NO: 155621 - DNA, 12 bp, Unknown
  misc_feature (1)..( 12): Result.004 file - promoters50/1015210
aaatgcttagtc

SEQ ID NO: 155622 - DNA, 12 bp, Unknown
  misc_feature (1)..( 12): Result.004 file - promoters50/1015210
aaattcttggca

SEQ ID NO: 155623 - DNA, 12 bp, Unknown
  misc_feature (1)..( 12): Result.004 file - promoters50/1015214
tgcttctttgca

SEQ ID NO: 155624 - DNA, 14 bp, Unknown
  misc_feature (1)..( 14): Result.004 file - promoters50/1015214
atatatgtaaacgt

SEQ ID NO: 155625 - DNA, 14 bp, Unknown
  misc_feature (1)..( 14): Result.004 file - promoters50/1015214
ctttatttaaaaag

SEQ ID NO: 155626 - DNA, 14 bp, Unknown
  misc_feature (1)..( 14): Result.004 file - promoters50/1015214
atagatgtttcatt

SEQ ID NO: 155627 - DNA, 14 bp, Unknown
  misc_feature (1)..( 14): Result.004 file - promoters50/1015214
tcgtatctaagacc

SEQ ID NO: 155628 - DNA, 14 bp, Unknown
  misc_feature (1)..( 14): Result.004 file - promoters50/1015214
ttagcattaaaata

SEQ ID NO: 155629 - DNA, 15 bp, Unknown
  misc_feature (1)..( 15): Result.004 file - promoters50/1015214
ttaattttagaaaga

SEQ ID NO: 155630 - DNA, 13 bp, Unknown
  misc_feature (1)..( 13): Result.004 file - promoters50/1015214
ttctgtaactaca

SEQ ID NO: 155631 - DNA, 10 bp, Unknown
  misc_feature (1)..( 10): Result.004 file - promoters50/1015214
ttttagggtt

SEQ ID NO: 155632 - DNA, 9 bp, Unknown
  misc_feature (1)..( 9): Result.004 file - promoters50/1015214
gaaaacaaa

SEQ ID NO: 155633 - DNA, 9 bp, Unknown
  misc_feature (1)..( 9): Result.004 file - promoters50/1015214
agaaagaaa

SEQ ID NO: 155634 - DNA, 9 bp, Unknown
  misc_feature (1)..( 9): Result.004 file - promoters50/1015214
taaaacatt

SEQ ID NO: 155635 - DNA, 9 bp, Unknown
  misc_feature (1)..( 9): Result.004 file - promoters50/1015214
gcacacaac

SEQ ID NO: 155636 - DNA, 9 bp, Unknown
  misc_feature (1)..( 9): Result.004 file - promoters50/1015214
tgaatgaaa

SEQ ID NO: 155637 - DNA, 9 bp, Unknown
  misc_feature (1)..( 9): Result.004 file - promoters50/1015247
tgaatgttg

SEQ ID NO: 155638 - DNA, 10 bp, Unknown
  misc_feature (1)..( 10): Result.004 file - promoters50/1015247
ttcttgtttc

SEQ ID NO: 155639 - DNA, 10 bp, Unknown
  misc_feature (1)..( 10): Result.004 file - promoters50/1015247
ttcttcttta

SEQ ID NO: 155640 - DNA, 10 bp, Unknown
  misc_feature (1)..( 10): Result.004 file - promoters50/1015247
aagatcttta

SEQ ID NO: 155641 - DNA, 9 bp, Unknown
  misc_feature (1)..( 9): Result.004 file - promoters50/1015247
aaaacaaaa

SEQ ID NO: 155642 - DNA, 9 bp, Unknown
  misc_feature (1)..( 9): Result.004 file - promoters50/1015247
aaaacaaaa

SEQ ID NO: 155643 - DNA, 9 bp, Unknown
  misc_feature (1)..( 9): Result.004 file - promoters50/1015247
tcaacaaaa

SEQ ID NO: 155644 - DNA, 10 bp, Unknown
  misc_feature (1)..( 10): Result.004 file - promoters50/1015247
attaaagaaa

SEQ ID NO: 155645 - DNA, 10 bp, Unknown
  misc_feature (1)..( 10): Result.004 file - promoters50/1015247
attaaaggaa

SEQ ID NO: 155646 - DNA, 10 bp, Unknown
  misc_feature (1)..( 10): Result.004 file - promoters50/1015264
agtaagggaa

SEQ ID NO: 155647 - DNA, 7 bp, Unknown
  misc_feature (1)..( 7): Result.004 file - promoters50/1015264
tcatttt

SEQ ID NO: 155648 - DNA, 7 bp, Unknown
  misc_feature (1)..( 7): Result.004 file - promoters50/1015264
tcatttg

SEQ ID NO: 155649 - DNA, 7 bp, Unknown
  misc_feature (1)..( 7): Result.004 file - promoters50/1015264
ccatttg

SEQ ID NO: 155650 - DNA, 9 bp, Unknown
  misc_feature (1)..( 9): Result.004 file - promoters50/1015264
taatttaaa

SEQ ID NO: 155651 - DNA, 9 bp, Unknown
  misc_feature (1)..( 9): Result.004 file - promoters50/1015264
caattaaaa

SEQ ID NO: 155652 - DNA, 9 bp, Unknown
  misc_feature (1)..( 9): Result.004 file - promoters50/1015264
taatttttc

SEQ ID NO: 155653 - DNA, 11 bp, Unknown
  misc_feature (1)..( 11): Result.004 file - promoters50/1015264
ctagaaattta

SEQ ID NO: 155654 - DNA, 11 bp, Unknown
  misc_feature (1)..( 11): Result.004 file - promoters50/1015264
taaaaaaatta

SEQ ID NO: 155655 - DNA, 11 bp, Unknown
  misc_feature (1)..( 11): Result.004 file - promoters50/1015264
attgaaaactt

SEQ ID NO: 155656 - DNA, 8 bp, Unknown
  misc_feature (1)..( 8): Result.004 file - promoters50/1015264
gtaattac

SEQ ID NO: 155657 - DNA, 8 bp, Unknown
  misc_feature (1)..( 8): Result.004 file - promoters50/1015264
ctaattaa

SEQ ID NO: 155658 - DNA, 8 bp, Unknown
  misc_feature (1)..( 8): Result.004 file - promoters50/1015264
ctaaataa

SEQ ID NO: 155659 - DNA, 7 bp, Unknown
  misc_feature (1)..( 7): Result.004 file - promoters50/1015264
tttattt

SEQ ID NO: 155660 - DNA, 7 bp, Unknown
  misc_feature (1)..( 7): Result.004 file - promoters50/1015264
tttatta

SEQ ID NO: 155661 - DNA, 7 bp, Unknown
  misc_feature (1)..( 7): Result.004 file - promoters50/1015264
tttatta

SEQ ID NO: 155662 - DNA, 8 bp, Unknown
  misc_feature (1)..( 8): Result.004 file - promoters50/1015264
agtattag

SEQ ID NO: 155663 - DNA, 8 bp, Unknown
  misc_feature (1)..( 8): Result.004 file - promoters50/1015264
tttattag

SEQ ID NO: 155664 - DNA, 8 bp, Unknown
  misc_feature (1)..( 8): Result.004 file - promoters50/1015264
tttattat

SEQ ID NO: 155665 - DNA, 10 bp, Unknown
  misc_feature (1)..( 10): Result.004 file - promoters50/1015264
tacaaaaatg

SEQ ID NO: 155666 - DNA, 10 bp, Unknown
  misc_feature (1)..( 10): Result.004 file - promoters50/1015264
tactaaataa

SEQ ID NO: 155667 - DNA, 10 bp, Unknown
  misc_feature (1)..( 10): Result.004 file - promoters50/1015264
ctctaattaa

SEQ ID NO: 155668 - DNA, 11 bp, Unknown
  misc_feature (1)..( 11): Result.004 file - promoters50/1015264
cgaatttgatt

SEQ ID NO: 155669 - DNA, 11 bp, Unknown
  misc_feature (1)..( 11): Result.004 file - promoters50/1015264
tttgtttgatt

SEQ ID NO: 155670 - DNA, 11 bp, Unknown
  misc_feature (1)..( 11): Result.004 file - promoters50/1015264
tttgtatgatt

SEQ ID NO: 155671 - DNA, 11 bp, Unknown
  misc_feature (1)..( 11): Result.004 file - promoters50/1015264
tttgtatacca

SEQ ID NO: 155672 - DNA, 11 bp, Unknown
  misc_feature (1)..( 11): Result.004 file - promoters50/1015264
tttgtatgatt

SEQ ID NO: 155673 - DNA, 11 bp, Unknown
  misc_feature (1)..( 11): Result.004 file - promoters50/1015375
tttgtttgatt

SEQ ID NO: 155674 - DNA, 8 bp, Unknown
  misc_feature (1)..( 8): Result.004 file - promoters50/1015375
tattctcg

SEQ ID NO: 155675 - DNA, 8 bp, Unknown
  misc_feature (1)..( 8): Result.004 file - promoters50/1015375
tattctag

SEQ ID NO: 155676 - DNA, 8 bp, Unknown
  misc_feature (1)..( 8): Result.004 file - promoters50/1015427
tattgtcg

SEQ ID NO: 155677 - DNA, 7 bp, Unknown
  misc_feature (1)..( 7): Result.004 file - promoters50/1015427
taattta

SEQ ID NO: 155678 - DNA, 7 bp, Unknown
  misc_feature (1)..( 7): Result.004 file - promoters50/1015427
taatttg

SEQ ID NO: 155679 - DNA, 7 bp, Unknown
  misc_feature (1)..( 7): Result.004 file - promoters50/1015427
caatttg

SEQ ID NO: 155680 - DNA, 8 bp, Unknown
  misc_feature (1)..( 8): Result.004 file - promoters50/1015427
agaaaatt

SEQ ID NO: 155681 - DNA, 8 bp, Unknown
  misc_feature (1)..( 8): Result.004 file - promoters50/1015427
agaaaaat

SEQ ID NO: 155682 - DNA, 8 bp, Unknown
  misc_feature (1)..( 8): Result.004 file - promoters50/1015516
agaaaaaa

SEQ ID NO: 155683 - DNA, 8 bp, Unknown
  misc_feature (1)..( 8): Result.004 file - promoters50/1015516
tgattcca

SEQ ID NO: 155684 - DNA, 8 bp, Unknown
  misc_feature (1)..( 8): Result.004 file - promoters50/1015516
tgatgcca

SEQ ID NO: 155685 - DNA, 8 bp, Unknown
  misc_feature (1)..( 8): Result.004 file - promoters50/1015524
tgatgcag

SEQ ID NO: 155686 - DNA, 9 bp, Unknown
  misc_feature (1)..( 9): Result.004 file - promoters50/1015524
cttttcttt

SEQ ID NO: 155687 - DNA, 9 bp, Unknown
  misc_feature (1)..( 9): Result.004 file - promoters50/1015524
tttttctta

SEQ ID NO: 155688 - DNA, 9 bp, Unknown
  misc_feature (1)..( 9): Result.004 file - promoters50/1015524
cttttttta

SEQ ID NO: 155689 - DNA, 9 bp, Unknown
  misc_feature (1)..( 9): Result.004 file - promoters50/1015524
aatttatta

SEQ ID NO: 155690 - DNA, 9 bp, Unknown
  misc_feature (1)..( 9): Result.004 file - promoters50/1015524
caattttta

SEQ ID NO: 155691 - DNA, 9 bp, Unknown
  misc_feature (1)..( 9): Result.004 file - promoters50/1015524
aatatatta

SEQ ID NO: 155692 - DNA, 18 bp, Unknown
  misc_feature (1)..( 18): Result.004 file - promoters50/1015524
cagatatacattgctttg

SEQ ID NO: 155693 - DNA, 18 bp, Unknown
  misc_feature (1)..( 18): Result.004 file - promoters50/1015524
cggatttacttgaatgag

SEQ ID NO: 155694 - DNA, 18 bp, Unknown
  misc_feature (1)..( 18): Result.004 file - promoters50/1015524
aagaaatagaacaaagag

SEQ ID NO: 155695 - DNA, 18 bp, Unknown
  misc_feature (1)..( 18): Result.004 file - promoters50/1015524
tttctataaattattttt

SEQ ID NO: 155696 - DNA, 18 bp, Unknown
  misc_feature (1)..( 18): Result.004 file - promoters50/1015524
ccggttttgataattccc

SEQ ID NO: 155697 - DNA, 18 bp, Unknown
  misc_feature (1)..( 18): Result.004 file - promoters50/1015524
aagagctaaaaacggata

SEQ ID NO: 155698 - DNA, 18 bp, Unknown
  misc_feature (1)..( 18): Result.004 file - promoters50/1015524
aagaaattgcatagttac

SEQ ID NO: 155699 - DNA, 18 bp, Unknown
  misc_feature (1)..( 18): Result.004 file - promoters50/1015524
ccaattttttatagatta

SEQ ID NO: 155700 - DNA, 9 bp, Unknown
  misc_feature (1)..( 9): Result.004 file - promoters50/1015524
atataaaca

SEQ ID NO: 155701 - DNA, 9 bp, Unknown
  misc_feature (1)..( 9): Result.004 file - promoters50/1015524
atataaaga

SEQ ID NO: 155702 - DNA, 9 bp, Unknown
  misc_feature (1)..( 9): Result.004 file - promoters50/1015524
atatataca

SEQ ID NO: 155703 - DNA, 9 bp, Unknown
  misc_feature (1)..( 9): Result.004 file - promoters50/1015524
atattaaca

SEQ ID NO: 155704 - DNA, 9 bp, Unknown
  misc_feature (1)..( 9): Result.004 file - promoters50/1015524
ttatttaac

SEQ ID NO: 155705 - DNA, 9 bp, Unknown
  misc_feature (1)..( 9): Result.004 file - promoters50/1015524
ctatatatt

SEQ ID NO: 155706 - DNA, 11 bp, Unknown
  misc_feature (1)..( 11): Result.004 file - promoters50/1015524
caaaaacaact

SEQ ID NO: 155707 - DNA, 11 bp, Unknown
  misc_feature (1)..( 11): Result.004 file - promoters50/1015524
taaatacattt

SEQ ID NO: 155708 - DNA, 11 bp, Unknown
  misc_feature (1)..( 11): Result.004 file - promoters50/1015524
caaatacattg

SEQ ID NO: 155709 - DNA, 11 bp, Unknown
  misc_feature (1)..( 11): Result.004 file - promoters50/1015524
caaatatttcc

SEQ ID NO: 155710 - DNA, 11 bp, Unknown
  misc_feature (1)..( 11): Result.004 file - promoters50/1015524
aagatacgttg

SEQ ID NO: 155711 - DNA, 11 bp, Unknown
  misc_feature (1)..( 11): Result.004 file - promoters50/1015524
tgaatagatta

SEQ ID NO: 155712 - DNA, 10 bp, Unknown
  misc_feature (1)..( 10): Result.004 file - promoters50/1015524
tttgtttctc

SEQ ID NO: 155713 - DNA, 10 bp, Unknown
  misc_feature (1)..( 10): Result.004 file - promoters50/1015524
attgttttcg

SEQ ID NO: 155714 - DNA, 10 bp, Unknown
  misc_feature (1)..( 10): Result.004 file - promoters50/1015524
aatgtttctc

SEQ ID NO: 155715 - DNA, 10 bp, Unknown
  misc_feature (1)..( 10): Result.004 file - promoters50/1015524
tttttttctg

SEQ ID NO: 155716 - DNA, 10 bp, Unknown
  misc_feature (1)..( 10): Result.004 file - promoters50/1015524
attgtttaag

SEQ ID NO: 155717 - DNA, 10 bp, Unknown
  misc_feature (1)..( 10): Result.004 file - promoters50/1015537
tttttttttt

SEQ ID NO: 155718 - DNA, 10 bp, Unknown
  misc_feature (1)..( 10): Result.004 file - promoters50/1015537
ttaattttgc

SEQ ID NO: 155719 - DNA, 10 bp, Unknown
  misc_feature (1)..( 10): Result.004 file - promoters50/1015537
ttaattgtct

SEQ ID NO: 155720 - DNA, 10 bp, Unknown
  misc_feature (1)..( 10): Result.004 file - promoters50/1015537
ctaatttatt

SEQ ID NO: 155721 - DNA, 10 bp, Unknown
  misc_feature (1)..( 10): Result.004 file - promoters50/1015537
caaatttaag

SEQ ID NO: 155722 - DNA, 10 bp, Unknown
  misc_feature (1)..( 10): Result.004 file - promoters50/1015537
aaaattcaag

SEQ ID NO: 155723 - DNA, 11 bp, Unknown
  misc_feature (1)..( 11): Result.004 file - promoters50/1015537
gaaatattata

SEQ ID NO: 155724 - DNA, 11 bp, Unknown
  misc_feature (1)..( 11): Result.004 file - promoters50/1015537
gtaatttaaaa

SEQ ID NO: 155725 - DNA, 9 bp, Unknown
  misc_feature (1)..( 9): Result.004 file - promoters50/1015537
taattttgc

SEQ ID NO: 155726 - DNA, 9 bp, Unknown
  misc_feature (1)..( 9): Result.004 file - promoters50/1015537
aaatcttga

SEQ ID NO: 155727 - DNA, 9 bp, Unknown
  misc_feature (1)..( 9): Result.004 file - promoters50/1015537
taatttatt

SEQ ID NO: 155728 - DNA, 9 bp, Unknown
  misc_feature (1)..( 9): Result.004 file - promoters50/1015537
aaatttaag

SEQ ID NO: 155729 - DNA, 9 bp, Unknown
  misc_feature (1)..( 9): Result.004 file - promoters50/1015537
aaattcaag

SEQ ID NO: 155730 - DNA, 9 bp, Unknown
  misc_feature (1)..( 9): Result.004 file - promoters50/1015537
taatttaaa

SEQ ID NO: 155731 - DNA, 9 bp, Unknown
  misc_feature (1)..( 9): Result.004 file - promoters50/1015537
aaatattat

SEQ ID NO: 155732 - DNA, 9 bp, Unknown
  misc_feature (1)..( 9): Result.004 file - promoters50/1015537
aaatataaa

SEQ ID NO: 155733 - DNA, 9 bp, Unknown
  misc_feature (1)..( 9): Result.004 file - promoters50/1015537
aaaaattca

SEQ ID NO: 155734 - DNA, 9 bp, Unknown
  misc_feature (1)..( 9): Result.004 file - promoters50/1015537
aaatttaag

SEQ ID NO: 155735 - DNA, 9 bp, Unknown
  misc_feature (1)..( 9): Result.004 file - promoters50/1015537
taatttaaa

SEQ ID NO: 155736 - DNA, 9 bp, Unknown
  misc_feature (1)..( 9): Result.004 file - promoters50/1015537
taatttatt

SEQ ID NO: 155737 - DNA, 10 bp, Unknown
  misc_feature (1)..( 10): Result.004 file - promoters50/1015537
aaagtataaa

SEQ ID NO: 155738 - DNA, 13 bp, Unknown
  misc_feature (1)..( 13): Result.004 file - promoters50/1015537
ccaaatattatcc

SEQ ID NO: 155739 - DNA, 13 bp, Unknown
  misc_feature (1)..( 13): Result.004 file - promoters50/1015537
tttgataatatct

SEQ ID NO: 155740 - DNA, 13 bp, Unknown
  misc_feature (1)..( 13): Result.004 file - promoters50/1015537
gaaattattattt

SEQ ID NO: 155741 - DNA, 13 bp, Unknown
  misc_feature (1)..( 13): Result.004 file - promoters50/1015537
gaaaaaattcaag

SEQ ID NO: 155742 - DNA, 13 bp, Unknown
  misc_feature (1)..( 13): Result.004 file - promoters50/1015537
agaaagaataata

SEQ ID NO: 155743 - DNA, 13 bp, Unknown
  misc_feature (1)..( 13): Result.004 file - promoters50/1015537
aattctaaaatct

SEQ ID NO: 155744 - DNA, 13 bp, Unknown
  misc_feature (1)..( 13): Result.004 file - promoters50/1015537
ccgactaaaaaaa

SEQ ID NO: 155745 - DNA, 10 bp, Unknown
  misc_feature (1)..( 10): Result.004 file - promoters50/1015537
aattgatata

SEQ ID NO: 155746 - DNA, 10 bp, Unknown
  misc_feature (1)..( 10): Result.004 file - promoters50/1015537
atctgaaata

SEQ ID NO: 155747 - DNA, 10 bp, Unknown
  misc_feature (1)..( 10): Result.004 file - promoters50/1015537
aattgatatt

SEQ ID NO: 155748 - DNA, 10 bp, Unknown
  misc_feature (1)..( 10): Result.004 file - promoters50/1015537
ttctaaaatc

SEQ ID NO: 155749 - DNA, 10 bp, Unknown
  misc_feature (1)..( 10): Result.004 file - promoters50/1015537
gactaaaaaa

SEQ ID NO: 155750 - DNA, 10 bp, Unknown
  misc_feature (1)..( 10): Result.004 file - promoters50/1015537
ttctaattta

SEQ ID NO: 155751 - DNA, 10 bp, Unknown
  misc_feature (1)..( 10): Result.004 file - promoters50/1015537
agaaaaaatt

SEQ ID NO: 155752 - DNA, 16 bp, Unknown
  misc_feature (1)..( 16): Result.004 file - promoters50/1015537
cggcaaaagtccaaac

SEQ ID NO: 155753 - DNA, 16 bp, Unknown
  misc_feature (1)..( 16): Result.004 file - promoters50/1015537
cacacaaaatccatat

SEQ ID NO: 155754 - DNA, 16 bp, Unknown
  misc_feature (1)..( 16): Result.004 file - promoters50/1015537
aaacaaaagttcaaac

SEQ ID NO: 155755 - DNA, 16 bp, Unknown
  misc_feature (1)..( 16): Result.004 file - promoters50/1015537
cacataaaatctggta

SEQ ID NO: 155756 - DNA, 16 bp, Unknown
  misc_feature (1)..( 16): Result.004 file - promoters50/1015537
atcataaaataataat

SEQ ID NO: 155757 - DNA, 16 bp, Unknown
  misc_feature (1)..( 16): Result.004 file - promoters50/1015537
aaccaaacaacaagct

SEQ ID NO: 155758 - DNA, 8 bp, Unknown
  misc_feature (1)..( 8): Result.004 file - promoters50/1015537
taagatat

SEQ ID NO: 155759 - DNA, 8 bp, Unknown
  misc_feature (1)..( 8): Result.004 file - promoters50/1015537
taaaatat

SEQ ID NO: 155760 - DNA, 8 bp, Unknown
  misc_feature (1)..( 8): Result.004 file - promoters50/1015537
tgaaatat

SEQ ID NO: 155761 - DNA, 8 bp, Unknown
  misc_feature (1)..( 8): Result.004 file - promoters50/1015537
gaaattat

SEQ ID NO: 155762 - DNA, 8 bp, Unknown
  misc_feature (1)..( 8): Result.004 file - promoters50/1015537
taaaattt

SEQ ID NO: 155763 - DNA, 8 bp, Unknown
  misc_feature (1)..( 8): Result.004 file - promoters50/1015541
aaaaattc

SEQ ID NO: 155764 - DNA, 8 bp, Unknown
  misc_feature (1)..( 8): Result.004 file - promoters50/1015541
aatacatt

SEQ ID NO: 155765 - DNA, 8 bp, Unknown
  misc_feature (1)..( 8): Result.004 file - promoters50/1015541
aatatatt

SEQ ID NO: 155766 - DNA, 8 bp, Unknown
  misc_feature (1)..( 8): Result.004 file - promoters50/1015541
aatgtatg

SEQ ID NO: 155767 - DNA, 12 bp, Unknown
  misc_feature (1)..( 12): Result.004 file - promoters50/1015541
ctatttttttct

SEQ ID NO: 155768 - DNA, 12 bp, Unknown
  misc_feature (1)..( 12): Result.004 file - promoters50/1015541
ctagtttcttct

SEQ ID NO: 155769 - DNA, 12 bp, Unknown
  misc_feature (1)..( 12): Result.004 file - promoters50/1015597
tctgttccttat

SEQ ID NO: 155770 - DNA, 10 bp, Unknown
  misc_feature (1)..( 10): Result.004 file - promoters50/1015597
aatctaattg

SEQ ID NO: 155771 - DNA, 10 bp, Unknown
  misc_feature (1)..( 10): Result.004 file - promoters50/1015597
tatctaatga

SEQ ID NO: 155772 - DNA, 10 bp, Unknown
  misc_feature (1)..( 10): Result.004 file - promoters50/1015597
aatataagaa

SEQ ID NO: 155773 - DNA, 10 bp, Unknown
  misc_feature (1)..( 10): Result.004 file - promoters50/1015597
caactaattt

SEQ ID NO: 155774 - DNA, 10 bp, Unknown
  misc_feature (1)..( 10): Result.004 file - promoters50/1015597
caacaaatgc

SEQ ID NO: 155775 - DNA, 10 bp, Unknown
  misc_feature (1)..( 10): Result.004 file - promoters50/1015597
atattaattt

SEQ ID NO: 155776 - DNA, 8 bp, Unknown
  misc_feature (1)..( 8): Result.004 file - promoters50/1015597
taaaaaaa

SEQ ID NO: 155777 - DNA, 8 bp, Unknown
  misc_feature (1)..( 8): Result.004 file - promoters50/1015597
taataaaa

SEQ ID NO: 155778 - DNA, 8 bp, Unknown
  misc_feature (1)..( 8): Result.004 file - promoters50/1015597
taaaaagt

SEQ ID NO: 155779 - DNA, 8 bp, Unknown
  misc_feature (1)..( 8): Result.004 file - promoters50/1015597
gaaagaag

SEQ ID NO: 155780 - DNA, 8 bp, Unknown
  misc_feature (1)..( 8): Result.004 file - promoters50/1015597
taacaagc

SEQ ID NO: 155781 - DNA, 8 bp, Unknown
  misc_feature (1)..( 8): Result.004 file - promoters50/1015606
taataagt

SEQ ID NO: 155782 - DNA, 8 bp, Unknown
  misc_feature (1)..( 8): Result.004 file - promoters50/1015606
acaagcga

SEQ ID NO: 155783 - DNA, 8 bp, Unknown
  misc_feature (1)..( 8): Result.004 file - promoters50/1015606
acaggcgg

SEQ ID NO: 155784 - DNA, 8 bp, Unknown
  misc_feature (1)..( 8): Result.004 file - promoters50/1015606
acaagcga

SEQ ID NO: 155785 - DNA, 8 bp, Unknown
  misc_feature (1)..( 8): Result.004 file - promoters50/1015606
ccaaacga

SEQ ID NO: 155786 - DNA, 10 bp, Unknown
  misc_feature (1)..( 10): Result.004 file - promoters50/1015606
aatttgtttg

SEQ ID NO: 155787 - DNA, 10 bp, Unknown
  misc_feature (1)..( 10): Result.004 file - promoters50/1015606
aatttgttat

SEQ ID NO: 155788 - DNA, 10 bp, Unknown
  misc_feature (1)..( 10): Result.004 file - promoters50/1015606
attttctttg

SEQ ID NO: 155789 - DNA, 10 bp, Unknown
  misc_feature (1)..( 10): Result.004 file - promoters50/1015637
aatttgtttg

SEQ ID NO: 155790 - DNA, 18 bp, Unknown
  misc_feature (1)..( 18): Result.004 file - promoters50/1015637
cggtactaaatgtatagt

SEQ ID NO: 155791 - DNA, 18 bp, Unknown
  misc_feature (1)..( 18): Result.004 file - promoters50/1015637
acaaagtaattgtttgtt

SEQ ID NO: 155792 - DNA, 18 bp, Unknown
  misc_feature (1)..( 18): Result.004 file - promoters50/1015637
gatatttaaatgggccta

SEQ ID NO: 155793 - DNA, 18 bp, Unknown
  misc_feature (1)..( 18): Result.004 file - promoters50/1015637
aaaaatcaatttttttga

SEQ ID NO: 155794 - DNA, 18 bp, Unknown
  misc_feature (1)..( 18): Result.004 file - promoters50/1015637
tacgaaagattgttagtt

SEQ ID NO: 155795 - DNA, 18 bp, Unknown
  misc_feature (1)..( 18): Result.004 file - promoters50/1015637
taggtataaagaaataaa

SEQ ID NO: 155796 - DNA, 10 bp, Unknown
  misc_feature (1)..( 10): Result.004 file - promoters50/1015637
ggaaagtata

SEQ ID NO: 155797 - DNA, 10 bp, Unknown
  misc_feature (1)..( 10): Result.004 file - promoters50/1015637
ggagagtttc

SEQ ID NO: 155798 - DNA, 10 bp, Unknown
  misc_feature (1)..( 10): Result.004 file - promoters50/1015637
gaaaagtaaa

SEQ ID NO: 155799 - DNA, 10 bp, Unknown
  misc_feature (1)..( 10): Result.004 file - promoters50/1015637
tcaaagtaga

SEQ ID NO: 155800 - DNA, 10 bp, Unknown
  misc_feature (1)..( 10): Result.004 file - promoters50/1015637
acaaaatagc

SEQ ID NO: 155801 - DNA, 10 bp, Unknown
  misc_feature (1)..( 10): Result.004 file - promoters50/1015661
aaaaagaaaa

SEQ ID NO: 155802 - DNA, 11 bp, Unknown
  misc_feature (1)..( 11): Result.004 file - promoters50/1015661
caaaatcaaat

SEQ ID NO: 155803 - DNA, 11 bp, Unknown
  misc_feature (1)..( 11): Result.004 file - promoters50/1015661
ggaaagcaatg

SEQ ID NO: 155804 - DNA, 11 bp, Unknown
  misc_feature (1)..( 11): Result.004 file - promoters50/1015661
cgaaatcataa

SEQ ID NO: 155805 - DNA, 11 bp, Unknown
  misc_feature (1)..( 11): Result.004 file - promoters50/1015661
tgcaattaaaa

SEQ ID NO: 155806 - DNA, 11 bp, Unknown
  misc_feature (1)..( 11): Result.004 file - promoters50/1015661
aaaaagaaatg

SEQ ID NO: 155807 - DNA, 11 bp, Unknown
  misc_feature (1)..( 11): Result.004 file - promoters50/1015661
caaaagagcta

SEQ ID NO: 155808 - DNA, 11 bp, Unknown
  misc_feature (1)..( 11): Result.004 file - promoters50/1015661
aaaaaaaaatg

SEQ ID NO: 155809 - DNA, 11 bp, Unknown
  misc_feature (1)..( 11): Result.004 file - promoters50/1015661
acaaataatat

SEQ ID NO: 155810 - DNA, 12 bp, Unknown
  misc_feature (1)..( 12): Result.004 file - promoters50/1015661
acattatagtat

SEQ ID NO: 155811 - DNA, 12 bp, Unknown
  misc_feature (1)..( 12): Result.004 file - promoters50/1015661
acattataatag

SEQ ID NO: 155812 - DNA, 12 bp, Unknown
  misc_feature (1)..( 12): Result.004 file - promoters50/1015661
ttattaaagtat

SEQ ID NO: 155813 - DNA, 12 bp, Unknown
  misc_feature (1)..( 12): Result.004 file - promoters50/1015661
aaattataacac

SEQ ID NO: 155814 - DNA, 12 bp, Unknown
  misc_feature (1)..( 12): Result.004 file - promoters50/1015661
tgattataattt

SEQ ID NO: 155815 - DNA, 11 bp, Unknown
  misc_feature (1)..( 11): Result.004 file - promoters50/1015661
tactaaagtgt

SEQ ID NO: 155816 - DNA, 16 bp, Unknown
  misc_feature (1)..( 16): Result.004 file - promoters50/1015661
atatttgtgtattctt

SEQ ID NO: 155817 - DNA, 16 bp, Unknown
  misc_feature (1)..( 16): Result.004 file - promoters50/1015661
gtatatgttacaacta

SEQ ID NO: 155818 - DNA, 16 bp, Unknown
  misc_feature (1)..( 16): Result.004 file - promoters50/1015661
gtatttgtttgacggt

SEQ ID NO: 155819 - DNA, 16 bp, Unknown
  misc_feature (1)..( 16): Result.004 file - promoters50/1015661
aattttgttattgctc

SEQ ID NO: 155820 - DNA, 16 bp, Unknown
  misc_feature (1)..( 16): Result.004 file - promoters50/1015661
gtatatcctagcattt

SEQ ID NO: 155821 - DNA, 16 bp, Unknown
  misc_feature (1)..( 16): Result.004 file - promoters50/1015661
ttatcttaaaacaaca

SEQ ID NO: 155822 - DNA, 16 bp, Unknown
  misc_feature (1)..( 16): Result.004 file - promoters50/1015676
ctatatgattgtaatt

SEQ ID NO: 155823 - DNA, 8 bp, Unknown
  misc_feature (1)..( 8): Result.004 file - promoters50/1015676
ttttgaaa

SEQ ID NO: 155824 - DNA, 8 bp, Unknown
  misc_feature (1)..( 8): Result.004 file - promoters50/1015676
ttttcaaa

SEQ ID NO: 155825 - DNA, 8 bp, Unknown
  misc_feature (1)..( 8): Result.004 file - promoters50/1015676
ttttgatg

SEQ ID NO: 155826 - DNA, 7 bp, Unknown
  misc_feature (1)..( 7): Result.004 file - promoters50/1015676
tattttc

SEQ ID NO: 155827 - DNA, 7 bp, Unknown
  misc_feature (1)..( 7): Result.004 file - promoters50/1015676
tatttta

SEQ ID NO: 155828 - DNA, 7 bp, Unknown
  misc_feature (1)..( 7): Result.004 file - promoters50/1015676
tattttc

SEQ ID NO: 155829 - DNA, 13 bp, Unknown
  misc_feature (1)..( 13): Result.004 file - promoters50/1015676
attttatcaatgg

SEQ ID NO: 155830 - DNA, 13 bp, Unknown
  misc_feature (1)..( 13): Result.004 file - promoters50/1015676
attatattaacat

SEQ ID NO: 155831 - DNA, 13 bp, Unknown
  misc_feature (1)..( 13): Result.004 file - promoters50/1015676
tgtatatgaacat

SEQ ID NO: 155832 - DNA, 8 bp, Unknown
  misc_feature (1)..( 8): Result.004 file - promoters50/1015676
ttaaaaca

SEQ ID NO: 155833 - DNA, 8 bp, Unknown
  misc_feature (1)..( 8): Result.004 file - promoters50/1015676
ttacaact

SEQ ID NO: 155834 - DNA, 8 bp, Unknown
  misc_feature (1)..( 8): Result.004 file - promoters50/1015676
ttaaaaca

SEQ ID NO: 155835 - DNA, 8 bp, Unknown
  misc_feature (1)..( 8): Result.004 file - promoters50/1015676
gtttcaaa

SEQ ID NO: 155836 - DNA, 8 bp, Unknown
  misc_feature (1)..( 8): Result.004 file - promoters50/1015676
ttttcaaa

SEQ ID NO: 155837 - DNA, 8 bp, Unknown
  misc_feature (1)..( 8): Result.004 file - promoters50/1015700
gttgcaac

SEQ ID NO: 155838 - DNA, 9 bp, Unknown
  misc_feature (1)..( 9): Result.004 file - promoters50/1015700
atttcgatc

SEQ ID NO: 155839 - DNA, 9 bp, Unknown
  misc_feature (1)..( 9): Result.004 file - promoters50/1015700
atttcgctt

SEQ ID NO: 155840 - DNA, 9 bp, Unknown
  misc_feature (1)..( 9): Result.004 file - promoters50/1015700
attacgatc

SEQ ID NO: 155841 - DNA, 9 bp, Unknown
  misc_feature (1)..( 9): Result.004 file - promoters50/1015726
attttgatg

SEQ ID NO: 155842 - DNA, 8 bp, Unknown
  misc_feature (1)..( 8): Result.004 file - promoters50/1015726
caatttga

SEQ ID NO: 155843 - DNA, 8 bp, Unknown
  misc_feature (1)..( 8): Result.004 file - promoters50/1015726
gaatttga

SEQ ID NO: 155844 - DNA, 8 bp, Unknown
  misc_feature (1)..( 8): Result.004 file - promoters50/1015726
caattttt

SEQ ID NO: 155845 - DNA, 11 bp, Unknown
  misc_feature (1)..( 11): Result.004 file - promoters50/1015726
gataaaacaaa

SEQ ID NO: 155846 - DNA, 11 bp, Unknown
  misc_feature (1)..( 11): Result.004 file - promoters50/1015726
gagtaaaaaaa

SEQ ID NO: 155847 - DNA, 11 bp, Unknown
  misc_feature (1)..( 11): Result.004 file - promoters50/1015748
agtgaaaacga

SEQ ID NO: 155848 - DNA, 14 bp, Unknown
  misc_feature (1)..( 14): Result.004 file - promoters50/1015748
catttaagtgttag

SEQ ID NO: 155849 - DNA, 14 bp, Unknown
  misc_feature (1)..( 14): Result.004 file - promoters50/1015748
attttcagtgtata

SEQ ID NO: 155850 - DNA, 14 bp, Unknown
  misc_feature (1)..( 14): Result.004 file - promoters50/1015748
actttaagttttag

SEQ ID NO: 155851 - DNA, 14 bp, Unknown
  misc_feature (1)..( 14): Result.004 file - promoters50/1015748
attttcaatctata

SEQ ID NO: 155852 - DNA, 14 bp, Unknown
  misc_feature (1)..( 14): Result.004 file - promoters50/1015748
tctttaaattattt

SEQ ID NO: 155853 - DNA, 14 bp, Unknown
  misc_feature (1)..( 14): Result.004 file - promoters50/1015748
tttgtaaattcatt

SEQ ID NO: 155854 - DNA, 13 bp, Unknown
  misc_feature (1)..( 13): Result.004 file - promoters50/1015748
tggacaaaaacct

SEQ ID NO: 155855 - DNA, 13 bp, Unknown
  misc_feature (1)..( 13): Result.004 file - promoters50/1015748
tacttgaaagcct

SEQ ID NO: 155856 - DNA, 14 bp, Unknown
  misc_feature (1)..( 14): Result.004 file - promoters50/1015748
tttaacaaatacca

SEQ ID NO: 155857 - DNA, 14 bp, Unknown
  misc_feature (1)..( 14): Result.004 file - promoters50/1015748
acagaaaaaaactc

SEQ ID NO: 155858 - DNA, 14 bp, Unknown
  misc_feature (1)..( 14): Result.004 file - promoters50/1015748
atttaaaaaaaatg

SEQ ID NO: 155859 - DNA, 14 bp, Unknown
  misc_feature (1)..( 14): Result.004 file - promoters50/1015748
atttaatcgttaat

SEQ ID NO: 155860 - DNA, 14 bp, Unknown
  misc_feature (1)..( 14): Result.004 file - promoters50/1015752
attgaaaatattga

SEQ ID NO: 155861 - DNA, 7 bp, Unknown
  misc_feature (1)..( 7): Result.004 file - promoters50/1015752
gcaaaag

SEQ ID NO: 155862 - DNA, 7 bp, Unknown
  misc_feature (1)..( 7): Result.004 file - promoters50/1015752
acaaaag

SEQ ID NO: 155863 - DNA, 7 bp, Unknown
  misc_feature (1)..( 7): Result.004 file - promoters50/1015752
gcaaaag

SEQ ID NO: 155864 - DNA, 10 bp, Unknown
  misc_feature (1)..( 10): Result.004 file - promoters50/1015752
aataaatgat

SEQ ID NO: 155865 - DNA, 10 bp, Unknown
  misc_feature (1)..( 10): Result.004 file - promoters50/1015752
aataagtgat

SEQ ID NO: 155866 - DNA, 10 bp, Unknown
  misc_feature (1)..( 10): Result.004 file - promoters50/1015763
aataaaggaa

SEQ ID NO: 155867 - DNA, 9 bp, Unknown
  misc_feature (1)..( 9): Result.004 file - promoters50/1015763
ctaatgttt

SEQ ID NO: 155868 - DNA, 9 bp, Unknown
  misc_feature (1)..( 9): Result.004 file - promoters50/1015763
tgaatcttt

SEQ ID NO: 155869 - DNA, 9 bp, Unknown
  misc_feature (1)..( 9): Result.004 file - promoters50/1015844
ctattgtgt

SEQ ID NO: 155870 - DNA, 10 bp, Unknown
  misc_feature (1)..( 10): Result.004 file - promoters50/1015844
ttcgaaatca

SEQ ID NO: 155871 - DNA, 10 bp, Unknown
  misc_feature (1)..( 10): Result.004 file - promoters50/1015844
ttctaaatca

SEQ ID NO: 155872 - DNA, 10 bp, Unknown
  misc_feature (1)..( 10): Result.004 file - promoters50/1015901
cacgaaatcg

SEQ ID NO: 155873 - DNA, 9 bp, Unknown
  misc_feature (1)..( 9): Result.004 file - promoters50/1015901
tatttgtta

SEQ ID NO: 155874 - DNA, 9 bp, Unknown
  misc_feature (1)..( 9): Result.004 file - promoters50/1015901
gctttttta

SEQ ID NO: 155875 - DNA, 9 bp, Unknown
  misc_feature (1)..( 9): Result.004 file - promoters50/1015901
tattggttt

SEQ ID NO: 155876 - DNA, 9 bp, Unknown
  misc_feature (1)..( 9): Result.004 file - promoters50/1015901
actttttgt

SEQ ID NO: 155877 - DNA, 8 bp, Unknown
  misc_feature (1)..( 8): Result.004 file - promoters50/1015901
attagttg

SEQ ID NO: 155878 - DNA, 10 bp, Unknown
  misc_feature (1)..( 10): Result.004 file - promoters50/1015901
taagcataca

SEQ ID NO: 155879 - DNA, 10 bp, Unknown
  misc_feature (1)..( 10): Result.004 file - promoters50/1015901
taaacattta

SEQ ID NO: 155880 - DNA, 10 bp, Unknown
  misc_feature (1)..( 10): Result.004 file - promoters50/1015901
gaagcagaca

SEQ ID NO: 155881 - DNA, 10 bp, Unknown
  misc_feature (1)..( 10): Result.004 file - promoters50/1015901
taaacatttt

SEQ ID NO: 155882 - DNA, 13 bp, Unknown
  misc_feature (1)..( 13): Result.004 file - promoters50/1015901
acaaatttctcat

SEQ ID NO: 155883 - DNA, 13 bp, Unknown
  misc_feature (1)..( 13): Result.004 file - promoters50/1015901
ccaaatttatcat

SEQ ID NO: 155884 - DNA, 13 bp, Unknown
  misc_feature (1)..( 13): Result.004 file - promoters50/1015901
ccaactttcaaga

SEQ ID NO: 155885 - DNA, 13 bp, Unknown
  misc_feature (1)..( 13): Result.004 file - promoters50/1016056
gctaatatatcat

SEQ ID NO: 155886 - DNA, 11 bp, Unknown
  misc_feature (1)..( 11): Result.004 file - promoters50/1016056
aataaaattat

SEQ ID NO: 155887 - DNA, 11 bp, Unknown
  misc_feature (1)..( 11): Result.004 file - promoters50/1016056
aatgaaatatc

SEQ ID NO: 155888 - DNA, 11 bp, Unknown
  misc_feature (1)..( 11): Result.004 file - promoters50/1016056
aataaaataaa

SEQ ID NO: 155889 - DNA, 11 bp, Unknown
  misc_feature (1)..( 11): Result.004 file - promoters50/1016056
aataaaatctt

SEQ ID NO: 155890 - DNA, 11 bp, Unknown
  misc_feature (1)..( 11): Result.004 file - promoters50/1016056
aataaaaactt

SEQ ID NO: 155891 - DNA, 11 bp, Unknown
  misc_feature (1)..( 11): Result.004 file - promoters50/1016063
aataaaggggt

SEQ ID NO: 155892 - DNA, 6 bp, Unknown
  misc_feature (1)..( 6): Result.004 file - promoters50/1016063
aaatca

SEQ ID NO: 155893 - DNA, 6 bp, Unknown
  misc_feature (1)..( 6): Result.004 file - promoters50/1016063
aaatca

SEQ ID NO: 155894 - DNA, 6 bp, Unknown
  misc_feature (1)..( 6): Result.004 file - promoters50/1016066
aaatca

SEQ ID NO: 155895 - DNA, 6 bp, Unknown
  misc_feature (1)..( 6): Result.004 file - promoters50/1016066
acatgt

SEQ ID NO: 155896 - DNA, 6 bp, Unknown
  misc_feature (1)..( 6): Result.004 file - promoters50/1016066
acatgt

SEQ ID NO: 155897 - DNA, 6 bp, Unknown
  misc_feature (1)..( 6): Result.004 file - promoters50/1016066
acatgt

SEQ ID NO: 155898 - DNA, 9 bp, Unknown
  misc_feature (1)..( 9): Result.004 file - promoters50/1016066
aattactaa

SEQ ID NO: 155899 - DNA, 9 bp, Unknown
  misc_feature (1)..( 9): Result.004 file - promoters50/1016066
tattattaa

SEQ ID NO: 155900 - DNA, 9 bp, Unknown
  misc_feature (1)..( 9): Result.004 file - promoters50/1016066
tattattca

SEQ ID NO: 155901 - DNA, 14 bp, Unknown
  misc_feature (1)..( 14): Result.004 file - promoters50/1016066
aattacaaaatgaa

SEQ ID NO: 155902 - DNA, 14 bp, Unknown
  misc_feature (1)..( 14): Result.004 file - promoters50/1016066
aaatacaaaaaaaa

SEQ ID NO: 155903 - DNA, 14 bp, Unknown
  misc_feature (1)..( 14): Result.004 file - promoters50/1016066
caaaacaaaacaaa

SEQ ID NO: 155904 - DNA, 12 bp, Unknown
  misc_feature (1)..( 12): Result.004 file - promoters50/1016066
aaaaaagtgcaa

SEQ ID NO: 155905 - DNA, 12 bp, Unknown
  misc_feature (1)..( 12): Result.004 file - promoters50/1016066
aaaaaaaagaag

SEQ ID NO: 155906 - DNA, 13 bp, Unknown
  misc_feature (1)..( 13): Result.004 file - promoters50/1016094
aaaacaaaacaaa

SEQ ID NO: 155907 - DNA, 15 bp, Unknown
  misc_feature (1)..( 15): Result.004 file - promoters50/1016094
cacatgtgagagtaa

SEQ ID NO: 155908 - DNA, 15 bp, Unknown
  misc_feature (1)..( 15): Result.004 file - promoters50/1016094
cacttgtgtttgatt

SEQ ID NO: 155909 - DNA, 15 bp, Unknown
  misc_feature (1)..( 15): Result.004 file - promoters50/1016094
tgattgagttttatt

SEQ ID NO: 155910 - DNA, 15 bp, Unknown
  misc_feature (1)..( 15): Result.004 file - promoters50/1016094
taattgtatttattt

SEQ ID NO: 155911 - DNA, 9 bp, Unknown
  misc_feature (1)..( 9): Result.004 file - promoters50/1016094
gaaaaaaaa

SEQ ID NO: 155912 - DNA, 9 bp, Unknown
  misc_feature (1)..( 9): Result.004 file - promoters50/1016094
gaataaaaa

SEQ ID NO: 155913 - DNA, 9 bp, Unknown
  misc_feature (1)..( 9): Result.004 file - promoters50/1016094
gaaaaaaat

SEQ ID NO: 155914 - DNA, 9 bp, Unknown
  misc_feature (1)..( 9): Result.004 file - promoters50/1016133
taaaataat

SEQ ID NO: 155915 - DNA, 8 bp, Unknown
  misc_feature (1)..( 8): Result.004 file - promoters50/1016133
ataacatt

SEQ ID NO: 155916 - DNA, 8 bp, Unknown
  misc_feature (1)..( 8): Result.004 file - promoters50/1016133
ataccatt

SEQ ID NO: 155917 - DNA, 8 bp, Unknown
  misc_feature (1)..( 8): Result.004 file - promoters50/1016133
gtaacatt

SEQ ID NO: 155918 - DNA, 10 bp, Unknown
  misc_feature (1)..( 10): Result.004 file - promoters50/1016133
gtatatcaaa

SEQ ID NO: 155919 - DNA, 10 bp, Unknown
  misc_feature (1)..( 10): Result.004 file - promoters50/1016133
aaatattaaa

SEQ ID NO: 155920 - DNA, 10 bp, Unknown
  misc_feature (1)..( 10): Result.004 file - promoters50/1016133
gtatgtcagc

SEQ ID NO: 155921 - DNA, 12 bp, Unknown
  misc_feature (1)..( 12): Result.004 file - promoters50/1016133
catcgtttgtat

SEQ ID NO: 155922 - DNA, 12 bp, Unknown
  misc_feature (1)..( 12): Result.004 file - promoters50/1016133
tatctttttctt

SEQ ID NO: 155923 - DNA, 12 bp, Unknown
  misc_feature (1)..( 12): Result.004 file - promoters50/1016133
tatttttgtctt

SEQ ID NO: 155924 - DNA, 7 bp, Unknown
  misc_feature (1)..( 7): Result.004 file - promoters50/1016133
tatttta

SEQ ID NO: 155925 - DNA, 7 bp, Unknown
  misc_feature (1)..( 7): Result.004 file - promoters50/1016133
catttta

SEQ ID NO: 155926 - DNA, 7 bp, Unknown
  misc_feature (1)..( 7): Result.004 file - promoters50/1016133
tattttt

SEQ ID NO: 155927 - DNA, 10 bp, Unknown
  misc_feature (1)..( 10): Result.004 file - promoters50/1016133
aaaatattac

SEQ ID NO: 155928 - DNA, 10 bp, Unknown
  misc_feature (1)..( 10): Result.004 file - promoters50/1016133
ataattttat

SEQ ID NO: 155929 - DNA, 10 bp, Unknown
  misc_feature (1)..( 10): Result.004 file - promoters50/1016133
aaaatattac

SEQ ID NO: 155930 - DNA, 8 bp, Unknown
  misc_feature (1)..( 8): Result.004 file - promoters50/1016133
aaatatat

SEQ ID NO: 155931 - DNA, 7 bp, Unknown
  misc_feature (1)..( 7): Result.004 file - promoters50/1016133
tatatat

SEQ ID NO: 155932 - DNA, 8 bp, Unknown
  misc_feature (1)..( 8): Result.004 file - promoters50/1016165
aaagataa

SEQ ID NO: 155933 - DNA, 9 bp, Unknown
  misc_feature (1)..( 9): Result.004 file - promoters50/1016165
taatcactg

SEQ ID NO: 155934 - DNA, 9 bp, Unknown
  misc_feature (1)..( 9): Result.004 file - promoters50/1016165
taatcacat

SEQ ID NO: 155935 - DNA, 9 bp, Unknown
  misc_feature (1)..( 9): Result.004 file - promoters50/1016165
taatcaaat

SEQ ID NO: 155936 - DNA, 9 bp, Unknown
  misc_feature (1)..( 9): Result.004 file - promoters50/1016165
aaataaaaa

SEQ ID NO: 155937 - DNA, 9 bp, Unknown
  misc_feature (1)..( 9): Result.004 file - promoters50/1016165
atataaaac

SEQ ID NO: 155938 - DNA, 10 bp, Unknown
  misc_feature (1)..( 10): Result.004 file - promoters50/1016165
atatacaaaa

SEQ ID NO: 155939 - DNA, 13 bp, Unknown
  misc_feature (1)..( 13): Result.004 file - promoters50/1016165
taatcactgatga

SEQ ID NO: 155940 - DNA, 13 bp, Unknown
  misc_feature (1)..( 13): Result.004 file - promoters50/1016165
ggaacactaatgt

SEQ ID NO: 155941 - DNA, 13 bp, Unknown
  misc_feature (1)..( 13): Result.004 file - promoters50/1016165
agtttactaattt

SEQ ID NO: 155942 - DNA, 13 bp, Unknown
  misc_feature (1)..( 13): Result.004 file - promoters50/1016165
cccttaataattt

SEQ ID NO: 155943 - DNA, 13 bp, Unknown
  misc_feature (1)..( 13): Result.004 file - promoters50/1016165
aaaaaactaatca

SEQ ID NO: 155944 - DNA, 13 bp, Unknown
  misc_feature (1)..( 13): Result.004 file - promoters50/1016165
aaaaaacgaatgg

SEQ ID NO: 155945 - DNA, 13 bp, Unknown
  misc_feature (1)..( 13): Result.004 file - promoters50/1016176
cacttgataattg

SEQ ID NO: 155946 - DNA, 16 bp, Unknown
  misc_feature (1)..( 16): Result.004 file - promoters50/1016176
aagcagaaaaactgga

SEQ ID NO: 155947 - DNA, 16 bp, Unknown
  misc_feature (1)..( 16): Result.004 file - promoters50/1016176
caaagtcaaacctgaa

SEQ ID NO: 155948 - DNA, 16 bp, Unknown
  misc_feature (1)..( 16): Result.004 file - promoters50/1016176
caaaataaaaattggt

SEQ ID NO: 155949 - DNA, 16 bp, Unknown
  misc_feature (1)..( 16): Result.004 file - promoters50/1016176
aaaatccaaacccaag

SEQ ID NO: 155950 - DNA, 16 bp, Unknown
  misc_feature (1)..( 16): Result.004 file - promoters50/1016176
agcaggccaaccccaa

SEQ ID NO: 155951 - DNA, 16 bp, Unknown
  misc_feature (1)..( 16): Result.004 file - promoters50/1016176
agaaaaaaaagttgtc

SEQ ID NO: 155952 - DNA, 16 bp, Unknown
  misc_feature (1)..( 16): Result.004 file - promoters50/1016176
tcaaaaaaaaaagttt

SEQ ID NO: 155953 - DNA, 8 bp, Unknown
  misc_feature (1)..( 8): Result.004 file - promoters50/1016176
aagaaacc

SEQ ID NO: 155954 - DNA, 8 bp, Unknown
  misc_feature (1)..( 8): Result.004 file - promoters50/1016176
cagacacc

SEQ ID NO: 155955 - DNA, 8 bp, Unknown
  misc_feature (1)..( 8): Result.004 file - promoters50/1016176
aagaaaaa

SEQ ID NO: 155956 - DNA, 8 bp, Unknown
  misc_feature (1)..( 8): Result.004 file - promoters50/1016176
cagaaaag

SEQ ID NO: 155957 - DNA, 8 bp, Unknown
  misc_feature (1)..( 8): Result.004 file - promoters50/1016176
aacataca

SEQ ID NO: 155958 - DNA, 8 bp, Unknown
  misc_feature (1)..( 8): Result.004 file - promoters50/1016223
aacaaaca

SEQ ID NO: 155959 - DNA, 8 bp, Unknown
  misc_feature (1)..( 8): Result.004 file - promoters50/1016223
aaaacaac

SEQ ID NO: 155960 - DNA, 8 bp, Unknown
  misc_feature (1)..( 8): Result.004 file - promoters50/1016223
aaaaaaac

SEQ ID NO: 155961 - DNA, 8 bp, Unknown
  misc_feature (1)..( 8): Result.004 file - promoters50/1016226
aaaacaat

SEQ ID NO: 155962 - DNA, 13 bp, Unknown
  misc_feature (1)..( 13): Result.004 file - promoters50/1016226
agatccgaaaatt

SEQ ID NO: 155963 - DNA, 13 bp, Unknown
  misc_feature (1)..( 13): Result.004 file - promoters50/1016226
attaccgaaaatt

SEQ ID NO: 155964 - DNA, 13 bp, Unknown
  misc_feature (1)..( 13): Result.004 file - promoters50/1016226
agatcggaaagtc

SEQ ID NO: 155965 - DNA, 9 bp, Unknown
  misc_feature (1)..( 9): Result.004 file - promoters50/1016226
gcaatgtct

SEQ ID NO: 155966 - DNA, 9 bp, Unknown
  misc_feature (1)..( 9): Result.004 file - promoters50/1016226
agaatatct

SEQ ID NO: 155967 - DNA, 9 bp, Unknown
  misc_feature (1)..( 9): Result.004 file - promoters50/1016238
gcaacgtct

SEQ ID NO: 155968 - DNA, 10 bp, Unknown
  misc_feature (1)..( 10): Result.004 file - promoters50/1016238
gattattttt

SEQ ID NO: 155969 - DNA, 10 bp, Unknown
  misc_feature (1)..( 10): Result.004 file - promoters50/1016238
gatgatttga

SEQ ID NO: 155970 - DNA, 10 bp, Unknown
  misc_feature (1)..( 10): Result.004 file - promoters50/1016238
atatattttt

SEQ ID NO: 155971 - DNA, 10 bp, Unknown
  misc_feature (1)..( 10): Result.004 file - promoters50/1016238
agtgattttt

SEQ ID NO: 155972 - DNA, 8 bp, Unknown
  misc_feature (1)..( 8): Result.004 file - promoters50/1016238
ccaacttt

SEQ ID NO: 155973 - DNA, 8 bp, Unknown
  misc_feature (1)..( 8): Result.004 file - promoters50/1016238
tcaatttt

SEQ ID NO: 155974 - DNA, 8 bp, Unknown
  misc_feature (1)..( 8): Result.004 file - promoters50/1016238
tcaatttg

SEQ ID NO: 155975 - DNA, 8 bp, Unknown
  misc_feature (1)..( 8): Result.004 file - promoters50/1016246
ctaatttt

SEQ ID NO: 155976 - DNA, 13 bp, Unknown
  misc_feature (1)..( 13): Result.004 file - promoters50/1016246
gttgtcagagatc

SEQ ID NO: 155977 - DNA, 13 bp, Unknown
  misc_feature (1)..( 13): Result.004 file - promoters50/1016246
atctcaagagatt

SEQ ID NO: 155978 - DNA, 13 bp, Unknown
  misc_feature (1)..( 13): Result.004 file - promoters50/1016246
gttgacagagacg

SEQ ID NO: 155979 - DNA, 13 bp, Unknown
  misc_feature (1)..( 13): Result.004 file - promoters50/1016246
gaaggtggagatt

SEQ ID NO: 155980 - DNA, 10 bp, Unknown
  misc_feature (1)..( 10): Result.004 file - promoters50/1016246
gtgaaaaaag

SEQ ID NO: 155981 - DNA, 10 bp, Unknown
  misc_feature (1)..( 10): Result.004 file - promoters50/1016246
gtgagaaaga

SEQ ID NO: 155982 - DNA, 10 bp, Unknown
  misc_feature (1)..( 10): Result.004 file - promoters50/1016250
gagagcaaga

SEQ ID NO: 155983 - DNA, 12 bp, Unknown
  misc_feature (1)..( 12): Result.004 file - promoters50/1016250
acttttacataa

SEQ ID NO: 155984 - DNA, 12 bp, Unknown
  misc_feature (1)..( 12): Result.004 file - promoters50/1016250
aattttgcatag

SEQ ID NO: 155985 - DNA, 12 bp, Unknown
  misc_feature (1)..( 12): Result.004 file - promoters50/1016250
tgtagtacatat

SEQ ID NO: 155986 - DNA, 12 bp, Unknown
  misc_feature (1)..( 12): Result.004 file - promoters50/1016250
tattttgtgtgt

SEQ ID NO: 155987 - DNA, 12 bp, Unknown
  misc_feature (1)..( 12): Result.004 file - promoters50/1016250
aaagaaacatat

SEQ ID NO: 155988 - DNA, 12 bp, Unknown
  misc_feature (1)..( 12): Result.004 file - promoters50/1016250
tattttacgtac

SEQ ID NO: 155989 - DNA, 15 bp, Unknown
  misc_feature (1)..( 15): Result.004 file - promoters50/1016250
gtaattagaaaattt

SEQ ID NO: 155990 - DNA, 15 bp, Unknown
  misc_feature (1)..( 15): Result.004 file - promoters50/1016250
aacattaaaaaaatg

SEQ ID NO: 155991 - DNA, 15 bp, Unknown
  misc_feature (1)..( 15): Result.004 file - promoters50/1016250
ctttaaagaaaaaga

SEQ ID NO: 155992 - DNA, 15 bp, Unknown
  misc_feature (1)..( 15): Result.004 file - promoters50/1016250
aacagtaaaaccata

SEQ ID NO: 155993 - DNA, 15 bp, Unknown
  misc_feature (1)..( 15): Result.004 file - promoters50/1016250
aacatcaaacaataa

SEQ ID NO: 155994 - DNA, 15 bp, Unknown
  misc_feature (1)..( 15): Result.004 file - promoters50/1016250
atgattaaaacatta

SEQ ID NO: 155995 - DNA, 16 bp, Unknown
  misc_feature (1)..( 16): Result.004 file - promoters50/1016250
aacgaaaaataaataa

SEQ ID NO: 155996 - DNA, 16 bp, Unknown
  misc_feature (1)..( 16): Result.004 file - promoters50/1016250
cttcataaaatctata

SEQ ID NO: 155997 - DNA, 16 bp, Unknown
  misc_feature (1)..( 16): Result.004 file - promoters50/1016250
attcataaactctata

SEQ ID NO: 155998 - DNA, 17 bp, Unknown
  misc_feature (1)..( 17): Result.004 file - promoters50/1016250
tatcactaaactcttag

SEQ ID NO: 155999 - DNA, 16 bp, Unknown
  misc_feature (1)..( 16): Result.004 file - promoters50/1016250
tttcttaatataaacg

SEQ ID NO: 156000 - DNA, 16 bp, Unknown
  misc_feature (1)..( 16): Result.004 file - promoters50/1016250
tttcatatgtttccaa

SEQ ID NO: 156001 - DNA, 17 bp, Unknown
  misc_feature (1)..( 17): Result.004 file - promoters50/1016261
attgcttcgtagattgc

SEQ ID NO: 156002 - DNA, 14 bp, Unknown
  misc_feature (1)..( 14): Result.004 file - promoters50/1016261
atacaattataaat

SEQ ID NO: 156003 - DNA, 14 bp, Unknown
  misc_feature (1)..( 14): Result.004 file - promoters50/1016261
taataataataata

SEQ ID NO: 156004 - DNA, 16 bp, Unknown
  misc_feature (1)..( 16): Result.004 file - promoters50/1016261
tatcaataaatgaaaa

SEQ ID NO: 156005 - DNA, 7 bp, Unknown
  misc_feature (1)..( 7): Result.004 file - promoters50/1016261
aaaaaaa

SEQ ID NO: 156006 - DNA, 7 bp, Unknown
  misc_feature (1)..( 7): Result.004 file - promoters50/1016261
aaaaaaa

SEQ ID NO: 156007 - DNA, 7 bp, Unknown
  misc_feature (1)..( 7): Result.004 file - promoters50/1016261
aaacaaa

SEQ ID NO: 156008 - DNA, 8 bp, Unknown
  misc_feature (1)..( 8): Result.004 file - promoters50/1016261
tatataaa

SEQ ID NO: 156009 - DNA, 8 bp, Unknown
  misc_feature (1)..( 8): Result.004 file - promoters50/1016261
actataaa

SEQ ID NO: 156010 - DNA, 8 bp, Unknown
  misc_feature (1)..( 8): Result.004 file - promoters50/1016268
tatataac

SEQ ID NO: 156011 - DNA, 10 bp, Unknown
  misc_feature (1)..( 10): Result.004 file - promoters50/1016268
ggagtttaaa

SEQ ID NO: 156012 - DNA, 10 bp, Unknown
  misc_feature (1)..( 10): Result.004 file - promoters50/1016268
attgtttaag

SEQ ID NO: 156013 - DNA, 11 bp, Unknown
  misc_feature (1)..( 11): Result.004 file - promoters50/1016268
ggattttcaaa

SEQ ID NO: 156014 - DNA, 9 bp, Unknown
  misc_feature (1)..( 9): Result.004 file - promoters50/1016268
ttatattct

SEQ ID NO: 156015 - DNA, 9 bp, Unknown
  misc_feature (1)..( 9): Result.004 file - promoters50/1016268
ttaaattcg

SEQ ID NO: 156016 - DNA, 9 bp, Unknown
  misc_feature (1)..( 9): Result.004 file - promoters50/1016268
aaatagtct

SEQ ID NO: 156017 - DNA, 8 bp, Unknown
  misc_feature (1)..( 8): Result.004 file - promoters50/1016268
gaataaac

SEQ ID NO: 156018 - DNA, 8 bp, Unknown
  misc_feature (1)..( 8): Result.004 file - promoters50/1016268
aaataaaa

SEQ ID NO: 156019 - DNA, 8 bp, Unknown
  misc_feature (1)..( 8): Result.004 file - promoters50/1016268
gaattaac

SEQ ID NO: 156020 - DNA, 7 bp, Unknown
  misc_feature (1)..( 7): Result.004 file - promoters50/1016268
aatacaa

SEQ ID NO: 156021 - DNA, 7 bp, Unknown
  misc_feature (1)..( 7): Result.004 file - promoters50/1016268
tatacaa

SEQ ID NO: 156022 - DNA, 7 bp, Unknown
  misc_feature (1)..( 7): Result.004 file - promoters50/1016268
aatacag

SEQ ID NO: 156023 - DNA, 9 bp, Unknown
  misc_feature (1)..( 9): Result.004 file - promoters50/1016268
aagacaaaa

SEQ ID NO: 156024 - DNA, 9 bp, Unknown
  misc_feature (1)..( 9): Result.004 file - promoters50/1016268
aagataaac

SEQ ID NO: 156025 - DNA, 9 bp, Unknown
  misc_feature (1)..( 9): Result.004 file - promoters50/1016268
aaaacaaaa

SEQ ID NO: 156026 - DNA, 8 bp, Unknown
  misc_feature (1)..( 8): Result.004 file - promoters50/1016268
ctctcttc

SEQ ID NO: 156027 - DNA, 8 bp, Unknown
  misc_feature (1)..( 8): Result.004 file - promoters50/1016268
ttctcttc

SEQ ID NO: 156028 - DNA, 8 bp, Unknown
  misc_feature (1)..( 8): Result.004 file - promoters50/1016268
ctctctct

SEQ ID NO: 156029 - DNA, 10 bp, Unknown
  misc_feature (1)..( 10): Result.004 file - promoters50/1016268
ggaaatgcaa

SEQ ID NO: 156030 - DNA, 10 bp, Unknown
  misc_feature (1)..( 10): Result.004 file - promoters50/1016268
aaaaattcaa

SEQ ID NO: 156031 - DNA, 10 bp, Unknown
  misc_feature (1)..( 10): Result.004 file - promoters50/1016268
aaaaatttga

SEQ ID NO: 156032 - DNA, 9 bp, Unknown
  misc_feature (1)..( 9): Result.004 file - promoters50/1016268
ttaaaaata

SEQ ID NO: 156033 - DNA, 9 bp, Unknown
  misc_feature (1)..( 9): Result.004 file - promoters50/1016268
ttaataatc

SEQ ID NO: 156034 - DNA, 9 bp, Unknown
  misc_feature (1)..( 9): Result.004 file - promoters50/1016268
ggtataatc

SEQ ID NO: 156035 - DNA, 9 bp, Unknown
  misc_feature (1)..( 9): Result.004 file - promoters50/1016268
ttttaagaa

SEQ ID NO: 156036 - DNA, 9 bp, Unknown
  misc_feature (1)..( 9): Result.004 file - promoters50/1016268
ttttaggaa

SEQ ID NO: 156037 - DNA, 9 bp, Unknown
  misc_feature (1)..( 9): Result.004 file - promoters50/1016268
aattaggaa

SEQ ID NO: 156038 - DNA, 8 bp, Unknown
  misc_feature (1)..( 8): Result.004 file - promoters50/1016268
aaattatt

SEQ ID NO: 156039 - DNA, 8 bp, Unknown
  misc_feature (1)..( 8): Result.004 file - promoters50/1016268
aaaatata

SEQ ID NO: 156040 - DNA, 8 bp, Unknown
  misc_feature (1)..( 8): Result.004 file - promoters50/1016268
aaaatatt

SEQ ID NO: 156041 - DNA, 8 bp, Unknown
  misc_feature (1)..( 8): Result.004 file - promoters50/1016268
cgtttgat

SEQ ID NO: 156042 - DNA, 8 bp, Unknown
  misc_feature (1)..( 8): Result.004 file - promoters50/1016268
tgtttgat

SEQ ID NO: 156043 - DNA, 8 bp, Unknown
  misc_feature (1)..( 8): Result.004 file - promoters50/1016268
cgtatgat

SEQ ID NO: 156044 - DNA, 9 bp, Unknown
  misc_feature (1)..( 9): Result.004 file - promoters50/1016268
aaatatata

SEQ ID NO: 156045 - DNA, 9 bp, Unknown
  misc_feature (1)..( 9): Result.004 file - promoters50/1016268
aaacatata

SEQ ID NO: 156046 - DNA, 9 bp, Unknown
  misc_feature (1)..( 9): Result.004 file - promoters50/1016268
aaatatata

SEQ ID NO: 156047 - DNA, 9 bp, Unknown
  misc_feature (1)..( 9): Result.004 file - promoters50/1016268
aaataataa

SEQ ID NO: 156048 - DNA, 9 bp, Unknown
  misc_feature (1)..( 9): Result.004 file - promoters50/1016268
aaatcataa

SEQ ID NO: 156049 - DNA, 10 bp, Unknown
  misc_feature (1)..( 10): Result.004 file - promoters50/1016268
ccatacatac

SEQ ID NO: 156050 - DNA, 8 bp, Unknown
  misc_feature (1)..( 8): Result.004 file - promoters50/1016268
aatttttg

SEQ ID NO: 156051 - DNA, 8 bp, Unknown
  misc_feature (1)..( 8): Result.004 file - promoters50/1016268
cattattg

SEQ ID NO: 156052 - DNA, 8 bp, Unknown
  misc_feature (1)..( 8): Result.004 file - promoters50/1016268
tattatat

SEQ ID NO: 156053 - DNA, 8 bp, Unknown
  misc_feature (1)..( 8): Result.004 file - promoters50/1016268
ttttcttt

SEQ ID NO: 156054 - DNA, 8 bp, Unknown
  misc_feature (1)..( 8): Result.004 file - promoters50/1016268
tttccttg

SEQ ID NO: 156055 - DNA, 8 bp, Unknown
  misc_feature (1)..( 8): Result.004 file - promoters50/1016268
tctccttg

SEQ ID NO: 156056 - DNA, 8 bp, Unknown
  misc_feature (1)..( 8): Result.004 file - promoters50/1016268
tatcataa

SEQ ID NO: 156057 - DNA, 8 bp, Unknown
  misc_feature (1)..( 8): Result.004 file - promoters50/1016268
tataataa

SEQ ID NO: 156058 - DNA, 8 bp, Unknown
  misc_feature (1)..( 8): Result.004 file - promoters50/1016268
aatagtaa

SEQ ID NO: 156059 - DNA, 8 bp, Unknown
  misc_feature (1)..( 8): Result.004 file - promoters50/1016268
gaaatata

SEQ ID NO: 156060 - DNA, 8 bp, Unknown
  misc_feature (1)..( 8): Result.004 file - promoters50/1016268
taaatata

SEQ ID NO: 156061 - DNA, 9 bp, Unknown
  misc_feature (1)..( 9): Result.004 file - promoters50/1016278
aaacatata

SEQ ID NO: 156062 - DNA, 8 bp, Unknown
  misc_feature (1)..( 8): Result.004 file - promoters50/1016278
taattaag

SEQ ID NO: 156063 - DNA, 8 bp, Unknown
  misc_feature (1)..( 8): Result.004 file - promoters50/1016278
taattatt

SEQ ID NO: 156064 - DNA, 8 bp, Unknown
  misc_feature (1)..( 8): Result.004 file - promoters50/1016278
taattatc

SEQ ID NO: 156065 - DNA, 8 bp, Unknown
  misc_feature (1)..( 8): Result.004 file - promoters50/1016278
aaattatt

SEQ ID NO: 156066 - DNA, 10 bp, Unknown
  misc_feature (1)..( 10): Result.004 file - promoters50/1016278
gttactgatt

SEQ ID NO: 156067 - DNA, 10 bp, Unknown
  misc_feature (1)..( 10): Result.004 file - promoters50/1016278
tttattgatc

SEQ ID NO: 156068 - DNA, 10 bp, Unknown
  misc_feature (1)..( 10): Result.004 file - promoters50/1016278
attacttatt

SEQ ID NO: 156069 - DNA, 11 bp, Unknown
  misc_feature (1)..( 11): Result.004 file - promoters50/1016368
tttgattgaat

SEQ ID NO: 156070 - DNA, 8 bp, Unknown
  misc_feature (1)..( 8): Result.004 file - promoters50/1016368
gagaatgc

SEQ ID NO: 156071 - DNA, 8 bp, Unknown
  misc_feature (1)..( 8): Result.004 file - promoters50/1016368
gagaatcg

SEQ ID NO: 156072 - DNA, 8 bp, Unknown
  misc_feature (1)..( 8): Result.004 file - promoters50/1016368
aagactcg

SEQ ID NO: 156073 - DNA, 11 bp, Unknown
  misc_feature (1)..( 11): Result.004 file - promoters50/1016368
tcacaatttgt

SEQ ID NO: 156074 - DNA, 11 bp, Unknown
  misc_feature (1)..( 11): Result.004 file - promoters50/1016368
atgtaatatgt

SEQ ID NO: 156075 - DNA, 11 bp, Unknown
  misc_feature (1)..( 11): Result.004 file - promoters50/1016368
tcataatttgg

SEQ ID NO: 156076 - DNA, 12 bp, Unknown
  misc_feature (1)..( 12): Result.004 file - promoters50/1016368
aaataaaaaaca

SEQ ID NO: 156077 - DNA, 12 bp, Unknown
  misc_feature (1)..( 12): Result.004 file - promoters50/1016368
aaatagaaaaca

SEQ ID NO: 156078 - DNA, 12 bp, Unknown
  misc_feature (1)..( 12): Result.004 file - promoters50/1016368
caatcaaaatct

SEQ ID NO: 156079 - DNA, 10 bp, Unknown
  misc_feature (1)..( 10): Result.004 file - promoters50/1016368
ccaatataat

SEQ ID NO: 156080 - DNA, 10 bp, Unknown
  misc_feature (1)..( 10): Result.004 file - promoters50/1016368
actatataat

SEQ ID NO: 156081 - DNA, 10 bp, Unknown
  misc_feature (1)..( 10): Result.004 file - promoters50/1016382
actatatata

SEQ ID NO: 156082 - DNA, 11 bp, Unknown
  misc_feature (1)..( 11): Result.004 file - promoters50/1016382
ttttaatatat

SEQ ID NO: 156083 - DNA, 11 bp, Unknown
  misc_feature (1)..( 11): Result.004 file - promoters50/1016382
ttttaatctat

SEQ ID NO: 156084 - DNA, 11 bp, Unknown
  misc_feature (1)..( 11): Result.004 file - promoters50/1016418
atttcatatcc

SEQ ID NO: 156085 - DNA, 12 bp, Unknown
  misc_feature (1)..( 12): Result.004 file - promoters50/1016418
ataatttcaaat

SEQ ID NO: 156086 - DNA, 12 bp, Unknown
  misc_feature (1)..( 12): Result.004 file - promoters50/1016418
ttgtcatcaaat

SEQ ID NO: 156087 - DNA, 12 bp, Unknown
  misc_feature (1)..( 12): Result.004 file - promoters50/1016418
cataatttaaaa

SEQ ID NO: 156088 - DNA, 12 bp, Unknown
  misc_feature (1)..( 12): Result.004 file - promoters50/1016418
tttctttcaaaa

SEQ ID NO: 156089 - DNA, 12 bp, Unknown
  misc_feature (1)..( 12): Result.004 file - promoters50/1016418
catcattactta

SEQ ID NO: 156090 - DNA, 12 bp, Unknown
  misc_feature (1)..( 12): Result.004 file - promoters50/1016418
catctttcagac

SEQ ID NO: 156091 - DNA, 14 bp, Unknown
  misc_feature (1)..( 14): Result.004 file - promoters50/1016418
tcattaatcaattg

SEQ ID NO: 156092 - DNA, 14 bp, Unknown
  misc_feature (1)..( 14): Result.004 file - promoters50/1016418
taaaatatcaatat

SEQ ID NO: 156093 - DNA, 14 bp, Unknown
  misc_feature (1)..( 14): Result.004 file - promoters50/1016418
tcattagtcaaatt

SEQ ID NO: 156094 - DNA, 14 bp, Unknown
  misc_feature (1)..( 14): Result.004 file - promoters50/1016418
cattatataaatgt

SEQ ID NO: 156095 - DNA, 13 bp, Unknown
  misc_feature (1)..( 13): Result.004 file - promoters50/1016418
aaatagtaactgt

SEQ ID NO: 156096 - DNA, 13 bp, Unknown
  misc_feature (1)..( 13): Result.004 file - promoters50/1016418
attatttggattt

SEQ ID NO: 156097 - DNA, 13 bp, Unknown
  misc_feature (1)..( 13): Result.004 file - promoters50/1016418
aatatttgttgat

SEQ ID NO: 156098 - DNA, 13 bp, Unknown
  misc_feature (1)..( 13): Result.004 file - promoters50/1016418
tttatgtggaaaa

SEQ ID NO: 156099 - DNA, 13 bp, Unknown
  misc_feature (1)..( 13): Result.004 file - promoters50/1016418
attaattgttcac

SEQ ID NO: 156100 - DNA, 13 bp, Unknown
  misc_feature (1)..( 13): Result.004 file - promoters50/1016426
tatattttgattt

SEQ ID NO: 156101 - DNA, 9 bp, Unknown
  misc_feature (1)..( 9): Result.004 file - promoters50/1016426
gaaagttaa

SEQ ID NO: 156102 - DNA, 9 bp, Unknown
  misc_feature (1)..( 9): Result.004 file - promoters50/1016426
gaaggtttt

SEQ ID NO: 156103 - DNA, 9 bp, Unknown
  misc_feature (1)..( 9): Result.004 file - promoters50/1016426
caaaattaa

SEQ ID NO: 156104 - DNA, 6 bp, Unknown
  misc_feature (1)..( 6): Result.004 file - promoters50/1016426
aatttt

SEQ ID NO: 156105 - DNA, 6 bp, Unknown
  misc_feature (1)..( 6): Result.004 file - promoters50/1016426
aatttt

SEQ ID NO: 156106 - DNA, 6 bp, Unknown
  misc_feature (1)..( 6): Result.004 file - promoters50/1016426
aatttt

SEQ ID NO: 156107 - DNA, 8 bp, Unknown
  misc_feature (1)..( 8): Result.004 file - promoters50/1016426
tttaaatt

SEQ ID NO: 156108 - DNA, 8 bp, Unknown
  misc_feature (1)..( 8): Result.004 file - promoters50/1016426
tttcaatt

SEQ ID NO: 156109 - DNA, 8 bp, Unknown
  misc_feature (1)..( 8): Result.004 file - promoters50/1016426
tttaaacc

SEQ ID NO: 156110 - DNA, 11 bp, Unknown
  misc_feature (1)..( 11): Result.004 file - promoters50/1016426
ttatacctaaa

SEQ ID NO: 156111 - DNA, 11 bp, Unknown
  misc_feature (1)..( 11): Result.004 file - promoters50/1016426
cattccctaaa

SEQ ID NO: 156112 - DNA, 11 bp, Unknown
  misc_feature (1)..( 11): Result.004 file - promoters50/1016426
ttaaacctaat

SEQ ID NO: 156113 - DNA, 8 bp, Unknown
  misc_feature (1)..( 8): Result.004 file - promoters50/1016426
tatcttcc

SEQ ID NO: 156114 - DNA, 8 bp, Unknown
  misc_feature (1)..( 8): Result.004 file - promoters50/1016426
tttcttcc

SEQ ID NO: 156115 - DNA, 8 bp, Unknown
  misc_feature (1)..( 8): Result.004 file - promoters50/1016468
tttattct

SEQ ID NO: 156116 - DNA, 12 bp, Unknown
  misc_feature (1)..( 12): Result.004 file - promoters50/1016468
gttaatttttga

SEQ ID NO: 156117 - DNA, 12 bp, Unknown
  misc_feature (1)..( 12): Result.004 file - promoters50/1016468
ttgaattttttt

SEQ ID NO: 156118 - DNA, 12 bp, Unknown
  misc_feature (1)..( 12): Result.004 file - promoters50/1016468
tctaattttcta

SEQ ID NO: 156119 - DNA, 12 bp, Unknown
  misc_feature (1)..( 12): Result.004 file - promoters50/1016468
gttaactttgta

SEQ ID NO: 156120 - DNA, 12 bp, Unknown
  misc_feature (1)..( 12): Result.004 file - promoters50/1016468
cttgagtttagg

SEQ ID NO: 156121 - DNA, 12 bp, Unknown
  misc_feature (1)..( 12): Result.004 file - promoters50/1016468
tccaactttctt

SEQ ID NO: 156122 - DNA, 12 bp, Unknown
  misc_feature (1)..( 12): Result.004 file - promoters50/1016468
catcacttggta

SEQ ID NO: 156123 - DNA, 12 bp, Unknown
  misc_feature (1)..( 12): Result.004 file - promoters50/1016468
gaacaaaaccgt

SEQ ID NO: 156124 - DNA, 12 bp, Unknown
  misc_feature (1)..( 12): Result.004 file - promoters50/1016468
gaagaaaaaata

SEQ ID NO: 156125 - DNA, 12 bp, Unknown
  misc_feature (1)..( 12): Result.004 file - promoters50/1016468
aaacaaacgtgg

SEQ ID NO: 156126 - DNA, 12 bp, Unknown
  misc_feature (1)..( 12): Result.004 file - promoters50/1016468
aaacaaatgttt

SEQ ID NO: 156127 - DNA, 12 bp, Unknown
  misc_feature (1)..( 12): Result.004 file - promoters50/1016468
taagaaaatata

SEQ ID NO: 156128 - DNA, 13 bp, Unknown
  misc_feature (1)..( 13): Result.004 file - promoters50/1016468
tatgagaaatcat

SEQ ID NO: 156129 - DNA, 9 bp, Unknown
  misc_feature (1)..( 9): Result.004 file - promoters50/1016468
tggccaact

SEQ ID NO: 156130 - DNA, 9 bp, Unknown
  misc_feature (1)..( 9): Result.004 file - promoters50/1016468
tggtcaaaa

SEQ ID NO: 156131 - DNA, 10 bp, Unknown
  misc_feature (1)..( 10): Result.004 file - promoters50/1016468
gagtctaaag

SEQ ID NO: 156132 - DNA, 10 bp, Unknown
  misc_feature (1)..( 10): Result.004 file - promoters50/1016468
atgtcaaaaa

SEQ ID NO: 156133 - DNA, 10 bp, Unknown
  misc_feature (1)..( 10): Result.004 file - promoters50/1016468
aagtccaaaa

SEQ ID NO: 156134 - DNA, 10 bp, Unknown
  misc_feature (1)..( 10): Result.004 file - promoters50/1016514
tccgcaaaaa

SEQ ID NO: 156135 - DNA, 16 bp, Unknown
  misc_feature (1)..( 16): Result.004 file - promoters50/1016514
ataattcaaataatta

SEQ ID NO: 156136 - DNA, 16 bp, Unknown
  misc_feature (1)..( 16): Result.004 file - promoters50/1016514
ttttccgaaatagtta

SEQ ID NO: 156137 - DNA, 16 bp, Unknown
  misc_feature (1)..( 16): Result.004 file - promoters50/1016514
ttttctgaactagaag

SEQ ID NO: 156138 - DNA, 9 bp, Unknown
  misc_feature (1)..( 9): Result.004 file - promoters50/1016514
aaagaaaaa

SEQ ID NO: 156139 - DNA, 9 bp, Unknown
  misc_feature (1)..( 9): Result.004 file - promoters50/1016514
taagaaaat

SEQ ID NO: 156140 - DNA, 9 bp, Unknown
  misc_feature (1)..( 9): Result.004 file - promoters50/1016525
taacaaaat

SEQ ID NO: 156141 - DNA, 8 bp, Unknown
  misc_feature (1)..( 8): Result.004 file - promoters50/1016525
ctttttaa

SEQ ID NO: 156142 - DNA, 8 bp, Unknown
  misc_feature (1)..( 8): Result.004 file - promoters50/1016525
ttttgtaa

SEQ ID NO: 156143 - DNA, 8 bp, Unknown
  misc_feature (1)..( 8): Result.004 file - promoters50/1016525
cttattat

SEQ ID NO: 156144 - DNA, 7 bp, Unknown
  misc_feature (1)..( 7): Result.004 file - promoters50/1016525
attttaa

SEQ ID NO: 156145 - DNA, 8 bp, Unknown
  misc_feature (1)..( 8): Result.004 file - promoters50/1016525
caataaac

SEQ ID NO: 156146 - DNA, 8 bp, Unknown
  misc_feature (1)..( 8): Result.004 file - promoters50/1016525
taataaat

SEQ ID NO: 156147 - DNA, 8 bp, Unknown
  misc_feature (1)..( 8): Result.004 file - promoters50/1016525
atataaac

SEQ ID NO: 156148 - DNA, 8 bp, Unknown
  misc_feature (1)..( 8): Result.004 file - promoters50/1016525
caataatc

SEQ ID NO: 156149 - DNA, 11 bp, Unknown
  misc_feature (1)..( 11): Result.004 file - promoters50/1016525
agaaaaacagg

SEQ ID NO: 156150 - DNA, 11 bp, Unknown
  misc_feature (1)..( 11): Result.004 file - promoters50/1016525
ataaaaacttt

SEQ ID NO: 156151 - DNA, 11 bp, Unknown
  misc_feature (1)..( 11): Result.004 file - promoters50/1016525
tgaaaaattag

SEQ ID NO: 156152 - DNA, 11 bp, Unknown
  misc_feature (1)..( 11): Result.004 file - promoters50/1016525
atataaacttt

SEQ ID NO: 156153 - DNA, 9 bp, Unknown
  misc_feature (1)..( 9): Result.004 file - promoters50/1016525
caataaacc

SEQ ID NO: 156154 - DNA, 9 bp, Unknown
  misc_feature (1)..( 9): Result.004 file - promoters50/1016525
taataaaga

SEQ ID NO: 156155 - DNA, 9 bp, Unknown
  misc_feature (1)..( 9): Result.004 file - promoters50/1016525
caataatat

SEQ ID NO: 156156 - DNA, 9 bp, Unknown
  misc_feature (1)..( 9): Result.004 file - promoters50/1016525
caaaaaaaa

SEQ ID NO: 156157 - DNA, 9 bp, Unknown
  misc_feature (1)..( 9): Result.004 file - promoters50/1016525
agatattaa

SEQ ID NO: 156158 - DNA, 9 bp, Unknown
  misc_feature (1)..( 9): Result.004 file - promoters50/1016525
aagaaaaat

SEQ ID NO: 156159 - DNA, 9 bp, Unknown
  misc_feature (1)..( 9): Result.004 file - promoters50/1016525
cagaaaaaa

SEQ ID NO: 156160 - DNA, 9 bp, Unknown
  misc_feature (1)..( 9): Result.004 file - promoters50/1016525
caaaaaaaa

SEQ ID NO: 156161 - DNA, 9 bp, Unknown
  misc_feature (1)..( 9): Result.004 file - promoters50/1016525
tagaaaaaa

SEQ ID NO: 156162 - DNA, 8 bp, Unknown
  misc_feature (1)..( 8): Result.004 file - promoters50/1016525
ttttaaaa

SEQ ID NO: 156163 - DNA, 8 bp, Unknown
  misc_feature (1)..( 8): Result.004 file - promoters50/1016525
atttaaaa

SEQ ID NO: 156164 - DNA, 9 bp, Unknown
  misc_feature (1)..( 9): Result.004 file - promoters50/1016525
attctaacg

SEQ ID NO: 156165 - DNA, 9 bp, Unknown
  misc_feature (1)..( 9): Result.004 file - promoters50/1016525
attcaaaat

SEQ ID NO: 156166 - DNA, 14 bp, Unknown
  misc_feature (1)..( 14): Result.004 file - promoters50/1016525
ttttaaaaatatct

SEQ ID NO: 156167 - DNA, 14 bp, Unknown
  misc_feature (1)..( 14): Result.004 file - promoters50/1016525
aaaacaaattattt

SEQ ID NO: 156168 - DNA, 14 bp, Unknown
  misc_feature (1)..( 14): Result.004 file - promoters50/1016525
aatttatatttttt

SEQ ID NO: 156169 - DNA, 14 bp, Unknown
  misc_feature (1)..( 14): Result.004 file - promoters50/1016525
aaaaccaattgata

SEQ ID NO: 156170 - DNA, 9 bp, Unknown
  misc_feature (1)..( 9): Result.004 file - promoters50/1016525
aaataataa

SEQ ID NO: 156171 - DNA, 9 bp, Unknown
  misc_feature (1)..( 9): Result.004 file - promoters50/1016525
aaatgatat

SEQ ID NO: 156172 - DNA, 9 bp, Unknown
  misc_feature (1)..( 9): Result.004 file - promoters50/1016525
agatattaa

SEQ ID NO: 156173 - DNA, 9 bp, Unknown
  misc_feature (1)..( 9): Result.004 file - promoters50/1016624
caataatat

SEQ ID NO: 156174 - DNA, 9 bp, Unknown
  misc_feature (1)..( 9): Result.004 file - promoters50/1016624
attctgaat

SEQ ID NO: 156175 - DNA, 9 bp, Unknown
  misc_feature (1)..( 9): Result.004 file - promoters50/1016624
cttcttaat

SEQ ID NO: 156176 - DNA, 9 bp, Unknown
  misc_feature (1)..( 9): Result.004 file - promoters50/1016624
cttcttcaa

SEQ ID NO: 156177 - DNA, 9 bp, Unknown
  misc_feature (1)..( 9): Result.004 file - promoters50/1016643
gttcttctt

SEQ ID NO: 156178 - DNA, 8 bp, Unknown
  misc_feature (1)..( 8): Result.004 file - promoters50/1016643
atcagcta

SEQ ID NO: 156179 - DNA, 8 bp, Unknown
  misc_feature (1)..( 8): Result.004 file - promoters50/1016643
ttcatcta

SEQ ID NO: 156180 - DNA, 8 bp, Unknown
  misc_feature (1)..( 8): Result.004 file - promoters50/1016665
ttcatctg

SEQ ID NO: 156181 - DNA, 12 bp, Unknown
  misc_feature (1)..( 12): Result.004 file - promoters50/1016665
caaatttatcat

SEQ ID NO: 156182 - DNA, 12 bp, Unknown
  misc_feature (1)..( 12): Result.004 file - promoters50/1016665
ctaatatatcat

SEQ ID NO: 156183 - DNA, 12 bp, Unknown
  misc_feature (1)..( 12): Result.004 file - promoters50/1016665
agaatatatctc

SEQ ID NO: 156184 - DNA, 13 bp, Unknown
  misc_feature (1)..( 13): Result.004 file - promoters50/1016665
ccaactttcaaga

SEQ ID NO: 156185 - DNA, 13 bp, Unknown
  misc_feature (1)..( 13): Result.004 file - promoters50/1016692
cccaataactctt

SEQ ID NO: 156186 - DNA, 10 bp, Unknown
  misc_feature (1)..( 10): Result.004 file - promoters50/1016692
caaacttata

SEQ ID NO: 156187 - DNA, 10 bp, Unknown
  misc_feature (1)..( 10): Result.004 file - promoters50/1016692
gaaagttaga

SEQ ID NO: 156188 - DNA, 10 bp, Unknown
  misc_feature (1)..( 10): Result.004 file - promoters50/1016692
tggactaata

SEQ ID NO: 156189 - DNA, 10 bp, Unknown
  misc_feature (1)..( 10): Result.004 file - promoters50/1016692
gaaagtttcc

SEQ ID NO: 156190 - DNA, 10 bp, Unknown
  misc_feature (1)..( 10): Result.004 file - promoters50/1016692
aaaaattaaa

SEQ ID NO: 156191 - DNA, 10 bp, Unknown
  misc_feature (1)..( 10): Result.004 file - promoters50/1016692
gaaacaagtt

SEQ ID NO: 156192 - DNA, 10 bp, Unknown
  misc_feature (1)..( 10): Result.004 file - promoters50/1016692
aaaataagaa

SEQ ID NO: 156193 - DNA, 10 bp, Unknown
  misc_feature (1)..( 10): Result.004 file - promoters50/1016692
gacacatgtt

SEQ ID NO: 156194 - DNA, 10 bp, Unknown
  misc_feature (1)..( 10): Result.004 file - promoters50/1016692
ataattagat

SEQ ID NO: 156195 - DNA, 10 bp, Unknown
  misc_feature (1)..( 10): Result.004 file - promoters50/1016729
aaaatatcta

SEQ ID NO: 156196 - DNA, 6 bp, Unknown
  misc_feature (1)..( 6): Result.004 file - promoters50/1016729
ttcata

SEQ ID NO: 156197 - DNA, 6 bp, Unknown
  misc_feature (1)..( 6): Result.004 file - promoters50/1016729
ttcata

SEQ ID NO: 156198 - DNA, 6 bp, Unknown
  misc_feature (1)..( 6): Result.004 file - promoters50/1016729
ttcata

SEQ ID NO: 156199 - DNA, 7 bp, Unknown
  misc_feature (1)..( 7): Result.004 file - promoters50/1016729
agcaacg

SEQ ID NO: 156200 - DNA, 7 bp, Unknown
  misc_feature (1)..( 7): Result.004 file - promoters50/1016729
agcaaca

SEQ ID NO: 156201 - DNA, 7 bp, Unknown
  misc_feature (1)..( 7): Result.004 file - promoters50/1016729
agccaca

SEQ ID NO: 156202 - DNA, 9 bp, Unknown
  misc_feature (1)..( 9): Result.004 file - promoters50/1016729
atcaaaaat

SEQ ID NO: 156203 - DNA, 9 bp, Unknown
  misc_feature (1)..( 9): Result.004 file - promoters50/1016729
agcaacaat

SEQ ID NO: 156204 - DNA, 9 bp, Unknown
  misc_feature (1)..( 9): Result.004 file - promoters50/1016767
agccacacc

SEQ ID NO: 156205 - DNA, 12 bp, Unknown
  misc_feature (1)..( 12): Result.004 file - promoters50/1016767
taatacatttat

SEQ ID NO: 156206 - DNA, 12 bp, Unknown
  misc_feature (1)..( 12): Result.004 file - promoters50/1016767
taataaattttg

SEQ ID NO: 156207 - DNA, 12 bp, Unknown
  misc_feature (1)..( 12): Result.004 file - promoters50/1016767
tgatatatttaa

SEQ ID NO: 156208 - DNA, 12 bp, Unknown
  misc_feature (1)..( 12): Result.004 file - promoters50/1016767
aaataaaactcg

SEQ ID NO: 156209 - DNA, 12 bp, Unknown
  misc_feature (1)..( 12): Result.004 file - promoters50/1016767
tgttaagttttg

SEQ ID NO: 156210 - DNA, 10 bp, Unknown
  misc_feature (1)..( 10): Result.004 file - promoters50/1016767
taaaatttaa

SEQ ID NO: 156211 - DNA, 10 bp, Unknown
  misc_feature (1)..( 10): Result.004 file - promoters50/1016767
acaaatttct

SEQ ID NO: 156212 - DNA, 10 bp, Unknown
  misc_feature (1)..( 10): Result.004 file - promoters50/1016767
ccaaatttat

SEQ ID NO: 156213 - DNA, 10 bp, Unknown
  misc_feature (1)..( 10): Result.004 file - promoters50/1016767
tgtaatctct

SEQ ID NO: 156214 - DNA, 10 bp, Unknown
  misc_feature (1)..( 10): Result.004 file - promoters50/1016771
ccaactttca

SEQ ID NO: 156215 - DNA, 9 bp, Unknown
  misc_feature (1)..( 9): Result.004 file - promoters50/1016771
atttttcta

SEQ ID NO: 156216 - DNA, 9 bp, Unknown
  misc_feature (1)..( 9): Result.004 file - promoters50/1016771
attgttccc

SEQ ID NO: 156217 - DNA, 9 bp, Unknown
  misc_feature (1)..( 9): Result.004 file - promoters50/1016771
attttataa

SEQ ID NO: 156218 - DNA, 9 bp, Unknown
  misc_feature (1)..( 9): Result.004 file - promoters50/1016771
tttgttcca

SEQ ID NO: 156219 - DNA, 9 bp, Unknown
  misc_feature (1)..( 9): Result.004 file - promoters50/1016771
attgttagc

SEQ ID NO: 156220 - DNA, 10 bp, Unknown
  misc_feature (1)..( 10): Result.004 file - promoters50/1016771
ctttcttctt

SEQ ID NO: 156221 - DNA, 10 bp, Unknown
  misc_feature (1)..( 10): Result.004 file - promoters50/1016771
aatgttattt

SEQ ID NO: 156222 - DNA, 12 bp, Unknown
  misc_feature (1)..( 12): Result.004 file - promoters50/1016771
atctactttatt

SEQ ID NO: 156223 - DNA, 12 bp, Unknown
  misc_feature (1)..( 12): Result.004 file - promoters50/1016771
cacaaatttatt

SEQ ID NO: 156224 - DNA, 12 bp, Unknown
  misc_feature (1)..( 12): Result.004 file - promoters50/1016771
ctctattttatt

SEQ ID NO: 156225 - DNA, 12 bp, Unknown
  misc_feature (1)..( 12): Result.004 file - promoters50/1016771
ttcttctttatc

SEQ ID NO: 156226 - DNA, 12 bp, Unknown
  misc_feature (1)..( 12): Result.004 file - promoters50/1016771
gtgagttttttt

SEQ ID NO: 156227 - DNA, 12 bp, Unknown
  misc_feature (1)..( 12): Result.004 file - promoters50/1016814
ttctacttcaaa

SEQ ID NO: 156228 - DNA, 11 bp, Unknown
  misc_feature (1)..( 11): Result.004 file - promoters50/1016814
acaacttttac

SEQ ID NO: 156229 - DNA, 11 bp, Unknown
  misc_feature (1)..( 11): Result.004 file - promoters50/1016814
caaacatttga

SEQ ID NO: 156230 - DNA, 11 bp, Unknown
  misc_feature (1)..( 11): Result.004 file - promoters50/1016814
gtgtcttctac

SEQ ID NO: 156231 - DNA, 11 bp, Unknown
  misc_feature (1)..( 11): Result.004 file - promoters50/1016814
caaactttcat

SEQ ID NO: 156232 - DNA, 11 bp, Unknown
  misc_feature (1)..( 11): Result.004 file - promoters50/1016814
taaactttagt

SEQ ID NO: 156233 - DNA, 11 bp, Unknown
  misc_feature (1)..( 11): Result.004 file - promoters50/1016814
taaaaattatt

SEQ ID NO: 156234 - DNA, 11 bp, Unknown
  misc_feature (1)..( 11): Result.004 file - promoters50/1016814
aaaagtattag

SEQ ID NO: 156235 - DNA, 9 bp, Unknown
  misc_feature (1)..( 9): Result.004 file - promoters50/1016814
tattgtatg

SEQ ID NO: 156236 - DNA, 9 bp, Unknown
  misc_feature (1)..( 9): Result.004 file - promoters50/1016814
aattttatc

SEQ ID NO: 156237 - DNA, 9 bp, Unknown
  misc_feature (1)..( 9): Result.004 file - promoters50/1016814
cattttatt

SEQ ID NO: 156238 - DNA, 9 bp, Unknown
  misc_feature (1)..( 9): Result.004 file - promoters50/1016814
cattttggg

SEQ ID NO: 156239 - DNA, 9 bp, Unknown
  misc_feature (1)..( 9): Result.004 file - promoters50/1016814
aattttgtg

SEQ ID NO: 156240 - DNA, 9 bp, Unknown
  misc_feature (1)..( 9): Result.004 file - promoters50/1016854
tgtttcatt

SEQ ID NO: 156241 - DNA, 8 bp, Unknown
  misc_feature (1)..( 8): Result.004 file - promoters50/1016854
aatcttct

SEQ ID NO: 156242 - DNA, 8 bp, Unknown
  misc_feature (1)..( 8): Result.004 file - promoters50/1016854
aatcttat

SEQ ID NO: 156243 - DNA, 8 bp, Unknown
  misc_feature (1)..( 8): Result.004 file - promoters50/1016881
tatcatat

SEQ ID NO: 156244 - DNA, 11 bp, Unknown
  misc_feature (1)..( 11): Result.004 file - promoters50/1016881
ttgtaattaat

SEQ ID NO: 156245 - DNA, 11 bp, Unknown
  misc_feature (1)..( 11): Result.004 file - promoters50/1016881
tattaataaat

SEQ ID NO: 156246 - DNA, 11 bp, Unknown
  misc_feature (1)..( 11): Result.004 file - promoters50/1016881
ttgtaattata

SEQ ID NO: 156247 - DNA, 11 bp, Unknown
  misc_feature (1)..( 11): Result.004 file - promoters50/1016881
atgcaatcaat

SEQ ID NO: 156248 - DNA, 8 bp, Unknown
  misc_feature (1)..( 8): Result.004 file - promoters50/1016881
attcattt

SEQ ID NO: 156249 - DNA, 8 bp, Unknown
  misc_feature (1)..( 8): Result.004 file - promoters50/1016881
attcattt

SEQ ID NO: 156250 - DNA, 8 bp, Unknown
  misc_feature (1)..( 8): Result.004 file - promoters50/1016881
atttatta

SEQ ID NO: 156251 - DNA, 7 bp, Unknown
  misc_feature (1)..( 7): Result.004 file - promoters50/1016881
gtttata

SEQ ID NO: 156252 - DNA, 7 bp, Unknown
  misc_feature (1)..( 7): Result.004 file - promoters50/1016881
gtttatt

SEQ ID NO: 156253 - DNA, 7 bp, Unknown
  misc_feature (1)..( 7): Result.004 file - promoters50/1016881
gttcatt

SEQ ID NO: 156254 - DNA, 9 bp, Unknown
  misc_feature (1)..( 9): Result.004 file - promoters50/1016881
ttaactttt

SEQ ID NO: 156255 - DNA, 9 bp, Unknown
  misc_feature (1)..( 9): Result.004 file - promoters50/1016881
ttaactttt

SEQ ID NO: 156256 - DNA, 9 bp, Unknown
  misc_feature (1)..( 9): Result.004 file - promoters50/1016881
gtaagtttg

SEQ ID NO: 156257 - DNA, 9 bp, Unknown
  misc_feature (1)..( 9): Result.004 file - promoters50/1016881
attattata

SEQ ID NO: 156258 - DNA, 9 bp, Unknown
  misc_feature (1)..( 9): Result.004 file - promoters50/1016881
attaatatc

SEQ ID NO: 156259 - DNA, 9 bp, Unknown
  misc_feature (1)..( 9): Result.004 file - promoters50/1016881
tgtattata

SEQ ID NO: 156260 - DNA, 7 bp, Unknown
  misc_feature (1)..( 7): Result.004 file - promoters50/1016881
aacatcg

SEQ ID NO: 156261 - DNA, 7 bp, Unknown
  misc_feature (1)..( 7): Result.004 file - promoters50/1016881
aacatct

SEQ ID NO: 156262 - DNA, 7 bp, Unknown
  misc_feature (1)..( 7): Result.004 file - promoters50/1016915
cacatct

SEQ ID NO: 156263 - DNA, 11 bp, Unknown
  misc_feature (1)..( 11): Result.004 file - promoters50/1016915
caatcaaataa

SEQ ID NO: 156264 - DNA, 11 bp, Unknown
  misc_feature (1)..( 11): Result.004 file - promoters50/1016915
caattaaaaat

SEQ ID NO: 156265 - DNA, 11 bp, Unknown
  misc_feature (1)..( 11): Result.004 file - promoters50/1016915
aaataaaataa

SEQ ID NO: 156266 - DNA, 8 bp, Unknown
  misc_feature (1)..( 8): Result.004 file - promoters50/1016915
aaaataga

SEQ ID NO: 156267 - DNA, 8 bp, Unknown
  misc_feature (1)..( 8): Result.004 file - promoters50/1016915
aaaataag

SEQ ID NO: 156268 - DNA, 8 bp, Unknown
  misc_feature (1)..( 8): Result.004 file - promoters50/1016915
aaactaag

SEQ ID NO: 156269 - DNA, 8 bp, Unknown
  misc_feature (1)..( 8): Result.004 file - promoters50/1016915
gaatatat

SEQ ID NO: 156270 - DNA, 8 bp, Unknown
  misc_feature (1)..( 8): Result.004 file - promoters50/1016915
agatatat

SEQ ID NO: 156271 - DNA, 8 bp, Unknown
  misc_feature (1)..( 8): Result.004 file - promoters50/1016915
agagataa

SEQ ID NO: 156272 - DNA, 8 bp, Unknown
  misc_feature (1)..( 8): Result.004 file - promoters50/1016915
caaataat

SEQ ID NO: 156273 - DNA, 8 bp, Unknown
  misc_feature (1)..( 8): Result.004 file - promoters50/1016915
caaaaaat

SEQ ID NO: 156274 - DNA, 8 bp, Unknown
  misc_feature (1)..( 8): Result.004 file - promoters50/1016931
ttaaaaat

SEQ ID NO: 156275 - DNA, 7 bp, Unknown
  misc_feature (1)..( 7): Result.004 file - promoters50/1016931
taaacaa

SEQ ID NO: 156276 - DNA, 7 bp, Unknown
  misc_feature (1)..( 7): Result.004 file - promoters50/1016931
taaacac

SEQ ID NO: 156277 - DNA, 7 bp, Unknown
  misc_feature (1)..( 7): Result.004 file - promoters50/1016931
aaaacaa

SEQ ID NO: 156278 - DNA, 10 bp, Unknown
  misc_feature (1)..( 10): Result.004 file - promoters50/1016931
tttttagatc

SEQ ID NO: 156279 - DNA, 10 bp, Unknown
  misc_feature (1)..( 10): Result.004 file - promoters50/1016931
cagttagatc

SEQ ID NO: 156280 - DNA, 10 bp, Unknown
  misc_feature (1)..( 10): Result.004 file - promoters50/1016931
tttatagatt

SEQ ID NO: 156281 - DNA, 10 bp, Unknown
  misc_feature (1)..( 10): Result.004 file - promoters50/1016931
ccaataaatt

SEQ ID NO: 156282 - DNA, 9 bp, Unknown
  misc_feature (1)..( 9): Result.004 file - promoters50/1016931
agatcattt

SEQ ID NO: 156283 - DNA, 9 bp, Unknown
  misc_feature (1)..( 9): Result.004 file - promoters50/1016931
aaatctttt

SEQ ID NO: 156284 - DNA, 9 bp, Unknown
  misc_feature (1)..( 9): Result.004 file - promoters50/1016931
aaatgttta

SEQ ID NO: 156285 - DNA, 7 bp, Unknown
  misc_feature (1)..( 7): Result.004 file - promoters50/1016931
gatttat

SEQ ID NO: 156286 - DNA, 7 bp, Unknown
  misc_feature (1)..( 7): Result.004 file - promoters50/1016931
gatctat

SEQ ID NO: 156287 - DNA, 7 bp, Unknown
  misc_feature (1)..( 7): Result.004 file - promoters50/1016931
gatatat

SEQ ID NO: 156288 - DNA, 7 bp, Unknown
  misc_feature (1)..( 7): Result.004 file - promoters50/1016931
atatcta

SEQ ID NO: 156289 - DNA, 7 bp, Unknown
  misc_feature (1)..( 7): Result.004 file - promoters50/1016931
ttatcta

SEQ ID NO: 156290 - DNA, 7 bp, Unknown
  misc_feature (1)..( 7): Result.004 file - promoters50/1016931
atagcta

SEQ ID NO: 156291 - DNA, 10 bp, Unknown
  misc_feature (1)..( 10): Result.004 file - promoters50/1016931
attattgttt

SEQ ID NO: 156292 - DNA, 10 bp, Unknown
  misc_feature (1)..( 10): Result.004 file - promoters50/1016931
gttactgttt

SEQ ID NO: 156293 - DNA, 10 bp, Unknown
  misc_feature (1)..( 10): Result.004 file - promoters50/1016931
atttttgtgt

SEQ ID NO: 156294 - DNA, 6 bp, Unknown
  misc_feature (1)..( 6): Result.004 file - promoters50/1016931
ttatct

SEQ ID NO: 156295 - DNA, 6 bp, Unknown
  misc_feature (1)..( 6): Result.004 file - promoters50/1016931
ttatct

SEQ ID NO: 156296 - DNA, 6 bp, Unknown
  misc_feature (1)..( 6): Result.004 file - promoters50/1016931
ttatct

SEQ ID NO: 156297 - DNA, 7 bp, Unknown
  misc_feature (1)..( 7): Result.004 file - promoters50/1016931
tcaaaag

SEQ ID NO: 156298 - DNA, 7 bp, Unknown
  misc_feature (1)..( 7): Result.004 file - promoters50/1016931
acaaaag

SEQ ID NO: 156299 - DNA, 7 bp, Unknown
  misc_feature (1)..( 7): Result.004 file - promoters50/1016931
acaaaaa

SEQ ID NO: 156300 - DNA, 12 bp, Unknown
  misc_feature (1)..( 12): Result.004 file - promoters50/1016931
tgataaatcttt

SEQ ID NO: 156301 - DNA, 12 bp, Unknown
  misc_feature (1)..( 12): Result.004 file - promoters50/1016931
caataaattagg

SEQ ID NO: 156302 - DNA, 12 bp, Unknown
  misc_feature (1)..( 12): Result.004 file - promoters50/1016936
tgattaatattt

SEQ ID NO: 156303 - DNA, 8 bp, Unknown
  misc_feature (1)..( 8): Result.004 file - promoters50/1016936
gttttaaa

SEQ ID NO: 156304 - DNA, 8 bp, Unknown
  misc_feature (1)..( 8): Result.004 file - promoters50/1016936
gttttaat

SEQ ID NO: 156305 - DNA, 8 bp, Unknown
  misc_feature (1)..( 8): Result.004 file - promoters50/1016936
atttgaat

SEQ ID NO: 156306 - DNA, 9 bp, Unknown
  misc_feature (1)..( 9): Result.004 file - promoters50/1016936
taatttcta

SEQ ID NO: 156307 - DNA, 9 bp, Unknown
  misc_feature (1)..( 9): Result.004 file - promoters50/1016936
cattttcta

SEQ ID NO: 156308 - DNA, 9 bp, Unknown
  misc_feature (1)..( 9): Result.004 file - promoters50/1016936
catgttctt

SEQ ID NO: 156309 - DNA, 8 bp, Unknown
  misc_feature (1)..( 8): Result.004 file - promoters50/1016936
atatattt

SEQ ID NO: 156310 - DNA, 8 bp, Unknown
  misc_feature (1)..( 8): Result.004 file - promoters50/1016936
atatattt

SEQ ID NO: 156311 - DNA, 8 bp, Unknown
  misc_feature (1)..( 8): Result.004 file - promoters50/1016951
gtattttt

SEQ ID NO: 156312 - DNA, 7 bp, Unknown
  misc_feature (1)..( 7): Result.004 file - promoters50/1016951
tgatttt

SEQ ID NO: 156313 - DNA, 7 bp, Unknown
  misc_feature (1)..( 7): Result.004 file - promoters50/1016951
agatttt

SEQ ID NO: 156314 - DNA, 7 bp, Unknown
  misc_feature (1)..( 7): Result.004 file - promoters50/1016951
agatttc

SEQ ID NO: 156315 - DNA, 7 bp, Unknown
  misc_feature (1)..( 7): Result.004 file - promoters50/1016951
caaacac

SEQ ID NO: 156316 - DNA, 7 bp, Unknown
  misc_feature (1)..( 7): Result.004 file - promoters50/1016951
caaacag

SEQ ID NO: 156317 - DNA, 7 bp, Unknown
  misc_feature (1)..( 7): Result.004 file - promoters50/1016951
aaaacac

SEQ ID NO: 156318 - DNA, 7 bp, Unknown
  misc_feature (1)..( 7): Result.004 file - promoters50/1016951
ttaaata

SEQ ID NO: 156319 - DNA, 7 bp, Unknown
  misc_feature (1)..( 7): Result.004 file - promoters50/1016951
ttatata

SEQ ID NO: 156320 - DNA, 7 bp, Unknown
  misc_feature (1)..( 7): Result.004 file - promoters50/1016951
atacata

SEQ ID NO: 156321 - DNA, 7 bp, Unknown
  misc_feature (1)..( 7): Result.004 file - promoters50/1016951
atatatt

SEQ ID NO: 156322 - DNA, 7 bp, Unknown
  misc_feature (1)..( 7): Result.004 file - promoters50/1016951
atatatc

SEQ ID NO: 156323 - DNA, 7 bp, Unknown
  misc_feature (1)..( 7): Result.004 file - promoters50/1016951
atacata

SEQ ID NO: 156324 - DNA, 6 bp, Unknown
  misc_feature (1)..( 6): Result.004 file - promoters50/1016951
aatttt

SEQ ID NO: 156325 - DNA, 6 bp, Unknown
  misc_feature (1)..( 6): Result.004 file - promoters50/1016951
aatttt

SEQ ID NO: 156326 - DNA, 7 bp, Unknown
  misc_feature (1)..( 7): Result.004 file - promoters50/1016951
aatgttt

SEQ ID NO: 156327 - DNA, 7 bp, Unknown
  misc_feature (1)..( 7): Result.004 file - promoters50/1016951
aacgtaa

SEQ ID NO: 156328 - DNA, 7 bp, Unknown
  misc_feature (1)..( 7): Result.004 file - promoters50/1016951
aacttaa

SEQ ID NO: 156329 - DNA, 7 bp, Unknown
  misc_feature (1)..( 7): Result.004 file - promoters50/1016951
aacataa

SEQ ID NO: 156330 - DNA, 8 bp, Unknown
  misc_feature (1)..( 8): Result.004 file - promoters50/1016951
ttacctaa

SEQ ID NO: 156331 - DNA, 8 bp, Unknown
  misc_feature (1)..( 8): Result.004 file - promoters50/1016951
atacataa

SEQ ID NO: 156332 - DNA, 8 bp, Unknown
  misc_feature (1)..( 8): Result.004 file - promoters50/1017020
atatatat

SEQ ID NO: 156333 - DNA, 14 bp, Unknown
  misc_feature (1)..( 14): Result.004 file - promoters50/1017020
tccagaaaaagttc

SEQ ID NO: 156334 - DNA, 14 bp, Unknown
  misc_feature (1)..( 14): Result.004 file - promoters50/1017020
ttgattcaaaattc

SEQ ID NO: 156335 - DNA, 14 bp, Unknown
  misc_feature (1)..( 14): Result.004 file - promoters50/1017020
ttgaatcaatattt

SEQ ID NO: 156336 - DNA, 15 bp, Unknown
  misc_feature (1)..( 15): Result.004 file - promoters50/1017020
agcagcctatacttt

SEQ ID NO: 156337 - DNA, 8 bp, Unknown
  misc_feature (1)..( 8): Result.004 file - promoters50/1017020
ttaatatg

SEQ ID NO: 156338 - DNA, 8 bp, Unknown
  misc_feature (1)..( 8): Result.004 file - promoters50/1017020
ttaatagc

SEQ ID NO: 156339 - DNA, 8 bp, Unknown
  misc_feature (1)..( 8): Result.004 file - promoters50/1017020
gtaatagc

SEQ ID NO: 156340 - DNA, 9 bp, Unknown
  misc_feature (1)..( 9): Result.004 file - promoters50/1017020
aaaacattt

SEQ ID NO: 156341 - DNA, 9 bp, Unknown
  misc_feature (1)..( 9): Result.004 file - promoters50/1017020
aaaagattt

SEQ ID NO: 156342 - DNA, 9 bp, Unknown
  misc_feature (1)..( 9): Result.004 file - promoters50/1017020
gaaagacaa

SEQ ID NO: 156343 - DNA, 9 bp, Unknown
  misc_feature (1)..( 9): Result.004 file - promoters50/1017020
ataagattg

SEQ ID NO: 156344 - DNA, 10 bp, Unknown
  misc_feature (1)..( 10): Result.004 file - promoters50/1017020
ctatgctttg

SEQ ID NO: 156345 - DNA, 10 bp, Unknown
  misc_feature (1)..( 10): Result.004 file - promoters50/1017020
ctatactttg

SEQ ID NO: 156346 - DNA, 10 bp, Unknown
  misc_feature (1)..( 10): Result.004 file - promoters50/1017041
caatatttta

SEQ ID NO: 156347 - DNA, 7 bp, Unknown
  misc_feature (1)..( 7): Result.004 file - promoters50/1017041
aagtttc

SEQ ID NO: 156348 - DNA, 7 bp, Unknown
  misc_feature (1)..( 7): Result.004 file - promoters50/1017041
gagtttc

SEQ ID NO: 156349 - DNA, 7 bp, Unknown
  misc_feature (1)..( 7): Result.004 file - promoters50/1017046
caatttt

SEQ ID NO: 156350 - DNA, 8 bp, Unknown
  misc_feature (1)..( 8): Result.004 file - promoters50/1017046
taatattt

SEQ ID NO: 156351 - DNA, 8 bp, Unknown
  misc_feature (1)..( 8): Result.004 file - promoters50/1017046
caattttt

SEQ ID NO: 156352 - DNA, 8 bp, Unknown
  misc_feature (1)..( 8): Result.004 file - promoters50/1017046
taatattt

SEQ ID NO: 156353 - DNA, 8 bp, Unknown
  misc_feature (1)..( 8): Result.004 file - promoters50/1017046
aatacttt

SEQ ID NO: 156354 - DNA, 8 bp, Unknown
  misc_feature (1)..( 8): Result.004 file - promoters50/1017046
attacttt

SEQ ID NO: 156355 - DNA, 8 bp, Unknown
  misc_feature (1)..( 8): Result.004 file - promoters50/1017046
aatatttt

SEQ ID NO: 156356 - DNA, 9 bp, Unknown
  misc_feature (1)..( 9): Result.004 file - promoters50/1017046
cctttttac

SEQ ID NO: 156357 - DNA, 9 bp, Unknown
  misc_feature (1)..( 9): Result.004 file - promoters50/1017046
gttttctac

SEQ ID NO: 156358 - DNA, 9 bp, Unknown
  misc_feature (1)..( 9): Result.004 file - promoters50/1017046
cctttttct

SEQ ID NO: 156359 - DNA, 8 bp, Unknown
  misc_feature (1)..( 8): Result.004 file - promoters50/1017046
taaattgg

SEQ ID NO: 156360 - DNA, 8 bp, Unknown
  misc_feature (1)..( 8): Result.004 file - promoters50/1017046
taaatttc

SEQ ID NO: 156361 - DNA, 8 bp, Unknown
  misc_feature (1)..( 8): Result.004 file - promoters50/1017046
taactttc

SEQ ID NO: 156362 - DNA, 14 bp, Unknown
  misc_feature (1)..( 14): Result.004 file - promoters50/1017046
atttccgtttcttt

SEQ ID NO: 156363 - DNA, 14 bp, Unknown
  misc_feature (1)..( 14): Result.004 file - promoters50/1017046
ttaataatttattt

SEQ ID NO: 156364 - DNA, 14 bp, Unknown
  misc_feature (1)..( 14): Result.004 file - promoters50/1017046
ttaacaattttttt

SEQ ID NO: 156365 - DNA, 10 bp, Unknown
  misc_feature (1)..( 10): Result.004 file - promoters50/1017046
tcgggatgga

SEQ ID NO: 156366 - DNA, 10 bp, Unknown
  misc_feature (1)..( 10): Result.004 file - promoters50/1017046
atgggttgga

SEQ ID NO: 156367 - DNA, 10 bp, Unknown
  misc_feature (1)..( 10): Result.004 file - promoters50/1017050
atggcttgca

SEQ ID NO: 156368 - DNA, 12 bp, Unknown
  misc_feature (1)..( 12): Result.004 file - promoters50/1017050
atgattatatga

SEQ ID NO: 156369 - DNA, 12 bp, Unknown
  misc_feature (1)..( 12): Result.004 file - promoters50/1017050
ttgattacatga

SEQ ID NO: 156370 - DNA, 12 bp, Unknown
  misc_feature (1)..( 12): Result.004 file - promoters50/1017050
atgtttacttct

SEQ ID NO: 156371 - DNA, 12 bp, Unknown
  misc_feature (1)..( 12): Result.004 file - promoters50/1017050
acgatgatacag

SEQ ID NO: 156372 - DNA, 12 bp, Unknown
  misc_feature (1)..( 12): Result.004 file - promoters50/1017050
ttgatttagggt

SEQ ID NO: 156373 - DNA, 12 bp, Unknown
  misc_feature (1)..( 12): Result.004 file - promoters50/1017050
ttgagtaccgcg

SEQ ID NO: 156374 - DNA, 12 bp, Unknown
  misc_feature (1)..( 12): Result.004 file - promoters50/1017050
gagattgatata

SEQ ID NO: 156375 - DNA, 12 bp, Unknown
  misc_feature (1)..( 12): Result.004 file - promoters50/1017050
tggcttgatatg

SEQ ID NO: 156376 - DNA, 12 bp, Unknown
  misc_feature (1)..( 12): Result.004 file - promoters50/1017050
aagattgatgaa

SEQ ID NO: 156377 - DNA, 12 bp, Unknown
  misc_feature (1)..( 12): Result.004 file - promoters50/1017050
ttttttgaaatg

SEQ ID NO: 156378 - DNA, 12 bp, Unknown
  misc_feature (1)..( 12): Result.004 file - promoters50/1017050
tagattggatac

SEQ ID NO: 156379 - DNA, 12 bp, Unknown
  misc_feature (1)..( 12): Result.004 file - promoters50/1017050
tagattaaaaaa

SEQ ID NO: 156380 - DNA, 12 bp, Unknown
  misc_feature (1)..( 12): Result.004 file - promoters50/1017109
gagagtgaaaac

SEQ ID NO: 156381 - DNA, 10 bp, Unknown
  misc_feature (1)..( 10): Result.004 file - promoters50/1017109
catttttctt

SEQ ID NO: 156382 - DNA, 10 bp, Unknown
  misc_feature (1)..( 10): Result.004 file - promoters50/1017109
ttatttactt

SEQ ID NO: 156383 - DNA, 10 bp, Unknown
  misc_feature (1)..( 10): Result.004 file - promoters50/1017113
ttaattacta

SEQ ID NO: 156384 - DNA, 11 bp, Unknown
  misc_feature (1)..( 11): Result.004 file - promoters50/1017113
taaaatgaaaa

SEQ ID NO: 156385 - DNA, 11 bp, Unknown
  misc_feature (1)..( 11): Result.004 file - promoters50/1017113
caaaaggaaaa

SEQ ID NO: 156386 - DNA, 11 bp, Unknown
  misc_feature (1)..( 11): Result.004 file - promoters50/1017113
taaaatattat

SEQ ID NO: 156387 - DNA, 9 bp, Unknown
  misc_feature (1)..( 9): Result.004 file - promoters50/1017113
tcaaaatac

SEQ ID NO: 156388 - DNA, 9 bp, Unknown
  misc_feature (1)..( 9): Result.004 file - promoters50/1017113
tcagaataa

SEQ ID NO: 156389 - DNA, 9 bp, Unknown
  misc_feature (1)..( 9): Result.004 file - promoters50/1017113
agaaaatat

SEQ ID NO: 156390 - DNA, 9 bp, Unknown
  misc_feature (1)..( 9): Result.004 file - promoters50/1017113
tataaatac

SEQ ID NO: 156391 - DNA, 9 bp, Unknown
  misc_feature (1)..( 9): Result.004 file - promoters50/1017113
ttttatgtt

SEQ ID NO: 156392 - DNA, 9 bp, Unknown
  misc_feature (1)..( 9): Result.004 file - promoters50/1017113
ttttctgtt

SEQ ID NO: 156393 - DNA, 9 bp, Unknown
  misc_feature (1)..( 9): Result.004 file - promoters50/1017113
gattaagtt

SEQ ID NO: 156394 - DNA, 14 bp, Unknown
  misc_feature (1)..( 14): Result.004 file - promoters50/1017113
ttaaggccgtttgt

SEQ ID NO: 156395 - DNA, 14 bp, Unknown
  misc_feature (1)..( 14): Result.004 file - promoters50/1017113
ttaaggggcaaata

SEQ ID NO: 156396 - DNA, 14 bp, Unknown
  misc_feature (1)..( 14): Result.004 file - promoters50/1017113
ctaagcccgtgtgt

SEQ ID NO: 156397 - DNA, 12 bp, Unknown
  misc_feature (1)..( 12): Result.004 file - promoters50/1017113
gaaaaaaaatat

SEQ ID NO: 156398 - DNA, 12 bp, Unknown
  misc_feature (1)..( 12): Result.004 file - promoters50/1017113
gaaagaaaatat

SEQ ID NO: 156399 - DNA, 12 bp, Unknown
  misc_feature (1)..( 12): Result.004 file - promoters50/1017113
acaagaaacgct

SEQ ID NO: 156400 - DNA, 10 bp, Unknown
  misc_feature (1)..( 10): Result.004 file - promoters50/1017113
atttggtttt

SEQ ID NO: 156401 - DNA, 10 bp, Unknown
  misc_feature (1)..( 10): Result.004 file - promoters50/1017113
attttgtttt

SEQ ID NO: 156402 - DNA, 10 bp, Unknown
  misc_feature (1)..( 10): Result.004 file - promoters50/1017113
cttttattta

SEQ ID NO: 156403 - DNA, 11 bp, Unknown
  misc_feature (1)..( 11): Result.004 file - promoters50/1017113
aatataagata

SEQ ID NO: 156404 - DNA, 11 bp, Unknown
  misc_feature (1)..( 11): Result.004 file - promoters50/1017113
aatatgagata

SEQ ID NO: 156405 - DNA, 11 bp, Unknown
  misc_feature (1)..( 11): Result.004 file - promoters50/1017113
gttacaaaata

SEQ ID NO: 156406 - DNA, 8 bp, Unknown
  misc_feature (1)..( 8): Result.004 file - promoters50/1017113
ttttattt

SEQ ID NO: 156407 - DNA, 8 bp, Unknown
  misc_feature (1)..( 8): Result.004 file - promoters50/1017113
ttttattt

SEQ ID NO: 156408 - DNA, 8 bp, Unknown
  misc_feature (1)..( 8): Result.004 file - promoters50/1017131
ttttgttt

SEQ ID NO: 156409 - DNA, 10 bp, Unknown
  misc_feature (1)..( 10): Result.004 file - promoters50/1017131
attaataaaa

SEQ ID NO: 156410 - DNA, 10 bp, Unknown
  misc_feature (1)..( 10): Result.004 file - promoters50/1017131
attaatattt

SEQ ID NO: 156411 - DNA, 10 bp, Unknown
  misc_feature (1)..( 10): Result.004 file - promoters50/1017131
attaataaag

SEQ ID NO: 156412 - DNA, 10 bp, Unknown
  misc_feature (1)..( 10): Result.004 file - promoters50/1017131
actaaaaaaa

SEQ ID NO: 156413 - DNA, 10 bp, Unknown
  misc_feature (1)..( 10): Result.004 file - promoters50/1017131
tttagtatat

SEQ ID NO: 156414 - DNA, 10 bp, Unknown
  misc_feature (1)..( 10): Result.004 file - promoters50/1017131
ttgagtctat

SEQ ID NO: 156415 - DNA, 13 bp, Unknown
  misc_feature (1)..( 13): Result.004 file - promoters50/1017131
gaaaagtaaaacc

SEQ ID NO: 156416 - DNA, 13 bp, Unknown
  misc_feature (1)..( 13): Result.004 file - promoters50/1017131
tttggataaaacg

SEQ ID NO: 156417 - DNA, 13 bp, Unknown
  misc_feature (1)..( 13): Result.004 file - promoters50/1017131
tttgaataaaagc

SEQ ID NO: 156418 - DNA, 13 bp, Unknown
  misc_feature (1)..( 13): Result.004 file - promoters50/1017131
aagggataaaaga

SEQ ID NO: 156419 - DNA, 13 bp, Unknown
  misc_feature (1)..( 13): Result.004 file - promoters50/1017131
cttggatataatg

SEQ ID NO: 156420 - DNA, 13 bp, Unknown
  misc_feature (1)..( 13): Result.004 file - promoters50/1017131
aatagagaaaacg

SEQ ID NO: 156421 - DNA, 13 bp, Unknown
  misc_feature (1)..( 13): Result.004 file - promoters50/1017131
agtcaagaaaaga

SEQ ID NO: 156422 - DNA, 10 bp, Unknown
  misc_feature (1)..( 10): Result.004 file - promoters50/1017131
gtaaaccaag

SEQ ID NO: 156423 - DNA, 10 bp, Unknown
  misc_feature (1)..( 10): Result.004 file - promoters50/1017131
agaaacaaag

SEQ ID NO: 156424 - DNA, 10 bp, Unknown
  misc_feature (1)..( 10): Result.004 file - promoters50/1017131
gggaaccaaa

SEQ ID NO: 156425 - DNA, 10 bp, Unknown
  misc_feature (1)..( 10): Result.004 file - promoters50/1017131
acaaaaaaag

SEQ ID NO: 156426 - DNA, 10 bp, Unknown
  misc_feature (1)..( 10): Result.004 file - promoters50/1017131
ccaaaaacag

SEQ ID NO: 156427 - DNA, 10 bp, Unknown
  misc_feature (1)..( 10): Result.004 file - promoters50/1017131
taaaataaat

SEQ ID NO: 156428 - DNA, 10 bp, Unknown
  misc_feature (1)..( 10): Result.004 file - promoters50/1017189
ccaaaaataa

SEQ ID NO: 156429 - DNA, 9 bp, Unknown
  misc_feature (1)..( 9): Result.004 file - promoters50/1017189
aagattgat

SEQ ID NO: 156430 - DNA, 9 bp, Unknown
  misc_feature (1)..( 9): Result.004 file - promoters50/1017189
aaggttgga

SEQ ID NO: 156431 - DNA, 9 bp, Unknown
  misc_feature (1)..( 9): Result.004 file - promoters50/1017189
ctgatggat

SEQ ID NO: 156432 - DNA, 6 bp, Unknown
  misc_feature (1)..( 6): Result.004 file - promoters50/1017189
ttttgt

SEQ ID NO: 156433 - DNA, 6 bp, Unknown
  misc_feature (1)..( 6): Result.004 file - promoters50/1017189
ttttgt

SEQ ID NO: 156434 - DNA, 6 bp, Unknown
  misc_feature (1)..( 6): Result.004 file - promoters50/1017189
ttttgt

SEQ ID NO: 156435 - DNA, 9 bp, Unknown
  misc_feature (1)..( 9): Result.004 file - promoters50/1017189
atgttatgt

SEQ ID NO: 156436 - DNA, 9 bp, Unknown
  misc_feature (1)..( 9): Result.004 file - promoters50/1017189
atgatataa

SEQ ID NO: 156437 - DNA, 9 bp, Unknown
  misc_feature (1)..( 9): Result.004 file - promoters50/1017189
ctgttctgt

SEQ ID NO: 156438 - DNA, 9 bp, Unknown
  misc_feature (1)..( 9): Result.004 file - promoters50/1017189
ctttctttt

SEQ ID NO: 156439 - DNA, 9 bp, Unknown
  misc_feature (1)..( 9): Result.004 file - promoters50/1017189
ttttgtttt

SEQ ID NO: 156440 - DNA, 9 bp, Unknown
  misc_feature (1)..( 9): Result.004 file - promoters50/1017282
ttttgtgga

SEQ ID NO: 156441 - DNA, 9 bp, Unknown
  misc_feature (1)..( 9): Result.004 file - promoters50/1017282
tctaacaac

SEQ ID NO: 156442 - DNA, 9 bp, Unknown
  misc_feature (1)..( 9): Result.004 file - promoters50/1017282
tctaactat

SEQ ID NO: 156443 - DNA, 9 bp, Unknown
  misc_feature (1)..( 9): Result.004 file - promoters50/1017282
gctaacaac

SEQ ID NO: 156444 - DNA, 9 bp, Unknown
  misc_feature (1)..( 9): Result.004 file - promoters50/1017282
tctaactcc

SEQ ID NO: 156445 - DNA, 9 bp, Unknown
  misc_feature (1)..( 9): Result.004 file - promoters50/1017282
aataacaaa

SEQ ID NO: 156446 - DNA, 9 bp, Unknown
  misc_feature (1)..( 9): Result.004 file - promoters50/1017286
tcttactac

SEQ ID NO: 156447 - DNA, 10 bp, Unknown
  misc_feature (1)..( 10): Result.004 file - promoters50/1017286
taatatgcaa

SEQ ID NO: 156448 - DNA, 10 bp, Unknown
  misc_feature (1)..( 10): Result.004 file - promoters50/1017286
caatatgtgc

SEQ ID NO: 156449 - DNA, 10 bp, Unknown
  misc_feature (1)..( 10): Result.004 file - promoters50/1017286
atatatgttt

SEQ ID NO: 156450 - DNA, 10 bp, Unknown
  misc_feature (1)..( 10): Result.004 file - promoters50/1017286
caatatttgt

SEQ ID NO: 156451 - DNA, 10 bp, Unknown
  misc_feature (1)..( 10): Result.004 file - promoters50/1017316
caaaattata

SEQ ID NO: 156452 - DNA, 10 bp, Unknown
  misc_feature (1)..( 10): Result.004 file - promoters50/1017316
tcaatttgaa

SEQ ID NO: 156453 - DNA, 10 bp, Unknown
  misc_feature (1)..( 10): Result.004 file - promoters50/1017316
aaaatttgat

SEQ ID NO: 156454 - DNA, 10 bp, Unknown
  misc_feature (1)..( 10): Result.004 file - promoters50/1017316
ttcattttta

SEQ ID NO: 156455 - DNA, 10 bp, Unknown
  misc_feature (1)..( 10): Result.004 file - promoters50/1017316
aaaaattgat

SEQ ID NO: 156456 - DNA, 11 bp, Unknown
  misc_feature (1)..( 11): Result.004 file - promoters50/1017316
tgaaaatcatc

SEQ ID NO: 156457 - DNA, 11 bp, Unknown
  misc_feature (1)..( 11): Result.004 file - promoters50/1017316
agaaaatttga

SEQ ID NO: 156458 - DNA, 11 bp, Unknown
  misc_feature (1)..( 11): Result.004 file - promoters50/1017316
tataaattcat

SEQ ID NO: 156459 - DNA, 11 bp, Unknown
  misc_feature (1)..( 11): Result.004 file - promoters50/1017316
tgataataata

SEQ ID NO: 156460 - DNA, 10 bp, Unknown
  misc_feature (1)..( 10): Result.004 file - promoters50/1017316
tttgtgtgtt

SEQ ID NO: 156461 - DNA, 10 bp, Unknown
  misc_feature (1)..( 10): Result.004 file - promoters50/1017316
tttttgtttg

SEQ ID NO: 156462 - DNA, 10 bp, Unknown
  misc_feature (1)..( 10): Result.004 file - promoters50/1017316
tttgtctgtt

SEQ ID NO: 156463 - DNA, 12 bp, Unknown
  misc_feature (1)..( 12): Result.004 file - promoters50/1017316
aaactcttaatt

SEQ ID NO: 156464 - DNA, 12 bp, Unknown
  misc_feature (1)..( 12): Result.004 file - promoters50/1017316
ggtaaattaatt

SEQ ID NO: 156465 - DNA, 12 bp, Unknown
  misc_feature (1)..( 12): Result.004 file - promoters50/1017316
aaattcttaatg

SEQ ID NO: 156466 - DNA, 11 bp, Unknown
  misc_feature (1)..( 11): Result.004 file - promoters50/1017316
ttgggctatat

SEQ ID NO: 156467 - DNA, 11 bp, Unknown
  misc_feature (1)..( 11): Result.004 file - promoters50/1017316
atgggctttat

SEQ ID NO: 156468 - DNA, 11 bp, Unknown
  misc_feature (1)..( 11): Result.004 file - promoters50/1017316
atgggcttata

SEQ ID NO: 156469 - DNA, 11 bp, Unknown
  misc_feature (1)..( 11): Result.004 file - promoters50/1017316
atgggcaaaat

SEQ ID NO: 156470 - DNA, 9 bp, Unknown
  misc_feature (1)..( 9): Result.004 file - promoters50/1017316
tttttactt

SEQ ID NO: 156471 - DNA, 9 bp, Unknown
  misc_feature (1)..( 9): Result.004 file - promoters50/1017316
ctttgactc

SEQ ID NO: 156472 - DNA, 9 bp, Unknown
  misc_feature (1)..( 9): Result.004 file - promoters50/1017316
tttttactt

SEQ ID NO: 156473 - DNA, 7 bp, Unknown
  misc_feature (1)..( 7): Result.004 file - promoters50/1017316
ttacttt

SEQ ID NO: 156474 - DNA, 7 bp, Unknown
  misc_feature (1)..( 7): Result.004 file - promoters50/1017316
ttactta

SEQ ID NO: 156475 - DNA, 7 bp, Unknown
  misc_feature (1)..( 7): Result.004 file - promoters50/1017316
ttacttt

SEQ ID NO: 156476 - DNA, 9 bp, Unknown
  misc_feature (1)..( 9): Result.004 file - promoters50/1017316
taatttcaa

SEQ ID NO: 156477 - DNA, 9 bp, Unknown
  misc_feature (1)..( 9): Result.004 file - promoters50/1017316
atgtttcaa

SEQ ID NO: 156478 - DNA, 9 bp, Unknown
  misc_feature (1)..( 9): Result.004 file - promoters50/1017354
atgtgtcag

SEQ ID NO: 156479 - DNA, 10 bp, Unknown
  misc_feature (1)..( 10): Result.004 file - promoters50/1017354
aaaatttaaa

SEQ ID NO: 156480 - DNA, 10 bp, Unknown
  misc_feature (1)..( 10): Result.004 file - promoters50/1017354
aaaattcgat

SEQ ID NO: 156481 - DNA, 10 bp, Unknown
  misc_feature (1)..( 10): Result.004 file - promoters50/1017358
caaatacgat

SEQ ID NO: 156482 - DNA, 12 bp, Unknown
  misc_feature (1)..( 12): Result.004 file - promoters50/1017358
accaaaaaagaa

SEQ ID NO: 156483 - DNA, 12 bp, Unknown
  misc_feature (1)..( 12): Result.004 file - promoters50/1017358
tactcaaaagag

SEQ ID NO: 156484 - DNA, 12 bp, Unknown
  misc_feature (1)..( 12): Result.004 file - promoters50/1017358
agttaaaaagtg

SEQ ID NO: 156485 - DNA, 12 bp, Unknown
  misc_feature (1)..( 12): Result.004 file - promoters50/1017358
accagaaatgaa

SEQ ID NO: 156486 - DNA, 12 bp, Unknown
  misc_feature (1)..( 12): Result.004 file - promoters50/1017358
atcgaaatagat

SEQ ID NO: 156487 - DNA, 12 bp, Unknown
  misc_feature (1)..( 12): Result.004 file - promoters50/1017358
attgagaaagaa

SEQ ID NO: 156488 - DNA, 11 bp, Unknown
  misc_feature (1)..( 11): Result.004 file - promoters50/1017358
acatatataaa

SEQ ID NO: 156489 - DNA, 11 bp, Unknown
  misc_feature (1)..( 11): Result.004 file - promoters50/1017358
atctatatata

SEQ ID NO: 156490 - DNA, 11 bp, Unknown
  misc_feature (1)..( 11): Result.004 file - promoters50/1017358
tgagatataat

SEQ ID NO: 156491 - DNA, 11 bp, Unknown
  misc_feature (1)..( 11): Result.004 file - promoters50/1017358
gcctatatata

SEQ ID NO: 156492 - DNA, 11 bp, Unknown
  misc_feature (1)..( 11): Result.004 file - promoters50/1017358
ccttataaata

SEQ ID NO: 156493 - DNA, 11 bp, Unknown
  misc_feature (1)..( 11): Result.004 file - promoters50/1017434
ccttaaaaacc

SEQ ID NO: 156494 - DNA, 11 bp, Unknown
  misc_feature (1)..( 11): Result.004 file - promoters50/1017434
aaggtaaacca

SEQ ID NO: 156495 - DNA, 11 bp, Unknown
  misc_feature (1)..( 11): Result.004 file - promoters50/1017434
aagataaagaa

SEQ ID NO: 156496 - DNA, 11 bp, Unknown
  misc_feature (1)..( 11): Result.004 file - promoters50/1017434
tggataaaatt

SEQ ID NO: 156497 - DNA, 11 bp, Unknown
  misc_feature (1)..( 11): Result.004 file - promoters50/1017434
cagaaaaagag

SEQ ID NO: 156498 - DNA, 11 bp, Unknown
  misc_feature (1)..( 11): Result.004 file - promoters50/1017434
gtaataaagaa

SEQ ID NO: 156499 - DNA, 11 bp, Unknown
  misc_feature (1)..( 11): Result.004 file - promoters50/1017434
tgcataacaaa

SEQ ID NO: 156500 - DNA, 10 bp, Unknown
  misc_feature (1)..( 10): Result.004 file - promoters50/1017434
aatttatatt

SEQ ID NO: 156501 - DNA, 10 bp, Unknown
  misc_feature (1)..( 10): Result.004 file - promoters50/1017434
tctttttatt

SEQ ID NO: 156502 - DNA, 10 bp, Unknown
  misc_feature (1)..( 10): Result.004 file - promoters50/1017434
tctttgtatc

SEQ ID NO: 156503 - DNA, 10 bp, Unknown
  misc_feature (1)..( 10): Result.004 file - promoters50/1017434
cctttttacc

SEQ ID NO: 156504 - DNA, 10 bp, Unknown
  misc_feature (1)..( 10): Result.004 file - promoters50/1017434
ccttattatg

SEQ ID NO: 156505 - DNA, 10 bp, Unknown
  misc_feature (1)..( 10): Result.004 file - promoters50/1017542
tattacttta

SEQ ID NO: 156506 - DNA, 7 bp, Unknown
  misc_feature (1)..( 7): Result.004 file - promoters50/1017542
taattca

SEQ ID NO: 156507 - DNA, 7 bp, Unknown
  misc_feature (1)..( 7): Result.004 file - promoters50/1017542
caattca

SEQ ID NO: 156508 - DNA, 7 bp, Unknown
  misc_feature (1)..( 7): Result.004 file - promoters50/1017552
caattct

SEQ ID NO: 156509 - DNA, 7 bp, Unknown
  misc_feature (1)..( 7): Result.004 file - promoters50/1017552
ttacaac

SEQ ID NO: 156510 - DNA, 7 bp, Unknown
  misc_feature (1)..( 7): Result.004 file - promoters50/1017552
ttagaac

SEQ ID NO: 156511 - DNA, 7 bp, Unknown
  misc_feature (1)..( 7): Result.004 file - promoters50/1017552
ttagaaa

SEQ ID NO: 156512 - DNA, 10 bp, Unknown
  misc_feature (1)..( 10): Result.004 file - promoters50/1017552
aacattgtaa

SEQ ID NO: 156513 - DNA, 10 bp, Unknown
  misc_feature (1)..( 10): Result.004 file - promoters50/1017552
agaattataa

SEQ ID NO: 156514 - DNA, 10 bp, Unknown
  misc_feature (1)..( 10): Result.004 file - promoters50/1017552
agagttatgc

SEQ ID NO: 156515 - DNA, 8 bp, Unknown
  misc_feature (1)..( 8): Result.004 file - promoters50/1017552
aggaaaaa

SEQ ID NO: 156516 - DNA, 8 bp, Unknown
  misc_feature (1)..( 8): Result.004 file - promoters50/1017552
tggaaaac

SEQ ID NO: 156517 - DNA, 8 bp, Unknown
  misc_feature (1)..( 8): Result.004 file - promoters50/1017552
aggaaaaa

SEQ ID NO: 156518 - DNA, 8 bp, Unknown
  misc_feature (1)..( 8): Result.004 file - promoters50/1017552
gaaaaatg

SEQ ID NO: 156519 - DNA, 8 bp, Unknown
  misc_feature (1)..( 8): Result.004 file - promoters50/1017552
aaaaaatg

SEQ ID NO: 156520 - DNA, 9 bp, Unknown
  misc_feature (1)..( 9): Result.004 file - promoters50/1017562
aaagaaatg

SEQ ID NO: 156521 - DNA, 11 bp, Unknown
  misc_feature (1)..( 11): Result.004 file - promoters50/1017562
atatattacta

SEQ ID NO: 156522 - DNA, 11 bp, Unknown
  misc_feature (1)..( 11): Result.004 file - promoters50/1017562
gaatcttacta

SEQ ID NO: 156523 - DNA, 11 bp, Unknown
  misc_feature (1)..( 11): Result.004 file - promoters50/1017562
atataatactt

SEQ ID NO: 156524 - DNA, 11 bp, Unknown
  misc_feature (1)..( 11): Result.004 file - promoters50/1017562
atataatccgg

SEQ ID NO: 156525 - DNA, 12 bp, Unknown
  misc_feature (1)..( 12): Result.004 file - promoters50/1017562
atatatattact

SEQ ID NO: 156526 - DNA, 12 bp, Unknown
  misc_feature (1)..( 12): Result.004 file - promoters50/1017562
ttatgtataata

SEQ ID NO: 156527 - DNA, 12 bp, Unknown
  misc_feature (1)..( 12): Result.004 file - promoters50/1017562
atatatattgac

SEQ ID NO: 156528 - DNA, 12 bp, Unknown
  misc_feature (1)..( 12): Result.004 file - promoters50/1017562
gaatatatgcac

SEQ ID NO: 156529 - DNA, 12 bp, Unknown
  misc_feature (1)..( 12): Result.004 file - promoters50/1017562
tgatataatact

SEQ ID NO: 156530 - DNA, 12 bp, Unknown
  misc_feature (1)..( 12): Result.004 file - promoters50/1017562
atatatattact

SEQ ID NO: 156531 - DNA, 12 bp, Unknown
  misc_feature (1)..( 12): Result.004 file - promoters50/1017562
tataatattaaa

SEQ ID NO: 156532 - DNA, 12 bp, Unknown
  misc_feature (1)..( 12): Result.004 file - promoters50/1017562
atatatattgac

SEQ ID NO: 156533 - DNA, 12 bp, Unknown
  misc_feature (1)..( 12): Result.004 file - promoters50/1017562
tgatataatact

SEQ ID NO: 156534 - DNA, 12 bp, Unknown
  misc_feature (1)..( 12): Result.004 file - promoters50/1017562
gaatataatccg

SEQ ID NO: 156535 - DNA, 12 bp, Unknown
  misc_feature (1)..( 12): Result.004 file - promoters50/1017562
ttcaatcaaaca

SEQ ID NO: 156536 - DNA, 12 bp, Unknown
  misc_feature (1)..( 12): Result.004 file - promoters50/1017562
aataatccaact

SEQ ID NO: 156537 - DNA, 12 bp, Unknown
  misc_feature (1)..( 12): Result.004 file - promoters50/1017562
taaaatcagaca

SEQ ID NO: 156538 - DNA, 12 bp, Unknown
  misc_feature (1)..( 12): Result.004 file - promoters50/1017562
aataattcaatc

SEQ ID NO: 156539 - DNA, 10 bp, Unknown
  misc_feature (1)..( 10): Result.004 file - promoters50/1017562
aaatataaat

SEQ ID NO: 156540 - DNA, 10 bp, Unknown
  misc_feature (1)..( 10): Result.004 file - promoters50/1017562
ctatataacc

SEQ ID NO: 156541 - DNA, 10 bp, Unknown
  misc_feature (1)..( 10): Result.004 file - promoters50/1017562
aaatttaaga

SEQ ID NO: 156542 - DNA, 10 bp, Unknown
  misc_feature (1)..( 10): Result.004 file - promoters50/1017562
ttgtaaaatt

SEQ ID NO: 156543 - DNA, 13 bp, Unknown
  misc_feature (1)..( 13): Result.004 file - promoters50/1017562
tataaatatctac

SEQ ID NO: 156544 - DNA, 13 bp, Unknown
  misc_feature (1)..( 13): Result.004 file - promoters50/1017562
catatatatacac

SEQ ID NO: 156545 - DNA, 13 bp, Unknown
  misc_feature (1)..( 13): Result.004 file - promoters50/1017562
tatatatatggtc

SEQ ID NO: 156546 - DNA, 13 bp, Unknown
  misc_feature (1)..( 13): Result.004 file - promoters50/1017562
tatttaaatctct

SEQ ID NO: 156547 - DNA, 8 bp, Unknown
  misc_feature (1)..( 8): Result.004 file - promoters50/1017562
agaataaa

SEQ ID NO: 156548 - DNA, 8 bp, Unknown
  misc_feature (1)..( 8): Result.004 file - promoters50/1017562
ggaaaaaa

SEQ ID NO: 156549 - DNA, 8 bp, Unknown
  misc_feature (1)..( 8): Result.004 file - promoters50/1017562
agactaac

SEQ ID NO: 156550 - DNA, 8 bp, Unknown
  misc_feature (1)..( 8): Result.004 file - promoters50/1017568
taactaac

SEQ ID NO: 156551 - DNA, 11 bp, Unknown
  misc_feature (1)..( 11): Result.004 file - promoters50/1017568
cataatttagt

SEQ ID NO: 156552 - DNA, 11 bp, Unknown
  misc_feature (1)..( 11): Result.004 file - promoters50/1017568
cataatgtaga

SEQ ID NO: 156553 - DNA, 9 bp, Unknown
  misc_feature (1)..( 9): Result.004 file - promoters50/1017568
taaattata

SEQ ID NO: 156554 - DNA, 10 bp, Unknown
  misc_feature (1)..( 10): Result.004 file - promoters50/1017568
ttaatttcct

SEQ ID NO: 156555 - DNA, 11 bp, Unknown
  misc_feature (1)..( 11): Result.004 file - promoters50/1017568
tcaaatataga

SEQ ID NO: 156556 - DNA, 11 bp, Unknown
  misc_feature (1)..( 11): Result.004 file - promoters50/1017568
tccaatatata

SEQ ID NO: 156557 - DNA, 11 bp, Unknown
  misc_feature (1)..( 11): Result.004 file - promoters50/1017568
cttaatgtttg

SEQ ID NO: 156558 - DNA, 15 bp, Unknown
  misc_feature (1)..( 15): Result.004 file - promoters50/1017568
tttattctgaaaagc

SEQ ID NO: 156559 - DNA, 15 bp, Unknown
  misc_feature (1)..( 15): Result.004 file - promoters50/1017568
ggaaatctcaaaatt

SEQ ID NO: 156560 - DNA, 15 bp, Unknown
  misc_feature (1)..( 15): Result.004 file - promoters50/1017568
tcgaacatgataagc

SEQ ID NO: 156561 - DNA, 15 bp, Unknown
  misc_feature (1)..( 15): Result.004 file - promoters50/1017568
ttttttcggaaaaac

SEQ ID NO: 156562 - DNA, 15 bp, Unknown
  misc_feature (1)..( 15): Result.004 file - promoters50/1017568
tgttagttcaaaaaa

SEQ ID NO: 156563 - DNA, 15 bp, Unknown
  misc_feature (1)..( 15): Result.004 file - promoters50/1017593
atttttctgttcaac

SEQ ID NO: 156564 - DNA, 8 bp, Unknown
  misc_feature (1)..( 8): Result.004 file - promoters50/1017593
ttgtctta

SEQ ID NO: 156565 - DNA, 8 bp, Unknown
  misc_feature (1)..( 8): Result.004 file - promoters50/1017593
ttgtttta

SEQ ID NO: 156566 - DNA, 8 bp, Unknown
  misc_feature (1)..( 8): Result.004 file - promoters50/1017596
tcgtttta

SEQ ID NO: 156567 - DNA, 8 bp, Unknown
  misc_feature (1)..( 8): Result.004 file - promoters50/1017596
tttgtttt

SEQ ID NO: 156568 - DNA, 8 bp, Unknown
  misc_feature (1)..( 8): Result.004 file - promoters50/1017596
tatgtttt

SEQ ID NO: 156569 - DNA, 8 bp, Unknown
  misc_feature (1)..( 8): Result.004 file - promoters50/1017596
tttcttta

SEQ ID NO: 156570 - DNA, 8 bp, Unknown
  misc_feature (1)..( 8): Result.004 file - promoters50/1017596
tatttaac

SEQ ID NO: 156571 - DNA, 8 bp, Unknown
  misc_feature (1)..( 8): Result.004 file - promoters50/1017596
tttttaac

SEQ ID NO: 156572 - DNA, 8 bp, Unknown
  misc_feature (1)..( 8): Result.004 file - promoters50/1017596
tatataag

SEQ ID NO: 156573 - DNA, 8 bp, Unknown
  misc_feature (1)..( 8): Result.004 file - promoters50/1017596
cttttgaa

SEQ ID NO: 156574 - DNA, 8 bp, Unknown
  misc_feature (1)..( 8): Result.004 file - promoters50/1017596
cttatgag

SEQ ID NO: 156575 - DNA, 8 bp, Unknown
  misc_feature (1)..( 8): Result.004 file - promoters50/1017618
attacgag

SEQ ID NO: 156576 - DNA, 15 bp, Unknown
  misc_feature (1)..( 15): Result.004 file - promoters50/1017618
tctcctataataaat

SEQ ID NO: 156577 - DNA, 15 bp, Unknown
  misc_feature (1)..( 15): Result.004 file - promoters50/1017618
tgtcctataaatata

SEQ ID NO: 156578 - DNA, 15 bp, Unknown
  misc_feature (1)..( 15): Result.004 file - promoters50/1017618
tcttctatatatatc

SEQ ID NO: 156579 - DNA, 15 bp, Unknown
  misc_feature (1)..( 15): Result.004 file - promoters50/1017618
tagcctttaaaaaag

SEQ ID NO: 156580 - DNA, 15 bp, Unknown
  misc_feature (1)..( 15): Result.004 file - promoters50/1017618
atcaatataaatacc

SEQ ID NO: 156581 - DNA, 15 bp, Unknown
  misc_feature (1)..( 15): Result.004 file - promoters50/1017618
acaagatcaaaaagc

SEQ ID NO: 156582 - DNA, 12 bp, Unknown
  misc_feature (1)..( 12): Result.004 file - promoters50/1017618
ataataaataca

SEQ ID NO: 156583 - DNA, 12 bp, Unknown
  misc_feature (1)..( 12): Result.004 file - promoters50/1017618
cctataaatata

SEQ ID NO: 156584 - DNA, 12 bp, Unknown
  misc_feature (1)..( 12): Result.004 file - promoters50/1017618
aatataaatacc

SEQ ID NO: 156585 - DNA, 12 bp, Unknown
  misc_feature (1)..( 12): Result.004 file - promoters50/1017618
tctatatatatc

SEQ ID NO: 156586 - DNA, 12 bp, Unknown
  misc_feature (1)..( 12): Result.004 file - promoters50/1017618
cctttaaaaaag

SEQ ID NO: 156587 - DNA, 12 bp, Unknown
  misc_feature (1)..( 12): Result.004 file - promoters50/1017618
agatcaaaaagc

SEQ ID NO: 156588 - DNA, 12 bp, Unknown
  misc_feature (1)..( 12): Result.004 file - promoters50/1017618
aaaataaactaa

SEQ ID NO: 156589 - DNA, 12 bp, Unknown
  misc_feature (1)..( 12): Result.004 file - promoters50/1017618
aaaataaaataa

SEQ ID NO: 156590 - DNA, 12 bp, Unknown
  misc_feature (1)..( 12): Result.004 file - promoters50/1017618
aaaaaaaaaaga

SEQ ID NO: 156591 - DNA, 12 bp, Unknown
  misc_feature (1)..( 12): Result.004 file - promoters50/1017618
caaataaatcgt

SEQ ID NO: 156592 - DNA, 12 bp, Unknown
  misc_feature (1)..( 12): Result.004 file - promoters50/1017618
caaagaaagaca

SEQ ID NO: 156593 - DNA, 12 bp, Unknown
  misc_feature (1)..( 12): Result.004 file - promoters50/1017626
tagataaaacga

SEQ ID NO: 156594 - DNA, 11 bp, Unknown
  misc_feature (1)..( 11): Result.004 file - promoters50/1017626
tcagtaaaaaa

SEQ ID NO: 156595 - DNA, 11 bp, Unknown
  misc_feature (1)..( 11): Result.004 file - promoters50/1017626
tcattaaaaat

SEQ ID NO: 156596 - DNA, 12 bp, Unknown
  misc_feature (1)..( 12): Result.004 file - promoters50/1017626
ttaataacaaat

SEQ ID NO: 156597 - DNA, 12 bp, Unknown
  misc_feature (1)..( 12): Result.004 file - promoters50/1017626
aaccaaaccaat

SEQ ID NO: 156598 - DNA, 9 bp, Unknown
  misc_feature (1)..( 9): Result.004 file - promoters50/1017626
ttttcataa

SEQ ID NO: 156599 - DNA, 9 bp, Unknown
  misc_feature (1)..( 9): Result.004 file - promoters50/1017626
attttataa

SEQ ID NO: 156600 - DNA, 10 bp, Unknown
  misc_feature (1)..( 10): Result.004 file - promoters50/1017626
ttttacatat

SEQ ID NO: 156601 - DNA, 10 bp, Unknown
  misc_feature (1)..( 10): Result.004 file - promoters50/1017626
attaaaatca

SEQ ID NO: 156602 - DNA, 7 bp, Unknown
  misc_feature (1)..( 7): Result.004 file - promoters50/1017626
tctctct

SEQ ID NO: 156603 - DNA, 7 bp, Unknown
  misc_feature (1)..( 7): Result.004 file - promoters50/1017626
tctctcg

SEQ ID NO: 156604 - DNA, 7 bp, Unknown
  misc_feature (1)..( 7): Result.004 file - promoters50/1017626
tctttct

SEQ ID NO: 156605 - DNA, 7 bp, Unknown
  misc_feature (1)..( 7): Result.004 file - promoters50/1017626
actttct

SEQ ID NO: 156606 - DNA, 10 bp, Unknown
  misc_feature (1)..( 10): Result.004 file - promoters50/1017626
aaaattggta

SEQ ID NO: 156607 - DNA, 10 bp, Unknown
  misc_feature (1)..( 10): Result.004 file - promoters50/1017626
caaattggaa

SEQ ID NO: 156608 - DNA, 10 bp, Unknown
  misc_feature (1)..( 10): Result.004 file - promoters50/1017626
cgatttgtag

SEQ ID NO: 156609 - DNA, 10 bp, Unknown
  misc_feature (1)..( 10): Result.004 file - promoters50/1017626
caaattttga

SEQ ID NO: 156610 - DNA, 11 bp, Unknown
  misc_feature (1)..( 11): Result.004 file - promoters50/1017626
atttagaatct

SEQ ID NO: 156611 - DNA, 11 bp, Unknown
  misc_feature (1)..( 11): Result.004 file - promoters50/1017626
aaatagtatcc

SEQ ID NO: 156612 - DNA, 11 bp, Unknown
  misc_feature (1)..( 11): Result.004 file - promoters50/1017626
aaatattattt

SEQ ID NO: 156613 - DNA, 11 bp, Unknown
  misc_feature (1)..( 11): Result.004 file - promoters50/1017626
cttaattattt

SEQ ID NO: 156614 - DNA, 11 bp, Unknown
  misc_feature (1)..( 11): Result.004 file - promoters50/1017626
gcctatataaa

SEQ ID NO: 156615 - DNA, 11 bp, Unknown
  misc_feature (1)..( 11): Result.004 file - promoters50/1017626
gcctataaata

SEQ ID NO: 156616 - DNA, 11 bp, Unknown
  misc_feature (1)..( 11): Result.004 file - promoters50/1017626
gcctatataaa

SEQ ID NO: 156617 - DNA, 11 bp, Unknown
  misc_feature (1)..( 11): Result.004 file - promoters50/1017626
atgtataaata

SEQ ID NO: 156618 - DNA, 12 bp, Unknown
  misc_feature (1)..( 12): Result.004 file - promoters50/1017626
gcctatataaat

SEQ ID NO: 156619 - DNA, 12 bp, Unknown
  misc_feature (1)..( 12): Result.004 file - promoters50/1017626
gtgcctataaat

SEQ ID NO: 156620 - DNA, 12 bp, Unknown
  misc_feature (1)..( 12): Result.004 file - promoters50/1017626
gcctatataaac

SEQ ID NO: 156621 - DNA, 12 bp, Unknown
  misc_feature (1)..( 12): Result.004 file - promoters50/1017626
atatgtataaat

SEQ ID NO: 156622 - DNA, 8 bp, Unknown
  misc_feature (1)..( 8): Result.004 file - promoters50/1017626
aaacgaat

SEQ ID NO: 156623 - DNA, 8 bp, Unknown
  misc_feature (1)..( 8): Result.004 file - promoters50/1017626
aaacgatc

SEQ ID NO: 156624 - DNA, 8 bp, Unknown
  misc_feature (1)..( 8): Result.004 file - promoters50/1017626
taacaaat

SEQ ID NO: 156625 - DNA, 8 bp, Unknown
  misc_feature (1)..( 8): Result.004 file - promoters50/1017626
aaaccaat

SEQ ID NO: 156626 - DNA, 8 bp, Unknown
  misc_feature (1)..( 8): Result.004 file - promoters50/1017626
ataataag

SEQ ID NO: 156627 - DNA, 8 bp, Unknown
  misc_feature (1)..( 8): Result.004 file - promoters50/1017626
ttaataac

SEQ ID NO: 156628 - DNA, 8 bp, Unknown
  misc_feature (1)..( 8): Result.004 file - promoters50/1017626
ccaataac

SEQ ID NO: 156629 - DNA, 8 bp, Unknown
  misc_feature (1)..( 8): Result.004 file - promoters50/1017649
ttaatata

SEQ ID NO: 156630 - DNA, 11 bp, Unknown
  misc_feature (1)..( 11): Result.004 file - promoters50/1017649
gaaataaaaag

SEQ ID NO: 156631 - DNA, 11 bp, Unknown
  misc_feature (1)..( 11): Result.004 file - promoters50/1017649
gtcatacaaat

SEQ ID NO: 156632 - DNA, 11 bp, Unknown
  misc_feature (1)..( 11): Result.004 file - promoters50/1017649
tagataataag

SEQ ID NO: 156633 - DNA, 11 bp, Unknown
  misc_feature (1)..( 11): Result.004 file - promoters50/1017649
gaaataaatca

SEQ ID NO: 156634 - DNA, 11 bp, Unknown
  misc_feature (1)..( 11): Result.004 file - promoters50/1017681
agaatcagtag

SEQ ID NO: 156635 - DNA, 12 bp, Unknown
  misc_feature (1)..( 12): Result.004 file - promoters50/1017681
aaacgagaaagt

SEQ ID NO: 156636 - DNA, 12 bp, Unknown
  misc_feature (1)..( 12): Result.004 file - promoters50/1017681
aaaagagtaaaa

SEQ ID NO: 156637 - DNA, 12 bp, Unknown
  misc_feature (1)..( 12): Result.004 file - promoters50/1017693
aaaagactaaaa

SEQ ID NO: 156638 - DNA, 8 bp, Unknown
  misc_feature (1)..( 8): Result.004 file - promoters50/1017693
aatatagt

SEQ ID NO: 156639 - DNA, 8 bp, Unknown
  misc_feature (1)..( 8): Result.004 file - promoters50/1017693
aataaagt

SEQ ID NO: 156640 - DNA, 8 bp, Unknown
  misc_feature (1)..( 8): Result.004 file - promoters50/1017693
aatattat

SEQ ID NO: 156641 - DNA, 8 bp, Unknown
  misc_feature (1)..( 8): Result.004 file - promoters50/1017693
attggtag

SEQ ID NO: 156642 - DNA, 8 bp, Unknown
  misc_feature (1)..( 8): Result.004 file - promoters50/1017693
atttgtat

SEQ ID NO: 156643 - DNA, 8 bp, Unknown
  misc_feature (1)..( 8): Result.004 file - promoters50/1017693
atttttat

SEQ ID NO: 156644 - DNA, 9 bp, Unknown
  misc_feature (1)..( 9): Result.004 file - promoters50/1017693
atgtttttg

SEQ ID NO: 156645 - DNA, 9 bp, Unknown
  misc_feature (1)..( 9): Result.004 file - promoters50/1017693
atgtctttg

SEQ ID NO: 156646 - DNA, 9 bp, Unknown
  misc_feature (1)..( 9): Result.004 file - promoters50/1017693
tggtttttc

SEQ ID NO: 156647 - DNA, 8 bp, Unknown
  misc_feature (1)..( 8): Result.004 file - promoters50/1017693
aaaaactt

SEQ ID NO: 156648 - DNA, 8 bp, Unknown
  misc_feature (1)..( 8): Result.004 file - promoters50/1017693
aaaaacaa

SEQ ID NO: 156649 - DNA, 8 bp, Unknown
  misc_feature (1)..( 8): Result.004 file - promoters50/1017802
taaatcaa

SEQ ID NO: 156650 - DNA, 25 bp, Unknown
  misc_feature (1)..( 25): Result.004 file - promoters50/1017802
aaagttgcttcaaattatagattct

SEQ ID NO: 156651 - DNA, 25 bp, Unknown
  misc_feature (1)..( 25): Result.004 file - promoters50/1017802
aaagttgctacaaattatagattct

SEQ ID NO: 156652 - DNA, 25 bp, Unknown
  misc_feature (1)..( 25): Result.004 file - promoters50/1017802
gagtttgctagcatcaataatcaca

SEQ ID NO: 156653 - DNA, 22 bp, Unknown
  misc_feature (1)..( 22): Result.004 file - promoters50/1017802
tcttttctgattttgtttctca

SEQ ID NO: 156654 - DNA, 22 bp, Unknown
  misc_feature (1)..( 22): Result.004 file - promoters50/1017802
tcttttctgatattgtttctca

SEQ ID NO: 156655 - DNA, 22 bp, Unknown
  misc_feature (1)..( 22): Result.004 file - promoters50/1017802
atgtatcttattttgagaggtc

SEQ ID NO: 156656 - DNA, 7 bp, Unknown
  misc_feature (1)..( 7): Result.004 file - promoters50/1017802
aaatata

SEQ ID NO: 156657 - DNA, 7 bp, Unknown
  misc_feature (1)..( 7): Result.004 file - promoters50/1017802
aaatata

SEQ ID NO: 156658 - DNA, 7 bp, Unknown
  misc_feature (1)..( 7): Result.004 file - promoters50/1017802
aaatata

SEQ ID NO: 156659 - DNA, 8 bp, Unknown
  misc_feature (1)..( 8): Result.004 file - promoters50/1017802
aataaaat

SEQ ID NO: 156660 - DNA, 8 bp, Unknown
  misc_feature (1)..( 8): Result.004 file - promoters50/1017802
gataaaat

SEQ ID NO: 156661 - DNA, 8 bp, Unknown
  misc_feature (1)..( 8): Result.004 file - promoters50/1017802
gataaatt

SEQ ID NO: 156662 - DNA, 6 bp, Unknown
  misc_feature (1)..( 6): Result.004 file - promoters50/1017802
atagga

SEQ ID NO: 156663 - DNA, 6 bp, Unknown
  misc_feature (1)..( 6): Result.004 file - promoters50/1017802
atagga

SEQ ID NO: 156664 - DNA, 6 bp, Unknown
  misc_feature (1)..( 6): Result.004 file - promoters50/1017802
atagga

SEQ ID NO: 156665 - DNA, 8 bp, Unknown
  misc_feature (1)..( 8): Result.004 file - promoters50/1017802
ataatatt

SEQ ID NO: 156666 - DNA, 8 bp, Unknown
  misc_feature (1)..( 8): Result.004 file - promoters50/1017802
ataaaatt

SEQ ID NO: 156667 - DNA, 8 bp, Unknown
  misc_feature (1)..( 8): Result.004 file - promoters50/1017802
ataaaata

SEQ ID NO: 156668 - DNA, 12 bp, Unknown
  misc_feature (1)..( 12): Result.004 file - promoters50/1017802
aaaaaataaaaa

SEQ ID NO: 156669 - DNA, 12 bp, Unknown
  misc_feature (1)..( 12): Result.004 file - promoters50/1017802
aaaaattaaaaa

SEQ ID NO: 156670 - DNA, 12 bp, Unknown
  misc_feature (1)..( 12): Result.004 file - promoters50/1017883
ctcaaataaaat

SEQ ID NO: 156671 - DNA, 11 bp, Unknown
  misc_feature (1)..( 11): Result.004 file - promoters50/1017883
taagtaacata

SEQ ID NO: 156672 - DNA, 11 bp, Unknown
  misc_feature (1)..( 11): Result.004 file - promoters50/1017883
gaagtatcatc

SEQ ID NO: 156673 - DNA, 11 bp, Unknown
  misc_feature (1)..( 11): Result.004 file - promoters50/1017883
aaataaacata

SEQ ID NO: 156674 - DNA, 11 bp, Unknown
  misc_feature (1)..( 11): Result.004 file - promoters50/1017883
aaagaatcaac

SEQ ID NO: 156675 - DNA, 11 bp, Unknown
  misc_feature (1)..( 11): Result.004 file - promoters50/1017883
aaagaaaaaaa

SEQ ID NO: 156676 - DNA, 11 bp, Unknown
  misc_feature (1)..( 11): Result.004 file - promoters50/1017883
aaataataagc

SEQ ID NO: 156677 - DNA, 14 bp, Unknown
  misc_feature (1)..( 14): Result.004 file - promoters50/1017883
gtccaatataaata

SEQ ID NO: 156678 - DNA, 14 bp, Unknown
  misc_feature (1)..( 14): Result.004 file - promoters50/1017883
cacgcctatatata

SEQ ID NO: 156679 - DNA, 14 bp, Unknown
  misc_feature (1)..( 14): Result.004 file - promoters50/1017883
ttctctaataaata

SEQ ID NO: 156680 - DNA, 14 bp, Unknown
  misc_feature (1)..( 14): Result.004 file - promoters50/1017883
tcgctttataaaca

SEQ ID NO: 156681 - DNA, 14 bp, Unknown
  misc_feature (1)..( 14): Result.004 file - promoters50/1017883
ctcttgtatatata

SEQ ID NO: 156682 - DNA, 14 bp, Unknown
  misc_feature (1)..( 14): Result.004 file - promoters50/1017883
gaattaaataaata

SEQ ID NO: 156683 - DNA, 14 bp, Unknown
  misc_feature (1)..( 14): Result.004 file - promoters50/1017883
tcgccttaaaaacc

SEQ ID NO: 156684 - DNA, 11 bp, Unknown
  misc_feature (1)..( 11): Result.004 file - promoters50/1017883
gctattatgtg

SEQ ID NO: 156685 - DNA, 11 bp, Unknown
  misc_feature (1)..( 11): Result.004 file - promoters50/1017883
tttattatgtg

SEQ ID NO: 156686 - DNA, 11 bp, Unknown
  misc_feature (1)..( 11): Result.004 file - promoters50/1017883
gttattatatt

SEQ ID NO: 156687 - DNA, 11 bp, Unknown
  misc_feature (1)..( 11): Result.004 file - promoters50/1017883
ttttttaatct

SEQ ID NO: 156688 - DNA, 11 bp, Unknown
  misc_feature (1)..( 11): Result.004 file - promoters50/1017883
tttttttcact

SEQ ID NO: 156689 - DNA, 11 bp, Unknown
  misc_feature (1)..( 11): Result.004 file - promoters50/1017883
acttttaaaaa

SEQ ID NO: 156690 - DNA, 11 bp, Unknown
  misc_feature (1)..( 11): Result.004 file - promoters50/1017883
ataattatttt

SEQ ID NO: 156691 - DNA, 14 bp, Unknown
  misc_feature (1)..( 14): Result.004 file - promoters50/1017883
aaacaaatgtttgt

SEQ ID NO: 156692 - DNA, 14 bp, Unknown
  misc_feature (1)..( 14): Result.004 file - promoters50/1017883
aaataaatttttta

SEQ ID NO: 156693 - DNA, 14 bp, Unknown
  misc_feature (1)..( 14): Result.004 file - promoters50/1017883
tctaaactgtgtgt

SEQ ID NO: 156694 - DNA, 14 bp, Unknown
  misc_feature (1)..( 14): Result.004 file - promoters50/1017883
aaacaattctttaa

SEQ ID NO: 156695 - DNA, 14 bp, Unknown
  misc_feature (1)..( 14): Result.004 file - promoters50/1017883
catcgcttgtttgt

SEQ ID NO: 156696 - DNA, 14 bp, Unknown
  misc_feature (1)..( 14): Result.004 file - promoters50/1017887
aaaaaaagaagaaa

SEQ ID NO: 156697 - DNA, 9 bp, Unknown
  misc_feature (1)..( 9): Result.004 file - promoters50/1017887
tttaaattc

SEQ ID NO: 156698 - DNA, 9 bp, Unknown
  misc_feature (1)..( 9): Result.004 file - promoters50/1017887
tttaaataa

SEQ ID NO: 156699 - DNA, 9 bp, Unknown
  misc_feature (1)..( 9): Result.004 file - promoters50/1017887
tttatataa

SEQ ID NO: 156700 - DNA, 10 bp, Unknown
  misc_feature (1)..( 10): Result.004 file - promoters50/1017887
caatattttt

SEQ ID NO: 156701 - DNA, 10 bp, Unknown
  misc_feature (1)..( 10): Result.004 file - promoters50/1017887
ttttattttt

SEQ ID NO: 156702 - DNA, 10 bp, Unknown
  misc_feature (1)..( 10): Result.004 file - promoters50/1017887
tttgatttac

SEQ ID NO: 156703 - DNA, 9 bp, Unknown
  misc_feature (1)..( 9): Result.004 file - promoters50/1017887
cattatatt

SEQ ID NO: 156704 - DNA, 9 bp, Unknown
  misc_feature (1)..( 9): Result.004 file - promoters50/1017887
catcatata

SEQ ID NO: 156705 - DNA, 9 bp, Unknown
  misc_feature (1)..( 9): Result.004 file - promoters50/1017887
ttttatatt

SEQ ID NO: 156706 - DNA, 12 bp, Unknown
  misc_feature (1)..( 12): Result.004 file - promoters50/1017887
acacacatgcat

SEQ ID NO: 156707 - DNA, 12 bp, Unknown
  misc_feature (1)..( 12): Result.004 file - promoters50/1017887
actttcatgcat

SEQ ID NO: 156708 - DNA, 12 bp, Unknown
  misc_feature (1)..( 12): Result.004 file - promoters50/1017887
actctcatgctt

SEQ ID NO: 156709 - DNA, 9 bp, Unknown
  misc_feature (1)..( 9): Result.004 file - promoters50/1017887
tatcattgg

SEQ ID NO: 156710 - DNA, 9 bp, Unknown
  misc_feature (1)..( 9): Result.004 file - promoters50/1017887
gatcaatgg

SEQ ID NO: 156711 - DNA, 9 bp, Unknown
  misc_feature (1)..( 9): Result.004 file - promoters50/1017964
gatgaatgt

SEQ ID NO: 156712 - DNA, 11 bp, Unknown
  misc_feature (1)..( 11): Result.004 file - promoters50/1017964
aaagtataaat

SEQ ID NO: 156713 - DNA, 11 bp, Unknown
  misc_feature (1)..( 11): Result.004 file - promoters50/1017964
ttagtttaaaa

SEQ ID NO: 156714 - DNA, 11 bp, Unknown
  misc_feature (1)..( 11): Result.004 file - promoters50/1017964
aaattataaat

SEQ ID NO: 156715 - DNA, 11 bp, Unknown
  misc_feature (1)..( 11): Result.004 file - promoters50/1017964
aaactattata

SEQ ID NO: 156716 - DNA, 11 bp, Unknown
  misc_feature (1)..( 11): Result.004 file - promoters50/1018052
caattattaac

SEQ ID NO: 156717 - DNA, 10 bp, Unknown
  misc_feature (1)..( 10): Result.004 file - promoters50/1018052
ctcagttgat

SEQ ID NO: 156718 - DNA, 10 bp, Unknown
  misc_feature (1)..( 10): Result.004 file - promoters50/1018052
ttcagtttct

SEQ ID NO: 156719 - DNA, 10 bp, Unknown
  misc_feature (1)..( 10): Result.004 file - promoters50/1018052
atcaattttg

SEQ ID NO: 156720 - DNA, 10 bp, Unknown
  misc_feature (1)..( 10): Result.004 file - promoters50/1018052
actaatttta

SEQ ID NO: 156721 - DNA, 10 bp, Unknown
  misc_feature (1)..( 10): Result.004 file - promoters50/1018052
atcatttttt

SEQ ID NO: 156722 - DNA, 10 bp, Unknown
  misc_feature (1)..( 10): Result.004 file - promoters50/1018052
accaattttg

SEQ ID NO: 156723 - DNA, 16 bp, Unknown
  misc_feature (1)..( 16): Result.004 file - promoters50/1018052
ttgattgattgataca

SEQ ID NO: 156724 - DNA, 16 bp, Unknown
  misc_feature (1)..( 16): Result.004 file - promoters50/1018052
ataatttatttaatat

SEQ ID NO: 156725 - DNA, 15 bp, Unknown
  misc_feature (1)..( 15): Result.004 file - promoters50/1018052
agcttggttgtttga

SEQ ID NO: 156726 - DNA, 16 bp, Unknown
  misc_feature (1)..( 16): Result.004 file - promoters50/1018052
ggaatgtattttcagt

SEQ ID NO: 156727 - DNA, 16 bp, Unknown
  misc_feature (1)..( 16): Result.004 file - promoters50/1018052
taagttagttactaaa

SEQ ID NO: 156728 - DNA, 16 bp, Unknown
  misc_feature (1)..( 16): Result.004 file - promoters50/1018052
atcatttttttctaga

SEQ ID NO: 156729 - DNA, 10 bp, Unknown
  misc_feature (1)..( 10): Result.004 file - promoters50/1018052
tgttttttag

SEQ ID NO: 156730 - DNA, 10 bp, Unknown
  misc_feature (1)..( 10): Result.004 file - promoters50/1018052
atatttttac

SEQ ID NO: 156731 - DNA, 10 bp, Unknown
  misc_feature (1)..( 10): Result.004 file - promoters50/1018052
actgttttag

SEQ ID NO: 156732 - DNA, 11 bp, Unknown
  misc_feature (1)..( 11): Result.004 file - promoters50/1018052
caattttgtag

SEQ ID NO: 156733 - DNA, 11 bp, Unknown
  misc_feature (1)..( 11): Result.004 file - promoters50/1018052
aggacttgtag

SEQ ID NO: 156734 - DNA, 11 bp, Unknown
  misc_feature (1)..( 11): Result.004 file - promoters50/1018077
caattttgcta

SEQ ID NO: 156735 - DNA, 16 bp, Unknown
  misc_feature (1)..( 16): Result.004 file - promoters50/1018077
cataatcattatatat

SEQ ID NO: 156736 - DNA, 16 bp, Unknown
  misc_feature (1)..( 16): Result.004 file - promoters50/1018077
cataattccgggtcta

SEQ ID NO: 156737 - DNA, 16 bp, Unknown
  misc_feature (1)..( 16): Result.004 file - promoters50/1018077
tataatgattctatat

SEQ ID NO: 156738 - DNA, 16 bp, Unknown
  misc_feature (1)..( 16): Result.004 file - promoters50/1018077
aagaatgatcatattt

SEQ ID NO: 156739 - DNA, 9 bp, Unknown
  misc_feature (1)..( 9): Result.004 file - promoters50/1018077
attatctcc

SEQ ID NO: 156740 - DNA, 9 bp, Unknown
  misc_feature (1)..( 9): Result.004 file - promoters50/1018077
attttctcc

SEQ ID NO: 156741 - DNA, 9 bp, Unknown
  misc_feature (1)..( 9): Result.004 file - promoters50/1018077
agtatttcc

SEQ ID NO: 156742 - DNA, 9 bp, Unknown
  misc_feature (1)..( 9): Result.004 file - promoters50/1018077
ggtttctcg

SEQ ID NO: 156743 - DNA, 10 bp, Unknown
  misc_feature (1)..( 10): Result.004 file - promoters50/1018077
tcaaacaaaa

SEQ ID NO: 156744 - DNA, 10 bp, Unknown
  misc_feature (1)..( 10): Result.004 file - promoters50/1018077
tcaaacatct

SEQ ID NO: 156745 - DNA, 10 bp, Unknown
  misc_feature (1)..( 10): Result.004 file - promoters50/1018077
caaaacaaaa

SEQ ID NO: 156746 - DNA, 7 bp, Unknown
  misc_feature (1)..( 7): Result.004 file - promoters50/1018077
actgttt

SEQ ID NO: 156747 - DNA, 7 bp, Unknown
  misc_feature (1)..( 7): Result.004 file - promoters50/1018077
actgttt

SEQ ID NO: 156748 - DNA, 7 bp, Unknown
  misc_feature (1)..( 7): Result.004 file - promoters50/1018085
actgttg

SEQ ID NO: 156749 - DNA, 10 bp, Unknown
  misc_feature (1)..( 10): Result.004 file - promoters50/1018085
aaataatttt

SEQ ID NO: 156750 - DNA, 10 bp, Unknown
  misc_feature (1)..( 10): Result.004 file - promoters50/1018085
gcatattttt

SEQ ID NO: 156751 - DNA, 10 bp, Unknown
  misc_feature (1)..( 10): Result.004 file - promoters50/1018085
aaataattca

SEQ ID NO: 156752 - DNA, 10 bp, Unknown
  misc_feature (1)..( 10): Result.004 file - promoters50/1018085
agattgtttt

SEQ ID NO: 156753 - DNA, 9 bp, Unknown
  misc_feature (1)..( 9): Result.004 file - promoters50/1018085
attttaagt

SEQ ID NO: 156754 - DNA, 9 bp, Unknown
  misc_feature (1)..( 9): Result.004 file - promoters50/1018085
gttttaata

SEQ ID NO: 156755 - DNA, 9 bp, Unknown
  misc_feature (1)..( 9): Result.004 file - promoters50/1018085
tttttagta

SEQ ID NO: 156756 - DNA, 9 bp, Unknown
  misc_feature (1)..( 9): Result.004 file - promoters50/1018085
ggtttggta

SEQ ID NO: 156757 - DNA, 9 bp, Unknown
  misc_feature (1)..( 9): Result.004 file - promoters50/1018085
gagcataag

SEQ ID NO: 156758 - DNA, 9 bp, Unknown
  misc_feature (1)..( 9): Result.004 file - promoters50/1018085
aagcaaaag

SEQ ID NO: 156759 - DNA, 10 bp, Unknown
  misc_feature (1)..( 10): Result.004 file - promoters50/1018085
gagaatcaag

SEQ ID NO: 156760 - DNA, 10 bp, Unknown
  misc_feature (1)..( 10): Result.004 file - promoters50/1018151
gagaataatc

SEQ ID NO: 156761 - DNA, 10 bp, Unknown
  misc_feature (1)..( 10): Result.004 file - promoters50/1018151
ggtttttatt

SEQ ID NO: 156762 - DNA, 10 bp, Unknown
  misc_feature (1)..( 10): Result.004 file - promoters50/1018151
ggttattatc

SEQ ID NO: 156763 - DNA, 10 bp, Unknown
  misc_feature (1)..( 10): Result.004 file - promoters50/1018151
aagttttatt

SEQ ID NO: 156764 - DNA, 10 bp, Unknown
  misc_feature (1)..( 10): Result.004 file - promoters50/1018151
aacaattatc

SEQ ID NO: 156765 - DNA, 10 bp, Unknown
  misc_feature (1)..( 10): Result.004 file - promoters50/1018151
ggttaatatc

SEQ ID NO: 156766 - DNA, 7 bp, Unknown
  misc_feature (1)..( 7): Result.004 file - promoters50/1018151
atttaaa

SEQ ID NO: 156767 - DNA, 7 bp, Unknown
  misc_feature (1)..( 7): Result.004 file - promoters50/1018151
atttaat

SEQ ID NO: 156768 - DNA, 8 bp, Unknown
  misc_feature (1)..( 8): Result.004 file - promoters50/1018151
ctttcaat

SEQ ID NO: 156769 - DNA, 8 bp, Unknown
  misc_feature (1)..( 8): Result.004 file - promoters50/1018151
aatataaa

SEQ ID NO: 156770 - DNA, 12 bp, Unknown
  misc_feature (1)..( 12): Result.004 file - promoters50/1018151
ggtctatataag

SEQ ID NO: 156771 - DNA, 12 bp, Unknown
  misc_feature (1)..( 12): Result.004 file - promoters50/1018151
tctctctataaa

SEQ ID NO: 156772 - DNA, 12 bp, Unknown
  misc_feature (1)..( 12): Result.004 file - promoters50/1018151
aagacttataag

SEQ ID NO: 156773 - DNA, 12 bp, Unknown
  misc_feature (1)..( 12): Result.004 file - promoters50/1018151
ggtgtatataat

SEQ ID NO: 156774 - DNA, 8 bp, Unknown
  misc_feature (1)..( 8): Result.004 file - promoters50/1018151
aaaagtaa

SEQ ID NO: 156775 - DNA, 8 bp, Unknown
  misc_feature (1)..( 8): Result.004 file - promoters50/1018151
taaaataa

SEQ ID NO: 156776 - DNA, 8 bp, Unknown
  misc_feature (1)..( 8): Result.004 file - promoters50/1018151
taatataa

SEQ ID NO: 156777 - DNA, 8 bp, Unknown
  misc_feature (1)..( 8): Result.004 file - promoters50/1018155
gaaaatat

SEQ ID NO: 156778 - DNA, 11 bp, Unknown
  misc_feature (1)..( 11): Result.004 file - promoters50/1018155
ttttgtactta

SEQ ID NO: 156779 - DNA, 11 bp, Unknown
  misc_feature (1)..( 11): Result.004 file - promoters50/1018155
ttttatacgtt

SEQ ID NO: 156780 - DNA, 11 bp, Unknown
  misc_feature (1)..( 11): Result.004 file - promoters50/1018155
atttatacatt

SEQ ID NO: 156781 - DNA, 11 bp, Unknown
  misc_feature (1)..( 11): Result.004 file - promoters50/1018155
ctatgtattta

SEQ ID NO: 156782 - DNA, 11 bp, Unknown
  misc_feature (1)..( 11): Result.004 file - promoters50/1018155
ttttgttttcc

SEQ ID NO: 156783 - DNA, 11 bp, Unknown
  misc_feature (1)..( 11): Result.004 file - promoters50/1018155
gattgttacac

SEQ ID NO: 156784 - DNA, 11 bp, Unknown
  misc_feature (1)..( 11): Result.004 file - promoters50/1018155
aaaataaaaat

SEQ ID NO: 156785 - DNA, 11 bp, Unknown
  misc_feature (1)..( 11): Result.004 file - promoters50/1018155
aagttaaaaac

SEQ ID NO: 156786 - DNA, 11 bp, Unknown
  misc_feature (1)..( 11): Result.004 file - promoters50/1018155
aaattaaaaaa

SEQ ID NO: 156787 - DNA, 11 bp, Unknown
  misc_feature (1)..( 11): Result.004 file - promoters50/1018155
gttttacaaat

SEQ ID NO: 156788 - DNA, 11 bp, Unknown
  misc_feature (1)..( 11): Result.004 file - promoters50/1018155
atcttataaaa

SEQ ID NO: 156789 - DNA, 11 bp, Unknown
  misc_feature (1)..( 11): Result.004 file - promoters50/1018155
tttttgcaatg

SEQ ID NO: 156790 - DNA, 10 bp, Unknown
  misc_feature (1)..( 10): Result.004 file - promoters50/1018155
ccaaaaaaaa

SEQ ID NO: 156791 - DNA, 10 bp, Unknown
  misc_feature (1)..( 10): Result.004 file - promoters50/1018155
tcaagaaacg

SEQ ID NO: 156792 - DNA, 11 bp, Unknown
  misc_feature (1)..( 11): Result.004 file - promoters50/1018155
ctaaaacaaat

SEQ ID NO: 156793 - DNA, 11 bp, Unknown
  misc_feature (1)..( 11): Result.004 file - promoters50/1018155
ccaaaacaaaa

SEQ ID NO: 156794 - DNA, 11 bp, Unknown
  misc_feature (1)..( 11): Result.004 file - promoters50/1018155
gcaagaagaag

SEQ ID NO: 156795 - DNA, 11 bp, Unknown
  misc_feature (1)..( 11): Result.004 file - promoters50/1018155
ccaatctagat

SEQ ID NO: 156796 - DNA, 14 bp, Unknown
  misc_feature (1)..( 14): Result.004 file - promoters50/1018155
gggaatataattaa

SEQ ID NO: 156797 - DNA, 14 bp, Unknown
  misc_feature (1)..( 14): Result.004 file - promoters50/1018155
ttacataaaatctg

SEQ ID NO: 156798 - DNA, 14 bp, Unknown
  misc_feature (1)..( 14): Result.004 file - promoters50/1018155
tttaataaaaatca

SEQ ID NO: 156799 - DNA, 14 bp, Unknown
  misc_feature (1)..( 14): Result.004 file - promoters50/1018155
tttaagaaaaaata

SEQ ID NO: 156800 - DNA, 14 bp, Unknown
  misc_feature (1)..( 14): Result.004 file - promoters50/1018155
gcttacaaaaactg

SEQ ID NO: 156801 - DNA, 15 bp, Unknown
  misc_feature (1)..( 15): Result.004 file - promoters50/1018155
agttggaaacaatag

SEQ ID NO: 156802 - DNA, 15 bp, Unknown
  misc_feature (1)..( 15): Result.004 file - promoters50/1018155
tataacaaaaacaat

SEQ ID NO: 156803 - DNA, 11 bp, Unknown
  misc_feature (1)..( 11): Result.004 file - promoters50/1018155
ataaaaatcat

SEQ ID NO: 156804 - DNA, 11 bp, Unknown
  misc_feature (1)..( 11): Result.004 file - promoters50/1018155
cttgaaaacat

SEQ ID NO: 156805 - DNA, 11 bp, Unknown
  misc_feature (1)..( 11): Result.004 file - promoters50/1018155
cataaaatctg

SEQ ID NO: 156806 - DNA, 11 bp, Unknown
  misc_feature (1)..( 11): Result.004 file - promoters50/1018155
tacaaaaactg

SEQ ID NO: 156807 - DNA, 11 bp, Unknown
  misc_feature (1)..( 11): Result.004 file - promoters50/1018155
aataaaaactc

SEQ ID NO: 156808 - DNA, 11 bp, Unknown
  misc_feature (1)..( 11): Result.004 file - promoters50/1018155
aacaaaatctt

SEQ ID NO: 156809 - DNA, 13 bp, Unknown
  misc_feature (1)..( 13): Result.004 file - promoters50/1018155
ttcattttttgca

SEQ ID NO: 156810 - DNA, 13 bp, Unknown
  misc_feature (1)..( 13): Result.004 file - promoters50/1018155
ttaattttttaat

SEQ ID NO: 156811 - DNA, 13 bp, Unknown
  misc_feature (1)..( 13): Result.004 file - promoters50/1018155
tcaatttactcca

SEQ ID NO: 156812 - DNA, 13 bp, Unknown
  misc_feature (1)..( 13): Result.004 file - promoters50/1018155
tgtgtttttgcaa

SEQ ID NO: 156813 - DNA, 13 bp, Unknown
  misc_feature (1)..( 13): Result.004 file - promoters50/1018155
tctctttttaggt

SEQ ID NO: 156814 - DNA, 13 bp, Unknown
  misc_feature (1)..( 13): Result.004 file - promoters50/1018159
aatcgttttacaa

SEQ ID NO: 156815 - DNA, 9 bp, Unknown
  misc_feature (1)..( 9): Result.004 file - promoters50/1018159
gaaatcgaa

SEQ ID NO: 156816 - DNA, 9 bp, Unknown
  misc_feature (1)..( 9): Result.004 file - promoters50/1018159
gaaatcctc

SEQ ID NO: 156817 - DNA, 9 bp, Unknown
  misc_feature (1)..( 9): Result.004 file - promoters50/1018159
gaaattgaa

SEQ ID NO: 156818 - DNA, 9 bp, Unknown
  misc_feature (1)..( 9): Result.004 file - promoters50/1018159
gaaattagg

SEQ ID NO: 156819 - DNA, 8 bp, Unknown
  misc_feature (1)..( 8): Result.004 file - promoters50/1018159
ataaattc

SEQ ID NO: 156820 - DNA, 8 bp, Unknown
  misc_feature (1)..( 8): Result.004 file - promoters50/1018159
gtaatttc

SEQ ID NO: 156821 - DNA, 8 bp, Unknown
  misc_feature (1)..( 8): Result.004 file - promoters50/1018159
ataaattg

SEQ ID NO: 156822 - DNA, 8 bp, Unknown
  misc_feature (1)..( 8): Result.004 file - promoters50/1018163
ataaatga

SEQ ID NO: 156823 - DNA, 12 bp, Unknown
  misc_feature (1)..( 12): Result.004 file - promoters50/1018163
ctcatgaaaaaa

SEQ ID NO: 156824 - DNA, 12 bp, Unknown
  misc_feature (1)..( 12): Result.004 file - promoters50/1018163
ctcatgacggga

SEQ ID NO: 156825 - DNA, 12 bp, Unknown
  misc_feature (1)..( 12): Result.004 file - promoters50/1018190
cacatgaaaaaa

SEQ ID NO: 156826 - DNA, 13 bp, Unknown
  misc_feature (1)..( 13): Result.004 file - promoters50/1018190
ctgatttttttat

SEQ ID NO: 156827 - DNA, 13 bp, Unknown
  misc_feature (1)..( 13): Result.004 file - promoters50/1018190
atcctttttttaa

SEQ ID NO: 156828 - DNA, 13 bp, Unknown
  misc_feature (1)..( 13): Result.004 file - promoters50/1018190
aacatttttcagt

SEQ ID NO: 156829 - DNA, 13 bp, Unknown
  misc_feature (1)..( 13): Result.004 file - promoters50/1018190
tttaattttgtat

SEQ ID NO: 156830 - DNA, 13 bp, Unknown
  misc_feature (1)..( 13): Result.004 file - promoters50/1018190
cgactttgtttgt

SEQ ID NO: 156831 - DNA, 13 bp, Unknown
  misc_feature (1)..( 13): Result.004 file - promoters50/1018206
acaatttaaaaac

SEQ ID NO: 156832 - DNA, 9 bp, Unknown
  misc_feature (1)..( 9): Result.004 file - promoters50/1018206
caatgatcc

SEQ ID NO: 156833 - DNA, 9 bp, Unknown
  misc_feature (1)..( 9): Result.004 file - promoters50/1018206
cattgatcc

SEQ ID NO: 156834 - DNA, 9 bp, Unknown
  misc_feature (1)..( 9): Result.004 file - promoters50/1018206
aaattatca

SEQ ID NO: 156835 - DNA, 9 bp, Unknown
  misc_feature (1)..( 9): Result.004 file - promoters50/1018206
aaaatatga

SEQ ID NO: 156836 - DNA, 9 bp, Unknown
  misc_feature (1)..( 9): Result.004 file - promoters50/1018206
aaatcatcc

SEQ ID NO: 156837 - DNA, 8 bp, Unknown
  misc_feature (1)..( 8): Result.004 file - promoters50/1018206
caatgatc

SEQ ID NO: 156838 - DNA, 8 bp, Unknown
  misc_feature (1)..( 8): Result.004 file - promoters50/1018206
aaatgata

SEQ ID NO: 156839 - DNA, 8 bp, Unknown
  misc_feature (1)..( 8): Result.004 file - promoters50/1018206
aaattatc

SEQ ID NO: 156840 - DNA, 8 bp, Unknown
  misc_feature (1)..( 8): Result.004 file - promoters50/1018206
aaaatatg

SEQ ID NO: 156841 - DNA, 8 bp, Unknown
  misc_feature (1)..( 8): Result.004 file - promoters50/1018206
aaatcatc

SEQ ID NO: 156842 - DNA, 16 bp, Unknown
  misc_feature (1)..( 16): Result.004 file - promoters50/1018206
gaaaaaaaagaaaaaa

SEQ ID NO: 156843 - DNA, 16 bp, Unknown
  misc_feature (1)..( 16): Result.004 file - promoters50/1018206
gaaaaaaaataaaaaa

SEQ ID NO: 156844 - DNA, 16 bp, Unknown
  misc_feature (1)..( 16): Result.004 file - promoters50/1018206
agaaaacaagagaatg

SEQ ID NO: 156845 - DNA, 16 bp, Unknown
  misc_feature (1)..( 16): Result.004 file - promoters50/1018206
atcaaacaaacagttg

SEQ ID NO: 156846 - DNA, 16 bp, Unknown
  misc_feature (1)..( 16): Result.004 file - promoters50/1018206
tcaaaacattatattt

SEQ ID NO: 156847 - DNA, 15 bp, Unknown
  misc_feature (1)..( 15): Result.004 file - promoters50/1018206
aaaaaaagctatatt

SEQ ID NO: 156848 - DNA, 15 bp, Unknown
  misc_feature (1)..( 15): Result.004 file - promoters50/1018206
gttaaaaactaaaaa

SEQ ID NO: 156849 - DNA, 15 bp, Unknown
  misc_feature (1)..( 15): Result.004 file - promoters50/1018206
gaaaaaaaataaaaa

SEQ ID NO: 156850 - DNA, 15 bp, Unknown
  misc_feature (1)..( 15): Result.004 file - promoters50/1018206
aacaaaaccatacag

SEQ ID NO: 156851 - DNA, 15 bp, Unknown
  misc_feature (1)..( 15): Result.004 file - promoters50/1018213
aacaaacagttgaat

SEQ ID NO: 156852 - DNA, 10 bp, Unknown
  misc_feature (1)..( 10): Result.004 file - promoters50/1018213
tattgtatat

SEQ ID NO: 156853 - DNA, 10 bp, Unknown
  misc_feature (1)..( 10): Result.004 file - promoters50/1018213
tatcgtatat

SEQ ID NO: 156854 - DNA, 10 bp, Unknown
  misc_feature (1)..( 10): Result.004 file - promoters50/1018213
aattatataa

SEQ ID NO: 156855 - DNA, 9 bp, Unknown
  misc_feature (1)..( 9): Result.004 file - promoters50/1018213
ttttataat

SEQ ID NO: 156856 - DNA, 9 bp, Unknown
  misc_feature (1)..( 9): Result.004 file - promoters50/1018213
ttttttaat

SEQ ID NO: 156857 - DNA, 9 bp, Unknown
  misc_feature (1)..( 9): Result.004 file - promoters50/1018213
tttttttca

SEQ ID NO: 156858 - DNA, 9 bp, Unknown
  misc_feature (1)..( 9): Result.004 file - promoters50/1018213
acttttaag

SEQ ID NO: 156859 - DNA, 9 bp, Unknown
  misc_feature (1)..( 9): Result.004 file - promoters50/1018213
taaaaaaag

SEQ ID NO: 156860 - DNA, 9 bp, Unknown
  misc_feature (1)..( 9): Result.004 file - promoters50/1018213
taagaaatt

SEQ ID NO: 156861 - DNA, 9 bp, Unknown
  misc_feature (1)..( 9): Result.004 file - promoters50/1018213
ctagacatt

SEQ ID NO: 156862 - DNA, 8 bp, Unknown
  misc_feature (1)..( 8): Result.004 file - promoters50/1018213
agaaattg

SEQ ID NO: 156863 - DNA, 8 bp, Unknown
  misc_feature (1)..( 8): Result.004 file - promoters50/1018213
agacattg

SEQ ID NO: 156864 - DNA, 8 bp, Unknown
  misc_feature (1)..( 8): Result.004 file - promoters50/1018213
agaaatta

SEQ ID NO: 156865 - DNA, 8 bp, Unknown
  misc_feature (1)..( 8): Result.004 file - promoters50/1018213
aatatttt

SEQ ID NO: 156866 - DNA, 8 bp, Unknown
  misc_feature (1)..( 8): Result.004 file - promoters50/1018213
aatttttt

SEQ ID NO: 156867 - DNA, 8 bp, Unknown
  misc_feature (1)..( 8): Result.004 file - promoters50/1018213
aatttttt

SEQ ID NO: 156868 - DNA, 11 bp, Unknown
  misc_feature (1)..( 11): Result.004 file - promoters50/1018213
ggacaagaatt

SEQ ID NO: 156869 - DNA, 11 bp, Unknown
  misc_feature (1)..( 11): Result.004 file - promoters50/1018213
atccaaaaata

SEQ ID NO: 156870 - DNA, 11 bp, Unknown
  misc_feature (1)..( 11): Result.004 file - promoters50/1018213
tcccaaaacta

SEQ ID NO: 156871 - DNA, 11 bp, Unknown
  misc_feature (1)..( 11): Result.004 file - promoters50/1018217
cgaaaaaaata

SEQ ID NO: 156872 - DNA, 11 bp, Unknown
  misc_feature (1)..( 11): Result.004 file - promoters50/1018217
atagaaaatat

SEQ ID NO: 156873 - DNA, 11 bp, Unknown
  misc_feature (1)..( 11): Result.004 file - promoters50/1018217
tacataaatat

SEQ ID NO: 156874 - DNA, 11 bp, Unknown
  misc_feature (1)..( 11): Result.004 file - promoters50/1018217
ataaaaaataa

SEQ ID NO: 156875 - DNA, 8 bp, Unknown
  misc_feature (1)..( 8): Result.004 file - promoters50/1018217
aaaaaaaa

SEQ ID NO: 156876 - DNA, 8 bp, Unknown
  misc_feature (1)..( 8): Result.004 file - promoters50/1018217
aaaaaaaa

SEQ ID NO: 156877 - DNA, 8 bp, Unknown
  misc_feature (1)..( 8): Result.004 file - promoters50/1018217
acataaat

SEQ ID NO: 156878 - DNA, 8 bp, Unknown
  misc_feature (1)..( 8): Result.004 file - promoters50/1018217
tcaaatgg

SEQ ID NO: 156879 - DNA, 8 bp, Unknown
  misc_feature (1)..( 8): Result.004 file - promoters50/1018217
tcaaatct

SEQ ID NO: 156880 - DNA, 8 bp, Unknown
  misc_feature (1)..( 8): Result.004 file - promoters50/1018220
acaaatct

SEQ ID NO: 156881 - DNA, 12 bp, Unknown
  misc_feature (1)..( 12): Result.004 file - promoters50/1018220
tgttgtaagttt

SEQ ID NO: 156882 - DNA, 12 bp, Unknown
  misc_feature (1)..( 12): Result.004 file - promoters50/1018220
acttgtcagttt

SEQ ID NO: 156883 - DNA, 12 bp, Unknown
  misc_feature (1)..( 12): Result.004 file - promoters50/1018220
tgttttaaaact

SEQ ID NO: 156884 - DNA, 9 bp, Unknown
  misc_feature (1)..( 9): Result.004 file - promoters50/1018220
tcaatttta

SEQ ID NO: 156885 - DNA, 9 bp, Unknown
  misc_feature (1)..( 9): Result.004 file - promoters50/1018220
tcattttta

SEQ ID NO: 156886 - DNA, 9 bp, Unknown
  misc_feature (1)..( 9): Result.004 file - promoters50/1018220
tcattttcg

SEQ ID NO: 156887 - DNA, 11 bp, Unknown
  misc_feature (1)..( 11): Result.004 file - promoters50/1018220
ttaccatgcaa

SEQ ID NO: 156888 - DNA, 11 bp, Unknown
  misc_feature (1)..( 11): Result.004 file - promoters50/1018220
atcaaatgcaa

SEQ ID NO: 156889 - DNA, 11 bp, Unknown
  misc_feature (1)..( 11): Result.004 file - promoters50/1018220
atctaattcaa

SEQ ID NO: 156890 - DNA, 8 bp, Unknown
  misc_feature (1)..( 8): Result.004 file - promoters50/1018220
aagtaaac

SEQ ID NO: 156891 - DNA, 8 bp, Unknown
  misc_feature (1)..( 8): Result.004 file - promoters50/1018220
tagttaac

SEQ ID NO: 156892 - DNA, 8 bp, Unknown
  misc_feature (1)..( 8): Result.004 file - promoters50/1018220
aagaaaac

SEQ ID NO: 156893 - DNA, 7 bp, Unknown
  misc_feature (1)..( 7): Result.004 file - promoters50/1018220
gagatag

SEQ ID NO: 156894 - DNA, 7 bp, Unknown
  misc_feature (1)..( 7): Result.004 file - promoters50/1018220
tagatag

SEQ ID NO: 156895 - DNA, 7 bp, Unknown
  misc_feature (1)..( 7): Result.004 file - promoters50/1018220
tagatat

SEQ ID NO: 156896 - DNA, 11 bp, Unknown
  misc_feature (1)..( 11): Result.004 file - promoters50/1018220
taaaagtaacg

SEQ ID NO: 156897 - DNA, 11 bp, Unknown
  misc_feature (1)..( 11): Result.004 file - promoters50/1018220
tttaagaaacg

SEQ ID NO: 156898 - DNA, 11 bp, Unknown
  misc_feature (1)..( 11): Result.004 file - promoters50/1018220
tttaaaaaaat

SEQ ID NO: 156899 - DNA, 9 bp, Unknown
  misc_feature (1)..( 9): Result.004 file - promoters50/1018220
atagaaaat

SEQ ID NO: 156900 - DNA, 9 bp, Unknown
  misc_feature (1)..( 9): Result.004 file - promoters50/1018220
tcagaaaat

SEQ ID NO: 156901 - DNA, 9 bp, Unknown
  misc_feature (1)..( 9): Result.004 file - promoters50/1018276
tcataaagc

SEQ ID NO: 156902 - DNA, 10 bp, Unknown
  misc_feature (1)..( 10): Result.004 file - promoters50/1018276
tcatttgtat

SEQ ID NO: 156903 - DNA, 10 bp, Unknown
  misc_feature (1)..( 10): Result.004 file - promoters50/1018276
tcatgtgtaa

SEQ ID NO: 156904 - DNA, 10 bp, Unknown
  misc_feature (1)..( 10): Result.004 file - promoters50/1018276
gaatttgttt

SEQ ID NO: 156905 - DNA, 10 bp, Unknown
  misc_feature (1)..( 10): Result.004 file - promoters50/1018276
atatttgttg

SEQ ID NO: 156906 - DNA, 10 bp, Unknown
  misc_feature (1)..( 10): Result.004 file - promoters50/1018276
aaatttatat

SEQ ID NO: 156907 - DNA, 10 bp, Unknown
  misc_feature (1)..( 10): Result.004 file - promoters50/1018276
ttatttattt

SEQ ID NO: 156908 - DNA, 20 bp, Unknown
  misc_feature (1)..( 20): Result.004 file - promoters50/1018276
aaaaacaaaaagtaaaacaa

SEQ ID NO: 156909 - DNA, 20 bp, Unknown
  misc_feature (1)..( 20): Result.004 file - promoters50/1018276
ttttgtgaaatgtattttgt

SEQ ID NO: 156910 - DNA, 20 bp, Unknown
  misc_feature (1)..( 20): Result.004 file - promoters50/1018276
atcaccaaaatctataatct

SEQ ID NO: 156911 - DNA, 20 bp, Unknown
  misc_feature (1)..( 20): Result.004 file - promoters50/1018276
ttttgtcaaatgatgaaata

SEQ ID NO: 156912 - DNA, 20 bp, Unknown
  misc_feature (1)..( 20): Result.004 file - promoters50/1018276
atcgtcttgctctgattttg

SEQ ID NO: 156913 - DNA, 20 bp, Unknown
  misc_feature (1)..( 20): Result.004 file - promoters50/1018382
atgtgttaaaagacttaaag

SEQ ID NO: 156914 - DNA, 9 bp, Unknown
  misc_feature (1)..( 9): Result.004 file - promoters50/1018382
aaaatattg

SEQ ID NO: 156915 - DNA, 9 bp, Unknown
  misc_feature (1)..( 9): Result.004 file - promoters50/1018382
ataatatta

SEQ ID NO: 156916 - DNA, 9 bp, Unknown
  misc_feature (1)..( 9): Result.004 file - promoters50/1018382
aaaaaattg

SEQ ID NO: 156917 - DNA, 9 bp, Unknown
  misc_feature (1)..( 9): Result.004 file - promoters50/1018382
taaataaaa

SEQ ID NO: 156918 - DNA, 12 bp, Unknown
  misc_feature (1)..( 12): Result.004 file - promoters50/1018382
aaaatattgtta

SEQ ID NO: 156919 - DNA, 12 bp, Unknown
  misc_feature (1)..( 12): Result.004 file - promoters50/1018382
agtttattatta

SEQ ID NO: 156920 - DNA, 12 bp, Unknown
  misc_feature (1)..( 12): Result.004 file - promoters50/1018382
aaaaaattggtc

SEQ ID NO: 156921 - DNA, 12 bp, Unknown
  misc_feature (1)..( 12): Result.004 file - promoters50/1018382
ttaatattttct

SEQ ID NO: 156922 - DNA, 13 bp, Unknown
  misc_feature (1)..( 13): Result.004 file - promoters50/1018382
aaatttgtaattt

SEQ ID NO: 156923 - DNA, 13 bp, Unknown
  misc_feature (1)..( 13): Result.004 file - promoters50/1018382
aaatttgttattt

SEQ ID NO: 156924 - DNA, 13 bp, Unknown
  misc_feature (1)..( 13): Result.004 file - promoters50/1018382
aaatctgtatttt

SEQ ID NO: 156925 - DNA, 13 bp, Unknown
  misc_feature (1)..( 13): Result.004 file - promoters50/1018382
ctttttgtttggt

SEQ ID NO: 156926 - DNA, 13 bp, Unknown
  misc_feature (1)..( 13): Result.004 file - promoters50/1018382
ctcgctgtattat

SEQ ID NO: 156927 - DNA, 9 bp, Unknown
  misc_feature (1)..( 9): Result.004 file - promoters50/1018382
atttactat

SEQ ID NO: 156928 - DNA, 9 bp, Unknown
  misc_feature (1)..( 9): Result.004 file - promoters50/1018382
ttttactac

SEQ ID NO: 156929 - DNA, 9 bp, Unknown
  misc_feature (1)..( 9): Result.004 file - promoters50/1018382
ctttattat

SEQ ID NO: 156930 - DNA, 9 bp, Unknown
  misc_feature (1)..( 9): Result.004 file - promoters50/1018382
ttttaccag

SEQ ID NO: 156931 - DNA, 14 bp, Unknown
  misc_feature (1)..( 14): Result.004 file - promoters50/1018382
gattataaaaaaaa

SEQ ID NO: 156932 - DNA, 14 bp, Unknown
  misc_feature (1)..( 14): Result.004 file - promoters50/1018382
gtttacaaaacaaa

SEQ ID NO: 156933 - DNA, 14 bp, Unknown
  misc_feature (1)..( 14): Result.004 file - promoters50/1018382
ggatatcaaaaaat

SEQ ID NO: 156934 - DNA, 14 bp, Unknown
  misc_feature (1)..( 14): Result.004 file - promoters50/1018382
tgttacaaattttc

SEQ ID NO: 156935 - DNA, 14 bp, Unknown
  misc_feature (1)..( 14): Result.004 file - promoters50/1018391
tgttacatccaaat

SEQ ID NO: 156936 - DNA, 12 bp, Unknown
  misc_feature (1)..( 12): Result.004 file - promoters50/1018391
ccctatatatcc

SEQ ID NO: 156937 - DNA, 12 bp, Unknown
  misc_feature (1)..( 12): Result.004 file - promoters50/1018391
cccaataacgaa

SEQ ID NO: 156938 - DNA, 12 bp, Unknown
  misc_feature (1)..( 12): Result.004 file - promoters50/1018391
acctaaataata

SEQ ID NO: 156939 - DNA, 12 bp, Unknown
  misc_feature (1)..( 12): Result.004 file - promoters50/1018391
aactatacataa

SEQ ID NO: 156940 - DNA, 12 bp, Unknown
  misc_feature (1)..( 12): Result.004 file - promoters50/1018391
gcctgaatcata

SEQ ID NO: 156941 - DNA, 12 bp, Unknown
  misc_feature (1)..( 12): Result.004 file - promoters50/1018454
atgtaattaaat

SEQ ID NO: 156942 - DNA, 12 bp, Unknown
  misc_feature (1)..( 12): Result.004 file - promoters50/1018454
agtcttttgtgc

SEQ ID NO: 156943 - DNA, 12 bp, Unknown
  misc_feature (1)..( 12): Result.004 file - promoters50/1018454
cccattttctgc

SEQ ID NO: 156944 - DNA, 12 bp, Unknown
  misc_feature (1)..( 12): Result.004 file - promoters50/1018454
catattatctat

SEQ ID NO: 156945 - DNA, 12 bp, Unknown
  misc_feature (1)..( 12): Result.004 file - promoters50/1018454
ttggttatctat

SEQ ID NO: 156946 - DNA, 12 bp, Unknown
  misc_feature (1)..( 12): Result.004 file - promoters50/1018454
cccagtttcatt

SEQ ID NO: 156947 - DNA, 12 bp, Unknown
  misc_feature (1)..( 12): Result.004 file - promoters50/1018454
taaattttcaat

SEQ ID NO: 156948 - DNA, 11 bp, Unknown
  misc_feature (1)..( 11): Result.004 file - promoters50/1018454
acaaaaatatg

SEQ ID NO: 156949 - DNA, 11 bp, Unknown
  misc_feature (1)..( 11): Result.004 file - promoters50/1018454
tgaaaattatt

SEQ ID NO: 156950 - DNA, 11 bp, Unknown
  misc_feature (1)..( 11): Result.004 file - promoters50/1018454
ttaaaaatatg

SEQ ID NO: 156951 - DNA, 11 bp, Unknown
  misc_feature (1)..( 11): Result.004 file - promoters50/1018454
agaaaatggtt

SEQ ID NO: 156952 - DNA, 11 bp, Unknown
  misc_feature (1)..( 11): Result.004 file - promoters50/1018454
agacaataaga

SEQ ID NO: 156953 - DNA, 11 bp, Unknown
  misc_feature (1)..( 11): Result.004 file - promoters50/1018472
ggaaaatttca

SEQ ID NO: 156954 - DNA, 12 bp, Unknown
  misc_feature (1)..( 12): Result.004 file - promoters50/1018472
aaatcttcaaat

SEQ ID NO: 156955 - DNA, 12 bp, Unknown
  misc_feature (1)..( 12): Result.004 file - promoters50/1018472
gttatttcaaat

SEQ ID NO: 156956 - DNA, 12 bp, Unknown
  misc_feature (1)..( 12): Result.004 file - promoters50/1018472
aaattttcaata

SEQ ID NO: 156957 - DNA, 12 bp, Unknown
  misc_feature (1)..( 12): Result.004 file - promoters50/1018472
tccaattaaatt

SEQ ID NO: 156958 - DNA, 9 bp, Unknown
  misc_feature (1)..( 9): Result.004 file - promoters50/1018472
aaaaaaaat

SEQ ID NO: 156959 - DNA, 9 bp, Unknown
  misc_feature (1)..( 9): Result.004 file - promoters50/1018472
aaaacaaat

SEQ ID NO: 156960 - DNA, 9 bp, Unknown
  misc_feature (1)..( 9): Result.004 file - promoters50/1018472
ttgaaaaat

SEQ ID NO: 156961 - DNA, 6 bp, Unknown
  misc_feature (1)..( 6): Result.004 file - promoters50/1018472
taaatt

SEQ ID NO: 156962 - DNA, 6 bp, Unknown
  misc_feature (1)..( 6): Result.004 file - promoters50/1018472
taaatt

SEQ ID NO: 156963 - DNA, 6 bp, Unknown
  misc_feature (1)..( 6): Result.004 file - promoters50/1018472
taaatt

SEQ ID NO: 156964 - DNA, 8 bp, Unknown
  misc_feature (1)..( 8): Result.004 file - promoters50/1018472
acaaaaaa

SEQ ID NO: 156965 - DNA, 8 bp, Unknown
  misc_feature (1)..( 8): Result.004 file - promoters50/1018472
acaaaatt

SEQ ID NO: 156966 - DNA, 8 bp, Unknown
  misc_feature (1)..( 8): Result.004 file - promoters50/1018472
acaacatt

SEQ ID NO: 156967 - DNA, 7 bp, Unknown
  misc_feature (1)..( 7): Result.004 file - promoters50/1018472
gtcaatt

SEQ ID NO: 156968 - DNA, 7 bp, Unknown
  misc_feature (1)..( 7): Result.004 file - promoters50/1018472
ctcaatt

SEQ ID NO: 156969 - DNA, 7 bp, Unknown
  misc_feature (1)..( 7): Result.004 file - promoters50/1018472
ctcaatg

SEQ ID NO: 156970 - DNA, 9 bp, Unknown
  misc_feature (1)..( 9): Result.004 file - promoters50/1018472
agatatttt

SEQ ID NO: 156971 - DNA, 9 bp, Unknown
  misc_feature (1)..( 9): Result.004 file - promoters50/1018472
agatattct

SEQ ID NO: 156972 - DNA, 9 bp, Unknown
  misc_feature (1)..( 9): Result.004 file - promoters50/1018472
tcatatttt

SEQ ID NO: 156973 - DNA, 7 bp, Unknown
  misc_feature (1)..( 7): Result.004 file - promoters50/1018472
ataaata

SEQ ID NO: 156974 - DNA, 7 bp, Unknown
  misc_feature (1)..( 7): Result.004 file - promoters50/1018472
ataaata

SEQ ID NO: 156975 - DNA, 7 bp, Unknown
  misc_feature (1)..( 7): Result.004 file - promoters50/1018523
ataaatt

SEQ ID NO: 156976 - DNA, 10 bp, Unknown
  misc_feature (1)..( 10): Result.004 file - promoters50/1018523
taaaaattaa

SEQ ID NO: 156977 - DNA, 10 bp, Unknown
  misc_feature (1)..( 10): Result.004 file - promoters50/1018523
taaaaatctc

SEQ ID NO: 156978 - DNA, 10 bp, Unknown
  misc_feature (1)..( 10): Result.004 file - promoters50/1018523
gtaaaatttc

SEQ ID NO: 156979 - DNA, 10 bp, Unknown
  misc_feature (1)..( 10): Result.004 file - promoters50/1018523
taacaattct

SEQ ID NO: 156980 - DNA, 10 bp, Unknown
  misc_feature (1)..( 10): Result.004 file - promoters50/1018523
aaaatattaa

SEQ ID NO: 156981 - DNA, 10 bp, Unknown
  misc_feature (1)..( 10): Result.004 file - promoters50/1018523
ataagattag

SEQ ID NO: 156982 - DNA, 10 bp, Unknown
  misc_feature (1)..( 10): Result.004 file - promoters50/1018523
ttaagatctt

SEQ ID NO: 156983 - DNA, 12 bp, Unknown
  misc_feature (1)..( 12): Result.004 file - promoters50/1018523
agttaaaaaata

SEQ ID NO: 156984 - DNA, 12 bp, Unknown
  misc_feature (1)..( 12): Result.004 file - promoters50/1018523
agttaatatata

SEQ ID NO: 156985 - DNA, 12 bp, Unknown
  misc_feature (1)..( 12): Result.004 file - promoters50/1018523
agttaaaaagtg

SEQ ID NO: 156986 - DNA, 12 bp, Unknown
  misc_feature (1)..( 12): Result.004 file - promoters50/1018523
tgttattatatt

SEQ ID NO: 156987 - DNA, 12 bp, Unknown
  misc_feature (1)..( 12): Result.004 file - promoters50/1018523
gaaaaaaaagac

SEQ ID NO: 156988 - DNA, 12 bp, Unknown
  misc_feature (1)..( 12): Result.004 file - promoters50/1018523
atgaaaaacaaa

SEQ ID NO: 156989 - DNA, 12 bp, Unknown
  misc_feature (1)..( 12): Result.004 file - promoters50/1018523
agttatttaaaa

SEQ ID NO: 156990 - DNA, 9 bp, Unknown
  misc_feature (1)..( 9): Result.004 file - promoters50/1018523
tacaaaaaa

SEQ ID NO: 156991 - DNA, 9 bp, Unknown
  misc_feature (1)..( 9): Result.004 file - promoters50/1018523
cccaaaaat

SEQ ID NO: 156992 - DNA, 9 bp, Unknown
  misc_feature (1)..( 9): Result.004 file - promoters50/1018523
aacaaaaaa

SEQ ID NO: 156993 - DNA, 10 bp, Unknown
  misc_feature (1)..( 10): Result.004 file - promoters50/1018523
gacaaataaa

SEQ ID NO: 156994 - DNA, 10 bp, Unknown
  misc_feature (1)..( 10): Result.004 file - promoters50/1018523
tacaaaacta

SEQ ID NO: 156995 - DNA, 10 bp, Unknown
  misc_feature (1)..( 10): Result.004 file - promoters50/1018523
tcctaaaatc

SEQ ID NO: 156996 - DNA, 12 bp, Unknown
  misc_feature (1)..( 12): Result.004 file - promoters50/1018523
aaacaataaaat

SEQ ID NO: 156997 - DNA, 12 bp, Unknown
  misc_feature (1)..( 12): Result.004 file - promoters50/1018523
aaacagtaaaac

SEQ ID NO: 156998 - DNA, 12 bp, Unknown
  misc_feature (1)..( 12): Result.004 file - promoters50/1018523
agataatatttc

SEQ ID NO: 156999 - DNA, 12 bp, Unknown
  misc_feature (1)..( 12): Result.004 file - promoters50/1018523
cgtcaaaaaact

SEQ ID NO: 157000 - DNA, 12 bp, Unknown
  misc_feature (1)..( 12): Result.004 file - promoters50/1018523
acattataaaat

SEQ ID NO: 157001 - DNA, 12 bp, Unknown
  misc_feature (1)..( 12): Result.004 file - promoters50/1018523
gaaaaataaata

SEQ ID NO: 157002 - DNA, 10 bp, Unknown
  misc_feature (1)..( 10): Result.004 file - promoters50/1018523
attaatattt

SEQ ID NO: 157003 - DNA, 10 bp, Unknown
  misc_feature (1)..( 10): Result.004 file - promoters50/1018523
attaataaag

SEQ ID NO: 157004 - DNA, 10 bp, Unknown
  misc_feature (1)..( 10): Result.004 file - promoters50/1018523
gataatattt

SEQ ID NO: 157005 - DNA, 10 bp, Unknown
  misc_feature (1)..( 10): Result.004 file - promoters50/1018523
tttattatag

SEQ ID NO: 157006 - DNA, 10 bp, Unknown
  misc_feature (1)..( 10): Result.004 file - promoters50/1018523
aaaaataaat

SEQ ID NO: 157007 - DNA, 10 bp, Unknown
  misc_feature (1)..( 10): Result.004 file - promoters50/1018523
tttattttat

SEQ ID NO: 157008 - DNA, 10 bp, Unknown
  misc_feature (1)..( 10): Result.004 file - promoters50/1018523
tatatcacaa

SEQ ID NO: 157009 - DNA, 10 bp, Unknown
  misc_feature (1)..( 10): Result.004 file - promoters50/1018523
tacattgtag

SEQ ID NO: 157010 - DNA, 15 bp, Unknown
  misc_feature (1)..( 15): Result.004 file - promoters50/1018523
ataaataaatttttg

SEQ ID NO: 157011 - DNA, 15 bp, Unknown
  misc_feature (1)..( 15): Result.004 file - promoters50/1018523
tcaaacaaatgtttg

SEQ ID NO: 157012 - DNA, 15 bp, Unknown
  misc_feature (1)..( 15): Result.004 file - promoters50/1018523
ttaactaatttctta

SEQ ID NO: 157013 - DNA, 15 bp, Unknown
  misc_feature (1)..( 15): Result.004 file - promoters50/1018523
ttaaaaaaagaagaa

SEQ ID NO: 157014 - DNA, 15 bp, Unknown
  misc_feature (1)..( 15): Result.004 file - promoters50/1018523
atacatatactgtat

SEQ ID NO: 157015 - DNA, 15 bp, Unknown
  misc_feature (1)..( 15): Result.004 file - promoters50/1018523
aaaaacaaacgtgga

SEQ ID NO: 157016 - DNA, 16 bp, Unknown
  misc_feature (1)..( 16): Result.004 file - promoters50/1018523
ataatataactcttgg

SEQ ID NO: 157017 - DNA, 16 bp, Unknown
  misc_feature (1)..( 16): Result.004 file - promoters50/1018523
ggaaaaaaaagacaaa

SEQ ID NO: 157018 - DNA, 14 bp, Unknown
  misc_feature (1)..( 14): Result.004 file - promoters50/1018523
aaaaatattattag

SEQ ID NO: 157019 - DNA, 14 bp, Unknown
  misc_feature (1)..( 14): Result.004 file - promoters50/1018523
tttgttattatatt

SEQ ID NO: 157020 - DNA, 14 bp, Unknown
  misc_feature (1)..( 14): Result.004 file - promoters50/1018523
agtgatataattat

SEQ ID NO: 157021 - DNA, 14 bp, Unknown
  misc_feature (1)..( 14): Result.004 file - promoters50/1018523
cgtcatattattag

SEQ ID NO: 157022 - DNA, 14 bp, Unknown
  misc_feature (1)..( 14): Result.004 file - promoters50/1018523
gttaatatatattt

SEQ ID NO: 157023 - DNA, 14 bp, Unknown
  misc_feature (1)..( 14): Result.004 file - promoters50/1018523
tggattatcatttt

SEQ ID NO: 157024 - DNA, 14 bp, Unknown
  misc_feature (1)..( 14): Result.004 file - promoters50/1018523
gggctaaaaatgac

SEQ ID NO: 157025 - DNA, 14 bp, Unknown
  misc_feature (1)..( 14): Result.004 file - promoters50/1018523
atagaaaaaaagac

SEQ ID NO: 157026 - DNA, 14 bp, Unknown
  misc_feature (1)..( 14): Result.004 file - promoters50/1018523
gtttcaaatacaag

SEQ ID NO: 157027 - DNA, 14 bp, Unknown
  misc_feature (1)..( 14): Result.004 file - promoters50/1018523
agatcaaataggtc

SEQ ID NO: 157028 - DNA, 14 bp, Unknown
  misc_feature (1)..( 14): Result.004 file - promoters50/1018523
gtttccaatatgtt

SEQ ID NO: 157029 - DNA, 14 bp, Unknown
  misc_feature (1)..( 14): Result.004 file - promoters50/1018523
aattggaagccaaa

SEQ ID NO: 157030 - DNA, 10 bp, Unknown
  misc_feature (1)..( 10): Result.004 file - promoters50/1018523
aataatataa

SEQ ID NO: 157031 - DNA, 10 bp, Unknown
  misc_feature (1)..( 10): Result.004 file - promoters50/1018523
aatgatattc

SEQ ID NO: 157032 - DNA, 10 bp, Unknown
  misc_feature (1)..( 10): Result.004 file - promoters50/1018523
aatttaacta

SEQ ID NO: 157033 - DNA, 10 bp, Unknown
  misc_feature (1)..( 10): Result.004 file - promoters50/1018523
aatgaaattc

SEQ ID NO: 157034 - DNA, 10 bp, Unknown
  misc_feature (1)..( 10): Result.004 file - promoters50/1018523
tttgatatat

SEQ ID NO: 157035 - DNA, 10 bp, Unknown
  misc_feature (1)..( 10): Result.004 file - promoters50/1018523
aatgaaaaac

SEQ ID NO: 157036 - DNA, 9 bp, Unknown
  misc_feature (1)..( 9): Result.004 file - promoters50/1018523
atatatact

SEQ ID NO: 157037 - DNA, 9 bp, Unknown
  misc_feature (1)..( 9): Result.004 file - promoters50/1018523
ctatatata

SEQ ID NO: 157038 - DNA, 9 bp, Unknown
  misc_feature (1)..( 9): Result.004 file - promoters50/1018523
ttataaact

SEQ ID NO: 157039 - DNA, 9 bp, Unknown
  misc_feature (1)..( 9): Result.004 file - promoters50/1018523
ttatatata

SEQ ID NO: 157040 - DNA, 9 bp, Unknown
  misc_feature (1)..( 9): Result.004 file - promoters50/1018523
ctataaatt

SEQ ID NO: 157041 - DNA, 9 bp, Unknown
  misc_feature (1)..( 9): Result.004 file - promoters50/1018529
ttaaaaacc

SEQ ID NO: 157042 - DNA, 15 bp, Unknown
  misc_feature (1)..( 15): Result.004 file - promoters50/1018529
cttatttaattgtta

SEQ ID NO: 157043 - DNA, 15 bp, Unknown
  misc_feature (1)..( 15): Result.004 file - promoters50/1018529
cttttttaaaaaact

SEQ ID NO: 157044 - DNA, 16 bp, Unknown
  misc_feature (1)..( 16): Result.004 file - promoters50/1018529
aagtatataaaatatt

SEQ ID NO: 157045 - DNA, 16 bp, Unknown
  misc_feature (1)..( 16): Result.004 file - promoters50/1018529
atgaatttaaagcttc

SEQ ID NO: 157046 - DNA, 16 bp, Unknown
  misc_feature (1)..( 16): Result.004 file - promoters50/1018529
attcatttgagtaaac

SEQ ID NO: 157047 - DNA, 16 bp, Unknown
  misc_feature (1)..( 16): Result.004 file - promoters50/1018536
attacgttaagaatat

SEQ ID NO: 157048 - DNA, 14 bp, Unknown
  misc_feature (1)..( 14): Result.004 file - promoters50/1018536
tgcattagttcttc

SEQ ID NO: 157049 - DNA, 14 bp, Unknown
  misc_feature (1)..( 14): Result.004 file - promoters50/1018536
taaatttgttatgt

SEQ ID NO: 157050 - DNA, 14 bp, Unknown
  misc_feature (1)..( 14): Result.004 file - promoters50/1018536
gttattagttaacc

SEQ ID NO: 157051 - DNA, 14 bp, Unknown
  misc_feature (1)..( 14): Result.004 file - promoters50/1018536
tataattgttaatc

SEQ ID NO: 157052 - DNA, 14 bp, Unknown
  misc_feature (1)..( 14): Result.004 file - promoters50/1018536
taaattttttaaaa

SEQ ID NO: 157053 - DNA, 14 bp, Unknown
  misc_feature (1)..( 14): Result.004 file - promoters50/1018536
tatacgttttaaaa

SEQ ID NO: 157054 - DNA, 15 bp, Unknown
  misc_feature (1)..( 15): Result.004 file - promoters50/1018536
aaacttataattatg

SEQ ID NO: 157055 - DNA, 15 bp, Unknown
  misc_feature (1)..( 15): Result.004 file - promoters50/1018536
atctttataagtata

SEQ ID NO: 157056 - DNA, 15 bp, Unknown
  misc_feature (1)..( 15): Result.004 file - promoters50/1018536
caaataataataatg

SEQ ID NO: 157057 - DNA, 15 bp, Unknown
  misc_feature (1)..( 15): Result.004 file - promoters50/1018536
aaatttgtaacttca

SEQ ID NO: 157058 - DNA, 15 bp, Unknown
  misc_feature (1)..( 15): Result.004 file - promoters50/1018536
cgttttaaaagtaag

SEQ ID NO: 157059 - DNA, 15 bp, Unknown
  misc_feature (1)..( 15): Result.004 file - promoters50/1018536
gctaatataagtaac

SEQ ID NO: 157060 - DNA, 15 bp, Unknown
  misc_feature (1)..( 15): Result.004 file - promoters50/1018536
atctttatacaaaac

SEQ ID NO: 157061 - DNA, 15 bp, Unknown
  misc_feature (1)..( 15): Result.004 file - promoters50/1018536
tatgttattagttaa

SEQ ID NO: 157062 - DNA, 12 bp, Unknown
  misc_feature (1)..( 12): Result.004 file - promoters50/1018536
tatataaacaaa

SEQ ID NO: 157063 - DNA, 12 bp, Unknown
  misc_feature (1)..( 12): Result.004 file - promoters50/1018536
cctataaatatc

SEQ ID NO: 157064 - DNA, 12 bp, Unknown
  misc_feature (1)..( 12): Result.004 file - promoters50/1018536
tatataataacc

SEQ ID NO: 157065 - DNA, 12 bp, Unknown
  misc_feature (1)..( 12): Result.004 file - promoters50/1018536
tatataaatgac

SEQ ID NO: 157066 - DNA, 12 bp, Unknown
  misc_feature (1)..( 12): Result.004 file - promoters50/1018536
tttataaataaa

SEQ ID NO: 157067 - DNA, 12 bp, Unknown
  misc_feature (1)..( 12): Result.004 file - promoters50/1018536
acgataaatatc

SEQ ID NO: 157068 - DNA, 13 bp, Unknown
  misc_feature (1)..( 13): Result.004 file - promoters50/1018536
ttttgaagaattt

SEQ ID NO: 157069 - DNA, 13 bp, Unknown
  misc_feature (1)..( 13): Result.004 file - promoters50/1018536
ttttgatgaatgt

SEQ ID NO: 157070 - DNA, 13 bp, Unknown
  misc_feature (1)..( 13): Result.004 file - promoters50/1018536
tatttatgacgag

SEQ ID NO: 157071 - DNA, 13 bp, Unknown
  misc_feature (1)..( 13): Result.004 file - promoters50/1018536
atttgctgaataa

SEQ ID NO: 157072 - DNA, 13 bp, Unknown
  misc_feature (1)..( 13): Result.004 file - promoters50/1018536
cccttgtgaatgt

SEQ ID NO: 157073 - DNA, 13 bp, Unknown
  misc_feature (1)..( 13): Result.004 file - promoters50/1018536
aaaagatgaagtc

SEQ ID NO: 157074 - DNA, 18 bp, Unknown
  misc_feature (1)..( 18): Result.004 file - promoters50/1018536
aaaatgttagataggaaa

SEQ ID NO: 157075 - DNA, 18 bp, Unknown
  misc_feature (1)..( 18): Result.004 file - promoters50/1018536
taaattttaaaattattc

SEQ ID NO: 157076 - DNA, 18 bp, Unknown
  misc_feature (1)..( 18): Result.004 file - promoters50/1018536
taaattttgaaataattt

SEQ ID NO: 157077 - DNA, 18 bp, Unknown
  misc_feature (1)..( 18): Result.004 file - promoters50/1018536
accattgtgaaataattt

SEQ ID NO: 157078 - DNA, 18 bp, Unknown
  misc_feature (1)..( 18): Result.004 file - promoters50/1018536
taaattttttaaaatata

SEQ ID NO: 157079 - DNA, 18 bp, Unknown
  misc_feature (1)..( 18): Result.004 file - promoters50/1018536
ttgattctaaaatattgt

SEQ ID NO: 157080 - DNA, 9 bp, Unknown
  misc_feature (1)..( 9): Result.004 file - promoters50/1018536
gtaatgtaa

SEQ ID NO: 157081 - DNA, 9 bp, Unknown
  misc_feature (1)..( 9): Result.004 file - promoters50/1018536
tgaatgtat

SEQ ID NO: 157082 - DNA, 9 bp, Unknown
  misc_feature (1)..( 9): Result.004 file - promoters50/1018536
ctaatataa

SEQ ID NO: 157083 - DNA, 9 bp, Unknown
  misc_feature (1)..( 9): Result.004 file - promoters50/1018536
ctaatgtga

SEQ ID NO: 157084 - DNA, 9 bp, Unknown
  misc_feature (1)..( 9): Result.004 file - promoters50/1018536
tgaatgtca

SEQ ID NO: 157085 - DNA, 9 bp, Unknown
  misc_feature (1)..( 9): Result.004 file - promoters50/1018536
ataatgtaa

SEQ ID NO: 157086 - DNA, 12 bp, Unknown
  misc_feature (1)..( 12): Result.004 file - promoters50/1018536
atttaaatgtca

SEQ ID NO: 157087 - DNA, 12 bp, Unknown
  misc_feature (1)..( 12): Result.004 file - promoters50/1018536
ctaaaaatatca

SEQ ID NO: 157088 - DNA, 12 bp, Unknown
  misc_feature (1)..( 12): Result.004 file - promoters50/1018536
tgtgaaatgtta

SEQ ID NO: 157089 - DNA, 12 bp, Unknown
  misc_feature (1)..( 12): Result.004 file - promoters50/1018536
ctaacaatctca

SEQ ID NO: 157090 - DNA, 12 bp, Unknown
  misc_feature (1)..( 12): Result.004 file - promoters50/1018536
agtaaaatatac

SEQ ID NO: 157091 - DNA, 12 bp, Unknown
  misc_feature (1)..( 12): Result.004 file - promoters50/1018536
aaaacaattacg

SEQ ID NO: 157092 - DNA, 12 bp, Unknown
  misc_feature (1)..( 12): Result.004 file - promoters50/1018536
catataattaat

SEQ ID NO: 157093 - DNA, 12 bp, Unknown
  misc_feature (1)..( 12): Result.004 file - promoters50/1018536
aatatatttaga

SEQ ID NO: 157094 - DNA, 12 bp, Unknown
  misc_feature (1)..( 12): Result.004 file - promoters50/1018536
aatatgtttgag

SEQ ID NO: 157095 - DNA, 12 bp, Unknown
  misc_feature (1)..( 12): Result.004 file - promoters50/1018536
ttaccatttagt

SEQ ID NO: 157096 - DNA, 12 bp, Unknown
  misc_feature (1)..( 12): Result.004 file - promoters50/1018536
gatttaatttcg

SEQ ID NO: 157097 - DNA, 12 bp, Unknown
  misc_feature (1)..( 12): Result.004 file - promoters50/1018691
ttgtaatttagt

SEQ ID NO: 157098 - DNA, 12 bp, Unknown
  misc_feature (1)..( 12): Result.004 file - promoters50/1018691
gttttaggcaac

SEQ ID NO: 157099 - DNA, 12 bp, Unknown
  misc_feature (1)..( 12): Result.004 file - promoters50/1018691
gaaaaaggcaaa

SEQ ID NO: 157100 - DNA, 12 bp, Unknown
  misc_feature (1)..( 12): Result.004 file - promoters50/1018691
gaaacaggtaaa

SEQ ID NO: 157101 - DNA, 7 bp, Unknown
  misc_feature (1)..( 7): Result.004 file - promoters50/1018691
taccttt

SEQ ID NO: 157102 - DNA, 7 bp, Unknown
  misc_feature (1)..( 7): Result.004 file - promoters50/1018691
tacattt

SEQ ID NO: 157103 - DNA, 7 bp, Unknown
  misc_feature (1)..( 7): Result.004 file - promoters50/1018698
aacattt

SEQ ID NO: 157104 - DNA, 10 bp, Unknown
  misc_feature (1)..( 10): Result.004 file - promoters50/1018698
cctcgaaaag

SEQ ID NO: 157105 - DNA, 10 bp, Unknown
  misc_feature (1)..( 10): Result.004 file - promoters50/1018698
aatcgaaaag

SEQ ID NO: 157106 - DNA, 10 bp, Unknown
  misc_feature (1)..( 10): Result.004 file - promoters50/1018743
aatcgaaccc

SEQ ID NO: 157107 - DNA, 10 bp, Unknown
  misc_feature (1)..( 10): Result.004 file - promoters50/1018743
gtccttgtcg

SEQ ID NO: 157108 - DNA, 10 bp, Unknown
  misc_feature (1)..( 10): Result.004 file - promoters50/1018743
agcctcgtcg

SEQ ID NO: 157109 - DNA, 10 bp, Unknown
  misc_feature (1)..( 10): Result.004 file - promoters50/1018755
gtccttgtta

SEQ ID NO: 157110 - DNA, 11 bp, Unknown
  misc_feature (1)..( 11): Result.004 file - promoters50/1018755
cactgcttgta

SEQ ID NO: 157111 - DNA, 11 bp, Unknown
  misc_feature (1)..( 11): Result.004 file - promoters50/1018755
gacttcttagt

SEQ ID NO: 157112 - DNA, 11 bp, Unknown
  misc_feature (1)..( 11): Result.004 file - promoters50/1018755
cacagctctaa

SEQ ID NO: 157113 - DNA, 11 bp, Unknown
  misc_feature (1)..( 11): Result.004 file - promoters50/1018755
atatgcttgct

SEQ ID NO: 157114 - DNA, 11 bp, Unknown
  misc_feature (1)..( 11): Result.004 file - promoters50/1018755
atcgtcttccc

SEQ ID NO: 157115 - DNA, 11 bp, Unknown
  misc_feature (1)..( 11): Result.004 file - promoters50/1018755
tggatcttccc

SEQ ID NO: 157116 - DNA, 11 bp, Unknown
  misc_feature (1)..( 11): Result.004 file - promoters50/1018755
gctttatttat

SEQ ID NO: 157117 - DNA, 11 bp, Unknown
  misc_feature (1)..( 11): Result.004 file - promoters50/1018755
tttttgtttac

SEQ ID NO: 157118 - DNA, 11 bp, Unknown
  misc_feature (1)..( 11): Result.004 file - promoters50/1018755
gaattattttg

SEQ ID NO: 157119 - DNA, 11 bp, Unknown
  misc_feature (1)..( 11): Result.004 file - promoters50/1018755
tttttatttat

SEQ ID NO: 157120 - DNA, 11 bp, Unknown
  misc_feature (1)..( 11): Result.004 file - promoters50/1018755
aaaatattttc

SEQ ID NO: 157121 - DNA, 11 bp, Unknown
  misc_feature (1)..( 11): Result.004 file - promoters50/1018770
tttttgtgctg

SEQ ID NO: 157122 - DNA, 16 bp, Unknown
  misc_feature (1)..( 16): Result.004 file - promoters50/1018770
gacataaattttttat

SEQ ID NO: 157123 - DNA, 16 bp, Unknown
  misc_feature (1)..( 16): Result.004 file - promoters50/1018770
aatatatattctgaat

SEQ ID NO: 157124 - DNA, 16 bp, Unknown
  misc_feature (1)..( 16): Result.004 file - promoters50/1018770
tttataaatgtatttc

SEQ ID NO: 157125 - DNA, 16 bp, Unknown
  misc_feature (1)..( 16): Result.004 file - promoters50/1018770
gacctaagtttaagtt

SEQ ID NO: 157126 - DNA, 16 bp, Unknown
  misc_feature (1)..( 16): Result.004 file - promoters50/1018770
atcatatttttttaaa

SEQ ID NO: 157127 - DNA, 16 bp, Unknown
  misc_feature (1)..( 16): Result.004 file - promoters50/1018770
gaacttaatttttttt

SEQ ID NO: 157128 - DNA, 16 bp, Unknown
  misc_feature (1)..( 16): Result.004 file - promoters50/1018770
acataaattttttata

SEQ ID NO: 157129 - DNA, 16 bp, Unknown
  misc_feature (1)..( 16): Result.004 file - promoters50/1018770
ctcagaatttttgcga

SEQ ID NO: 157130 - DNA, 16 bp, Unknown
  misc_feature (1)..( 16): Result.004 file - promoters50/1018770
ttcactctttttgata

SEQ ID NO: 157131 - DNA, 16 bp, Unknown
  misc_feature (1)..( 16): Result.004 file - promoters50/1018770
gacctaagtttaagtt

SEQ ID NO: 157132 - DNA, 16 bp, Unknown
  misc_feature (1)..( 16): Result.004 file - promoters50/1018770
ccaattctttttgcca

SEQ ID NO: 157133 - DNA, 16 bp, Unknown
  misc_feature (1)..( 16): Result.004 file - promoters50/1018783
ccattcctttttgtat

SEQ ID NO: 157134 - DNA, 11 bp, Unknown
  misc_feature (1)..( 11): Result.004 file - promoters50/1018783
atcatagtatt

SEQ ID NO: 157135 - DNA, 11 bp, Unknown
  misc_feature (1)..( 11): Result.004 file - promoters50/1018783
tttataatata

SEQ ID NO: 157136 - DNA, 11 bp, Unknown
  misc_feature (1)..( 11): Result.004 file - promoters50/1018783
caaatactatt

SEQ ID NO: 157137 - DNA, 11 bp, Unknown
  misc_feature (1)..( 11): Result.004 file - promoters50/1018783
tttgtaattag

SEQ ID NO: 157138 - DNA, 11 bp, Unknown
  misc_feature (1)..( 11): Result.004 file - promoters50/1018783
tttctaataat

SEQ ID NO: 157139 - DNA, 9 bp, Unknown
  misc_feature (1)..( 9): Result.004 file - promoters50/1018783
aaatatata

SEQ ID NO: 157140 - DNA, 9 bp, Unknown
  misc_feature (1)..( 9): Result.004 file - promoters50/1018783
aaaaataat

SEQ ID NO: 157141 - DNA, 9 bp, Unknown
  misc_feature (1)..( 9): Result.004 file - promoters50/1018783
aaaactaaa

SEQ ID NO: 157142 - DNA, 9 bp, Unknown
  misc_feature (1)..( 9): Result.004 file - promoters50/1018783
taaactaat

SEQ ID NO: 157143 - DNA, 10 bp, Unknown
  misc_feature (1)..( 10): Result.004 file - promoters50/1018783
aaatcatatg

SEQ ID NO: 157144 - DNA, 18 bp, Unknown
  misc_feature (1)..( 18): Result.004 file - promoters50/1018783
atgattaaaatctagatg

SEQ ID NO: 157145 - DNA, 18 bp, Unknown
  misc_feature (1)..( 18): Result.004 file - promoters50/1018783
ccaattaaataaatgaaa

SEQ ID NO: 157146 - DNA, 19 bp, Unknown
  misc_feature (1)..( 19): Result.004 file - promoters50/1018783
gattttataatataaataa

SEQ ID NO: 157147 - DNA, 19 bp, Unknown
  misc_feature (1)..( 19): Result.004 file - promoters50/1018783
ccacttaactttaagtttc

SEQ ID NO: 157148 - DNA, 19 bp, Unknown
  misc_feature (1)..( 19): Result.004 file - promoters50/1018786
actcaataaatattgtata

SEQ ID NO: 157149 - DNA, 7 bp, Unknown
  misc_feature (1)..( 7): Result.004 file - promoters50/1018786
tattttt

SEQ ID NO: 157150 - DNA, 7 bp, Unknown
  misc_feature (1)..( 7): Result.004 file - promoters50/1018786
aattttt

SEQ ID NO: 157151 - DNA, 7 bp, Unknown
  misc_feature (1)..( 7): Result.004 file - promoters50/1018786
tatttta

SEQ ID NO: 157152 - DNA, 8 bp, Unknown
  misc_feature (1)..( 8): Result.004 file - promoters50/1018786
tttattat

SEQ ID NO: 157153 - DNA, 8 bp, Unknown
  misc_feature (1)..( 8): Result.004 file - promoters50/1018786
cttattat

SEQ ID NO: 157154 - DNA, 8 bp, Unknown
  misc_feature (1)..( 8): Result.004 file - promoters50/1018786
attatttc

SEQ ID NO: 157155 - DNA, 10 bp, Unknown
  misc_feature (1)..( 10): Result.004 file - promoters50/1018786
ggtggttggc

SEQ ID NO: 157156 - DNA, 10 bp, Unknown
  misc_feature (1)..( 10): Result.004 file - promoters50/1018786
attggttggt

SEQ ID NO: 157157 - DNA, 10 bp, Unknown
  misc_feature (1)..( 10): Result.004 file - promoters50/1018835
attggtaggt

SEQ ID NO: 157158 - DNA, 9 bp, Unknown
  misc_feature (1)..( 9): Result.004 file - promoters50/1018835
atttaaata

SEQ ID NO: 157159 - DNA, 9 bp, Unknown
  misc_feature (1)..( 9): Result.004 file - promoters50/1018835
gtttcaatt

SEQ ID NO: 157160 - DNA, 9 bp, Unknown
  misc_feature (1)..( 9): Result.004 file - promoters50/1018835
gttccaaca

SEQ ID NO: 157161 - DNA, 9 bp, Unknown
  misc_feature (1)..( 9): Result.004 file - promoters50/1018835
caatcaatt

SEQ ID NO: 157162 - DNA, 8 bp, Unknown
  misc_feature (1)..( 8): Result.004 file - promoters50/1018835
gaagtgcg

SEQ ID NO: 157163 - DNA, 8 bp, Unknown
  misc_feature (1)..( 8): Result.004 file - promoters50/1018835
gaaatgct

SEQ ID NO: 157164 - DNA, 8 bp, Unknown
  misc_feature (1)..( 8): Result.004 file - promoters50/1018835
ctaatgct

SEQ ID NO: 157165 - DNA, 8 bp, Unknown
  misc_feature (1)..( 8): Result.004 file - promoters50/1018890
gaaatgtg

SEQ ID NO: 157166 - DNA, 8 bp, Unknown
  misc_feature (1)..( 8): Result.004 file - promoters50/1018890
ttactatt

SEQ ID NO: 157167 - DNA, 8 bp, Unknown
  misc_feature (1)..( 8): Result.004 file - promoters50/1018890
ttaatatt

SEQ ID NO: 157168 - DNA, 8 bp, Unknown
  misc_feature (1)..( 8): Result.004 file - promoters50/1018890
ttaatatt

SEQ ID NO: 157169 - DNA, 8 bp, Unknown
  misc_feature (1)..( 8): Result.004 file - promoters50/1018890
gtactatc

SEQ ID NO: 157170 - DNA, 7 bp, Unknown
  misc_feature (1)..( 7): Result.004 file - promoters50/1018890
taaaatg

SEQ ID NO: 157171 - DNA, 7 bp, Unknown
  misc_feature (1)..( 7): Result.004 file - promoters50/1018890
aaaaatg

SEQ ID NO: 157172 - DNA, 7 bp, Unknown
  misc_feature (1)..( 7): Result.004 file - promoters50/1018890
aaaaata

SEQ ID NO: 157173 - DNA, 8 bp, Unknown
  misc_feature (1)..( 8): Result.004 file - promoters50/1018890
attatttc

SEQ ID NO: 157174 - DNA, 8 bp, Unknown
  misc_feature (1)..( 8): Result.004 file - promoters50/1018890
attattga

SEQ ID NO: 157175 - DNA, 8 bp, Unknown
  misc_feature (1)..( 8): Result.004 file - promoters50/1018890
attactga

SEQ ID NO: 157176 - DNA, 7 bp, Unknown
  misc_feature (1)..( 7): Result.004 file - promoters50/1018890
aaaataa

SEQ ID NO: 157177 - DNA, 7 bp, Unknown
  misc_feature (1)..( 7): Result.004 file - promoters50/1018890
aaaataa

SEQ ID NO: 157178 - DNA, 7 bp, Unknown
  misc_feature (1)..( 7): Result.004 file - promoters50/1018890
taaataa

SEQ ID NO: 157179 - DNA, 7 bp, Unknown
  misc_feature (1)..( 7): Result.004 file - promoters50/1018890
aaaatag

SEQ ID NO: 157180 - DNA, 9 bp, Unknown
  misc_feature (1)..( 9): Result.004 file - promoters50/1018890
aaataaatt

SEQ ID NO: 157181 - DNA, 9 bp, Unknown
  misc_feature (1)..( 9): Result.004 file - promoters50/1018890
taattaatt

SEQ ID NO: 157182 - DNA, 9 bp, Unknown
  misc_feature (1)..( 9): Result.004 file - promoters50/1018890
aaataattg

SEQ ID NO: 157183 - DNA, 9 bp, Unknown
  misc_feature (1)..( 9): Result.004 file - promoters50/1018890
ctatatata

SEQ ID NO: 157184 - DNA, 9 bp, Unknown
  misc_feature (1)..( 9): Result.004 file - promoters50/1018890
ctatatata

SEQ ID NO: 157185 - DNA, 9 bp, Unknown
  misc_feature (1)..( 9): Result.004 file - promoters50/1018890
ctatataac

SEQ ID NO: 157186 - DNA, 8 bp, Unknown
  misc_feature (1)..( 8): Result.004 file - promoters50/1018890
aatttacg

SEQ ID NO: 157187 - DNA, 8 bp, Unknown
  misc_feature (1)..( 8): Result.004 file - promoters50/1018890
aatttatt

SEQ ID NO: 157188 - DNA, 8 bp, Unknown
  misc_feature (1)..( 8): Result.004 file - promoters50/1018890
tatttatt

SEQ ID NO: 157189 - DNA, 8 bp, Unknown
  misc_feature (1)..( 8): Result.004 file - promoters50/1018890
actagtgt

SEQ ID NO: 157190 - DNA, 8 bp, Unknown
  misc_feature (1)..( 8): Result.004 file - promoters50/1018890
actagttc

SEQ ID NO: 157191 - DNA, 8 bp, Unknown
  misc_feature (1)..( 8): Result.004 file - promoters50/1018890
actatttc

SEQ ID NO: 157192 - DNA, 11 bp, Unknown
  misc_feature (1)..( 11): Result.004 file - promoters50/1018890
gcaattttatt

SEQ ID NO: 157193 - DNA, 11 bp, Unknown
  misc_feature (1)..( 11): Result.004 file - promoters50/1018890
gcaattttatt

SEQ ID NO: 157194 - DNA, 11 bp, Unknown
  misc_feature (1)..( 11): Result.004 file - promoters50/1018890
aaaaatttatt

SEQ ID NO: 157195 - DNA, 13 bp, Unknown
  misc_feature (1)..( 13): Result.004 file - promoters50/1018890
ggtggaacatgaa

SEQ ID NO: 157196 - DNA, 13 bp, Unknown
  misc_feature (1)..( 13): Result.004 file - promoters50/1018890
ggtggtacatgaa

SEQ ID NO: 157197 - DNA, 13 bp, Unknown
  misc_feature (1)..( 13): Result.004 file - promoters50/1018890
agacgatcatgaa

SEQ ID NO: 157198 - DNA, 8 bp, Unknown
  misc_feature (1)..( 8): Result.004 file - promoters50/1018890
gcaaccac

SEQ ID NO: 157199 - DNA, 8 bp, Unknown
  misc_feature (1)..( 8): Result.004 file - promoters50/1018890
gcatccaa

SEQ ID NO: 157200 - DNA, 8 bp, Unknown
  misc_feature (1)..( 8): Result.004 file - promoters50/1018890
gcattcaa

SEQ ID NO: 157201 - DNA, 7 bp, Unknown
  misc_feature (1)..( 7): Result.004 file - promoters50/1018890
atacata

SEQ ID NO: 157202 - DNA, 7 bp, Unknown
  misc_feature (1)..( 7): Result.004 file - promoters50/1018890
ataaata

SEQ ID NO: 157203 - DNA, 7 bp, Unknown
  misc_feature (1)..( 7): Result.004 file - promoters50/1018920
aaacaaa

SEQ ID NO: 157204 - DNA, 11 bp, Unknown
  misc_feature (1)..( 11): Result.004 file - promoters50/1018920
ttaatttcaat

SEQ ID NO: 157205 - DNA, 11 bp, Unknown
  misc_feature (1)..( 11): Result.004 file - promoters50/1018920
ctaatttccaa

SEQ ID NO: 157206 - DNA, 11 bp, Unknown
  misc_feature (1)..( 11): Result.004 file - promoters50/1018920
aaaatttcaaa

SEQ ID NO: 157207 - DNA, 11 bp, Unknown
  misc_feature (1)..( 11): Result.004 file - promoters50/1018920
atcatttcaca

SEQ ID NO: 157208 - DNA, 11 bp, Unknown
  misc_feature (1)..( 11): Result.004 file - promoters50/1018920
ctcattccaaa

SEQ ID NO: 157209 - DNA, 11 bp, Unknown
  misc_feature (1)..( 11): Result.004 file - promoters50/1018920
ctaacttcaag

SEQ ID NO: 157210 - DNA, 11 bp, Unknown
  misc_feature (1)..( 11): Result.004 file - promoters50/1018956
ctattttccaa

SEQ ID NO: 157211 - DNA, 7 bp, Unknown
  misc_feature (1)..( 7): Result.004 file - promoters50/1018956
aaaagaa

SEQ ID NO: 157212 - DNA, 7 bp, Unknown
  misc_feature (1)..( 7): Result.004 file - promoters50/1018956
aaatgaa

SEQ ID NO: 157213 - DNA, 7 bp, Unknown
  misc_feature (1)..( 7): Result.004 file - promoters50/1018973
aaaagaa

SEQ ID NO: 157214 - DNA, 12 bp, Unknown
  misc_feature (1)..( 12): Result.004 file - promoters50/1018973
atataagtaaca

SEQ ID NO: 157215 - DNA, 12 bp, Unknown
  misc_feature (1)..( 12): Result.004 file - promoters50/1018973
ttataagtataa

SEQ ID NO: 157216 - DNA, 12 bp, Unknown
  misc_feature (1)..( 12): Result.004 file - promoters50/1018973
gatgaagtcaca

SEQ ID NO: 157217 - DNA, 13 bp, Unknown
  misc_feature (1)..( 13): Result.004 file - promoters50/1018973
gagtaatgtaatt

SEQ ID NO: 157218 - DNA, 13 bp, Unknown
  misc_feature (1)..( 13): Result.004 file - promoters50/1018973
taataatgtaaaa

SEQ ID NO: 157219 - DNA, 13 bp, Unknown
  misc_feature (1)..( 13): Result.004 file - promoters50/1018973
ttataattatgca

SEQ ID NO: 157220 - DNA, 13 bp, Unknown
  misc_feature (1)..( 13): Result.004 file - promoters50/1018973
atattattatttc

SEQ ID NO: 157221 - DNA, 11 bp, Unknown
  misc_feature (1)..( 11): Result.004 file - promoters50/1018973
ctataaatatc

SEQ ID NO: 157222 - DNA, 11 bp, Unknown
  misc_feature (1)..( 11): Result.004 file - promoters50/1018973
ctataaaaacc

SEQ ID NO: 157223 - DNA, 11 bp, Unknown
  misc_feature (1)..( 11): Result.004 file - promoters50/1018973
atataaacaaa

SEQ ID NO: 157224 - DNA, 11 bp, Unknown
  misc_feature (1)..( 11): Result.004 file - promoters50/1018973
cgataaatatc

SEQ ID NO: 157225 - DNA, 11 bp, Unknown
  misc_feature (1)..( 11): Result.004 file - promoters50/1018973
ttataaataaa

SEQ ID NO: 157226 - DNA, 11 bp, Unknown
  misc_feature (1)..( 11): Result.004 file - promoters50/1018973
ccataaaagca

SEQ ID NO: 157227 - DNA, 11 bp, Unknown
  misc_feature (1)..( 11): Result.004 file - promoters50/1018973
atctttataag

SEQ ID NO: 157228 - DNA, 11 bp, Unknown
  misc_feature (1)..( 11): Result.004 file - promoters50/1018973
atctttataca

SEQ ID NO: 157229 - DNA, 11 bp, Unknown
  misc_feature (1)..( 11): Result.004 file - promoters50/1018973
aaatttgtaac

SEQ ID NO: 157230 - DNA, 11 bp, Unknown
  misc_feature (1)..( 11): Result.004 file - promoters50/1018973
caatttttaaa

SEQ ID NO: 157231 - DNA, 11 bp, Unknown
  misc_feature (1)..( 11): Result.004 file - promoters50/1018973
atattattatt

SEQ ID NO: 157232 - DNA, 11 bp, Unknown
  misc_feature (1)..( 11): Result.004 file - promoters50/1018973
gtgttttgaaa

SEQ ID NO: 157233 - DNA, 9 bp, Unknown
  misc_feature (1)..( 9): Result.004 file - promoters50/1018973
aattgttaa

SEQ ID NO: 157234 - DNA, 9 bp, Unknown
  misc_feature (1)..( 9): Result.004 file - promoters50/1018973
atttgttat

SEQ ID NO: 157235 - DNA, 9 bp, Unknown
  misc_feature (1)..( 9): Result.004 file - promoters50/1018973
aatttttaa

SEQ ID NO: 157236 - DNA, 9 bp, Unknown
  misc_feature (1)..( 9): Result.004 file - promoters50/1018973
tattattat

SEQ ID NO: 157237 - DNA, 10 bp, Unknown
  misc_feature (1)..( 10): Result.004 file - promoters50/1018973
cattagttct

SEQ ID NO: 157238 - DNA, 10 bp, Unknown
  misc_feature (1)..( 10): Result.004 file - promoters50/1019024
aatgtgtttt

SEQ ID NO: 157239 - DNA, 11 bp, Unknown
  misc_feature (1)..( 11): Result.004 file - promoters50/1019024
gtttatttaat

SEQ ID NO: 157240 - DNA, 11 bp, Unknown
  misc_feature (1)..( 11): Result.004 file - promoters50/1019024
ttttaattaat

SEQ ID NO: 157241 - DNA, 11 bp, Unknown
  misc_feature (1)..( 11): Result.004 file - promoters50/1019024
atttatttata

SEQ ID NO: 157242 - DNA, 11 bp, Unknown
  misc_feature (1)..( 11): Result.004 file - promoters50/1019024
atttaattctc

SEQ ID NO: 157243 - DNA, 11 bp, Unknown
  misc_feature (1)..( 11): Result.004 file - promoters50/1019030
aattactttct

SEQ ID NO: 157244 - DNA, 12 bp, Unknown
  misc_feature (1)..( 12): Result.004 file - promoters50/1019030
taaattttgaaa

SEQ ID NO: 157245 - DNA, 12 bp, Unknown
  misc_feature (1)..( 12): Result.004 file - promoters50/1019030
tatattttgaat

SEQ ID NO: 157246 - DNA, 12 bp, Unknown
  misc_feature (1)..( 12): Result.004 file - promoters50/1019030
taaattttaaaa

SEQ ID NO: 157247 - DNA, 11 bp, Unknown
  misc_feature (1)..( 11): Result.004 file - promoters50/1019030
ttacaaaatta

SEQ ID NO: 157248 - DNA, 11 bp, Unknown
  misc_feature (1)..( 11): Result.004 file - promoters50/1019030
tttaaaaatta

SEQ ID NO: 157249 - DNA, 11 bp, Unknown
  misc_feature (1)..( 11): Result.004 file - promoters50/1019030
ttaccaaatat

SEQ ID NO: 157250 - DNA, 11 bp, Unknown
  misc_feature (1)..( 11): Result.004 file - promoters50/1019030
ttacaatattt

SEQ ID NO: 157251 - DNA, 11 bp, Unknown
  misc_feature (1)..( 11): Result.004 file - promoters50/1019030
tttttgaaaaa

SEQ ID NO: 157252 - DNA, 11 bp, Unknown
  misc_feature (1)..( 11): Result.004 file - promoters50/1019030
tcaaagaaaaa

SEQ ID NO: 157253 - DNA, 11 bp, Unknown
  misc_feature (1)..( 11): Result.004 file - promoters50/1019030
tcaaataaaat

SEQ ID NO: 157254 - DNA, 11 bp, Unknown
  misc_feature (1)..( 11): Result.004 file - promoters50/1019030
ttaaattaaac

SEQ ID NO: 157255 - DNA, 7 bp, Unknown
  misc_feature (1)..( 7): Result.004 file - promoters50/1019030
attttag

SEQ ID NO: 157256 - DNA, 7 bp, Unknown
  misc_feature (1)..( 7): Result.004 file - promoters50/1019030
tttttag

SEQ ID NO: 157257 - DNA, 7 bp, Unknown
  misc_feature (1)..( 7): Result.004 file - promoters50/1019030
attttaa

SEQ ID NO: 157258 - DNA, 7 bp, Unknown
  misc_feature (1)..( 7): Result.004 file - promoters50/1019030
attatag

SEQ ID NO: 157259 - DNA, 7 bp, Unknown
  misc_feature (1)..( 7): Result.004 file - promoters50/1019030
ataaaaa

SEQ ID NO: 157260 - DNA, 7 bp, Unknown
  misc_feature (1)..( 7): Result.004 file - promoters50/1019030
ataaaaa

SEQ ID NO: 157261 - DNA, 7 bp, Unknown
  misc_feature (1)..( 7): Result.004 file - promoters50/1019030
ctaaaaa

SEQ ID NO: 157262 - DNA, 7 bp, Unknown
  misc_feature (1)..( 7): Result.004 file - promoters50/1019030
ataaaaa

SEQ ID NO: 157263 - DNA, 9 bp, Unknown
  misc_feature (1)..( 9): Result.004 file - promoters50/1019030
caaagaaaa

SEQ ID NO: 157264 - DNA, 9 bp, Unknown
  misc_feature (1)..( 9): Result.004 file - promoters50/1019030
aaaacaaaa

SEQ ID NO: 157265 - DNA, 9 bp, Unknown
  misc_feature (1)..( 9): Result.004 file - promoters50/1019030
aaaagaaat

SEQ ID NO: 157266 - DNA, 9 bp, Unknown
  misc_feature (1)..( 9): Result.004 file - promoters50/1019030
aaaacatgt

SEQ ID NO: 157267 - DNA, 8 bp, Unknown
  misc_feature (1)..( 8): Result.004 file - promoters50/1019030
tattttag

SEQ ID NO: 157268 - DNA, 8 bp, Unknown
  misc_feature (1)..( 8): Result.004 file - promoters50/1019030
tattttgt

SEQ ID NO: 157269 - DNA, 8 bp, Unknown
  misc_feature (1)..( 8): Result.004 file - promoters50/1019030
aattatag

SEQ ID NO: 157270 - DNA, 7 bp, Unknown
  misc_feature (1)..( 7): Result.004 file - promoters50/1019030
ttaaaaa

SEQ ID NO: 157271 - DNA, 7 bp, Unknown
  misc_feature (1)..( 7): Result.004 file - promoters50/1019030
ataaaaa

SEQ ID NO: 157272 - DNA, 7 bp, Unknown
  misc_feature (1)..( 7): Result.004 file - promoters50/1019030
ataaaat

SEQ ID NO: 157273 - DNA, 9 bp, Unknown
  misc_feature (1)..( 9): Result.004 file - promoters50/1019030
gaaaaatgt

SEQ ID NO: 157274 - DNA, 9 bp, Unknown
  misc_feature (1)..( 9): Result.004 file - promoters50/1019030
aaaacatgt

SEQ ID NO: 157275 - DNA, 9 bp, Unknown
  misc_feature (1)..( 9): Result.004 file - promoters50/1019030
aaaacaaaa

SEQ ID NO: 157276 - DNA, 7 bp, Unknown
  misc_feature (1)..( 7): Result.004 file - promoters50/1019030
aaaataa

SEQ ID NO: 157277 - DNA, 13 bp, Unknown
  misc_feature (1)..( 13): Result.004 file - promoters50/1019030
tattataaattaa

SEQ ID NO: 157278 - DNA, 13 bp, Unknown
  misc_feature (1)..( 13): Result.004 file - promoters50/1019030
tattatatatttt

SEQ ID NO: 157279 - DNA, 8 bp, Unknown
  misc_feature (1)..( 8): Result.004 file - promoters50/1019030
aattgtag

SEQ ID NO: 157280 - DNA, 8 bp, Unknown
  misc_feature (1)..( 8): Result.004 file - promoters50/1019030
aattatag

SEQ ID NO: 157281 - DNA, 8 bp, Unknown
  misc_feature (1)..( 8): Result.004 file - promoters50/1019030
aatcatat

SEQ ID NO: 157282 - DNA, 6 bp, Unknown
  misc_feature (1)..( 6): Result.004 file - promoters50/1019030
ataaaa

SEQ ID NO: 157283 - DNA, 6 bp, Unknown
  misc_feature (1)..( 6): Result.004 file - promoters50/1019030
ataaaa

SEQ ID NO: 157284 - DNA, 6 bp, Unknown
  misc_feature (1)..( 6): Result.004 file - promoters50/1019030
ataaaa

SEQ ID NO: 157285 - DNA, 7 bp, Unknown
  misc_feature (1)..( 7): Result.004 file - promoters50/1019030
tgtctaa

SEQ ID NO: 157286 - DNA, 7 bp, Unknown
  misc_feature (1)..( 7): Result.004 file - promoters50/1019030
tgtataa

SEQ ID NO: 157287 - DNA, 7 bp, Unknown
  misc_feature (1)..( 7): Result.004 file - promoters50/1019030
tgtttct

SEQ ID NO: 157288 - DNA, 9 bp, Unknown
  misc_feature (1)..( 9): Result.004 file - promoters50/1019030
aaaataaaa

SEQ ID NO: 157289 - DNA, 9 bp, Unknown
  misc_feature (1)..( 9): Result.004 file - promoters50/1019030
aaaatatct

SEQ ID NO: 157290 - DNA, 9 bp, Unknown
  misc_feature (1)..( 9): Result.004 file - promoters50/1019048
aaaaaaaaa

SEQ ID NO: 157291 - DNA, 11 bp, Unknown
  misc_feature (1)..( 11): Result.004 file - promoters50/1019048
cgataataaat

SEQ ID NO: 157292 - DNA, 11 bp, Unknown
  misc_feature (1)..( 11): Result.004 file - promoters50/1019048
cgatgatactt

SEQ ID NO: 157293 - DNA, 11 bp, Unknown
  misc_feature (1)..( 11): Result.004 file - promoters50/1019048
ggatcatataa

SEQ ID NO: 157294 - DNA, 11 bp, Unknown
  misc_feature (1)..( 11): Result.004 file - promoters50/1019048
acctgaaactc

SEQ ID NO: 157295 - DNA, 11 bp, Unknown
  misc_feature (1)..( 11): Result.004 file - promoters50/1019048
cgatcatgtaa

SEQ ID NO: 157296 - DNA, 11 bp, Unknown
  misc_feature (1)..( 11): Result.004 file - promoters50/1019048
tggtgtaatga

SEQ ID NO: 157297 - DNA, 11 bp, Unknown
  misc_feature (1)..( 11): Result.004 file - promoters50/1019048
atataataaaa

SEQ ID NO: 157298 - DNA, 11 bp, Unknown
  misc_feature (1)..( 11): Result.004 file - promoters50/1019048
gtttaacaaat

SEQ ID NO: 157299 - DNA, 12 bp, Unknown
  misc_feature (1)..( 12): Result.004 file - promoters50/1019048
ttttaatgaaat

SEQ ID NO: 157300 - DNA, 12 bp, Unknown
  misc_feature (1)..( 12): Result.004 file - promoters50/1019048
ttttacaagaca

SEQ ID NO: 157301 - DNA, 12 bp, Unknown
  misc_feature (1)..( 12): Result.004 file - promoters50/1019048
tcttaatggcta

SEQ ID NO: 157302 - DNA, 12 bp, Unknown
  misc_feature (1)..( 12): Result.004 file - promoters50/1019052
ttttacgtctat

SEQ ID NO: 157303 - DNA, 8 bp, Unknown
  misc_feature (1)..( 8): Result.004 file - promoters50/1019052
catatgtt

SEQ ID NO: 157304 - DNA, 8 bp, Unknown
  misc_feature (1)..( 8): Result.004 file - promoters50/1019052
gatatgtt

SEQ ID NO: 157305 - DNA, 8 bp, Unknown
  misc_feature (1)..( 8): Result.004 file - promoters50/1019052
catttgtt

SEQ ID NO: 157306 - DNA, 7 bp, Unknown
  misc_feature (1)..( 7): Result.004 file - promoters50/1019052
ttataag

SEQ ID NO: 157307 - DNA, 7 bp, Unknown
  misc_feature (1)..( 7): Result.004 file - promoters50/1019052
ttataaa

SEQ ID NO: 157308 - DNA, 7 bp, Unknown
  misc_feature (1)..( 7): Result.004 file - promoters50/1019052
atataaa

SEQ ID NO: 157309 - DNA, 10 bp, Unknown
  misc_feature (1)..( 10): Result.004 file - promoters50/1019052
ttaactacaa

SEQ ID NO: 157310 - DNA, 10 bp, Unknown
  misc_feature (1)..( 10): Result.004 file - promoters50/1019052
ttaactgaga

SEQ ID NO: 157311 - DNA, 10 bp, Unknown
  misc_feature (1)..( 10): Result.004 file - promoters50/1019067
ataacagaga

SEQ ID NO: 157312 - DNA, 9 bp, Unknown
  misc_feature (1)..( 9): Result.004 file - promoters50/1019067
aaaataatc

SEQ ID NO: 157313 - DNA, 9 bp, Unknown
  misc_feature (1)..( 9): Result.004 file - promoters50/1019067
aaaaaaatg

SEQ ID NO: 157314 - DNA, 9 bp, Unknown
  misc_feature (1)..( 9): Result.004 file - promoters50/1019067
agaaaaatg

SEQ ID NO: 157315 - DNA, 9 bp, Unknown
  misc_feature (1)..( 9): Result.004 file - promoters50/1019067
agagaaagg

SEQ ID NO: 157316 - DNA, 10 bp, Unknown
  misc_feature (1)..( 10): Result.004 file - promoters50/1019067
tatatatata

SEQ ID NO: 157317 - DNA, 10 bp, Unknown
  misc_feature (1)..( 10): Result.004 file - promoters50/1019067
tatatatata

SEQ ID NO: 157318 - DNA, 10 bp, Unknown
  misc_feature (1)..( 10): Result.004 file - promoters50/1019067
tatacatata

SEQ ID NO: 157319 - DNA, 10 bp, Unknown
  misc_feature (1)..( 10): Result.004 file - promoters50/1019067
tatttatagg

SEQ ID NO: 157320 - DNA, 10 bp, Unknown
  misc_feature (1)..( 10): Result.004 file - promoters50/1019067
tatataacaa

SEQ ID NO: 157321 - DNA, 10 bp, Unknown
  misc_feature (1)..( 10): Result.004 file - promoters50/1019067
aatccaatta

SEQ ID NO: 157322 - DNA, 10 bp, Unknown
  misc_feature (1)..( 10): Result.004 file - promoters50/1019067
aatctaattg

SEQ ID NO: 157323 - DNA, 10 bp, Unknown
  misc_feature (1)..( 10): Result.004 file - promoters50/1019067
taggcaatta

SEQ ID NO: 157324 - DNA, 10 bp, Unknown
  misc_feature (1)..( 10): Result.004 file - promoters50/1019067
cttctaatat

SEQ ID NO: 157325 - DNA, 10 bp, Unknown
  misc_feature (1)..( 10): Result.004 file - promoters50/1019067
taatagaaaa

SEQ ID NO: 157326 - DNA, 10 bp, Unknown
  misc_feature (1)..( 10): Result.004 file - promoters50/1019067
taaaagaaac

SEQ ID NO: 157327 - DNA, 10 bp, Unknown
  misc_feature (1)..( 10): Result.004 file - promoters50/1019067
tctaagaaac

SEQ ID NO: 157328 - DNA, 10 bp, Unknown
  misc_feature (1)..( 10): Result.004 file - promoters50/1019105
aaaaacaaaa

SEQ ID NO: 157329 - DNA, 11 bp, Unknown
  misc_feature (1)..( 11): Result.004 file - promoters50/1019105
gcaacgaaaaa

SEQ ID NO: 157330 - DNA, 11 bp, Unknown
  misc_feature (1)..( 11): Result.004 file - promoters50/1019105
agtgggaaaaa

SEQ ID NO: 157331 - DNA, 11 bp, Unknown
  misc_feature (1)..( 11): Result.004 file - promoters50/1019105
gctacgaaaat

SEQ ID NO: 157332 - DNA, 11 bp, Unknown
  misc_feature (1)..( 11): Result.004 file - promoters50/1019105
gctaccaaact

SEQ ID NO: 157333 - DNA, 11 bp, Unknown
  misc_feature (1)..( 11): Result.004 file - promoters50/1019105
cctactaaatt

SEQ ID NO: 157334 - DNA, 11 bp, Unknown
  misc_feature (1)..( 11): Result.004 file - promoters50/1019105
ataactaaagc

SEQ ID NO: 157335 - DNA, 10 bp, Unknown
  misc_feature (1)..( 10): Result.004 file - promoters50/1019105
gcaacgaaaa

SEQ ID NO: 157336 - DNA, 10 bp, Unknown
  misc_feature (1)..( 10): Result.004 file - promoters50/1019105
aaaacgaaga

SEQ ID NO: 157337 - DNA, 10 bp, Unknown
  misc_feature (1)..( 10): Result.004 file - promoters50/1019105
ataactaaag

SEQ ID NO: 157338 - DNA, 10 bp, Unknown
  misc_feature (1)..( 10): Result.004 file - promoters50/1019105
gctacgaaaa

SEQ ID NO: 157339 - DNA, 10 bp, Unknown
  misc_feature (1)..( 10): Result.004 file - promoters50/1019105
gctaccaaac

SEQ ID NO: 157340 - DNA, 10 bp, Unknown
  misc_feature (1)..( 10): Result.004 file - promoters50/1019111
cctactaaat

SEQ ID NO: 157341 - DNA, 8 bp, Unknown
  misc_feature (1)..( 8): Result.004 file - promoters50/1019111
ataagata

SEQ ID NO: 157342 - DNA, 8 bp, Unknown
  misc_feature (1)..( 8): Result.004 file - promoters50/1019111
atatgatt

SEQ ID NO: 157343 - DNA, 8 bp, Unknown
  misc_feature (1)..( 8): Result.004 file - promoters50/1019111
ataatata

SEQ ID NO: 157344 - DNA, 7 bp, Unknown
  misc_feature (1)..( 7): Result.004 file - promoters50/1019111
gttttag

SEQ ID NO: 157345 - DNA, 7 bp, Unknown
  misc_feature (1)..( 7): Result.004 file - promoters50/1019111
gttctag

SEQ ID NO: 157346 - DNA, 7 bp, Unknown
  misc_feature (1)..( 7): Result.004 file - promoters50/1019111
attttag

SEQ ID NO: 157347 - DNA, 11 bp, Unknown
  misc_feature (1)..( 11): Result.004 file - promoters50/1019111
ttataatttat

SEQ ID NO: 157348 - DNA, 11 bp, Unknown
  misc_feature (1)..( 11): Result.004 file - promoters50/1019111
ttatattttag

SEQ ID NO: 157349 - DNA, 11 bp, Unknown
  misc_feature (1)..( 11): Result.004 file - promoters50/1019111
cacagttttag

SEQ ID NO: 157350 - DNA, 8 bp, Unknown
  misc_feature (1)..( 8): Result.004 file - promoters50/1019111
attttttt

SEQ ID NO: 157351 - DNA, 8 bp, Unknown
  misc_feature (1)..( 8): Result.004 file - promoters50/1019111
attttttt

SEQ ID NO: 157352 - DNA, 8 bp, Unknown
  misc_feature (1)..( 8): Result.004 file - promoters50/1019111
attttttt

SEQ ID NO: 157353 - DNA, 15 bp, Unknown
  misc_feature (1)..( 15): Result.004 file - promoters50/1019111
gttattaagtttcaa

SEQ ID NO: 157354 - DNA, 15 bp, Unknown
  misc_feature (1)..( 15): Result.004 file - promoters50/1019111
ttttatttctttcaa

SEQ ID NO: 157355 - DNA, 15 bp, Unknown
  misc_feature (1)..( 15): Result.004 file - promoters50/1019253
tttaatttatttcat

SEQ ID NO: 157356 - DNA, 7 bp, Unknown
  misc_feature (1)..( 7): Result.004 file - promoters50/1019253
tttcttc

SEQ ID NO: 157357 - DNA, 7 bp, Unknown
  misc_feature (1)..( 7): Result.004 file - promoters50/1019253
tttctta

SEQ ID NO: 157358 - DNA, 7 bp, Unknown
  misc_feature (1)..( 7): Result.004 file - promoters50/1019253
ttttttc

SEQ ID NO: 157359 - DNA, 9 bp, Unknown
  misc_feature (1)..( 9): Result.004 file - promoters50/1019253
tattatttc

SEQ ID NO: 157360 - DNA, 9 bp, Unknown
  misc_feature (1)..( 9): Result.004 file - promoters50/1019253
atttatttt

SEQ ID NO: 157361 - DNA, 9 bp, Unknown
  misc_feature (1)..( 9): Result.004 file - promoters50/1019253
tatgatttc

SEQ ID NO: 157362 - DNA, 11 bp, Unknown
  misc_feature (1)..( 11): Result.004 file - promoters50/1019253
tttatagattt

SEQ ID NO: 157363 - DNA, 11 bp, Unknown
  misc_feature (1)..( 11): Result.004 file - promoters50/1019253
attaaagaaaa

SEQ ID NO: 157364 - DNA, 11 bp, Unknown
  misc_feature (1)..( 11): Result.004 file - promoters50/1019253
attaaagcaaa

SEQ ID NO: 157365 - DNA, 9 bp, Unknown
  misc_feature (1)..( 9): Result.004 file - promoters50/1019253
tttttattt

SEQ ID NO: 157366 - DNA, 9 bp, Unknown
  misc_feature (1)..( 9): Result.004 file - promoters50/1019253
tttttcttt

SEQ ID NO: 157367 - DNA, 9 bp, Unknown
  misc_feature (1)..( 9): Result.004 file - promoters50/1019253
tgtttctta

SEQ ID NO: 157368 - DNA, 11 bp, Unknown
  misc_feature (1)..( 11): Result.004 file - promoters50/1019253
attaaacttta

SEQ ID NO: 157369 - DNA, 11 bp, Unknown
  misc_feature (1)..( 11): Result.004 file - promoters50/1019253
attaaagcaaa

SEQ ID NO: 157370 - DNA, 11 bp, Unknown
  misc_feature (1)..( 11): Result.004 file - promoters50/1019257
attaaagaaaa

SEQ ID NO: 157371 - DNA, 13 bp, Unknown
  misc_feature (1)..( 13): Result.004 file - promoters50/1019257
ggagaattcatta

SEQ ID NO: 157372 - DNA, 13 bp, Unknown
  misc_feature (1)..( 13): Result.004 file - promoters50/1019257
atatttttcattt

SEQ ID NO: 157373 - DNA, 13 bp, Unknown
  misc_feature (1)..( 13): Result.004 file - promoters50/1019257
gagatttttattt

SEQ ID NO: 157374 - DNA, 13 bp, Unknown
  misc_feature (1)..( 13): Result.004 file - promoters50/1019257
agaattttgttat

SEQ ID NO: 157375 - DNA, 13 bp, Unknown
  misc_feature (1)..( 13): Result.004 file - promoters50/1019257
ataattttgttaa

SEQ ID NO: 157376 - DNA, 13 bp, Unknown
  misc_feature (1)..( 13): Result.004 file - promoters50/1019257
tggattttgaatt

SEQ ID NO: 157377 - DNA, 11 bp, Unknown
  misc_feature (1)..( 11): Result.004 file - promoters50/1019257
ttttgaatttt

SEQ ID NO: 157378 - DNA, 11 bp, Unknown
  misc_feature (1)..( 11): Result.004 file - promoters50/1019257
atttgaattaa

SEQ ID NO: 157379 - DNA, 11 bp, Unknown
  misc_feature (1)..( 11): Result.004 file - promoters50/1019257
acttgacttaa

SEQ ID NO: 157380 - DNA, 11 bp, Unknown
  misc_feature (1)..( 11): Result.004 file - promoters50/1019257
atttgagggta

SEQ ID NO: 157381 - DNA, 11 bp, Unknown
  misc_feature (1)..( 11): Result.004 file - promoters50/1019257
cttagacttaa

SEQ ID NO: 157382 - DNA, 11 bp, Unknown
  misc_feature (1)..( 11): Result.004 file - promoters50/1019257
agacgacttaa

SEQ ID NO: 157383 - DNA, 15 bp, Unknown
  misc_feature (1)..( 15): Result.004 file - promoters50/1019257
cggattttgtgatta

SEQ ID NO: 157384 - DNA, 15 bp, Unknown
  misc_feature (1)..( 15): Result.004 file - promoters50/1019257
agaattttgttatta

SEQ ID NO: 157385 - DNA, 15 bp, Unknown
  misc_feature (1)..( 15): Result.004 file - promoters50/1019257
tggattttgaatttt

SEQ ID NO: 157386 - DNA, 15 bp, Unknown
  misc_feature (1)..( 15): Result.004 file - promoters50/1019257
gagatttttatttgc

SEQ ID NO: 157387 - DNA, 15 bp, Unknown
  misc_feature (1)..( 15): Result.004 file - promoters50/1019257
aatatttttcattta

SEQ ID NO: 157388 - DNA, 15 bp, Unknown
  misc_feature (1)..( 15): Result.004 file - promoters50/1019260
ataattttgttaaaa

SEQ ID NO: 157389 - DNA, 8 bp, Unknown
  misc_feature (1)..( 8): Result.004 file - promoters50/1019260
aaaaccta

SEQ ID NO: 157390 - DNA, 8 bp, Unknown
  misc_feature (1)..( 8): Result.004 file - promoters50/1019260
aaaacctg

SEQ ID NO: 157391 - DNA, 8 bp, Unknown
  misc_feature (1)..( 8): Result.004 file - promoters50/1019260
taaatctg

SEQ ID NO: 157392 - DNA, 10 bp, Unknown
  misc_feature (1)..( 10): Result.004 file - promoters50/1019260
tttatgcttt

SEQ ID NO: 157393 - DNA, 10 bp, Unknown
  misc_feature (1)..( 10): Result.004 file - promoters50/1019260
gttatgattt

SEQ ID NO: 157394 - DNA, 10 bp, Unknown
  misc_feature (1)..( 10): Result.004 file - promoters50/1019287
gttatgctgg

SEQ ID NO: 157395 - DNA, 13 bp, Unknown
  misc_feature (1)..( 13): Result.004 file - promoters50/1019287
cataacaaaaatt

SEQ ID NO: 157396 - DNA, 13 bp, Unknown
  misc_feature (1)..( 13): Result.004 file - promoters50/1019287
aaaaacaaaagaa

SEQ ID NO: 157397 - DNA, 13 bp, Unknown
  misc_feature (1)..( 13): Result.004 file - promoters50/1019287
cttctcaaaaact

SEQ ID NO: 157398 - DNA, 13 bp, Unknown
  misc_feature (1)..( 13): Result.004 file - promoters50/1019287
tcattcaaaagat

SEQ ID NO: 157399 - DNA, 13 bp, Unknown
  misc_feature (1)..( 13): Result.004 file - promoters50/1019287
aggaaaaaaaaaa

SEQ ID NO: 157400 - DNA, 13 bp, Unknown
  misc_feature (1)..( 13): Result.004 file - promoters50/1019287
ttctccaaagtta

SEQ ID NO: 157401 - DNA, 15 bp, Unknown
  misc_feature (1)..( 15): Result.004 file - promoters50/1019287
caaatatttttaata

SEQ ID NO: 157402 - DNA, 15 bp, Unknown
  misc_feature (1)..( 15): Result.004 file - promoters50/1019287
gaaatatttttatgt

SEQ ID NO: 157403 - DNA, 15 bp, Unknown
  misc_feature (1)..( 15): Result.004 file - promoters50/1019287
actttttttttaaca

SEQ ID NO: 157404 - DNA, 15 bp, Unknown
  misc_feature (1)..( 15): Result.004 file - promoters50/1019287
gaaatacgttgaaag

SEQ ID NO: 157405 - DNA, 15 bp, Unknown
  misc_feature (1)..( 15): Result.004 file - promoters50/1019287
tttgaaattttatgg

SEQ ID NO: 157406 - DNA, 15 bp, Unknown
  misc_feature (1)..( 15): Result.004 file - promoters50/1019287
tggtatgtttgatgg

SEQ ID NO: 157407 - DNA, 12 bp, Unknown
  misc_feature (1)..( 12): Result.004 file - promoters50/1019287
tcataagagaat

SEQ ID NO: 157408 - DNA, 12 bp, Unknown
  misc_feature (1)..( 12): Result.004 file - promoters50/1019287
tcaaaagattta

SEQ ID NO: 157409 - DNA, 12 bp, Unknown
  misc_feature (1)..( 12): Result.004 file - promoters50/1019287
acattagatgag

SEQ ID NO: 157410 - DNA, 12 bp, Unknown
  misc_feature (1)..( 12): Result.004 file - promoters50/1019287
acaaaagaaaaa

SEQ ID NO: 157411 - DNA, 12 bp, Unknown
  misc_feature (1)..( 12): Result.004 file - promoters50/1019287
cataaacattta

SEQ ID NO: 157412 - DNA, 12 bp, Unknown
  misc_feature (1)..( 12): Result.004 file - promoters50/1019494
ttcttagctgag

SEQ ID NO: 157413 - DNA, 12 bp, Unknown
  misc_feature (1)..( 12): Result.004 file - promoters50/1019494
aattaacttttt

SEQ ID NO: 157414 - DNA, 12 bp, Unknown
  misc_feature (1)..( 12): Result.004 file - promoters50/1019494
aattaacatttg

SEQ ID NO: 157415 - DNA, 12 bp, Unknown
  misc_feature (1)..( 12): Result.004 file - promoters50/1019494
tttggtcttttt

SEQ ID NO: 157416 - DNA, 7 bp, Unknown
  misc_feature (1)..( 7): Result.004 file - promoters50/1019494
ataaata

SEQ ID NO: 157417 - DNA, 7 bp, Unknown
  misc_feature (1)..( 7): Result.004 file - promoters50/1019494
atatata

SEQ ID NO: 157418 - DNA, 7 bp, Unknown
  misc_feature (1)..( 7): Result.004 file - promoters50/1019498
atatatg

SEQ ID NO: 157419 - DNA, 10 bp, Unknown
  misc_feature (1)..( 10): Result.004 file - promoters50/1019498
gcggtaacta

SEQ ID NO: 157420 - DNA, 10 bp, Unknown
  misc_feature (1)..( 10): Result.004 file - promoters50/1019498
gcggcaaccg

SEQ ID NO: 157421 - DNA, 10 bp, Unknown
  misc_feature (1)..( 10): Result.004 file - promoters50/1019498
caagtaccta

SEQ ID NO: 157422 - DNA, 15 bp, Unknown
  misc_feature (1)..( 15): Result.004 file - promoters50/1019498
caaagtatgaaaacg

SEQ ID NO: 157423 - DNA, 15 bp, Unknown
  misc_feature (1)..( 15): Result.004 file - promoters50/1019498
caaagtatattaaac

SEQ ID NO: 157424 - DNA, 15 bp, Unknown
  misc_feature (1)..( 15): Result.004 file - promoters50/1019498
tatagtataataaac

SEQ ID NO: 157425 - DNA, 9 bp, Unknown
  misc_feature (1)..( 9): Result.004 file - promoters50/1019498
tttattttg

SEQ ID NO: 157426 - DNA, 9 bp, Unknown
  misc_feature (1)..( 9): Result.004 file - promoters50/1019498
cttatttaa

SEQ ID NO: 157427 - DNA, 9 bp, Unknown
  misc_feature (1)..( 9): Result.004 file - promoters50/1019498
tttattata

SEQ ID NO: 157428 - DNA, 9 bp, Unknown
  misc_feature (1)..( 9): Result.004 file - promoters50/1019498
catatataa

SEQ ID NO: 157429 - DNA, 8 bp, Unknown
  misc_feature (1)..( 8): Result.004 file - promoters50/1019498
gtatatgt

SEQ ID NO: 157430 - DNA, 8 bp, Unknown
  misc_feature (1)..( 8): Result.004 file - promoters50/1019498
atatatgt

SEQ ID NO: 157431 - DNA, 8 bp, Unknown
  misc_feature (1)..( 8): Result.004 file - promoters50/1019498
atatataa

SEQ ID NO: 157432 - DNA, 10 bp, Unknown
  misc_feature (1)..( 10): Result.004 file - promoters50/1019498
tatcatatat

SEQ ID NO: 157433 - DNA, 10 bp, Unknown
  misc_feature (1)..( 10): Result.004 file - promoters50/1019498
aatcatgtat

SEQ ID NO: 157434 - DNA, 10 bp, Unknown
  misc_feature (1)..( 10): Result.004 file - promoters50/1019498
aataatgggc

SEQ ID NO: 157435 - DNA, 12 bp, Unknown
  misc_feature (1)..( 12): Result.004 file - promoters50/1019498
tttgaaattaac

SEQ ID NO: 157436 - DNA, 12 bp, Unknown
  misc_feature (1)..( 12): Result.004 file - promoters50/1019498
agtataataaac

SEQ ID NO: 157437 - DNA, 12 bp, Unknown
  misc_feature (1)..( 12): Result.004 file - promoters50/1019498
agtatattaaac

SEQ ID NO: 157438 - DNA, 8 bp, Unknown
  misc_feature (1)..( 8): Result.004 file - promoters50/1019498
atttttca

SEQ ID NO: 157439 - DNA, 8 bp, Unknown
  misc_feature (1)..( 8): Result.004 file - promoters50/1019498
ctttttca

SEQ ID NO: 157440 - DNA, 8 bp, Unknown
  misc_feature (1)..( 8): Result.004 file - promoters50/1019524
ctttttta

SEQ ID NO: 157441 - DNA, 13 bp, Unknown
  misc_feature (1)..( 13): Result.004 file - promoters50/1019524
gaatggagaggaa

SEQ ID NO: 157442 - DNA, 13 bp, Unknown
  misc_feature (1)..( 13): Result.004 file - promoters50/1019524
acatgtagagggg

SEQ ID NO: 157443 - DNA, 13 bp, Unknown
  misc_feature (1)..( 13): Result.004 file - promoters50/1019524
agatgaatttaaa

SEQ ID NO: 157444 - DNA, 13 bp, Unknown
  misc_feature (1)..( 13): Result.004 file - promoters50/1019524
tcatgaatacggt

SEQ ID NO: 157445 - DNA, 13 bp, Unknown
  misc_feature (1)..( 13): Result.004 file - promoters50/1019524
aaatgtattttga

SEQ ID NO: 157446 - DNA, 13 bp, Unknown
  misc_feature (1)..( 13): Result.004 file - promoters50/1019537
ggttgtagtttga

SEQ ID NO: 157447 - DNA, 9 bp, Unknown
  misc_feature (1)..( 9): Result.004 file - promoters50/1019537
agcattttt

SEQ ID NO: 157448 - DNA, 9 bp, Unknown
  misc_feature (1)..( 9): Result.004 file - promoters50/1019537
caaattttt

SEQ ID NO: 157449 - DNA, 9 bp, Unknown
  misc_feature (1)..( 9): Result.004 file - promoters50/1019537
tctattttt

SEQ ID NO: 157450 - DNA, 9 bp, Unknown
  misc_feature (1)..( 9): Result.004 file - promoters50/1019537
tttatttaa

SEQ ID NO: 157451 - DNA, 9 bp, Unknown
  misc_feature (1)..( 9): Result.004 file - promoters50/1019537
tttcttttg

SEQ ID NO: 157452 - DNA, 9 bp, Unknown
  misc_feature (1)..( 9): Result.004 file - promoters50/1019537
cgtatctaa

SEQ ID NO: 157453 - DNA, 12 bp, Unknown
  misc_feature (1)..( 12): Result.004 file - promoters50/1019537
aagagagagatg

SEQ ID NO: 157454 - DNA, 12 bp, Unknown
  misc_feature (1)..( 12): Result.004 file - promoters50/1019537
tagatagatgtt

SEQ ID NO: 157455 - DNA, 12 bp, Unknown
  misc_feature (1)..( 12): Result.004 file - promoters50/1019537
aagagaattagg

SEQ ID NO: 157456 - DNA, 12 bp, Unknown
  misc_feature (1)..( 12): Result.004 file - promoters50/1019537
aatatatgtaaa

SEQ ID NO: 157457 - DNA, 12 bp, Unknown
  misc_feature (1)..( 12): Result.004 file - promoters50/1019537
tttatttaaaaa

SEQ ID NO: 157458 - DNA, 12 bp, Unknown
  misc_feature (1)..( 12): Result.004 file - promoters50/1019537
tagcattaaaat

SEQ ID NO: 157459 - DNA, 12 bp, Unknown
  misc_feature (1)..( 12): Result.004 file - promoters50/1019537
attttagaaaga

SEQ ID NO: 157460 - DNA, 12 bp, Unknown
  misc_feature (1)..( 12): Result.004 file - promoters50/1019537
tttatatggttg

SEQ ID NO: 157461 - DNA, 8 bp, Unknown
  misc_feature (1)..( 8): Result.004 file - promoters50/1019537
tatataaa

SEQ ID NO: 157462 - DNA, 8 bp, Unknown
  misc_feature (1)..( 8): Result.004 file - promoters50/1019537
tatttaaa

SEQ ID NO: 157463 - DNA, 8 bp, Unknown
  misc_feature (1)..( 8): Result.004 file - promoters50/1019537
tctataaa

SEQ ID NO: 157464 - DNA, 8 bp, Unknown
  misc_feature (1)..( 8): Result.004 file - promoters50/1019537
tatatact

SEQ ID NO: 157465 - DNA, 8 bp, Unknown
  misc_feature (1)..( 8): Result.004 file - promoters50/1019537
tatataag

SEQ ID NO: 157466 - DNA, 8 bp, Unknown
  misc_feature (1)..( 8): Result.004 file - promoters50/1019537
tatataaa

SEQ ID NO: 157467 - DNA, 11 bp, Unknown
  misc_feature (1)..( 11): Result.004 file - promoters50/1019537
agtgaatgttg

SEQ ID NO: 157468 - DNA, 11 bp, Unknown
  misc_feature (1)..( 11): Result.004 file - promoters50/1019537
tatgaatgaaa

SEQ ID NO: 157469 - DNA, 11 bp, Unknown
  misc_feature (1)..( 11): Result.004 file - promoters50/1019537
ggtgtatggtt

SEQ ID NO: 157470 - DNA, 11 bp, Unknown
  misc_feature (1)..( 11): Result.004 file - promoters50/1019537
tatgaattcta

SEQ ID NO: 157471 - DNA, 11 bp, Unknown
  misc_feature (1)..( 11): Result.004 file - promoters50/1019537
agagaaagaaa

SEQ ID NO: 157472 - DNA, 11 bp, Unknown
  misc_feature (1)..( 11): Result.004 file - promoters50/1019537
tggaaaacaaa

SEQ ID NO: 157473 - DNA, 11 bp, Unknown
  misc_feature (1)..( 11): Result.004 file - promoters50/1019545
gattaaaacat

SEQ ID NO: 157474 - DNA, 8 bp, Unknown
  misc_feature (1)..( 8): Result.004 file - promoters50/1019545
atatactc

SEQ ID NO: 157475 - DNA, 8 bp, Unknown
  misc_feature (1)..( 8): Result.004 file - promoters50/1019545
atattctc

SEQ ID NO: 157476 - DNA, 8 bp, Unknown
  misc_feature (1)..( 8): Result.004 file - promoters50/1019545
atatattc

SEQ ID NO: 157477 - DNA, 8 bp, Unknown
  misc_feature (1)..( 8): Result.004 file - promoters50/1019545
aaagcaga

SEQ ID NO: 157478 - DNA, 8 bp, Unknown
  misc_feature (1)..( 8): Result.004 file - promoters50/1019545
gaagcaga

SEQ ID NO: 157479 - DNA, 8 bp, Unknown
  misc_feature (1)..( 8): Result.004 file - promoters50/1019545
gaaccagt

SEQ ID NO: 157480 - DNA, 8 bp, Unknown
  misc_feature (1)..( 8): Result.004 file - promoters50/1019545
ttttattc

SEQ ID NO: 157481 - DNA, 8 bp, Unknown
  misc_feature (1)..( 8): Result.004 file - promoters50/1019545
attttttc

SEQ ID NO: 157482 - DNA, 8 bp, Unknown
  misc_feature (1)..( 8): Result.004 file - promoters50/1019545
ttttattg

SEQ ID NO: 157483 - DNA, 10 bp, Unknown
  misc_feature (1)..( 10): Result.004 file - promoters50/1019545
tttgtagaga

SEQ ID NO: 157484 - DNA, 10 bp, Unknown
  misc_feature (1)..( 10): Result.004 file - promoters50/1019545
atagtataga

SEQ ID NO: 157485 - DNA, 10 bp, Unknown
  misc_feature (1)..( 10): Result.004 file - promoters50/1019545
ataatataat

SEQ ID NO: 157486 - DNA, 10 bp, Unknown
  misc_feature (1)..( 10): Result.004 file - promoters50/1019545
ataatgtaat

SEQ ID NO: 157487 - DNA, 10 bp, Unknown
  misc_feature (1)..( 10): Result.004 file - promoters50/1019545
ataatataat

SEQ ID NO: 157488 - DNA, 10 bp, Unknown
  misc_feature (1)..( 10): Result.004 file - promoters50/1019559
atagtataga

SEQ ID NO: 157489 - DNA, 10 bp, Unknown
  misc_feature (1)..( 10): Result.004 file - promoters50/1019559
taaagtatga

SEQ ID NO: 157490 - DNA, 10 bp, Unknown
  misc_feature (1)..( 10): Result.004 file - promoters50/1019559
taaagtaaag

SEQ ID NO: 157491 - DNA, 10 bp, Unknown
  misc_feature (1)..( 10): Result.004 file - promoters50/1019559
aaaagaaaag

SEQ ID NO: 157492 - DNA, 11 bp, Unknown
  misc_feature (1)..( 11): Result.004 file - promoters50/1019559
aaaagtcttca

SEQ ID NO: 157493 - DNA, 11 bp, Unknown
  misc_feature (1)..( 11): Result.004 file - promoters50/1019559
aaaagttgcag

SEQ ID NO: 157494 - DNA, 11 bp, Unknown
  misc_feature (1)..( 11): Result.004 file - promoters50/1019559
gaaatttgcag

SEQ ID NO: 157495 - DNA, 10 bp, Unknown
  misc_feature (1)..( 10): Result.004 file - promoters50/1019559
atttttcaaa

SEQ ID NO: 157496 - DNA, 10 bp, Unknown
  misc_feature (1)..( 10): Result.004 file - promoters50/1019559
aattttgaaa

SEQ ID NO: 157497 - DNA, 10 bp, Unknown
  misc_feature (1)..( 10): Result.004 file - promoters50/1019559
aattttgttg

SEQ ID NO: 157498 - DNA, 11 bp, Unknown
  misc_feature (1)..( 11): Result.004 file - promoters50/1019559
cttgaaacaaa

SEQ ID NO: 157499 - DNA, 11 bp, Unknown
  misc_feature (1)..( 11): Result.004 file - promoters50/1019559
ggagaaagaaa

SEQ ID NO: 157500 - DNA, 11 bp, Unknown
  misc_feature (1)..( 11): Result.004 file - promoters50/1019559
ggagaaagcgg

SEQ ID NO: 157501 - DNA, 9 bp, Unknown
  misc_feature (1)..( 9): Result.004 file - promoters50/1019559
atctgagct

SEQ ID NO: 157502 - DNA, 9 bp, Unknown
  misc_feature (1)..( 9): Result.004 file - promoters50/1019559
ttcttagct

SEQ ID NO: 157503 - DNA, 9 bp, Unknown
  misc_feature (1)..( 9): Result.004 file - promoters50/1019559
ttcttatca

SEQ ID NO: 157504 - DNA, 8 bp, Unknown
  misc_feature (1)..( 8): Result.004 file - promoters50/1019559
aaaacatt

SEQ ID NO: 157505 - DNA, 8 bp, Unknown
  misc_feature (1)..( 8): Result.004 file - promoters50/1019559
gaaagatt

SEQ ID NO: 157506 - DNA, 8 bp, Unknown
  misc_feature (1)..( 8): Result.004 file - promoters50/1019604
gaaagaaa

SEQ ID NO: 157507 - DNA, 17 bp, Unknown
  misc_feature (1)..( 17): Result.004 file - promoters50/1019604
tctctactatataaaca

SEQ ID NO: 157508 - DNA, 17 bp, Unknown
  misc_feature (1)..( 17): Result.004 file - promoters50/1019604
tctctactatataaaca

SEQ ID NO: 157509 - DNA, 17 bp, Unknown
  misc_feature (1)..( 17): Result.004 file - promoters50/1019604
cttcaccaatataatct

SEQ ID NO: 157510 - DNA, 17 bp, Unknown
  misc_feature (1)..( 17): Result.004 file - promoters50/1019604
acacaactatatataca

SEQ ID NO: 157511 - DNA, 17 bp, Unknown
  misc_feature (1)..( 17): Result.004 file - promoters50/1019604
ttgctcctctataaaac

SEQ ID NO: 157512 - DNA, 17 bp, Unknown
  misc_feature (1)..( 17): Result.004 file - promoters50/1019604
aactatggatataaatt

SEQ ID NO: 157513 - DNA, 13 bp, Unknown
  misc_feature (1)..( 13): Result.004 file - promoters50/1019604
tttctagaaacct

SEQ ID NO: 157514 - DNA, 13 bp, Unknown
  misc_feature (1)..( 13): Result.004 file - promoters50/1019604
tgtctaaaaataa

SEQ ID NO: 157515 - DNA, 13 bp, Unknown
  misc_feature (1)..( 13): Result.004 file - promoters50/1019604
tttctagaaccaa

SEQ ID NO: 157516 - DNA, 13 bp, Unknown
  misc_feature (1)..( 13): Result.004 file - promoters50/1019604
tgtttaaaagtag

SEQ ID NO: 157517 - DNA, 13 bp, Unknown
  misc_feature (1)..( 13): Result.004 file - promoters50/1019604
tgtttacattatc

SEQ ID NO: 157518 - DNA, 13 bp, Unknown
  misc_feature (1)..( 13): Result.004 file - promoters50/1019604
aatttgaaaatag

SEQ ID NO: 157519 - DNA, 10 bp, Unknown
  misc_feature (1)..( 10): Result.004 file - promoters50/1019604
tcaagacaaa

SEQ ID NO: 157520 - DNA, 10 bp, Unknown
  misc_feature (1)..( 10): Result.004 file - promoters50/1019604
acaaaacatt

SEQ ID NO: 157521 - DNA, 10 bp, Unknown
  misc_feature (1)..( 10): Result.004 file - promoters50/1019604
tcaagacatc

SEQ ID NO: 157522 - DNA, 10 bp, Unknown
  misc_feature (1)..( 10): Result.004 file - promoters50/1019604
ccaagtcaaa

SEQ ID NO: 157523 - DNA, 10 bp, Unknown
  misc_feature (1)..( 10): Result.004 file - promoters50/1019604
aatagataaa

SEQ ID NO: 157524 - DNA, 10 bp, Unknown
  misc_feature (1)..( 10): Result.004 file - promoters50/1019604
aatagacaat

SEQ ID NO: 157525 - DNA, 10 bp, Unknown
  misc_feature (1)..( 10): Result.004 file - promoters50/1019659
acaagtccat

SEQ ID NO: 157526 - DNA, 8 bp, Unknown
  misc_feature (1)..( 8): Result.004 file - promoters50/1019659
gttctatt

SEQ ID NO: 157527 - DNA, 8 bp, Unknown
  misc_feature (1)..( 8): Result.004 file - promoters50/1019659
gttcgatt

SEQ ID NO: 157528 - DNA, 8 bp, Unknown
  misc_feature (1)..( 8): Result.004 file - promoters50/1019659
attctatt

SEQ ID NO: 157529 - DNA, 8 bp, Unknown
  misc_feature (1)..( 8): Result.004 file - promoters50/1019659
attagttt

SEQ ID NO: 157530 - DNA, 8 bp, Unknown
  misc_feature (1)..( 8): Result.004 file - promoters50/1019659
tttatttt

SEQ ID NO: 157531 - DNA, 8 bp, Unknown
  misc_feature (1)..( 8): Result.004 file - promoters50/1019663
tttatttc

SEQ ID NO: 157532 - DNA, 8 bp, Unknown
  misc_feature (1)..( 8): Result.004 file - promoters50/1019663
gttgtgat

SEQ ID NO: 157533 - DNA, 8 bp, Unknown
  misc_feature (1)..( 8): Result.004 file - promoters50/1019663
gttttgaa

SEQ ID NO: 157534 - DNA, 8 bp, Unknown
  misc_feature (1)..( 8): Result.004 file - promoters50/1019663
cttttgaa

SEQ ID NO: 157535 - DNA, 10 bp, Unknown
  misc_feature (1)..( 10): Result.004 file - promoters50/1019663
tacatacaac

SEQ ID NO: 157536 - DNA, 10 bp, Unknown
  misc_feature (1)..( 10): Result.004 file - promoters50/1019663
aacaaacaac

SEQ ID NO: 157537 - DNA, 10 bp, Unknown
  misc_feature (1)..( 10): Result.004 file - promoters50/1019663
aatatatatg

SEQ ID NO: 157538 - DNA, 9 bp, Unknown
  misc_feature (1)..( 9): Result.004 file - promoters50/1019663
tgttggaat

SEQ ID NO: 157539 - DNA, 9 bp, Unknown
  misc_feature (1)..( 9): Result.004 file - promoters50/1019663
ttttgaaat

SEQ ID NO: 157540 - DNA, 9 bp, Unknown
  misc_feature (1)..( 9): Result.004 file - promoters50/1019663
ttttgaatg

SEQ ID NO: 157541 - DNA, 7 bp, Unknown
  misc_feature (1)..( 7): Result.004 file - promoters50/1019663
ttttgat

SEQ ID NO: 157542 - DNA, 7 bp, Unknown
  misc_feature (1)..( 7): Result.004 file - promoters50/1019663
ttttgaa

SEQ ID NO: 157543 - DNA, 7 bp, Unknown
  misc_feature (1)..( 7): Result.004 file - promoters50/1019663
ttttgaa

SEQ ID NO: 157544 - DNA, 7 bp, Unknown
  misc_feature (1)..( 7): Result.004 file - promoters50/1019663
cttgtat

SEQ ID NO: 157545 - DNA, 7 bp, Unknown
  misc_feature (1)..( 7): Result.004 file - promoters50/1019663
cttatat

SEQ ID NO: 157546 - DNA, 7 bp, Unknown
  misc_feature (1)..( 7): Result.004 file - promoters50/1019695
tttatat

SEQ ID NO: 157547 - DNA, 8 bp, Unknown
  misc_feature (1)..( 8): Result.004 file - promoters50/1019695
attagtta

SEQ ID NO: 157548 - DNA, 8 bp, Unknown
  misc_feature (1)..( 8): Result.004 file - promoters50/1019695
atttgtta

SEQ ID NO: 157549 - DNA, 8 bp, Unknown
  misc_feature (1)..( 8): Result.004 file - promoters50/1019695
atttttta

SEQ ID NO: 157550 - DNA, 9 bp, Unknown
  misc_feature (1)..( 9): Result.004 file - promoters50/1019695
gtttatgta

SEQ ID NO: 157551 - DNA, 9 bp, Unknown
  misc_feature (1)..( 9): Result.004 file - promoters50/1019695
gttgatgga

SEQ ID NO: 157552 - DNA, 9 bp, Unknown
  misc_feature (1)..( 9): Result.004 file - promoters50/1019695
tctgatgga

SEQ ID NO: 157553 - DNA, 8 bp, Unknown
  misc_feature (1)..( 8): Result.004 file - promoters50/1019695
ttttcatc

SEQ ID NO: 157554 - DNA, 8 bp, Unknown
  misc_feature (1)..( 8): Result.004 file - promoters50/1019695
ttttcaac

SEQ ID NO: 157555 - DNA, 8 bp, Unknown
  misc_feature (1)..( 8): Result.004 file - promoters50/1019734
gtttaaac

SEQ ID NO: 157556 - DNA, 12 bp, Unknown
  misc_feature (1)..( 12): Result.004 file - promoters50/1019734
taaatcattttt

SEQ ID NO: 157557 - DNA, 12 bp, Unknown
  misc_feature (1)..( 12): Result.004 file - promoters50/1019734
aatttcatttag

SEQ ID NO: 157558 - DNA, 12 bp, Unknown
  misc_feature (1)..( 12): Result.004 file - promoters50/1019734
gaaataattttc

SEQ ID NO: 157559 - DNA, 13 bp, Unknown
  misc_feature (1)..( 13): Result.004 file - promoters50/1019734
aaattcatgtttt

SEQ ID NO: 157560 - DNA, 13 bp, Unknown
  misc_feature (1)..( 13): Result.004 file - promoters50/1019734
caaataaaagaag

SEQ ID NO: 157561 - DNA, 13 bp, Unknown
  misc_feature (1)..( 13): Result.004 file - promoters50/1019746
caaatatcgttgt

SEQ ID NO: 157562 - DNA, 10 bp, Unknown
  misc_feature (1)..( 10): Result.004 file - promoters50/1019746
taattgatga

SEQ ID NO: 157563 - DNA, 10 bp, Unknown
  misc_feature (1)..( 10): Result.004 file - promoters50/1019746
ccattgatac

SEQ ID NO: 157564 - DNA, 10 bp, Unknown
  misc_feature (1)..( 10): Result.004 file - promoters50/1019746
aaattgattt

SEQ ID NO: 157565 - DNA, 10 bp, Unknown
  misc_feature (1)..( 10): Result.004 file - promoters50/1019746
ggattaatac

SEQ ID NO: 157566 - DNA, 10 bp, Unknown
  misc_feature (1)..( 10): Result.004 file - promoters50/1019746
gatttgattg

SEQ ID NO: 157567 - DNA, 10 bp, Unknown
  misc_feature (1)..( 10): Result.004 file - promoters50/1019746
gatttaattc

SEQ ID NO: 157568 - DNA, 11 bp, Unknown
  misc_feature (1)..( 11): Result.004 file - promoters50/1019746
taaagcccaag

SEQ ID NO: 157569 - DNA, 11 bp, Unknown
  misc_feature (1)..( 11): Result.004 file - promoters50/1019746
taaggccaggc

SEQ ID NO: 157570 - DNA, 11 bp, Unknown
  misc_feature (1)..( 11): Result.004 file - promoters50/1019746
taaggcccaaa

SEQ ID NO: 157571 - DNA, 11 bp, Unknown
  misc_feature (1)..( 11): Result.004 file - promoters50/1019746
taagcccatat

SEQ ID NO: 157572 - DNA, 11 bp, Unknown
  misc_feature (1)..( 11): Result.004 file - promoters50/1019746
aaaggcccaat

SEQ ID NO: 157573 - DNA, 11 bp, Unknown
  misc_feature (1)..( 11): Result.004 file - promoters50/1019746
aaggcccatta

SEQ ID NO: 157574 - DNA, 11 bp, Unknown
  misc_feature (1)..( 11): Result.004 file - promoters50/1019746
ctaggcctaat

SEQ ID NO: 157575 - DNA, 12 bp, Unknown
  misc_feature (1)..( 12): Result.004 file - promoters50/1019746
agtattttttct

SEQ ID NO: 157576 - DNA, 12 bp, Unknown
  misc_feature (1)..( 12): Result.004 file - promoters50/1019746
tatatttttaat

SEQ ID NO: 157577 - DNA, 12 bp, Unknown
  misc_feature (1)..( 12): Result.004 file - promoters50/1019746
aatatgtttctt

SEQ ID NO: 157578 - DNA, 12 bp, Unknown
  misc_feature (1)..( 12): Result.004 file - promoters50/1019746
ggtatgtttgat

SEQ ID NO: 157579 - DNA, 12 bp, Unknown
  misc_feature (1)..( 12): Result.004 file - promoters50/1019746
ggtttgtagtat

SEQ ID NO: 157580 - DNA, 12 bp, Unknown
  misc_feature (1)..( 12): Result.004 file - promoters50/1019746
acaattttaaat

SEQ ID NO: 157581 - DNA, 12 bp, Unknown
  misc_feature (1)..( 12): Result.004 file - promoters50/1019764
acactcttaaat

SEQ ID NO: 157582 - DNA, 7 bp, Unknown
  misc_feature (1)..( 7): Result.004 file - promoters50/1019764
tttgttt

SEQ ID NO: 157583 - DNA, 7 bp, Unknown
  misc_feature (1)..( 7): Result.004 file - promoters50/1019764
tttgttt

SEQ ID NO: 157584 - DNA, 7 bp, Unknown
  misc_feature (1)..( 7): Result.004 file - promoters50/1019764
tttctgt

SEQ ID NO: 157585 - DNA, 9 bp, Unknown
  misc_feature (1)..( 9): Result.004 file - promoters50/1019764
agatgtatt

SEQ ID NO: 157586 - DNA, 9 bp, Unknown
  misc_feature (1)..( 9): Result.004 file - promoters50/1019764
agatgtatt

SEQ ID NO: 157587 - DNA, 9 bp, Unknown
  misc_feature (1)..( 9): Result.004 file - promoters50/1019776
agatgttga

SEQ ID NO: 157588 - DNA, 11 bp, Unknown
  misc_feature (1)..( 11): Result.004 file - promoters50/1019776
atactttgttt

SEQ ID NO: 157589 - DNA, 11 bp, Unknown
  misc_feature (1)..( 11): Result.004 file - promoters50/1019776
atattttcttt

SEQ ID NO: 157590 - DNA, 11 bp, Unknown
  misc_feature (1)..( 11): Result.004 file - promoters50/1019776
ccaatttgtta

SEQ ID NO: 157591 - DNA, 9 bp, Unknown
  misc_feature (1)..( 9): Result.004 file - promoters50/1019776
gaataaaaa

SEQ ID NO: 157592 - DNA, 9 bp, Unknown
  misc_feature (1)..( 9): Result.004 file - promoters50/1019776
gtatataaa

SEQ ID NO: 157593 - DNA, 9 bp, Unknown
  misc_feature (1)..( 9): Result.004 file - promoters50/1019776
gtatatatt

SEQ ID NO: 157594 - DNA, 9 bp, Unknown
  misc_feature (1)..( 9): Result.004 file - promoters50/1019776
aaattaact

SEQ ID NO: 157595 - DNA, 9 bp, Unknown
  misc_feature (1)..( 9): Result.004 file - promoters50/1019776
aaagtaaag

SEQ ID NO: 157596 - DNA, 9 bp, Unknown
  misc_feature (1)..( 9): Result.004 file - promoters50/1019776
aaagaaaag

SEQ ID NO: 157597 - DNA, 8 bp, Unknown
  misc_feature (1)..( 8): Result.004 file - promoters50/1019776
ctaattca

SEQ ID NO: 157598 - DNA, 8 bp, Unknown
  misc_feature (1)..( 8): Result.004 file - promoters50/1019776
ttaattca

SEQ ID NO: 157599 - DNA, 8 bp, Unknown
  misc_feature (1)..( 8): Result.004 file - promoters50/1019907
ttaattaa

SEQ ID NO: 157600 - DNA, 10 bp, Unknown
  misc_feature (1)..( 10): Result.004 file - promoters50/1019907
ttttcactaa

SEQ ID NO: 157601 - DNA, 10 bp, Unknown
  misc_feature (1)..( 10): Result.004 file - promoters50/1019907
tttttactat

SEQ ID NO: 157602 - DNA, 10 bp, Unknown
  misc_feature (1)..( 10): Result.004 file - promoters50/1019907
gtttcaataa

SEQ ID NO: 157603 - DNA, 11 bp, Unknown
  misc_feature (1)..( 11): Result.004 file - promoters50/1019907
ggaaaaaatta

SEQ ID NO: 157604 - DNA, 11 bp, Unknown
  misc_feature (1)..( 11): Result.004 file - promoters50/1019907
tcacaaactta

SEQ ID NO: 157605 - DNA, 11 bp, Unknown
  misc_feature (1)..( 11): Result.004 file - promoters50/1019907
tcacacactca

SEQ ID NO: 157606 - DNA, 8 bp, Unknown
  misc_feature (1)..( 8): Result.004 file - promoters50/1019907
ataaaatg

SEQ ID NO: 157607 - DNA, 8 bp, Unknown
  misc_feature (1)..( 8): Result.004 file - promoters50/1019907
atataatt

SEQ ID NO: 157608 - DNA, 8 bp, Unknown
  misc_feature (1)..( 8): Result.004 file - promoters50/1019915
caataatt

SEQ ID NO: 157609 - DNA, 7 bp, Unknown
  misc_feature (1)..( 7): Result.004 file - promoters50/1019915
aacaaga

SEQ ID NO: 157610 - DNA, 7 bp, Unknown
  misc_feature (1)..( 7): Result.004 file - promoters50/1019915
aactaga

SEQ ID NO: 157611 - DNA, 7 bp, Unknown
  misc_feature (1)..( 7): Result.004 file - promoters50/1019915
aactaga

SEQ ID NO: 157612 - DNA, 9 bp, Unknown
  misc_feature (1)..( 9): Result.004 file - promoters50/1019915
ctgcaaatt

SEQ ID NO: 157613 - DNA, 9 bp, Unknown
  misc_feature (1)..( 9): Result.004 file - promoters50/1019915
tgtcaaatt

SEQ ID NO: 157614 - DNA, 9 bp, Unknown
  misc_feature (1)..( 9): Result.004 file - promoters50/1019915
tgtcatatt

SEQ ID NO: 157615 - DNA, 10 bp, Unknown
  misc_feature (1)..( 10): Result.004 file - promoters50/1019915
gaccgaaaaa

SEQ ID NO: 157616 - DNA, 10 bp, Unknown
  misc_feature (1)..( 10): Result.004 file - promoters50/1019915
ttaagaaaaa

SEQ ID NO: 157617 - DNA, 10 bp, Unknown
  misc_feature (1)..( 10): Result.004 file - promoters50/1019915
ttaacaaaac

SEQ ID NO: 157618 - DNA, 8 bp, Unknown
  misc_feature (1)..( 8): Result.004 file - promoters50/1019915
ctaaaaac

SEQ ID NO: 157619 - DNA, 8 bp, Unknown
  misc_feature (1)..( 8): Result.004 file - promoters50/1019915
ttaaaaaa

SEQ ID NO: 157620 - DNA, 8 bp, Unknown
  misc_feature (1)..( 8): Result.004 file - promoters50/1019915
ctagaaac

SEQ ID NO: 157621 - DNA, 8 bp, Unknown
  misc_feature (1)..( 8): Result.004 file - promoters50/1019915
aaaataaa

SEQ ID NO: 157622 - DNA, 8 bp, Unknown
  misc_feature (1)..( 8): Result.004 file - promoters50/1019915
aaaacaaa

SEQ ID NO: 157623 - DNA, 8 bp, Unknown
  misc_feature (1)..( 8): Result.004 file - promoters50/1019915
aaaataaa

SEQ ID NO: 157624 - DNA, 8 bp, Unknown
  misc_feature (1)..( 8): Result.004 file - promoters50/1019915
tttctagt

SEQ ID NO: 157625 - DNA, 8 bp, Unknown
  misc_feature (1)..( 8): Result.004 file - promoters50/1019915
tttttagt

SEQ ID NO: 157626 - DNA, 8 bp, Unknown
  misc_feature (1)..( 8): Result.004 file - promoters50/1019915
attttaga

SEQ ID NO: 157627 - DNA, 12 bp, Unknown
  misc_feature (1)..( 12): Result.004 file - promoters50/1019915
ataacaccgtta

SEQ ID NO: 157628 - DNA, 12 bp, Unknown
  misc_feature (1)..( 12): Result.004 file - promoters50/1019915
ataaaaccatta

SEQ ID NO: 157629 - DNA, 12 bp, Unknown
  misc_feature (1)..( 12): Result.004 file - promoters50/1019915
attaaaccattc

SEQ ID NO: 157630 - DNA, 10 bp, Unknown
  misc_feature (1)..( 10): Result.004 file - promoters50/1019915
aaatagtgat

SEQ ID NO: 157631 - DNA, 10 bp, Unknown
  misc_feature (1)..( 10): Result.004 file - promoters50/1019915
ttatattgat

SEQ ID NO: 157632 - DNA, 10 bp, Unknown
  misc_feature (1)..( 10): Result.004 file - promoters50/1019928
ttatattgtt

SEQ ID NO: 157633 - DNA, 16 bp, Unknown
  misc_feature (1)..( 16): Result.004 file - promoters50/1019928
cgaaatttgtaacttc

SEQ ID NO: 157634 - DNA, 16 bp, Unknown
  misc_feature (1)..( 16): Result.004 file - promoters50/1019928
atatctttataagtat

SEQ ID NO: 157635 - DNA, 16 bp, Unknown
  misc_feature (1)..( 16): Result.004 file - promoters50/1019928
gaaaacttataattat

SEQ ID NO: 157636 - DNA, 16 bp, Unknown
  misc_feature (1)..( 16): Result.004 file - promoters50/1019928
ataactttatgttatt

SEQ ID NO: 157637 - DNA, 16 bp, Unknown
  misc_feature (1)..( 16): Result.004 file - promoters50/1019928
caatctttatacaaaa

SEQ ID NO: 157638 - DNA, 16 bp, Unknown
  misc_feature (1)..( 16): Result.004 file - promoters50/1019928
ataactttatgttatt

SEQ ID NO: 157639 - DNA, 16 bp, Unknown
  misc_feature (1)..( 16): Result.004 file - promoters50/1019928
atattattatttctcg

SEQ ID NO: 157640 - DNA, 13 bp, Unknown
  misc_feature (1)..( 13): Result.004 file - promoters50/1019928
aaatttgttatgt

SEQ ID NO: 157641 - DNA, 13 bp, Unknown
  misc_feature (1)..( 13): Result.004 file - promoters50/1019928
ataattgttaatc

SEQ ID NO: 157642 - DNA, 14 bp, Unknown
  misc_feature (1)..( 14): Result.004 file - promoters50/1019928
tgcattagttcttc

SEQ ID NO: 157643 - DNA, 14 bp, Unknown
  misc_feature (1)..( 14): Result.004 file - promoters50/1019928
actttatgttatta

SEQ ID NO: 157644 - DNA, 14 bp, Unknown
  misc_feature (1)..( 14): Result.004 file - promoters50/1019928
taattttgttttat

SEQ ID NO: 157645 - DNA, 14 bp, Unknown
  misc_feature (1)..( 14): Result.004 file - promoters50/1019928
caatgatattatta

SEQ ID NO: 157646 - DNA, 17 bp, Unknown
  misc_feature (1)..( 17): Result.004 file - promoters50/1019928
tctattttaattcgttg

SEQ ID NO: 157647 - DNA, 17 bp, Unknown
  misc_feature (1)..( 17): Result.004 file - promoters50/1019928
aaacttttaaaatgcta

SEQ ID NO: 157648 - DNA, 17 bp, Unknown
  misc_feature (1)..( 17): Result.004 file - promoters50/1019928
aatttttcaatatttcg

SEQ ID NO: 157649 - DNA, 17 bp, Unknown
  misc_feature (1)..( 17): Result.004 file - promoters50/1019928
cttatttgaaattttca

SEQ ID NO: 157650 - DNA, 17 bp, Unknown
  misc_feature (1)..( 17): Result.004 file - promoters50/1019928
aaaatttcataaacttt

SEQ ID NO: 157651 - DNA, 17 bp, Unknown
  misc_feature (1)..( 17): Result.004 file - promoters50/1019928
aaaattgtgaaggaagc

SEQ ID NO: 157652 - DNA, 17 bp, Unknown
  misc_feature (1)..( 17): Result.004 file - promoters50/1019928
aaagaatgaaatctgtc

SEQ ID NO: 157653 - DNA, 9 bp, Unknown
  misc_feature (1)..( 9): Result.004 file - promoters50/1019928
cccataaaa

SEQ ID NO: 157654 - DNA, 9 bp, Unknown
  misc_feature (1)..( 9): Result.004 file - promoters50/1019928
gctataaaa

SEQ ID NO: 157655 - DNA, 9 bp, Unknown
  misc_feature (1)..( 9): Result.004 file - promoters50/1019928
cctataaat

SEQ ID NO: 157656 - DNA, 9 bp, Unknown
  misc_feature (1)..( 9): Result.004 file - promoters50/1019928
tatataaac

SEQ ID NO: 157657 - DNA, 9 bp, Unknown
  misc_feature (1)..( 9): Result.004 file - promoters50/1019928
tatataaat

SEQ ID NO: 157658 - DNA, 9 bp, Unknown
  misc_feature (1)..( 9): Result.004 file - promoters50/1019928
tatataaat

SEQ ID NO: 157659 - DNA, 11 bp, Unknown
  misc_feature (1)..( 11): Result.004 file - promoters50/1019928
ctataaatatc

SEQ ID NO: 157660 - DNA, 11 bp, Unknown
  misc_feature (1)..( 11): Result.004 file - promoters50/1019928
atataaacaaa

SEQ ID NO: 157661 - DNA, 11 bp, Unknown
  misc_feature (1)..( 11): Result.004 file - promoters50/1019928
atataaatgac

SEQ ID NO: 157662 - DNA, 11 bp, Unknown
  misc_feature (1)..( 11): Result.004 file - promoters50/1019928
cgataaatatc

SEQ ID NO: 157663 - DNA, 11 bp, Unknown
  misc_feature (1)..( 11): Result.004 file - promoters50/1019928
atataaatgac

SEQ ID NO: 157664 - DNA, 11 bp, Unknown
  misc_feature (1)..( 11): Result.004 file - promoters50/1019928
ctataaaaacc

SEQ ID NO: 157665 - DNA, 9 bp, Unknown
  misc_feature (1)..( 9): Result.004 file - promoters50/1019928
ctaaacttt

SEQ ID NO: 157666 - DNA, 9 bp, Unknown
  misc_feature (1)..( 9): Result.004 file - promoters50/1019928
tgaaaattt

SEQ ID NO: 157667 - DNA, 9 bp, Unknown
  misc_feature (1)..( 9): Result.004 file - promoters50/1019928
ataaacttt

SEQ ID NO: 157668 - DNA, 9 bp, Unknown
  misc_feature (1)..( 9): Result.004 file - promoters50/1019928
agaaaattc

SEQ ID NO: 157669 - DNA, 9 bp, Unknown
  misc_feature (1)..( 9): Result.004 file - promoters50/1019928
agaaaagaa

SEQ ID NO: 157670 - DNA, 9 bp, Unknown
  misc_feature (1)..( 9): Result.004 file - promoters50/1019979
aaaaaattg

SEQ ID NO: 157671 - DNA, 10 bp, Unknown
  misc_feature (1)..( 10): Result.004 file - promoters50/1019979
atataataca

SEQ ID NO: 157672 - DNA, 10 bp, Unknown
  misc_feature (1)..( 10): Result.004 file - promoters50/1019979
ataaaatatg

SEQ ID NO: 157673 - DNA, 10 bp, Unknown
  misc_feature (1)..( 10): Result.004 file - promoters50/1020005
gtaaaagatg

SEQ ID NO: 157674 - DNA, 8 bp, Unknown
  misc_feature (1)..( 8): Result.004 file - promoters50/1020005
tcttaaat

SEQ ID NO: 157675 - DNA, 8 bp, Unknown
  misc_feature (1)..( 8): Result.004 file - promoters50/1020005
tctaaaac

SEQ ID NO: 157676 - DNA, 8 bp, Unknown
  misc_feature (1)..( 8): Result.004 file - promoters50/1020005
agtaaaac

SEQ ID NO: 157677 - DNA, 11 bp, Unknown
  misc_feature (1)..( 11): Result.004 file - promoters50/1020005
aagaaaaaatg

SEQ ID NO: 157678 - DNA, 11 bp, Unknown
  misc_feature (1)..( 11): Result.004 file - promoters50/1020005
aagcaaagagg

SEQ ID NO: 157679 - DNA, 11 bp, Unknown
  misc_feature (1)..( 11): Result.004 file - promoters50/1020019
aaggaaacagg

SEQ ID NO: 157680 - DNA, 7 bp, Unknown
  misc_feature (1)..( 7): Result.004 file - promoters50/1020019
agtttta

SEQ ID NO: 157681 - DNA, 7 bp, Unknown
  misc_feature (1)..( 7): Result.004 file - promoters50/1020019
agttttt

SEQ ID NO: 157682 - DNA, 7 bp, Unknown
  misc_feature (1)..( 7): Result.004 file - promoters50/1020019
agttttt

SEQ ID NO: 157683 - DNA, 9 bp, Unknown
  misc_feature (1)..( 9): Result.004 file - promoters50/1020019
tttttaatc

SEQ ID NO: 157684 - DNA, 9 bp, Unknown
  misc_feature (1)..( 9): Result.004 file - promoters50/1020019
attttaatc

SEQ ID NO: 157685 - DNA, 9 bp, Unknown
  misc_feature (1)..( 9): Result.004 file - promoters50/1020019
tttttaatt

SEQ ID NO: 157686 - DNA, 12 bp, Unknown
  misc_feature (1)..( 12): Result.004 file - promoters50/1020019
agatattttata

SEQ ID NO: 157687 - DNA, 12 bp, Unknown
  misc_feature (1)..( 12): Result.004 file - promoters50/1020019
attcattttata

SEQ ID NO: 157688 - DNA, 12 bp, Unknown
  misc_feature (1)..( 12): Result.004 file - promoters50/1020019
ttaaattttaat

SEQ ID NO: 157689 - DNA, 12 bp, Unknown
  misc_feature (1)..( 12): Result.004 file - promoters50/1020019
ccatatattatt

SEQ ID NO: 157690 - DNA, 8 bp, Unknown
  misc_feature (1)..( 8): Result.004 file - promoters50/1020019
agacaaac

SEQ ID NO: 157691 - DNA, 8 bp, Unknown
  misc_feature (1)..( 8): Result.004 file - promoters50/1020019
agaaaaac

SEQ ID NO: 157692 - DNA, 8 bp, Unknown
  misc_feature (1)..( 8): Result.004 file - promoters50/1020019
ccacaaac

SEQ ID NO: 157693 - DNA, 8 bp, Unknown
  misc_feature (1)..( 8): Result.004 file - promoters50/1020019
tacaatta

SEQ ID NO: 157694 - DNA, 8 bp, Unknown
  misc_feature (1)..( 8): Result.004 file - promoters50/1020019
gacattta

SEQ ID NO: 157695 - DNA, 8 bp, Unknown
  misc_feature (1)..( 8): Result.004 file - promoters50/1020019
gactttta

SEQ ID NO: 157696 - DNA, 9 bp, Unknown
  misc_feature (1)..( 9): Result.004 file - promoters50/1020019
ataagatat

SEQ ID NO: 157697 - DNA, 9 bp, Unknown
  misc_feature (1)..( 9): Result.004 file - promoters50/1020019
ataatatat

SEQ ID NO: 157698 - DNA, 9 bp, Unknown
  misc_feature (1)..( 9): Result.004 file - promoters50/1020019
gccatatat

SEQ ID NO: 157699 - DNA, 12 bp, Unknown
  misc_feature (1)..( 12): Result.004 file - promoters50/1020019
tattgccaaaat

SEQ ID NO: 157700 - DNA, 12 bp, Unknown
  misc_feature (1)..( 12): Result.004 file - promoters50/1020019
tattgacaaaat

SEQ ID NO: 157701 - DNA, 12 bp, Unknown
  misc_feature (1)..( 12): Result.004 file - promoters50/1020019
tattgactttta

SEQ ID NO: 157702 - DNA, 12 bp, Unknown
  misc_feature (1)..( 12): Result.004 file - promoters50/1020019
tttagacacaat

SEQ ID NO: 157703 - DNA, 8 bp, Unknown
  misc_feature (1)..( 8): Result.004 file - promoters50/1020019
cattaaaa

SEQ ID NO: 157704 - DNA, 8 bp, Unknown
  misc_feature (1)..( 8): Result.004 file - promoters50/1020019
gtttaaaa

SEQ ID NO: 157705 - DNA, 8 bp, Unknown
  misc_feature (1)..( 8): Result.004 file - promoters50/1020023
cattgaaa

SEQ ID NO: 157706 - DNA, 12 bp, Unknown
  misc_feature (1)..( 12): Result.004 file - promoters50/1020023
atatttatataa

SEQ ID NO: 157707 - DNA, 12 bp, Unknown
  misc_feature (1)..( 12): Result.004 file - promoters50/1020023
caatttagataa

SEQ ID NO: 157708 - DNA, 12 bp, Unknown
  misc_feature (1)..( 12): Result.004 file - promoters50/1020023
aagtttataaaa

SEQ ID NO: 157709 - DNA, 12 bp, Unknown
  misc_feature (1)..( 12): Result.004 file - promoters50/1020023
caatttaatacc

SEQ ID NO: 157710 - DNA, 12 bp, Unknown
  misc_feature (1)..( 12): Result.004 file - promoters50/1020023
tgattaataatt

SEQ ID NO: 157711 - DNA, 12 bp, Unknown
  misc_feature (1)..( 12): Result.004 file - promoters50/1020023
gccttaatatcg

SEQ ID NO: 157712 - DNA, 12 bp, Unknown
  misc_feature (1)..( 12): Result.004 file - promoters50/1020023
tggtttatggca

SEQ ID NO: 157713 - DNA, 12 bp, Unknown
  misc_feature (1)..( 12): Result.004 file - promoters50/1020023
tcctatatatca

SEQ ID NO: 157714 - DNA, 12 bp, Unknown
  misc_feature (1)..( 12): Result.004 file - promoters50/1020023
ttctatatatat

SEQ ID NO: 157715 - DNA, 12 bp, Unknown
  misc_feature (1)..( 12): Result.004 file - promoters50/1020023
tcctataaatat

SEQ ID NO: 157716 - DNA, 12 bp, Unknown
  misc_feature (1)..( 12): Result.004 file - promoters50/1020023
tcctataaattg

SEQ ID NO: 157717 - DNA, 12 bp, Unknown
  misc_feature (1)..( 12): Result.004 file - promoters50/1020023
aaatataaatat

SEQ ID NO: 157718 - DNA, 12 bp, Unknown
  misc_feature (1)..( 12): Result.004 file - promoters50/1020023
gtgtataaatat

SEQ ID NO: 157719 - DNA, 13 bp, Unknown
  misc_feature (1)..( 13): Result.004 file - promoters50/1020023
actatttaaaagt

SEQ ID NO: 157720 - DNA, 13 bp, Unknown
  misc_feature (1)..( 13): Result.004 file - promoters50/1020023
actattcttcgat

SEQ ID NO: 157721 - DNA, 14 bp, Unknown
  misc_feature (1)..( 14): Result.004 file - promoters50/1020023
cctaattaagtctt

SEQ ID NO: 157722 - DNA, 14 bp, Unknown
  misc_feature (1)..( 14): Result.004 file - promoters50/1020023
gataaataaactta

SEQ ID NO: 157723 - DNA, 14 bp, Unknown
  misc_feature (1)..( 14): Result.004 file - promoters50/1020023
ctataataaaatta

SEQ ID NO: 157724 - DNA, 14 bp, Unknown
  misc_feature (1)..( 14): Result.004 file - promoters50/1020023
accaaataaaagaa

SEQ ID NO: 157725 - DNA, 12 bp, Unknown
  misc_feature (1)..( 12): Result.004 file - promoters50/1020023
aattttatgcaa

SEQ ID NO: 157726 - DNA, 12 bp, Unknown
  misc_feature (1)..( 12): Result.004 file - promoters50/1020023
atttttatgtat

SEQ ID NO: 157727 - DNA, 12 bp, Unknown
  misc_feature (1)..( 12): Result.004 file - promoters50/1020023
gattttatcttt

SEQ ID NO: 157728 - DNA, 12 bp, Unknown
  misc_feature (1)..( 12): Result.004 file - promoters50/1020023
ttttttttgtat

SEQ ID NO: 157729 - DNA, 12 bp, Unknown
  misc_feature (1)..( 12): Result.004 file - promoters50/1020023
tctgttatgtct

SEQ ID NO: 157730 - DNA, 12 bp, Unknown
  misc_feature (1)..( 12): Result.004 file - promoters50/1020023
gtttttctgttt

SEQ ID NO: 157731 - DNA, 12 bp, Unknown
  misc_feature (1)..( 12): Result.004 file - promoters50/1020046
gattttcagatt

SEQ ID NO: 157732 - DNA, 11 bp, Unknown
  misc_feature (1)..( 11): Result.004 file - promoters50/1020046
gatcttaattc

SEQ ID NO: 157733 - DNA, 11 bp, Unknown
  misc_feature (1)..( 11): Result.004 file - promoters50/1020046
taatttaatta

SEQ ID NO: 157734 - DNA, 11 bp, Unknown
  misc_feature (1)..( 11): Result.004 file - promoters50/1020046
ctcattatttc

SEQ ID NO: 157735 - DNA, 11 bp, Unknown
  misc_feature (1)..( 11): Result.004 file - promoters50/1020046
gattttaataa

SEQ ID NO: 157736 - DNA, 11 bp, Unknown
  misc_feature (1)..( 11): Result.004 file - promoters50/1020046
ttaataaatcg

SEQ ID NO: 157737 - DNA, 11 bp, Unknown
  misc_feature (1)..( 11): Result.004 file - promoters50/1020046
tattctaaaaa

SEQ ID NO: 157738 - DNA, 8 bp, Unknown
  misc_feature (1)..( 8): Result.004 file - promoters50/1020046
tttataag

SEQ ID NO: 157739 - DNA, 8 bp, Unknown
  misc_feature (1)..( 8): Result.004 file - promoters50/1020046
cttataaa

SEQ ID NO: 157740 - DNA, 8 bp, Unknown
  misc_feature (1)..( 8): Result.004 file - promoters50/1020046
tttatata

SEQ ID NO: 157741 - DNA, 8 bp, Unknown
  misc_feature (1)..( 8): Result.004 file - promoters50/1020046
tttataaa

SEQ ID NO: 157742 - DNA, 9 bp, Unknown
  misc_feature (1)..( 9): Result.004 file - promoters50/1020046
tctattaag

SEQ ID NO: 157743 - DNA, 10 bp, Unknown
  misc_feature (1)..( 10): Result.004 file - promoters50/1020046
tttagatatg

SEQ ID NO: 157744 - DNA, 13 bp, Unknown
  misc_feature (1)..( 13): Result.004 file - promoters50/1020046
tgtatatattttt

SEQ ID NO: 157745 - DNA, 13 bp, Unknown
  misc_feature (1)..( 13): Result.004 file - promoters50/1020046
aaaatatatatat

SEQ ID NO: 157746 - DNA, 13 bp, Unknown
  misc_feature (1)..( 13): Result.004 file - promoters50/1020046
cgtttatgtttgg

SEQ ID NO: 157747 - DNA, 13 bp, Unknown
  misc_feature (1)..( 13): Result.004 file - promoters50/1020046
taaacatattcaa

SEQ ID NO: 157748 - DNA, 13 bp, Unknown
  misc_feature (1)..( 13): Result.004 file - promoters50/1020046
aaaatttatcaat

SEQ ID NO: 157749 - DNA, 13 bp, Unknown
  misc_feature (1)..( 13): Result.004 file - promoters50/1020046
aaattataaaccc

SEQ ID NO: 157750 - DNA, 13 bp, Unknown
  misc_feature (1)..( 13): Result.004 file - promoters50/1020046
ttattttattttt

SEQ ID NO: 157751 - DNA, 19 bp, Unknown
  misc_feature (1)..( 19): Result.004 file - promoters50/1020046
ttagaaaagtcatgtttct

SEQ ID NO: 157752 - DNA, 19 bp, Unknown
  misc_feature (1)..( 19): Result.004 file - promoters50/1020046
taatcaaagacatttttct

SEQ ID NO: 157753 - DNA, 19 bp, Unknown
  misc_feature (1)..( 19): Result.004 file - promoters50/1020046
taattaaaaacaaattacc

SEQ ID NO: 157754 - DNA, 19 bp, Unknown
  misc_feature (1)..( 19): Result.004 file - promoters50/1020046
caccaaaaaaaaaaaaaaa

SEQ ID NO: 157755 - DNA, 19 bp, Unknown
  misc_feature (1)..( 19): Result.004 file - promoters50/1020046
ttgaaaaaaactgcaaaaa

SEQ ID NO: 157756 - DNA, 19 bp, Unknown
  misc_feature (1)..( 19): Result.004 file - promoters50/1020046
cctaataagtaaggtaagc

SEQ ID NO: 157757 - DNA, 19 bp, Unknown
  misc_feature (1)..( 19): Result.004 file - promoters50/1020046
atattcaagtaaaatgcgt

SEQ ID NO: 157758 - DNA, 12 bp, Unknown
  misc_feature (1)..( 12): Result.004 file - promoters50/1020046
ttaaaaattaga

SEQ ID NO: 157759 - DNA, 12 bp, Unknown
  misc_feature (1)..( 12): Result.004 file - promoters50/1020046
aataaatttaga

SEQ ID NO: 157760 - DNA, 11 bp, Unknown
  misc_feature (1)..( 11): Result.004 file - promoters50/1020046
aaaaaatatac

SEQ ID NO: 157761 - DNA, 11 bp, Unknown
  misc_feature (1)..( 11): Result.004 file - promoters50/1020046
gaaaatttaga

SEQ ID NO: 157762 - DNA, 12 bp, Unknown
  misc_feature (1)..( 12): Result.004 file - promoters50/1020046
aacaaaattatt

SEQ ID NO: 157763 - DNA, 12 bp, Unknown
  misc_feature (1)..( 12): Result.004 file - promoters50/1020046
taagaaacggca

SEQ ID NO: 157764 - DNA, 12 bp, Unknown
  misc_feature (1)..( 12): Result.004 file - promoters50/1020046
gaagaaagacga

SEQ ID NO: 157765 - DNA, 12 bp, Unknown
  misc_feature (1)..( 12): Result.004 file - promoters50/1020046
tctataaagaca

SEQ ID NO: 157766 - DNA, 12 bp, Unknown
  misc_feature (1)..( 12): Result.004 file - promoters50/1020046
tatttaaacaca

SEQ ID NO: 157767 - DNA, 12 bp, Unknown
  misc_feature (1)..( 12): Result.004 file - promoters50/1020046
tttataaacaca

SEQ ID NO: 157768 - DNA, 12 bp, Unknown
  misc_feature (1)..( 12): Result.004 file - promoters50/1020046
tttataaccaaa

SEQ ID NO: 157769 - DNA, 12 bp, Unknown
  misc_feature (1)..( 12): Result.004 file - promoters50/1020046
cccttaaaaccg

SEQ ID NO: 157770 - DNA, 12 bp, Unknown
  misc_feature (1)..( 12): Result.004 file - promoters50/1020046
cttttaaaccat

SEQ ID NO: 157771 - DNA, 12 bp, Unknown
  misc_feature (1)..( 12): Result.004 file - promoters50/1020046
tttaaatgtgat

SEQ ID NO: 157772 - DNA, 12 bp, Unknown
  misc_feature (1)..( 12): Result.004 file - promoters50/1020046
attaaattgaga

SEQ ID NO: 157773 - DNA, 13 bp, Unknown
  misc_feature (1)..( 13): Result.004 file - promoters50/1020046
tttcaaattcgag

SEQ ID NO: 157774 - DNA, 13 bp, Unknown
  misc_feature (1)..( 13): Result.004 file - promoters50/1020046
tttgaaaactgga

SEQ ID NO: 157775 - DNA, 13 bp, Unknown
  misc_feature (1)..( 13): Result.004 file - promoters50/1020046
attcaaattcctt

SEQ ID NO: 157776 - DNA, 13 bp, Unknown
  misc_feature (1)..( 13): Result.004 file - promoters50/1020046
tgagaaaaataaa

SEQ ID NO: 157777 - DNA, 14 bp, Unknown
  misc_feature (1)..( 14): Result.004 file - promoters50/1020046
cccaaaaaatatat

SEQ ID NO: 157778 - DNA, 14 bp, Unknown
  misc_feature (1)..( 14): Result.004 file - promoters50/1020046
aagtaaacatattc

SEQ ID NO: 157779 - DNA, 14 bp, Unknown
  misc_feature (1)..( 14): Result.004 file - promoters50/1020046
cattcaaaatttat

SEQ ID NO: 157780 - DNA, 14 bp, Unknown
  misc_feature (1)..( 14): Result.004 file - promoters50/1020046
aaaagaaattataa

SEQ ID NO: 157781 - DNA, 14 bp, Unknown
  misc_feature (1)..( 14): Result.004 file - promoters50/1020046
ttctaaatacttat

SEQ ID NO: 157782 - DNA, 14 bp, Unknown
  misc_feature (1)..( 14): Result.004 file - promoters50/1020046
gccaaaactttgtc

SEQ ID NO: 157783 - DNA, 13 bp, Unknown
  misc_feature (1)..( 13): Result.004 file - promoters50/1020046
cataaaatatgta

SEQ ID NO: 157784 - DNA, 13 bp, Unknown
  misc_feature (1)..( 13): Result.004 file - promoters50/1020046
aataaaaaataaa

SEQ ID NO: 157785 - DNA, 13 bp, Unknown
  misc_feature (1)..( 13): Result.004 file - promoters50/1020046
aataaaaaataaa

SEQ ID NO: 157786 - DNA, 13 bp, Unknown
  misc_feature (1)..( 13): Result.004 file - promoters50/1020046
cctaaaaagtggg

SEQ ID NO: 157787 - DNA, 13 bp, Unknown
  misc_feature (1)..( 13): Result.004 file - promoters50/1020046
aatcaaattatag

SEQ ID NO: 157788 - DNA, 13 bp, Unknown
  misc_feature (1)..( 13): Result.004 file - promoters50/1020145
aattaaaacaaaa

SEQ ID NO: 157789 - DNA, 8 bp, Unknown
  misc_feature (1)..( 8): Result.004 file - promoters50/1020145
atttgaaa

SEQ ID NO: 157790 - DNA, 8 bp, Unknown
  misc_feature (1)..( 8): Result.004 file - promoters50/1020145
atttgaat

SEQ ID NO: 157791 - DNA, 8 bp, Unknown
  misc_feature (1)..( 8): Result.004 file - promoters50/1020208
atttaaat

SEQ ID NO: 157792 - DNA, 12 bp, Unknown
  misc_feature (1)..( 12): Result.004 file - promoters50/1020208
aataaatttatt

SEQ ID NO: 157793 - DNA, 12 bp, Unknown
  misc_feature (1)..( 12): Result.004 file - promoters50/1020208
tataaatcacta

SEQ ID NO: 157794 - DNA, 12 bp, Unknown
  misc_feature (1)..( 12): Result.004 file - promoters50/1020208
actaaaattaga

SEQ ID NO: 157795 - DNA, 12 bp, Unknown
  misc_feature (1)..( 12): Result.004 file - promoters50/1020208
caaaaaaagaaa

SEQ ID NO: 157796 - DNA, 12 bp, Unknown
  misc_feature (1)..( 12): Result.004 file - promoters50/1020208
ttccaattaggg

SEQ ID NO: 157797 - DNA, 12 bp, Unknown
  misc_feature (1)..( 12): Result.004 file - promoters50/1020208
caaaaactgtta

SEQ ID NO: 157798 - DNA, 12 bp, Unknown
  misc_feature (1)..( 12): Result.004 file - promoters50/1020208
acatatgattgt

SEQ ID NO: 157799 - DNA, 12 bp, Unknown
  misc_feature (1)..( 12): Result.004 file - promoters50/1020208
tttgatgaatgt

SEQ ID NO: 157800 - DNA, 12 bp, Unknown
  misc_feature (1)..( 12): Result.004 file - promoters50/1020208
ccttgtgaatgt

SEQ ID NO: 157801 - DNA, 12 bp, Unknown
  misc_feature (1)..( 12): Result.004 file - promoters50/1020208
cgtgatgaagaa

SEQ ID NO: 157802 - DNA, 12 bp, Unknown
  misc_feature (1)..( 12): Result.004 file - promoters50/1020208
aaagatgaagtc

SEQ ID NO: 157803 - DNA, 12 bp, Unknown
  misc_feature (1)..( 12): Result.004 file - promoters50/1020223
tttgctgaataa

SEQ ID NO: 157804 - DNA, 9 bp, Unknown
  misc_feature (1)..( 9): Result.004 file - promoters50/1020223
tttgtagtg

SEQ ID NO: 157805 - DNA, 9 bp, Unknown
  misc_feature (1)..( 9): Result.004 file - promoters50/1020223
tttgttgtg

SEQ ID NO: 157806 - DNA, 9 bp, Unknown
  misc_feature (1)..( 9): Result.004 file - promoters50/1020223
attgtagct

SEQ ID NO: 157807 - DNA, 8 bp, Unknown
  misc_feature (1)..( 8): Result.004 file - promoters50/1020223
tgtttgtt

SEQ ID NO: 157808 - DNA, 8 bp, Unknown
  misc_feature (1)..( 8): Result.004 file - promoters50/1020223
gatttgtt

SEQ ID NO: 157809 - DNA, 8 bp, Unknown
  misc_feature (1)..( 8): Result.004 file - promoters50/1020223
gatatgta

SEQ ID NO: 157810 - DNA, 8 bp, Unknown
  misc_feature (1)..( 8): Result.004 file - promoters50/1020223
tgatttgt

SEQ ID NO: 157811 - DNA, 8 bp, Unknown
  misc_feature (1)..( 8): Result.004 file - promoters50/1020223
tgatttgg

SEQ ID NO: 157812 - DNA, 8 bp, Unknown
  misc_feature (1)..( 8): Result.004 file - promoters50/1020223
agatatgt

SEQ ID NO: 157813 - DNA, 12 bp, Unknown
  misc_feature (1)..( 12): Result.004 file - promoters50/1020223
gatttgttcaat

SEQ ID NO: 157814 - DNA, 12 bp, Unknown
  misc_feature (1)..( 12): Result.004 file - promoters50/1020223
agtttgttcaat

SEQ ID NO: 157815 - DNA, 12 bp, Unknown
  misc_feature (1)..( 12): Result.004 file - promoters50/1020223
gatatgtatgtt

SEQ ID NO: 157816 - DNA, 7 bp, Unknown
  misc_feature (1)..( 7): Result.004 file - promoters50/1020223
gtttgtt

SEQ ID NO: 157817 - DNA, 7 bp, Unknown
  misc_feature (1)..( 7): Result.004 file - promoters50/1020223
ttttgtt

SEQ ID NO: 157818 - DNA, 7 bp, Unknown
  misc_feature (1)..( 7): Result.004 file - promoters50/1020223
gtttgtg

SEQ ID NO: 157819 - DNA, 8 bp, Unknown
  misc_feature (1)..( 8): Result.004 file - promoters50/1020223
atcatatt

SEQ ID NO: 157820 - DNA, 8 bp, Unknown
  misc_feature (1)..( 8): Result.004 file - promoters50/1020223
atcatatt

SEQ ID NO: 157821 - DNA, 8 bp, Unknown
  misc_feature (1)..( 8): Result.004 file - promoters50/1020265
atcatatt

SEQ ID NO: 157822 - DNA, 8 bp, Unknown
  misc_feature (1)..( 8): Result.004 file - promoters50/1020265
atgactac

SEQ ID NO: 157823 - DNA, 8 bp, Unknown
  misc_feature (1)..( 8): Result.004 file - promoters50/1020265
atgactta

SEQ ID NO: 157824 - DNA, 8 bp, Unknown
  misc_feature (1)..( 8): Result.004 file - promoters50/1020265
ttgattta

SEQ ID NO: 157825 - DNA, 7 bp, Unknown
  misc_feature (1)..( 7): Result.004 file - promoters50/1020265
attgtgt

SEQ ID NO: 157826 - DNA, 7 bp, Unknown
  misc_feature (1)..( 7): Result.004 file - promoters50/1020265
attctgt

SEQ ID NO: 157827 - DNA, 7 bp, Unknown
  misc_feature (1)..( 7): Result.004 file - promoters50/1020265
tttgtgt

SEQ ID NO: 157828 - DNA, 8 bp, Unknown
  misc_feature (1)..( 8): Result.004 file - promoters50/1020265
atttttca

SEQ ID NO: 157829 - DNA, 8 bp, Unknown
  misc_feature (1)..( 8): Result.004 file - promoters50/1020265
attattct

SEQ ID NO: 157830 - DNA, 8 bp, Unknown
  misc_feature (1)..( 8): Result.004 file - promoters50/1020265
cttattct

SEQ ID NO: 157831 - DNA, 8 bp, Unknown
  misc_feature (1)..( 8): Result.004 file - promoters50/1020265
ggaataaa

SEQ ID NO: 157832 - DNA, 8 bp, Unknown
  misc_feature (1)..( 8): Result.004 file - promoters50/1020265
tgaagaaa

SEQ ID NO: 157833 - DNA, 8 bp, Unknown
  misc_feature (1)..( 8): Result.004 file - promoters50/1020272
tgaagaat

SEQ ID NO: 157834 - DNA, 8 bp, Unknown
  misc_feature (1)..( 8): Result.004 file - promoters50/1020272
gcgacaaa

SEQ ID NO: 157835 - DNA, 8 bp, Unknown
  misc_feature (1)..( 8): Result.004 file - promoters50/1020272
gcggcaac

SEQ ID NO: 157836 - DNA, 8 bp, Unknown
  misc_feature (1)..( 8): Result.004 file - promoters50/1020272
gcggtaac

SEQ ID NO: 157837 - DNA, 8 bp, Unknown
  misc_feature (1)..( 8): Result.004 file - promoters50/1020272
aaacattt

SEQ ID NO: 157838 - DNA, 8 bp, Unknown
  misc_feature (1)..( 8): Result.004 file - promoters50/1020272
aaacgttt

SEQ ID NO: 157839 - DNA, 8 bp, Unknown
  misc_feature (1)..( 8): Result.004 file - promoters50/1020272
aaaagtta

SEQ ID NO: 157840 - DNA, 6 bp, Unknown
  misc_feature (1)..( 6): Result.004 file - promoters50/1020272
tttatt

SEQ ID NO: 157841 - DNA, 6 bp, Unknown
  misc_feature (1)..( 6): Result.004 file - promoters50/1020272
tttatt

SEQ ID NO: 157842 - DNA, 7 bp, Unknown
  misc_feature (1)..( 7): Result.004 file - promoters50/1020272
tttaatt

SEQ ID NO: 157843 - DNA, 11 bp, Unknown
  misc_feature (1)..( 11): Result.004 file - promoters50/1020272
caagtacctac

SEQ ID NO: 157844 - DNA, 11 bp, Unknown
  misc_feature (1)..( 11): Result.004 file - promoters50/1020272
gcggtaactaa

SEQ ID NO: 157845 - DNA, 11 bp, Unknown
  misc_feature (1)..( 11): Result.004 file - promoters50/1020272
gcggcaaccgc

SEQ ID NO: 157846 - DNA, 11 bp, Unknown
  misc_feature (1)..( 11): Result.004 file - promoters50/1020272
tcgtaaactaa

SEQ ID NO: 157847 - DNA, 9 bp, Unknown
  misc_feature (1)..( 9): Result.004 file - promoters50/1020272
ttgaaatta

SEQ ID NO: 157848 - DNA, 9 bp, Unknown
  misc_feature (1)..( 9): Result.004 file - promoters50/1020272
ttgagattg

SEQ ID NO: 157849 - DNA, 9 bp, Unknown
  misc_feature (1)..( 9): Result.004 file - promoters50/1020274
cgaagattg

SEQ ID NO: 157850 - DNA, 11 bp, Unknown
  misc_feature (1)..( 11): Result.004 file - promoters50/1020274
aaatttaaaaa

SEQ ID NO: 157851 - DNA, 11 bp, Unknown
  misc_feature (1)..( 11): Result.004 file - promoters50/1020274
atatttaaaat

SEQ ID NO: 157852 - DNA, 11 bp, Unknown
  misc_feature (1)..( 11): Result.004 file - promoters50/1020274
aaacttaaatg

SEQ ID NO: 157853 - DNA, 11 bp, Unknown
  misc_feature (1)..( 11): Result.004 file - promoters50/1020274
gcattaaaaaa

SEQ ID NO: 157854 - DNA, 11 bp, Unknown
  misc_feature (1)..( 11): Result.004 file - promoters50/1020274
taagagtaaaa

SEQ ID NO: 157855 - DNA, 11 bp, Unknown
  misc_feature (1)..( 11): Result.004 file - promoters50/1020274
ttagaataatt

SEQ ID NO: 157856 - DNA, 11 bp, Unknown
  misc_feature (1)..( 11): Result.004 file - promoters50/1020274
aaagaatataa

SEQ ID NO: 157857 - DNA, 11 bp, Unknown
  misc_feature (1)..( 11): Result.004 file - promoters50/1020274
aaagaagataa

SEQ ID NO: 157858 - DNA, 16 bp, Unknown
  misc_feature (1)..( 16): Result.004 file - promoters50/1020274
tgaaaataacatcaat

SEQ ID NO: 157859 - DNA, 16 bp, Unknown
  misc_feature (1)..( 16): Result.004 file - promoters50/1020274
tgataattcgaagacg

SEQ ID NO: 157860 - DNA, 16 bp, Unknown
  misc_feature (1)..( 16): Result.004 file - promoters50/1020274
tcaaaattaacaacaa

SEQ ID NO: 157861 - DNA, 16 bp, Unknown
  misc_feature (1)..( 16): Result.004 file - promoters50/1020274
ttccaacagcaagtag

SEQ ID NO: 157862 - DNA, 9 bp, Unknown
  misc_feature (1)..( 9): Result.004 file - promoters50/1020274
tattaatat

SEQ ID NO: 157863 - DNA, 9 bp, Unknown
  misc_feature (1)..( 9): Result.004 file - promoters50/1020274
tataaatca

SEQ ID NO: 157864 - DNA, 9 bp, Unknown
  misc_feature (1)..( 9): Result.004 file - promoters50/1020274
tatttatat

SEQ ID NO: 157865 - DNA, 9 bp, Unknown
  misc_feature (1)..( 9): Result.004 file - promoters50/1020274
cattagtat

SEQ ID NO: 157866 - DNA, 17 bp, Unknown
  misc_feature (1)..( 17): Result.004 file - promoters50/1020274
aaaataacatcaattag

SEQ ID NO: 157867 - DNA, 17 bp, Unknown
  misc_feature (1)..( 17): Result.004 file - promoters50/1020274
tttccaacagcaagtag

SEQ ID NO: 157868 - DNA, 17 bp, Unknown
  misc_feature (1)..( 17): Result.004 file - promoters50/1020274
aaattaacaacaaatcc

SEQ ID NO: 157869 - DNA, 17 bp, Unknown
  misc_feature (1)..( 17): Result.004 file - promoters50/1020274
tatgtaacaaacaaaaa

SEQ ID NO: 157870 - DNA, 17 bp, Unknown
  misc_feature (1)..( 17): Result.004 file - promoters50/1020274
gaagtaaaaaatggtat

SEQ ID NO: 157871 - DNA, 9 bp, Unknown
  misc_feature (1)..( 9): Result.004 file - promoters50/1020274
aatttttat

SEQ ID NO: 157872 - DNA, 9 bp, Unknown
  misc_feature (1)..( 9): Result.004 file - promoters50/1020274
gatttttga

SEQ ID NO: 157873 - DNA, 9 bp, Unknown
  misc_feature (1)..( 9): Result.004 file - promoters50/1020274
aatatttat

SEQ ID NO: 157874 - DNA, 9 bp, Unknown
  misc_feature (1)..( 9): Result.004 file - promoters50/1020274
aatattaca

SEQ ID NO: 157875 - DNA, 9 bp, Unknown
  misc_feature (1)..( 9): Result.004 file - promoters50/1020274
agtatttaa

SEQ ID NO: 157876 - DNA, 9 bp, Unknown
  misc_feature (1)..( 9): Result.004 file - promoters50/1020274
atttttatt

SEQ ID NO: 157877 - DNA, 9 bp, Unknown
  misc_feature (1)..( 9): Result.004 file - promoters50/1020274
tatttaatt

SEQ ID NO: 157878 - DNA, 9 bp, Unknown
  misc_feature (1)..( 9): Result.004 file - promoters50/1020274
catttaaaa

SEQ ID NO: 157879 - DNA, 9 bp, Unknown
  misc_feature (1)..( 9): Result.004 file - promoters50/1020313
tatataact

SEQ ID NO: 157880 - DNA, 13 bp, Unknown
  misc_feature (1)..( 13): Result.004 file - promoters50/1020313
tgtttattttact

SEQ ID NO: 157881 - DNA, 13 bp, Unknown
  misc_feature (1)..( 13): Result.004 file - promoters50/1020313
attttttttttag

SEQ ID NO: 157882 - DNA, 13 bp, Unknown
  misc_feature (1)..( 13): Result.004 file - promoters50/1020313
tgttaattgtctc

SEQ ID NO: 157883 - DNA, 13 bp, Unknown
  misc_feature (1)..( 13): Result.004 file - promoters50/1020313
aaccaattttact

SEQ ID NO: 157884 - DNA, 13 bp, Unknown
  misc_feature (1)..( 13): Result.004 file - promoters50/1020313
tatttatttattt

SEQ ID NO: 157885 - DNA, 13 bp, Unknown
  misc_feature (1)..( 13): Result.004 file - promoters50/1020313
tgtttattggcgt

SEQ ID NO: 157886 - DNA, 14 bp, Unknown
  misc_feature (1)..( 14): Result.004 file - promoters50/1020313
tcagagtcgtcaag

SEQ ID NO: 157887 - DNA, 14 bp, Unknown
  misc_feature (1)..( 14): Result.004 file - promoters50/1020313
aggaagtcatcatt

SEQ ID NO: 157888 - DNA, 14 bp, Unknown
  misc_feature (1)..( 14): Result.004 file - promoters50/1020313
ttaacttcatcaaa

SEQ ID NO: 157889 - DNA, 14 bp, Unknown
  misc_feature (1)..( 14): Result.004 file - promoters50/1020313
atgacgtcataatt

SEQ ID NO: 157890 - DNA, 14 bp, Unknown
  misc_feature (1)..( 14): Result.004 file - promoters50/1020313
ttaactttatcata

SEQ ID NO: 157891 - DNA, 14 bp, Unknown
  misc_feature (1)..( 14): Result.004 file - promoters50/1020362
gaaacgacgccatt

SEQ ID NO: 157892 - DNA, 11 bp, Unknown
  misc_feature (1)..( 11): Result.004 file - promoters50/1020362
ccccaaacaaa

SEQ ID NO: 157893 - DNA, 11 bp, Unknown
  misc_feature (1)..( 11): Result.004 file - promoters50/1020362
ccccaaccaat

SEQ ID NO: 157894 - DNA, 11 bp, Unknown
  misc_feature (1)..( 11): Result.004 file - promoters50/1020362
tgtcaaaaaaa

SEQ ID NO: 157895 - DNA, 7 bp, Unknown
  misc_feature (1)..( 7): Result.004 file - promoters50/1020362
attttgg

SEQ ID NO: 157896 - DNA, 7 bp, Unknown
  misc_feature (1)..( 7): Result.004 file - promoters50/1020362
attgtgg

SEQ ID NO: 157897 - DNA, 7 bp, Unknown
  misc_feature (1)..( 7): Result.004 file - promoters50/1020362
atagttt

SEQ ID NO: 157898 - DNA, 7 bp, Unknown
  misc_feature (1)..( 7): Result.004 file - promoters50/1020362
atgtaag

SEQ ID NO: 157899 - DNA, 7 bp, Unknown
  misc_feature (1)..( 7): Result.004 file - promoters50/1020362
atgtaac

SEQ ID NO: 157900 - DNA, 7 bp, Unknown
  misc_feature (1)..( 7): Result.004 file - promoters50/1020362
atgaaag

SEQ ID NO: 157901 - DNA, 8 bp, Unknown
  misc_feature (1)..( 8): Result.004 file - promoters50/1020362
caaatctc

SEQ ID NO: 157902 - DNA, 8 bp, Unknown
  misc_feature (1)..( 8): Result.004 file - promoters50/1020362
aaaatctc

SEQ ID NO: 157903 - DNA, 8 bp, Unknown
  misc_feature (1)..( 8): Result.004 file - promoters50/1020364
caactctc

SEQ ID NO: 157904 - DNA, 13 bp, Unknown
  misc_feature (1)..( 13): Result.004 file - promoters50/1020364
ctgataaatatat

SEQ ID NO: 157905 - DNA, 13 bp, Unknown
  misc_feature (1)..( 13): Result.004 file - promoters50/1020364
ttgttaactatat

SEQ ID NO: 157906 - DNA, 13 bp, Unknown
  misc_feature (1)..( 13): Result.004 file - promoters50/1020364
tgattaattaatc

SEQ ID NO: 157907 - DNA, 13 bp, Unknown
  misc_feature (1)..( 13): Result.004 file - promoters50/1020364
aaacaaaacatat

SEQ ID NO: 157908 - DNA, 13 bp, Unknown
  misc_feature (1)..( 13): Result.004 file - promoters50/1020364
accctaattatct

SEQ ID NO: 157909 - DNA, 13 bp, Unknown
  misc_feature (1)..( 13): Result.004 file - promoters50/1020364
tgataaattattc

SEQ ID NO: 157910 - DNA, 13 bp, Unknown
  misc_feature (1)..( 13): Result.004 file - promoters50/1020364
aaattaaaatggt

SEQ ID NO: 157911 - DNA, 13 bp, Unknown
  misc_feature (1)..( 13): Result.004 file - promoters50/1020364
taattaatttctt

SEQ ID NO: 157912 - DNA, 13 bp, Unknown
  misc_feature (1)..( 13): Result.004 file - promoters50/1020364
aaactaaaaaggt

SEQ ID NO: 157913 - DNA, 13 bp, Unknown
  misc_feature (1)..( 13): Result.004 file - promoters50/1020364
aaatcaaatcgaa

SEQ ID NO: 157914 - DNA, 13 bp, Unknown
  misc_feature (1)..( 13): Result.004 file - promoters50/1020364
aaagactttgggt

SEQ ID NO: 157915 - DNA, 14 bp, Unknown
  misc_feature (1)..( 14): Result.004 file - promoters50/1020430
aaatctaaccacaa

SEQ ID NO: 157916 - DNA, 12 bp, Unknown
  misc_feature (1)..( 12): Result.004 file - promoters50/1020430
tatataactctg

SEQ ID NO: 157917 - DNA, 12 bp, Unknown
  misc_feature (1)..( 12): Result.004 file - promoters50/1020430
catataaatttg

SEQ ID NO: 157918 - DNA, 12 bp, Unknown
  misc_feature (1)..( 12): Result.004 file - promoters50/1020430
tatatatactct

SEQ ID NO: 157919 - DNA, 12 bp, Unknown
  misc_feature (1)..( 12): Result.004 file - promoters50/1020430
tctataaataca

SEQ ID NO: 157920 - DNA, 12 bp, Unknown
  misc_feature (1)..( 12): Result.004 file - promoters50/1020430
tatatatagaaa

SEQ ID NO: 157921 - DNA, 12 bp, Unknown
  misc_feature (1)..( 12): Result.004 file - promoters50/1020430
tatatataaaac

SEQ ID NO: 157922 - DNA, 12 bp, Unknown
  misc_feature (1)..( 12): Result.004 file - promoters50/1020430
gatataatacag

SEQ ID NO: 157923 - DNA, 11 bp, Unknown
  misc_feature (1)..( 11): Result.004 file - promoters50/1020430
taaagaaatgc

SEQ ID NO: 157924 - DNA, 11 bp, Unknown
  misc_feature (1)..( 11): Result.004 file - promoters50/1020430
taaacaaaatt

SEQ ID NO: 157925 - DNA, 11 bp, Unknown
  misc_feature (1)..( 11): Result.004 file - promoters50/1020430
aaaacaaaggt

SEQ ID NO: 157926 - DNA, 11 bp, Unknown
  misc_feature (1)..( 11): Result.004 file - promoters50/1020430
taaacaaatga

SEQ ID NO: 157927 - DNA, 11 bp, Unknown
  misc_feature (1)..( 11): Result.004 file - promoters50/1020430
gtcccaaatgg

SEQ ID NO: 157928 - DNA, 11 bp, Unknown
  misc_feature (1)..( 11): Result.004 file - promoters50/1020430
aatacaagtgg

SEQ ID NO: 157929 - DNA, 9 bp, Unknown
  misc_feature (1)..( 9): Result.004 file - promoters50/1020430
ggaacaaaa

SEQ ID NO: 157930 - DNA, 9 bp, Unknown
  misc_feature (1)..( 9): Result.004 file - promoters50/1020430
aaaacaaac

SEQ ID NO: 157931 - DNA, 9 bp, Unknown
  misc_feature (1)..( 9): Result.004 file - promoters50/1020430
agaagaaaa

SEQ ID NO: 157932 - DNA, 9 bp, Unknown
  misc_feature (1)..( 9): Result.004 file - promoters50/1020430
cgaataaaa

SEQ ID NO: 157933 - DNA, 9 bp, Unknown
  misc_feature (1)..( 9): Result.004 file - promoters50/1020430
caaacaaat

SEQ ID NO: 157934 - DNA, 9 bp, Unknown
  misc_feature (1)..( 9): Result.004 file - promoters50/1020430
aaaacaatt

SEQ ID NO: 157935 - DNA, 9 bp, Unknown
  misc_feature (1)..( 9): Result.004 file - promoters50/1020430
acaccaatg

SEQ ID NO: 157936 - DNA, 9 bp, Unknown
  misc_feature (1)..( 9): Result.004 file - promoters50/1020430
tcacaaatt

SEQ ID NO: 157937 - DNA, 9 bp, Unknown
  misc_feature (1)..( 9): Result.004 file - promoters50/1020430
caaccaatg

SEQ ID NO: 157938 - DNA, 9 bp, Unknown
  misc_feature (1)..( 9): Result.004 file - promoters50/1020430
caaccaact

SEQ ID NO: 157939 - DNA, 9 bp, Unknown
  misc_feature (1)..( 9): Result.004 file - promoters50/1020430
tcagaaact

SEQ ID NO: 157940 - DNA, 9 bp, Unknown
  misc_feature (1)..( 9): Result.004 file - promoters50/1020508
tcagaacaa

SEQ ID NO: 157941 - DNA, 10 bp, Unknown
  misc_feature (1)..( 10): Result.004 file - promoters50/1020508
acaaaattgt

SEQ ID NO: 157942 - DNA, 10 bp, Unknown
  misc_feature (1)..( 10): Result.004 file - promoters50/1020508
acaacattag

SEQ ID NO: 157943 - DNA, 10 bp, Unknown
  misc_feature (1)..( 10): Result.004 file - promoters50/1020508
gatacattaa

SEQ ID NO: 157944 - DNA, 10 bp, Unknown
  misc_feature (1)..( 10): Result.004 file - promoters50/1020508
tcgacattac

SEQ ID NO: 157945 - DNA, 10 bp, Unknown
  misc_feature (1)..( 10): Result.004 file - promoters50/1020512
cttacattaa

SEQ ID NO: 157946 - DNA, 10 bp, Unknown
  misc_feature (1)..( 10): Result.004 file - promoters50/1020512
aacaaatata

SEQ ID NO: 157947 - DNA, 10 bp, Unknown
  misc_feature (1)..( 10): Result.004 file - promoters50/1020512
aactaatata

SEQ ID NO: 157948 - DNA, 10 bp, Unknown
  misc_feature (1)..( 10): Result.004 file - promoters50/1020512
tgaaaatatt

SEQ ID NO: 157949 - DNA, 10 bp, Unknown
  misc_feature (1)..( 10): Result.004 file - promoters50/1020512
tgcaaagaaa

SEQ ID NO: 157950 - DNA, 10 bp, Unknown
  misc_feature (1)..( 10): Result.004 file - promoters50/1020512
ctctaatatg

SEQ ID NO: 157951 - DNA, 10 bp, Unknown
  misc_feature (1)..( 10): Result.004 file - promoters50/1020512
ttctaatttt

SEQ ID NO: 157952 - DNA, 10 bp, Unknown
  misc_feature (1)..( 10): Result.004 file - promoters50/1020512
atctaataaa

SEQ ID NO: 157953 - DNA, 12 bp, Unknown
  misc_feature (1)..( 12): Result.004 file - promoters50/1020512
aaactgaaccaa

SEQ ID NO: 157954 - DNA, 12 bp, Unknown
  misc_feature (1)..( 12): Result.004 file - promoters50/1020512
aaaatgaaaaac

SEQ ID NO: 157955 - DNA, 12 bp, Unknown
  misc_feature (1)..( 12): Result.004 file - promoters50/1020512
cgaataaaaaaa

SEQ ID NO: 157956 - DNA, 12 bp, Unknown
  misc_feature (1)..( 12): Result.004 file - promoters50/1020512
attttaaaaaaa

SEQ ID NO: 157957 - DNA, 12 bp, Unknown
  misc_feature (1)..( 12): Result.004 file - promoters50/1020512
cgattaacaaac

SEQ ID NO: 157958 - DNA, 12 bp, Unknown
  misc_feature (1)..( 12): Result.004 file - promoters50/1020512
aaaaagacaaac

SEQ ID NO: 157959 - DNA, 12 bp, Unknown
  misc_feature (1)..( 12): Result.004 file - promoters50/1020512
catttaacactt

SEQ ID NO: 157960 - DNA, 11 bp, Unknown
  misc_feature (1)..( 11): Result.004 file - promoters50/1020512
ataaaaaaaaa

SEQ ID NO: 157961 - DNA, 11 bp, Unknown
  misc_feature (1)..( 11): Result.004 file - promoters50/1020512
ggaaaaaaaag

SEQ ID NO: 157962 - DNA, 12 bp, Unknown
  misc_feature (1)..( 12): Result.004 file - promoters50/1020512
aaaatgaaaaac

SEQ ID NO: 157963 - DNA, 12 bp, Unknown
  misc_feature (1)..( 12): Result.004 file - promoters50/1020512
attttaaaaaaa

SEQ ID NO: 157964 - DNA, 12 bp, Unknown
  misc_feature (1)..( 12): Result.004 file - promoters50/1020512
cgattaacaaac

SEQ ID NO: 157965 - DNA, 12 bp, Unknown
  misc_feature (1)..( 12): Result.004 file - promoters50/1020535
catttaacactt

SEQ ID NO: 157966 - DNA, 6 bp, Unknown
  misc_feature (1)..( 6): Result.004 file - promoters50/1020535
gaaaat

SEQ ID NO: 157967 - DNA, 6 bp, Unknown
  misc_feature (1)..( 6): Result.004 file - promoters50/1020535
gaaaat

SEQ ID NO: 157968 - DNA, 6 bp, Unknown
  misc_feature (1)..( 6): Result.004 file - promoters50/1020535
gaaaat

SEQ ID NO: 157969 - DNA, 10 bp, Unknown
  misc_feature (1)..( 10): Result.004 file - promoters50/1020535
cctgaaaatt

SEQ ID NO: 157970 - DNA, 10 bp, Unknown
  misc_feature (1)..( 10): Result.004 file - promoters50/1020535
tgagaaaatt

SEQ ID NO: 157971 - DNA, 10 bp, Unknown
  misc_feature (1)..( 10): Result.004 file - promoters50/1020543
tgagaaaaat

SEQ ID NO: 157972 - DNA, 13 bp, Unknown
  misc_feature (1)..( 13): Result.004 file - promoters50/1020543
caaaaaaaaaaaa

SEQ ID NO: 157973 - DNA, 13 bp, Unknown
  misc_feature (1)..( 13): Result.004 file - promoters50/1020543
caaaaatgttaat

SEQ ID NO: 157974 - DNA, 13 bp, Unknown
  misc_feature (1)..( 13): Result.004 file - promoters50/1020543
gaaagatgtcaat

SEQ ID NO: 157975 - DNA, 10 bp, Unknown
  misc_feature (1)..( 10): Result.004 file - promoters50/1020543
tttgaaaaga

SEQ ID NO: 157976 - DNA, 10 bp, Unknown
  misc_feature (1)..( 10): Result.004 file - promoters50/1020543
aaaaaaaaga

SEQ ID NO: 157977 - DNA, 11 bp, Unknown
  misc_feature (1)..( 11): Result.004 file - promoters50/1020543
gaagaaacaga

SEQ ID NO: 157978 - DNA, 8 bp, Unknown
  misc_feature (1)..( 8): Result.004 file - promoters50/1020543
ttttatga

SEQ ID NO: 157979 - DNA, 8 bp, Unknown
  misc_feature (1)..( 8): Result.004 file - promoters50/1020543
tttcatgt

SEQ ID NO: 157980 - DNA, 8 bp, Unknown
  misc_feature (1)..( 8): Result.004 file - promoters50/1020543
tttcgtgt

SEQ ID NO: 157981 - DNA, 12 bp, Unknown
  misc_feature (1)..( 12): Result.004 file - promoters50/1020543
tgaaaagatgaa

SEQ ID NO: 157982 - DNA, 12 bp, Unknown
  misc_feature (1)..( 12): Result.004 file - promoters50/1020543
acacaagaagaa

SEQ ID NO: 157983 - DNA, 12 bp, Unknown
  misc_feature (1)..( 12): Result.004 file - promoters50/1020557
gaaaaaaaagaa

SEQ ID NO: 157984 - DNA, 17 bp, Unknown
  misc_feature (1)..( 17): Result.004 file - promoters50/1020557
tctctactatataaaca

SEQ ID NO: 157985 - DNA, 17 bp, Unknown
  misc_feature (1)..( 17): Result.004 file - promoters50/1020557
tctctactatataaaca

SEQ ID NO: 157986 - DNA, 17 bp, Unknown
  misc_feature (1)..( 17): Result.004 file - promoters50/1020557
tttctaatataaaacaa

SEQ ID NO: 157987 - DNA, 17 bp, Unknown
  misc_feature (1)..( 17): Result.004 file - promoters50/1020557
ataggcctatatatact

SEQ ID NO: 157988 - DNA, 17 bp, Unknown
  misc_feature (1)..( 17): Result.004 file - promoters50/1020557
ttgctcctctataaaac

SEQ ID NO: 157989 - DNA, 17 bp, Unknown
  misc_feature (1)..( 17): Result.004 file - promoters50/1020557
acacaactatatataca

SEQ ID NO: 157990 - DNA, 17 bp, Unknown
  misc_feature (1)..( 17): Result.004 file - promoters50/1020596
atgtgtttatacaaata

SEQ ID NO: 157991 - DNA, 12 bp, Unknown
  misc_feature (1)..( 12): Result.004 file - promoters50/1020596
tatggaaagagg

SEQ ID NO: 157992 - DNA, 12 bp, Unknown
  misc_feature (1)..( 12): Result.004 file - promoters50/1020596
tattgaaagtag

SEQ ID NO: 157993 - DNA, 12 bp, Unknown
  misc_feature (1)..( 12): Result.004 file - promoters50/1020596
aatggaagtaag

SEQ ID NO: 157994 - DNA, 12 bp, Unknown
  misc_feature (1)..( 12): Result.004 file - promoters50/1020596
ctctgaaagttt

SEQ ID NO: 157995 - DNA, 12 bp, Unknown
  misc_feature (1)..( 12): Result.004 file - promoters50/1020596
gtgataaaattt

SEQ ID NO: 157996 - DNA, 8 bp, Unknown
  misc_feature (1)..( 8): Result.004 file - promoters50/1020596
cattaata

SEQ ID NO: 157997 - DNA, 8 bp, Unknown
  misc_feature (1)..( 8): Result.004 file - promoters50/1020596
cataaatt

SEQ ID NO: 157998 - DNA, 8 bp, Unknown
  misc_feature (1)..( 8): Result.004 file - promoters50/1020596
gataaatc

SEQ ID NO: 157999 - DNA, 8 bp, Unknown
  misc_feature (1)..( 8): Result.004 file - promoters50/1020596
tttaaatt

SEQ ID NO: 158000 - DNA, 8 bp, Unknown
  misc_feature (1)..( 8): Result.004 file - promoters50/1020619
attaaata

SEQ ID NO: 158001 - DNA, 12 bp, Unknown
  misc_feature (1)..( 12): Result.004 file - promoters50/1020619
tttaaattctat

SEQ ID NO: 158002 - DNA, 12 bp, Unknown
  misc_feature (1)..( 12): Result.004 file - promoters50/1020619
cttaaatacttt

SEQ ID NO: 158003 - DNA, 12 bp, Unknown
  misc_feature (1)..( 12): Result.004 file - promoters50/1020619
tttcaatttgga

SEQ ID NO: 158004 - DNA, 12 bp, Unknown
  misc_feature (1)..( 12): Result.004 file - promoters50/1020619
aataaatagatt

SEQ ID NO: 158005 - DNA, 12 bp, Unknown
  misc_feature (1)..( 12): Result.004 file - promoters50/1020619
tttatataacta

SEQ ID NO: 158006 - DNA, 12 bp, Unknown
  misc_feature (1)..( 12): Result.004 file - promoters50/1020619
tactaatagata

SEQ ID NO: 158007 - DNA, 10 bp, Unknown
  misc_feature (1)..( 10): Result.004 file - promoters50/1020619
ttctatttcc

SEQ ID NO: 158008 - DNA, 10 bp, Unknown
  misc_feature (1)..( 10): Result.004 file - promoters50/1020619
aactatttaa

SEQ ID NO: 158009 - DNA, 10 bp, Unknown
  misc_feature (1)..( 10): Result.004 file - promoters50/1020619
ttcaatttgg

SEQ ID NO: 158010 - DNA, 10 bp, Unknown
  misc_feature (1)..( 10): Result.004 file - promoters50/1020619
ttttatttac

SEQ ID NO: 158011 - DNA, 11 bp, Unknown
  misc_feature (1)..( 11): Result.004 file - promoters50/1020619
aaaaacttttt

SEQ ID NO: 158012 - DNA, 11 bp, Unknown
  misc_feature (1)..( 11): Result.004 file - promoters50/1020619
aataaacttaa

SEQ ID NO: 158013 - DNA, 11 bp, Unknown
  misc_feature (1)..( 11): Result.004 file - promoters50/1020634
ccctaattaag

SEQ ID NO: 158014 - DNA, 11 bp, Unknown
  misc_feature (1)..( 11): Result.004 file - promoters50/1020634
atttaaagact

SEQ ID NO: 158015 - DNA, 11 bp, Unknown
  misc_feature (1)..( 11): Result.004 file - promoters50/1020634
ccgaaaatact

SEQ ID NO: 158016 - DNA, 11 bp, Unknown
  misc_feature (1)..( 11): Result.004 file - promoters50/1020634
tccaaaataac

SEQ ID NO: 158017 - DNA, 11 bp, Unknown
  misc_feature (1)..( 11): Result.004 file - promoters50/1020634
taaaaaataga

SEQ ID NO: 158018 - DNA, 11 bp, Unknown
  misc_feature (1)..( 11): Result.004 file - promoters50/1020634
tccaaaatcat

SEQ ID NO: 158019 - DNA, 11 bp, Unknown
  misc_feature (1)..( 11): Result.004 file - promoters50/1020634
attataatcat

SEQ ID NO: 158020 - DNA, 11 bp, Unknown
  misc_feature (1)..( 11): Result.004 file - promoters50/1020634
tcactaatcaa

SEQ ID NO: 158021 - DNA, 14 bp, Unknown
  misc_feature (1)..( 14): Result.004 file - promoters50/1020634
gttttaaaatagta

SEQ ID NO: 158022 - DNA, 14 bp, Unknown
  misc_feature (1)..( 14): Result.004 file - promoters50/1020634
cttttcaaattgtg

SEQ ID NO: 158023 - DNA, 14 bp, Unknown
  misc_feature (1)..( 14): Result.004 file - promoters50/1020634
tgtttgaaactgat

SEQ ID NO: 158024 - DNA, 14 bp, Unknown
  misc_feature (1)..( 14): Result.004 file - promoters50/1020634
aagctcagattagt

SEQ ID NO: 158025 - DNA, 14 bp, Unknown
  misc_feature (1)..( 14): Result.004 file - promoters50/1020634
gatgtcatattcgt

SEQ ID NO: 158026 - DNA, 14 bp, Unknown
  misc_feature (1)..( 14): Result.004 file - promoters50/1020646
ggatagagataagt

SEQ ID NO: 158027 - DNA, 11 bp, Unknown
  misc_feature (1)..( 11): Result.004 file - promoters50/1020646
aataatttgta

SEQ ID NO: 158028 - DNA, 11 bp, Unknown
  misc_feature (1)..( 11): Result.004 file - promoters50/1020646
aattattggta

SEQ ID NO: 158029 - DNA, 11 bp, Unknown
  misc_feature (1)..( 11): Result.004 file - promoters50/1020646
aatattttagg

SEQ ID NO: 158030 - DNA, 11 bp, Unknown
  misc_feature (1)..( 11): Result.004 file - promoters50/1020666
actattttact

SEQ ID NO: 158031 - DNA, 13 bp, Unknown
  misc_feature (1)..( 13): Result.004 file - promoters50/1020666
aaagaaaccaatt

SEQ ID NO: 158032 - DNA, 13 bp, Unknown
  misc_feature (1)..( 13): Result.004 file - promoters50/1020666
aaataaatattgt

SEQ ID NO: 158033 - DNA, 13 bp, Unknown
  misc_feature (1)..( 13): Result.004 file - promoters50/1020666
aaaaaaaatcttc

SEQ ID NO: 158034 - DNA, 13 bp, Unknown
  misc_feature (1)..( 13): Result.004 file - promoters50/1020666
aaaaaaaacgaat

SEQ ID NO: 158035 - DNA, 13 bp, Unknown
  misc_feature (1)..( 13): Result.004 file - promoters50/1020666
atatataagatgt

SEQ ID NO: 158036 - DNA, 13 bp, Unknown
  misc_feature (1)..( 13): Result.004 file - promoters50/1020666
gtatatacggttt

SEQ ID NO: 158037 - DNA, 10 bp, Unknown
  misc_feature (1)..( 10): Result.004 file - promoters50/1020666
taacaaactg

SEQ ID NO: 158038 - DNA, 10 bp, Unknown
  misc_feature (1)..( 10): Result.004 file - promoters50/1020666
ccacaaacaa

SEQ ID NO: 158039 - DNA, 10 bp, Unknown
  misc_feature (1)..( 10): Result.004 file - promoters50/1020666
taagaaatat

SEQ ID NO: 158040 - DNA, 10 bp, Unknown
  misc_feature (1)..( 10): Result.004 file - promoters50/1020666
ccacaaacca

SEQ ID NO: 158041 - DNA, 10 bp, Unknown
  misc_feature (1)..( 10): Result.004 file - promoters50/1020666
ctccaaaaat

SEQ ID NO: 158042 - DNA, 10 bp, Unknown
  misc_feature (1)..( 10): Result.004 file - promoters50/1020666
ctagaaataa

SEQ ID NO: 158043 - DNA, 10 bp, Unknown
  misc_feature (1)..( 10): Result.004 file - promoters50/1020666
tggtaaataa

SEQ ID NO: 158044 - DNA, 14 bp, Unknown
  misc_feature (1)..( 14): Result.004 file - promoters50/1020666
aactaatacattga

SEQ ID NO: 158045 - DNA, 14 bp, Unknown
  misc_feature (1)..( 14): Result.004 file - promoters50/1020666
aacaaatctataaa

SEQ ID NO: 158046 - DNA, 14 bp, Unknown
  misc_feature (1)..( 14): Result.004 file - promoters50/1020666
cactcatactttga

SEQ ID NO: 158047 - DNA, 14 bp, Unknown
  misc_feature (1)..( 14): Result.004 file - promoters50/1020666
aacgaatggcaagt

SEQ ID NO: 158048 - DNA, 14 bp, Unknown
  misc_feature (1)..( 14): Result.004 file - promoters50/1020666
aagttataatttct

SEQ ID NO: 158049 - DNA, 8 bp, Unknown
  misc_feature (1)..( 8): Result.004 file - promoters50/1020666
tactttgt

SEQ ID NO: 158050 - DNA, 7 bp, Unknown
  misc_feature (1)..( 7): Result.004 file - promoters50/1020666
tatcaaa

SEQ ID NO: 158051 - DNA, 7 bp, Unknown
  misc_feature (1)..( 7): Result.004 file - promoters50/1020666
tattaaa

SEQ ID NO: 158052 - DNA, 7 bp, Unknown
  misc_feature (1)..( 7): Result.004 file - promoters50/1020666
tataaaa

SEQ ID NO: 158053 - DNA, 7 bp, Unknown
  misc_feature (1)..( 7): Result.004 file - promoters50/1020666
tattaat

SEQ ID NO: 158054 - DNA, 7 bp, Unknown
  misc_feature (1)..( 7): Result.004 file - promoters50/1020666
tataaat

SEQ ID NO: 158055 - DNA, 7 bp, Unknown
  misc_feature (1)..( 7): Result.004 file - promoters50/1020666
taataac

SEQ ID NO: 158056 - DNA, 11 bp, Unknown
  misc_feature (1)..( 11): Result.004 file - promoters50/1020666
aattacttttt

SEQ ID NO: 158057 - DNA, 11 bp, Unknown
  misc_feature (1)..( 11): Result.004 file - promoters50/1020666
gattagttttc

SEQ ID NO: 158058 - DNA, 11 bp, Unknown
  misc_feature (1)..( 11): Result.004 file - promoters50/1020666
ataaacttttt

SEQ ID NO: 158059 - DNA, 11 bp, Unknown
  misc_feature (1)..( 11): Result.004 file - promoters50/1020666
atttaattttg

SEQ ID NO: 158060 - DNA, 11 bp, Unknown
  misc_feature (1)..( 11): Result.004 file - promoters50/1020666
gaattgttttc

SEQ ID NO: 158061 - DNA, 11 bp, Unknown
  misc_feature (1)..( 11): Result.004 file - promoters50/1020680
gattaggtatc

SEQ ID NO: 158062 - DNA, 8 bp, Unknown
  misc_feature (1)..( 8): Result.004 file - promoters50/1020680
attgggtg

SEQ ID NO: 158063 - DNA, 8 bp, Unknown
  misc_feature (1)..( 8): Result.004 file - promoters50/1020680
tttgagtg

SEQ ID NO: 158064 - DNA, 8 bp, Unknown
  misc_feature (1)..( 8): Result.004 file - promoters50/1020680
tttgagaa

SEQ ID NO: 158065 - DNA, 8 bp, Unknown
  misc_feature (1)..( 8): Result.004 file - promoters50/1020680
gttgagtt

SEQ ID NO: 158066 - DNA, 11 bp, Unknown
  misc_feature (1)..( 11): Result.004 file - promoters50/1020680
ttaaaacaaaa

SEQ ID NO: 158067 - DNA, 11 bp, Unknown
  misc_feature (1)..( 11): Result.004 file - promoters50/1020680
ggtaaagaaag

SEQ ID NO: 158068 - DNA, 12 bp, Unknown
  misc_feature (1)..( 12): Result.004 file - promoters50/1020680
tatttcacaaaa

SEQ ID NO: 158069 - DNA, 12 bp, Unknown
  misc_feature (1)..( 12): Result.004 file - promoters50/1020690
gttaaaccaaaa

SEQ ID NO: 158070 - DNA, 11 bp, Unknown
  misc_feature (1)..( 11): Result.004 file - promoters50/1020690
attttaatgtg

SEQ ID NO: 158071 - DNA, 11 bp, Unknown
  misc_feature (1)..( 11): Result.004 file - promoters50/1020690
gatttattgtt

SEQ ID NO: 158072 - DNA, 11 bp, Unknown
  misc_feature (1)..( 11): Result.004 file - promoters50/1020690
cattgattata

SEQ ID NO: 158073 - DNA, 11 bp, Unknown
  misc_feature (1)..( 11): Result.004 file - promoters50/1020690
catcgattcat

SEQ ID NO: 158074 - DNA, 11 bp, Unknown
  misc_feature (1)..( 11): Result.004 file - promoters50/1020690
aatttattttc

SEQ ID NO: 158075 - DNA, 11 bp, Unknown
  misc_feature (1)..( 11): Result.004 file - promoters50/1020690
atgtgaactta

SEQ ID NO: 158076 - DNA, 15 bp, Unknown
  misc_feature (1)..( 15): Result.004 file - promoters50/1020690
tggagatttaagaac

SEQ ID NO: 158077 - DNA, 15 bp, Unknown
  misc_feature (1)..( 15): Result.004 file - promoters50/1020690
ttaatatttaagatt

SEQ ID NO: 158078 - DNA, 15 bp, Unknown
  misc_feature (1)..( 15): Result.004 file - promoters50/1020690
tttggatttattgtt

SEQ ID NO: 158079 - DNA, 15 bp, Unknown
  misc_feature (1)..( 15): Result.004 file - promoters50/1020690
ctaccattgattata

SEQ ID NO: 158080 - DNA, 15 bp, Unknown
  misc_feature (1)..( 15): Result.004 file - promoters50/1020690
catcgattcatatga

SEQ ID NO: 158081 - DNA, 15 bp, Unknown
  misc_feature (1)..( 15): Result.004 file - promoters50/1020690
gatgaatttattttc

SEQ ID NO: 158082 - DNA, 15 bp, Unknown
  misc_feature (1)..( 15): Result.004 file - promoters50/1020697
gctaatgtgaactta

SEQ ID NO: 158083 - DNA, 8 bp, Unknown
  misc_feature (1)..( 8): Result.004 file - promoters50/1020697
aaattaaa

SEQ ID NO: 158084 - DNA, 8 bp, Unknown
  misc_feature (1)..( 8): Result.004 file - promoters50/1020697
gaatcaaa

SEQ ID NO: 158085 - DNA, 8 bp, Unknown
  misc_feature (1)..( 8): Result.004 file - promoters50/1020697
aaattacc

SEQ ID NO: 158086 - DNA, 17 bp, Unknown
  misc_feature (1)..( 17): Result.004 file - promoters50/1020697
attatttattaattgtt

SEQ ID NO: 158087 - DNA, 17 bp, Unknown
  misc_feature (1)..( 17): Result.004 file - promoters50/1020697
attaattattaattata

SEQ ID NO: 158088 - DNA, 17 bp, Unknown
  misc_feature (1)..( 17): Result.004 file - promoters50/1020697
atttctcattaatggaa

SEQ ID NO: 158089 - DNA, 17 bp, Unknown
  misc_feature (1)..( 17): Result.004 file - promoters50/1020697
atcagctagtaatgata

SEQ ID NO: 158090 - DNA, 7 bp, Unknown
  misc_feature (1)..( 7): Result.004 file - promoters50/1020697
agaacat

SEQ ID NO: 158091 - DNA, 7 bp, Unknown
  misc_feature (1)..( 7): Result.004 file - promoters50/1020697
agagcat

SEQ ID NO: 158092 - DNA, 7 bp, Unknown
  misc_feature (1)..( 7): Result.004 file - promoters50/1020697
agagcag

SEQ ID NO: 158093 - DNA, 8 bp, Unknown
  misc_feature (1)..( 8): Result.004 file - promoters50/1020697
aaaattag

SEQ ID NO: 158094 - DNA, 8 bp, Unknown
  misc_feature (1)..( 8): Result.004 file - promoters50/1020697
ctaattag

SEQ ID NO: 158095 - DNA, 8 bp, Unknown
  misc_feature (1)..( 8): Result.004 file - promoters50/1020697
ctatttat

SEQ ID NO: 158096 - DNA, 11 bp, Unknown
  misc_feature (1)..( 11): Result.004 file - promoters50/1020697
taataaaaaat

SEQ ID NO: 158097 - DNA, 11 bp, Unknown
  misc_feature (1)..( 11): Result.004 file - promoters50/1020697
taattaaattt

SEQ ID NO: 158098 - DNA, 11 bp, Unknown
  misc_feature (1)..( 11): Result.004 file - promoters50/1020697
ccattaacttt

SEQ ID NO: 158099 - DNA, 9 bp, Unknown
  misc_feature (1)..( 9): Result.004 file - promoters50/1020697
caaaacaga

SEQ ID NO: 158100 - DNA, 9 bp, Unknown
  misc_feature (1)..( 9): Result.004 file - promoters50/1020697
taaaaaaga

SEQ ID NO: 158101 - DNA, 9 bp, Unknown
  misc_feature (1)..( 9): Result.004 file - promoters50/1020697
taaaaactt

SEQ ID NO: 158102 - DNA, 7 bp, Unknown
  misc_feature (1)..( 7): Result.004 file - promoters50/1020697
tttaaaa

SEQ ID NO: 158103 - DNA, 7 bp, Unknown
  misc_feature (1)..( 7): Result.004 file - promoters50/1020697
tttaaat

SEQ ID NO: 158104 - DNA, 7 bp, Unknown
  misc_feature (1)..( 7): Result.004 file - promoters50/1020697
attaaat

SEQ ID NO: 158105 - DNA, 9 bp, Unknown
  misc_feature (1)..( 9): Result.004 file - promoters50/1020697
aaagagaag

SEQ ID NO: 158106 - DNA, 9 bp, Unknown
  misc_feature (1)..( 9): Result.004 file - promoters50/1020697
agagagaag

SEQ ID NO: 158107 - DNA, 9 bp, Unknown
  misc_feature (1)..( 9): Result.004 file - promoters50/1020701
agagtgaaa

SEQ ID NO: 158108 - DNA, 13 bp, Unknown
  misc_feature (1)..( 13): Result.004 file - promoters50/1020701
ataaattaatgcc

SEQ ID NO: 158109 - DNA, 13 bp, Unknown
  misc_feature (1)..( 13): Result.004 file - promoters50/1020701
atatattaatgtt

SEQ ID NO: 158110 - DNA, 13 bp, Unknown
  misc_feature (1)..( 13): Result.004 file - promoters50/1020701
gaaaatttatgtc

SEQ ID NO: 158111 - DNA, 13 bp, Unknown
  misc_feature (1)..( 13): Result.004 file - promoters50/1020701
ccatattaataaa

SEQ ID NO: 158112 - DNA, 13 bp, Unknown
  misc_feature (1)..( 13): Result.004 file - promoters50/1020701
ataagttattata

SEQ ID NO: 158113 - DNA, 13 bp, Unknown
  misc_feature (1)..( 13): Result.004 file - promoters50/1020701
tttggttattgta

SEQ ID NO: 158114 - DNA, 13 bp, Unknown
  misc_feature (1)..( 13): Result.004 file - promoters50/1020701
cgagtataaggtt

SEQ ID NO: 158115 - DNA, 8 bp, Unknown
  misc_feature (1)..( 8): Result.004 file - promoters50/1020701
tcataatt

SEQ ID NO: 158116 - DNA, 8 bp, Unknown
  misc_feature (1)..( 8): Result.004 file - promoters50/1020701
tcacaatt

SEQ ID NO: 158117 - DNA, 8 bp, Unknown
  misc_feature (1)..( 8): Result.004 file - promoters50/1020701
taatattt

SEQ ID NO: 158118 - DNA, 8 bp, Unknown
  misc_feature (1)..( 8): Result.004 file - promoters50/1020701
taatatgt

SEQ ID NO: 158119 - DNA, 8 bp, Unknown
  misc_feature (1)..( 8): Result.004 file - promoters50/1020701
taatataa

SEQ ID NO: 158120 - DNA, 8 bp, Unknown
  misc_feature (1)..( 8): Result.004 file - promoters50/1020713
tcacaaca

SEQ ID NO: 158121 - DNA, 7 bp, Unknown
  misc_feature (1)..( 7): Result.004 file - promoters50/1020713
taagtta

SEQ ID NO: 158122 - DNA, 7 bp, Unknown
  misc_feature (1)..( 7): Result.004 file - promoters50/1020713
gaagtta

SEQ ID NO: 158123 - DNA, 7 bp, Unknown
  misc_feature (1)..( 7): Result.004 file - promoters50/1020713
taattta

SEQ ID NO: 158124 - DNA, 8 bp, Unknown
  misc_feature (1)..( 8): Result.004 file - promoters50/1020713
tgaagaaa

SEQ ID NO: 158125 - DNA, 8 bp, Unknown
  misc_feature (1)..( 8): Result.004 file - promoters50/1020713
agaaaaaa

SEQ ID NO: 158126 - DNA, 8 bp, Unknown
  misc_feature (1)..( 8): Result.004 file - promoters50/1020713
agaaaaca

SEQ ID NO: 158127 - DNA, 7 bp, Unknown
  misc_feature (1)..( 7): Result.004 file - promoters50/1020713
gaatttt

SEQ ID NO: 158128 - DNA, 7 bp, Unknown
  misc_feature (1)..( 7): Result.004 file - promoters50/1020713
gaaattt

SEQ ID NO: 158129 - DNA, 7 bp, Unknown
  misc_feature (1)..( 7): Result.004 file - promoters50/1020713
aaaattt

SEQ ID NO: 158130 - DNA, 8 bp, Unknown
  misc_feature (1)..( 8): Result.004 file - promoters50/1020713
gttagtta

SEQ ID NO: 158131 - DNA, 8 bp, Unknown
  misc_feature (1)..( 8): Result.004 file - promoters50/1020713
gttggttg

SEQ ID NO: 158132 - DNA, 8 bp, Unknown
  misc_feature (1)..( 8): Result.004 file - promoters50/1020713
tttattta

SEQ ID NO: 158133 - DNA, 8 bp, Unknown
  misc_feature (1)..( 8): Result.004 file - promoters50/1020713
ataagaga

SEQ ID NO: 158134 - DNA, 8 bp, Unknown
  misc_feature (1)..( 8): Result.004 file - promoters50/1020713
ataagagg

SEQ ID NO: 158135 - DNA, 8 bp, Unknown
  misc_feature (1)..( 8): Result.004 file - promoters50/1020713
ttaatagg

SEQ ID NO: 158136 - DNA, 9 bp, Unknown
  misc_feature (1)..( 9): Result.004 file - promoters50/1020713
aggcccatg

SEQ ID NO: 158137 - DNA, 9 bp, Unknown
  misc_feature (1)..( 9): Result.004 file - promoters50/1020713
aggcccatt

SEQ ID NO: 158138 - DNA, 9 bp, Unknown
  misc_feature (1)..( 9): Result.004 file - promoters50/1020730
aagcccatt

SEQ ID NO: 158139 - DNA, 7 bp, Unknown
  misc_feature (1)..( 7): Result.004 file - promoters50/1020730
taattta

SEQ ID NO: 158140 - DNA, 7 bp, Unknown
  misc_feature (1)..( 7): Result.004 file - promoters50/1020730
taagtta

SEQ ID NO: 158141 - DNA, 7 bp, Unknown
  misc_feature (1)..( 7): Result.004 file - promoters50/1020730
taatttt

SEQ ID NO: 158142 - DNA, 12 bp, Unknown
  misc_feature (1)..( 12): Result.004 file - promoters50/1020730
attaatctccaa

SEQ ID NO: 158143 - DNA, 12 bp, Unknown
  misc_feature (1)..( 12): Result.004 file - promoters50/1020730
attcatcttgtc

SEQ ID NO: 158144 - DNA, 12 bp, Unknown
  misc_feature (1)..( 12): Result.004 file - promoters50/1020730
ttgaatctcttt

SEQ ID NO: 158145 - DNA, 12 bp, Unknown
  misc_feature (1)..( 12): Result.004 file - promoters50/1020730
caagatcacttt

SEQ ID NO: 158146 - DNA, 10 bp, Unknown
  misc_feature (1)..( 10): Result.004 file - promoters50/1020730
aaaataattt

SEQ ID NO: 158147 - DNA, 10 bp, Unknown
  misc_feature (1)..( 10): Result.004 file - promoters50/1020730
tggatatttt

SEQ ID NO: 158148 - DNA, 10 bp, Unknown
  misc_feature (1)..( 10): Result.004 file - promoters50/1020730
aaactaatgt

SEQ ID NO: 158149 - DNA, 11 bp, Unknown
  misc_feature (1)..( 11): Result.004 file - promoters50/1020730
aaatttgaata

SEQ ID NO: 158150 - DNA, 11 bp, Unknown
  misc_feature (1)..( 11): Result.004 file - promoters50/1020730
ttgtctgaata

SEQ ID NO: 158151 - DNA, 11 bp, Unknown
  misc_feature (1)..( 11): Result.004 file - promoters50/1020730
ttgtcggaatc

SEQ ID NO: 158152 - DNA, 9 bp, Unknown
  misc_feature (1)..( 9): Result.004 file - promoters50/1020730
gtacaaatt

SEQ ID NO: 158153 - DNA, 9 bp, Unknown
  misc_feature (1)..( 9): Result.004 file - promoters50/1020730
gtagaaaaa

SEQ ID NO: 158154 - DNA, 9 bp, Unknown
  misc_feature (1)..( 9): Result.004 file - promoters50/1020786
agagaaaaa

SEQ ID NO: 158155 - DNA, 12 bp, Unknown
  misc_feature (1)..( 12): Result.004 file - promoters50/1020786
aaatttatgtcg

SEQ ID NO: 158156 - DNA, 12 bp, Unknown
  misc_feature (1)..( 12): Result.004 file - promoters50/1020786
agatttatttcg

SEQ ID NO: 158157 - DNA, 12 bp, Unknown
  misc_feature (1)..( 12): Result.004 file - promoters50/1020786
aaattaatgcca

SEQ ID NO: 158158 - DNA, 12 bp, Unknown
  misc_feature (1)..( 12): Result.004 file - promoters50/1020786
ccatttatggac

SEQ ID NO: 158159 - DNA, 12 bp, Unknown
  misc_feature (1)..( 12): Result.004 file - promoters50/1020786
agttttatttta

SEQ ID NO: 158160 - DNA, 12 bp, Unknown
  misc_feature (1)..( 12): Result.004 file - promoters50/1020786
ggatttttggtg

SEQ ID NO: 158161 - DNA, 12 bp, Unknown
  misc_feature (1)..( 12): Result.004 file - promoters50/1020786
aaattaatattt

SEQ ID NO: 158162 - DNA, 13 bp, Unknown
  misc_feature (1)..( 13): Result.004 file - promoters50/1020786
ttaacaaactaat

SEQ ID NO: 158163 - DNA, 13 bp, Unknown
  misc_feature (1)..( 13): Result.004 file - promoters50/1020786
aagacaaacggtc

SEQ ID NO: 158164 - DNA, 13 bp, Unknown
  misc_feature (1)..( 13): Result.004 file - promoters50/1020786
caatcaaattaat

SEQ ID NO: 158165 - DNA, 13 bp, Unknown
  misc_feature (1)..( 13): Result.004 file - promoters50/1020786
gttaaaaaatatt

SEQ ID NO: 158166 - DNA, 13 bp, Unknown
  misc_feature (1)..( 13): Result.004 file - promoters50/1020786
tttaaaatcgtca

SEQ ID NO: 158167 - DNA, 13 bp, Unknown
  misc_feature (1)..( 13): Result.004 file - promoters50/1020786
tttaaattaatta

SEQ ID NO: 158168 - DNA, 14 bp, Unknown
  misc_feature (1)..( 14): Result.004 file - promoters50/1020786
cctctatataaacc

SEQ ID NO: 158169 - DNA, 14 bp, Unknown
  misc_feature (1)..( 14): Result.004 file - promoters50/1020786
tctccctataaatt

SEQ ID NO: 158170 - DNA, 14 bp, Unknown
  misc_feature (1)..( 14): Result.004 file - promoters50/1020786
tacctttataaact

SEQ ID NO: 158171 - DNA, 14 bp, Unknown
  misc_feature (1)..( 14): Result.004 file - promoters50/1020786
cctatatataaaca

SEQ ID NO: 158172 - DNA, 14 bp, Unknown
  misc_feature (1)..( 14): Result.004 file - promoters50/1020786
ttctcgtataaata

SEQ ID NO: 158173 - DNA, 14 bp, Unknown
  misc_feature (1)..( 14): Result.004 file - promoters50/1020786
cgatattatatagg

SEQ ID NO: 158174 - DNA, 17 bp, Unknown
  misc_feature (1)..( 17): Result.004 file - promoters50/1020786
tacttaagcaaaaatta

SEQ ID NO: 158175 - DNA, 17 bp, Unknown
  misc_feature (1)..( 17): Result.004 file - promoters50/1020786
ttgttcgtcaaaaaact

SEQ ID NO: 158176 - DNA, 17 bp, Unknown
  misc_feature (1)..( 17): Result.004 file - promoters50/1020786
ctttaatgcaaagatta

SEQ ID NO: 158177 - DNA, 17 bp, Unknown
  misc_feature (1)..( 17): Result.004 file - promoters50/1020786
ggatagtttaaaaatta

SEQ ID NO: 158178 - DNA, 17 bp, Unknown
  misc_feature (1)..( 17): Result.004 file - promoters50/1020786
tatactcccaaaaacag

SEQ ID NO: 158179 - DNA, 17 bp, Unknown
  misc_feature (1)..( 17): Result.004 file - promoters50/1020786
tagtgctaaaaatacat

SEQ ID NO: 158180 - DNA, 17 bp, Unknown
  misc_feature (1)..( 17): Result.004 file - promoters50/1020786
ttagaaatcaaacagat

SEQ ID NO: 158181 - DNA, 14 bp, Unknown
  misc_feature (1)..( 14): Result.004 file - promoters50/1020786
aacgacaaaacaag

SEQ ID NO: 158182 - DNA, 14 bp, Unknown
  misc_feature (1)..( 14): Result.004 file - promoters50/1020786
aacaacaaaaaaag

SEQ ID NO: 158183 - DNA, 14 bp, Unknown
  misc_feature (1)..( 14): Result.004 file - promoters50/1020786
tttaataaaccaat

SEQ ID NO: 158184 - DNA, 14 bp, Unknown
  misc_feature (1)..( 14): Result.004 file - promoters50/1020786
aacgaccataatta

SEQ ID NO: 158185 - DNA, 14 bp, Unknown
  misc_feature (1)..( 14): Result.004 file - promoters50/1020786
cacaacattgcttc

SEQ ID NO: 158186 - DNA, 14 bp, Unknown
  misc_feature (1)..( 14): Result.004 file - promoters50/1020786
atcaacaaaaattg

SEQ ID NO: 158187 - DNA, 14 bp, Unknown
  misc_feature (1)..( 14): Result.004 file - promoters50/1020786
ggcaacaaatcatt

SEQ ID NO: 158188 - DNA, 12 bp, Unknown
  misc_feature (1)..( 12): Result.004 file - promoters50/1020786
gatgaaatataa

SEQ ID NO: 158189 - DNA, 12 bp, Unknown
  misc_feature (1)..( 12): Result.004 file - promoters50/1020786
tgccaaatatta

SEQ ID NO: 158190 - DNA, 11 bp, Unknown
  misc_feature (1)..( 11): Result.004 file - promoters50/1020786
taaaaatacat

SEQ ID NO: 158191 - DNA, 11 bp, Unknown
  misc_feature (1)..( 11): Result.004 file - promoters50/1020786
caaaaacagta

SEQ ID NO: 158192 - DNA, 12 bp, Unknown
  misc_feature (1)..( 12): Result.004 file - promoters50/1020786
caaacaataaaa

SEQ ID NO: 158193 - DNA, 12 bp, Unknown
  misc_feature (1)..( 12): Result.004 file - promoters50/1020786
caaaaaacttta

SEQ ID NO: 158194 - DNA, 10 bp, Unknown
  misc_feature (1)..( 10): Result.004 file - promoters50/1020786
ataaagtata

SEQ ID NO: 158195 - DNA, 10 bp, Unknown
  misc_feature (1)..( 10): Result.004 file - promoters50/1020786
ctaaaatatc

SEQ ID NO: 158196 - DNA, 10 bp, Unknown
  misc_feature (1)..( 10): Result.004 file - promoters50/1020786
caaaaataag

SEQ ID NO: 158197 - DNA, 10 bp, Unknown
  misc_feature (1)..( 10): Result.004 file - promoters50/1020786
acaaaaaaag

SEQ ID NO: 158198 - DNA, 10 bp, Unknown
  misc_feature (1)..( 10): Result.004 file - promoters50/1020786
acaaaaaagg

SEQ ID NO: 158199 - DNA, 10 bp, Unknown
  misc_feature (1)..( 10): Result.004 file - promoters50/1020786
ttaaaataaa

SEQ ID NO: 158200 - DNA, 9 bp, Unknown
  misc_feature (1)..( 9): Result.004 file - promoters50/1020786
cgatataac

SEQ ID NO: 158201 - DNA, 9 bp, Unknown
  misc_feature (1)..( 9): Result.004 file - promoters50/1020786
acatataaa

SEQ ID NO: 158202 - DNA, 9 bp, Unknown
  misc_feature (1)..( 9): Result.004 file - promoters50/1020786
acagatagg

SEQ ID NO: 158203 - DNA, 9 bp, Unknown
  misc_feature (1)..( 9): Result.004 file - promoters50/1020786
tgataaaaa

SEQ ID NO: 158204 - DNA, 10 bp, Unknown
  misc_feature (1)..( 10): Result.004 file - promoters50/1020786
atatatgaac

SEQ ID NO: 158205 - DNA, 10 bp, Unknown
  misc_feature (1)..( 10): Result.004 file - promoters50/1020818
ttctataaat

SEQ ID NO: 158206 - DNA, 13 bp, Unknown
  misc_feature (1)..( 13): Result.004 file - promoters50/1020818
aactttttttctt

SEQ ID NO: 158207 - DNA, 13 bp, Unknown
  misc_feature (1)..( 13): Result.004 file - promoters50/1020818
ataatttttcctt

SEQ ID NO: 158208 - DNA, 13 bp, Unknown
  misc_feature (1)..( 13): Result.004 file - promoters50/1020818
ataatgtttgagt

SEQ ID NO: 158209 - DNA, 11 bp, Unknown
  misc_feature (1)..( 11): Result.004 file - promoters50/1020818
caaaaattaag

SEQ ID NO: 158210 - DNA, 11 bp, Unknown
  misc_feature (1)..( 11): Result.004 file - promoters50/1020818
caataattttt

SEQ ID NO: 158211 - DNA, 11 bp, Unknown
  misc_feature (1)..( 11): Result.004 file - promoters50/1020818
aaaacatttat

SEQ ID NO: 158212 - DNA, 11 bp, Unknown
  misc_feature (1)..( 11): Result.004 file - promoters50/1020818
acataatgttt

SEQ ID NO: 158213 - DNA, 10 bp, Unknown
  misc_feature (1)..( 10): Result.004 file - promoters50/1020818
taaaaaagaa

SEQ ID NO: 158214 - DNA, 10 bp, Unknown
  misc_feature (1)..( 10): Result.004 file - promoters50/1020818
taaaaaaggg

SEQ ID NO: 158215 - DNA, 10 bp, Unknown
  misc_feature (1)..( 10): Result.004 file - promoters50/1020818
tataaaagaa

SEQ ID NO: 158216 - DNA, 9 bp, Unknown
  misc_feature (1)..( 9): Result.004 file - promoters50/1020818
gtcaaatcc

SEQ ID NO: 158217 - DNA, 9 bp, Unknown
  misc_feature (1)..( 9): Result.004 file - promoters50/1020818
gtcaaaaaa

SEQ ID NO: 158218 - DNA, 9 bp, Unknown
  misc_feature (1)..( 9): Result.004 file - promoters50/1020834
ctcaaaaaa

SEQ ID NO: 158219 - DNA, 8 bp, Unknown
  misc_feature (1)..( 8): Result.004 file - promoters50/1020834
agactacc

SEQ ID NO: 158220 - DNA, 8 bp, Unknown
  misc_feature (1)..( 8): Result.004 file - promoters50/1020834
agaatacc

SEQ ID NO: 158221 - DNA, 8 bp, Unknown
  misc_feature (1)..( 8): Result.004 file - promoters50/1020838
agaataga

SEQ ID NO: 158222 - DNA, 8 bp, Unknown
  misc_feature (1)..( 8): Result.004 file - promoters50/1020838
gaaggaat

SEQ ID NO: 158223 - DNA, 8 bp, Unknown
  misc_feature (1)..( 8): Result.004 file - promoters50/1020838
gaaagaaa

SEQ ID NO: 158224 - DNA, 8 bp, Unknown
  misc_feature (1)..( 8): Result.004 file - promoters50/1020838
aaagtaat

SEQ ID NO: 158225 - DNA, 8 bp, Unknown
  misc_feature (1)..( 8): Result.004 file - promoters50/1020838
cttttgaa

SEQ ID NO: 158226 - DNA, 8 bp, Unknown
  misc_feature (1)..( 8): Result.004 file - promoters50/1020838
ctttggaa

SEQ ID NO: 158227 - DNA, 8 bp, Unknown
  misc_feature (1)..( 8): Result.004 file - promoters50/1020838
attttgag

SEQ ID NO: 158228 - DNA, 8 bp, Unknown
  misc_feature (1)..( 8): Result.004 file - promoters50/1020838
atttttaa

SEQ ID NO: 158229 - DNA, 8 bp, Unknown
  misc_feature (1)..( 8): Result.004 file - promoters50/1020838
ctttgtaa

SEQ ID NO: 158230 - DNA, 8 bp, Unknown
  misc_feature (1)..( 8): Result.004 file - promoters50/1020838
attttttg

SEQ ID NO: 158231 - DNA, 7 bp, Unknown
  misc_feature (1)..( 7): Result.004 file - promoters50/1020838
aataaaa

SEQ ID NO: 158232 - DNA, 7 bp, Unknown
  misc_feature (1)..( 7): Result.004 file - promoters50/1020838
aataaat

SEQ ID NO: 158233 - DNA, 7 bp, Unknown
  misc_feature (1)..( 7): Result.004 file - promoters50/1020842
aataaaa

SEQ ID NO: 158234 - DNA, 8 bp, Unknown
  misc_feature (1)..( 8): Result.004 file - promoters50/1020842
taaaagat

SEQ ID NO: 158235 - DNA, 8 bp, Unknown
  misc_feature (1)..( 8): Result.004 file - promoters50/1020842
aaaaggat

SEQ ID NO: 158236 - DNA, 8 bp, Unknown
  misc_feature (1)..( 8): Result.004 file - promoters50/1020842
taaaagat

SEQ ID NO: 158237 - DNA, 10 bp, Unknown
  misc_feature (1)..( 10): Result.004 file - promoters50/1020842
tcatcaattt

SEQ ID NO: 158238 - DNA, 10 bp, Unknown
  misc_feature (1)..( 10): Result.004 file - promoters50/1020842
tcatcaataa

SEQ ID NO: 158239 - DNA, 10 bp, Unknown
  misc_feature (1)..( 10): Result.004 file - promoters50/1020842
ccatcaattt

SEQ ID NO: 158240 - DNA, 8 bp, Unknown
  misc_feature (1)..( 8): Result.004 file - promoters50/1020842
taacaata

SEQ ID NO: 158241 - DNA, 8 bp, Unknown
  misc_feature (1)..( 8): Result.004 file - promoters50/1020842
taaaaatt

SEQ ID NO: 158242 - DNA, 8 bp, Unknown
  misc_feature (1)..( 8): Result.004 file - promoters50/1020842
ttaaaatt

SEQ ID NO: 158243 - DNA, 8 bp, Unknown
  misc_feature (1)..( 8): Result.004 file - promoters50/1020842
gaaactct

SEQ ID NO: 158244 - DNA, 8 bp, Unknown
  misc_feature (1)..( 8): Result.004 file - promoters50/1020842
aaaattct

SEQ ID NO: 158245 - DNA, 8 bp, Unknown
  misc_feature (1)..( 8): Result.004 file - promoters50/1020842
aaaatttt

SEQ ID NO: 158246 - DNA, 8 bp, Unknown
  misc_feature (1)..( 8): Result.004 file - promoters50/1020842
gaaacaga

SEQ ID NO: 158247 - DNA, 8 bp, Unknown
  misc_feature (1)..( 8): Result.004 file - promoters50/1020842
gaaacaaa

SEQ ID NO: 158248 - DNA, 8 bp, Unknown
  misc_feature (1)..( 8): Result.004 file - promoters50/1020848
taaaaaaa

SEQ ID NO: 158249 - DNA, 8 bp, Unknown
  misc_feature (1)..( 8): Result.004 file - promoters50/1020848
taatatgt

SEQ ID NO: 158250 - DNA, 8 bp, Unknown
  misc_feature (1)..( 8): Result.004 file - promoters50/1020848
aaatttgt

SEQ ID NO: 158251 - DNA, 8 bp, Unknown
  misc_feature (1)..( 8): Result.004 file - promoters50/1020848
aaatttac

SEQ ID NO: 158252 - DNA, 8 bp, Unknown
  misc_feature (1)..( 8): Result.004 file - promoters50/1020848
ctacattc

SEQ ID NO: 158253 - DNA, 8 bp, Unknown
  misc_feature (1)..( 8): Result.004 file - promoters50/1020848
ctacattt

SEQ ID NO: 158254 - DNA, 8 bp, Unknown
  misc_feature (1)..( 8): Result.004 file - promoters50/1020863
atactttt

SEQ ID NO: 158255 - DNA, 13 bp, Unknown
  misc_feature (1)..( 13): Result.004 file - promoters50/1020863
aaacaaatgtttg

SEQ ID NO: 158256 - DNA, 13 bp, Unknown
  misc_feature (1)..( 13): Result.004 file - promoters50/1020863
aaacaaacgtgga

SEQ ID NO: 158257 - DNA, 13 bp, Unknown
  misc_feature (1)..( 13): Result.004 file - promoters50/1020863
aaataaatttttg

SEQ ID NO: 158258 - DNA, 13 bp, Unknown
  misc_feature (1)..( 13): Result.004 file - promoters50/1020863
aaaaaaagaagaa

SEQ ID NO: 158259 - DNA, 13 bp, Unknown
  misc_feature (1)..( 13): Result.004 file - promoters50/1020863
taactaatttctt

SEQ ID NO: 158260 - DNA, 13 bp, Unknown
  misc_feature (1)..( 13): Result.004 file - promoters50/1020863
atacatatactgt

SEQ ID NO: 158261 - DNA, 10 bp, Unknown
  misc_feature (1)..( 10): Result.004 file - promoters50/1020863
gttattatat

SEQ ID NO: 158262 - DNA, 10 bp, Unknown
  misc_feature (1)..( 10): Result.004 file - promoters50/1020863
catattatta

SEQ ID NO: 158263 - DNA, 10 bp, Unknown
  misc_feature (1)..( 10): Result.004 file - promoters50/1020863
aatattatta

SEQ ID NO: 158264 - DNA, 10 bp, Unknown
  misc_feature (1)..( 10): Result.004 file - promoters50/1020863
gttaatatat

SEQ ID NO: 158265 - DNA, 10 bp, Unknown
  misc_feature (1)..( 10): Result.004 file - promoters50/1020863
gatataatta

SEQ ID NO: 158266 - DNA, 10 bp, Unknown
  misc_feature (1)..( 10): Result.004 file - promoters50/1020863
attatcattt

SEQ ID NO: 158267 - DNA, 14 bp, Unknown
  misc_feature (1)..( 14): Result.004 file - promoters50/1020863
gtttcaaatacaag

SEQ ID NO: 158268 - DNA, 14 bp, Unknown
  misc_feature (1)..( 14): Result.004 file - promoters50/1020863
gtttccaatatgtt

SEQ ID NO: 158269 - DNA, 14 bp, Unknown
  misc_feature (1)..( 14): Result.004 file - promoters50/1020863
agatcaaataggtc

SEQ ID NO: 158270 - DNA, 14 bp, Unknown
  misc_feature (1)..( 14): Result.004 file - promoters50/1020863
gaaaaaaagacaaa

SEQ ID NO: 158271 - DNA, 14 bp, Unknown
  misc_feature (1)..( 14): Result.004 file - promoters50/1020863
gggctaaaaatgac

SEQ ID NO: 158272 - DNA, 14 bp, Unknown
  misc_feature (1)..( 14): Result.004 file - promoters50/1020863
gattaaattggaag

SEQ ID NO: 158273 - DNA, 10 bp, Unknown
  misc_feature (1)..( 10): Result.004 file - promoters50/1020863
gtaaaatttc

SEQ ID NO: 158274 - DNA, 10 bp, Unknown
  misc_feature (1)..( 10): Result.004 file - promoters50/1020863
taaaaattaa

SEQ ID NO: 158275 - DNA, 11 bp, Unknown
  misc_feature (1)..( 11): Result.004 file - promoters50/1020863
gaaaatattaa

SEQ ID NO: 158276 - DNA, 11 bp, Unknown
  misc_feature (1)..( 11): Result.004 file - promoters50/1020863
tagaatactaa

SEQ ID NO: 158277 - DNA, 11 bp, Unknown
  misc_feature (1)..( 11): Result.004 file - promoters50/1020863
gtaacaattct

SEQ ID NO: 158278 - DNA, 11 bp, Unknown
  misc_feature (1)..( 11): Result.004 file - promoters50/1020863
ttaacaaaaaa

SEQ ID NO: 158279 - DNA, 11 bp, Unknown
  misc_feature (1)..( 11): Result.004 file - promoters50/1020863
ggaacaagtct

SEQ ID NO: 158280 - DNA, 11 bp, Unknown
  misc_feature (1)..( 11): Result.004 file - promoters50/1020863
ggagcaataga

SEQ ID NO: 158281 - DNA, 12 bp, Unknown
  misc_feature (1)..( 12): Result.004 file - promoters50/1020863
aatgatattcgt

SEQ ID NO: 158282 - DNA, 12 bp, Unknown
  misc_feature (1)..( 12): Result.004 file - promoters50/1020863
aatgaaattcat

SEQ ID NO: 158283 - DNA, 12 bp, Unknown
  misc_feature (1)..( 12): Result.004 file - promoters50/1020863
tttgatatatac

SEQ ID NO: 158284 - DNA, 12 bp, Unknown
  misc_feature (1)..( 12): Result.004 file - promoters50/1020863
cgcaatagtcga

SEQ ID NO: 158285 - DNA, 12 bp, Unknown
  misc_feature (1)..( 12): Result.004 file - promoters50/1020863
aatgaaaaacaa

SEQ ID NO: 158286 - DNA, 12 bp, Unknown
  misc_feature (1)..( 12): Result.004 file - promoters50/1020863
acaaaaagtgaa

SEQ ID NO: 158287 - DNA, 12 bp, Unknown
  misc_feature (1)..( 12): Result.004 file - promoters50/1020863
gtttgtttaaca

SEQ ID NO: 158288 - DNA, 12 bp, Unknown
  misc_feature (1)..( 12): Result.004 file - promoters50/1020863
ttttatttcttt

SEQ ID NO: 158289 - DNA, 12 bp, Unknown
  misc_feature (1)..( 12): Result.004 file - promoters50/1020863
ttttgtttctgg

SEQ ID NO: 158290 - DNA, 12 bp, Unknown
  misc_feature (1)..( 12): Result.004 file - promoters50/1020863
ttctgtttcaca

SEQ ID NO: 158291 - DNA, 12 bp, Unknown
  misc_feature (1)..( 12): Result.004 file - promoters50/1020863
ttttataatgat

SEQ ID NO: 158292 - DNA, 12 bp, Unknown
  misc_feature (1)..( 12): Result.004 file - promoters50/1020863
atatgtctgcgc

SEQ ID NO: 158293 - DNA, 12 bp, Unknown
  misc_feature (1)..( 12): Result.004 file - promoters50/1020892
ttatatcttata

SEQ ID NO: 158294 - DNA, 16 bp, Unknown
  misc_feature (1)..( 16): Result.004 file - promoters50/1020892
tgaacatgtagacgac

SEQ ID NO: 158295 - DNA, 16 bp, Unknown
  misc_feature (1)..( 16): Result.004 file - promoters50/1020892
agaacaagtagacgac

SEQ ID NO: 158296 - DNA, 16 bp, Unknown
  misc_feature (1)..( 16): Result.004 file - promoters50/1020892
cgaagaagtataaaaa

SEQ ID NO: 158297 - DNA, 16 bp, Unknown
  misc_feature (1)..( 16): Result.004 file - promoters50/1020892
cgatgaaagcagaagc

SEQ ID NO: 158298 - DNA, 16 bp, Unknown
  misc_feature (1)..( 16): Result.004 file - promoters50/1020892
acaacaagtgagactc

SEQ ID NO: 158299 - DNA, 16 bp, Unknown
  misc_feature (1)..( 16): Result.004 file - promoters50/1020892
catgcaagatgagagt

SEQ ID NO: 158300 - DNA, 14 bp, Unknown
  misc_feature (1)..( 14): Result.004 file - promoters50/1020892
tactacagacagta

SEQ ID NO: 158301 - DNA, 14 bp, Unknown
  misc_feature (1)..( 14): Result.004 file - promoters50/1020892
atttacagaacaat

SEQ ID NO: 158302 - DNA, 14 bp, Unknown
  misc_feature (1)..( 14): Result.004 file - promoters50/1020892
cattactgaagccc

SEQ ID NO: 158303 - DNA, 14 bp, Unknown
  misc_feature (1)..( 14): Result.004 file - promoters50/1020892
gcttactgaaaaat

SEQ ID NO: 158304 - DNA, 14 bp, Unknown
  misc_feature (1)..( 14): Result.004 file - promoters50/1020892
agctgctgcagcac

SEQ ID NO: 158305 - DNA, 14 bp, Unknown
  misc_feature (1)..( 14): Result.004 file - promoters50/1020940
aaatattggggcct

SEQ ID NO: 158306 - DNA, 9 bp, Unknown
  misc_feature (1)..( 9): Result.004 file - promoters50/1020940
aaaaattaa

SEQ ID NO: 158307 - DNA, 9 bp, Unknown
  misc_feature (1)..( 9): Result.004 file - promoters50/1020940
aaatattct

SEQ ID NO: 158308 - DNA, 9 bp, Unknown
  misc_feature (1)..( 9): Result.004 file - promoters50/1020940
gtaaattat

SEQ ID NO: 158309 - DNA, 9 bp, Unknown
  misc_feature (1)..( 9): Result.004 file - promoters50/1020940
acaaagtaa

SEQ ID NO: 158310 - DNA, 9 bp, Unknown
  misc_feature (1)..( 9): Result.004 file - promoters50/1020940
aaaaatgaa

SEQ ID NO: 158311 - DNA, 9 bp, Unknown
  misc_feature (1)..( 9): Result.004 file - promoters50/1020940
caatatttg

SEQ ID NO: 158312 - DNA, 10 bp, Unknown
  misc_feature (1)..( 10): Result.004 file - promoters50/1020940
tatatatacc

SEQ ID NO: 158313 - DNA, 10 bp, Unknown
  misc_feature (1)..( 10): Result.004 file - promoters50/1020940
tatataaacc

SEQ ID NO: 158314 - DNA, 10 bp, Unknown
  misc_feature (1)..( 10): Result.004 file - promoters50/1020940
tatataaagg

SEQ ID NO: 158315 - DNA, 10 bp, Unknown
  misc_feature (1)..( 10): Result.004 file - promoters50/1020940
tatataatag

SEQ ID NO: 158316 - DNA, 10 bp, Unknown
  misc_feature (1)..( 10): Result.004 file - promoters50/1020940
tatataatgg

SEQ ID NO: 158317 - DNA, 10 bp, Unknown
  misc_feature (1)..( 10): Result.004 file - promoters50/1020940
tatttaaaca

SEQ ID NO: 158318 - DNA, 10 bp, Unknown
  misc_feature (1)..( 10): Result.004 file - promoters50/1020940
aatataatct

SEQ ID NO: 158319 - DNA, 11 bp, Unknown
  misc_feature (1)..( 11): Result.004 file - promoters50/1020940
aaataaaatgt

SEQ ID NO: 158320 - DNA, 11 bp, Unknown
  misc_feature (1)..( 11): Result.004 file - promoters50/1020940
tgctaaaattg

SEQ ID NO: 158321 - DNA, 11 bp, Unknown
  misc_feature (1)..( 11): Result.004 file - promoters50/1020940
tattaacatga

SEQ ID NO: 158322 - DNA, 11 bp, Unknown
  misc_feature (1)..( 11): Result.004 file - promoters50/1020940
aaagaaaacat

SEQ ID NO: 158323 - DNA, 11 bp, Unknown
  misc_feature (1)..( 11): Result.004 file - promoters50/1020940
acgtaagattg

SEQ ID NO: 158324 - DNA, 11 bp, Unknown
  misc_feature (1)..( 11): Result.004 file - promoters50/1020940
cattcacaatt

SEQ ID NO: 158325 - DNA, 11 bp, Unknown
  misc_feature (1)..( 11): Result.004 file - promoters50/1020940
aagtaaactag

SEQ ID NO: 158326 - DNA, 12 bp, Unknown
  misc_feature (1)..( 12): Result.004 file - promoters50/1020940
acaaaatagatt

SEQ ID NO: 158327 - DNA, 12 bp, Unknown
  misc_feature (1)..( 12): Result.004 file - promoters50/1020940
gaaaaaaagaaa

SEQ ID NO: 158328 - DNA, 12 bp, Unknown
  misc_feature (1)..( 12): Result.004 file - promoters50/1020940
acaaaattagac

SEQ ID NO: 158329 - DNA, 12 bp, Unknown
  misc_feature (1)..( 12): Result.004 file - promoters50/1020940
acaataaagtag

SEQ ID NO: 158330 - DNA, 13 bp, Unknown
  misc_feature (1)..( 13): Result.004 file - promoters50/1020940
agttaaataaagc

SEQ ID NO: 158331 - DNA, 13 bp, Unknown
  misc_feature (1)..( 13): Result.004 file - promoters50/1020940
ccaagtaaaaacc

SEQ ID NO: 158332 - DNA, 13 bp, Unknown
  misc_feature (1)..( 13): Result.004 file - promoters50/1020940
taatagtttcttt

SEQ ID NO: 158333 - DNA, 13 bp, Unknown
  misc_feature (1)..( 13): Result.004 file - promoters50/1020940
taagagttttacg

SEQ ID NO: 158334 - DNA, 13 bp, Unknown
  misc_feature (1)..( 13): Result.004 file - promoters50/1020940
acataatttctta

SEQ ID NO: 158335 - DNA, 13 bp, Unknown
  misc_feature (1)..( 13): Result.004 file - promoters50/1020940
tgataattaggga

SEQ ID NO: 158336 - DNA, 13 bp, Unknown
  misc_feature (1)..( 13): Result.004 file - promoters50/1020940
ttgaattttttta

SEQ ID NO: 158337 - DNA, 13 bp, Unknown
  misc_feature (1)..( 13): Result.004 file - promoters50/1020940
tagatgttttttt

SEQ ID NO: 158338 - DNA, 13 bp, Unknown
  misc_feature (1)..( 13): Result.004 file - promoters50/1020940
atagtttcttttt

SEQ ID NO: 158339 - DNA, 13 bp, Unknown
  misc_feature (1)..( 13): Result.004 file - promoters50/1020940
ttggtttctcatt

SEQ ID NO: 158340 - DNA, 13 bp, Unknown
  misc_feature (1)..( 13): Result.004 file - promoters50/1020940
ataatttcttact

SEQ ID NO: 158341 - DNA, 13 bp, Unknown
  misc_feature (1)..( 13): Result.004 file - promoters50/1020940
ataattagggatt

SEQ ID NO: 158342 - DNA, 13 bp, Unknown
  misc_feature (1)..( 13): Result.004 file - promoters50/1020940
ataattaacgaac

SEQ ID NO: 158343 - DNA, 13 bp, Unknown
  misc_feature (1)..( 13): Result.004 file - promoters50/1020940
tgtttttttcatt

SEQ ID NO: 158344 - DNA, 13 bp, Unknown
  misc_feature (1)..( 13): Result.004 file - promoters50/1020940
gaatttttttaat

SEQ ID NO: 158345 - DNA, 13 bp, Unknown
  misc_feature (1)..( 13): Result.004 file - promoters50/1020940
atgaatctctctg

SEQ ID NO: 158346 - DNA, 13 bp, Unknown
  misc_feature (1)..( 13): Result.004 file - promoters50/1020940
aacaatcactctc

SEQ ID NO: 158347 - DNA, 13 bp, Unknown
  misc_feature (1)..( 13): Result.004 file - promoters50/1020940
atcaatccctctc

SEQ ID NO: 158348 - DNA, 13 bp, Unknown
  misc_feature (1)..( 13): Result.004 file - promoters50/1020940
ttaaatctctccc

SEQ ID NO: 158349 - DNA, 13 bp, Unknown
  misc_feature (1)..( 13): Result.004 file - promoters50/1020940
aacaaacacaaca

SEQ ID NO: 158350 - DNA, 13 bp, Unknown
  misc_feature (1)..( 13): Result.004 file - promoters50/1020940
tttaaacaagctg

SEQ ID NO: 158351 - DNA, 13 bp, Unknown
  misc_feature (1)..( 13): Result.004 file - promoters50/1020940
tttttgcagtaaa

SEQ ID NO: 158352 - DNA, 13 bp, Unknown
  misc_feature (1)..( 13): Result.004 file - promoters50/1020940
ttattgtagtgta

SEQ ID NO: 158353 - DNA, 13 bp, Unknown
  misc_feature (1)..( 13): Result.004 file - promoters50/1020940
tcattgtagtagt

SEQ ID NO: 158354 - DNA, 13 bp, Unknown
  misc_feature (1)..( 13): Result.004 file - promoters50/1020940
gattttcagtaat

SEQ ID NO: 158355 - DNA, 13 bp, Unknown
  misc_feature (1)..( 13): Result.004 file - promoters50/1020940
gattttcacaaac

SEQ ID NO: 158356 - DNA, 13 bp, Unknown
  misc_feature (1)..( 13): Result.004 file - promoters50/1020940
gtttctcattaat

SEQ ID NO: 158357 - DNA, 11 bp, Unknown
  misc_feature (1)..( 11): Result.004 file - promoters50/1020940
gattttcacaa

SEQ ID NO: 158358 - DNA, 11 bp, Unknown
  misc_feature (1)..( 11): Result.004 file - promoters50/1020940
ttttttcattg

SEQ ID NO: 158359 - DNA, 11 bp, Unknown
  misc_feature (1)..( 11): Result.004 file - promoters50/1020940
gattttcagta

SEQ ID NO: 158360 - DNA, 11 bp, Unknown
  misc_feature (1)..( 11): Result.004 file - promoters50/1020940
gatttttacat

SEQ ID NO: 158361 - DNA, 11 bp, Unknown
  misc_feature (1)..( 11): Result.004 file - promoters50/1020940
cgttttgattt

SEQ ID NO: 158362 - DNA, 12 bp, Unknown
  misc_feature (1)..( 12): Result.004 file - promoters50/1020940
ggtttctcatta

SEQ ID NO: 158363 - DNA, 10 bp, Unknown
  misc_feature (1)..( 10): Result.004 file - promoters50/1020940
atttttacat

SEQ ID NO: 158364 - DNA, 10 bp, Unknown
  misc_feature (1)..( 10): Result.004 file - promoters50/1020940
agttttacgt

SEQ ID NO: 158365 - DNA, 10 bp, Unknown
  misc_feature (1)..( 10): Result.004 file - promoters50/1020940
tttttttcat

SEQ ID NO: 158366 - DNA, 10 bp, Unknown
  misc_feature (1)..( 10): Result.004 file - promoters50/1020940
agttttattg

SEQ ID NO: 158367 - DNA, 10 bp, Unknown
  misc_feature (1)..( 10): Result.004 file - promoters50/1020940
attttttggt

SEQ ID NO: 158368 - DNA, 10 bp, Unknown
  misc_feature (1)..( 10): Result.004 file - promoters50/1020940
atttttttaa

SEQ ID NO: 158369 - DNA, 14 bp, Unknown
  misc_feature (1)..( 14): Result.004 file - promoters50/1020940
tcgtgatttttaca

SEQ ID NO: 158370 - DNA, 14 bp, Unknown
  misc_feature (1)..( 14): Result.004 file - promoters50/1020940
ttttgattttacca

SEQ ID NO: 158371 - DNA, 14 bp, Unknown
  misc_feature (1)..( 14): Result.004 file - promoters50/1020940
tcaagattttgatt

SEQ ID NO: 158372 - DNA, 14 bp, Unknown
  misc_feature (1)..( 14): Result.004 file - promoters50/1020940
ttttggtttctcat

SEQ ID NO: 158373 - DNA, 14 bp, Unknown
  misc_feature (1)..( 14): Result.004 file - promoters50/1020940
accaagttttattg

SEQ ID NO: 158374 - DNA, 14 bp, Unknown
  misc_feature (1)..( 14): Result.004 file - promoters50/1020968
atgtttttttcatt

SEQ ID NO: 158375 - DNA, 12 bp, Unknown
  misc_feature (1)..( 12): Result.004 file - promoters50/1020968
gtaatttaaaat

SEQ ID NO: 158376 - DNA, 12 bp, Unknown
  misc_feature (1)..( 12): Result.004 file - promoters50/1020968
atcatttaagtt

SEQ ID NO: 158377 - DNA, 12 bp, Unknown
  misc_feature (1)..( 12): Result.004 file - promoters50/1020968
gtaatttaatgc

SEQ ID NO: 158378 - DNA, 12 bp, Unknown
  misc_feature (1)..( 12): Result.004 file - promoters50/1020968
cgaattcaaacc

SEQ ID NO: 158379 - DNA, 12 bp, Unknown
  misc_feature (1)..( 12): Result.004 file - promoters50/1020968
tatttttaaaat

SEQ ID NO: 158380 - DNA, 12 bp, Unknown
  misc_feature (1)..( 12): Result.004 file - promoters50/1020968
gaaatgtaactt

SEQ ID NO: 158381 - DNA, 14 bp, Unknown
  misc_feature (1)..( 14): Result.004 file - promoters50/1020968
catttaagttttaa

SEQ ID NO: 158382 - DNA, 14 bp, Unknown
  misc_feature (1)..( 14): Result.004 file - promoters50/1020968
catataaacaacaa

SEQ ID NO: 158383 - DNA, 14 bp, Unknown
  misc_feature (1)..( 14): Result.004 file - promoters50/1020968
catgtaaatctaat

SEQ ID NO: 158384 - DNA, 14 bp, Unknown
  misc_feature (1)..( 14): Result.004 file - promoters50/1020968
tatttgagttatgt

SEQ ID NO: 158385 - DNA, 14 bp, Unknown
  misc_feature (1)..( 14): Result.004 file - promoters50/1020968
ggtttaaattttaa

SEQ ID NO: 158386 - DNA, 15 bp, Unknown
  misc_feature (1)..( 15): Result.004 file - promoters50/1020968
aattctaaaatcttc

SEQ ID NO: 158387 - DNA, 15 bp, Unknown
  misc_feature (1)..( 15): Result.004 file - promoters50/1020968
tattataaacttttt

SEQ ID NO: 158388 - DNA, 11 bp, Unknown
  misc_feature (1)..( 11): Result.004 file - promoters50/1020968
gttatagttaa

SEQ ID NO: 158389 - DNA, 11 bp, Unknown
  misc_feature (1)..( 11): Result.004 file - promoters50/1020968
tttataattac

SEQ ID NO: 158390 - DNA, 11 bp, Unknown
  misc_feature (1)..( 11): Result.004 file - promoters50/1020968
attatagattt

SEQ ID NO: 158391 - DNA, 11 bp, Unknown
  misc_feature (1)..( 11): Result.004 file - promoters50/1020968
tttatatattt

SEQ ID NO: 158392 - DNA, 11 bp, Unknown
  misc_feature (1)..( 11): Result.004 file - promoters50/1020968
tgacaaattac

SEQ ID NO: 158393 - DNA, 11 bp, Unknown
  misc_feature (1)..( 11): Result.004 file - promoters50/1020968
attaaatatgt

SEQ ID NO: 158394 - DNA, 11 bp, Unknown
  misc_feature (1)..( 11): Result.004 file - promoters50/1020968
ctaaaatatca

SEQ ID NO: 158395 - DNA, 9 bp, Unknown
  misc_feature (1)..( 9): Result.004 file - promoters50/1020968
gtcaataaa

SEQ ID NO: 158396 - DNA, 9 bp, Unknown
  misc_feature (1)..( 9): Result.004 file - promoters50/1020968
gaaaataaa

SEQ ID NO: 158397 - DNA, 9 bp, Unknown
  misc_feature (1)..( 9): Result.004 file - promoters50/1020968
cgaaataaa

SEQ ID NO: 158398 - DNA, 10 bp, Unknown
  misc_feature (1)..( 10): Result.004 file - promoters50/1020968
ataaagtaat

SEQ ID NO: 158399 - DNA, 10 bp, Unknown
  misc_feature (1)..( 10): Result.004 file - promoters50/1020968
agaaaaaaaa

SEQ ID NO: 158400 - DNA, 10 bp, Unknown
  misc_feature (1)..( 10): Result.004 file - promoters50/1020968
gaaaaataaa

SEQ ID NO: 158401 - DNA, 10 bp, Unknown
  misc_feature (1)..( 10): Result.004 file - promoters50/1020968
ttaaaatatt

SEQ ID NO: 158402 - DNA, 10 bp, Unknown
  misc_feature (1)..( 10): Result.004 file - promoters50/1020968
tttaaaatcg

SEQ ID NO: 158403 - DNA, 10 bp, Unknown
  misc_feature (1)..( 10): Result.004 file - promoters50/1020968
cgtaaaattt

SEQ ID NO: 158404 - DNA, 10 bp, Unknown
  misc_feature (1)..( 10): Result.004 file - promoters50/1020968
tttaaaattg

SEQ ID NO: 158405 - DNA, 10 bp, Unknown
  misc_feature (1)..( 10): Result.004 file - promoters50/1020968
aataaaatga

SEQ ID NO: 158406 - DNA, 10 bp, Unknown
  misc_feature (1)..( 10): Result.004 file - promoters50/1020968
tttaaaatat

SEQ ID NO: 158407 - DNA, 10 bp, Unknown
  misc_feature (1)..( 10): Result.004 file - promoters50/1020968
attaaaatat

SEQ ID NO: 158408 - DNA, 10 bp, Unknown
  misc_feature (1)..( 10): Result.004 file - promoters50/1020968
cttaatatac

SEQ ID NO: 158409 - DNA, 10 bp, Unknown
  misc_feature (1)..( 10): Result.004 file - promoters50/1021047
tggaaacttt

SEQ ID NO: 158410 - DNA, 11 bp, Unknown
  misc_feature (1)..( 11): Result.004 file - promoters50/1021047
tgttatattaa

SEQ ID NO: 158411 - DNA, 11 bp, Unknown
  misc_feature (1)..( 11): Result.004 file - promoters50/1021047
aattattttaa

SEQ ID NO: 158412 - DNA, 11 bp, Unknown
  misc_feature (1)..( 11): Result.004 file - promoters50/1021047
acttattttat

SEQ ID NO: 158413 - DNA, 12 bp, Unknown
  misc_feature (1)..( 12): Result.004 file - promoters50/1021047
gtttgattttta

SEQ ID NO: 158414 - DNA, 12 bp, Unknown
  misc_feature (1)..( 12): Result.004 file - promoters50/1021047
tttcaatattgg

SEQ ID NO: 158415 - DNA, 12 bp, Unknown
  misc_feature (1)..( 12): Result.004 file - promoters50/1021047
tttgaattcatt

SEQ ID NO: 158416 - DNA, 13 bp, Unknown
  misc_feature (1)..( 13): Result.004 file - promoters50/1021047
gaacaatcattgg

SEQ ID NO: 158417 - DNA, 13 bp, Unknown
  misc_feature (1)..( 13): Result.004 file - promoters50/1021047
gtaggatatttct

SEQ ID NO: 158418 - DNA, 11 bp, Unknown
  misc_feature (1)..( 11): Result.004 file - promoters50/1021047
ttatgtattca

SEQ ID NO: 158419 - DNA, 11 bp, Unknown
  misc_feature (1)..( 11): Result.004 file - promoters50/1021047
ttaagtagatt

SEQ ID NO: 158420 - DNA, 11 bp, Unknown
  misc_feature (1)..( 11): Result.004 file - promoters50/1021047
ataattagttt

SEQ ID NO: 158421 - DNA, 11 bp, Unknown
  misc_feature (1)..( 11): Result.004 file - promoters50/1021047
cgaagaagatt

SEQ ID NO: 158422 - DNA, 11 bp, Unknown
  misc_feature (1)..( 11): Result.004 file - promoters50/1021047
gtaattactgg

SEQ ID NO: 158423 - DNA, 11 bp, Unknown
  misc_feature (1)..( 11): Result.004 file - promoters50/1021047
agaagaagtta

SEQ ID NO: 158424 - DNA, 13 bp, Unknown
  misc_feature (1)..( 13): Result.004 file - promoters50/1021047
caagtatataaac

SEQ ID NO: 158425 - DNA, 13 bp, Unknown
  misc_feature (1)..( 13): Result.004 file - promoters50/1021047
aaattatttaaat

SEQ ID NO: 158426 - DNA, 13 bp, Unknown
  misc_feature (1)..( 13): Result.004 file - promoters50/1021047
caagaatatacat

SEQ ID NO: 158427 - DNA, 13 bp, Unknown
  misc_feature (1)..( 13): Result.004 file - promoters50/1021047
ataaaataaaaac

SEQ ID NO: 158428 - DNA, 13 bp, Unknown
  misc_feature (1)..( 13): Result.004 file - promoters50/1021047
cagtaaaataaag

SEQ ID NO: 158429 - DNA, 13 bp, Unknown
  misc_feature (1)..( 13): Result.004 file - promoters50/1021047
aagaagtaagaac

SEQ ID NO: 158430 - DNA, 13 bp, Unknown
  misc_feature (1)..( 13): Result.004 file - promoters50/1021047
gagtctataaatt

SEQ ID NO: 158431 - DNA, 13 bp, Unknown
  misc_feature (1)..( 13): Result.004 file - promoters50/1021047
tattatataaacg

SEQ ID NO: 158432 - DNA, 13 bp, Unknown
  misc_feature (1)..( 13): Result.004 file - promoters50/1021047
gtgtctataaata

SEQ ID NO: 158433 - DNA, 13 bp, Unknown
  misc_feature (1)..( 13): Result.004 file - promoters50/1021047
tattatataactc

SEQ ID NO: 158434 - DNA, 13 bp, Unknown
  misc_feature (1)..( 13): Result.004 file - promoters50/1021047
aagtatatatact

SEQ ID NO: 158435 - DNA, 13 bp, Unknown
  misc_feature (1)..( 13): Result.004 file - promoters50/1021079
aaatctataaata

SEQ ID NO: 158436 - DNA, 11 bp, Unknown
  misc_feature (1)..( 11): Result.004 file - promoters50/1021079
agtaaaatatt

SEQ ID NO: 158437 - DNA, 11 bp, Unknown
  misc_feature (1)..( 11): Result.004 file - promoters50/1021079
aataaaatctc

SEQ ID NO: 158438 - DNA, 11 bp, Unknown
  misc_feature (1)..( 11): Result.004 file - promoters50/1021079
agtaaaaatac

SEQ ID NO: 158439 - DNA, 11 bp, Unknown
  misc_feature (1)..( 11): Result.004 file - promoters50/1021079
tttaaaatata

SEQ ID NO: 158440 - DNA, 11 bp, Unknown
  misc_feature (1)..( 11): Result.004 file - promoters50/1021079
accaaaaaaaa

SEQ ID NO: 158441 - DNA, 11 bp, Unknown
  misc_feature (1)..( 11): Result.004 file - promoters50/1021079
gatataatctt

SEQ ID NO: 158442 - DNA, 11 bp, Unknown
  misc_feature (1)..( 11): Result.004 file - promoters50/1021079
aggaaaacata

SEQ ID NO: 158443 - DNA, 13 bp, Unknown
  misc_feature (1)..( 13): Result.004 file - promoters50/1021079
aattgaaacacca

SEQ ID NO: 158444 - DNA, 13 bp, Unknown
  misc_feature (1)..( 13): Result.004 file - promoters50/1021079
gtttgatacacat

SEQ ID NO: 158445 - DNA, 14 bp, Unknown
  misc_feature (1)..( 14): Result.004 file - promoters50/1021079
tgtgttttactcat

SEQ ID NO: 158446 - DNA, 13 bp, Unknown
  misc_feature (1)..( 13): Result.004 file - promoters50/1021079
tttttatatcttg

SEQ ID NO: 158447 - DNA, 14 bp, Unknown
  misc_feature (1)..( 14): Result.004 file - promoters50/1021079
atttgtataccaaa

SEQ ID NO: 158448 - DNA, 14 bp, Unknown
  misc_feature (1)..( 14): Result.004 file - promoters50/1021104
gactcttgacacaa

SEQ ID NO: 158449 - DNA, 12 bp, Unknown
  misc_feature (1)..( 12): Result.004 file - promoters50/1021104
aattctaaaatc

SEQ ID NO: 158450 - DNA, 12 bp, Unknown
  misc_feature (1)..( 12): Result.004 file - promoters50/1021104
aattcttaaatt

SEQ ID NO: 158451 - DNA, 12 bp, Unknown
  misc_feature (1)..( 12): Result.004 file - promoters50/1021104
tgttccaaattc

SEQ ID NO: 158452 - DNA, 12 bp, Unknown
  misc_feature (1)..( 12): Result.004 file - promoters50/1021104
ctttattaaatt

SEQ ID NO: 158453 - DNA, 12 bp, Unknown
  misc_feature (1)..( 12): Result.004 file - promoters50/1021104
ttttcttaggtg

SEQ ID NO: 158454 - DNA, 12 bp, Unknown
  misc_feature (1)..( 12): Result.004 file - promoters50/1021136
gtgactttaatc

SEQ ID NO: 158455 - DNA, 9 bp, Unknown
  misc_feature (1)..( 9): Result.004 file - promoters50/1021136
ttaaaaata

SEQ ID NO: 158456 - DNA, 9 bp, Unknown
  misc_feature (1)..( 9): Result.004 file - promoters50/1021136
ttaaaaatc

SEQ ID NO: 158457 - DNA, 9 bp, Unknown
  misc_feature (1)..( 9): Result.004 file - promoters50/1021136
ataataata

SEQ ID NO: 158458 - DNA, 9 bp, Unknown
  misc_feature (1)..( 9): Result.004 file - promoters50/1021136
acaaaaatc

SEQ ID NO: 158459 - DNA, 7 bp, Unknown
  misc_feature (1)..( 7): Result.004 file - promoters50/1021136
atttgtt

SEQ ID NO: 158460 - DNA, 7 bp, Unknown
  misc_feature (1)..( 7): Result.004 file - promoters50/1021136
gtttgtt

SEQ ID NO: 158461 - DNA, 7 bp, Unknown
  misc_feature (1)..( 7): Result.004 file - promoters50/1021136
ttttgtt

SEQ ID NO: 158462 - DNA, 7 bp, Unknown
  misc_feature (1)..( 7): Result.004 file - promoters50/1021136
gtttgtg

SEQ ID NO: 158463 - DNA, 8 bp, Unknown
  misc_feature (1)..( 8): Result.004 file - promoters50/1021136
caagaaaa

SEQ ID NO: 158464 - DNA, 8 bp, Unknown
  misc_feature (1)..( 8): Result.004 file - promoters50/1021136
aaagaaaa

SEQ ID NO: 158465 - DNA, 8 bp, Unknown
  misc_feature (1)..( 8): Result.004 file - promoters50/1021136
aaagaaac

SEQ ID NO: 158466 - DNA, 8 bp, Unknown
  misc_feature (1)..( 8): Result.004 file - promoters50/1021136
aaagtaaa

SEQ ID NO: 158467 - DNA, 11 bp, Unknown
  misc_feature (1)..( 11): Result.004 file - promoters50/1021136
tttttgcattt

SEQ ID NO: 158468 - DNA, 11 bp, Unknown
  misc_feature (1)..( 11): Result.004 file - promoters50/1021136
tctttgaattt

SEQ ID NO: 158469 - DNA, 11 bp, Unknown
  misc_feature (1)..( 11): Result.004 file - promoters50/1021136
tgattgcatag

SEQ ID NO: 158470 - DNA, 11 bp, Unknown
  misc_feature (1)..( 11): Result.004 file - promoters50/1021136
tctctgagttt

SEQ ID NO: 158471 - DNA, 7 bp, Unknown
  misc_feature (1)..( 7): Result.004 file - promoters50/1021136
aaaaatt

SEQ ID NO: 158472 - DNA, 7 bp, Unknown
  misc_feature (1)..( 7): Result.004 file - promoters50/1021136
aaaaata

SEQ ID NO: 158473 - DNA, 8 bp, Unknown
  misc_feature (1)..( 8): Result.004 file - promoters50/1021136
aaacaata

SEQ ID NO: 158474 - DNA, 8 bp, Unknown
  misc_feature (1)..( 8): Result.004 file - promoters50/1021148
aaaaaatc

SEQ ID NO: 158475 - DNA, 14 bp, Unknown
  misc_feature (1)..( 14): Result.004 file - promoters50/1021148
ataataattttttt

SEQ ID NO: 158476 - DNA, 14 bp, Unknown
  misc_feature (1)..( 14): Result.004 file - promoters50/1021148
gtgataatttcacg

SEQ ID NO: 158477 - DNA, 14 bp, Unknown
  misc_feature (1)..( 14): Result.004 file - promoters50/1021148
ataaaaatttgatt

SEQ ID NO: 158478 - DNA, 11 bp, Unknown
  misc_feature (1)..( 11): Result.004 file - promoters50/1021148
aatatttactt

SEQ ID NO: 158479 - DNA, 14 bp, Unknown
  misc_feature (1)..( 14): Result.004 file - promoters50/1021148
ggttgaatttgatt

SEQ ID NO: 158480 - DNA, 14 bp, Unknown
  misc_feature (1)..( 14): Result.004 file - promoters50/1021148
gtagatataaagaa

SEQ ID NO: 158481 - DNA, 11 bp, Unknown
  misc_feature (1)..( 11): Result.004 file - promoters50/1021148
aaatttgtaaa

SEQ ID NO: 158482 - DNA, 11 bp, Unknown
  misc_feature (1)..( 11): Result.004 file - promoters50/1021148
agatttgtgtc

SEQ ID NO: 158483 - DNA, 11 bp, Unknown
  misc_feature (1)..( 11): Result.004 file - promoters50/1021148
gtatttataaa

SEQ ID NO: 158484 - DNA, 11 bp, Unknown
  misc_feature (1)..( 11): Result.004 file - promoters50/1021148
acatttttaag

SEQ ID NO: 158485 - DNA, 11 bp, Unknown
  misc_feature (1)..( 11): Result.004 file - promoters50/1021148
aaatttgaaaa

SEQ ID NO: 158486 - DNA, 11 bp, Unknown
  misc_feature (1)..( 11): Result.004 file - promoters50/1021148
tcatttatcag

SEQ ID NO: 158487 - DNA, 11 bp, Unknown
  misc_feature (1)..( 11): Result.004 file - promoters50/1021148
ctttttttaca

SEQ ID NO: 158488 - DNA, 13 bp, Unknown
  misc_feature (1)..( 13): Result.004 file - promoters50/1021148
caaagaaaatata

SEQ ID NO: 158489 - DNA, 13 bp, Unknown
  misc_feature (1)..( 13): Result.004 file - promoters50/1021148
ttcaaaaattatt

SEQ ID NO: 158490 - DNA, 13 bp, Unknown
  misc_feature (1)..( 13): Result.004 file - promoters50/1021148
caaaaaaattatc

SEQ ID NO: 158491 - DNA, 14 bp, Unknown
  misc_feature (1)..( 14): Result.004 file - promoters50/1021148
gaaacgaatctaat

SEQ ID NO: 158492 - DNA, 14 bp, Unknown
  misc_feature (1)..( 14): Result.004 file - promoters50/1021148
cataaaaattcgac

SEQ ID NO: 158493 - DNA, 14 bp, Unknown
  misc_feature (1)..( 14): Result.004 file - promoters50/1021148
cataataatttgaa

SEQ ID NO: 158494 - DNA, 14 bp, Unknown
  misc_feature (1)..( 14): Result.004 file - promoters50/1021148
cgacaaaacaaact

SEQ ID NO: 158495 - DNA, 14 bp, Unknown
  misc_feature (1)..( 14): Result.004 file - promoters50/1021148
aaaaaaaatggcct

SEQ ID NO: 158496 - DNA, 14 bp, Unknown
  misc_feature (1)..( 14): Result.004 file - promoters50/1021148
agaaaaaaaacatt

SEQ ID NO: 158497 - DNA, 15 bp, Unknown
  misc_feature (1)..( 15): Result.004 file - promoters50/1021148
tgaaataaaagatgt

SEQ ID NO: 158498 - DNA, 15 bp, Unknown
  misc_feature (1)..( 15): Result.004 file - promoters50/1021148
cgaaaaaaaaataaa

SEQ ID NO: 158499 - DNA, 15 bp, Unknown
  misc_feature (1)..( 15): Result.004 file - promoters50/1021148
agaaataaaaattgg

SEQ ID NO: 158500 - DNA, 15 bp, Unknown
  misc_feature (1)..( 15): Result.004 file - promoters50/1021148
tgaaaaatataaaat

SEQ ID NO: 158501 - DNA, 15 bp, Unknown
  misc_feature (1)..( 15): Result.004 file - promoters50/1021148
acaagagaaacttgt

SEQ ID NO: 158502 - DNA, 15 bp, Unknown
  misc_feature (1)..( 15): Result.004 file - promoters50/1021148
ggtagtaaaagttta

SEQ ID NO: 158503 - DNA, 9 bp, Unknown
  misc_feature (1)..( 9): Result.004 file - promoters50/1021148
attttacta

SEQ ID NO: 158504 - DNA, 9 bp, Unknown
  misc_feature (1)..( 9): Result.004 file - promoters50/1021148
cttttacga

SEQ ID NO: 158505 - DNA, 9 bp, Unknown
  misc_feature (1)..( 9): Result.004 file - promoters50/1021148
attttataa

SEQ ID NO: 158506 - DNA, 9 bp, Unknown
  misc_feature (1)..( 9): Result.004 file - promoters50/1021148
attttatag

SEQ ID NO: 158507 - DNA, 9 bp, Unknown
  misc_feature (1)..( 9): Result.004 file - promoters50/1021148
tatttaacg

SEQ ID NO: 158508 - DNA, 9 bp, Unknown
  misc_feature (1)..( 9): Result.004 file - promoters50/1021148
atttgatat

SEQ ID NO: 158509 - DNA, 15 bp, Unknown
  misc_feature (1)..( 15): Result.004 file - promoters50/1021148
tacaagaaaaaaaaa

SEQ ID NO: 158510 - DNA, 15 bp, Unknown
  misc_feature (1)..( 15): Result.004 file - promoters50/1021148
aaaaataaaaaatta

SEQ ID NO: 158511 - DNA, 15 bp, Unknown
  misc_feature (1)..( 15): Result.004 file - promoters50/1021148
agaaataaaaattgg

SEQ ID NO: 158512 - DNA, 15 bp, Unknown
  misc_feature (1)..( 15): Result.004 file - promoters50/1021148
aatttgaaaaatata

SEQ ID NO: 158513 - DNA, 15 bp, Unknown
  misc_feature (1)..( 15): Result.004 file - promoters50/1021148
acaagagaaacttgt

SEQ ID NO: 158514 - DNA, 15 bp, Unknown
  misc_feature (1)..( 15): Result.004 file - promoters50/1021148
ggacataaaaattcg

SEQ ID NO: 158515 - DNA, 9 bp, Unknown
  misc_feature (1)..( 9): Result.004 file - promoters50/1021148
ctttatttt

SEQ ID NO: 158516 - DNA, 9 bp, Unknown
  misc_feature (1)..( 9): Result.004 file - promoters50/1021148
ttttattta

SEQ ID NO: 158517 - DNA, 9 bp, Unknown
  misc_feature (1)..( 9): Result.004 file - promoters50/1021148
ttttctttt

SEQ ID NO: 158518 - DNA, 10 bp, Unknown
  misc_feature (1)..( 10): Result.004 file - promoters50/1021148
gtttgattaa

SEQ ID NO: 158519 - DNA, 10 bp, Unknown
  misc_feature (1)..( 10): Result.004 file - promoters50/1021148
attttataat

SEQ ID NO: 158520 - DNA, 10 bp, Unknown
  misc_feature (1)..( 10): Result.004 file - promoters50/1021148
ttttgcttga

SEQ ID NO: 158521 - DNA, 15 bp, Unknown
  misc_feature (1)..( 15): Result.004 file - promoters50/1021148
cttttttttatttgc

SEQ ID NO: 158522 - DNA, 15 bp, Unknown
  misc_feature (1)..( 15): Result.004 file - promoters50/1021148
ctaatttctatccat

SEQ ID NO: 158523 - DNA, 15 bp, Unknown
  misc_feature (1)..( 15): Result.004 file - promoters50/1021148
ataatttttttgttt

SEQ ID NO: 158524 - DNA, 15 bp, Unknown
  misc_feature (1)..( 15): Result.004 file - promoters50/1021148
acaatttatattata

SEQ ID NO: 158525 - DNA, 15 bp, Unknown
  misc_feature (1)..( 15): Result.004 file - promoters50/1021148
aacatttttaagaag

SEQ ID NO: 158526 - DNA, 15 bp, Unknown
  misc_feature (1)..( 15): Result.004 file - promoters50/1021218
atctttttttacaac

SEQ ID NO: 158527 - DNA, 18 bp, Unknown
  misc_feature (1)..( 18): Result.004 file - promoters50/1021218
ttttatcacatataagct

SEQ ID NO: 158528 - DNA, 18 bp, Unknown
  misc_feature (1)..( 18): Result.004 file - promoters50/1021218
tgattttggatataatat

SEQ ID NO: 158529 - DNA, 18 bp, Unknown
  misc_feature (1)..( 18): Result.004 file - promoters50/1021218
ttcaaattcttatcagct

SEQ ID NO: 158530 - DNA, 18 bp, Unknown
  misc_feature (1)..( 18): Result.004 file - promoters50/1021218
agtcagcacacataaaat

SEQ ID NO: 158531 - DNA, 18 bp, Unknown
  misc_feature (1)..( 18): Result.004 file - promoters50/1021218
agtcggcaaacaacaaga

SEQ ID NO: 158532 - DNA, 18 bp, Unknown
  misc_feature (1)..( 18): Result.004 file - promoters50/1021218
aaccaacggagataagct

SEQ ID NO: 158533 - DNA, 17 bp, Unknown
  misc_feature (1)..( 17): Result.004 file - promoters50/1021218
gaaacgacgccattatc

SEQ ID NO: 158534 - DNA, 17 bp, Unknown
  misc_feature (1)..( 17): Result.004 file - promoters50/1021218
aagatgacgtcataatt

SEQ ID NO: 158535 - DNA, 17 bp, Unknown
  misc_feature (1)..( 17): Result.004 file - promoters50/1021218
taaacaacgcaagactc

SEQ ID NO: 158536 - DNA, 17 bp, Unknown
  misc_feature (1)..( 17): Result.004 file - promoters50/1021218
taatcaaaccaaacatg

SEQ ID NO: 158537 - DNA, 17 bp, Unknown
  misc_feature (1)..( 17): Result.004 file - promoters50/1021218
gtcaggaagtcatcatt

SEQ ID NO: 158538 - DNA, 17 bp, Unknown
  misc_feature (1)..( 17): Result.004 file - promoters50/1021239
caattaacttcatcaaa

SEQ ID NO: 158539 - DNA, 10 bp, Unknown
  misc_feature (1)..( 10): Result.004 file - promoters50/1021239
aaaaaataaa

SEQ ID NO: 158540 - DNA, 10 bp, Unknown
  misc_feature (1)..( 10): Result.004 file - promoters50/1021239
caaaaacaaa

SEQ ID NO: 158541 - DNA, 10 bp, Unknown
  misc_feature (1)..( 10): Result.004 file - promoters50/1021239
caaaaagtcg

SEQ ID NO: 158542 - DNA, 8 bp, Unknown
  misc_feature (1)..( 8): Result.004 file - promoters50/1021239
ttcgatgt

SEQ ID NO: 158543 - DNA, 8 bp, Unknown
  misc_feature (1)..( 8): Result.004 file - promoters50/1021239
ttcaatga

SEQ ID NO: 158544 - DNA, 8 bp, Unknown
  misc_feature (1)..( 8): Result.004 file - promoters50/1021239
ttctgcaa

SEQ ID NO: 158545 - DNA, 7 bp, Unknown
  misc_feature (1)..( 7): Result.004 file - promoters50/1021239
cacttaa

SEQ ID NO: 158546 - DNA, 7 bp, Unknown
  misc_feature (1)..( 7): Result.004 file - promoters50/1021239
cacttaa

SEQ ID NO: 158547 - DNA, 7 bp, Unknown
  misc_feature (1)..( 7): Result.004 file - promoters50/1021242
gacttaa

SEQ ID NO: 158548 - DNA, 11 bp, Unknown
  misc_feature (1)..( 11): Result.004 file - promoters50/1021242
aaaaaatgtga

SEQ ID NO: 158549 - DNA, 11 bp, Unknown
  misc_feature (1)..( 11): Result.004 file - promoters50/1021242
aaataattttt

SEQ ID NO: 158550 - DNA, 11 bp, Unknown
  misc_feature (1)..( 11): Result.004 file - promoters50/1021242
aaactgtgaaa

SEQ ID NO: 158551 - DNA, 11 bp, Unknown
  misc_feature (1)..( 11): Result.004 file - promoters50/1021323
ttactgtggtt

SEQ ID NO: 158552 - DNA, 11 bp, Unknown
  misc_feature (1)..( 11): Result.004 file - promoters50/1021323
cagaaacctaa

SEQ ID NO: 158553 - DNA, 11 bp, Unknown
  misc_feature (1)..( 11): Result.004 file - promoters50/1021323
ttgaaacgtaa

SEQ ID NO: 158554 - DNA, 11 bp, Unknown
  misc_feature (1)..( 11): Result.004 file - promoters50/1021323
acgaaaaaagt

SEQ ID NO: 158555 - DNA, 11 bp, Unknown
  misc_feature (1)..( 11): Result.004 file - promoters50/1021323
ttgaaaaattt

SEQ ID NO: 158556 - DNA, 11 bp, Unknown
  misc_feature (1)..( 11): Result.004 file - promoters50/1021323
aagaaaaagac

SEQ ID NO: 158557 - DNA, 11 bp, Unknown
  misc_feature (1)..( 11): Result.004 file - promoters50/1021323
gagaaaaaaag

SEQ ID NO: 158558 - DNA, 11 bp, Unknown
  misc_feature (1)..( 11): Result.004 file - promoters50/1021323
cttaaacaaga

SEQ ID NO: 158559 - DNA, 11 bp, Unknown
  misc_feature (1)..( 11): Result.004 file - promoters50/1021323
cgtaaacagta

SEQ ID NO: 158560 - DNA, 11 bp, Unknown
  misc_feature (1)..( 11): Result.004 file - promoters50/1021323
acgaaaaaagt

SEQ ID NO: 158561 - DNA, 11 bp, Unknown
  misc_feature (1)..( 11): Result.004 file - promoters50/1021323
gaaaaaaagtt

SEQ ID NO: 158562 - DNA, 11 bp, Unknown
  misc_feature (1)..( 11): Result.004 file - promoters50/1021323
ttgaaaaattt

SEQ ID NO: 158563 - DNA, 11 bp, Unknown
  misc_feature (1)..( 11): Result.004 file - promoters50/1021323
aagaaaaagac

SEQ ID NO: 158564 - DNA, 11 bp, Unknown
  misc_feature (1)..( 11): Result.004 file - promoters50/1021323
atcattttgtt

SEQ ID NO: 158565 - DNA, 11 bp, Unknown
  misc_feature (1)..( 11): Result.004 file - promoters50/1021323
ttgatttggtt

SEQ ID NO: 158566 - DNA, 11 bp, Unknown
  misc_feature (1)..( 11): Result.004 file - promoters50/1021323
aaccttttgtt

SEQ ID NO: 158567 - DNA, 11 bp, Unknown
  misc_feature (1)..( 11): Result.004 file - promoters50/1021323
atcatcttggt

SEQ ID NO: 158568 - DNA, 11 bp, Unknown
  misc_feature (1)..( 11): Result.004 file - promoters50/1021323
tgaattttgac

SEQ ID NO: 158569 - DNA, 11 bp, Unknown
  misc_feature (1)..( 11): Result.004 file - promoters50/1021323
gtgacttggag

SEQ ID NO: 158570 - DNA, 11 bp, Unknown
  misc_feature (1)..( 11): Result.004 file - promoters50/1021334
atgacgtggaa

SEQ ID NO: 158571 - DNA, 9 bp, Unknown
  misc_feature (1)..( 9): Result.004 file - promoters50/1021334
gtagataag

SEQ ID NO: 158572 - DNA, 9 bp, Unknown
  misc_feature (1)..( 9): Result.004 file - promoters50/1021334
atagaaaag

SEQ ID NO: 158573 - DNA, 9 bp, Unknown
  misc_feature (1)..( 9): Result.004 file - promoters50/1021334
atagtaaat

SEQ ID NO: 158574 - DNA, 11 bp, Unknown
  misc_feature (1)..( 11): Result.004 file - promoters50/1021334
tattttcctaa

SEQ ID NO: 158575 - DNA, 11 bp, Unknown
  misc_feature (1)..( 11): Result.004 file - promoters50/1021334
tattttgtgtt

SEQ ID NO: 158576 - DNA, 11 bp, Unknown
  misc_feature (1)..( 11): Result.004 file - promoters50/1021334
tatttttgatc

SEQ ID NO: 158577 - DNA, 11 bp, Unknown
  misc_feature (1)..( 11): Result.004 file - promoters50/1021334
aattttttgtt

SEQ ID NO: 158578 - DNA, 7 bp, Unknown
  misc_feature (1)..( 7): Result.004 file - promoters50/1021334
aaaatga

SEQ ID NO: 158579 - DNA, 7 bp, Unknown
  misc_feature (1)..( 7): Result.004 file - promoters50/1021334
aaaatgg

SEQ ID NO: 158580 - DNA, 7 bp, Unknown
  misc_feature (1)..( 7): Result.004 file - promoters50/1021334
aaagtga

SEQ ID NO: 158581 - DNA, 8 bp, Unknown
  misc_feature (1)..( 8): Result.004 file - promoters50/1021334
cagaaatg

SEQ ID NO: 158582 - DNA, 8 bp, Unknown
  misc_feature (1)..( 8): Result.004 file - promoters50/1021334
aagaaatg

SEQ ID NO: 158583 - DNA, 8 bp, Unknown
  misc_feature (1)..( 8): Result.004 file - promoters50/1021334
aagaaagt

SEQ ID NO: 158584 - DNA, 7 bp, Unknown
  misc_feature (1)..( 7): Result.004 file - promoters50/1021334
tgttgac

SEQ ID NO: 158585 - DNA, 7 bp, Unknown
  misc_feature (1)..( 7): Result.004 file - promoters50/1021334
tgtggac

SEQ ID NO: 158586 - DNA, 7 bp, Unknown
  misc_feature (1)..( 7): Result.004 file - promoters50/1021334
tgtggaa

SEQ ID NO: 158587 - DNA, 11 bp, Unknown
  misc_feature (1)..( 11): Result.004 file - promoters50/1021334
aattttgctaa

SEQ ID NO: 158588 - DNA, 11 bp, Unknown
  misc_feature (1)..( 11): Result.004 file - promoters50/1021334
aattttttgtt

SEQ ID NO: 158589 - DNA, 11 bp, Unknown
  misc_feature (1)..( 11): Result.004 file - promoters50/1021334
tattttgtgtt

SEQ ID NO: 158590 - DNA, 11 bp, Unknown
  misc_feature (1)..( 11): Result.004 file - promoters50/1021419
tcatttgtggc

SEQ ID NO: 158591 - DNA, 9 bp, Unknown
  misc_feature (1)..( 9): Result.004 file - promoters50/1021419
ggtaaatgc

SEQ ID NO: 158592 - DNA, 9 bp, Unknown
  misc_feature (1)..( 9): Result.004 file - promoters50/1021419
attaaatga

SEQ ID NO: 158593 - DNA, 9 bp, Unknown
  misc_feature (1)..( 9): Result.004 file - promoters50/1021419
tgtaaatct

SEQ ID NO: 158594 - DNA, 9 bp, Unknown
  misc_feature (1)..( 9): Result.004 file - promoters50/1021419
tttaaattt

SEQ ID NO: 158595 - DNA, 9 bp, Unknown
  misc_feature (1)..( 9): Result.004 file - promoters50/1021419
atttaatcc

SEQ ID NO: 158596 - DNA, 9 bp, Unknown
  misc_feature (1)..( 9): Result.004 file - promoters50/1021419
gggaaatga

SEQ ID NO: 158597 - DNA, 9 bp, Unknown
  misc_feature (1)..( 9): Result.004 file - promoters50/1021438
attcaattc

SEQ ID NO: 158598 - DNA, 12 bp, Unknown
  misc_feature (1)..( 12): Result.004 file - promoters50/1021438
tggttggttgca

SEQ ID NO: 158599 - DNA, 12 bp, Unknown
  misc_feature (1)..( 12): Result.004 file - promoters50/1021438
gttttgtttgtg

SEQ ID NO: 158600 - DNA, 12 bp, Unknown
  misc_feature (1)..( 12): Result.004 file - promoters50/1021438
ttagtggctgct

SEQ ID NO: 158601 - DNA, 12 bp, Unknown
  misc_feature (1)..( 12): Result.004 file - promoters50/1021438
attttgttttct

SEQ ID NO: 158602 - DNA, 12 bp, Unknown
  misc_feature (1)..( 12): Result.004 file - promoters50/1021438
tttctgtttggt

SEQ ID NO: 158603 - DNA, 12 bp, Unknown
  misc_feature (1)..( 12): Result.004 file - promoters50/1021438
tttatgttcggt

SEQ ID NO: 158604 - DNA, 12 bp, Unknown
  misc_feature (1)..( 12): Result.004 file - promoters50/1021445
ggtatgtttgat

SEQ ID NO: 158605 - DNA, 14 bp, Unknown
  misc_feature (1)..( 14): Result.004 file - promoters50/1021445
agtattaaaaatgc

SEQ ID NO: 158606 - DNA, 14 bp, Unknown
  misc_feature (1)..( 14): Result.004 file - promoters50/1021445
accattaaagctcc

SEQ ID NO: 158607 - DNA, 14 bp, Unknown
  misc_feature (1)..( 14): Result.004 file - promoters50/1021445
agttttaaagtttg

SEQ ID NO: 158608 - DNA, 14 bp, Unknown
  misc_feature (1)..( 14): Result.004 file - promoters50/1021445
tttattgaagacta

SEQ ID NO: 158609 - DNA, 14 bp, Unknown
  misc_feature (1)..( 14): Result.004 file - promoters50/1021445
ctgtttgaaatttt

SEQ ID NO: 158610 - DNA, 14 bp, Unknown
  misc_feature (1)..( 14): Result.004 file - promoters50/1021445
cgttttatatttcg

SEQ ID NO: 158611 - DNA, 11 bp, Unknown
  misc_feature (1)..( 11): Result.004 file - promoters50/1021445
ttttaaaaagg

SEQ ID NO: 158612 - DNA, 11 bp, Unknown
  misc_feature (1)..( 11): Result.004 file - promoters50/1021445
aattaaaaaaa

SEQ ID NO: 158613 - DNA, 11 bp, Unknown
  misc_feature (1)..( 11): Result.004 file - promoters50/1021445
cactaaaaagg

SEQ ID NO: 158614 - DNA, 11 bp, Unknown
  misc_feature (1)..( 11): Result.004 file - promoters50/1021445
ctcaaaaaagc

SEQ ID NO: 158615 - DNA, 11 bp, Unknown
  misc_feature (1)..( 11): Result.004 file - promoters50/1021445
aatcaaacttg

SEQ ID NO: 158616 - DNA, 12 bp, Unknown
  misc_feature (1)..( 12): Result.004 file - promoters50/1021445
ttataataaatt

SEQ ID NO: 158617 - DNA, 12 bp, Unknown
  misc_feature (1)..( 12): Result.004 file - promoters50/1021445
acataatgaatg

SEQ ID NO: 158618 - DNA, 11 bp, Unknown
  misc_feature (1)..( 11): Result.004 file - promoters50/1021445
aaaagaaattg

SEQ ID NO: 158619 - DNA, 11 bp, Unknown
  misc_feature (1)..( 11): Result.004 file - promoters50/1021445
aaaaaaaaatc

SEQ ID NO: 158620 - DNA, 11 bp, Unknown
  misc_feature (1)..( 11): Result.004 file - promoters50/1021445
agcagaaattg

SEQ ID NO: 158621 - DNA, 11 bp, Unknown
  misc_feature (1)..( 11): Result.004 file - promoters50/1021445
ataataaatta

SEQ ID NO: 158622 - DNA, 11 bp, Unknown
  misc_feature (1)..( 11): Result.004 file - promoters50/1021445
ataatgaatgg

SEQ ID NO: 158623 - DNA, 11 bp, Unknown
  misc_feature (1)..( 11): Result.004 file - promoters50/1021445
tgtagaaatga

SEQ ID NO: 158624 - DNA, 9 bp, Unknown
  misc_feature (1)..( 9): Result.004 file - promoters50/1021445
aaaacaaat

SEQ ID NO: 158625 - DNA, 9 bp, Unknown
  misc_feature (1)..( 9): Result.004 file - promoters50/1021445
aaaactaat

SEQ ID NO: 158626 - DNA, 9 bp, Unknown
  misc_feature (1)..( 9): Result.004 file - promoters50/1021445
aaaaaaatt

SEQ ID NO: 158627 - DNA, 9 bp, Unknown
  misc_feature (1)..( 9): Result.004 file - promoters50/1021445
ataacaaac

SEQ ID NO: 158628 - DNA, 9 bp, Unknown
  misc_feature (1)..( 9): Result.004 file - promoters50/1021445
gaaacaaca

SEQ ID NO: 158629 - DNA, 9 bp, Unknown
  misc_feature (1)..( 9): Result.004 file - promoters50/1021445
gtaataaac

SEQ ID NO: 158630 - DNA, 12 bp, Unknown
  misc_feature (1)..( 12): Result.004 file - promoters50/1021445
ttatcaaaacgc

SEQ ID NO: 158631 - DNA, 12 bp, Unknown
  misc_feature (1)..( 12): Result.004 file - promoters50/1021445
atataaaactct

SEQ ID NO: 158632 - DNA, 12 bp, Unknown
  misc_feature (1)..( 12): Result.004 file - promoters50/1021445
gtataaaaagcg

SEQ ID NO: 158633 - DNA, 12 bp, Unknown
  misc_feature (1)..( 12): Result.004 file - promoters50/1021445
ggataaaagctt

SEQ ID NO: 158634 - DNA, 12 bp, Unknown
  misc_feature (1)..( 12): Result.004 file - promoters50/1021445
ctataaaggctt

SEQ ID NO: 158635 - DNA, 12 bp, Unknown
  misc_feature (1)..( 12): Result.004 file - promoters50/1021445
ttataaacgctg

SEQ ID NO: 158636 - DNA, 12 bp, Unknown
  misc_feature (1)..( 12): Result.004 file - promoters50/1021445
atataaattgtt

SEQ ID NO: 158637 - DNA, 13 bp, Unknown
  misc_feature (1)..( 13): Result.004 file - promoters50/1021445
cagagaaatggtt

SEQ ID NO: 158638 - DNA, 13 bp, Unknown
  misc_feature (1)..( 13): Result.004 file - promoters50/1021445
cactaaaaaggtt

SEQ ID NO: 158639 - DNA, 13 bp, Unknown
  misc_feature (1)..( 13): Result.004 file - promoters50/1021445
actacaaaagtta

SEQ ID NO: 158640 - DNA, 13 bp, Unknown
  misc_feature (1)..( 13): Result.004 file - promoters50/1021445
aaaacaaaaagaa

SEQ ID NO: 158641 - DNA, 13 bp, Unknown
  misc_feature (1)..( 13): Result.004 file - promoters50/1021445
tcagtaaaagttt

SEQ ID NO: 158642 - DNA, 13 bp, Unknown
  misc_feature (1)..( 13): Result.004 file - promoters50/1021549
ccctcaaaaaagc

SEQ ID NO: 158643 - DNA, 10 bp, Unknown
  misc_feature (1)..( 10): Result.004 file - promoters50/1021549
atatacaatt

SEQ ID NO: 158644 - DNA, 10 bp, Unknown
  misc_feature (1)..( 10): Result.004 file - promoters50/1021549
ttattcaaac

SEQ ID NO: 158645 - DNA, 10 bp, Unknown
  misc_feature (1)..( 10): Result.004 file - promoters50/1021549
gtataattct

SEQ ID NO: 158646 - DNA, 10 bp, Unknown
  misc_feature (1)..( 10): Result.004 file - promoters50/1021549
gtattcattc

SEQ ID NO: 158647 - DNA, 10 bp, Unknown
  misc_feature (1)..( 10): Result.004 file - promoters50/1021549
gaattgaaac

SEQ ID NO: 158648 - DNA, 10 bp, Unknown
  misc_feature (1)..( 10): Result.004 file - promoters50/1021549
tcattgaaag

SEQ ID NO: 158649 - DNA, 12 bp, Unknown
  misc_feature (1)..( 12): Result.004 file - promoters50/1021549
aaagcccatttt

SEQ ID NO: 158650 - DNA, 12 bp, Unknown
  misc_feature (1)..( 12): Result.004 file - promoters50/1021549
aaagcccataga

SEQ ID NO: 158651 - DNA, 12 bp, Unknown
  misc_feature (1)..( 12): Result.004 file - promoters50/1021549
aaagcccaatag

SEQ ID NO: 158652 - DNA, 12 bp, Unknown
  misc_feature (1)..( 12): Result.004 file - promoters50/1021549
ccagcccattca

SEQ ID NO: 158653 - DNA, 12 bp, Unknown
  misc_feature (1)..( 12): Result.004 file - promoters50/1021549
atggcccaatag

SEQ ID NO: 158654 - DNA, 12 bp, Unknown
  misc_feature (1)..( 12): Result.004 file - promoters50/1021645
agggcccaacat

SEQ ID NO: 158655 - DNA, 8 bp, Unknown
  misc_feature (1)..( 8): Result.004 file - promoters50/1021645
agtccatg

SEQ ID NO: 158656 - DNA, 8 bp, Unknown
  misc_feature (1)..( 8): Result.004 file - promoters50/1021645
cttccatg

SEQ ID NO: 158657 - DNA, 8 bp, Unknown
  misc_feature (1)..( 8): Result.004 file - promoters50/1021645
ctttcatg

SEQ ID NO: 158658 - DNA, 9 bp, Unknown
  misc_feature (1)..( 9): Result.004 file - promoters50/1021645
tttgcaatt

SEQ ID NO: 158659 - DNA, 9 bp, Unknown
  misc_feature (1)..( 9): Result.004 file - promoters50/1021645
tttgaaatt

SEQ ID NO: 158660 - DNA, 9 bp, Unknown
  misc_feature (1)..( 9): Result.004 file - promoters50/1021719
agtgccatt

SEQ ID NO: 158661 - DNA, 7 bp, Unknown
  misc_feature (1)..( 7): Result.004 file - promoters50/1021719
attaatt

SEQ ID NO: 158662 - DNA, 7 bp, Unknown
  misc_feature (1)..( 7): Result.004 file - promoters50/1021719
atttatt

SEQ ID NO: 158663 - DNA, 7 bp, Unknown
  misc_feature (1)..( 7): Result.004 file - promoters50/1021772
atttatc

SEQ ID NO: 158664 - DNA, 9 bp, Unknown
  misc_feature (1)..( 9): Result.004 file - promoters50/1021772
aaatctata

SEQ ID NO: 158665 - DNA, 9 bp, Unknown
  misc_feature (1)..( 9): Result.004 file - promoters50/1021772
aaatctaac

SEQ ID NO: 158666 - DNA, 9 bp, Unknown
  misc_feature (1)..( 9): Result.004 file - promoters50/1021772
taatctata

SEQ ID NO: 158667 - DNA, 10 bp, Unknown
  misc_feature (1)..( 10): Result.004 file - promoters50/1021772
tatacaaaaa

SEQ ID NO: 158668 - DNA, 10 bp, Unknown
  misc_feature (1)..( 10): Result.004 file - promoters50/1021772
tatataaaaa

SEQ ID NO: 158669 - DNA, 10 bp, Unknown
  misc_feature (1)..( 10): Result.004 file - promoters50/1021772
attatgaaaa

SEQ ID NO: 158670 - DNA, 10 bp, Unknown
  misc_feature (1)..( 10): Result.004 file - promoters50/1021772
caataacttg

SEQ ID NO: 158671 - DNA, 10 bp, Unknown
  misc_feature (1)..( 10): Result.004 file - promoters50/1021772
caataaaagt

SEQ ID NO: 158672 - DNA, 10 bp, Unknown
  misc_feature (1)..( 10): Result.004 file - promoters50/1021833
aaataaaagt

SEQ ID NO: 158673 - DNA, 14 bp, Unknown
  misc_feature (1)..( 14): Result.004 file - promoters50/1021833
tgatgtttgattaa

SEQ ID NO: 158674 - DNA, 14 bp, Unknown
  misc_feature (1)..( 14): Result.004 file - promoters50/1021833
atatgcttgcttaa

SEQ ID NO: 158675 - DNA, 14 bp, Unknown
  misc_feature (1)..( 14): Result.004 file - promoters50/1021833
cttctttggattaa

SEQ ID NO: 158676 - DNA, 14 bp, Unknown
  misc_feature (1)..( 14): Result.004 file - promoters50/1021833
actggttttattat

SEQ ID NO: 158677 - DNA, 14 bp, Unknown
  misc_feature (1)..( 14): Result.004 file - promoters50/1021833
ggatctttagatcc

SEQ ID NO: 158678 - DNA, 14 bp, Unknown
  misc_feature (1)..( 14): Result.004 file - promoters50/1021833
agattttttttcgg

SEQ ID NO: 158679 - DNA, 14 bp, Unknown
  misc_feature (1)..( 14): Result.004 file - promoters50/1021833
ggagcttgggcaaa

SEQ ID NO: 158680 - DNA, 10 bp, Unknown
  misc_feature (1)..( 10): Result.004 file - promoters50/1021833
cttttattat

SEQ ID NO: 158681 - DNA, 10 bp, Unknown
  misc_feature (1)..( 10): Result.004 file - promoters50/1021833
gtttgattaa

SEQ ID NO: 158682 - DNA, 10 bp, Unknown
  misc_feature (1)..( 10): Result.004 file - promoters50/1021833
tctttcttat

SEQ ID NO: 158683 - DNA, 10 bp, Unknown
  misc_feature (1)..( 10): Result.004 file - promoters50/1021833
tttacattta

SEQ ID NO: 158684 - DNA, 10 bp, Unknown
  misc_feature (1)..( 10): Result.004 file - promoters50/1021833
gtttgatttg

SEQ ID NO: 158685 - DNA, 10 bp, Unknown
  misc_feature (1)..( 10): Result.004 file - promoters50/1021833
gtttgacata

SEQ ID NO: 158686 - DNA, 10 bp, Unknown
  misc_feature (1)..( 10): Result.004 file - promoters50/1021840
gttttctttg

SEQ ID NO: 158687 - DNA, 10 bp, Unknown
  misc_feature (1)..( 10): Result.004 file - promoters50/1021840
ccatattaac

SEQ ID NO: 158688 - DNA, 10 bp, Unknown
  misc_feature (1)..( 10): Result.004 file - promoters50/1021840
aaataataaa

SEQ ID NO: 158689 - DNA, 10 bp, Unknown
  misc_feature (1)..( 10): Result.004 file - promoters50/1021840
aaatcatatg

SEQ ID NO: 158690 - DNA, 10 bp, Unknown
  misc_feature (1)..( 10): Result.004 file - promoters50/1021840
acttaacaaa

SEQ ID NO: 158691 - DNA, 10 bp, Unknown
  misc_feature (1)..( 10): Result.004 file - promoters50/1021840
gaagaacaaa

SEQ ID NO: 158692 - DNA, 9 bp, Unknown
  misc_feature (1)..( 9): Result.004 file - promoters50/1021840
ctttttttt

SEQ ID NO: 158693 - DNA, 9 bp, Unknown
  misc_feature (1)..( 9): Result.004 file - promoters50/1021840
tatttattt

SEQ ID NO: 158694 - DNA, 9 bp, Unknown
  misc_feature (1)..( 9): Result.004 file - promoters50/1021840
tcttcttta

SEQ ID NO: 158695 - DNA, 9 bp, Unknown
  misc_feature (1)..( 9): Result.004 file - promoters50/1021840
tattgattc

SEQ ID NO: 158696 - DNA, 13 bp, Unknown
  misc_feature (1)..( 13): Result.004 file - promoters50/1021840
tcaaaaattatat

SEQ ID NO: 158697 - DNA, 13 bp, Unknown
  misc_feature (1)..( 13): Result.004 file - promoters50/1021840
tcaaaaatcatat

SEQ ID NO: 158698 - DNA, 13 bp, Unknown
  misc_feature (1)..( 13): Result.004 file - promoters50/1021840
acaaaaaatctaa

SEQ ID NO: 158699 - DNA, 13 bp, Unknown
  misc_feature (1)..( 13): Result.004 file - promoters50/1021862
aatgaaataataa

SEQ ID NO: 158700 - DNA, 12 bp, Unknown
  misc_feature (1)..( 12): Result.004 file - promoters50/1021862
tgatgtaatcgt

SEQ ID NO: 158701 - DNA, 12 bp, Unknown
  misc_feature (1)..( 12): Result.004 file - promoters50/1021862
ttttgtaattta

SEQ ID NO: 158702 - DNA, 12 bp, Unknown
  misc_feature (1)..( 12): Result.004 file - promoters50/1021862
tcttgtaattac

SEQ ID NO: 158703 - DNA, 12 bp, Unknown
  misc_feature (1)..( 12): Result.004 file - promoters50/1021862
aacagtagtttc

SEQ ID NO: 158704 - DNA, 12 bp, Unknown
  misc_feature (1)..( 12): Result.004 file - promoters50/1021862
ttttataaagta

SEQ ID NO: 158705 - DNA, 12 bp, Unknown
  misc_feature (1)..( 12): Result.004 file - promoters50/1021862
ttgttgagtttc

SEQ ID NO: 158706 - DNA, 14 bp, Unknown
  misc_feature (1)..( 14): Result.004 file - promoters50/1021862
catataaacaacaa

SEQ ID NO: 158707 - DNA, 14 bp, Unknown
  misc_feature (1)..( 14): Result.004 file - promoters50/1021862
catttaagttttaa

SEQ ID NO: 158708 - DNA, 14 bp, Unknown
  misc_feature (1)..( 14): Result.004 file - promoters50/1021862
tatttgagttatgt

SEQ ID NO: 158709 - DNA, 14 bp, Unknown
  misc_feature (1)..( 14): Result.004 file - promoters50/1021862
ggtttaaattttaa

SEQ ID NO: 158710 - DNA, 14 bp, Unknown
  misc_feature (1)..( 14): Result.004 file - promoters50/1021862
atggaaagtttgca

SEQ ID NO: 158711 - DNA, 14 bp, Unknown
  misc_feature (1)..( 14): Result.004 file - promoters50/1021862
tacacaaatttgtt

SEQ ID NO: 158712 - DNA, 10 bp, Unknown
  misc_feature (1)..( 10): Result.004 file - promoters50/1021862
ataatattca

SEQ ID NO: 158713 - DNA, 10 bp, Unknown
  misc_feature (1)..( 10): Result.004 file - promoters50/1021862
gaaattttca

SEQ ID NO: 158714 - DNA, 10 bp, Unknown
  misc_feature (1)..( 10): Result.004 file - promoters50/1021862
ataaaattag

SEQ ID NO: 158715 - DNA, 10 bp, Unknown
  misc_feature (1)..( 10): Result.004 file - promoters50/1021862
ttaaatttaa

SEQ ID NO: 158716 - DNA, 10 bp, Unknown
  misc_feature (1)..( 10): Result.004 file - promoters50/1021862
ttaatttttt

SEQ ID NO: 158717 - DNA, 10 bp, Unknown
  misc_feature (1)..( 10): Result.004 file - promoters50/1021862
gcaatttaga

SEQ ID NO: 158718 - DNA, 9 bp, Unknown
  misc_feature (1)..( 9): Result.004 file - promoters50/1021862
caataaaat

SEQ ID NO: 158719 - DNA, 9 bp, Unknown
  misc_feature (1)..( 9): Result.004 file - promoters50/1021862
aaataaatc

SEQ ID NO: 158720 - DNA, 9 bp, Unknown
  misc_feature (1)..( 9): Result.004 file - promoters50/1021862
aaataaact

SEQ ID NO: 158721 - DNA, 9 bp, Unknown
  misc_feature (1)..( 9): Result.004 file - promoters50/1021862
taataaata

SEQ ID NO: 158722 - DNA, 10 bp, Unknown
  misc_feature (1)..( 10): Result.004 file - promoters50/1021862
aaagtaattt

SEQ ID NO: 158723 - DNA, 10 bp, Unknown
  misc_feature (1)..( 10): Result.004 file - promoters50/1021862
acagtagttt

SEQ ID NO: 158724 - DNA, 9 bp, Unknown
  misc_feature (1)..( 9): Result.004 file - promoters50/1021862
ataaaatga

SEQ ID NO: 158725 - DNA, 9 bp, Unknown
  misc_feature (1)..( 9): Result.004 file - promoters50/1021862
gtaaaattt

SEQ ID NO: 158726 - DNA, 9 bp, Unknown
  misc_feature (1)..( 9): Result.004 file - promoters50/1021862
ttaaaatat

SEQ ID NO: 158727 - DNA, 9 bp, Unknown
  misc_feature (1)..( 9): Result.004 file - promoters50/1021862
ttaaaatcg

SEQ ID NO: 158728 - DNA, 9 bp, Unknown
  misc_feature (1)..( 9): Result.004 file - promoters50/1021862
ggaaacttt

SEQ ID NO: 158729 - DNA, 9 bp, Unknown
  misc_feature (1)..( 9): Result.004 file - promoters50/1021862
gtataatgg

SEQ ID NO: 158730 - DNA, 16 bp, Unknown
  misc_feature (1)..( 16): Result.004 file - promoters50/1021862
acaaaataaaaagatt

SEQ ID NO: 158731 - DNA, 16 bp, Unknown
  misc_feature (1)..( 16): Result.004 file - promoters50/1021862
tcaaattaagtacaca

SEQ ID NO: 158732 - DNA, 16 bp, Unknown
  misc_feature (1)..( 16): Result.004 file - promoters50/1021862
ggaaaaaaaaaaaaaa

SEQ ID NO: 158733 - DNA, 16 bp, Unknown
  misc_feature (1)..( 16): Result.004 file - promoters50/1021862
acaaatttgagtgtta

SEQ ID NO: 158734 - DNA, 16 bp, Unknown
  misc_feature (1)..( 16): Result.004 file - promoters50/1021862
tcaaatgaccaaataa

SEQ ID NO: 158735 - DNA, 16 bp, Unknown
  misc_feature (1)..( 16): Result.004 file - promoters50/1021870
gagaagaaagacgaag

SEQ ID NO: 158736 - DNA, 13 bp, Unknown
  misc_feature (1)..( 13): Result.004 file - promoters50/1021870
gatcaaaatctgg

SEQ ID NO: 158737 - DNA, 13 bp, Unknown
  misc_feature (1)..( 13): Result.004 file - promoters50/1021870
ctaaaaaatcgta

SEQ ID NO: 158738 - DNA, 13 bp, Unknown
  misc_feature (1)..( 13): Result.004 file - promoters50/1021870
gatttaaatttgg

SEQ ID NO: 158739 - DNA, 13 bp, Unknown
  misc_feature (1)..( 13): Result.004 file - promoters50/1021870
aaacaaaattgtt

SEQ ID NO: 158740 - DNA, 13 bp, Unknown
  misc_feature (1)..( 13): Result.004 file - promoters50/1021870
taacaaataatta

SEQ ID NO: 158741 - DNA, 13 bp, Unknown
  misc_feature (1)..( 13): Result.004 file - promoters50/1021870
aacctaattttaa

SEQ ID NO: 158742 - DNA, 13 bp, Unknown
  misc_feature (1)..( 13): Result.004 file - promoters50/1021870
aatcaacatatac

SEQ ID NO: 158743 - DNA, 9 bp, Unknown
  misc_feature (1)..( 9): Result.004 file - promoters50/1021870
ccataattt

SEQ ID NO: 158744 - DNA, 9 bp, Unknown
  misc_feature (1)..( 9): Result.004 file - promoters50/1021870
ccaaaatca

SEQ ID NO: 158745 - DNA, 9 bp, Unknown
  misc_feature (1)..( 9): Result.004 file - promoters50/1021870
aaataatta

SEQ ID NO: 158746 - DNA, 9 bp, Unknown
  misc_feature (1)..( 9): Result.004 file - promoters50/1021870
acatcattt

SEQ ID NO: 158747 - DNA, 9 bp, Unknown
  misc_feature (1)..( 9): Result.004 file - promoters50/1021870
aaataatta

SEQ ID NO: 158748 - DNA, 9 bp, Unknown
  misc_feature (1)..( 9): Result.004 file - promoters50/1021870
acttaatta

SEQ ID NO: 158749 - DNA, 9 bp, Unknown
  misc_feature (1)..( 9): Result.004 file - promoters50/1021870
tgatcattt

SEQ ID NO: 158750 - DNA, 13 bp, Unknown
  misc_feature (1)..( 13): Result.004 file - promoters50/1021870
gcaattttttagg

SEQ ID NO: 158751 - DNA, 13 bp, Unknown
  misc_feature (1)..( 13): Result.004 file - promoters50/1021870
tgtttttattatt

SEQ ID NO: 158752 - DNA, 13 bp, Unknown
  misc_feature (1)..( 13): Result.004 file - promoters50/1021870
ctattttattaaa

SEQ ID NO: 158753 - DNA, 13 bp, Unknown
  misc_feature (1)..( 13): Result.004 file - promoters50/1021870
gaaatttaatatt

SEQ ID NO: 158754 - DNA, 13 bp, Unknown
  misc_feature (1)..( 13): Result.004 file - promoters50/1021870
aatcttccacttt

SEQ ID NO: 158755 - DNA, 13 bp, Unknown
  misc_feature (1)..( 13): Result.004 file - promoters50/1021870
cgcatttaatcaa

SEQ ID NO: 158756 - DNA, 10 bp, Unknown
  misc_feature (1)..( 10): Result.004 file - promoters50/1021870
attacatata

SEQ ID NO: 158757 - DNA, 10 bp, Unknown
  misc_feature (1)..( 10): Result.004 file - promoters50/1021870
tcaacatata

SEQ ID NO: 158758 - DNA, 10 bp, Unknown
  misc_feature (1)..( 10): Result.004 file - promoters50/1021870
tttaaataaa

SEQ ID NO: 158759 - DNA, 10 bp, Unknown
  misc_feature (1)..( 10): Result.004 file - promoters50/1021870
gtaacaaata

SEQ ID NO: 158760 - DNA, 10 bp, Unknown
  misc_feature (1)..( 10): Result.004 file - promoters50/1021870
ctaaaaaatc

SEQ ID NO: 158761 - DNA, 10 bp, Unknown
  misc_feature (1)..( 10): Result.004 file - promoters50/1021870
tttaaatttg

SEQ ID NO: 158762 - DNA, 10 bp, Unknown
  misc_feature (1)..( 10): Result.004 file - promoters50/1021870
ttttaatcgg

SEQ ID NO: 158763 - DNA, 12 bp, Unknown
  misc_feature (1)..( 12): Result.004 file - promoters50/1021870
tttaaacaattt

SEQ ID NO: 158764 - DNA, 12 bp, Unknown
  misc_feature (1)..( 12): Result.004 file - promoters50/1021870
aacaaacaaaat

SEQ ID NO: 158765 - DNA, 12 bp, Unknown
  misc_feature (1)..( 12): Result.004 file - promoters50/1021870
tttaatcaaata

SEQ ID NO: 158766 - DNA, 12 bp, Unknown
  misc_feature (1)..( 12): Result.004 file - promoters50/1021870
gacaaacatttt

SEQ ID NO: 158767 - DNA, 12 bp, Unknown
  misc_feature (1)..( 12): Result.004 file - promoters50/1021870
gtcaagcaagcg

SEQ ID NO: 158768 - DNA, 12 bp, Unknown
  misc_feature (1)..( 12): Result.004 file - promoters50/1021870
cttcatcaaacc

SEQ ID NO: 158769 - DNA, 9 bp, Unknown
  misc_feature (1)..( 9): Result.004 file - promoters50/1021870
gatttaaat

SEQ ID NO: 158770 - DNA, 9 bp, Unknown
  misc_feature (1)..( 9): Result.004 file - promoters50/1021870
aattttaat

SEQ ID NO: 158771 - DNA, 9 bp, Unknown
  misc_feature (1)..( 9): Result.004 file - promoters50/1021870
aattcaaac

SEQ ID NO: 158772 - DNA, 9 bp, Unknown
  misc_feature (1)..( 9): Result.004 file - promoters50/1021870
tgtttaaat

SEQ ID NO: 158773 - DNA, 9 bp, Unknown
  misc_feature (1)..( 9): Result.004 file - promoters50/1021870
aattcaaag

SEQ ID NO: 158774 - DNA, 9 bp, Unknown
  misc_feature (1)..( 9): Result.004 file - promoters50/1021935
tacttaatc

SEQ ID NO: 158775 - DNA, 6 bp, Unknown
  misc_feature (1)..( 6): Result.004 file - promoters50/1021935
ttttgt

SEQ ID NO: 158776 - DNA, 6 bp, Unknown
  misc_feature (1)..( 6): Result.004 file - promoters50/1021935
ttttgt

SEQ ID NO: 158777 - DNA, 6 bp, Unknown
  misc_feature (1)..( 6): Result.004 file - promoters50/1021935
ttttgt

SEQ ID NO: 158778 - DNA, 9 bp, Unknown
  misc_feature (1)..( 9): Result.004 file - promoters50/1021935
gtgttcaga

SEQ ID NO: 158779 - DNA, 9 bp, Unknown
  misc_feature (1)..( 9): Result.004 file - promoters50/1021935
gtggtcacc

SEQ ID NO: 158780 - DNA, 9 bp, Unknown
  misc_feature (1)..( 9): Result.004 file - promoters50/1021968
atgtttaga

SEQ ID NO: 158781 - DNA, 13 bp, Unknown
  misc_feature (1)..( 13): Result.004 file - promoters50/1021968
ccaataatttaca

SEQ ID NO: 158782 - DNA, 13 bp, Unknown
  misc_feature (1)..( 13): Result.004 file - promoters50/1021968
tcaacaatgtaca

SEQ ID NO: 158783 - DNA, 13 bp, Unknown
  misc_feature (1)..( 13): Result.004 file - promoters50/1021968
ttgaaaatttata

SEQ ID NO: 158784 - DNA, 13 bp, Unknown
  misc_feature (1)..( 13): Result.004 file - promoters50/1021968
tgtataattttat

SEQ ID NO: 158785 - DNA, 13 bp, Unknown
  misc_feature (1)..( 13): Result.004 file - promoters50/1021968
taaatcatttttt

SEQ ID NO: 158786 - DNA, 13 bp, Unknown
  misc_feature (1)..( 13): Result.004 file - promoters50/1021968
gtaaaaataagaa

SEQ ID NO: 158787 - DNA, 10 bp, Unknown
  misc_feature (1)..( 10): Result.004 file - promoters50/1021968
cctttttacc

SEQ ID NO: 158788 - DNA, 10 bp, Unknown
  misc_feature (1)..( 10): Result.004 file - promoters50/1021968
ccttattatg

SEQ ID NO: 158789 - DNA, 10 bp, Unknown
  misc_feature (1)..( 10): Result.004 file - promoters50/1021968
tatttttaat

SEQ ID NO: 158790 - DNA, 11 bp, Unknown
  misc_feature (1)..( 11): Result.004 file - promoters50/1021968
aaagttttact

SEQ ID NO: 158791 - DNA, 11 bp, Unknown
  misc_feature (1)..( 11): Result.004 file - promoters50/1021968
agtctttgctt

SEQ ID NO: 158792 - DNA, 11 bp, Unknown
  misc_feature (1)..( 11): Result.004 file - promoters50/1021968
agttgtttata

SEQ ID NO: 158793 - DNA, 11 bp, Unknown
  misc_feature (1)..( 11): Result.004 file - promoters50/1021968
gtatgtttgat

SEQ ID NO: 158794 - DNA, 9 bp, Unknown
  misc_feature (1)..( 9): Result.004 file - promoters50/1021968
ggaaaaaaa

SEQ ID NO: 158795 - DNA, 9 bp, Unknown
  misc_feature (1)..( 9): Result.004 file - promoters50/1021968
agaagaaaa

SEQ ID NO: 158796 - DNA, 9 bp, Unknown
  misc_feature (1)..( 9): Result.004 file - promoters50/1021968
ataaaaaat

SEQ ID NO: 158797 - DNA, 9 bp, Unknown
  misc_feature (1)..( 9): Result.004 file - promoters50/1021968
tcaaaaaaa

SEQ ID NO: 158798 - DNA, 9 bp, Unknown
  misc_feature (1)..( 9): Result.004 file - promoters50/1021968
tcaataaac

SEQ ID NO: 158799 - DNA, 10 bp, Unknown
  misc_feature (1)..( 10): Result.004 file - promoters50/1021968
caaatacaaa

SEQ ID NO: 158800 - DNA, 11 bp, Unknown
  misc_feature (1)..( 11): Result.004 file - promoters50/1021968
ctttttaccag

SEQ ID NO: 158801 - DNA, 11 bp, Unknown
  misc_feature (1)..( 11): Result.004 file - promoters50/1021968
aagtttgccag

SEQ ID NO: 158802 - DNA, 11 bp, Unknown
  misc_feature (1)..( 11): Result.004 file - promoters50/1021968
agttttacttt

SEQ ID NO: 158803 - DNA, 11 bp, Unknown
  misc_feature (1)..( 11): Result.004 file - promoters50/1021968
gtctttgctta

SEQ ID NO: 158804 - DNA, 11 bp, Unknown
  misc_feature (1)..( 11): Result.004 file - promoters50/1021968
ttgtttatata

SEQ ID NO: 158805 - DNA, 11 bp, Unknown
  misc_feature (1)..( 11): Result.004 file - promoters50/1021976
gagttcataat

SEQ ID NO: 158806 - DNA, 9 bp, Unknown
  misc_feature (1)..( 9): Result.004 file - promoters50/1021976
ctagcgaag

SEQ ID NO: 158807 - DNA, 9 bp, Unknown
  misc_feature (1)..( 9): Result.004 file - promoters50/1021976
gtagagaag

SEQ ID NO: 158808 - DNA, 9 bp, Unknown
  misc_feature (1)..( 9): Result.004 file - promoters50/1022005
gtagagaaa

SEQ ID NO: 158809 - DNA, 15 bp, Unknown
  misc_feature (1)..( 15): Result.004 file - promoters50/1022005
tctgcaattaaaact

SEQ ID NO: 158810 - DNA, 15 bp, Unknown
  misc_feature (1)..( 15): Result.004 file - promoters50/1022005
gattcaattagtaat

SEQ ID NO: 158811 - DNA, 15 bp, Unknown
  misc_feature (1)..( 15): Result.004 file - promoters50/1022005
aaatcaaatctttct

SEQ ID NO: 158812 - DNA, 15 bp, Unknown
  misc_feature (1)..( 15): Result.004 file - promoters50/1022005
agatcacatctcact

SEQ ID NO: 158813 - DNA, 15 bp, Unknown
  misc_feature (1)..( 15): Result.004 file - promoters50/1022005
gattaaaatcgttct

SEQ ID NO: 158814 - DNA, 15 bp, Unknown
  misc_feature (1)..( 15): Result.004 file - promoters50/1022005
aaaccaatagaaaac

SEQ ID NO: 158815 - DNA, 11 bp, Unknown
  misc_feature (1)..( 11): Result.004 file - promoters50/1022005
aattaaaactt

SEQ ID NO: 158816 - DNA, 11 bp, Unknown
  misc_feature (1)..( 11): Result.004 file - promoters50/1022005
aaaaaaaactc

SEQ ID NO: 158817 - DNA, 11 bp, Unknown
  misc_feature (1)..( 11): Result.004 file - promoters50/1022005
aatcaaatctt

SEQ ID NO: 158818 - DNA, 11 bp, Unknown
  misc_feature (1)..( 11): Result.004 file - promoters50/1022005
gatcacatctc

SEQ ID NO: 158819 - DNA, 11 bp, Unknown
  misc_feature (1)..( 11): Result.004 file - promoters50/1022005
ggagaaatctc

SEQ ID NO: 158820 - DNA, 11 bp, Unknown
  misc_feature (1)..( 11): Result.004 file - promoters50/1022014
atataaaccaa

SEQ ID NO: 158821 - DNA, 10 bp, Unknown
  misc_feature (1)..( 10): Result.004 file - promoters50/1022014
cttctttatt

SEQ ID NO: 158822 - DNA, 10 bp, Unknown
  misc_feature (1)..( 10): Result.004 file - promoters50/1022014
agtctttatt

SEQ ID NO: 158823 - DNA, 10 bp, Unknown
  misc_feature (1)..( 10): Result.004 file - promoters50/1022014
cttttttatt

SEQ ID NO: 158824 - DNA, 7 bp, Unknown
  misc_feature (1)..( 7): Result.004 file - promoters50/1022014
tttgaaa

SEQ ID NO: 158825 - DNA, 7 bp, Unknown
  misc_feature (1)..( 7): Result.004 file - promoters50/1022014
tttaaaa

SEQ ID NO: 158826 - DNA, 7 bp, Unknown
  misc_feature (1)..( 7): Result.004 file - promoters50/1022014
tttgaat

SEQ ID NO: 158827 - DNA, 8 bp, Unknown
  misc_feature (1)..( 8): Result.004 file - promoters50/1022014
gtcaaaat

SEQ ID NO: 158828 - DNA, 8 bp, Unknown
  misc_feature (1)..( 8): Result.004 file - promoters50/1022014
gtcacaat

SEQ ID NO: 158829 - DNA, 8 bp, Unknown
  misc_feature (1)..( 8): Result.004 file - promoters50/1022059
gtccaaag

SEQ ID NO: 158830 - DNA, 11 bp, Unknown
  misc_feature (1)..( 11): Result.004 file - promoters50/1022059
ggttaggtcat

SEQ ID NO: 158831 - DNA, 11 bp, Unknown
  misc_feature (1)..( 11): Result.004 file - promoters50/1022059
gattaggtcat

SEQ ID NO: 158832 - DNA, 11 bp, Unknown
  misc_feature (1)..( 11): Result.004 file - promoters50/1022088
gatcaggaaag

SEQ ID NO: 158833 - DNA, 9 bp, Unknown
  misc_feature (1)..( 9): Result.004 file - promoters50/1022088
aaaatagtt

SEQ ID NO: 158834 - DNA, 9 bp, Unknown
  misc_feature (1)..( 9): Result.004 file - promoters50/1022088
ctaattgtt

SEQ ID NO: 158835 - DNA, 9 bp, Unknown
  misc_feature (1)..( 9): Result.004 file - promoters50/1022088
ctacttgga

SEQ ID NO: 158836 - DNA, 8 bp, Unknown
  misc_feature (1)..( 8): Result.004 file - promoters50/1022088
caataaag

SEQ ID NO: 158837 - DNA, 8 bp, Unknown
  misc_feature (1)..( 8): Result.004 file - promoters50/1022088
caaaaaag

SEQ ID NO: 158838 - DNA, 8 bp, Unknown
  misc_feature (1)..( 8): Result.004 file - promoters50/1022088
gaaaaaaa

SEQ ID NO: 158839 - DNA, 11 bp, Unknown
  misc_feature (1)..( 11): Result.004 file - promoters50/1022088
ttatgtttttt

SEQ ID NO: 158840 - DNA, 11 bp, Unknown
  misc_feature (1)..( 11): Result.004 file - promoters50/1022088
ttatgatttga

SEQ ID NO: 158841 - DNA, 11 bp, Unknown
  misc_feature (1)..( 11): Result.004 file - promoters50/1022088
aaatgaattga

SEQ ID NO: 158842 - DNA, 9 bp, Unknown
  misc_feature (1)..( 9): Result.004 file - promoters50/1022088
aaaagattt

SEQ ID NO: 158843 - DNA, 9 bp, Unknown
  misc_feature (1)..( 9): Result.004 file - promoters50/1022088
aaaaaattg

SEQ ID NO: 158844 - DNA, 9 bp, Unknown
  misc_feature (1)..( 9): Result.004 file - promoters50/1022088
aaaaaagta

SEQ ID NO: 158845 - DNA, 9 bp, Unknown
  misc_feature (1)..( 9): Result.004 file - promoters50/1022088
tccaaattg

SEQ ID NO: 158846 - DNA, 9 bp, Unknown
  misc_feature (1)..( 9): Result.004 file - promoters50/1022088
aaaatgaat

SEQ ID NO: 158847 - DNA, 9 bp, Unknown
  misc_feature (1)..( 9): Result.004 file - promoters50/1022088
aaattgaat

SEQ ID NO: 158848 - DNA, 9 bp, Unknown
  misc_feature (1)..( 9): Result.004 file - promoters50/1022088
aaattgtgg

SEQ ID NO: 158849 - DNA, 12 bp, Unknown
  misc_feature (1)..( 12): Result.004 file - promoters50/1022088
tacaaaaaaaat

SEQ ID NO: 158850 - DNA, 12 bp, Unknown
  misc_feature (1)..( 12): Result.004 file - promoters50/1022088
taccaaataaat

SEQ ID NO: 158851 - DNA, 12 bp, Unknown
  misc_feature (1)..( 12): Result.004 file - promoters50/1022111
tcacaaactcgc

SEQ ID NO: 158852 - DNA, 8 bp, Unknown
  misc_feature (1)..( 8): Result.004 file - promoters50/1022111
ttattttg

SEQ ID NO: 158853 - DNA, 8 bp, Unknown
  misc_feature (1)..( 8): Result.004 file - promoters50/1022111
ttatttaa

SEQ ID NO: 158854 - DNA, 8 bp, Unknown
  misc_feature (1)..( 8): Result.004 file - promoters50/1022127
atatataa

SEQ ID NO: 158855 - DNA, 8 bp, Unknown
  misc_feature (1)..( 8): Result.004 file - promoters50/1022127
caaacgat

SEQ ID NO: 158856 - DNA, 8 bp, Unknown
  misc_feature (1)..( 8): Result.004 file - promoters50/1022127
caaacgaa

SEQ ID NO: 158857 - DNA, 8 bp, Unknown
  misc_feature (1)..( 8): Result.004 file - promoters50/1022127
aaaaagat

SEQ ID NO: 158858 - DNA, 8 bp, Unknown
  misc_feature (1)..( 8): Result.004 file - promoters50/1022127
taaaaaaa

SEQ ID NO: 158859 - DNA, 8 bp, Unknown
  misc_feature (1)..( 8): Result.004 file - promoters50/1022127
caaagaaa

SEQ ID NO: 158860 - DNA, 8 bp, Unknown
  misc_feature (1)..( 8): Result.004 file - promoters50/1022131
caaagacg

SEQ ID NO: 158861 - DNA, 12 bp, Unknown
  misc_feature (1)..( 12): Result.004 file - promoters50/1022131
acttaaaatgga

SEQ ID NO: 158862 - DNA, 12 bp, Unknown
  misc_feature (1)..( 12): Result.004 file - promoters50/1022131
ttttaaaaaaag

SEQ ID NO: 158863 - DNA, 12 bp, Unknown
  misc_feature (1)..( 12): Result.004 file - promoters50/1022131
atttaaaagacc

SEQ ID NO: 158864 - DNA, 13 bp, Unknown
  misc_feature (1)..( 13): Result.004 file - promoters50/1022131
gattagaaacaga

SEQ ID NO: 158865 - DNA, 13 bp, Unknown
  misc_feature (1)..( 13): Result.004 file - promoters50/1022131
tttttaaacgagt

SEQ ID NO: 158866 - DNA, 12 bp, Unknown
  misc_feature (1)..( 12): Result.004 file - promoters50/1022131
ctgtaaaaggaa

SEQ ID NO: 158867 - DNA, 12 bp, Unknown
  misc_feature (1)..( 12): Result.004 file - promoters50/1022131
ttaaaaaaagaa

SEQ ID NO: 158868 - DNA, 12 bp, Unknown
  misc_feature (1)..( 12): Result.004 file - promoters50/1022131
ttagaaacagac

SEQ ID NO: 158869 - DNA, 12 bp, Unknown
  misc_feature (1)..( 12): Result.004 file - promoters50/1022182
aatttaaaagac

SEQ ID NO: 158870 - DNA, 9 bp, Unknown
  misc_feature (1)..( 9): Result.004 file - promoters50/1022182
tgctaaatt

SEQ ID NO: 158871 - DNA, 9 bp, Unknown
  misc_feature (1)..( 9): Result.004 file - promoters50/1022182
tgcttaatt

SEQ ID NO: 158872 - DNA, 9 bp, Unknown
  misc_feature (1)..( 9): Result.004 file - promoters50/1022182
acctatatt

SEQ ID NO: 158873 - DNA, 9 bp, Unknown
  misc_feature (1)..( 9): Result.004 file - promoters50/1022182
tggctgttt

SEQ ID NO: 158874 - DNA, 9 bp, Unknown
  misc_feature (1)..( 9): Result.004 file - promoters50/1022182
tggttgtta

SEQ ID NO: 158875 - DNA, 9 bp, Unknown
  misc_feature (1)..( 9): Result.004 file - promoters50/1022182
cagcttttt

SEQ ID NO: 158876 - DNA, 9 bp, Unknown
  misc_feature (1)..( 9): Result.004 file - promoters50/1022182
aattgattc

SEQ ID NO: 158877 - DNA, 9 bp, Unknown
  misc_feature (1)..( 9): Result.004 file - promoters50/1022182
aatttattt

SEQ ID NO: 158878 - DNA, 9 bp, Unknown
  misc_feature (1)..( 9): Result.004 file - promoters50/1022182
atttggttc

SEQ ID NO: 158879 - DNA, 10 bp, Unknown
  misc_feature (1)..( 10): Result.004 file - promoters50/1022182
agtttacttc

SEQ ID NO: 158880 - DNA, 10 bp, Unknown
  misc_feature (1)..( 10): Result.004 file - promoters50/1022182
ttttttactg

SEQ ID NO: 158881 - DNA, 10 bp, Unknown
  misc_feature (1)..( 10): Result.004 file - promoters50/1022182
tagttttctg

SEQ ID NO: 158882 - DNA, 10 bp, Unknown
  misc_feature (1)..( 10): Result.004 file - promoters50/1022182
tagtcttcaa

SEQ ID NO: 158883 - DNA, 10 bp, Unknown
  misc_feature (1)..( 10): Result.004 file - promoters50/1022182
atcttttctt

SEQ ID NO: 158884 - DNA, 8 bp, Unknown
  misc_feature (1)..( 8): Result.004 file - promoters50/1022182
ggaatctg

SEQ ID NO: 158885 - DNA, 8 bp, Unknown
  misc_feature (1)..( 8): Result.004 file - promoters50/1022182
ggaatctg

SEQ ID NO: 158886 - DNA, 8 bp, Unknown
  misc_feature (1)..( 8): Result.004 file - promoters50/1022192
ctaatctg

SEQ ID NO: 158887 - DNA, 8 bp, Unknown
  misc_feature (1)..( 8): Result.004 file - promoters50/1022192
ttgtttag

SEQ ID NO: 158888 - DNA, 8 bp, Unknown
  misc_feature (1)..( 8): Result.004 file - promoters50/1022192
ttgtttaa

SEQ ID NO: 158889 - DNA, 8 bp, Unknown
  misc_feature (1)..( 8): Result.004 file - promoters50/1022192
ttggttag

SEQ ID NO: 158890 - DNA, 8 bp, Unknown
  misc_feature (1)..( 8): Result.004 file - promoters50/1022192
tcatagtt

SEQ ID NO: 158891 - DNA, 8 bp, Unknown
  misc_feature (1)..( 8): Result.004 file - promoters50/1022192
tcaaagtc

SEQ ID NO: 158892 - DNA, 8 bp, Unknown
  misc_feature (1)..( 8): Result.004 file - promoters50/1022192
acattgtt

SEQ ID NO: 158893 - DNA, 10 bp, Unknown
  misc_feature (1)..( 10): Result.004 file - promoters50/1022192
acaatgaaaa

SEQ ID NO: 158894 - DNA, 10 bp, Unknown
  misc_feature (1)..( 10): Result.004 file - promoters50/1022192
cttatgaaat

SEQ ID NO: 158895 - DNA, 10 bp, Unknown
  misc_feature (1)..( 10): Result.004 file - promoters50/1022192
cttttgaaat

SEQ ID NO: 158896 - DNA, 13 bp, Unknown
  misc_feature (1)..( 13): Result.004 file - promoters50/1022192
ggagttattatat

SEQ ID NO: 158897 - DNA, 13 bp, Unknown
  misc_feature (1)..( 13): Result.004 file - promoters50/1022192
ggacttatgaaat

SEQ ID NO: 158898 - DNA, 13 bp, Unknown
  misc_feature (1)..( 13): Result.004 file - promoters50/1022192
catcttttgaaat

SEQ ID NO: 158899 - DNA, 10 bp, Unknown
  misc_feature (1)..( 10): Result.004 file - promoters50/1022192
gttttttacg

SEQ ID NO: 158900 - DNA, 10 bp, Unknown
  misc_feature (1)..( 10): Result.004 file - promoters50/1022192
actttttaaa

SEQ ID NO: 158901 - DNA, 10 bp, Unknown
  misc_feature (1)..( 10): Result.004 file - promoters50/1022192
acttcttaaa

SEQ ID NO: 158902 - DNA, 12 bp, Unknown
  misc_feature (1)..( 12): Result.004 file - promoters50/1022192
cttcttaccaag

SEQ ID NO: 158903 - DNA, 12 bp, Unknown
  misc_feature (1)..( 12): Result.004 file - promoters50/1022192
tttcttactaag

SEQ ID NO: 158904 - DNA, 13 bp, Unknown
  misc_feature (1)..( 13): Result.004 file - promoters50/1022192
tttacttgttggg

SEQ ID NO: 158905 - DNA, 10 bp, Unknown
  misc_feature (1)..( 10): Result.004 file - promoters50/1022192
ctttttaaaa

SEQ ID NO: 158906 - DNA, 10 bp, Unknown
  misc_feature (1)..( 10): Result.004 file - promoters50/1022192
cttttgaaat

SEQ ID NO: 158907 - DNA, 10 bp, Unknown
  misc_feature (1)..( 10): Result.004 file - promoters50/1022227
cttatgaaat

SEQ ID NO: 158908 - DNA, 11 bp, Unknown
  misc_feature (1)..( 11): Result.004 file - promoters50/1022227
gatgcattttc

SEQ ID NO: 158909 - DNA, 11 bp, Unknown
  misc_feature (1)..( 11): Result.004 file - promoters50/1022227
tttgcagtttc

SEQ ID NO: 158910 - DNA, 11 bp, Unknown
  misc_feature (1)..( 11): Result.004 file - promoters50/1022242
tttgtagtttt

SEQ ID NO: 158911 - DNA, 13 bp, Unknown
  misc_feature (1)..( 13): Result.004 file - promoters50/1022242
aaacaatatgtaa

SEQ ID NO: 158912 - DNA, 13 bp, Unknown
  misc_feature (1)..( 13): Result.004 file - promoters50/1022242
agcatatatgtaa

SEQ ID NO: 158913 - DNA, 13 bp, Unknown
  misc_feature (1)..( 13): Result.004 file - promoters50/1022242
agcatttatgtgt

SEQ ID NO: 158914 - DNA, 6 bp, Unknown
  misc_feature (1)..( 6): Result.004 file - promoters50/1022242
acataa

SEQ ID NO: 158915 - DNA, 6 bp, Unknown
  misc_feature (1)..( 6): Result.004 file - promoters50/1022242
acataa

SEQ ID NO: 158916 - DNA, 6 bp, Unknown
  misc_feature (1)..( 6): Result.004 file - promoters50/1022242
acataa

SEQ ID NO: 158917 - DNA, 11 bp, Unknown
  misc_feature (1)..( 11): Result.004 file - promoters50/1022242
aaaaaagaatt

SEQ ID NO: 158918 - DNA, 11 bp, Unknown
  misc_feature (1)..( 11): Result.004 file - promoters50/1022242
tctaaagcatt

SEQ ID NO: 158919 - DNA, 11 bp, Unknown
  misc_feature (1)..( 11): Result.004 file - promoters50/1022252
tcttaagccac

SEQ ID NO: 158920 - DNA, 8 bp, Unknown
  misc_feature (1)..( 8): Result.004 file - promoters50/1022252
taaaaatt

SEQ ID NO: 158921 - DNA, 8 bp, Unknown
  misc_feature (1)..( 8): Result.004 file - promoters50/1022252
taataatt

SEQ ID NO: 158922 - DNA, 8 bp, Unknown
  misc_feature (1)..( 8): Result.004 file - promoters50/1022252
aaaaaatt

SEQ ID NO: 158923 - DNA, 8 bp, Unknown
  misc_feature (1)..( 8): Result.004 file - promoters50/1022252
aaaaaatt

SEQ ID NO: 158924 - DNA, 8 bp, Unknown
  misc_feature (1)..( 8): Result.004 file - promoters50/1022252
aaaagatt

SEQ ID NO: 158925 - DNA, 8 bp, Unknown
  misc_feature (1)..( 8): Result.004 file - promoters50/1022252
aaaaaaaa

SEQ ID NO: 158926 - DNA, 7 bp, Unknown
  misc_feature (1)..( 7): Result.004 file - promoters50/1022252
aaaatta

SEQ ID NO: 158927 - DNA, 7 bp, Unknown
  misc_feature (1)..( 7): Result.004 file - promoters50/1022252
aaaattt

SEQ ID NO: 158928 - DNA, 7 bp, Unknown
  misc_feature (1)..( 7): Result.004 file - promoters50/1022256
gaaatta

SEQ ID NO: 158929 - DNA, 11 bp, Unknown
  misc_feature (1)..( 11): Result.004 file - promoters50/1022256
aaatattaaat

SEQ ID NO: 158930 - DNA, 11 bp, Unknown
  misc_feature (1)..( 11): Result.004 file - promoters50/1022256
aaacatttaat

SEQ ID NO: 158931 - DNA, 11 bp, Unknown
  misc_feature (1)..( 11): Result.004 file - promoters50/1022256
atttattaatt

SEQ ID NO: 158932 - DNA, 10 bp, Unknown
  misc_feature (1)..( 10): Result.004 file - promoters50/1022256
agataatgag

SEQ ID NO: 158933 - DNA, 10 bp, Unknown
  misc_feature (1)..( 10): Result.004 file - promoters50/1022256
ttataaagag

SEQ ID NO: 158934 - DNA, 10 bp, Unknown
  misc_feature (1)..( 10): Result.004 file - promoters50/1022256
agataatttt

SEQ ID NO: 158935 - DNA, 8 bp, Unknown
  misc_feature (1)..( 8): Result.004 file - promoters50/1022256
ttttttca

SEQ ID NO: 158936 - DNA, 8 bp, Unknown
  misc_feature (1)..( 8): Result.004 file - promoters50/1022256
ttttatca

SEQ ID NO: 158937 - DNA, 8 bp, Unknown
  misc_feature (1)..( 8): Result.004 file - promoters50/1022256
ttttattt

SEQ ID NO: 158938 - DNA, 11 bp, Unknown
  misc_feature (1)..( 11): Result.004 file - promoters50/1022256
tatatatatac

SEQ ID NO: 158939 - DNA, 11 bp, Unknown
  misc_feature (1)..( 11): Result.004 file - promoters50/1022256
tatataaatac

SEQ ID NO: 158940 - DNA, 11 bp, Unknown
  misc_feature (1)..( 11): Result.004 file - promoters50/1022256
gttataaaacc

SEQ ID NO: 158941 - DNA, 7 bp, Unknown
  misc_feature (1)..( 7): Result.004 file - promoters50/1022256
aaaagaa

SEQ ID NO: 158942 - DNA, 7 bp, Unknown
  misc_feature (1)..( 7): Result.004 file - promoters50/1022256
aaaagac

SEQ ID NO: 158943 - DNA, 7 bp, Unknown
  misc_feature (1)..( 7): Result.004 file - promoters50/1022256
aaaaact

SEQ ID NO: 158944 - DNA, 8 bp, Unknown
  misc_feature (1)..( 8): Result.004 file - promoters50/1022256
taaattaa

SEQ ID NO: 158945 - DNA, 8 bp, Unknown
  misc_feature (1)..( 8): Result.004 file - promoters50/1022256
aaaactaa

SEQ ID NO: 158946 - DNA, 9 bp, Unknown
  misc_feature (1)..( 9): Result.004 file - promoters50/1022264
aaagactga

SEQ ID NO: 158947 - DNA, 10 bp, Unknown
  misc_feature (1)..( 10): Result.004 file - promoters50/1022264
aaatattgtt

SEQ ID NO: 158948 - DNA, 10 bp, Unknown
  misc_feature (1)..( 10): Result.004 file - promoters50/1022264
aaagatttat

SEQ ID NO: 158949 - DNA, 10 bp, Unknown
  misc_feature (1)..( 10): Result.004 file - promoters50/1022264
aaagttttat

SEQ ID NO: 158950 - DNA, 9 bp, Unknown
  misc_feature (1)..( 9): Result.004 file - promoters50/1022264
gctcatttt

SEQ ID NO: 158951 - DNA, 9 bp, Unknown
  misc_feature (1)..( 9): Result.004 file - promoters50/1022264
aaacatttt

SEQ ID NO: 158952 - DNA, 9 bp, Unknown
  misc_feature (1)..( 9): Result.004 file - promoters50/1022264
gctcacttt

SEQ ID NO: 158953 - DNA, 17 bp, Unknown
  misc_feature (1)..( 17): Result.004 file - promoters50/1022264
attttttgtttcaaata

SEQ ID NO: 158954 - DNA, 17 bp, Unknown
  misc_feature (1)..( 17): Result.004 file - promoters50/1022264
atttttagtttgttaat

SEQ ID NO: 158955 - DNA, 17 bp, Unknown
  misc_feature (1)..( 17): Result.004 file - promoters50/1022264
ttctgttgtatcagata

SEQ ID NO: 158956 - DNA, 9 bp, Unknown
  misc_feature (1)..( 9): Result.004 file - promoters50/1022264
tttgttaat

SEQ ID NO: 158957 - DNA, 9 bp, Unknown
  misc_feature (1)..( 9): Result.004 file - promoters50/1022264
attgtaaat

SEQ ID NO: 158958 - DNA, 9 bp, Unknown
  misc_feature (1)..( 9): Result.004 file - promoters50/1022264
tttgttagc

SEQ ID NO: 158959 - DNA, 8 bp, Unknown
  misc_feature (1)..( 8): Result.004 file - promoters50/1022264
taaaatct

SEQ ID NO: 158960 - DNA, 8 bp, Unknown
  misc_feature (1)..( 8): Result.004 file - promoters50/1022264
taaaattc

SEQ ID NO: 158961 - DNA, 8 bp, Unknown
  misc_feature (1)..( 8): Result.004 file - promoters50/1022264
aaaacttc

SEQ ID NO: 158962 - DNA, 10 bp, Unknown
  misc_feature (1)..( 10): Result.004 file - promoters50/1022264
attgttttaa

SEQ ID NO: 158963 - DNA, 10 bp, Unknown
  misc_feature (1)..( 10): Result.004 file - promoters50/1022264
aaagttttat

SEQ ID NO: 158964 - DNA, 10 bp, Unknown
  misc_feature (1)..( 10): Result.004 file - promoters50/1022268
aaagatttat

SEQ ID NO: 158965 - DNA, 9 bp, Unknown
  misc_feature (1)..( 9): Result.004 file - promoters50/1022268
atcctccga

SEQ ID NO: 158966 - DNA, 9 bp, Unknown
  misc_feature (1)..( 9): Result.004 file - promoters50/1022268
ctccgccga

SEQ ID NO: 158967 - DNA, 9 bp, Unknown
  misc_feature (1)..( 9): Result.004 file - promoters50/1022292
ctccggcga

SEQ ID NO: 158968 - DNA, 12 bp, Unknown
  misc_feature (1)..( 12): Result.004 file - promoters50/1022292
agaaaataaaaa

SEQ ID NO: 158969 - DNA, 12 bp, Unknown
  misc_feature (1)..( 12): Result.004 file - promoters50/1022292
tttgaattaaat

SEQ ID NO: 158970 - DNA, 12 bp, Unknown
  misc_feature (1)..( 12): Result.004 file - promoters50/1022292
aatctataaaaa

SEQ ID NO: 158971 - DNA, 12 bp, Unknown
  misc_feature (1)..( 12): Result.004 file - promoters50/1022292
agaaaataaaaa

SEQ ID NO: 158972 - DNA, 12 bp, Unknown
  misc_feature (1)..( 12): Result.004 file - promoters50/1022292
acagaataaaaa

SEQ ID NO: 158973 - DNA, 12 bp, Unknown
  misc_feature (1)..( 12): Result.004 file - promoters50/1022292
gttgactaaaaa

SEQ ID NO: 158974 - DNA, 12 bp, Unknown
  misc_feature (1)..( 12): Result.004 file - promoters50/1022292
tatatataaaaa

SEQ ID NO: 158975 - DNA, 12 bp, Unknown
  misc_feature (1)..( 12): Result.004 file - promoters50/1022292
aaaatcaaaaat

SEQ ID NO: 158976 - DNA, 12 bp, Unknown
  misc_feature (1)..( 12): Result.004 file - promoters50/1022292
ttaattaaaaga

SEQ ID NO: 158977 - DNA, 12 bp, Unknown
  misc_feature (1)..( 12): Result.004 file - promoters50/1022292
aaaaacaaggaa

SEQ ID NO: 158978 - DNA, 12 bp, Unknown
  misc_feature (1)..( 12): Result.004 file - promoters50/1022292
gtgatcaaatcc

SEQ ID NO: 158979 - DNA, 12 bp, Unknown
  misc_feature (1)..( 12): Result.004 file - promoters50/1022292
gaaaataaaaaa

SEQ ID NO: 158980 - DNA, 12 bp, Unknown
  misc_feature (1)..( 12): Result.004 file - promoters50/1022292
tgacataaattt

SEQ ID NO: 158981 - DNA, 11 bp, Unknown
  misc_feature (1)..( 11): Result.004 file - promoters50/1022292
aacaaaagatt

SEQ ID NO: 158982 - DNA, 11 bp, Unknown
  misc_feature (1)..( 11): Result.004 file - promoters50/1022292
aaataaagatc

SEQ ID NO: 158983 - DNA, 11 bp, Unknown
  misc_feature (1)..( 11): Result.004 file - promoters50/1022292
atataaaaatt

SEQ ID NO: 158984 - DNA, 11 bp, Unknown
  misc_feature (1)..( 11): Result.004 file - promoters50/1022292
aaataaaaatc

SEQ ID NO: 158985 - DNA, 11 bp, Unknown
  misc_feature (1)..( 11): Result.004 file - promoters50/1022292
ttccaatgaaa

SEQ ID NO: 158986 - DNA, 11 bp, Unknown
  misc_feature (1)..( 11): Result.004 file - promoters50/1022292
gactaaaaaac

SEQ ID NO: 158987 - DNA, 9 bp, Unknown
  misc_feature (1)..( 9): Result.004 file - promoters50/1022292
gaaataatt

SEQ ID NO: 158988 - DNA, 9 bp, Unknown
  misc_feature (1)..( 9): Result.004 file - promoters50/1022292
caaagaata

SEQ ID NO: 158989 - DNA, 9 bp, Unknown
  misc_feature (1)..( 9): Result.004 file - promoters50/1022292
taaaaaata

SEQ ID NO: 158990 - DNA, 9 bp, Unknown
  misc_feature (1)..( 9): Result.004 file - promoters50/1022292
aaaagaatc

SEQ ID NO: 158991 - DNA, 9 bp, Unknown
  misc_feature (1)..( 9): Result.004 file - promoters50/1022292
aaaacaatt

SEQ ID NO: 158992 - DNA, 9 bp, Unknown
  misc_feature (1)..( 9): Result.004 file - promoters50/1022296
caaagaaac

SEQ ID NO: 158993 - DNA, 8 bp, Unknown
  misc_feature (1)..( 8): Result.004 file - promoters50/1022296
tatttagg

SEQ ID NO: 158994 - DNA, 8 bp, Unknown
  misc_feature (1)..( 8): Result.004 file - promoters50/1022296
tatttatg

SEQ ID NO: 158995 - DNA, 8 bp, Unknown
  misc_feature (1)..( 8): Result.004 file - promoters50/1022296
tatatatt

SEQ ID NO: 158996 - DNA, 8 bp, Unknown
  misc_feature (1)..( 8): Result.004 file - promoters50/1022296
aatttatc

SEQ ID NO: 158997 - DNA, 8 bp, Unknown
  misc_feature (1)..( 8): Result.004 file - promoters50/1022296
aatttaat

SEQ ID NO: 158998 - DNA, 8 bp, Unknown
  misc_feature (1)..( 8): Result.004 file - promoters50/1022370
aataaatt

SEQ ID NO: 158999 - DNA, 11 bp, Unknown
  misc_feature (1)..( 11): Result.004 file - promoters50/1022370
caagtatataa

SEQ ID NO: 159000 - DNA, 11 bp, Unknown
  misc_feature (1)..( 11): Result.004 file - promoters50/1022370
caactatatat

SEQ ID NO: 159001 - DNA, 11 bp, Unknown
  misc_feature (1)..( 11): Result.004 file - promoters50/1022370
gagttatatat

SEQ ID NO: 159002 - DNA, 11 bp, Unknown
  misc_feature (1)..( 11): Result.004 file - promoters50/1022370
tctctatataa

SEQ ID NO: 159003 - DNA, 11 bp, Unknown
  misc_feature (1)..( 11): Result.004 file - promoters50/1022383
taagcatacat

SEQ ID NO: 159004 - DNA, 8 bp, Unknown
  misc_feature (1)..( 8): Result.004 file - promoters50/1022383
attgcctc

SEQ ID NO: 159005 - DNA, 8 bp, Unknown
  misc_feature (1)..( 8): Result.004 file - promoters50/1022383
attgccat

SEQ ID NO: 159006 - DNA, 8 bp, Unknown
  misc_feature (1)..( 8): Result.004 file - promoters50/1022383
atttccat

SEQ ID NO: 159007 - DNA, 9 bp, Unknown
  misc_feature (1)..( 9): Result.004 file - promoters50/1022383
tcaaatgaa

SEQ ID NO: 159008 - DNA, 9 bp, Unknown
  misc_feature (1)..( 9): Result.004 file - promoters50/1022383
caaaatgaa

SEQ ID NO: 159009 - DNA, 9 bp, Unknown
  misc_feature (1)..( 9): Result.004 file - promoters50/1022383
caaaatgta

SEQ ID NO: 159010 - DNA, 7 bp, Unknown
  misc_feature (1)..( 7): Result.004 file - promoters50/1022383
agatctc

SEQ ID NO: 159011 - DNA, 7 bp, Unknown
  misc_feature (1)..( 7): Result.004 file - promoters50/1022383
agatctc

SEQ ID NO: 159012 - DNA, 7 bp, Unknown
  misc_feature (1)..( 7): Result.004 file - promoters50/1022383
agatctt

SEQ ID NO: 159013 - DNA, 7 bp, Unknown
  misc_feature (1)..( 7): Result.004 file - promoters50/1022383
cttttgc

SEQ ID NO: 159014 - DNA, 7 bp, Unknown
  misc_feature (1)..( 7): Result.004 file - promoters50/1022383
tttttgc

SEQ ID NO: 159015 - DNA, 8 bp, Unknown
  misc_feature (1)..( 8): Result.004 file - promoters50/1022383
gttattgt

SEQ ID NO: 159016 - DNA, 9 bp, Unknown
  misc_feature (1)..( 9): Result.004 file - promoters50/1022383
tcctccatg

SEQ ID NO: 159017 - DNA, 9 bp, Unknown
  misc_feature (1)..( 9): Result.004 file - promoters50/1022383
atttccatg

SEQ ID NO: 159018 - DNA, 9 bp, Unknown
  misc_feature (1)..( 9): Result.004 file - promoters50/1022389
attgccatc

SEQ ID NO: 159019 - DNA, 11 bp, Unknown
  misc_feature (1)..( 11): Result.004 file - promoters50/1022389
gcttcaatttt

SEQ ID NO: 159020 - DNA, 11 bp, Unknown
  misc_feature (1)..( 11): Result.004 file - promoters50/1022389
gcttcattttt

SEQ ID NO: 159021 - DNA, 11 bp, Unknown
  misc_feature (1)..( 11): Result.004 file - promoters50/1022389
atagcaatttt

SEQ ID NO: 159022 - DNA, 8 bp, Unknown
  misc_feature (1)..( 8): Result.004 file - promoters50/1022389
aaatatta

SEQ ID NO: 159023 - DNA, 8 bp, Unknown
  misc_feature (1)..( 8): Result.004 file - promoters50/1022389
aaatatta

SEQ ID NO: 159024 - DNA, 8 bp, Unknown
  misc_feature (1)..( 8): Result.004 file - promoters50/1022401
aaatatac

SEQ ID NO: 159025 - DNA, 8 bp, Unknown
  misc_feature (1)..( 8): Result.004 file - promoters50/1022401
taaaaata

SEQ ID NO: 159026 - DNA, 8 bp, Unknown
  misc_feature (1)..( 8): Result.004 file - promoters50/1022401
taaagata

SEQ ID NO: 159027 - DNA, 8 bp, Unknown
  misc_feature (1)..( 8): Result.004 file - promoters50/1022401
taagaata

SEQ ID NO: 159028 - DNA, 8 bp, Unknown
  misc_feature (1)..( 8): Result.004 file - promoters50/1022401
gaaaaaca

SEQ ID NO: 159029 - DNA, 8 bp, Unknown
  misc_feature (1)..( 8): Result.004 file - promoters50/1022401
taaagaca

SEQ ID NO: 159030 - DNA, 8 bp, Unknown
  misc_feature (1)..( 8): Result.004 file - promoters50/1022401
taacaatt

SEQ ID NO: 159031 - DNA, 8 bp, Unknown
  misc_feature (1)..( 8): Result.004 file - promoters50/1022401
gaaaaatg

SEQ ID NO: 159032 - DNA, 10 bp, Unknown
  misc_feature (1)..( 10): Result.004 file - promoters50/1022401
gtaaaacaaa

SEQ ID NO: 159033 - DNA, 10 bp, Unknown
  misc_feature (1)..( 10): Result.004 file - promoters50/1022401
attaaacaaa

SEQ ID NO: 159034 - DNA, 10 bp, Unknown
  misc_feature (1)..( 10): Result.004 file - promoters50/1022401
acataacact

SEQ ID NO: 159035 - DNA, 10 bp, Unknown
  misc_feature (1)..( 10): Result.004 file - promoters50/1022401
ttaaaaaaaa

SEQ ID NO: 159036 - DNA, 10 bp, Unknown
  misc_feature (1)..( 10): Result.004 file - promoters50/1022401
gactaaaaaa

SEQ ID NO: 159037 - DNA, 10 bp, Unknown
  misc_feature (1)..( 10): Result.004 file - promoters50/1022401
gtggaaaaaa

SEQ ID NO: 159038 - DNA, 9 bp, Unknown
  misc_feature (1)..( 9): Result.004 file - promoters50/1022401
taatgtaac

SEQ ID NO: 159039 - DNA, 9 bp, Unknown
  misc_feature (1)..( 9): Result.004 file - promoters50/1022401
agttgtaac

SEQ ID NO: 159040 - DNA, 9 bp, Unknown
  misc_feature (1)..( 9): Result.004 file - promoters50/1022401
aaatataaa

SEQ ID NO: 159041 - DNA, 9 bp, Unknown
  misc_feature (1)..( 9): Result.004 file - promoters50/1022401
tgttttaag

SEQ ID NO: 159042 - DNA, 9 bp, Unknown
  misc_feature (1)..( 9): Result.004 file - promoters50/1022401
ggttttatt

SEQ ID NO: 159043 - DNA, 9 bp, Unknown
  misc_feature (1)..( 9): Result.004 file - promoters50/1022401
aaataaaaa

SEQ ID NO: 159044 - DNA, 10 bp, Unknown
  misc_feature (1)..( 10): Result.004 file - promoters50/1022401
ctatttaaga

SEQ ID NO: 159045 - DNA, 10 bp, Unknown
  misc_feature (1)..( 10): Result.004 file - promoters50/1022401
gtatataata

SEQ ID NO: 159046 - DNA, 10 bp, Unknown
  misc_feature (1)..( 10): Result.004 file - promoters50/1022401
tcatttaaaa

SEQ ID NO: 159047 - DNA, 10 bp, Unknown
  misc_feature (1)..( 10): Result.004 file - promoters50/1022401
tcaattaatc

SEQ ID NO: 159048 - DNA, 10 bp, Unknown
  misc_feature (1)..( 10): Result.004 file - promoters50/1022401
ttttttaatt

SEQ ID NO: 159049 - DNA, 10 bp, Unknown
  misc_feature (1)..( 10): Result.004 file - promoters50/1022401
ttattttttg

SEQ ID NO: 159050 - DNA, 11 bp, Unknown
  misc_feature (1)..( 11): Result.004 file - promoters50/1022401
agatttttaat

SEQ ID NO: 159051 - DNA, 11 bp, Unknown
  misc_feature (1)..( 11): Result.004 file - promoters50/1022401
ttattgttagg

SEQ ID NO: 159052 - DNA, 11 bp, Unknown
  misc_feature (1)..( 11): Result.004 file - promoters50/1022401
tccttttcaat

SEQ ID NO: 159053 - DNA, 11 bp, Unknown
  misc_feature (1)..( 11): Result.004 file - promoters50/1022401
tgttttttaat

SEQ ID NO: 159054 - DNA, 11 bp, Unknown
  misc_feature (1)..( 11): Result.004 file - promoters50/1022401
tcatttaaaac

SEQ ID NO: 159055 - DNA, 11 bp, Unknown
  misc_feature (1)..( 11): Result.004 file - promoters50/1022401
ttattttttgt

SEQ ID NO: 159056 - DNA, 11 bp, Unknown
  misc_feature (1)..( 11): Result.004 file - promoters50/1022401
ataaaaagtta

SEQ ID NO: 159057 - DNA, 11 bp, Unknown
  misc_feature (1)..( 11): Result.004 file - promoters50/1022401
atataaaccta

SEQ ID NO: 159058 - DNA, 11 bp, Unknown
  misc_feature (1)..( 11): Result.004 file - promoters50/1022401
aaaaaaagtta

SEQ ID NO: 159059 - DNA, 11 bp, Unknown
  misc_feature (1)..( 11): Result.004 file - promoters50/1022401
ttataaatcgt

SEQ ID NO: 159060 - DNA, 11 bp, Unknown
  misc_feature (1)..( 11): Result.004 file - promoters50/1022401
ttataattttt

SEQ ID NO: 159061 - DNA, 11 bp, Unknown
  misc_feature (1)..( 11): Result.004 file - promoters50/1022401
caataaacgat

SEQ ID NO: 159062 - DNA, 11 bp, Unknown
  misc_feature (1)..( 11): Result.004 file - promoters50/1022401
ttattattccc

SEQ ID NO: 159063 - DNA, 11 bp, Unknown
  misc_feature (1)..( 11): Result.004 file - promoters50/1022401
gtttaaagata

SEQ ID NO: 159064 - DNA, 11 bp, Unknown
  misc_feature (1)..( 11): Result.004 file - promoters50/1022401
tgttacagaga

SEQ ID NO: 159065 - DNA, 11 bp, Unknown
  misc_feature (1)..( 11): Result.004 file - promoters50/1022401
tgtcacatatc

SEQ ID NO: 159066 - DNA, 11 bp, Unknown
  misc_feature (1)..( 11): Result.004 file - promoters50/1022401
aatcaaataat

SEQ ID NO: 159067 - DNA, 11 bp, Unknown
  misc_feature (1)..( 11): Result.004 file - promoters50/1022401
tagcaaagaat

SEQ ID NO: 159068 - DNA, 11 bp, Unknown
  misc_feature (1)..( 11): Result.004 file - promoters50/1022434
aattaaataat

SEQ ID NO: 159069 - DNA, 9 bp, Unknown
  misc_feature (1)..( 9): Result.004 file - promoters50/1022434
ccattttcg

SEQ ID NO: 159070 - DNA, 9 bp, Unknown
  misc_feature (1)..( 9): Result.004 file - promoters50/1022434
agattatcg

SEQ ID NO: 159071 - DNA, 9 bp, Unknown
  misc_feature (1)..( 9): Result.004 file - promoters50/1022441
agattatct

SEQ ID NO: 159072 - DNA, 12 bp, Unknown
  misc_feature (1)..( 12): Result.004 file - promoters50/1022441
aattgattattt

SEQ ID NO: 159073 - DNA, 12 bp, Unknown
  misc_feature (1)..( 12): Result.004 file - promoters50/1022441
aattgatttttt

SEQ ID NO: 159074 - DNA, 12 bp, Unknown
  misc_feature (1)..( 12): Result.004 file - promoters50/1022527
acttgattggta

SEQ ID NO: 159075 - DNA, 7 bp, Unknown
  misc_feature (1)..( 7): Result.004 file - promoters50/1022527
tgttaag

SEQ ID NO: 159076 - DNA, 7 bp, Unknown
  misc_feature (1)..( 7): Result.004 file - promoters50/1022527
tgtgaag

SEQ ID NO: 159077 - DNA, 7 bp, Unknown
  misc_feature (1)..( 7): Result.004 file - promoters50/1022527
tgtgaac

SEQ ID NO: 159078 - DNA, 7 bp, Unknown
  misc_feature (1)..( 7): Result.004 file - promoters50/1022527
tatgaaa

SEQ ID NO: 159079 - DNA, 7 bp, Unknown
  misc_feature (1)..( 7): Result.004 file - promoters50/1022527
tatgaac

SEQ ID NO: 159080 - DNA, 7 bp, Unknown
  misc_feature (1)..( 7): Result.004 file - promoters50/1022527
aatgaaa

SEQ ID NO: 159081 - DNA, 12 bp, Unknown
  misc_feature (1)..( 12): Result.004 file - promoters50/1022527
aataaaataatg

SEQ ID NO: 159082 - DNA, 12 bp, Unknown
  misc_feature (1)..( 12): Result.004 file - promoters50/1022527
aataaaccagat

SEQ ID NO: 159083 - DNA, 12 bp, Unknown
  misc_feature (1)..( 12): Result.004 file - promoters50/1022527
aaaaaaaattaa

SEQ ID NO: 159084 - DNA, 8 bp, Unknown
  misc_feature (1)..( 8): Result.004 file - promoters50/1022527
atagaaca

SEQ ID NO: 159085 - DNA, 8 bp, Unknown
  misc_feature (1)..( 8): Result.004 file - promoters50/1022527
ataaaact

SEQ ID NO: 159086 - DNA, 8 bp, Unknown
  misc_feature (1)..( 8): Result.004 file - promoters50/1022527
taaaaact

SEQ ID NO: 159087 - DNA, 11 bp, Unknown
  misc_feature (1)..( 11): Result.004 file - promoters50/1022527
tatgtcaaatt

SEQ ID NO: 159088 - DNA, 11 bp, Unknown
  misc_feature (1)..( 11): Result.004 file - promoters50/1022527
aatgtctaatt

SEQ ID NO: 159089 - DNA, 11 bp, Unknown
  misc_feature (1)..( 11): Result.004 file - promoters50/1022546
aatgtcttaat

SEQ ID NO: 159090 - DNA, 11 bp, Unknown
  misc_feature (1)..( 11): Result.004 file - promoters50/1022546
tcgattttcaa

SEQ ID NO: 159091 - DNA, 11 bp, Unknown
  misc_feature (1)..( 11): Result.004 file - promoters50/1022546
aagattttatt

SEQ ID NO: 159092 - DNA, 11 bp, Unknown
  misc_feature (1)..( 11): Result.004 file - promoters50/1022546
aagatttacgc

SEQ ID NO: 159093 - DNA, 11 bp, Unknown
  misc_feature (1)..( 11): Result.004 file - promoters50/1022546
aacatttaatt

SEQ ID NO: 159094 - DNA, 8 bp, Unknown
  misc_feature (1)..( 8): Result.004 file - promoters50/1022546
caaccaat

SEQ ID NO: 159095 - DNA, 8 bp, Unknown
  misc_feature (1)..( 8): Result.004 file - promoters50/1022546
caaccaat

SEQ ID NO: 159096 - DNA, 8 bp, Unknown
  misc_feature (1)..( 8): Result.004 file - promoters50/1022546
aaaccaaa

SEQ ID NO: 159097 - DNA, 13 bp, Unknown
  misc_feature (1)..( 13): Result.004 file - promoters50/1022546
gttgatctcaaaa

SEQ ID NO: 159098 - DNA, 13 bp, Unknown
  misc_feature (1)..( 13): Result.004 file - promoters50/1022546
tgcaatctcaata

SEQ ID NO: 159099 - DNA, 13 bp, Unknown
  misc_feature (1)..( 13): Result.004 file - promoters50/1022546
gtttatctgaaaa

SEQ ID NO: 159100 - DNA, 8 bp, Unknown
  misc_feature (1)..( 8): Result.004 file - promoters50/1022546
tttccgtg

SEQ ID NO: 159101 - DNA, 8 bp, Unknown
  misc_feature (1)..( 8): Result.004 file - promoters50/1022546
tttgcgtc

SEQ ID NO: 159102 - DNA, 8 bp, Unknown
  misc_feature (1)..( 8): Result.004 file - promoters50/1022546
cttccgtg

SEQ ID NO: 159103 - DNA, 7 bp, Unknown
  misc_feature (1)..( 7): Result.004 file - promoters50/1022546
taaaaaa

SEQ ID NO: 159104 - DNA, 7 bp, Unknown
  misc_feature (1)..( 7): Result.004 file - promoters50/1022546
caaaaaa

SEQ ID NO: 159105 - DNA, 7 bp, Unknown
  misc_feature (1)..( 7): Result.004 file - promoters50/1022546
taaaaag

SEQ ID NO: 159106 - DNA, 9 bp, Unknown
  misc_feature (1)..( 9): Result.004 file - promoters50/1022546
ttctcttta

SEQ ID NO: 159107 - DNA, 9 bp, Unknown
  misc_feature (1)..( 9): Result.004 file - promoters50/1022546
ctctatttt

SEQ ID NO: 159108 - DNA, 9 bp, Unknown
  misc_feature (1)..( 9): Result.004 file - promoters50/1022561
ttcccttta

SEQ ID NO: 159109 - DNA, 8 bp, Unknown
  misc_feature (1)..( 8): Result.004 file - promoters50/1022561
caaaaagt

SEQ ID NO: 159110 - DNA, 8 bp, Unknown
  misc_feature (1)..( 8): Result.004 file - promoters50/1022561
aaaaaaga

SEQ ID NO: 159111 - DNA, 8 bp, Unknown
  misc_feature (1)..( 8): Result.004 file - promoters50/1022561
aaaaaagg

SEQ ID NO: 159112 - DNA, 8 bp, Unknown
  misc_feature (1)..( 8): Result.004 file - promoters50/1022561
caaaaatt

SEQ ID NO: 159113 - DNA, 9 bp, Unknown
  misc_feature (1)..( 9): Result.004 file - promoters50/1022561
gaaaacaga

SEQ ID NO: 159114 - DNA, 9 bp, Unknown
  misc_feature (1)..( 9): Result.004 file - promoters50/1022561
gaaaaaaaa

SEQ ID NO: 159115 - DNA, 9 bp, Unknown
  misc_feature (1)..( 9): Result.004 file - promoters50/1022561
gaagaaaga

SEQ ID NO: 159116 - DNA, 9 bp, Unknown
  misc_feature (1)..( 9): Result.004 file - promoters50/1022561
caaaaaaag

SEQ ID NO: 159117 - DNA, 9 bp, Unknown
  misc_feature (1)..( 9): Result.004 file - promoters50/1022561
agagaaagg

SEQ ID NO: 159118 - DNA, 9 bp, Unknown
  misc_feature (1)..( 9): Result.004 file - promoters50/1022578
caaaatagt

SEQ ID NO: 159119 - DNA, 7 bp, Unknown
  misc_feature (1)..( 7): Result.004 file - promoters50/1022578
aaggaag

SEQ ID NO: 159120 - DNA, 7 bp, Unknown
  misc_feature (1)..( 7): Result.004 file - promoters50/1022578
aaggaaa

SEQ ID NO: 159121 - DNA, 8 bp, Unknown
  misc_feature (1)..( 8): Result.004 file - promoters50/1022586
caggtaaa

SEQ ID NO: 159122 - DNA, 9 bp, Unknown
  misc_feature (1)..( 9): Result.004 file - promoters50/1022586
aaacatttc

SEQ ID NO: 159123 - DNA, 9 bp, Unknown
  misc_feature (1)..( 9): Result.004 file - promoters50/1022586
gtacaattc

SEQ ID NO: 159124 - DNA, 9 bp, Unknown
  misc_feature (1)..( 9): Result.004 file - promoters50/1022586
aaatattga

SEQ ID NO: 159125 - DNA, 8 bp, Unknown
  misc_feature (1)..( 8): Result.004 file - promoters50/1022586
tataaata

SEQ ID NO: 159126 - DNA, 8 bp, Unknown
  misc_feature (1)..( 8): Result.004 file - promoters50/1022586
tataaaac

SEQ ID NO: 159127 - DNA, 8 bp, Unknown
  misc_feature (1)..( 8): Result.004 file - promoters50/1022586
tataaata

SEQ ID NO: 159128 - DNA, 7 bp, Unknown
  misc_feature (1)..( 7): Result.004 file - promoters50/1022586
tttgata

SEQ ID NO: 159129 - DNA, 7 bp, Unknown
  misc_feature (1)..( 7): Result.004 file - promoters50/1022586
tttaata

SEQ ID NO: 159130 - DNA, 7 bp, Unknown
  misc_feature (1)..( 7): Result.004 file - promoters50/1022586
tttaata

SEQ ID NO: 159131 - DNA, 7 bp, Unknown
  misc_feature (1)..( 7): Result.004 file - promoters50/1022586
aaaatcc

SEQ ID NO: 159132 - DNA, 7 bp, Unknown
  misc_feature (1)..( 7): Result.004 file - promoters50/1022586
aaattcc

SEQ ID NO: 159133 - DNA, 8 bp, Unknown
  misc_feature (1)..( 8): Result.004 file - promoters50/1022586
aaagttct

SEQ ID NO: 159134 - DNA, 7 bp, Unknown
  misc_feature (1)..( 7): Result.004 file - promoters50/1022586
tttgtat

SEQ ID NO: 159135 - DNA, 7 bp, Unknown
  misc_feature (1)..( 7): Result.004 file - promoters50/1022586
tttgtag

SEQ ID NO: 159136 - DNA, 7 bp, Unknown
  misc_feature (1)..( 7): Result.004 file - promoters50/1022586
tttctag

SEQ ID NO: 159137 - DNA, 9 bp, Unknown
  misc_feature (1)..( 9): Result.004 file - promoters50/1022586
cccaataaa

SEQ ID NO: 159138 - DNA, 9 bp, Unknown
  misc_feature (1)..( 9): Result.004 file - promoters50/1022586
accaaaaaa

SEQ ID NO: 159139 - DNA, 9 bp, Unknown
  misc_feature (1)..( 9): Result.004 file - promoters50/1022594
acctaaaca

SEQ ID NO: 159140 - DNA, 7 bp, Unknown
  misc_feature (1)..( 7): Result.004 file - promoters50/1022594
aaaacta

SEQ ID NO: 159141 - DNA, 7 bp, Unknown
  misc_feature (1)..( 7): Result.004 file - promoters50/1022594
gaaacta

SEQ ID NO: 159142 - DNA, 7 bp, Unknown
  misc_feature (1)..( 7): Result.004 file - promoters50/1022594
aaaactt

SEQ ID NO: 159143 - DNA, 10 bp, Unknown
  misc_feature (1)..( 10): Result.004 file - promoters50/1022594
actaaagaaa

SEQ ID NO: 159144 - DNA, 10 bp, Unknown
  misc_feature (1)..( 10): Result.004 file - promoters50/1022594
actaaataaa

SEQ ID NO: 159145 - DNA, 10 bp, Unknown
  misc_feature (1)..( 10): Result.004 file - promoters50/1022594
tagaaaaaaa

SEQ ID NO: 159146 - DNA, 10 bp, Unknown
  misc_feature (1)..( 10): Result.004 file - promoters50/1022594
cttaaataga

SEQ ID NO: 159147 - DNA, 9 bp, Unknown
  misc_feature (1)..( 9): Result.004 file - promoters50/1022594
aattgaaaa

SEQ ID NO: 159148 - DNA, 9 bp, Unknown
  misc_feature (1)..( 9): Result.004 file - promoters50/1022594
aatagaaaa

SEQ ID NO: 159149 - DNA, 9 bp, Unknown
  misc_feature (1)..( 9): Result.004 file - promoters50/1022610
catagaaaa

SEQ ID NO: 159150 - DNA, 15 bp, Unknown
  misc_feature (1)..( 15): Result.004 file - promoters50/1022610
aaaaatgtatatata

SEQ ID NO: 159151 - DNA, 15 bp, Unknown
  misc_feature (1)..( 15): Result.004 file - promoters50/1022610
atgaatttattactg

SEQ ID NO: 159152 - DNA, 15 bp, Unknown
  misc_feature (1)..( 15): Result.004 file - promoters50/1022610
gccactgtaaataaa

SEQ ID NO: 159153 - DNA, 15 bp, Unknown
  misc_feature (1)..( 15): Result.004 file - promoters50/1022610
aaaaatttatatgat

SEQ ID NO: 159154 - DNA, 15 bp, Unknown
  misc_feature (1)..( 15): Result.004 file - promoters50/1022610
gaaagtgtcaaagaa

SEQ ID NO: 159155 - DNA, 15 bp, Unknown
  misc_feature (1)..( 15): Result.004 file - promoters50/1022662
ttttgtgtaaagaaa

SEQ ID NO: 159156 - DNA, 12 bp, Unknown
  misc_feature (1)..( 12): Result.004 file - promoters50/1022662
cccatttgtaaa

SEQ ID NO: 159157 - DNA, 12 bp, Unknown
  misc_feature (1)..( 12): Result.004 file - promoters50/1022662
aatctttataaa

SEQ ID NO: 159158 - DNA, 12 bp, Unknown
  misc_feature (1)..( 12): Result.004 file - promoters50/1022662
gattcttgtaac

SEQ ID NO: 159159 - DNA, 12 bp, Unknown
  misc_feature (1)..( 12): Result.004 file - promoters50/1022662
attttttgtatc

SEQ ID NO: 159160 - DNA, 12 bp, Unknown
  misc_feature (1)..( 12): Result.004 file - promoters50/1022662
tatctttattta

SEQ ID NO: 159161 - DNA, 12 bp, Unknown
  misc_feature (1)..( 12): Result.004 file - promoters50/1022687
attttttgttcg

SEQ ID NO: 159162 - DNA, 12 bp, Unknown
  misc_feature (1)..( 12): Result.004 file - promoters50/1022687
tattattttgaa

SEQ ID NO: 159163 - DNA, 12 bp, Unknown
  misc_feature (1)..( 12): Result.004 file - promoters50/1022687
atgcattgtgag

SEQ ID NO: 159164 - DNA, 12 bp, Unknown
  misc_feature (1)..( 12): Result.004 file - promoters50/1022687
gtttatttttta

SEQ ID NO: 159165 - DNA, 12 bp, Unknown
  misc_feature (1)..( 12): Result.004 file - promoters50/1022687
ccatgtttcgaa

SEQ ID NO: 159166 - DNA, 12 bp, Unknown
  misc_feature (1)..( 12): Result.004 file - promoters50/1022687
ttttattttacc

SEQ ID NO: 159167 - DNA, 12 bp, Unknown
  misc_feature (1)..( 12): Result.004 file - promoters50/1022687
gtttctttgctc

SEQ ID NO: 159168 - DNA, 20 bp, Unknown
  misc_feature (1)..( 20): Result.004 file - promoters50/1022687
agagtttttaagaagattag

SEQ ID NO: 159169 - DNA, 20 bp, Unknown
  misc_feature (1)..( 20): Result.004 file - promoters50/1022687
tcagtgtttgatgcatagtt

SEQ ID NO: 159170 - DNA, 20 bp, Unknown
  misc_feature (1)..( 20): Result.004 file - promoters50/1022687
agagattttgatttcctaat

SEQ ID NO: 159171 - DNA, 20 bp, Unknown
  misc_feature (1)..( 20): Result.004 file - promoters50/1022687
ctcatttttattttaatggt

SEQ ID NO: 159172 - DNA, 20 bp, Unknown
  misc_feature (1)..( 20): Result.004 file - promoters50/1022687
tattattttgaacacgacaa

SEQ ID NO: 159173 - DNA, 20 bp, Unknown
  misc_feature (1)..( 20): Result.004 file - promoters50/1022687
tgatgttttaatttaaatgg

SEQ ID NO: 159174 - DNA, 11 bp, Unknown
  misc_feature (1)..( 11): Result.004 file - promoters50/1022687
agtttttaaga

SEQ ID NO: 159175 - DNA, 11 bp, Unknown
  misc_feature (1)..( 11): Result.004 file - promoters50/1022687
atgttttaatt

SEQ ID NO: 159176 - DNA, 11 bp, Unknown
  misc_feature (1)..( 11): Result.004 file - promoters50/1022687
catttttattt

SEQ ID NO: 159177 - DNA, 11 bp, Unknown
  misc_feature (1)..( 11): Result.004 file - promoters50/1022687
gattattatta

SEQ ID NO: 159178 - DNA, 11 bp, Unknown
  misc_feature (1)..( 11): Result.004 file - promoters50/1022687
caatttgattc

SEQ ID NO: 159179 - DNA, 11 bp, Unknown
  misc_feature (1)..( 11): Result.004 file - promoters50/1022687
gattttgattt

SEQ ID NO: 159180 - DNA, 11 bp, Unknown
  misc_feature (1)..( 11): Result.004 file - promoters50/1022687
atggtttaatt

SEQ ID NO: 159181 - DNA, 11 bp, Unknown
  misc_feature (1)..( 11): Result.004 file - promoters50/1022687
tttgatgcata

SEQ ID NO: 159182 - DNA, 11 bp, Unknown
  misc_feature (1)..( 11): Result.004 file - promoters50/1022687
tttgattcctt

SEQ ID NO: 159183 - DNA, 11 bp, Unknown
  misc_feature (1)..( 11): Result.004 file - promoters50/1022687
tttgatttcct

SEQ ID NO: 159184 - DNA, 11 bp, Unknown
  misc_feature (1)..( 11): Result.004 file - promoters50/1022687
gttgatgtttt

SEQ ID NO: 159185 - DNA, 11 bp, Unknown
  misc_feature (1)..( 11): Result.004 file - promoters50/1022687
tttaatggttt

SEQ ID NO: 159186 - DNA, 11 bp, Unknown
  misc_feature (1)..( 11): Result.004 file - promoters50/1022687
tttaattgctt

SEQ ID NO: 159187 - DNA, 13 bp, Unknown
  misc_feature (1)..( 13): Result.004 file - promoters50/1022687
tttgccttttgac

SEQ ID NO: 159188 - DNA, 13 bp, Unknown
  misc_feature (1)..( 13): Result.004 file - promoters50/1022687
ctgttcttttgtt

SEQ ID NO: 159189 - DNA, 13 bp, Unknown
  misc_feature (1)..( 13): Result.004 file - promoters50/1022687
tttacctttttcc

SEQ ID NO: 159190 - DNA, 13 bp, Unknown
  misc_feature (1)..( 13): Result.004 file - promoters50/1022687
aatccgttttgtt

SEQ ID NO: 159191 - DNA, 13 bp, Unknown
  misc_feature (1)..( 13): Result.004 file - promoters50/1022687
cactccttttcta

SEQ ID NO: 159192 - DNA, 13 bp, Unknown
  misc_feature (1)..( 13): Result.004 file - promoters50/1022687
taattcttttgga

SEQ ID NO: 159193 - DNA, 12 bp, Unknown
  misc_feature (1)..( 12): Result.004 file - promoters50/1022687
agttgcatactg

SEQ ID NO: 159194 - DNA, 12 bp, Unknown
  misc_feature (1)..( 12): Result.004 file - promoters50/1022687
aattgcttactg

SEQ ID NO: 159195 - DNA, 12 bp, Unknown
  misc_feature (1)..( 12): Result.004 file - promoters50/1022687
atttgattcctt

SEQ ID NO: 159196 - DNA, 12 bp, Unknown
  misc_feature (1)..( 12): Result.004 file - promoters50/1022687
ttttaatttaaa

SEQ ID NO: 159197 - DNA, 12 bp, Unknown
  misc_feature (1)..( 12): Result.004 file - promoters50/1022687
ttttgatttcct

SEQ ID NO: 159198 - DNA, 12 bp, Unknown
  misc_feature (1)..( 12): Result.004 file - promoters50/1022728
ttttaatggttt

SEQ ID NO: 159199 - DNA, 8 bp, Unknown
  misc_feature (1)..( 8): Result.004 file - promoters50/1022728
agtacatg

SEQ ID NO: 159200 - DNA, 8 bp, Unknown
  misc_feature (1)..( 8): Result.004 file - promoters50/1022728
agtaaatg

SEQ ID NO: 159201 - DNA, 8 bp, Unknown
  misc_feature (1)..( 8): Result.004 file - promoters50/1022728
agtaaaga

SEQ ID NO: 159202 - DNA, 8 bp, Unknown
  misc_feature (1)..( 8): Result.004 file - promoters50/1022728
agtaaaga

SEQ ID NO: 159203 - DNA, 8 bp, Unknown
  misc_feature (1)..( 8): Result.004 file - promoters50/1022728
gatgtttt

SEQ ID NO: 159204 - DNA, 8 bp, Unknown
  misc_feature (1)..( 8): Result.004 file - promoters50/1022728
gatttttt

SEQ ID NO: 159205 - DNA, 8 bp, Unknown
  misc_feature (1)..( 8): Result.004 file - promoters50/1022728
aatttttg

SEQ ID NO: 159206 - DNA, 7 bp, Unknown
  misc_feature (1)..( 7): Result.004 file - promoters50/1022728
aaaaaca

SEQ ID NO: 159207 - DNA, 7 bp, Unknown
  misc_feature (1)..( 7): Result.004 file - promoters50/1022728
aaaaact

SEQ ID NO: 159208 - DNA, 7 bp, Unknown
  misc_feature (1)..( 7): Result.004 file - promoters50/1022728
aaagact

SEQ ID NO: 159209 - DNA, 7 bp, Unknown
  misc_feature (1)..( 7): Result.004 file - promoters50/1022728
ggaaaga

SEQ ID NO: 159210 - DNA, 7 bp, Unknown
  misc_feature (1)..( 7): Result.004 file - promoters50/1022728
agaaaga

SEQ ID NO: 159211 - DNA, 7 bp, Unknown
  misc_feature (1)..( 7): Result.004 file - promoters50/1022728
aaaaaga

SEQ ID NO: 159212 - DNA, 11 bp, Unknown
  misc_feature (1)..( 11): Result.004 file - promoters50/1022728
caattgtaata

SEQ ID NO: 159213 - DNA, 11 bp, Unknown
  misc_feature (1)..( 11): Result.004 file - promoters50/1022728
caattataata

SEQ ID NO: 159214 - DNA, 11 bp, Unknown
  misc_feature (1)..( 11): Result.004 file - promoters50/1022728
atattataatt

SEQ ID NO: 159215 - DNA, 9 bp, Unknown
  misc_feature (1)..( 9): Result.004 file - promoters50/1022728
gtgaaaata

SEQ ID NO: 159216 - DNA, 9 bp, Unknown
  misc_feature (1)..( 9): Result.004 file - promoters50/1022728
aagaaaata

SEQ ID NO: 159217 - DNA, 9 bp, Unknown
  misc_feature (1)..( 9): Result.004 file - promoters50/1022742
aagtaaaga

SEQ ID NO: 159218 - DNA, 7 bp, Unknown
  misc_feature (1)..( 7): Result.004 file - promoters50/1022742
cgttttt

SEQ ID NO: 159219 - DNA, 7 bp, Unknown
  misc_feature (1)..( 7): Result.004 file - promoters50/1022742
agttttt

SEQ ID NO: 159220 - DNA, 7 bp, Unknown
  misc_feature (1)..( 7): Result.004 file - promoters50/1022742
cgttttt

SEQ ID NO: 159221 - DNA, 8 bp, Unknown
  misc_feature (1)..( 8): Result.004 file - promoters50/1022742
ttttaaat

SEQ ID NO: 159222 - DNA, 8 bp, Unknown
  misc_feature (1)..( 8): Result.004 file - promoters50/1022742
ttttgaat

SEQ ID NO: 159223 - DNA, 8 bp, Unknown
  misc_feature (1)..( 8): Result.004 file - promoters50/1022742
ttttgagt

SEQ ID NO: 159224 - DNA, 9 bp, Unknown
  misc_feature (1)..( 9): Result.004 file - promoters50/1022742
aaataagcg

SEQ ID NO: 159225 - DNA, 9 bp, Unknown
  misc_feature (1)..( 9): Result.004 file - promoters50/1022742
aaaaaagaa

SEQ ID NO: 159226 - DNA, 9 bp, Unknown
  misc_feature (1)..( 9): Result.004 file - promoters50/1022748
caaaacgaa

SEQ ID NO: 159227 - DNA, 8 bp, Unknown
  misc_feature (1)..( 8): Result.004 file - promoters50/1022748
aaagtttt

SEQ ID NO: 159228 - DNA, 8 bp, Unknown
  misc_feature (1)..( 8): Result.004 file - promoters50/1022748
gaagtttg

SEQ ID NO: 159229 - DNA, 9 bp, Unknown
  misc_feature (1)..( 9): Result.004 file - promoters50/1022748
aaatgtttg

SEQ ID NO: 159230 - DNA, 9 bp, Unknown
  misc_feature (1)..( 9): Result.004 file - promoters50/1022748
caaagttgt

SEQ ID NO: 159231 - DNA, 9 bp, Unknown
  misc_feature (1)..( 9): Result.004 file - promoters50/1022748
caaattttt

SEQ ID NO: 159232 - DNA, 9 bp, Unknown
  misc_feature (1)..( 9): Result.004 file - promoters50/1022748
taatgtttc

SEQ ID NO: 159233 - DNA, 13 bp, Unknown
  misc_feature (1)..( 13): Result.004 file - promoters50/1022748
aattaaaaatggg

SEQ ID NO: 159234 - DNA, 13 bp, Unknown
  misc_feature (1)..( 13): Result.004 file - promoters50/1022748
ttttaaaaaaggg

SEQ ID NO: 159235 - DNA, 13 bp, Unknown
  misc_feature (1)..( 13): Result.004 file - promoters50/1022748
tattaaagtttgg

SEQ ID NO: 159236 - DNA, 13 bp, Unknown
  misc_feature (1)..( 13): Result.004 file - promoters50/1022748
aattaaagaccaa

SEQ ID NO: 159237 - DNA, 13 bp, Unknown
  misc_feature (1)..( 13): Result.004 file - promoters50/1022748
tggcccaaaaggg

SEQ ID NO: 159238 - DNA, 13 bp, Unknown
  misc_feature (1)..( 13): Result.004 file - promoters50/1022748
tattaagaaaggc

SEQ ID NO: 159239 - DNA, 13 bp, Unknown
  misc_feature (1)..( 13): Result.004 file - promoters50/1022748
agttcaaaaaaaa

SEQ ID NO: 159240 - DNA, 13 bp, Unknown
  misc_feature (1)..( 13): Result.004 file - promoters50/1022748
ttagttaaaaaag

SEQ ID NO: 159241 - DNA, 13 bp, Unknown
  misc_feature (1)..( 13): Result.004 file - promoters50/1022748
tttcttaaaaaat

SEQ ID NO: 159242 - DNA, 13 bp, Unknown
  misc_feature (1)..( 13): Result.004 file - promoters50/1022748
atatataaaaatt

SEQ ID NO: 159243 - DNA, 13 bp, Unknown
  misc_feature (1)..( 13): Result.004 file - promoters50/1022748
atatgtaaaacga

SEQ ID NO: 159244 - DNA, 13 bp, Unknown
  misc_feature (1)..( 13): Result.004 file - promoters50/1022748
gagaataaaaatt

SEQ ID NO: 159245 - DNA, 11 bp, Unknown
  misc_feature (1)..( 11): Result.004 file - promoters50/1022748
gaaaataaaaa

SEQ ID NO: 159246 - DNA, 11 bp, Unknown
  misc_feature (1)..( 11): Result.004 file - promoters50/1022748
atatataaaaa

SEQ ID NO: 159247 - DNA, 11 bp, Unknown
  misc_feature (1)..( 11): Result.004 file - promoters50/1022748
agtcaaacaaa

SEQ ID NO: 159248 - DNA, 11 bp, Unknown
  misc_feature (1)..( 11): Result.004 file - promoters50/1022748
gagaataaaaa

SEQ ID NO: 159249 - DNA, 11 bp, Unknown
  misc_feature (1)..( 11): Result.004 file - promoters50/1022748
tttcttaaaaa

SEQ ID NO: 159250 - DNA, 11 bp, Unknown
  misc_feature (1)..( 11): Result.004 file - promoters50/1022785
atatgtaaaac

SEQ ID NO: 159251 - DNA, 10 bp, Unknown
  misc_feature (1)..( 10): Result.004 file - promoters50/1022785
gcagaagaag

SEQ ID NO: 159252 - DNA, 10 bp, Unknown
  misc_feature (1)..( 10): Result.004 file - promoters50/1022785
gcagaggaag

SEQ ID NO: 159253 - DNA, 10 bp, Unknown
  misc_feature (1)..( 10): Result.004 file - promoters50/1022785
gcaaaagtct

SEQ ID NO: 159254 - DNA, 10 bp, Unknown
  misc_feature (1)..( 10): Result.004 file - promoters50/1022785
gcaaaaacca

SEQ ID NO: 159255 - DNA, 7 bp, Unknown
  misc_feature (1)..( 7): Result.004 file - promoters50/1022785
gtaagat

SEQ ID NO: 159256 - DNA, 7 bp, Unknown
  misc_feature (1)..( 7): Result.004 file - promoters50/1022785
gtaagag

SEQ ID NO: 159257 - DNA, 7 bp, Unknown
  misc_feature (1)..( 7): Result.004 file - promoters50/1022785
gtacgag

SEQ ID NO: 159258 - DNA, 14 bp, Unknown
  misc_feature (1)..( 14): Result.004 file - promoters50/1022785
ttgctaaaaccctt

SEQ ID NO: 159259 - DNA, 14 bp, Unknown
  misc_feature (1)..( 14): Result.004 file - promoters50/1022785
ttgataaaaccaaa

SEQ ID NO: 159260 - DNA, 14 bp, Unknown
  misc_feature (1)..( 14): Result.004 file - promoters50/1022793
ccaagtaaactaaa

SEQ ID NO: 159261 - DNA, 11 bp, Unknown
  misc_feature (1)..( 11): Result.004 file - promoters50/1022793
caattaggttt

SEQ ID NO: 159262 - DNA, 11 bp, Unknown
  misc_feature (1)..( 11): Result.004 file - promoters50/1022793
aaatgaggttt

SEQ ID NO: 159263 - DNA, 11 bp, Unknown
  misc_feature (1)..( 11): Result.004 file - promoters50/1022814
caactagttga

SEQ ID NO: 159264 - DNA, 11 bp, Unknown
  misc_feature (1)..( 11): Result.004 file - promoters50/1022814
tataaattata

SEQ ID NO: 159265 - DNA, 11 bp, Unknown
  misc_feature (1)..( 11): Result.004 file - promoters50/1022814
tataaaggaaa

SEQ ID NO: 159266 - DNA, 11 bp, Unknown
  misc_feature (1)..( 11): Result.004 file - promoters50/1022814
aataaataata

SEQ ID NO: 159267 - DNA, 11 bp, Unknown
  misc_feature (1)..( 11): Result.004 file - promoters50/1022814
ataaattatat

SEQ ID NO: 159268 - DNA, 11 bp, Unknown
  misc_feature (1)..( 11): Result.004 file - promoters50/1022814
aatacttatat

SEQ ID NO: 159269 - DNA, 11 bp, Unknown
  misc_feature (1)..( 11): Result.004 file - promoters50/1022824
ataaataatac

SEQ ID NO: 159270 - DNA, 10 bp, Unknown
  misc_feature (1)..( 10): Result.004 file - promoters50/1022824
ataaactctc

SEQ ID NO: 159271 - DNA, 10 bp, Unknown
  misc_feature (1)..( 10): Result.004 file - promoters50/1022824
ataaactaat

SEQ ID NO: 159272 - DNA, 10 bp, Unknown
  misc_feature (1)..( 10): Result.004 file - promoters50/1022824
aaaaactaaa

SEQ ID NO: 159273 - DNA, 10 bp, Unknown
  misc_feature (1)..( 10): Result.004 file - promoters50/1022824
aggtactaaa

SEQ ID NO: 159274 - DNA, 12 bp, Unknown
  misc_feature (1)..( 12): Result.004 file - promoters50/1022824
gcgttttcagtt

SEQ ID NO: 159275 - DNA, 12 bp, Unknown
  misc_feature (1)..( 12): Result.004 file - promoters50/1022824
ctcttttaagtt

SEQ ID NO: 159276 - DNA, 12 bp, Unknown
  misc_feature (1)..( 12): Result.004 file - promoters50/1022824
cccttttactta

SEQ ID NO: 159277 - DNA, 12 bp, Unknown
  misc_feature (1)..( 12): Result.004 file - promoters50/1022824
aagttttatgtc

SEQ ID NO: 159278 - DNA, 9 bp, Unknown
  misc_feature (1)..( 9): Result.004 file - promoters50/1022824
ttactcatt

SEQ ID NO: 159279 - DNA, 9 bp, Unknown
  misc_feature (1)..( 9): Result.004 file - promoters50/1022824
aaactaatt

SEQ ID NO: 159280 - DNA, 9 bp, Unknown
  misc_feature (1)..( 9): Result.004 file - promoters50/1022824
aaactaaaa

SEQ ID NO: 159281 - DNA, 9 bp, Unknown
  misc_feature (1)..( 9): Result.004 file - promoters50/1022932
gtactaaac

SEQ ID NO: 159282 - DNA, 9 bp, Unknown
  misc_feature (1)..( 9): Result.004 file - promoters50/1022932
cttaatttc

SEQ ID NO: 159283 - DNA, 9 bp, Unknown
  misc_feature (1)..( 9): Result.004 file - promoters50/1022932
tttacttta

SEQ ID NO: 159284 - DNA, 9 bp, Unknown
  misc_feature (1)..( 9): Result.004 file - promoters50/1022932
gttactttt

SEQ ID NO: 159285 - DNA, 9 bp, Unknown
  misc_feature (1)..( 9): Result.004 file - promoters50/1022932
cttaattat

SEQ ID NO: 159286 - DNA, 9 bp, Unknown
  misc_feature (1)..( 9): Result.004 file - promoters50/1022932
ccaaatttc

SEQ ID NO: 159287 - DNA, 9 bp, Unknown
  misc_feature (1)..( 9): Result.004 file - promoters50/1022979
gcaactttg

SEQ ID NO: 159288 - DNA, 9 bp, Unknown
  misc_feature (1)..( 9): Result.004 file - promoters50/1022979
acccatttt

SEQ ID NO: 159289 - DNA, 9 bp, Unknown
  misc_feature (1)..( 9): Result.004 file - promoters50/1022979
taacatttt

SEQ ID NO: 159290 - DNA, 9 bp, Unknown
  misc_feature (1)..( 9): Result.004 file - promoters50/1022979
taaaatttt

SEQ ID NO: 159291 - DNA, 9 bp, Unknown
  misc_feature (1)..( 9): Result.004 file - promoters50/1022979
tttttctct

SEQ ID NO: 159292 - DNA, 9 bp, Unknown
  misc_feature (1)..( 9): Result.004 file - promoters50/1022979
tttttctct

SEQ ID NO: 159293 - DNA, 9 bp, Unknown
  misc_feature (1)..( 9): Result.004 file - promoters50/1022983
ggtttctcc

SEQ ID NO: 159294 - DNA, 10 bp, Unknown
  misc_feature (1)..( 10): Result.004 file - promoters50/1022983
atttcttatt

SEQ ID NO: 159295 - DNA, 10 bp, Unknown
  misc_feature (1)..( 10): Result.004 file - promoters50/1022983
atttctccta

SEQ ID NO: 159296 - DNA, 10 bp, Unknown
  misc_feature (1)..( 10): Result.004 file - promoters50/1022983
ttttattaca

SEQ ID NO: 159297 - DNA, 10 bp, Unknown
  misc_feature (1)..( 10): Result.004 file - promoters50/1022983
atttcatatg

SEQ ID NO: 159298 - DNA, 10 bp, Unknown
  misc_feature (1)..( 10): Result.004 file - promoters50/1022983
gtttaattct

SEQ ID NO: 159299 - DNA, 10 bp, Unknown
  misc_feature (1)..( 10): Result.004 file - promoters50/1022987
gtttaaataa

SEQ ID NO: 159300 - DNA, 10 bp, Unknown
  misc_feature (1)..( 10): Result.004 file - promoters50/1022987
agtcttgtga

SEQ ID NO: 159301 - DNA, 10 bp, Unknown
  misc_feature (1)..( 10): Result.004 file - promoters50/1022987
tgtcttgttc

SEQ ID NO: 159302 - DNA, 10 bp, Unknown
  misc_feature (1)..( 10): Result.004 file - promoters50/1022987
agtctttcag

SEQ ID NO: 159303 - DNA, 11 bp, Unknown
  misc_feature (1)..( 11): Result.004 file - promoters50/1022987
taaacttgtgt

SEQ ID NO: 159304 - DNA, 11 bp, Unknown
  misc_feature (1)..( 11): Result.004 file - promoters50/1022987
ccaacttcttc

SEQ ID NO: 159305 - DNA, 11 bp, Unknown
  misc_feature (1)..( 11): Result.004 file - promoters50/1023029
tgtcgttccta

SEQ ID NO: 159306 - DNA, 7 bp, Unknown
  misc_feature (1)..( 7): Result.004 file - promoters50/1023029
cgtatac

SEQ ID NO: 159307 - DNA, 7 bp, Unknown
  misc_feature (1)..( 7): Result.004 file - promoters50/1023029
cgtatat

SEQ ID NO: 159308 - DNA, 7 bp, Unknown
  misc_feature (1)..( 7): Result.004 file - promoters50/1023029
agtatat

SEQ ID NO: 159309 - DNA, 9 bp, Unknown
  misc_feature (1)..( 9): Result.004 file - promoters50/1023029
ataggttac

SEQ ID NO: 159310 - DNA, 9 bp, Unknown
  misc_feature (1)..( 9): Result.004 file - promoters50/1023029
atatgttgc

SEQ ID NO: 159311 - DNA, 9 bp, Unknown
  misc_feature (1)..( 9): Result.004 file - promoters50/1023029
atagtttac

SEQ ID NO: 159312 - DNA, 9 bp, Unknown
  misc_feature (1)..( 9): Result.004 file - promoters50/1023029
gatatttta

SEQ ID NO: 159313 - DNA, 9 bp, Unknown
  misc_feature (1)..( 9): Result.004 file - promoters50/1023029
taaatttta

SEQ ID NO: 159314 - DNA, 9 bp, Unknown
  misc_feature (1)..( 9): Result.004 file - promoters50/1023029
ataatttga

SEQ ID NO: 159315 - DNA, 11 bp, Unknown
  misc_feature (1)..( 11): Result.004 file - promoters50/1023029
atatatatgaa

SEQ ID NO: 159316 - DNA, 11 bp, Unknown
  misc_feature (1)..( 11): Result.004 file - promoters50/1023029
aagtatatgaa

SEQ ID NO: 159317 - DNA, 11 bp, Unknown
  misc_feature (1)..( 11): Result.004 file - promoters50/1023029
aagcatattta

SEQ ID NO: 159318 - DNA, 9 bp, Unknown
  misc_feature (1)..( 9): Result.004 file - promoters50/1023029
caatataaa

SEQ ID NO: 159319 - DNA, 9 bp, Unknown
  misc_feature (1)..( 9): Result.004 file - promoters50/1023029
caatataaa

SEQ ID NO: 159320 - DNA, 9 bp, Unknown
  misc_feature (1)..( 9): Result.004 file - promoters50/1023029
ctatataac

SEQ ID NO: 159321 - DNA, 10 bp, Unknown
  misc_feature (1)..( 10): Result.004 file - promoters50/1023029
gatacttaat

SEQ ID NO: 159322 - DNA, 10 bp, Unknown
  misc_feature (1)..( 10): Result.004 file - promoters50/1023029
tttactcaat

SEQ ID NO: 159323 - DNA, 10 bp, Unknown
  misc_feature (1)..( 10): Result.004 file - promoters50/1023029
tttactcacc

SEQ ID NO: 159324 - DNA, 9 bp, Unknown
  misc_feature (1)..( 9): Result.004 file - promoters50/1023029
gaacatatt

SEQ ID NO: 159325 - DNA, 9 bp, Unknown
  misc_feature (1)..( 9): Result.004 file - promoters50/1023029
aagcatatt

SEQ ID NO: 159326 - DNA, 9 bp, Unknown
  misc_feature (1)..( 9): Result.004 file - promoters50/1023029
aagtatatg

SEQ ID NO: 159327 - DNA, 8 bp, Unknown
  misc_feature (1)..( 8): Result.004 file - promoters50/1023029
tttaaatt

SEQ ID NO: 159328 - DNA, 8 bp, Unknown
  misc_feature (1)..( 8): Result.004 file - promoters50/1023029
tttatatt

SEQ ID NO: 159329 - DNA, 8 bp, Unknown
  misc_feature (1)..( 8): Result.004 file - promoters50/1023037
tttgtata

SEQ ID NO: 159330 - DNA, 9 bp, Unknown
  misc_feature (1)..( 9): Result.004 file - promoters50/1023037
gggcatatt

SEQ ID NO: 159331 - DNA, 9 bp, Unknown
  misc_feature (1)..( 9): Result.004 file - promoters50/1023037
gggtatata

SEQ ID NO: 159332 - DNA, 9 bp, Unknown
  misc_feature (1)..( 9): Result.004 file - promoters50/1023037
tggtagata

SEQ ID NO: 159333 - DNA, 11 bp, Unknown
  misc_feature (1)..( 11): Result.004 file - promoters50/1023037
acagtttataa

SEQ ID NO: 159334 - DNA, 11 bp, Unknown
  misc_feature (1)..( 11): Result.004 file - promoters50/1023037
agagtatatta

SEQ ID NO: 159335 - DNA, 11 bp, Unknown
  misc_feature (1)..( 11): Result.004 file - promoters50/1023037
acaatttataa

SEQ ID NO: 159336 - DNA, 9 bp, Unknown
  misc_feature (1)..( 9): Result.004 file - promoters50/1023037
tgattcact

SEQ ID NO: 159337 - DNA, 9 bp, Unknown
  misc_feature (1)..( 9): Result.004 file - promoters50/1023037
aaattcact

SEQ ID NO: 159338 - DNA, 9 bp, Unknown
  misc_feature (1)..( 9): Result.004 file - promoters50/1023062
aaatgcacc

SEQ ID NO: 159339 - DNA, 11 bp, Unknown
  misc_feature (1)..( 11): Result.004 file - promoters50/1023062
taaaaaatgtt

SEQ ID NO: 159340 - DNA, 11 bp, Unknown
  misc_feature (1)..( 11): Result.004 file - promoters50/1023062
tgaaaaattca

SEQ ID NO: 159341 - DNA, 11 bp, Unknown
  misc_feature (1)..( 11): Result.004 file - promoters50/1023062
ataaaaaaatc

SEQ ID NO: 159342 - DNA, 12 bp, Unknown
  misc_feature (1)..( 12): Result.004 file - promoters50/1023062
ctaaagaatttt

SEQ ID NO: 159343 - DNA, 12 bp, Unknown
  misc_feature (1)..( 12): Result.004 file - promoters50/1023062
ccaaaaacgtta

SEQ ID NO: 159344 - DNA, 12 bp, Unknown
  misc_feature (1)..( 12): Result.004 file - promoters50/1023062
gaaaataataat

SEQ ID NO: 159345 - DNA, 12 bp, Unknown
  misc_feature (1)..( 12): Result.004 file - promoters50/1023062
ctacagaatggg

SEQ ID NO: 159346 - DNA, 10 bp, Unknown
  misc_feature (1)..( 10): Result.004 file - promoters50/1023062
gtttcttatc

SEQ ID NO: 159347 - DNA, 10 bp, Unknown
  misc_feature (1)..( 10): Result.004 file - promoters50/1023062
atttattatc

SEQ ID NO: 159348 - DNA, 10 bp, Unknown
  misc_feature (1)..( 10): Result.004 file - promoters50/1023062
atttcttttc

SEQ ID NO: 159349 - DNA, 10 bp, Unknown
  misc_feature (1)..( 10): Result.004 file - promoters50/1023062
tcttcttacg

SEQ ID NO: 159350 - DNA, 10 bp, Unknown
  misc_feature (1)..( 10): Result.004 file - promoters50/1023062
ttttctttgt

SEQ ID NO: 159351 - DNA, 11 bp, Unknown
  misc_feature (1)..( 11): Result.004 file - promoters50/1023079
ctttacttcaa

SEQ ID NO: 159352 - DNA, 8 bp, Unknown
  misc_feature (1)..( 8): Result.004 file - promoters50/1023079
tttgtttg

SEQ ID NO: 159353 - DNA, 8 bp, Unknown
  misc_feature (1)..( 8): Result.004 file - promoters50/1023079
tttcttta

SEQ ID NO: 159354 - DNA, 8 bp, Unknown
  misc_feature (1)..( 8): Result.004 file - promoters50/1023079
tttgattg

SEQ ID NO: 159355 - DNA, 8 bp, Unknown
  misc_feature (1)..( 8): Result.004 file - promoters50/1023079
aatcttta

SEQ ID NO: 159356 - DNA, 8 bp, Unknown
  misc_feature (1)..( 8): Result.004 file - promoters50/1023079
tttgtttg

SEQ ID NO: 159357 - DNA, 14 bp, Unknown
  misc_feature (1)..( 14): Result.004 file - promoters50/1023079
gatctaacggctaa

SEQ ID NO: 159358 - DNA, 14 bp, Unknown
  misc_feature (1)..( 14): Result.004 file - promoters50/1023079
gatttaatttaaaa

SEQ ID NO: 159359 - DNA, 14 bp, Unknown
  misc_feature (1)..( 14): Result.004 file - promoters50/1023079
gttttaattctttg

SEQ ID NO: 159360 - DNA, 14 bp, Unknown
  misc_feature (1)..( 14): Result.004 file - promoters50/1023079
tgttttattccaat

SEQ ID NO: 159361 - DNA, 14 bp, Unknown
  misc_feature (1)..( 14): Result.004 file - promoters50/1023089
aaattaattaaatt

SEQ ID NO: 159362 - DNA, 11 bp, Unknown
  misc_feature (1)..( 11): Result.004 file - promoters50/1023089
ctactaaaatc

SEQ ID NO: 159363 - DNA, 11 bp, Unknown
  misc_feature (1)..( 11): Result.004 file - promoters50/1023089
atacaaaaatt

SEQ ID NO: 159364 - DNA, 11 bp, Unknown
  misc_feature (1)..( 11): Result.004 file - promoters50/1023089
atacaacaatt

SEQ ID NO: 159365 - DNA, 11 bp, Unknown
  misc_feature (1)..( 11): Result.004 file - promoters50/1023089
gattaatacat

SEQ ID NO: 159366 - DNA, 11 bp, Unknown
  misc_feature (1)..( 11): Result.004 file - promoters50/1023089
gattaatactt

SEQ ID NO: 159367 - DNA, 11 bp, Unknown
  misc_feature (1)..( 11): Result.004 file - promoters50/1023089
cacaaattctt

SEQ ID NO: 159368 - DNA, 10 bp, Unknown
  misc_feature (1)..( 10): Result.004 file - promoters50/1023089
atacattcta

SEQ ID NO: 159369 - DNA, 10 bp, Unknown
  misc_feature (1)..( 10): Result.004 file - promoters50/1023089
ataaattctt

SEQ ID NO: 159370 - DNA, 10 bp, Unknown
  misc_feature (1)..( 10): Result.004 file - promoters50/1023089
ataaatactt

SEQ ID NO: 159371 - DNA, 12 bp, Unknown
  misc_feature (1)..( 12): Result.004 file - promoters50/1023089
ataaatttgata

SEQ ID NO: 159372 - DNA, 12 bp, Unknown
  misc_feature (1)..( 12): Result.004 file - promoters50/1023089
tgtattttgatt

SEQ ID NO: 159373 - DNA, 12 bp, Unknown
  misc_feature (1)..( 12): Result.004 file - promoters50/1023089
ataaaattgata

SEQ ID NO: 159374 - DNA, 11 bp, Unknown
  misc_feature (1)..( 11): Result.004 file - promoters50/1023089
ataataaactc

SEQ ID NO: 159375 - DNA, 11 bp, Unknown
  misc_feature (1)..( 11): Result.004 file - promoters50/1023089
ataaaaaatcg

SEQ ID NO: 159376 - DNA, 11 bp, Unknown
  misc_feature (1)..( 11): Result.004 file - promoters50/1023124
aaaaaaaaaat

SEQ ID NO: 159377 - DNA, 16 bp, Unknown
  misc_feature (1)..( 16): Result.004 file - promoters50/1023124
ttgtcaaaaaaaaaaa

SEQ ID NO: 159378 - DNA, 16 bp, Unknown
  misc_feature (1)..( 16): Result.004 file - promoters50/1023124
attttaaaaaaaaaaa

SEQ ID NO: 159379 - DNA, 16 bp, Unknown
  misc_feature (1)..( 16): Result.004 file - promoters50/1023124
attttaaaacaatgaa

SEQ ID NO: 159380 - DNA, 16 bp, Unknown
  misc_feature (1)..( 16): Result.004 file - promoters50/1023124
cttttcaaatctgcag

SEQ ID NO: 159381 - DNA, 16 bp, Unknown
  misc_feature (1)..( 16): Result.004 file - promoters50/1023124
atcatcaaatttgttt

SEQ ID NO: 159382 - DNA, 16 bp, Unknown
  misc_feature (1)..( 16): Result.004 file - promoters50/1023128
cttatcatgaataatg

SEQ ID NO: 159383 - DNA, 9 bp, Unknown
  misc_feature (1)..( 9): Result.004 file - promoters50/1023128
aataaaaaa

SEQ ID NO: 159384 - DNA, 9 bp, Unknown
  misc_feature (1)..( 9): Result.004 file - promoters50/1023128
catataaag

SEQ ID NO: 159385 - DNA, 9 bp, Unknown
  misc_feature (1)..( 9): Result.004 file - promoters50/1023128
gacaaaaaa

SEQ ID NO: 159386 - DNA, 9 bp, Unknown
  misc_feature (1)..( 9): Result.004 file - promoters50/1023128
tatataact

SEQ ID NO: 159387 - DNA, 9 bp, Unknown
  misc_feature (1)..( 9): Result.004 file - promoters50/1023143
tatgtaata

SEQ ID NO: 159388 - DNA, 7 bp, Unknown
  misc_feature (1)..( 7): Result.004 file - promoters50/1023143
aattatg

SEQ ID NO: 159389 - DNA, 7 bp, Unknown
  misc_feature (1)..( 7): Result.004 file - promoters50/1023143
tattatg

SEQ ID NO: 159390 - DNA, 7 bp, Unknown
  misc_feature (1)..( 7): Result.004 file - promoters50/1023155
tattata

SEQ ID NO: 159391 - DNA, 7 bp, Unknown
  misc_feature (1)..( 7): Result.004 file - promoters50/1023155
attcaag

SEQ ID NO: 159392 - DNA, 7 bp, Unknown
  misc_feature (1)..( 7): Result.004 file - promoters50/1023155
attcaaa

SEQ ID NO: 159393 - DNA, 7 bp, Unknown
  misc_feature (1)..( 7): Result.004 file - promoters50/1023155
cttcaaa

SEQ ID NO: 159394 - DNA, 10 bp, Unknown
  misc_feature (1)..( 10): Result.004 file - promoters50/1023155
tttctccata

SEQ ID NO: 159395 - DNA, 10 bp, Unknown
  misc_feature (1)..( 10): Result.004 file - promoters50/1023155
tttttccgcc

SEQ ID NO: 159396 - DNA, 10 bp, Unknown
  misc_feature (1)..( 10): Result.004 file - promoters50/1023185
cttctcaata

SEQ ID NO: 159397 - DNA, 9 bp, Unknown
  misc_feature (1)..( 9): Result.004 file - promoters50/1023185
aatgatctt

SEQ ID NO: 159398 - DNA, 9 bp, Unknown
  misc_feature (1)..( 9): Result.004 file - promoters50/1023185
aatgaactt

SEQ ID NO: 159399 - DNA, 9 bp, Unknown
  misc_feature (1)..( 9): Result.004 file - promoters50/1023185
gatgaaccc

SEQ ID NO: 159400 - DNA, 8 bp, Unknown
  misc_feature (1)..( 8): Result.004 file - promoters50/1023185
acacattg

SEQ ID NO: 159401 - DNA, 8 bp, Unknown
  misc_feature (1)..( 8): Result.004 file - promoters50/1023185
acacattt

SEQ ID NO: 159402 - DNA, 8 bp, Unknown
  misc_feature (1)..( 8): Result.004 file - promoters50/1023210
tcacattt

SEQ ID NO: 159403 - DNA, 8 bp, Unknown
  misc_feature (1)..( 8): Result.004 file - promoters50/1023210
ttctggcc

SEQ ID NO: 159404 - DNA, 8 bp, Unknown
  misc_feature (1)..( 8): Result.004 file - promoters50/1023210
ttcttgcc

SEQ ID NO: 159405 - DNA, 8 bp, Unknown
  misc_feature (1)..( 8): Result.004 file - promoters50/1023210
gtcttgcg

SEQ ID NO: 159406 - DNA, 10 bp, Unknown
  misc_feature (1)..( 10): Result.004 file - promoters50/1023210
tacgtgtcaa

SEQ ID NO: 159407 - DNA, 10 bp, Unknown
  misc_feature (1)..( 10): Result.004 file - promoters50/1023210
tacgtgtcaa

SEQ ID NO: 159408 - DNA, 10 bp, Unknown
  misc_feature (1)..( 10): Result.004 file - promoters50/1023210
cacgtgtcat

SEQ ID NO: 159409 - DNA, 20 bp, Unknown
  misc_feature (1)..( 20): Result.004 file - promoters50/1023210
ttggttattgcttcaccgcc

SEQ ID NO: 159410 - DNA, 20 bp, Unknown
  misc_feature (1)..( 20): Result.004 file - promoters50/1023210
ttggctattgcttccacgcc

SEQ ID NO: 159411 - DNA, 20 bp, Unknown
  misc_feature (1)..( 20): Result.004 file - promoters50/1023210
ttagctattgcttcaccgcc

SEQ ID NO: 159412 - DNA, 15 bp, Unknown
  misc_feature (1)..( 15): Result.004 file - promoters50/1023210
cgccttagctttctc

SEQ ID NO: 159413 - DNA, 15 bp, Unknown
  misc_feature (1)..( 15): Result.004 file - promoters50/1023210
cgccttagctttctc

SEQ ID NO: 159414 - DNA, 15 bp, Unknown
  misc_feature (1)..( 15): Result.004 file - promoters50/1023210
cgccttagctttctc

SEQ ID NO: 159415 - DNA, 22 bp, Unknown
  misc_feature (1)..( 22): Result.004 file - promoters50/1023210
gaccgactcgtcctcgtctttt

SEQ ID NO: 159416 - DNA, 22 bp, Unknown
  misc_feature (1)..( 22): Result.004 file - promoters50/1023210
gaccgagtcgtcctcgtctttt

SEQ ID NO: 159417 - DNA, 22 bp, Unknown
  misc_feature (1)..( 22): Result.004 file - promoters50/1023210
gacctagtcgtcctcgtctttt

SEQ ID NO: 159418 - DNA, 9 bp, Unknown
  misc_feature (1)..( 9): Result.004 file - promoters50/1023210
caataaaac

SEQ ID NO: 159419 - DNA, 9 bp, Unknown
  misc_feature (1)..( 9): Result.004 file - promoters50/1023210
caaaaaaaa

SEQ ID NO: 159420 - DNA, 9 bp, Unknown
  misc_feature (1)..( 9): Result.004 file - promoters50/1023210
gaaaacaac

SEQ ID NO: 159421 - DNA, 6 bp, Unknown
  misc_feature (1)..( 6): Result.004 file - promoters50/1023210
aaaaca

SEQ ID NO: 159422 - DNA, 6 bp, Unknown
  misc_feature (1)..( 6): Result.004 file - promoters50/1023210
aaaaca

SEQ ID NO: 159423 - DNA, 6 bp, Unknown
  misc_feature (1)..( 6): Result.004 file - promoters50/1023210
aaaaca

SEQ ID NO: 159424 - DNA, 19 bp, Unknown
  misc_feature (1)..( 19): Result.004 file - promoters50/1023210
ttcttcttctataaattaa

SEQ ID NO: 159425 - DNA, 19 bp, Unknown
  misc_feature (1)..( 19): Result.004 file - promoters50/1023210
ttcttcttctataaaacaa

SEQ ID NO: 159426 - DNA, 19 bp, Unknown
  misc_feature (1)..( 19): Result.004 file - promoters50/1023210
ttttgcttctataaatcaa

SEQ ID NO: 159427 - DNA, 19 bp, Unknown
  misc_feature (1)..( 19): Result.004 file - promoters50/1023221
gatctttgccggaaaacaa

SEQ ID NO: 159428 - DNA, 10 bp, Unknown
  misc_feature (1)..( 10): Result.004 file - promoters50/1023221
ccaactagaa

SEQ ID NO: 159429 - DNA, 10 bp, Unknown
  misc_feature (1)..( 10): Result.004 file - promoters50/1023221
acaagtagaa

SEQ ID NO: 159430 - DNA, 10 bp, Unknown
  misc_feature (1)..( 10): Result.004 file - promoters50/1023221
accactagac

SEQ ID NO: 159431 - DNA, 10 bp, Unknown
  misc_feature (1)..( 10): Result.004 file - promoters50/1023221
acaagtaatc

SEQ ID NO: 159432 - DNA, 10 bp, Unknown
  misc_feature (1)..( 10): Result.004 file - promoters50/1023221
acaagtcttc

SEQ ID NO: 159433 - DNA, 10 bp, Unknown
  misc_feature (1)..( 10): Result.004 file - promoters50/1023237
tggagtagaa

SEQ ID NO: 159434 - DNA, 15 bp, Unknown
  misc_feature (1)..( 15): Result.004 file - promoters50/1023237
ttttgttgtttcttc

SEQ ID NO: 159435 - DNA, 15 bp, Unknown
  misc_feature (1)..( 15): Result.004 file - promoters50/1023237
tcttgttgtttacgt

SEQ ID NO: 159436 - DNA, 15 bp, Unknown
  misc_feature (1)..( 15): Result.004 file - promoters50/1023237
ttttgtttgtttgtg

SEQ ID NO: 159437 - DNA, 15 bp, Unknown
  misc_feature (1)..( 15): Result.004 file - promoters50/1023237
cttggttccagaagc

SEQ ID NO: 159438 - DNA, 15 bp, Unknown
  misc_feature (1)..( 15): Result.004 file - promoters50/1023237
tgtgtttcttttttc

SEQ ID NO: 159439 - DNA, 15 bp, Unknown
  misc_feature (1)..( 15): Result.004 file - promoters50/1023237
tgtttttctttcttt

SEQ ID NO: 159440 - DNA, 13 bp, Unknown
  misc_feature (1)..( 13): Result.004 file - promoters50/1023237
gagaaacttgtaa

SEQ ID NO: 159441 - DNA, 13 bp, Unknown
  misc_feature (1)..( 13): Result.004 file - promoters50/1023237
gagaaataaatga

SEQ ID NO: 159442 - DNA, 13 bp, Unknown
  misc_feature (1)..( 13): Result.004 file - promoters50/1023237
gagaaaatttgat

SEQ ID NO: 159443 - DNA, 13 bp, Unknown
  misc_feature (1)..( 13): Result.004 file - promoters50/1023237
cagaaaaatggtt

SEQ ID NO: 159444 - DNA, 13 bp, Unknown
  misc_feature (1)..( 13): Result.004 file - promoters50/1023237
aagaacattggat

SEQ ID NO: 159445 - DNA, 13 bp, Unknown
  misc_feature (1)..( 13): Result.004 file - promoters50/1023237
atgaaaaaggttt

SEQ ID NO: 159446 - DNA, 16 bp, Unknown
  misc_feature (1)..( 16): Result.004 file - promoters50/1023237
aaatgttttgttgttt

SEQ ID NO: 159447 - DNA, 16 bp, Unknown
  misc_feature (1)..( 16): Result.004 file - promoters50/1023237
aaaagttttgcaagaa

SEQ ID NO: 159448 - DNA, 16 bp, Unknown
  misc_feature (1)..( 16): Result.004 file - promoters50/1023237
aaggtttttgtttgtt

SEQ ID NO: 159449 - DNA, 16 bp, Unknown
  misc_feature (1)..( 16): Result.004 file - promoters50/1023237
atatgtttttctttct

SEQ ID NO: 159450 - DNA, 16 bp, Unknown
  misc_feature (1)..( 16): Result.004 file - promoters50/1023237
gtatggttttaaatgt

SEQ ID NO: 159451 - DNA, 16 bp, Unknown
  misc_feature (1)..( 16): Result.004 file - promoters50/1023237
ttatggtcgtttaatg

SEQ ID NO: 159452 - DNA, 16 bp, Unknown
  misc_feature (1)..( 16): Result.004 file - promoters50/1023237
gttgattttgaaagaa

SEQ ID NO: 159453 - DNA, 7 bp, Unknown
  misc_feature (1)..( 7): Result.004 file - promoters50/1023237
tttttaa

SEQ ID NO: 159454 - DNA, 7 bp, Unknown
  misc_feature (1)..( 7): Result.004 file - promoters50/1023237
tttttat

SEQ ID NO: 159455 - DNA, 7 bp, Unknown
  misc_feature (1)..( 7): Result.004 file - promoters50/1023237
cttttaa

SEQ ID NO: 159456 - DNA, 8 bp, Unknown
  misc_feature (1)..( 8): Result.004 file - promoters50/1023237
tttcttaa

SEQ ID NO: 159457 - DNA, 8 bp, Unknown
  misc_feature (1)..( 8): Result.004 file - promoters50/1023237
attgttat

SEQ ID NO: 159458 - DNA, 8 bp, Unknown
  misc_feature (1)..( 8): Result.004 file - promoters50/1023270
cttctaag

SEQ ID NO: 159459 - DNA, 13 bp, Unknown
  misc_feature (1)..( 13): Result.004 file - promoters50/1023270
tggatttcttttt

SEQ ID NO: 159460 - DNA, 13 bp, Unknown
  misc_feature (1)..( 13): Result.004 file - promoters50/1023270
gggttttgtttta

SEQ ID NO: 159461 - DNA, 13 bp, Unknown
  misc_feature (1)..( 13): Result.004 file - promoters50/1023270
caactttgtttct

SEQ ID NO: 159462 - DNA, 13 bp, Unknown
  misc_feature (1)..( 13): Result.004 file - promoters50/1023270
tatttttgtggat

SEQ ID NO: 159463 - DNA, 13 bp, Unknown
  misc_feature (1)..( 13): Result.004 file - promoters50/1023270
ttgtgaagtttta

SEQ ID NO: 159464 - DNA, 13 bp, Unknown
  misc_feature (1)..( 13): Result.004 file - promoters50/1023270
caaccttgtaatg

SEQ ID NO: 159465 - DNA, 8 bp, Unknown
  misc_feature (1)..( 8): Result.004 file - promoters50/1023270
ctataatt

SEQ ID NO: 159466 - DNA, 8 bp, Unknown
  misc_feature (1)..( 8): Result.004 file - promoters50/1023270
gtattatt

SEQ ID NO: 159467 - DNA, 8 bp, Unknown
  misc_feature (1)..( 8): Result.004 file - promoters50/1023270
atataatc

SEQ ID NO: 159468 - DNA, 8 bp, Unknown
  misc_feature (1)..( 8): Result.004 file - promoters50/1023270
agattatt

SEQ ID NO: 159469 - DNA, 8 bp, Unknown
  misc_feature (1)..( 8): Result.004 file - promoters50/1023270
ataaaata

SEQ ID NO: 159470 - DNA, 10 bp, Unknown
  misc_feature (1)..( 10): Result.004 file - promoters50/1023270
gttgaactca

SEQ ID NO: 159471 - DNA, 10 bp, Unknown
  misc_feature (1)..( 10): Result.004 file - promoters50/1023270
tttgaacccc

SEQ ID NO: 159472 - DNA, 10 bp, Unknown
  misc_feature (1)..( 10): Result.004 file - promoters50/1023270
gttaaacgtt

SEQ ID NO: 159473 - DNA, 11 bp, Unknown
  misc_feature (1)..( 11): Result.004 file - promoters50/1023270
tttggaataat

SEQ ID NO: 159474 - DNA, 11 bp, Unknown
  misc_feature (1)..( 11): Result.004 file - promoters50/1023297
ttttaaatgtt

SEQ ID NO: 159475 - DNA, 8 bp, Unknown
  misc_feature (1)..( 8): Result.004 file - promoters50/1023297
ttttgtct

SEQ ID NO: 159476 - DNA, 8 bp, Unknown
  misc_feature (1)..( 8): Result.004 file - promoters50/1023297
atttctct

SEQ ID NO: 159477 - DNA, 8 bp, Unknown
  misc_feature (1)..( 8): Result.004 file - promoters50/1023297
ttttgttt

SEQ ID NO: 159478 - DNA, 8 bp, Unknown
  misc_feature (1)..( 8): Result.004 file - promoters50/1023297
ttttttct

SEQ ID NO: 159479 - DNA, 8 bp, Unknown
  misc_feature (1)..( 8): Result.004 file - promoters50/1023297
tcttctct

SEQ ID NO: 159480 - DNA, 8 bp, Unknown
  misc_feature (1)..( 8): Result.004 file - promoters50/1023299
atttatgt

SEQ ID NO: 159481 - DNA, 11 bp, Unknown
  misc_feature (1)..( 11): Result.004 file - promoters50/1023299
atggaaacaca

SEQ ID NO: 159482 - DNA, 11 bp, Unknown
  misc_feature (1)..( 11): Result.004 file - promoters50/1023299
ctataaataca

SEQ ID NO: 159483 - DNA, 11 bp, Unknown
  misc_feature (1)..( 11): Result.004 file - promoters50/1023299
ctataaatatc

SEQ ID NO: 159484 - DNA, 11 bp, Unknown
  misc_feature (1)..( 11): Result.004 file - promoters50/1023299
ctttaaatacc

SEQ ID NO: 159485 - DNA, 11 bp, Unknown
  misc_feature (1)..( 11): Result.004 file - promoters50/1023299
atataaacgct

SEQ ID NO: 159486 - DNA, 11 bp, Unknown
  misc_feature (1)..( 11): Result.004 file - promoters50/1023324
ttataaaacat

SEQ ID NO: 159487 - DNA, 9 bp, Unknown
  misc_feature (1)..( 9): Result.004 file - promoters50/1023324
atttcaaag

SEQ ID NO: 159488 - DNA, 9 bp, Unknown
  misc_feature (1)..( 9): Result.004 file - promoters50/1023324
gattcaaag

SEQ ID NO: 159489 - DNA, 9 bp, Unknown
  misc_feature (1)..( 9): Result.004 file - promoters50/1023324
atttaaaag

SEQ ID NO: 159490 - DNA, 7 bp, Unknown
  misc_feature (1)..( 7): Result.004 file - promoters50/1023324
atacatt

SEQ ID NO: 159491 - DNA, 7 bp, Unknown
  misc_feature (1)..( 7): Result.004 file - promoters50/1023324
ataaatt

SEQ ID NO: 159492 - DNA, 7 bp, Unknown
  misc_feature (1)..( 7): Result.004 file - promoters50/1023339
ataaata

SEQ ID NO: 159493 - DNA, 10 bp, Unknown
  misc_feature (1)..( 10): Result.004 file - promoters50/1023339
gaagatcatc

SEQ ID NO: 159494 - DNA, 10 bp, Unknown
  misc_feature (1)..( 10): Result.004 file - promoters50/1023339
taagaacatt

SEQ ID NO: 159495 - DNA, 10 bp, Unknown
  misc_feature (1)..( 10): Result.004 file - promoters50/1023339
gaagatgatg

SEQ ID NO: 159496 - DNA, 10 bp, Unknown
  misc_feature (1)..( 10): Result.004 file - promoters50/1023339
acagaaaatt

SEQ ID NO: 159497 - DNA, 10 bp, Unknown
  misc_feature (1)..( 10): Result.004 file - promoters50/1023339
atagagaata

SEQ ID NO: 159498 - DNA, 10 bp, Unknown
  misc_feature (1)..( 10): Result.004 file - promoters50/1023397
caagaacgag

SEQ ID NO: 159499 - DNA, 15 bp, Unknown
  misc_feature (1)..( 15): Result.004 file - promoters50/1023397
attctttcttttttt

SEQ ID NO: 159500 - DNA, 15 bp, Unknown
  misc_feature (1)..( 15): Result.004 file - promoters50/1023397
cttctttttggttaa

SEQ ID NO: 159501 - DNA, 15 bp, Unknown
  misc_feature (1)..( 15): Result.004 file - promoters50/1023397
tttctttttttggtt

SEQ ID NO: 159502 - DNA, 15 bp, Unknown
  misc_feature (1)..( 15): Result.004 file - promoters50/1023397
attcttaacaacgtt

SEQ ID NO: 159503 - DNA, 15 bp, Unknown
  misc_feature (1)..( 15): Result.004 file - promoters50/1023397
cttcttcttcgtcaa

SEQ ID NO: 159504 - DNA, 15 bp, Unknown
  misc_feature (1)..( 15): Result.004 file - promoters50/1023397
ctttttttttttggt

SEQ ID NO: 159505 - DNA, 15 bp, Unknown
  misc_feature (1)..( 15): Result.004 file - promoters50/1023397
tttatttgttaaact

SEQ ID NO: 159506 - DNA, 10 bp, Unknown
  misc_feature (1)..( 10): Result.004 file - promoters50/1023397
cggatattcg

SEQ ID NO: 159507 - DNA, 10 bp, Unknown
  misc_feature (1)..( 10): Result.004 file - promoters50/1023397
atgattttcc

SEQ ID NO: 159508 - DNA, 10 bp, Unknown
  misc_feature (1)..( 10): Result.004 file - promoters50/1023397
tgaattatcc

SEQ ID NO: 159509 - DNA, 10 bp, Unknown
  misc_feature (1)..( 10): Result.004 file - promoters50/1023397
aaaattattt

SEQ ID NO: 159510 - DNA, 10 bp, Unknown
  misc_feature (1)..( 10): Result.004 file - promoters50/1023397
tacattgttt

SEQ ID NO: 159511 - DNA, 10 bp, Unknown
  misc_feature (1)..( 10): Result.004 file - promoters50/1023397
tgaatttgta

SEQ ID NO: 159512 - DNA, 10 bp, Unknown
  misc_feature (1)..( 10): Result.004 file - promoters50/1023397
aaacttatct

SEQ ID NO: 159513 - DNA, 14 bp, Unknown
  misc_feature (1)..( 14): Result.004 file - promoters50/1023397
ctttttttggtttt

SEQ ID NO: 159514 - DNA, 14 bp, Unknown
  misc_feature (1)..( 14): Result.004 file - promoters50/1023397
tttttttggttttt

SEQ ID NO: 159515 - DNA, 15 bp, Unknown
  misc_feature (1)..( 15): Result.004 file - promoters50/1023397
cttctttttggttaa

SEQ ID NO: 159516 - DNA, 15 bp, Unknown
  misc_feature (1)..( 15): Result.004 file - promoters50/1023397
cttcttcttcgtcaa

SEQ ID NO: 159517 - DNA, 15 bp, Unknown
  misc_feature (1)..( 15): Result.004 file - promoters50/1023397
ctttttttttttggt

SEQ ID NO: 159518 - DNA, 15 bp, Unknown
  misc_feature (1)..( 15): Result.004 file - promoters50/1023397
atttatttgttaaac

SEQ ID NO: 159519 - DNA, 15 bp, Unknown
  misc_feature (1)..( 15): Result.004 file - promoters50/1023407
gtttttttaatacga

SEQ ID NO: 159520 - DNA, 10 bp, Unknown
  misc_feature (1)..( 10): Result.004 file - promoters50/1023407
ataatacatc

SEQ ID NO: 159521 - DNA, 10 bp, Unknown
  misc_feature (1)..( 10): Result.004 file - promoters50/1023407
gtaatacata

SEQ ID NO: 159522 - DNA, 10 bp, Unknown
  misc_feature (1)..( 10): Result.004 file - promoters50/1023407
ataatataca

SEQ ID NO: 159523 - DNA, 10 bp, Unknown
  misc_feature (1)..( 10): Result.004 file - promoters50/1023407
ttaataccta

SEQ ID NO: 159524 - DNA, 10 bp, Unknown
  misc_feature (1)..( 10): Result.004 file - promoters50/1023407
ctaatttacc

SEQ ID NO: 159525 - DNA, 10 bp, Unknown
  misc_feature (1)..( 10): Result.004 file - promoters50/1023407
ggattttacc

SEQ ID NO: 159526 - DNA, 10 bp, Unknown
  misc_feature (1)..( 10): Result.004 file - promoters50/1023407
gagtttctcc

SEQ ID NO: 159527 - DNA, 10 bp, Unknown
  misc_feature (1)..( 10): Result.004 file - promoters50/1023407
gagattcctc

SEQ ID NO: 159528 - DNA, 10 bp, Unknown
  misc_feature (1)..( 10): Result.004 file - promoters50/1023407
aggtttcttt

SEQ ID NO: 159529 - DNA, 10 bp, Unknown
  misc_feature (1)..( 10): Result.004 file - promoters50/1023407
tcgttgcttc

SEQ ID NO: 159530 - DNA, 10 bp, Unknown
  misc_feature (1)..( 10): Result.004 file - promoters50/1023407
aagtttctga

SEQ ID NO: 159531 - DNA, 10 bp, Unknown
  misc_feature (1)..( 10): Result.004 file - promoters50/1023426
aagactcctc

SEQ ID NO: 159532 - DNA, 8 bp, Unknown
  misc_feature (1)..( 8): Result.004 file - promoters50/1023426
tcagaatt

SEQ ID NO: 159533 - DNA, 8 bp, Unknown
  misc_feature (1)..( 8): Result.004 file - promoters50/1023426
ggagaatt

SEQ ID NO: 159534 - DNA, 8 bp, Unknown
  misc_feature (1)..( 8): Result.004 file - promoters50/1023426
tcacaatg

SEQ ID NO: 159535 - DNA, 8 bp, Unknown
  misc_feature (1)..( 8): Result.004 file - promoters50/1023426
atttaatt

SEQ ID NO: 159536 - DNA, 8 bp, Unknown
  misc_feature (1)..( 8): Result.004 file - promoters50/1023426
attgaatt

SEQ ID NO: 159537 - DNA, 8 bp, Unknown
  misc_feature (1)..( 8): Result.004 file - promoters50/1023432
atttaaca

SEQ ID NO: 159538 - DNA, 12 bp, Unknown
  misc_feature (1)..( 12): Result.004 file - promoters50/1023432
atagcatttttg

SEQ ID NO: 159539 - DNA, 12 bp, Unknown
  misc_feature (1)..( 12): Result.004 file - promoters50/1023432
taaccatatttg

SEQ ID NO: 159540 - DNA, 12 bp, Unknown
  misc_feature (1)..( 12): Result.004 file - promoters50/1023432
acttcattttac

SEQ ID NO: 159541 - DNA, 12 bp, Unknown
  misc_feature (1)..( 12): Result.004 file - promoters50/1023432
tggccattgttg

SEQ ID NO: 159542 - DNA, 12 bp, Unknown
  misc_feature (1)..( 12): Result.004 file - promoters50/1023432
atagcttttttt

SEQ ID NO: 159543 - DNA, 12 bp, Unknown
  misc_feature (1)..( 12): Result.004 file - promoters50/1023432
tcaggattgtta

SEQ ID NO: 159544 - DNA, 10 bp, Unknown
  misc_feature (1)..( 10): Result.004 file - promoters50/1023432
aaatttaatc

SEQ ID NO: 159545 - DNA, 10 bp, Unknown
  misc_feature (1)..( 10): Result.004 file - promoters50/1023432
gtattgaatc

SEQ ID NO: 159546 - DNA, 10 bp, Unknown
  misc_feature (1)..( 10): Result.004 file - promoters50/1023432
aaatgtaact

SEQ ID NO: 159547 - DNA, 10 bp, Unknown
  misc_feature (1)..( 10): Result.004 file - promoters50/1023432
taatttaatg

SEQ ID NO: 159548 - DNA, 10 bp, Unknown
  misc_feature (1)..( 10): Result.004 file - promoters50/1023432
ttgttgaatt

SEQ ID NO: 159549 - DNA, 10 bp, Unknown
  misc_feature (1)..( 10): Result.004 file - promoters50/1023432
agatttaaat

SEQ ID NO: 159550 - DNA, 13 bp, Unknown
  misc_feature (1)..( 13): Result.004 file - promoters50/1023432
taattaaaataca

SEQ ID NO: 159551 - DNA, 13 bp, Unknown
  misc_feature (1)..( 13): Result.004 file - promoters50/1023432
agccgaaaaaaca

SEQ ID NO: 159552 - DNA, 13 bp, Unknown
  misc_feature (1)..( 13): Result.004 file - promoters50/1023432
gatgtaagatatt

SEQ ID NO: 159553 - DNA, 13 bp, Unknown
  misc_feature (1)..( 13): Result.004 file - promoters50/1023432
ccgataaatttgc

SEQ ID NO: 159554 - DNA, 13 bp, Unknown
  misc_feature (1)..( 13): Result.004 file - promoters50/1023432
gtagcaaaagaaa

SEQ ID NO: 159555 - DNA, 13 bp, Unknown
  misc_feature (1)..( 13): Result.004 file - promoters50/1023453
aaagaaagatatc

SEQ ID NO: 159556 - DNA, 12 bp, Unknown
  misc_feature (1)..( 12): Result.004 file - promoters50/1023453
agaaaagaaaga

SEQ ID NO: 159557 - DNA, 12 bp, Unknown
  misc_feature (1)..( 12): Result.004 file - promoters50/1023453
gaaaaagaaaaa

SEQ ID NO: 159558 - DNA, 12 bp, Unknown
  misc_feature (1)..( 12): Result.004 file - promoters50/1023453
agaaaagaaata

SEQ ID NO: 159559 - DNA, 12 bp, Unknown
  misc_feature (1)..( 12): Result.004 file - promoters50/1023453
ttgaaagaaaat

SEQ ID NO: 159560 - DNA, 12 bp, Unknown
  misc_feature (1)..( 12): Result.004 file - promoters50/1023453
agataagtaaag

SEQ ID NO: 159561 - DNA, 13 bp, Unknown
  misc_feature (1)..( 13): Result.004 file - promoters50/1023453
ggataagcaaaaa

SEQ ID NO: 159562 - DNA, 12 bp, Unknown
  misc_feature (1)..( 12): Result.004 file - promoters50/1023453
gtttcaatcttc

SEQ ID NO: 159563 - DNA, 12 bp, Unknown
  misc_feature (1)..( 12): Result.004 file - promoters50/1023453
gggacaatctaa

SEQ ID NO: 159564 - DNA, 12 bp, Unknown
  misc_feature (1)..( 12): Result.004 file - promoters50/1023453
gtttcaatcttc

SEQ ID NO: 159565 - DNA, 12 bp, Unknown
  misc_feature (1)..( 12): Result.004 file - promoters50/1023453
gtttaaatcaga

SEQ ID NO: 159566 - DNA, 12 bp, Unknown
  misc_feature (1)..( 12): Result.004 file - promoters50/1023453
agttcaaaattt

SEQ ID NO: 159567 - DNA, 12 bp, Unknown
  misc_feature (1)..( 12): Result.004 file - promoters50/1023453
tgtgtaatctaa

SEQ ID NO: 159568 - DNA, 9 bp, Unknown
  misc_feature (1)..( 9): Result.004 file - promoters50/1023453
ctaattttg

SEQ ID NO: 159569 - DNA, 9 bp, Unknown
  misc_feature (1)..( 9): Result.004 file - promoters50/1023453
ctaatttta

SEQ ID NO: 159570 - DNA, 9 bp, Unknown
  misc_feature (1)..( 9): Result.004 file - promoters50/1023453
caaatgttg

SEQ ID NO: 159571 - DNA, 9 bp, Unknown
  misc_feature (1)..( 9): Result.004 file - promoters50/1023453
ccaatgttt

SEQ ID NO: 159572 - DNA, 9 bp, Unknown
  misc_feature (1)..( 9): Result.004 file - promoters50/1023453
taaattttc

SEQ ID NO: 159573 - DNA, 9 bp, Unknown
  misc_feature (1)..( 9): Result.004 file - promoters50/1023579
caaatgtaa

SEQ ID NO: 159574 - DNA, 9 bp, Unknown
  misc_feature (1)..( 9): Result.004 file - promoters50/1023579
aactatcat

SEQ ID NO: 159575 - DNA, 9 bp, Unknown
  misc_feature (1)..( 9): Result.004 file - promoters50/1023579
taatatcat

SEQ ID NO: 159576 - DNA, 9 bp, Unknown
  misc_feature (1)..( 9): Result.004 file - promoters50/1023579
taaaatcaa

SEQ ID NO: 159577 - DNA, 10 bp, Unknown
  misc_feature (1)..( 10): Result.004 file - promoters50/1023579
aaataatcat

SEQ ID NO: 159578 - DNA, 10 bp, Unknown
  misc_feature (1)..( 10): Result.004 file - promoters50/1023579
atataaacat

SEQ ID NO: 159579 - DNA, 10 bp, Unknown
  misc_feature (1)..( 10): Result.004 file - promoters50/1023583
aaagaatcca

SEQ ID NO: 159580 - DNA, 9 bp, Unknown
  misc_feature (1)..( 9): Result.004 file - promoters50/1023583
gtttttatg

SEQ ID NO: 159581 - DNA, 9 bp, Unknown
  misc_feature (1)..( 9): Result.004 file - promoters50/1023583
gttattata

SEQ ID NO: 159582 - DNA, 9 bp, Unknown
  misc_feature (1)..( 9): Result.004 file - promoters50/1023583
gtttgtgta

SEQ ID NO: 159583 - DNA, 9 bp, Unknown
  misc_feature (1)..( 9): Result.004 file - promoters50/1023583
atcgtcttc

SEQ ID NO: 159584 - DNA, 9 bp, Unknown
  misc_feature (1)..( 9): Result.004 file - promoters50/1023583
accgtcttg

SEQ ID NO: 159585 - DNA, 9 bp, Unknown
  misc_feature (1)..( 9): Result.004 file - promoters50/1023583
atcatcttc

SEQ ID NO: 159586 - DNA, 10 bp, Unknown
  misc_feature (1)..( 10): Result.004 file - promoters50/1023583
tgaaaagaaa

SEQ ID NO: 159587 - DNA, 10 bp, Unknown
  misc_feature (1)..( 10): Result.004 file - promoters50/1023583
tgagaagagc

SEQ ID NO: 159588 - DNA, 10 bp, Unknown
  misc_feature (1)..( 10): Result.004 file - promoters50/1023583
acaaacgaag

SEQ ID NO: 159589 - DNA, 10 bp, Unknown
  misc_feature (1)..( 10): Result.004 file - promoters50/1023583
acaaaacaaa

SEQ ID NO: 159590 - DNA, 12 bp, Unknown
  misc_feature (1)..( 12): Result.004 file - promoters50/1023583
tgggtttataag

SEQ ID NO: 159591 - DNA, 12 bp, Unknown
  misc_feature (1)..( 12): Result.004 file - promoters50/1023583
agagtttttaag

SEQ ID NO: 159592 - DNA, 12 bp, Unknown
  misc_feature (1)..( 12): Result.004 file - promoters50/1023594
agtgtttgatgc

SEQ ID NO: 159593 - DNA, 9 bp, Unknown
  misc_feature (1)..( 9): Result.004 file - promoters50/1023594
tgaaaaatt

SEQ ID NO: 159594 - DNA, 9 bp, Unknown
  misc_feature (1)..( 9): Result.004 file - promoters50/1023594
acaaagatt

SEQ ID NO: 159595 - DNA, 9 bp, Unknown
  misc_feature (1)..( 9): Result.004 file - promoters50/1023594
tgagaaatt

SEQ ID NO: 159596 - DNA, 9 bp, Unknown
  misc_feature (1)..( 9): Result.004 file - promoters50/1023594
taaaaaatg

SEQ ID NO: 159597 - DNA, 9 bp, Unknown
  misc_feature (1)..( 9): Result.004 file - promoters50/1023594
ataaaaatt

SEQ ID NO: 159598 - DNA, 9 bp, Unknown
  misc_feature (1)..( 9): Result.004 file - promoters50/1023594
agaaaaaga

SEQ ID NO: 159599 - DNA, 9 bp, Unknown
  misc_feature (1)..( 9): Result.004 file - promoters50/1023594
ccaaagagg

SEQ ID NO: 159600 - DNA, 9 bp, Unknown
  misc_feature (1)..( 9): Result.004 file - promoters50/1023594
atataaagg

SEQ ID NO: 159601 - DNA, 12 bp, Unknown
  misc_feature (1)..( 12): Result.004 file - promoters50/1023594
attaaatcaaat

SEQ ID NO: 159602 - DNA, 12 bp, Unknown
  misc_feature (1)..( 12): Result.004 file - promoters50/1023594
aggaaagcaatg

SEQ ID NO: 159603 - DNA, 13 bp, Unknown
  misc_feature (1)..( 13): Result.004 file - promoters50/1023594
acaaaattgaatc

SEQ ID NO: 159604 - DNA, 13 bp, Unknown
  misc_feature (1)..( 13): Result.004 file - promoters50/1023594
accaaaacaacac

SEQ ID NO: 159605 - DNA, 13 bp, Unknown
  misc_feature (1)..( 13): Result.004 file - promoters50/1023594
ttaaaaagaaatg

SEQ ID NO: 159606 - DNA, 13 bp, Unknown
  misc_feature (1)..( 13): Result.004 file - promoters50/1023594
ttagaaagatact

SEQ ID NO: 159607 - DNA, 10 bp, Unknown
  misc_feature (1)..( 10): Result.004 file - promoters50/1023594
ttcaaacaga

SEQ ID NO: 159608 - DNA, 10 bp, Unknown
  misc_feature (1)..( 10): Result.004 file - promoters50/1023594
caaaaacagt

SEQ ID NO: 159609 - DNA, 10 bp, Unknown
  misc_feature (1)..( 10): Result.004 file - promoters50/1023594
aaaaaacatt

SEQ ID NO: 159610 - DNA, 10 bp, Unknown
  misc_feature (1)..( 10): Result.004 file - promoters50/1023594
ataaaataaa

SEQ ID NO: 159611 - DNA, 10 bp, Unknown
  misc_feature (1)..( 10): Result.004 file - promoters50/1023594
tcaaaataaa

SEQ ID NO: 159612 - DNA, 10 bp, Unknown
  misc_feature (1)..( 10): Result.004 file - promoters50/1023594
ccaaaatgtc

SEQ ID NO: 159613 - DNA, 10 bp, Unknown
  misc_feature (1)..( 10): Result.004 file - promoters50/1023594
ccaaaatcaa

SEQ ID NO: 159614 - DNA, 10 bp, Unknown
  misc_feature (1)..( 10): Result.004 file - promoters50/1023594
tcactattag

SEQ ID NO: 159615 - DNA, 10 bp, Unknown
  misc_feature (1)..( 10): Result.004 file - promoters50/1023594
caactattcg

SEQ ID NO: 159616 - DNA, 10 bp, Unknown
  misc_feature (1)..( 10): Result.004 file - promoters50/1023594
tcattattat

SEQ ID NO: 159617 - DNA, 10 bp, Unknown
  misc_feature (1)..( 10): Result.004 file - promoters50/1023594
gtattattga

SEQ ID NO: 159618 - DNA, 10 bp, Unknown
  misc_feature (1)..( 10): Result.004 file - promoters50/1023594
taattattca

SEQ ID NO: 159619 - DNA, 10 bp, Unknown
  misc_feature (1)..( 10): Result.004 file - promoters50/1023594
ttaatattat

SEQ ID NO: 159620 - DNA, 10 bp, Unknown
  misc_feature (1)..( 10): Result.004 file - promoters50/1023594
atattatgaa

SEQ ID NO: 159621 - DNA, 10 bp, Unknown
  misc_feature (1)..( 10): Result.004 file - promoters50/1023594
caattaagaa

SEQ ID NO: 159622 - DNA, 11 bp, Unknown
  misc_feature (1)..( 11): Result.004 file - promoters50/1023594
tgaacttatga

SEQ ID NO: 159623 - DNA, 11 bp, Unknown
  misc_feature (1)..( 11): Result.004 file - promoters50/1023594
tgaatttataa

SEQ ID NO: 159624 - DNA, 11 bp, Unknown
  misc_feature (1)..( 11): Result.004 file - promoters50/1023594
acaactaatgg

SEQ ID NO: 159625 - DNA, 11 bp, Unknown
  misc_feature (1)..( 11): Result.004 file - promoters50/1023594
acaattaaacc

SEQ ID NO: 159626 - DNA, 11 bp, Unknown
  misc_feature (1)..( 11): Result.004 file - promoters50/1023594
tcaaataatcg

SEQ ID NO: 159627 - DNA, 11 bp, Unknown
  misc_feature (1)..( 11): Result.004 file - promoters50/1023594
tacttttttaa

SEQ ID NO: 159628 - DNA, 12 bp, Unknown
  misc_feature (1)..( 12): Result.004 file - promoters50/1023594
tttgaattttga

SEQ ID NO: 159629 - DNA, 12 bp, Unknown
  misc_feature (1)..( 12): Result.004 file - promoters50/1023594
tttgcattttaa

SEQ ID NO: 159630 - DNA, 12 bp, Unknown
  misc_feature (1)..( 12): Result.004 file - promoters50/1023594
ttttaatcaaca

SEQ ID NO: 159631 - DNA, 12 bp, Unknown
  misc_feature (1)..( 12): Result.004 file - promoters50/1023594
gatgacttttgt

SEQ ID NO: 159632 - DNA, 12 bp, Unknown
  misc_feature (1)..( 12): Result.004 file - promoters50/1023594
atttttttttgt

SEQ ID NO: 159633 - DNA, 12 bp, Unknown
  misc_feature (1)..( 12): Result.004 file - promoters50/1023594
cttgaatttttt

SEQ ID NO: 159634 - DNA, 12 bp, Unknown
  misc_feature (1)..( 12): Result.004 file - promoters50/1023594
attgaatctaaa

SEQ ID NO: 159635 - DNA, 9 bp, Unknown
  misc_feature (1)..( 9): Result.004 file - promoters50/1023594
ttcaacaat

SEQ ID NO: 159636 - DNA, 9 bp, Unknown
  misc_feature (1)..( 9): Result.004 file - promoters50/1023594
gaaaacaat

SEQ ID NO: 159637 - DNA, 9 bp, Unknown
  misc_feature (1)..( 9): Result.004 file - promoters50/1023594
ttcgacaaa

SEQ ID NO: 159638 - DNA, 9 bp, Unknown
  misc_feature (1)..( 9): Result.004 file - promoters50/1023594
ctaaacaaa

SEQ ID NO: 159639 - DNA, 9 bp, Unknown
  misc_feature (1)..( 9): Result.004 file - promoters50/1023594
ttaaaaaat

SEQ ID NO: 159640 - DNA, 9 bp, Unknown
  misc_feature (1)..( 9): Result.004 file - promoters50/1023594
gcaaataat

SEQ ID NO: 159641 - DNA, 12 bp, Unknown
  misc_feature (1)..( 12): Result.004 file - promoters50/1023594
caacaatagagg

SEQ ID NO: 159642 - DNA, 12 bp, Unknown
  misc_feature (1)..( 12): Result.004 file - promoters50/1023594
aaaggatagaga

SEQ ID NO: 159643 - DNA, 12 bp, Unknown
  misc_feature (1)..( 12): Result.004 file - promoters50/1023594
aaagaatagaaa

SEQ ID NO: 159644 - DNA, 12 bp, Unknown
  misc_feature (1)..( 12): Result.004 file - promoters50/1023594
aaataattcgtt

SEQ ID NO: 159645 - DNA, 12 bp, Unknown
  misc_feature (1)..( 12): Result.004 file - promoters50/1023594
tatctatagaaa

SEQ ID NO: 159646 - DNA, 12 bp, Unknown
  misc_feature (1)..( 12): Result.004 file - promoters50/1023594
aaaaaatgttat

SEQ ID NO: 159647 - DNA, 12 bp, Unknown
  misc_feature (1)..( 12): Result.004 file - promoters50/1023594
caaaacaattaa

SEQ ID NO: 159648 - DNA, 12 bp, Unknown
  misc_feature (1)..( 12): Result.004 file - promoters50/1023594
tcaaataatcga

SEQ ID NO: 159649 - DNA, 12 bp, Unknown
  misc_feature (1)..( 12): Result.004 file - promoters50/1023594
caaaataatgaa

SEQ ID NO: 159650 - DNA, 12 bp, Unknown
  misc_feature (1)..( 12): Result.004 file - promoters50/1023594
ccaaacaaagag

SEQ ID NO: 159651 - DNA, 12 bp, Unknown
  misc_feature (1)..( 12): Result.004 file - promoters50/1023594
attcacaactaa

SEQ ID NO: 159652 - DNA, 12 bp, Unknown
  misc_feature (1)..( 12): Result.004 file - promoters50/1023594
ccaaccaatcat

SEQ ID NO: 159653 - DNA, 11 bp, Unknown
  misc_feature (1)..( 11): Result.004 file - promoters50/1023594
ttgataatata

SEQ ID NO: 159654 - DNA, 11 bp, Unknown
  misc_feature (1)..( 11): Result.004 file - promoters50/1023594
atgataaaata

SEQ ID NO: 159655 - DNA, 11 bp, Unknown
  misc_feature (1)..( 11): Result.004 file - promoters50/1023594
tctaaaaaaac

SEQ ID NO: 159656 - DNA, 11 bp, Unknown
  misc_feature (1)..( 11): Result.004 file - promoters50/1023594
ttcaaaataaa

SEQ ID NO: 159657 - DNA, 11 bp, Unknown
  misc_feature (1)..( 11): Result.004 file - promoters50/1023594
atgctaataac

SEQ ID NO: 159658 - DNA, 11 bp, Unknown
  misc_feature (1)..( 11): Result.004 file - promoters50/1023594
gccaaaatgtc

SEQ ID NO: 159659 - DNA, 9 bp, Unknown
  misc_feature (1)..( 9): Result.004 file - promoters50/1023594
tattattga

SEQ ID NO: 159660 - DNA, 9 bp, Unknown
  misc_feature (1)..( 9): Result.004 file - promoters50/1023594
tattatatc

SEQ ID NO: 159661 - DNA, 9 bp, Unknown
  misc_feature (1)..( 9): Result.004 file - promoters50/1023594
tattatgaa

SEQ ID NO: 159662 - DNA, 9 bp, Unknown
  misc_feature (1)..( 9): Result.004 file - promoters50/1023594
tattattat

SEQ ID NO: 159663 - DNA, 9 bp, Unknown
  misc_feature (1)..( 9): Result.004 file - promoters50/1023594
aattattca

SEQ ID NO: 159664 - DNA, 9 bp, Unknown
  misc_feature (1)..( 9): Result.004 file - promoters50/1023619
aattaagaa

SEQ ID NO: 159665 - DNA, 15 bp, Unknown
  misc_feature (1)..( 15): Result.004 file - promoters50/1023619
tttaataaagtttga

SEQ ID NO: 159666 - DNA, 15 bp, Unknown
  misc_feature (1)..( 15): Result.004 file - promoters50/1023619
catcgaaaagttaaa

SEQ ID NO: 159667 - DNA, 15 bp, Unknown
  misc_feature (1)..( 15): Result.004 file - promoters50/1023619
accccacaagttaaa

SEQ ID NO: 159668 - DNA, 15 bp, Unknown
  misc_feature (1)..( 15): Result.004 file - promoters50/1023619
gaacgaaaagtcact

SEQ ID NO: 159669 - DNA, 15 bp, Unknown
  misc_feature (1)..( 15): Result.004 file - promoters50/1023619
gaatgaaaaagtcac

SEQ ID NO: 159670 - DNA, 15 bp, Unknown
  misc_feature (1)..( 15): Result.004 file - promoters50/1023619
ttcagaaaaagcgaa

SEQ ID NO: 159671 - DNA, 13 bp, Unknown
  misc_feature (1)..( 13): Result.004 file - promoters50/1023619
aattgattctaat

SEQ ID NO: 159672 - DNA, 13 bp, Unknown
  misc_feature (1)..( 13): Result.004 file - promoters50/1023619
aatttatttcgta

SEQ ID NO: 159673 - DNA, 13 bp, Unknown
  misc_feature (1)..( 13): Result.004 file - promoters50/1023619
ctttgatttgaat

SEQ ID NO: 159674 - DNA, 13 bp, Unknown
  misc_feature (1)..( 13): Result.004 file - promoters50/1023619
aattgatgaaaga

SEQ ID NO: 159675 - DNA, 13 bp, Unknown
  misc_feature (1)..( 13): Result.004 file - promoters50/1023619
aattgagcaatgt

SEQ ID NO: 159676 - DNA, 13 bp, Unknown
  misc_feature (1)..( 13): Result.004 file - promoters50/1023619
cattgttgagaga

SEQ ID NO: 159677 - DNA, 13 bp, Unknown
  misc_feature (1)..( 13): Result.004 file - promoters50/1023619
cattggtttagtt

SEQ ID NO: 159678 - DNA, 13 bp, Unknown
  misc_feature (1)..( 13): Result.004 file - promoters50/1023619
ttttaatctctcg

SEQ ID NO: 159679 - DNA, 13 bp, Unknown
  misc_feature (1)..( 13): Result.004 file - promoters50/1023619
atagaatctttcg

SEQ ID NO: 159680 - DNA, 13 bp, Unknown
  misc_feature (1)..( 13): Result.004 file - promoters50/1023619
gtttaatctgagt

SEQ ID NO: 159681 - DNA, 13 bp, Unknown
  misc_feature (1)..( 13): Result.004 file - promoters50/1023619
gtttaagagtata

SEQ ID NO: 159682 - DNA, 13 bp, Unknown
  misc_feature (1)..( 13): Result.004 file - promoters50/1023619
gttgaagtctaat

SEQ ID NO: 159683 - DNA, 13 bp, Unknown
  misc_feature (1)..( 13): Result.004 file - promoters50/1023634
ttggaatctgaca

SEQ ID NO: 159684 - DNA, 12 bp, Unknown
  misc_feature (1)..( 12): Result.004 file - promoters50/1023634
aaaaatgtgaaa

SEQ ID NO: 159685 - DNA, 12 bp, Unknown
  misc_feature (1)..( 12): Result.004 file - promoters50/1023634
caaactgtgaaa

SEQ ID NO: 159686 - DNA, 12 bp, Unknown
  misc_feature (1)..( 12): Result.004 file - promoters50/1023634
aaaaatcgtcat

SEQ ID NO: 159687 - DNA, 13 bp, Unknown
  misc_feature (1)..( 13): Result.004 file - promoters50/1023634
aaataatttttag

SEQ ID NO: 159688 - DNA, 13 bp, Unknown
  misc_feature (1)..( 13): Result.004 file - promoters50/1023634
atgttatgtgaca

SEQ ID NO: 159689 - DNA, 13 bp, Unknown
  misc_feature (1)..( 13): Result.004 file - promoters50/1023634
tcttgatagttta

SEQ ID NO: 159690 - DNA, 13 bp, Unknown
  misc_feature (1)..( 13): Result.004 file - promoters50/1023634
gttacttgttagt

SEQ ID NO: 159691 - DNA, 13 bp, Unknown
  misc_feature (1)..( 13): Result.004 file - promoters50/1023634
taaacatatttga

SEQ ID NO: 159692 - DNA, 18 bp, Unknown
  misc_feature (1)..( 18): Result.004 file - promoters50/1023634
attttaagaaagtatata

SEQ ID NO: 159693 - DNA, 18 bp, Unknown
  misc_feature (1)..( 18): Result.004 file - promoters50/1023634
tttttaaaaaactatata

SEQ ID NO: 159694 - DNA, 18 bp, Unknown
  misc_feature (1)..( 18): Result.004 file - promoters50/1023634
agatttagaaagagatgt

SEQ ID NO: 159695 - DNA, 18 bp, Unknown
  misc_feature (1)..( 18): Result.004 file - promoters50/1023634
tagctaacaaataatttt

SEQ ID NO: 159696 - DNA, 18 bp, Unknown
  misc_feature (1)..( 18): Result.004 file - promoters50/1023634
aatttaaagcttcacatt

SEQ ID NO: 159697 - DNA, 18 bp, Unknown
  misc_feature (1)..( 18): Result.004 file - promoters50/1023681
tttttatctgagaaattt

SEQ ID NO: 159698 - DNA, 8 bp, Unknown
  misc_feature (1)..( 8): Result.004 file - promoters50/1023681
aaatgaaa

SEQ ID NO: 159699 - DNA, 8 bp, Unknown
  misc_feature (1)..( 8): Result.004 file - promoters50/1023681
caatcaaa

SEQ ID NO: 159700 - DNA, 8 bp, Unknown
  misc_feature (1)..( 8): Result.004 file - promoters50/1023698
aaatgagg

SEQ ID NO: 159701 - DNA, 9 bp, Unknown
  misc_feature (1)..( 9): Result.004 file - promoters50/1023698
aagtaaaaa

SEQ ID NO: 159702 - DNA, 9 bp, Unknown
  misc_feature (1)..( 9): Result.004 file - promoters50/1023698
aagcaaaaa

SEQ ID NO: 159703 - DNA, 9 bp, Unknown
  misc_feature (1)..( 9): Result.004 file - promoters50/1023698
aagcaaaaa

SEQ ID NO: 159704 - DNA, 8 bp, Unknown
  misc_feature (1)..( 8): Result.004 file - promoters50/1023698
ctttattt

SEQ ID NO: 159705 - DNA, 8 bp, Unknown
  misc_feature (1)..( 8): Result.004 file - promoters50/1023698
ttttattt

SEQ ID NO: 159706 - DNA, 8 bp, Unknown
  misc_feature (1)..( 8): Result.004 file - promoters50/1023698
ctttatag

SEQ ID NO: 159707 - DNA, 10 bp, Unknown
  misc_feature (1)..( 10): Result.004 file - promoters50/1023698
taaaaaataa

SEQ ID NO: 159708 - DNA, 10 bp, Unknown
  misc_feature (1)..( 10): Result.004 file - promoters50/1023698
taaaatataa

SEQ ID NO: 159709 - DNA, 11 bp, Unknown
  misc_feature (1)..( 11): Result.004 file - promoters50/1023698
atagaaattaa

SEQ ID NO: 159710 - DNA, 10 bp, Unknown
  misc_feature (1)..( 10): Result.004 file - promoters50/1023698
acattattgt

SEQ ID NO: 159711 - DNA, 10 bp, Unknown
  misc_feature (1)..( 10): Result.004 file - promoters50/1023698
acattataaa

SEQ ID NO: 159712 - DNA, 10 bp, Unknown
  misc_feature (1)..( 10): Result.004 file - promoters50/1023747
ttattgtaaa

SEQ ID NO: 159713 - DNA, 7 bp, Unknown
  misc_feature (1)..( 7): Result.004 file - promoters50/1023747
ataaatc

SEQ ID NO: 159714 - DNA, 7 bp, Unknown
  misc_feature (1)..( 7): Result.004 file - promoters50/1023747
atacatc

SEQ ID NO: 159715 - DNA, 7 bp, Unknown
  misc_feature (1)..( 7): Result.004 file - promoters50/1023747
aaaaaaa

SEQ ID NO: 159716 - DNA, 7 bp, Unknown
  misc_feature (1)..( 7): Result.004 file - promoters50/1023747
aataata

SEQ ID NO: 159717 - DNA, 7 bp, Unknown
  misc_feature (1)..( 7): Result.004 file - promoters50/1023747
aattata

SEQ ID NO: 159718 - DNA, 7 bp, Unknown
  misc_feature (1)..( 7): Result.004 file - promoters50/1023747
aattatg

SEQ ID NO: 159719 - DNA, 8 bp, Unknown
  misc_feature (1)..( 8): Result.004 file - promoters50/1023747
aaatcaca

SEQ ID NO: 159720 - DNA, 8 bp, Unknown
  misc_feature (1)..( 8): Result.004 file - promoters50/1023747
aaatcatt

SEQ ID NO: 159721 - DNA, 8 bp, Unknown
  misc_feature (1)..( 8): Result.004 file - promoters50/1023782
caatcatt

SEQ ID NO: 159722 - DNA, 10 bp, Unknown
  misc_feature (1)..( 10): Result.004 file - promoters50/1023782
ataaatcaaa

SEQ ID NO: 159723 - DNA, 10 bp, Unknown
  misc_feature (1)..( 10): Result.004 file - promoters50/1023782
ggaaatgaaa

SEQ ID NO: 159724 - DNA, 10 bp, Unknown
  misc_feature (1)..( 10): Result.004 file - promoters50/1023782
ggaaaagaaa

SEQ ID NO: 159725 - DNA, 10 bp, Unknown
  misc_feature (1)..( 10): Result.004 file - promoters50/1023782
atgcaagaaa

SEQ ID NO: 159726 - DNA, 12 bp, Unknown
  misc_feature (1)..( 12): Result.004 file - promoters50/1023782
agtttggatatc

SEQ ID NO: 159727 - DNA, 12 bp, Unknown
  misc_feature (1)..( 12): Result.004 file - promoters50/1023782
agtttggatttt

SEQ ID NO: 159728 - DNA, 12 bp, Unknown
  misc_feature (1)..( 12): Result.004 file - promoters50/1023782
aaattgggtttt

SEQ ID NO: 159729 - DNA, 12 bp, Unknown
  misc_feature (1)..( 12): Result.004 file - promoters50/1023786
tcaatggtttac

SEQ ID NO: 159730 - DNA, 7 bp, Unknown
  misc_feature (1)..( 7): Result.004 file - promoters50/1023786
ctaattc

SEQ ID NO: 159731 - DNA, 7 bp, Unknown
  misc_feature (1)..( 7): Result.004 file - promoters50/1023786
ctaattt

SEQ ID NO: 159732 - DNA, 7 bp, Unknown
  misc_feature (1)..( 7): Result.004 file - promoters50/1023786
ctatttt

SEQ ID NO: 159733 - DNA, 7 bp, Unknown
  misc_feature (1)..( 7): Result.004 file - promoters50/1023786
gtatttt

SEQ ID NO: 159734 - DNA, 7 bp, Unknown
  misc_feature (1)..( 7): Result.004 file - promoters50/1023786
gtaattt

SEQ ID NO: 159735 - DNA, 7 bp, Unknown
  misc_feature (1)..( 7): Result.004 file - promoters50/1023851
ataattt

SEQ ID NO: 159736 - DNA, 20 bp, Unknown
  misc_feature (1)..( 20): Result.004 file - promoters50/1023851
aaacaatagttttgacatat

SEQ ID NO: 159737 - DNA, 20 bp, Unknown
  misc_feature (1)..( 20): Result.004 file - promoters50/1023851
gaaaacctaagttgatatat

SEQ ID NO: 159738 - DNA, 20 bp, Unknown
  misc_feature (1)..( 20): Result.004 file - promoters50/1023851
aaaccatagttttgaccaac

SEQ ID NO: 159739 - DNA, 29 bp, Unknown
  misc_feature (1)..( 29): Result.004 file - promoters50/1023851
aaaaaccaaatatactgtaatactagcaa

SEQ ID NO: 159740 - DNA, 29 bp, Unknown
  misc_feature (1)..( 29): Result.004 file - promoters50/1023851
aaaaaccaaaaataccgtaatactatcaa

SEQ ID NO: 159741 - DNA, 29 bp, Unknown
  misc_feature (1)..( 29): Result.004 file - promoters50/1023851
ataggccaaaactgaaaacctaagttgat

SEQ ID NO: 159742 - DNA, 8 bp, Unknown
  misc_feature (1)..( 8): Result.004 file - promoters50/1023851
aaaaacaa

SEQ ID NO: 159743 - DNA, 8 bp, Unknown
  misc_feature (1)..( 8): Result.004 file - promoters50/1023851
caaaacaa

SEQ ID NO: 159744 - DNA, 8 bp, Unknown
  misc_feature (1)..( 8): Result.004 file - promoters50/1023891
caaaactg

SEQ ID NO: 159745 - DNA, 11 bp, Unknown
  misc_feature (1)..( 11): Result.004 file - promoters50/1023891
cattcaaaacg

SEQ ID NO: 159746 - DNA, 11 bp, Unknown
  misc_feature (1)..( 11): Result.004 file - promoters50/1023891
catttaaattt

SEQ ID NO: 159747 - DNA, 11 bp, Unknown
  misc_feature (1)..( 11): Result.004 file - promoters50/1023891
gctttgaatca

SEQ ID NO: 159748 - DNA, 11 bp, Unknown
  misc_feature (1)..( 11): Result.004 file - promoters50/1023891
aattttaattt

SEQ ID NO: 159749 - DNA, 11 bp, Unknown
  misc_feature (1)..( 11): Result.004 file - promoters50/1023891
tggattagttt

SEQ ID NO: 159750 - DNA, 13 bp, Unknown
  misc_feature (1)..( 13): Result.004 file - promoters50/1023891
aaagttttaatgt

SEQ ID NO: 159751 - DNA, 13 bp, Unknown
  misc_feature (1)..( 13): Result.004 file - promoters50/1023891
aaaattttaaaat

SEQ ID NO: 159752 - DNA, 13 bp, Unknown
  misc_feature (1)..( 13): Result.004 file - promoters50/1023891
gatattttataga

SEQ ID NO: 159753 - DNA, 13 bp, Unknown
  misc_feature (1)..( 13): Result.004 file - promoters50/1023891
tttcttttacaga

SEQ ID NO: 159754 - DNA, 13 bp, Unknown
  misc_feature (1)..( 13): Result.004 file - promoters50/1023963
ataattttagaga

SEQ ID NO: 159755 - DNA, 14 bp, Unknown
  misc_feature (1)..( 14): Result.004 file - promoters50/1023963
aagaacacataatg

SEQ ID NO: 159756 - DNA, 14 bp, Unknown
  misc_feature (1)..( 14): Result.004 file - promoters50/1023963
cgctacaaataaac

SEQ ID NO: 159757 - DNA, 14 bp, Unknown
  misc_feature (1)..( 14): Result.004 file - promoters50/1023963
gaagacaactatga

SEQ ID NO: 159758 - DNA, 14 bp, Unknown
  misc_feature (1)..( 14): Result.004 file - promoters50/1023963
gaaaacacataatg

SEQ ID NO: 159759 - DNA, 14 bp, Unknown
  misc_feature (1)..( 14): Result.004 file - promoters50/1023963
ttttacaaatgtaa

SEQ ID NO: 159760 - DNA, 14 bp, Unknown
  misc_feature (1)..( 14): Result.004 file - promoters50/1023963
gaagactgacgacg

SEQ ID NO: 159761 - DNA, 12 bp, Unknown
  misc_feature (1)..( 12): Result.004 file - promoters50/1023963
attttagaaaag

SEQ ID NO: 159762 - DNA, 12 bp, Unknown
  misc_feature (1)..( 12): Result.004 file - promoters50/1023963
acattaaaaaaa

SEQ ID NO: 159763 - DNA, 12 bp, Unknown
  misc_feature (1)..( 12): Result.004 file - promoters50/1023963
acattgaaatgt

SEQ ID NO: 159764 - DNA, 12 bp, Unknown
  misc_feature (1)..( 12): Result.004 file - promoters50/1023963
agagtaaataat

SEQ ID NO: 159765 - DNA, 12 bp, Unknown
  misc_feature (1)..( 12): Result.004 file - promoters50/1023963
acagtgatcatc

SEQ ID NO: 159766 - DNA, 12 bp, Unknown
  misc_feature (1)..( 12): Result.004 file - promoters50/1024003
aacgtatatatg

SEQ ID NO: 159767 - DNA, 8 bp, Unknown
  misc_feature (1)..( 8): Result.004 file - promoters50/1024003
ttttatct

SEQ ID NO: 159768 - DNA, 8 bp, Unknown
  misc_feature (1)..( 8): Result.004 file - promoters50/1024003
ttttttct

SEQ ID NO: 159769 - DNA, 8 bp, Unknown
  misc_feature (1)..( 8): Result.004 file - promoters50/1024015
gtttctcc

SEQ ID NO: 159770 - DNA, 11 bp, Unknown
  misc_feature (1)..( 11): Result.004 file - promoters50/1024015
aagatagagat

SEQ ID NO: 159771 - DNA, 11 bp, Unknown
  misc_feature (1)..( 11): Result.004 file - promoters50/1024015
tacatacagat

SEQ ID NO: 159772 - DNA, 11 bp, Unknown
  misc_feature (1)..( 11): Result.004 file - promoters50/1024015
aggatagatag

SEQ ID NO: 159773 - DNA, 11 bp, Unknown
  misc_feature (1)..( 11): Result.004 file - promoters50/1024015
tagatacagac

SEQ ID NO: 159774 - DNA, 11 bp, Unknown
  misc_feature (1)..( 11): Result.004 file - promoters50/1024015
cacaaacaaga

SEQ ID NO: 159775 - DNA, 11 bp, Unknown
  misc_feature (1)..( 11): Result.004 file - promoters50/1024045
cacaaaacatc

SEQ ID NO: 159776 - DNA, 10 bp, Unknown
  misc_feature (1)..( 10): Result.004 file - promoters50/1024045
aatttgagac

SEQ ID NO: 159777 - DNA, 10 bp, Unknown
  misc_feature (1)..( 10): Result.004 file - promoters50/1024045
agtttgagac

SEQ ID NO: 159778 - DNA, 10 bp, Unknown
  misc_feature (1)..( 10): Result.004 file - promoters50/1024045
aatatgatgg

SEQ ID NO: 159779 - DNA, 9 bp, Unknown
  misc_feature (1)..( 9): Result.004 file - promoters50/1024045
gaatttggg

SEQ ID NO: 159780 - DNA, 9 bp, Unknown
  misc_feature (1)..( 9): Result.004 file - promoters50/1024045
aaatttggt

SEQ ID NO: 159781 - DNA, 9 bp, Unknown
  misc_feature (1)..( 9): Result.004 file - promoters50/1024045
aaatttggg

SEQ ID NO: 159782 - DNA, 9 bp, Unknown
  misc_feature (1)..( 9): Result.004 file - promoters50/1024045
aaatttcaa

SEQ ID NO: 159783 - DNA, 8 bp, Unknown
  misc_feature (1)..( 8): Result.004 file - promoters50/1024045
gagagata

SEQ ID NO: 159784 - DNA, 8 bp, Unknown
  misc_feature (1)..( 8): Result.004 file - promoters50/1024045
aagatata

SEQ ID NO: 159785 - DNA, 8 bp, Unknown
  misc_feature (1)..( 8): Result.004 file - promoters50/1024045
aaaaaata

SEQ ID NO: 159786 - DNA, 7 bp, Unknown
  misc_feature (1)..( 7): Result.004 file - promoters50/1024045
aatcaat

SEQ ID NO: 159787 - DNA, 7 bp, Unknown
  misc_feature (1)..( 7): Result.004 file - promoters50/1024045
aattaat

SEQ ID NO: 159788 - DNA, 7 bp, Unknown
  misc_feature (1)..( 7): Result.004 file - promoters50/1024045
gattaat

SEQ ID NO: 159789 - DNA, 6 bp, Unknown
  misc_feature (1)..( 6): Result.004 file - promoters50/1024045
taatta

SEQ ID NO: 159790 - DNA, 6 bp, Unknown
  misc_feature (1)..( 6): Result.004 file - promoters50/1024045
taatta

SEQ ID NO: 159791 - DNA, 6 bp, Unknown
  misc_feature (1)..( 6): Result.004 file - promoters50/1024126
taatta

SEQ ID NO: 159792 - DNA, 15 bp, Unknown
  misc_feature (1)..( 15): Result.004 file - promoters50/1024126
tttattgaaaaatca

SEQ ID NO: 159793 - DNA, 15 bp, Unknown
  misc_feature (1)..( 15): Result.004 file - promoters50/1024126
ttgattcaaaattct

SEQ ID NO: 159794 - DNA, 15 bp, Unknown
  misc_feature (1)..( 15): Result.004 file - promoters50/1024126
tcagttgaaaccgaa

SEQ ID NO: 159795 - DNA, 15 bp, Unknown
  misc_feature (1)..( 15): Result.004 file - promoters50/1024126
agtattgacgatact

SEQ ID NO: 159796 - DNA, 15 bp, Unknown
  misc_feature (1)..( 15): Result.004 file - promoters50/1024126
atgatttaaattatt

SEQ ID NO: 159797 - DNA, 15 bp, Unknown
  misc_feature (1)..( 15): Result.004 file - promoters50/1024126
ggtgaagaagaattg

SEQ ID NO: 159798 - DNA, 15 bp, Unknown
  misc_feature (1)..( 15): Result.004 file - promoters50/1024126
agtcttgaattgttc

SEQ ID NO: 159799 - DNA, 15 bp, Unknown
  misc_feature (1)..( 15): Result.004 file - promoters50/1024126
gaaaacgaagaggaa

SEQ ID NO: 159800 - DNA, 13 bp, Unknown
  misc_feature (1)..( 13): Result.004 file - promoters50/1024126
ataaaataatatg

SEQ ID NO: 159801 - DNA, 13 bp, Unknown
  misc_feature (1)..( 13): Result.004 file - promoters50/1024126
ttctgatattata

SEQ ID NO: 159802 - DNA, 13 bp, Unknown
  misc_feature (1)..( 13): Result.004 file - promoters50/1024126
aaaaaaaattata

SEQ ID NO: 159803 - DNA, 13 bp, Unknown
  misc_feature (1)..( 13): Result.004 file - promoters50/1024126
catataaagtaat

SEQ ID NO: 159804 - DNA, 13 bp, Unknown
  misc_feature (1)..( 13): Result.004 file - promoters50/1024126
ttttcttattatc

SEQ ID NO: 159805 - DNA, 13 bp, Unknown
  misc_feature (1)..( 13): Result.004 file - promoters50/1024126
atgagaaaataac

SEQ ID NO: 159806 - DNA, 11 bp, Unknown
  misc_feature (1)..( 11): Result.004 file - promoters50/1024126
tattaaaatag

SEQ ID NO: 159807 - DNA, 11 bp, Unknown
  misc_feature (1)..( 11): Result.004 file - promoters50/1024126
tatcaaagaat

SEQ ID NO: 159808 - DNA, 11 bp, Unknown
  misc_feature (1)..( 11): Result.004 file - promoters50/1024126
aattaaaaaaa

SEQ ID NO: 159809 - DNA, 11 bp, Unknown
  misc_feature (1)..( 11): Result.004 file - promoters50/1024126
taagaaaagga

SEQ ID NO: 159810 - DNA, 11 bp, Unknown
  misc_feature (1)..( 11): Result.004 file - promoters50/1024126
aacgaagagga

SEQ ID NO: 159811 - DNA, 11 bp, Unknown
  misc_feature (1)..( 11): Result.004 file - promoters50/1024126
gaagaagaatt

SEQ ID NO: 159812 - DNA, 10 bp, Unknown
  misc_feature (1)..( 10): Result.004 file - promoters50/1024126
gaaaaatcat

SEQ ID NO: 159813 - DNA, 10 bp, Unknown
  misc_feature (1)..( 10): Result.004 file - promoters50/1024126
aaaaaattct

SEQ ID NO: 159814 - DNA, 10 bp, Unknown
  misc_feature (1)..( 10): Result.004 file - promoters50/1024126
gaagaattgt

SEQ ID NO: 159815 - DNA, 10 bp, Unknown
  misc_feature (1)..( 10): Result.004 file - promoters50/1024126
tcaaaattct

SEQ ID NO: 159816 - DNA, 10 bp, Unknown
  misc_feature (1)..( 10): Result.004 file - promoters50/1024126
taaacatttg

SEQ ID NO: 159817 - DNA, 10 bp, Unknown
  misc_feature (1)..( 10): Result.004 file - promoters50/1024126
aaagaataca

SEQ ID NO: 159818 - DNA, 10 bp, Unknown
  misc_feature (1)..( 10): Result.004 file - promoters50/1024126
gaagaggaag

SEQ ID NO: 159819 - DNA, 8 bp, Unknown
  misc_feature (1)..( 8): Result.004 file - promoters50/1024126
aaacaaca

SEQ ID NO: 159820 - DNA, 8 bp, Unknown
  misc_feature (1)..( 8): Result.004 file - promoters50/1024126
caactaca

SEQ ID NO: 159821 - DNA, 8 bp, Unknown
  misc_feature (1)..( 8): Result.004 file - promoters50/1024126
aaaaaact

SEQ ID NO: 159822 - DNA, 8 bp, Unknown
  misc_feature (1)..( 8): Result.004 file - promoters50/1024126
aaacaaat

SEQ ID NO: 159823 - DNA, 8 bp, Unknown
  misc_feature (1)..( 8): Result.004 file - promoters50/1024126
aaagaaag

SEQ ID NO: 159824 - DNA, 8 bp, Unknown
  misc_feature (1)..( 8): Result.004 file - promoters50/1024130
gaactaat

SEQ ID NO: 159825 - DNA, 8 bp, Unknown
  misc_feature (1)..( 8): Result.004 file - promoters50/1024130
ttggcaac

SEQ ID NO: 159826 - DNA, 8 bp, Unknown
  misc_feature (1)..( 8): Result.004 file - promoters50/1024130
ttgtcaac

SEQ ID NO: 159827 - DNA, 8 bp, Unknown
  misc_feature (1)..( 8): Result.004 file - promoters50/1024166
ttgtcagg

SEQ ID NO: 159828 - DNA, 12 bp, Unknown
  misc_feature (1)..( 12): Result.004 file - promoters50/1024166
attaaaaaaaaa

SEQ ID NO: 159829 - DNA, 12 bp, Unknown
  misc_feature (1)..( 12): Result.004 file - promoters50/1024166
aataacaaaaaa

SEQ ID NO: 159830 - DNA, 12 bp, Unknown
  misc_feature (1)..( 12): Result.004 file - promoters50/1024166
attataaacaaa

SEQ ID NO: 159831 - DNA, 12 bp, Unknown
  misc_feature (1)..( 12): Result.004 file - promoters50/1024166
cccaaaaagttt

SEQ ID NO: 159832 - DNA, 12 bp, Unknown
  misc_feature (1)..( 12): Result.004 file - promoters50/1024166
aagaaaaaaaaa

SEQ ID NO: 159833 - DNA, 12 bp, Unknown
  misc_feature (1)..( 12): Result.004 file - promoters50/1024166
accaaaaaaaat

SEQ ID NO: 159834 - DNA, 12 bp, Unknown
  misc_feature (1)..( 12): Result.004 file - promoters50/1024166
tttataagcatt

SEQ ID NO: 159835 - DNA, 13 bp, Unknown
  misc_feature (1)..( 13): Result.004 file - promoters50/1024166
agttatgttttgt

SEQ ID NO: 159836 - DNA, 13 bp, Unknown
  misc_feature (1)..( 13): Result.004 file - promoters50/1024166
tattattttttaa

SEQ ID NO: 159837 - DNA, 13 bp, Unknown
  misc_feature (1)..( 13): Result.004 file - promoters50/1024166
atttatgtatagt

SEQ ID NO: 159838 - DNA, 13 bp, Unknown
  misc_feature (1)..( 13): Result.004 file - promoters50/1024166
agtcatgcaacaa

SEQ ID NO: 159839 - DNA, 13 bp, Unknown
  misc_feature (1)..( 13): Result.004 file - promoters50/1024166
ttttgtgttttgt

SEQ ID NO: 159840 - DNA, 13 bp, Unknown
  misc_feature (1)..( 13): Result.004 file - promoters50/1024189
taatatatattct

SEQ ID NO: 159841 - DNA, 10 bp, Unknown
  misc_feature (1)..( 10): Result.004 file - promoters50/1024189
tctttacagt

SEQ ID NO: 159842 - DNA, 10 bp, Unknown
  misc_feature (1)..( 10): Result.004 file - promoters50/1024189
actttacgtt

SEQ ID NO: 159843 - DNA, 10 bp, Unknown
  misc_feature (1)..( 10): Result.004 file - promoters50/1024189
tctttatcta

SEQ ID NO: 159844 - DNA, 10 bp, Unknown
  misc_feature (1)..( 10): Result.004 file - promoters50/1024189
actatacaac

SEQ ID NO: 159845 - DNA, 10 bp, Unknown
  misc_feature (1)..( 10): Result.004 file - promoters50/1024189
attttttttt

SEQ ID NO: 159846 - DNA, 10 bp, Unknown
  misc_feature (1)..( 10): Result.004 file - promoters50/1024189
gttttttgta

SEQ ID NO: 159847 - DNA, 10 bp, Unknown
  misc_feature (1)..( 10): Result.004 file - promoters50/1024189
ttttttcttt

SEQ ID NO: 159848 - DNA, 8 bp, Unknown
  misc_feature (1)..( 8): Result.004 file - promoters50/1024189
atataata

SEQ ID NO: 159849 - DNA, 8 bp, Unknown
  misc_feature (1)..( 8): Result.004 file - promoters50/1024189
ttattata

SEQ ID NO: 159850 - DNA, 8 bp, Unknown
  misc_feature (1)..( 8): Result.004 file - promoters50/1024189
atataaaa

SEQ ID NO: 159851 - DNA, 8 bp, Unknown
  misc_feature (1)..( 8): Result.004 file - promoters50/1024189
ttataatg

SEQ ID NO: 159852 - DNA, 8 bp, Unknown
  misc_feature (1)..( 8): Result.004 file - promoters50/1024189
atataata

SEQ ID NO: 159853 - DNA, 8 bp, Unknown
  misc_feature (1)..( 8): Result.004 file - promoters50/1024189
gtataaat

SEQ ID NO: 159854 - DNA, 8 bp, Unknown
  misc_feature (1)..( 8): Result.004 file - promoters50/1024189
atatatta

SEQ ID NO: 159855 - DNA, 12 bp, Unknown
  misc_feature (1)..( 12): Result.004 file - promoters50/1024189
gcctaaaatata

SEQ ID NO: 159856 - DNA, 12 bp, Unknown
  misc_feature (1)..( 12): Result.004 file - promoters50/1024189
aaccaaaatata

SEQ ID NO: 159857 - DNA, 12 bp, Unknown
  misc_feature (1)..( 12): Result.004 file - promoters50/1024189
ataaaaaataaa

SEQ ID NO: 159858 - DNA, 12 bp, Unknown
  misc_feature (1)..( 12): Result.004 file - promoters50/1024189
cttgtaaacata

SEQ ID NO: 159859 - DNA, 12 bp, Unknown
  misc_feature (1)..( 12): Result.004 file - promoters50/1024189
ataataaatagg

SEQ ID NO: 159860 - DNA, 12 bp, Unknown
  misc_feature (1)..( 12): Result.004 file - promoters50/1024189
tgtataaattta

SEQ ID NO: 159861 - DNA, 15 bp, Unknown
  misc_feature (1)..( 15): Result.004 file - promoters50/1024189
taataacatcacttt

SEQ ID NO: 159862 - DNA, 15 bp, Unknown
  misc_feature (1)..( 15): Result.004 file - promoters50/1024189
atataaaatcaataa

SEQ ID NO: 159863 - DNA, 15 bp, Unknown
  misc_feature (1)..( 15): Result.004 file - promoters50/1024189
agtagaaattaatat

SEQ ID NO: 159864 - DNA, 15 bp, Unknown
  misc_feature (1)..( 15): Result.004 file - promoters50/1024189
atagataattaagtt

SEQ ID NO: 159865 - DNA, 15 bp, Unknown
  misc_feature (1)..( 15): Result.004 file - promoters50/1024189
accatatattattat

SEQ ID NO: 159866 - DNA, 15 bp, Unknown
  misc_feature (1)..( 15): Result.004 file - promoters50/1024189
gtataaatttactca

SEQ ID NO: 159867 - DNA, 11 bp, Unknown
  misc_feature (1)..( 11): Result.004 file - promoters50/1024189
gttactgattt

SEQ ID NO: 159868 - DNA, 11 bp, Unknown
  misc_feature (1)..( 11): Result.004 file - promoters50/1024189
tttattgatca

SEQ ID NO: 159869 - DNA, 11 bp, Unknown
  misc_feature (1)..( 11): Result.004 file - promoters50/1024189
ttgtctgtttt

SEQ ID NO: 159870 - DNA, 11 bp, Unknown
  misc_feature (1)..( 11): Result.004 file - promoters50/1024189
tttgttggtgt

SEQ ID NO: 159871 - DNA, 11 bp, Unknown
  misc_feature (1)..( 11): Result.004 file - promoters50/1024189
gggattgattc

SEQ ID NO: 159872 - DNA, 11 bp, Unknown
  misc_feature (1)..( 11): Result.004 file - promoters50/1024189
tctatttataa

SEQ ID NO: 159873 - DNA, 13 bp, Unknown
  misc_feature (1)..( 13): Result.004 file - promoters50/1024189
tctaattttgtat

SEQ ID NO: 159874 - DNA, 13 bp, Unknown
  misc_feature (1)..( 13): Result.004 file - promoters50/1024189
tttaattttaatt

SEQ ID NO: 159875 - DNA, 13 bp, Unknown
  misc_feature (1)..( 13): Result.004 file - promoters50/1024189
attaatttttatt

SEQ ID NO: 159876 - DNA, 13 bp, Unknown
  misc_feature (1)..( 13): Result.004 file - promoters50/1024189
attgattctctca

SEQ ID NO: 159877 - DNA, 13 bp, Unknown
  misc_feature (1)..( 13): Result.004 file - promoters50/1024189
attgatcaatcaa

SEQ ID NO: 159878 - DNA, 13 bp, Unknown
  misc_feature (1)..( 13): Result.004 file - promoters50/1024199
ttcaatcttattg

SEQ ID NO: 159879 - DNA, 16 bp, Unknown
  misc_feature (1)..( 16): Result.004 file - promoters50/1024199
atttatgtctttgtat

SEQ ID NO: 159880 - DNA, 16 bp, Unknown
  misc_feature (1)..( 16): Result.004 file - promoters50/1024199
agactcatctctgtgg

SEQ ID NO: 159881 - DNA, 16 bp, Unknown
  misc_feature (1)..( 16): Result.004 file - promoters50/1024199
attaatgtattttatg

SEQ ID NO: 159882 - DNA, 16 bp, Unknown
  misc_feature (1)..( 16): Result.004 file - promoters50/1024199
tataataaattttttc

SEQ ID NO: 159883 - DNA, 16 bp, Unknown
  misc_feature (1)..( 16): Result.004 file - promoters50/1024199
gtgattaaattttata

SEQ ID NO: 159884 - DNA, 16 bp, Unknown
  misc_feature (1)..( 16): Result.004 file - promoters50/1024199
gaattttaattaaaac

SEQ ID NO: 159885 - DNA, 16 bp, Unknown
  misc_feature (1)..( 16): Result.004 file - promoters50/1024199
gctgagccatttatgt

SEQ ID NO: 159886 - DNA, 17 bp, Unknown
  misc_feature (1)..( 17): Result.004 file - promoters50/1024199
tatataaatcccttaaa

SEQ ID NO: 159887 - DNA, 17 bp, Unknown
  misc_feature (1)..( 17): Result.004 file - promoters50/1024199
tttatgaatccatataa

SEQ ID NO: 159888 - DNA, 17 bp, Unknown
  misc_feature (1)..( 17): Result.004 file - promoters50/1024199
ataaataatctcttaaa

SEQ ID NO: 159889 - DNA, 17 bp, Unknown
  misc_feature (1)..( 17): Result.004 file - promoters50/1024199
tttataaactcagtgat

SEQ ID NO: 159890 - DNA, 17 bp, Unknown
  misc_feature (1)..( 17): Result.004 file - promoters50/1024199
agtcttaagcacagaac

SEQ ID NO: 159891 - DNA, 17 bp, Unknown
  misc_feature (1)..( 17): Result.004 file - promoters50/1024199
tttataagtaggtcatt

SEQ ID NO: 159892 - DNA, 10 bp, Unknown
  misc_feature (1)..( 10): Result.004 file - promoters50/1024199
agccatattg

SEQ ID NO: 159893 - DNA, 10 bp, Unknown
  misc_feature (1)..( 10): Result.004 file - promoters50/1024199
aaccatatgt

SEQ ID NO: 159894 - DNA, 10 bp, Unknown
  misc_feature (1)..( 10): Result.004 file - promoters50/1024199
gagcattttg

SEQ ID NO: 159895 - DNA, 10 bp, Unknown
  misc_feature (1)..( 10): Result.004 file - promoters50/1024199
aacaataatg

SEQ ID NO: 159896 - DNA, 11 bp, Unknown
  misc_feature (1)..( 11): Result.004 file - promoters50/1024199
ttcaatcatgt

SEQ ID NO: 159897 - DNA, 11 bp, Unknown
  misc_feature (1)..( 11): Result.004 file - promoters50/1024203
tatcatttttt

SEQ ID NO: 159898 - DNA, 7 bp, Unknown
  misc_feature (1)..( 7): Result.004 file - promoters50/1024203
aaatgtc

SEQ ID NO: 159899 - DNA, 7 bp, Unknown
  misc_feature (1)..( 7): Result.004 file - promoters50/1024203
aaatgta

SEQ ID NO: 159900 - DNA, 7 bp, Unknown
  misc_feature (1)..( 7): Result.004 file - promoters50/1024203
aaaagtc

SEQ ID NO: 159901 - DNA, 7 bp, Unknown
  misc_feature (1)..( 7): Result.004 file - promoters50/1024206
aaatgtc

SEQ ID NO: 159902 - DNA, 13 bp, Unknown
  misc_feature (1)..( 13): Result.004 file - promoters50/1024206
atgttattgatat

SEQ ID NO: 159903 - DNA, 13 bp, Unknown
  misc_feature (1)..( 13): Result.004 file - promoters50/1024206
aaattagtgattc

SEQ ID NO: 159904 - DNA, 13 bp, Unknown
  misc_feature (1)..( 13): Result.004 file - promoters50/1024206
atgttattgttat

SEQ ID NO: 159905 - DNA, 9 bp, Unknown
  misc_feature (1)..( 9): Result.004 file - promoters50/1024206
gggtgatgt

SEQ ID NO: 159906 - DNA, 9 bp, Unknown
  misc_feature (1)..( 9): Result.004 file - promoters50/1024206
tggttatgt

SEQ ID NO: 159907 - DNA, 9 bp, Unknown
  misc_feature (1)..( 9): Result.004 file - promoters50/1024214
tggatattt

SEQ ID NO: 159908 - DNA, 11 bp, Unknown
  misc_feature (1)..( 11): Result.004 file - promoters50/1024214
gcttatattaa

SEQ ID NO: 159909 - DNA, 11 bp, Unknown
  misc_feature (1)..( 11): Result.004 file - promoters50/1024214
gctgatatttg

SEQ ID NO: 159910 - DNA, 11 bp, Unknown
  misc_feature (1)..( 11): Result.004 file - promoters50/1024214
atttatattga

SEQ ID NO: 159911 - DNA, 11 bp, Unknown
  misc_feature (1)..( 11): Result.004 file - promoters50/1024214
atagatttttg

SEQ ID NO: 159912 - DNA, 11 bp, Unknown
  misc_feature (1)..( 11): Result.004 file - promoters50/1024214
ggtgaaattaa

SEQ ID NO: 159913 - DNA, 11 bp, Unknown
  misc_feature (1)..( 11): Result.004 file - promoters50/1024214
gaagactttag

SEQ ID NO: 159914 - DNA, 11 bp, Unknown
  misc_feature (1)..( 11): Result.004 file - promoters50/1024214
tacactataga

SEQ ID NO: 159915 - DNA, 16 bp, Unknown
  misc_feature (1)..( 16): Result.004 file - promoters50/1024214
gtttagtttagaagtc

SEQ ID NO: 159916 - DNA, 16 bp, Unknown
  misc_feature (1)..( 16): Result.004 file - promoters50/1024214
ccattgttgagagatt

SEQ ID NO: 159917 - DNA, 17 bp, Unknown
  misc_feature (1)..( 17): Result.004 file - promoters50/1024214
ttttaattgatgaaaga

SEQ ID NO: 159918 - DNA, 17 bp, Unknown
  misc_feature (1)..( 17): Result.004 file - promoters50/1024214
gtcaaattgatttagct

SEQ ID NO: 159919 - DNA, 17 bp, Unknown
  misc_feature (1)..( 17): Result.004 file - promoters50/1024214
agggatttgattggttg

SEQ ID NO: 159920 - DNA, 17 bp, Unknown
  misc_feature (1)..( 17): Result.004 file - promoters50/1024214
gtcaaatttatttcgta

SEQ ID NO: 159921 - DNA, 13 bp, Unknown
  misc_feature (1)..( 13): Result.004 file - promoters50/1024214
acattggtttagt

SEQ ID NO: 159922 - DNA, 13 bp, Unknown
  misc_feature (1)..( 13): Result.004 file - promoters50/1024214
cattcattttagt

SEQ ID NO: 159923 - DNA, 13 bp, Unknown
  misc_feature (1)..( 13): Result.004 file - promoters50/1024214
aaattgatttagc

SEQ ID NO: 159924 - DNA, 13 bp, Unknown
  misc_feature (1)..( 13): Result.004 file - promoters50/1024214
caattgattctaa

SEQ ID NO: 159925 - DNA, 13 bp, Unknown
  misc_feature (1)..( 13): Result.004 file - promoters50/1024214
gatttgattggtt

SEQ ID NO: 159926 - DNA, 13 bp, Unknown
  misc_feature (1)..( 13): Result.004 file - promoters50/1024214
aaatttatttcgt

SEQ ID NO: 159927 - DNA, 13 bp, Unknown
  misc_feature (1)..( 13): Result.004 file - promoters50/1024214
aaatcgattccgc

SEQ ID NO: 159928 - DNA, 13 bp, Unknown
  misc_feature (1)..( 13): Result.004 file - promoters50/1024214
taattgatgaaag

SEQ ID NO: 159929 - DNA, 13 bp, Unknown
  misc_feature (1)..( 13): Result.004 file - promoters50/1024214
aattgattctaat

SEQ ID NO: 159930 - DNA, 13 bp, Unknown
  misc_feature (1)..( 13): Result.004 file - promoters50/1024214
aattgagcaatgt

SEQ ID NO: 159931 - DNA, 13 bp, Unknown
  misc_feature (1)..( 13): Result.004 file - promoters50/1024214
aattgatgaaaga

SEQ ID NO: 159932 - DNA, 13 bp, Unknown
  misc_feature (1)..( 13): Result.004 file - promoters50/1024214
aattgatttagct

SEQ ID NO: 159933 - DNA, 13 bp, Unknown
  misc_feature (1)..( 13): Result.004 file - promoters50/1024214
aatttatttcgta

SEQ ID NO: 159934 - DNA, 13 bp, Unknown
  misc_feature (1)..( 13): Result.004 file - promoters50/1024236
cattgttgagaga

SEQ ID NO: 159935 - DNA, 9 bp, Unknown
  misc_feature (1)..( 9): Result.004 file - promoters50/1024236
cataataat

SEQ ID NO: 159936 - DNA, 9 bp, Unknown
  misc_feature (1)..( 9): Result.004 file - promoters50/1024236
aataaaaat

SEQ ID NO: 159937 - DNA, 9 bp, Unknown
  misc_feature (1)..( 9): Result.004 file - promoters50/1024236
ttaaataat

SEQ ID NO: 159938 - DNA, 9 bp, Unknown
  misc_feature (1)..( 9): Result.004 file - promoters50/1024236
attaataaa

SEQ ID NO: 159939 - DNA, 9 bp, Unknown
  misc_feature (1)..( 9): Result.004 file - promoters50/1024236
attagtaaa

SEQ ID NO: 159940 - DNA, 9 bp, Unknown
  misc_feature (1)..( 9): Result.004 file - promoters50/1024236
tatagtatg

SEQ ID NO: 159941 - DNA, 15 bp, Unknown
  misc_feature (1)..( 15): Result.004 file - promoters50/1024236
ctgaaaaagaaatta

SEQ ID NO: 159942 - DNA, 15 bp, Unknown
  misc_feature (1)..( 15): Result.004 file - promoters50/1024236
aaacccaagacattt

SEQ ID NO: 159943 - DNA, 15 bp, Unknown
  misc_feature (1)..( 15): Result.004 file - promoters50/1024236
aaaccctagacttgg

SEQ ID NO: 159944 - DNA, 15 bp, Unknown
  misc_feature (1)..( 15): Result.004 file - promoters50/1024236
attttctatacttgg

SEQ ID NO: 159945 - DNA, 15 bp, Unknown
  misc_feature (1)..( 15): Result.004 file - promoters50/1024236
caactttaggcttag

SEQ ID NO: 159946 - DNA, 15 bp, Unknown
  misc_feature (1)..( 15): Result.004 file - promoters50/1024236
taagggtatatttgt

SEQ ID NO: 159947 - DNA, 8 bp, Unknown
  misc_feature (1)..( 8): Result.004 file - promoters50/1024236
taaaaaaa

SEQ ID NO: 159948 - DNA, 8 bp, Unknown
  misc_feature (1)..( 8): Result.004 file - promoters50/1024236
gaaaaaaa

SEQ ID NO: 159949 - DNA, 8 bp, Unknown
  misc_feature (1)..( 8): Result.004 file - promoters50/1024236
taaaaata

SEQ ID NO: 159950 - DNA, 8 bp, Unknown
  misc_feature (1)..( 8): Result.004 file - promoters50/1024236
taaataaa

SEQ ID NO: 159951 - DNA, 8 bp, Unknown
  misc_feature (1)..( 8): Result.004 file - promoters50/1024236
caaaaaac

SEQ ID NO: 159952 - DNA, 8 bp, Unknown
  misc_feature (1)..( 8): Result.004 file - promoters50/1024236
agaataaa

SEQ ID NO: 159953 - DNA, 13 bp, Unknown
  misc_feature (1)..( 13): Result.004 file - promoters50/1024236
tttactatttata

SEQ ID NO: 159954 - DNA, 13 bp, Unknown
  misc_feature (1)..( 13): Result.004 file - promoters50/1024236
taaactcttttga

SEQ ID NO: 159955 - DNA, 13 bp, Unknown
  misc_feature (1)..( 13): Result.004 file - promoters50/1024236
tttaatatatatt

SEQ ID NO: 159956 - DNA, 13 bp, Unknown
  misc_feature (1)..( 13): Result.004 file - promoters50/1024236
atcgttattaata

SEQ ID NO: 159957 - DNA, 13 bp, Unknown
  misc_feature (1)..( 13): Result.004 file - promoters50/1024236
attagtaaaagaa

SEQ ID NO: 159958 - DNA, 13 bp, Unknown
  misc_feature (1)..( 13): Result.004 file - promoters50/1024247
taatttcttttca

SEQ ID NO: 159959 - DNA, 8 bp, Unknown
  misc_feature (1)..( 8): Result.004 file - promoters50/1024247
cactatgc

SEQ ID NO: 159960 - DNA, 8 bp, Unknown
  misc_feature (1)..( 8): Result.004 file - promoters50/1024247
aactttgc

SEQ ID NO: 159961 - DNA, 8 bp, Unknown
  misc_feature (1)..( 8): Result.004 file - promoters50/1024247
aacttttt

SEQ ID NO: 159962 - DNA, 8 bp, Unknown
  misc_feature (1)..( 8): Result.004 file - promoters50/1024247
tacttttg

SEQ ID NO: 159963 - DNA, 11 bp, Unknown
  misc_feature (1)..( 11): Result.004 file - promoters50/1024247
acatctctctt

SEQ ID NO: 159964 - DNA, 11 bp, Unknown
  misc_feature (1)..( 11): Result.004 file - promoters50/1024247
tgtactccctt

SEQ ID NO: 159965 - DNA, 11 bp, Unknown
  misc_feature (1)..( 11): Result.004 file - promoters50/1024247
atcactcactc

SEQ ID NO: 159966 - DNA, 9 bp, Unknown
  misc_feature (1)..( 9): Result.004 file - promoters50/1024247
gcagagaag

SEQ ID NO: 159967 - DNA, 9 bp, Unknown
  misc_feature (1)..( 9): Result.004 file - promoters50/1024247
gcaaagaaa

SEQ ID NO: 159968 - DNA, 9 bp, Unknown
  misc_feature (1)..( 9): Result.004 file - promoters50/1024247
tgaaagaaa

SEQ ID NO: 159969 - DNA, 8 bp, Unknown
  misc_feature (1)..( 8): Result.004 file - promoters50/1024247
tctttttc

SEQ ID NO: 159970 - DNA, 8 bp, Unknown
  misc_feature (1)..( 8): Result.004 file - promoters50/1024247
gatttttc

SEQ ID NO: 159971 - DNA, 8 bp, Unknown
  misc_feature (1)..( 8): Result.004 file - promoters50/1024247
tcttttta

SEQ ID NO: 159972 - DNA, 11 bp, Unknown
  misc_feature (1)..( 11): Result.004 file - promoters50/1024247
ctacagaaaga

SEQ ID NO: 159973 - DNA, 11 bp, Unknown
  misc_feature (1)..( 11): Result.004 file - promoters50/1024247
taacataaaga

SEQ ID NO: 159974 - DNA, 11 bp, Unknown
  misc_feature (1)..( 11): Result.004 file - promoters50/1024251
taacatgaaga

SEQ ID NO: 159975 - DNA, 8 bp, Unknown
  misc_feature (1)..( 8): Result.004 file - promoters50/1024251
aaaacaaa

SEQ ID NO: 159976 - DNA, 8 bp, Unknown
  misc_feature (1)..( 8): Result.004 file - promoters50/1024251
caaataaa

SEQ ID NO: 159977 - DNA, 8 bp, Unknown
  misc_feature (1)..( 8): Result.004 file - promoters50/1024251
caattaag

SEQ ID NO: 159978 - DNA, 7 bp, Unknown
  misc_feature (1)..( 7): Result.004 file - promoters50/1024251
attttaa

SEQ ID NO: 159979 - DNA, 7 bp, Unknown
  misc_feature (1)..( 7): Result.004 file - promoters50/1024251
attttat

SEQ ID NO: 159980 - DNA, 7 bp, Unknown
  misc_feature (1)..( 7): Result.004 file - promoters50/1024251
tttttat

SEQ ID NO: 159981 - DNA, 9 bp, Unknown
  misc_feature (1)..( 9): Result.004 file - promoters50/1024251
acaacaagt

SEQ ID NO: 159982 - DNA, 9 bp, Unknown
  misc_feature (1)..( 9): Result.004 file - promoters50/1024251
acaacaata

SEQ ID NO: 159983 - DNA, 9 bp, Unknown
  misc_feature (1)..( 9): Result.004 file - promoters50/1024251
ataacaata

SEQ ID NO: 159984 - DNA, 8 bp, Unknown
  misc_feature (1)..( 8): Result.004 file - promoters50/1024251
caaaataa

SEQ ID NO: 159985 - DNA, 8 bp, Unknown
  misc_feature (1)..( 8): Result.004 file - promoters50/1024251
taaattaa

SEQ ID NO: 159986 - DNA, 8 bp, Unknown
  misc_feature (1)..( 8): Result.004 file - promoters50/1024257
taaattgt

SEQ ID NO: 159987 - DNA, 9 bp, Unknown
  misc_feature (1)..( 9): Result.004 file - promoters50/1024257
tttctaaat

SEQ ID NO: 159988 - DNA, 9 bp, Unknown
  misc_feature (1)..( 9): Result.004 file - promoters50/1024257
tttctaaaa

SEQ ID NO: 159989 - DNA, 9 bp, Unknown
  misc_feature (1)..( 9): Result.004 file - promoters50/1024257
attctaact

SEQ ID NO: 159990 - DNA, 9 bp, Unknown
  misc_feature (1)..( 9): Result.004 file - promoters50/1024257
aatctaaca

SEQ ID NO: 159991 - DNA, 10 bp, Unknown
  misc_feature (1)..( 10): Result.004 file - promoters50/1024277
ggcctacaat

SEQ ID NO: 159992 - DNA, 9 bp, Unknown
  misc_feature (1)..( 9): Result.004 file - promoters50/1024277
taaaaaaaa

SEQ ID NO: 159993 - DNA, 9 bp, Unknown
  misc_feature (1)..( 9): Result.004 file - promoters50/1024277
taaacaaaa

SEQ ID NO: 159994 - DNA, 9 bp, Unknown
  misc_feature (1)..( 9): Result.004 file - promoters50/1024277
taaacaaaa

SEQ ID NO: 159995 - DNA, 7 bp, Unknown
  misc_feature (1)..( 7): Result.004 file - promoters50/1024277
ttctaat

SEQ ID NO: 159996 - DNA, 7 bp, Unknown
  misc_feature (1)..( 7): Result.004 file - promoters50/1024277
ttctaat

SEQ ID NO: 159997 - DNA, 7 bp, Unknown
  misc_feature (1)..( 7): Result.004 file - promoters50/1024288
ttctaat

SEQ ID NO: 159998 - DNA, 7 bp, Unknown
  misc_feature (1)..( 7): Result.004 file - promoters50/1024288
gattttt

SEQ ID NO: 159999 - DNA, 7 bp, Unknown
  misc_feature (1)..( 7): Result.004 file - promoters50/1024288
gattttt

SEQ ID NO: 160000 - DNA, 7 bp, Unknown
  misc_feature (1)..( 7): Result.004 file - promoters50/1024288
gattttt

SEQ ID NO: 160001 - DNA, 11 bp, Unknown
  misc_feature (1)..( 11): Result.004 file - promoters50/1024288
aacaaaaagtc

SEQ ID NO: 160002 - DNA, 11 bp, Unknown
  misc_feature (1)..( 11): Result.004 file - promoters50/1024288
aaccaaaactt

SEQ ID NO: 160003 - DNA, 11 bp, Unknown
  misc_feature (1)..( 11): Result.004 file - promoters50/1024288
aaaaaaataaa

SEQ ID NO: 160004 - DNA, 9 bp, Unknown
  misc_feature (1)..( 9): Result.004 file - promoters50/1024288
aagatatgg

SEQ ID NO: 160005 - DNA, 9 bp, Unknown
  misc_feature (1)..( 9): Result.004 file - promoters50/1024288
tggatatgt

SEQ ID NO: 160006 - DNA, 9 bp, Unknown
  misc_feature (1)..( 9): Result.004 file - promoters50/1024288
tcaatatat

SEQ ID NO: 160007 - DNA, 9 bp, Unknown
  misc_feature (1)..( 9): Result.004 file - promoters50/1024288
tcaaagagt

SEQ ID NO: 160008 - DNA, 9 bp, Unknown
  misc_feature (1)..( 9): Result.004 file - promoters50/1024288
tcaaagaat

SEQ ID NO: 160009 - DNA, 9 bp, Unknown
  misc_feature (1)..( 9): Result.004 file - promoters50/1024355
tgaaaaaat

SEQ ID NO: 160010 - DNA, 9 bp, Unknown
  misc_feature (1)..( 9): Result.004 file - promoters50/1024355
tttgatttt

SEQ ID NO: 160011 - DNA, 9 bp, Unknown
  misc_feature (1)..( 9): Result.004 file - promoters50/1024355
tttgataca

SEQ ID NO: 160012 - DNA, 9 bp, Unknown
  misc_feature (1)..( 9): Result.004 file - promoters50/1024355
tttgattgt

SEQ ID NO: 160013 - DNA, 9 bp, Unknown
  misc_feature (1)..( 9): Result.004 file - promoters50/1024355
cttgacaca

SEQ ID NO: 160014 - DNA, 9 bp, Unknown
  misc_feature (1)..( 9): Result.004 file - promoters50/1024355
gttgattta

SEQ ID NO: 160015 - DNA, 9 bp, Unknown
  misc_feature (1)..( 9): Result.004 file - promoters50/1024355
attgttttg

SEQ ID NO: 160016 - DNA, 11 bp, Unknown
  misc_feature (1)..( 11): Result.004 file - promoters50/1024355
ctatgctctgt

SEQ ID NO: 160017 - DNA, 11 bp, Unknown
  misc_feature (1)..( 11): Result.004 file - promoters50/1024355
ctatactctct

SEQ ID NO: 160018 - DNA, 11 bp, Unknown
  misc_feature (1)..( 11): Result.004 file - promoters50/1024355
atatacttttt

SEQ ID NO: 160019 - DNA, 11 bp, Unknown
  misc_feature (1)..( 11): Result.004 file - promoters50/1024355
gtattcttatg

SEQ ID NO: 160020 - DNA, 11 bp, Unknown
  misc_feature (1)..( 11): Result.004 file - promoters50/1024355
ttgaactttct

SEQ ID NO: 160021 - DNA, 11 bp, Unknown
  misc_feature (1)..( 11): Result.004 file - promoters50/1024367
gtattcaaata

SEQ ID NO: 160022 - DNA, 10 bp, Unknown
  misc_feature (1)..( 10): Result.004 file - promoters50/1024367
ataagtttca

SEQ ID NO: 160023 - DNA, 10 bp, Unknown
  misc_feature (1)..( 10): Result.004 file - promoters50/1024367
ttaactttga

SEQ ID NO: 160024 - DNA, 10 bp, Unknown
  misc_feature (1)..( 10): Result.004 file - promoters50/1024367
aaaagtttat

SEQ ID NO: 160025 - DNA, 10 bp, Unknown
  misc_feature (1)..( 10): Result.004 file - promoters50/1024367
tgaagtatca

SEQ ID NO: 160026 - DNA, 10 bp, Unknown
  misc_feature (1)..( 10): Result.004 file - promoters50/1024367
ataaattttg

SEQ ID NO: 160027 - DNA, 10 bp, Unknown
  misc_feature (1)..( 10): Result.004 file - promoters50/1024367
tgaactttag

SEQ ID NO: 160028 - DNA, 9 bp, Unknown
  misc_feature (1)..( 9): Result.004 file - promoters50/1024367
aaaataata

SEQ ID NO: 160029 - DNA, 9 bp, Unknown
  misc_feature (1)..( 9): Result.004 file - promoters50/1024367
aaaataaag

SEQ ID NO: 160030 - DNA, 9 bp, Unknown
  misc_feature (1)..( 9): Result.004 file - promoters50/1024367
caaatcata

SEQ ID NO: 160031 - DNA, 9 bp, Unknown
  misc_feature (1)..( 9): Result.004 file - promoters50/1024367
gaaataaat

SEQ ID NO: 160032 - DNA, 9 bp, Unknown
  misc_feature (1)..( 9): Result.004 file - promoters50/1024367
caaacaatg

SEQ ID NO: 160033 - DNA, 9 bp, Unknown
  misc_feature (1)..( 9): Result.004 file - promoters50/1024367
aaaataaaa

SEQ ID NO: 160034 - DNA, 12 bp, Unknown
  misc_feature (1)..( 12): Result.004 file - promoters50/1024367
tttatatataac

SEQ ID NO: 160035 - DNA, 12 bp, Unknown
  misc_feature (1)..( 12): Result.004 file - promoters50/1024367
actatataagaa

SEQ ID NO: 160036 - DNA, 12 bp, Unknown
  misc_feature (1)..( 12): Result.004 file - promoters50/1024367
catatatataac

SEQ ID NO: 160037 - DNA, 12 bp, Unknown
  misc_feature (1)..( 12): Result.004 file - promoters50/1024367
tttatattctca

SEQ ID NO: 160038 - DNA, 12 bp, Unknown
  misc_feature (1)..( 12): Result.004 file - promoters50/1024367
tgtatatatact

SEQ ID NO: 160039 - DNA, 12 bp, Unknown
  misc_feature (1)..( 12): Result.004 file - promoters50/1024367
gagatataatac

SEQ ID NO: 160040 - DNA, 12 bp, Unknown
  misc_feature (1)..( 12): Result.004 file - promoters50/1024367
cctatatataaa

SEQ ID NO: 160041 - DNA, 9 bp, Unknown
  misc_feature (1)..( 9): Result.004 file - promoters50/1024367
ataataaat

SEQ ID NO: 160042 - DNA, 9 bp, Unknown
  misc_feature (1)..( 9): Result.004 file - promoters50/1024367
ataaaaaac

SEQ ID NO: 160043 - DNA, 9 bp, Unknown
  misc_feature (1)..( 9): Result.004 file - promoters50/1024367
ttaaaaaag

SEQ ID NO: 160044 - DNA, 9 bp, Unknown
  misc_feature (1)..( 9): Result.004 file - promoters50/1024367
aaaataaaa

SEQ ID NO: 160045 - DNA, 9 bp, Unknown
  misc_feature (1)..( 9): Result.004 file - promoters50/1024367
gcaaacaat

SEQ ID NO: 160046 - DNA, 9 bp, Unknown
  misc_feature (1)..( 9): Result.004 file - promoters50/1024367
acaaaaaga

SEQ ID NO: 160047 - DNA, 8 bp, Unknown
  misc_feature (1)..( 8): Result.004 file - promoters50/1024367
aattttgg

SEQ ID NO: 160048 - DNA, 8 bp, Unknown
  misc_feature (1)..( 8): Result.004 file - promoters50/1024367
aattttaa

SEQ ID NO: 160049 - DNA, 8 bp, Unknown
  misc_feature (1)..( 8): Result.004 file - promoters50/1024367
aatttttt

SEQ ID NO: 160050 - DNA, 8 bp, Unknown
  misc_feature (1)..( 8): Result.004 file - promoters50/1024367
tattttat

SEQ ID NO: 160051 - DNA, 8 bp, Unknown
  misc_feature (1)..( 8): Result.004 file - promoters50/1024367
ctttttat

SEQ ID NO: 160052 - DNA, 9 bp, Unknown
  misc_feature (1)..( 9): Result.004 file - promoters50/1024367
tatttctat

SEQ ID NO: 160053 - DNA, 15 bp, Unknown
  misc_feature (1)..( 15): Result.004 file - promoters50/1024367
gataggttttccgaa

SEQ ID NO: 160054 - DNA, 15 bp, Unknown
  misc_feature (1)..( 15): Result.004 file - promoters50/1024367
gatagattttcgatc

SEQ ID NO: 160055 - DNA, 15 bp, Unknown
  misc_feature (1)..( 15): Result.004 file - promoters50/1024367
taattcttttccatc

SEQ ID NO: 160056 - DNA, 15 bp, Unknown
  misc_feature (1)..( 15): Result.004 file - promoters50/1024367
tatacattcgtttta

SEQ ID NO: 160057 - DNA, 15 bp, Unknown
  misc_feature (1)..( 15): Result.004 file - promoters50/1024367
gtggaaatttcccat

SEQ ID NO: 160058 - DNA, 15 bp, Unknown
  misc_feature (1)..( 15): Result.004 file - promoters50/1024367
taatgattttgtcta

SEQ ID NO: 160059 - DNA, 10 bp, Unknown
  misc_feature (1)..( 10): Result.004 file - promoters50/1024367
gtgtttgatt

SEQ ID NO: 160060 - DNA, 10 bp, Unknown
  misc_feature (1)..( 10): Result.004 file - promoters50/1024367
catttttatt

SEQ ID NO: 160061 - DNA, 10 bp, Unknown
  misc_feature (1)..( 10): Result.004 file - promoters50/1024367
atatttcatt

SEQ ID NO: 160062 - DNA, 10 bp, Unknown
  misc_feature (1)..( 10): Result.004 file - promoters50/1024367
tttttttaca

SEQ ID NO: 160063 - DNA, 10 bp, Unknown
  misc_feature (1)..( 10): Result.004 file - promoters50/1024367
aatttttagt

SEQ ID NO: 160064 - DNA, 10 bp, Unknown
  misc_feature (1)..( 10): Result.004 file - promoters50/1024375
aatctttaaa

SEQ ID NO: 160065 - DNA, 9 bp, Unknown
  misc_feature (1)..( 9): Result.004 file - promoters50/1024375
aatatgtat

SEQ ID NO: 160066 - DNA, 9 bp, Unknown
  misc_feature (1)..( 9): Result.004 file - promoters50/1024375
aatttgtta

SEQ ID NO: 160067 - DNA, 9 bp, Unknown
  misc_feature (1)..( 9): Result.004 file - promoters50/1024375
gttatgtac

SEQ ID NO: 160068 - DNA, 9 bp, Unknown
  misc_feature (1)..( 9): Result.004 file - promoters50/1024375
ggtttgttg

SEQ ID NO: 160069 - DNA, 9 bp, Unknown
  misc_feature (1)..( 9): Result.004 file - promoters50/1024375
tctttgtta

SEQ ID NO: 160070 - DNA, 9 bp, Unknown
  misc_feature (1)..( 9): Result.004 file - promoters50/1024375
cgtttttta

SEQ ID NO: 160071 - DNA, 9 bp, Unknown
  misc_feature (1)..( 9): Result.004 file - promoters50/1024375
aatttggat

SEQ ID NO: 160072 - DNA, 12 bp, Unknown
  misc_feature (1)..( 12): Result.004 file - promoters50/1024375
aataaaaatatt

SEQ ID NO: 160073 - DNA, 12 bp, Unknown
  misc_feature (1)..( 12): Result.004 file - promoters50/1024375
tttaataatggg

SEQ ID NO: 160074 - DNA, 12 bp, Unknown
  misc_feature (1)..( 12): Result.004 file - promoters50/1024375
aagaaaaaaaaa

SEQ ID NO: 160075 - DNA, 12 bp, Unknown
  misc_feature (1)..( 12): Result.004 file - promoters50/1024375
cagaataaaaac

SEQ ID NO: 160076 - DNA, 12 bp, Unknown
  misc_feature (1)..( 12): Result.004 file - promoters50/1024375
aatcaaaaaatt

SEQ ID NO: 160077 - DNA, 12 bp, Unknown
  misc_feature (1)..( 12): Result.004 file - promoters50/1024408
actaaaccaaga

SEQ ID NO: 160078 - DNA, 8 bp, Unknown
  misc_feature (1)..( 8): Result.004 file - promoters50/1024408
tttgttaa

SEQ ID NO: 160079 - DNA, 8 bp, Unknown
  misc_feature (1)..( 8): Result.004 file - promoters50/1024408
tttgataa

SEQ ID NO: 160080 - DNA, 8 bp, Unknown
  misc_feature (1)..( 8): Result.004 file - promoters50/1024408
tttatgac

SEQ ID NO: 160081 - DNA, 8 bp, Unknown
  misc_feature (1)..( 8): Result.004 file - promoters50/1024408
actataat

SEQ ID NO: 160082 - DNA, 8 bp, Unknown
  misc_feature (1)..( 8): Result.004 file - promoters50/1024408
actaaaat

SEQ ID NO: 160083 - DNA, 8 bp, Unknown
  misc_feature (1)..( 8): Result.004 file - promoters50/1024420
catataat

SEQ ID NO: 160084 - DNA, 12 bp, Unknown
  misc_feature (1)..( 12): Result.004 file - promoters50/1024420
ataaaaataaaa

SEQ ID NO: 160085 - DNA, 12 bp, Unknown
  misc_feature (1)..( 12): Result.004 file - promoters50/1024420
ataaaaaaaaaa

SEQ ID NO: 160086 - DNA, 12 bp, Unknown
  misc_feature (1)..( 12): Result.004 file - promoters50/1024431
atacaaacgttg

SEQ ID NO: 160087 - DNA, 15 bp, Unknown
  misc_feature (1)..( 15): Result.004 file - promoters50/1024431
cggtatataattcaa

SEQ ID NO: 160088 - DNA, 15 bp, Unknown
  misc_feature (1)..( 15): Result.004 file - promoters50/1024431
caaaaaataattttc

SEQ ID NO: 160089 - DNA, 15 bp, Unknown
  misc_feature (1)..( 15): Result.004 file - promoters50/1024431
tgcattattattcaa

SEQ ID NO: 160090 - DNA, 15 bp, Unknown
  misc_feature (1)..( 15): Result.004 file - promoters50/1024431
atataaataaatcaa

SEQ ID NO: 160091 - DNA, 15 bp, Unknown
  misc_feature (1)..( 15): Result.004 file - promoters50/1024431
ttaaatacaatttca

SEQ ID NO: 160092 - DNA, 15 bp, Unknown
  misc_feature (1)..( 15): Result.004 file - promoters50/1024431
caaaaaataatctag

SEQ ID NO: 160093 - DNA, 16 bp, Unknown
  misc_feature (1)..( 16): Result.004 file - promoters50/1024431
caacttttcttagttt

SEQ ID NO: 160094 - DNA, 16 bp, Unknown
  misc_feature (1)..( 16): Result.004 file - promoters50/1024431
taattttcctttgtaa

SEQ ID NO: 160095 - DNA, 16 bp, Unknown
  misc_feature (1)..( 16): Result.004 file - promoters50/1024431
taggttttgttatgga

SEQ ID NO: 160096 - DNA, 16 bp, Unknown
  misc_feature (1)..( 16): Result.004 file - promoters50/1024431
tatatcttcttatttt

SEQ ID NO: 160097 - DNA, 16 bp, Unknown
  misc_feature (1)..( 16): Result.004 file - promoters50/1024431
tatattttaggtgtac

SEQ ID NO: 160098 - DNA, 16 bp, Unknown
  misc_feature (1)..( 16): Result.004 file - promoters50/1024431
aatatttttcttattg

SEQ ID NO: 160099 - DNA, 12 bp, Unknown
  misc_feature (1)..( 12): Result.004 file - promoters50/1024431
aaaataactcac

SEQ ID NO: 160100 - DNA, 12 bp, Unknown
  misc_feature (1)..( 12): Result.004 file - promoters50/1024431
gaaataaatcac

SEQ ID NO: 160101 - DNA, 12 bp, Unknown
  misc_feature (1)..( 12): Result.004 file - promoters50/1024431
gaaataaaaaga

SEQ ID NO: 160102 - DNA, 12 bp, Unknown
  misc_feature (1)..( 12): Result.004 file - promoters50/1024431
aaaatatatcag

SEQ ID NO: 160103 - DNA, 12 bp, Unknown
  misc_feature (1)..( 12): Result.004 file - promoters50/1024431
gagataaatagt

SEQ ID NO: 160104 - DNA, 12 bp, Unknown
  misc_feature (1)..( 12): Result.004 file - promoters50/1024454
tagataaagttt

SEQ ID NO: 160105 - DNA, 9 bp, Unknown
  misc_feature (1)..( 9): Result.004 file - promoters50/1024454
aaacagaaa

SEQ ID NO: 160106 - DNA, 9 bp, Unknown
  misc_feature (1)..( 9): Result.004 file - promoters50/1024454
atacataaa

SEQ ID NO: 160107 - DNA, 9 bp, Unknown
  misc_feature (1)..( 9): Result.004 file - promoters50/1024470
aaagagaat

SEQ ID NO: 160108 - DNA, 10 bp, Unknown
  misc_feature (1)..( 10): Result.004 file - promoters50/1024470
taatggagaa

SEQ ID NO: 160109 - DNA, 10 bp, Unknown
  misc_feature (1)..( 10): Result.004 file - promoters50/1024470
ggaaggagaa

SEQ ID NO: 160110 - DNA, 10 bp, Unknown
  misc_feature (1)..( 10): Result.004 file - promoters50/1024470
ggagggagat

SEQ ID NO: 160111 - DNA, 7 bp, Unknown
  misc_feature (1)..( 7): Result.004 file - promoters50/1024470
tttttaa

SEQ ID NO: 160112 - DNA, 7 bp, Unknown
  misc_feature (1)..( 7): Result.004 file - promoters50/1024470
tttttac

SEQ ID NO: 160113 - DNA, 7 bp, Unknown
  misc_feature (1)..( 7): Result.004 file - promoters50/1024470
ttttttt

SEQ ID NO: 160114 - DNA, 7 bp, Unknown
  misc_feature (1)..( 7): Result.004 file - promoters50/1024470
ttttaac

SEQ ID NO: 160115 - DNA, 7 bp, Unknown
  misc_feature (1)..( 7): Result.004 file - promoters50/1024470
tttaaac

SEQ ID NO: 160116 - DNA, 7 bp, Unknown
  misc_feature (1)..( 7): Result.004 file - promoters50/1024470
tttaaaa

SEQ ID NO: 160117 - DNA, 11 bp, Unknown
  misc_feature (1)..( 11): Result.004 file - promoters50/1024470
taaatttatac

SEQ ID NO: 160118 - DNA, 11 bp, Unknown
  misc_feature (1)..( 11): Result.004 file - promoters50/1024470
taaacttaact

SEQ ID NO: 160119 - DNA, 11 bp, Unknown
  misc_feature (1)..( 11): Result.004 file - promoters50/1024470
attatttttac

SEQ ID NO: 160120 - DNA, 9 bp, Unknown
  misc_feature (1)..( 9): Result.004 file - promoters50/1024470
attttctta

SEQ ID NO: 160121 - DNA, 9 bp, Unknown
  misc_feature (1)..( 9): Result.004 file - promoters50/1024470
gttttcttg

SEQ ID NO: 160122 - DNA, 9 bp, Unknown
  misc_feature (1)..( 9): Result.004 file - promoters50/1024470
attttttta

SEQ ID NO: 160123 - DNA, 11 bp, Unknown
  misc_feature (1)..( 11): Result.004 file - promoters50/1024470
ttttaaaggga

SEQ ID NO: 160124 - DNA, 11 bp, Unknown
  misc_feature (1)..( 11): Result.004 file - promoters50/1024470
tttaaaaagga

SEQ ID NO: 160125 - DNA, 11 bp, Unknown
  misc_feature (1)..( 11): Result.004 file - promoters50/1024470
tttaaacagaa

SEQ ID NO: 160126 - DNA, 7 bp, Unknown
  misc_feature (1)..( 7): Result.004 file - promoters50/1024470
aaattgt

SEQ ID NO: 160127 - DNA, 7 bp, Unknown
  misc_feature (1)..( 7): Result.004 file - promoters50/1024470
taattgt

SEQ ID NO: 160128 - DNA, 7 bp, Unknown
  misc_feature (1)..( 7): Result.004 file - promoters50/1024499
gaatttg

SEQ ID NO: 160129 - DNA, 12 bp, Unknown
  misc_feature (1)..( 12): Result.004 file - promoters50/1024499
tcgaaccaaaat

SEQ ID NO: 160130 - DNA, 12 bp, Unknown
  misc_feature (1)..( 12): Result.004 file - promoters50/1024499
agaaactaaaaa

SEQ ID NO: 160131 - DNA, 12 bp, Unknown
  misc_feature (1)..( 12): Result.004 file - promoters50/1024499
aaaaaataaaaa

SEQ ID NO: 160132 - DNA, 12 bp, Unknown
  misc_feature (1)..( 12): Result.004 file - promoters50/1024499
tttaattaaaaa

SEQ ID NO: 160133 - DNA, 12 bp, Unknown
  misc_feature (1)..( 12): Result.004 file - promoters50/1024499
ttttattaattt

SEQ ID NO: 160134 - DNA, 12 bp, Unknown
  misc_feature (1)..( 12): Result.004 file - promoters50/1024499
atttactaatag

SEQ ID NO: 160135 - DNA, 11 bp, Unknown
  misc_feature (1)..( 11): Result.004 file - promoters50/1024499
aacattaatat

SEQ ID NO: 160136 - DNA, 11 bp, Unknown
  misc_feature (1)..( 11): Result.004 file - promoters50/1024499
gacaataatag

SEQ ID NO: 160137 - DNA, 11 bp, Unknown
  misc_feature (1)..( 11): Result.004 file - promoters50/1024499
aacatttcata

SEQ ID NO: 160138 - DNA, 11 bp, Unknown
  misc_feature (1)..( 11): Result.004 file - promoters50/1024499
ctttttaatat

SEQ ID NO: 160139 - DNA, 11 bp, Unknown
  misc_feature (1)..( 11): Result.004 file - promoters50/1024499
aacatttaatt

SEQ ID NO: 160140 - DNA, 11 bp, Unknown
  misc_feature (1)..( 11): Result.004 file - promoters50/1024499
tacattttgta

SEQ ID NO: 160141 - DNA, 18 bp, Unknown
  misc_feature (1)..( 18): Result.004 file - promoters50/1024499
aactaaaaatatatttat

SEQ ID NO: 160142 - DNA, 18 bp, Unknown
  misc_feature (1)..( 18): Result.004 file - promoters50/1024499
agtataaaatactttatc

SEQ ID NO: 160143 - DNA, 18 bp, Unknown
  misc_feature (1)..( 18): Result.004 file - promoters50/1024499
caagtaagatattttttt

SEQ ID NO: 160144 - DNA, 18 bp, Unknown
  misc_feature (1)..( 18): Result.004 file - promoters50/1024499
acttttaaatacttttta

SEQ ID NO: 160145 - DNA, 18 bp, Unknown
  misc_feature (1)..( 18): Result.004 file - promoters50/1024499
agtatataattttagaga

SEQ ID NO: 160146 - DNA, 18 bp, Unknown
  misc_feature (1)..( 18): Result.004 file - promoters50/1024499
atagccacattgttttta

SEQ ID NO: 160147 - DNA, 11 bp, Unknown
  misc_feature (1)..( 11): Result.004 file - promoters50/1024499
actataaatag

SEQ ID NO: 160148 - DNA, 11 bp, Unknown
  misc_feature (1)..( 11): Result.004 file - promoters50/1024499
tctataaaaaa

SEQ ID NO: 160149 - DNA, 11 bp, Unknown
  misc_feature (1)..( 11): Result.004 file - promoters50/1024499
tatataaatag

SEQ ID NO: 160150 - DNA, 11 bp, Unknown
  misc_feature (1)..( 11): Result.004 file - promoters50/1024499
catataaataa

SEQ ID NO: 160151 - DNA, 11 bp, Unknown
  misc_feature (1)..( 11): Result.004 file - promoters50/1024499
tatataaataa

SEQ ID NO: 160152 - DNA, 11 bp, Unknown
  misc_feature (1)..( 11): Result.004 file - promoters50/1024499
actatatatat

SEQ ID NO: 160153 - DNA, 11 bp, Unknown
  misc_feature (1)..( 11): Result.004 file - promoters50/1024499
tatataaatac

SEQ ID NO: 160154 - DNA, 16 bp, Unknown
  misc_feature (1)..( 16): Result.004 file - promoters50/1024499
gaaaatatttgtaatc

SEQ ID NO: 160155 - DNA, 16 bp, Unknown
  misc_feature (1)..( 16): Result.004 file - promoters50/1024499
tagtagatttgttaca

SEQ ID NO: 160156 - DNA, 16 bp, Unknown
  misc_feature (1)..( 16): Result.004 file - promoters50/1024499
aactttctttttaatg

SEQ ID NO: 160157 - DNA, 16 bp, Unknown
  misc_feature (1)..( 16): Result.004 file - promoters50/1024499
ttttaattttgttatt

SEQ ID NO: 160158 - DNA, 16 bp, Unknown
  misc_feature (1)..( 16): Result.004 file - promoters50/1024499
aattaaacttttaaat

SEQ ID NO: 160159 - DNA, 16 bp, Unknown
  misc_feature (1)..( 16): Result.004 file - promoters50/1024499
atcgaaacatttaatt

SEQ ID NO: 160160 - DNA, 16 bp, Unknown
  misc_feature (1)..( 16): Result.004 file - promoters50/1024499
ttaaacatttcatagc

SEQ ID NO: 160161 - DNA, 17 bp, Unknown
  misc_feature (1)..( 17): Result.004 file - promoters50/1024499
ggacaataatagtataa

SEQ ID NO: 160162 - DNA, 17 bp, Unknown
  misc_feature (1)..( 17): Result.004 file - promoters50/1024499
tgatcttaccagtatac

SEQ ID NO: 160163 - DNA, 17 bp, Unknown
  misc_feature (1)..( 17): Result.004 file - promoters50/1024499
ccaaaaaaagagtttaa

SEQ ID NO: 160164 - DNA, 17 bp, Unknown
  misc_feature (1)..( 17): Result.004 file - promoters50/1024499
tttatttagcaggataa

SEQ ID NO: 160165 - DNA, 17 bp, Unknown
  misc_feature (1)..( 17): Result.004 file - promoters50/1024499
gtcggtcatcagtatcg

SEQ ID NO: 160166 - DNA, 17 bp, Unknown
  misc_feature (1)..( 17): Result.004 file - promoters50/1024499
tttcattttcaattttt

SEQ ID NO: 160167 - DNA, 13 bp, Unknown
  misc_feature (1)..( 13): Result.004 file - promoters50/1024499
aaaaatatattta

SEQ ID NO: 160168 - DNA, 13 bp, Unknown
  misc_feature (1)..( 13): Result.004 file - promoters50/1024499
taagatatttttt

SEQ ID NO: 160169 - DNA, 13 bp, Unknown
  misc_feature (1)..( 13): Result.004 file - promoters50/1024499
tttaatatttcat

SEQ ID NO: 160170 - DNA, 13 bp, Unknown
  misc_feature (1)..( 13): Result.004 file - promoters50/1024499
taaaatactttat

SEQ ID NO: 160171 - DNA, 13 bp, Unknown
  misc_feature (1)..( 13): Result.004 file - promoters50/1024499
cacagtatataat

SEQ ID NO: 160172 - DNA, 13 bp, Unknown
  misc_feature (1)..( 13): Result.004 file - promoters50/1024499
cacattgttttta

SEQ ID NO: 160173 - DNA, 13 bp, Unknown
  misc_feature (1)..( 13): Result.004 file - promoters50/1024499
attaatgtttgta

SEQ ID NO: 160174 - DNA, 13 bp, Unknown
  misc_feature (1)..( 13): Result.004 file - promoters50/1024499
atatatttatttg

SEQ ID NO: 160175 - DNA, 13 bp, Unknown
  misc_feature (1)..( 13): Result.004 file - promoters50/1024499
gatatttttttta

SEQ ID NO: 160176 - DNA, 13 bp, Unknown
  misc_feature (1)..( 13): Result.004 file - promoters50/1024499
ttgtttttattca

SEQ ID NO: 160177 - DNA, 13 bp, Unknown
  misc_feature (1)..( 13): Result.004 file - promoters50/1024499
agagatttctttg

SEQ ID NO: 160178 - DNA, 13 bp, Unknown
  misc_feature (1)..( 13): Result.004 file - promoters50/1024499
taatgtttgtaat

SEQ ID NO: 160179 - DNA, 13 bp, Unknown
  misc_feature (1)..( 13): Result.004 file - promoters50/1024499
aatactttttaat

SEQ ID NO: 160180 - DNA, 11 bp, Unknown
  misc_feature (1)..( 11): Result.004 file - promoters50/1024499
aatcaatcttt

SEQ ID NO: 160181 - DNA, 11 bp, Unknown
  misc_feature (1)..( 11): Result.004 file - promoters50/1024499
aatcaaatgac

SEQ ID NO: 160182 - DNA, 11 bp, Unknown
  misc_feature (1)..( 11): Result.004 file - promoters50/1024499
aattaatttta

SEQ ID NO: 160183 - DNA, 11 bp, Unknown
  misc_feature (1)..( 11): Result.004 file - promoters50/1024499
aattaatgttt

SEQ ID NO: 160184 - DNA, 11 bp, Unknown
  misc_feature (1)..( 11): Result.004 file - promoters50/1024499
ttttaatgcat

SEQ ID NO: 160185 - DNA, 11 bp, Unknown
  misc_feature (1)..( 11): Result.004 file - promoters50/1024499
ttttaatattt

SEQ ID NO: 160186 - DNA, 15 bp, Unknown
  misc_feature (1)..( 15): Result.004 file - promoters50/1024499
aatcaatctttaagc

SEQ ID NO: 160187 - DNA, 15 bp, Unknown
  misc_feature (1)..( 15): Result.004 file - promoters50/1024499
attcaattttttaaa

SEQ ID NO: 160188 - DNA, 15 bp, Unknown
  misc_feature (1)..( 15): Result.004 file - promoters50/1024499
ttttaatatttcata

SEQ ID NO: 160189 - DNA, 15 bp, Unknown
  misc_feature (1)..( 15): Result.004 file - promoters50/1024499
aattaatgtttgtaa

SEQ ID NO: 160190 - DNA, 15 bp, Unknown
  misc_feature (1)..( 15): Result.004 file - promoters50/1024499
aagatatttttttta

SEQ ID NO: 160191 - DNA, 15 bp, Unknown
  misc_feature (1)..( 15): Result.004 file - promoters50/1024499
tttagagatttcttt

SEQ ID NO: 160192 - DNA, 13 bp, Unknown
  misc_feature (1)..( 13): Result.004 file - promoters50/1024499
tatatttatttga

SEQ ID NO: 160193 - DNA, 13 bp, Unknown
  misc_feature (1)..( 13): Result.004 file - promoters50/1024499
tttattaatttga

SEQ ID NO: 160194 - DNA, 13 bp, Unknown
  misc_feature (1)..( 13): Result.004 file - promoters50/1024499
tcgactaatttta

SEQ ID NO: 160195 - DNA, 13 bp, Unknown
  misc_feature (1)..( 13): Result.004 file - promoters50/1024499
gttattaactttc

SEQ ID NO: 160196 - DNA, 13 bp, Unknown
  misc_feature (1)..( 13): Result.004 file - promoters50/1024499
aaccgtaacttgg

SEQ ID NO: 160197 - DNA, 13 bp, Unknown
  misc_feature (1)..( 13): Result.004 file - promoters50/1024499
tttactaatagaa

SEQ ID NO: 160198 - DNA, 11 bp, Unknown
  misc_feature (1)..( 11): Result.004 file - promoters50/1024499
ctcgactaatt

SEQ ID NO: 160199 - DNA, 11 bp, Unknown
  misc_feature (1)..( 11): Result.004 file - promoters50/1024499
atttactaata

SEQ ID NO: 160200 - DNA, 11 bp, Unknown
  misc_feature (1)..( 11): Result.004 file - promoters50/1024499
tgttattaact

SEQ ID NO: 160201 - DNA, 11 bp, Unknown
  misc_feature (1)..( 11): Result.004 file - promoters50/1024499
ttttattaatt

SEQ ID NO: 160202 - DNA, 11 bp, Unknown
  misc_feature (1)..( 11): Result.004 file - promoters50/1024499
tttaattaaaa

SEQ ID NO: 160203 - DNA, 11 bp, Unknown
  misc_feature (1)..( 11): Result.004 file - promoters50/1024550
cttgtctaata

SEQ ID NO: 160204 - DNA, 9 bp, Unknown
  misc_feature (1)..( 9): Result.004 file - promoters50/1024550
caaatctgt

SEQ ID NO: 160205 - DNA, 9 bp, Unknown
  misc_feature (1)..( 9): Result.004 file - promoters50/1024550
aaaatctgg

SEQ ID NO: 160206 - DNA, 9 bp, Unknown
  misc_feature (1)..( 9): Result.004 file - promoters50/1024550
ccaatttgg

SEQ ID NO: 160207 - DNA, 9 bp, Unknown
  misc_feature (1)..( 9): Result.004 file - promoters50/1024570
aaaatcatt

SEQ ID NO: 160208 - DNA, 10 bp, Unknown
  misc_feature (1)..( 10): Result.004 file - promoters50/1024570
atgtaaaacc

SEQ ID NO: 160209 - DNA, 10 bp, Unknown
  misc_feature (1)..( 10): Result.004 file - promoters50/1024570
atgaaaaacc

SEQ ID NO: 160210 - DNA, 10 bp, Unknown
  misc_feature (1)..( 10): Result.004 file - promoters50/1024603
tggaaaaagg

SEQ ID NO: 160211 - DNA, 7 bp, Unknown
  misc_feature (1)..( 7): Result.004 file - promoters50/1024603
ctatata

SEQ ID NO: 160212 - DNA, 7 bp, Unknown
  misc_feature (1)..( 7): Result.004 file - promoters50/1024603
atatata

SEQ ID NO: 160213 - DNA, 7 bp, Unknown
  misc_feature (1)..( 7): Result.004 file - promoters50/1024603
atacatt

SEQ ID NO: 160214 - DNA, 7 bp, Unknown
  misc_feature (1)..( 7): Result.004 file - promoters50/1024603
taacatg

SEQ ID NO: 160215 - DNA, 7 bp, Unknown
  misc_feature (1)..( 7): Result.004 file - promoters50/1024603
taaaatg

SEQ ID NO: 160216 - DNA, 7 bp, Unknown
  misc_feature (1)..( 7): Result.004 file - promoters50/1024603
taacatg

SEQ ID NO: 160217 - DNA, 13 bp, Unknown
  misc_feature (1)..( 13): Result.004 file - promoters50/1024603
aattttcccacat

SEQ ID NO: 160218 - DNA, 13 bp, Unknown
  misc_feature (1)..( 13): Result.004 file - promoters50/1024603
aattgtccatcat

SEQ ID NO: 160219 - DNA, 13 bp, Unknown
  misc_feature (1)..( 13): Result.004 file - promoters50/1024603
agttttccccaaa

SEQ ID NO: 160220 - DNA, 13 bp, Unknown
  misc_feature (1)..( 13): Result.004 file - promoters50/1024603
tttattccacaaa

SEQ ID NO: 160221 - DNA, 12 bp, Unknown
  misc_feature (1)..( 12): Result.004 file - promoters50/1024603
tttaagatctca

SEQ ID NO: 160222 - DNA, 12 bp, Unknown
  misc_feature (1)..( 12): Result.004 file - promoters50/1024603
gagtagatatca

SEQ ID NO: 160223 - DNA, 12 bp, Unknown
  misc_feature (1)..( 12): Result.004 file - promoters50/1024603
tattagaaattt

SEQ ID NO: 160224 - DNA, 8 bp, Unknown
  misc_feature (1)..( 8): Result.004 file - promoters50/1024603
agattagt

SEQ ID NO: 160225 - DNA, 8 bp, Unknown
  misc_feature (1)..( 8): Result.004 file - promoters50/1024603
agattaga

SEQ ID NO: 160226 - DNA, 8 bp, Unknown
  misc_feature (1)..( 8): Result.004 file - promoters50/1024603
ctattaga

SEQ ID NO: 160227 - DNA, 9 bp, Unknown
  misc_feature (1)..( 9): Result.004 file - promoters50/1024603
acattatgt

SEQ ID NO: 160228 - DNA, 9 bp, Unknown
  misc_feature (1)..( 9): Result.004 file - promoters50/1024603
aaattgtgt

SEQ ID NO: 160229 - DNA, 9 bp, Unknown
  misc_feature (1)..( 9): Result.004 file - promoters50/1024611
aaatcgtgt

SEQ ID NO: 160230 - DNA, 10 bp, Unknown
  misc_feature (1)..( 10): Result.004 file - promoters50/1024611
tcaaaatagc

SEQ ID NO: 160231 - DNA, 10 bp, Unknown
  misc_feature (1)..( 10): Result.004 file - promoters50/1024611
ccaaaagagc

SEQ ID NO: 160232 - DNA, 10 bp, Unknown
  misc_feature (1)..( 10): Result.004 file - promoters50/1024639
tcaaaagctt

SEQ ID NO: 160233 - DNA, 9 bp, Unknown
  misc_feature (1)..( 9): Result.004 file - promoters50/1024639
gtaaaatta

SEQ ID NO: 160234 - DNA, 9 bp, Unknown
  misc_feature (1)..( 9): Result.004 file - promoters50/1024639
tacaaatta

SEQ ID NO: 160235 - DNA, 9 bp, Unknown
  misc_feature (1)..( 9): Result.004 file - promoters50/1024639
gtataattt

SEQ ID NO: 160236 - DNA, 9 bp, Unknown
  misc_feature (1)..( 9): Result.004 file - promoters50/1024639
taagaaata

SEQ ID NO: 160237 - DNA, 9 bp, Unknown
  misc_feature (1)..( 9): Result.004 file - promoters50/1024639
taataaata

SEQ ID NO: 160238 - DNA, 9 bp, Unknown
  misc_feature (1)..( 9): Result.004 file - promoters50/1024639
gtatatata

SEQ ID NO: 160239 - DNA, 6 bp, Unknown
  misc_feature (1)..( 6): Result.004 file - promoters50/1024639
tttaaa

SEQ ID NO: 160240 - DNA, 6 bp, Unknown
  misc_feature (1)..( 6): Result.004 file - promoters50/1024639
tttaaa

SEQ ID NO: 160241 - DNA, 6 bp, Unknown
  misc_feature (1)..( 6): Result.004 file - promoters50/1024639
tttaaa

SEQ ID NO: 160242 - DNA, 10 bp, Unknown
  misc_feature (1)..( 10): Result.004 file - promoters50/1024639
ttatcttaaa

SEQ ID NO: 160243 - DNA, 10 bp, Unknown
  misc_feature (1)..( 10): Result.004 file - promoters50/1024639
ttttctaaaa

SEQ ID NO: 160244 - DNA, 10 bp, Unknown
  misc_feature (1)..( 10): Result.004 file - promoters50/1024639
ttatattaga

SEQ ID NO: 160245 - DNA, 9 bp, Unknown
  misc_feature (1)..( 9): Result.004 file - promoters50/1024639
agatctttt

SEQ ID NO: 160246 - DNA, 9 bp, Unknown
  misc_feature (1)..( 9): Result.004 file - promoters50/1024639
tgatttttt

SEQ ID NO: 160247 - DNA, 9 bp, Unknown
  misc_feature (1)..( 9): Result.004 file - promoters50/1024639
tgatttcct

SEQ ID NO: 160248 - DNA, 7 bp, Unknown
  misc_feature (1)..( 7): Result.004 file - promoters50/1024639
taattac

SEQ ID NO: 160249 - DNA, 7 bp, Unknown
  misc_feature (1)..( 7): Result.004 file - promoters50/1024639
taattat

SEQ ID NO: 160250 - DNA, 7 bp, Unknown
  misc_feature (1)..( 7): Result.004 file - promoters50/1024639
gaattat

SEQ ID NO: 160251 - DNA, 8 bp, Unknown
  misc_feature (1)..( 8): Result.004 file - promoters50/1024639
actaattg

SEQ ID NO: 160252 - DNA, 8 bp, Unknown
  misc_feature (1)..( 8): Result.004 file - promoters50/1024639
actaattt

SEQ ID NO: 160253 - DNA, 8 bp, Unknown
  misc_feature (1)..( 8): Result.004 file - promoters50/1024662
tgtaattt

SEQ ID NO: 160254 - DNA, 17 bp, Unknown
  misc_feature (1)..( 17): Result.004 file - promoters50/1024662
aaataataaaacattgg

SEQ ID NO: 160255 - DNA, 17 bp, Unknown
  misc_feature (1)..( 17): Result.004 file - promoters50/1024662
acataagaaaattgaca

SEQ ID NO: 160256 - DNA, 17 bp, Unknown
  misc_feature (1)..( 17): Result.004 file - promoters50/1024662
ccaccggaaaatttatc

SEQ ID NO: 160257 - DNA, 17 bp, Unknown
  misc_feature (1)..( 17): Result.004 file - promoters50/1024662
tgggaagagaattgaca

SEQ ID NO: 160258 - DNA, 17 bp, Unknown
  misc_feature (1)..( 17): Result.004 file - promoters50/1024662
gatatcgaaaatgttgg

SEQ ID NO: 160259 - DNA, 17 bp, Unknown
  misc_feature (1)..( 17): Result.004 file - promoters50/1024713
tgggaagtgaagaccac

SEQ ID NO: 160260 - DNA, 9 bp, Unknown
  misc_feature (1)..( 9): Result.004 file - promoters50/1024713
caaattttc

SEQ ID NO: 160261 - DNA, 9 bp, Unknown
  misc_feature (1)..( 9): Result.004 file - promoters50/1024713
gaaatttgc

SEQ ID NO: 160262 - DNA, 9 bp, Unknown
  misc_feature (1)..( 9): Result.004 file - promoters50/1024713
gaactttgc

SEQ ID NO: 160263 - DNA, 11 bp, Unknown
  misc_feature (1)..( 11): Result.004 file - promoters50/1024713
aaattttcctt

SEQ ID NO: 160264 - DNA, 11 bp, Unknown
  misc_feature (1)..( 11): Result.004 file - promoters50/1024713
gaactttgctt

SEQ ID NO: 160265 - DNA, 11 bp, Unknown
  misc_feature (1)..( 11): Result.004 file - promoters50/1024713
gaaatttgcag

SEQ ID NO: 160266 - DNA, 10 bp, Unknown
  misc_feature (1)..( 10): Result.004 file - promoters50/1024713
taatttgttt

SEQ ID NO: 160267 - DNA, 10 bp, Unknown
  misc_feature (1)..( 10): Result.004 file - promoters50/1024713
aaatttattt

SEQ ID NO: 160268 - DNA, 10 bp, Unknown
  misc_feature (1)..( 10): Result.004 file - promoters50/1024713
aaatttgcag

SEQ ID NO: 160269 - DNA, 8 bp, Unknown
  misc_feature (1)..( 8): Result.004 file - promoters50/1024713
attatttt

SEQ ID NO: 160270 - DNA, 8 bp, Unknown
  misc_feature (1)..( 8): Result.004 file - promoters50/1024713
catatttt

SEQ ID NO: 160271 - DNA, 8 bp, Unknown
  misc_feature (1)..( 8): Result.004 file - promoters50/1024713
catctttt

SEQ ID NO: 160272 - DNA, 13 bp, Unknown
  misc_feature (1)..( 13): Result.004 file - promoters50/1024713
tttgaaacatttt

SEQ ID NO: 160273 - DNA, 13 bp, Unknown
  misc_feature (1)..( 13): Result.004 file - promoters50/1024713
tttaaaactaaaa

SEQ ID NO: 160274 - DNA, 13 bp, Unknown
  misc_feature (1)..( 13): Result.004 file - promoters50/1024756
taaaaaactaaaa

SEQ ID NO: 160275 - DNA, 14 bp, Unknown
  misc_feature (1)..( 14): Result.004 file - promoters50/1024756
taacagtcaaaccg

SEQ ID NO: 160276 - DNA, 14 bp, Unknown
  misc_feature (1)..( 14): Result.004 file - promoters50/1024756
gtcaggtcaaatcc

SEQ ID NO: 160277 - DNA, 14 bp, Unknown
  misc_feature (1)..( 14): Result.004 file - promoters50/1024756
taacagtcaaaaaa

SEQ ID NO: 160278 - DNA, 14 bp, Unknown
  misc_feature (1)..( 14): Result.004 file - promoters50/1024783
aaaatctcaaaaaa

SEQ ID NO: 160279 - DNA, 6 bp, Unknown
  misc_feature (1)..( 6): Result.004 file - promoters50/1024783
attttt

SEQ ID NO: 160280 - DNA, 6 bp, Unknown
  misc_feature (1)..( 6): Result.004 file - promoters50/1024783
attttt

SEQ ID NO: 160281 - DNA, 7 bp, Unknown
  misc_feature (1)..( 7): Result.004 file - promoters50/1024783
attcttt

SEQ ID NO: 160282 - DNA, 8 bp, Unknown
  misc_feature (1)..( 8): Result.004 file - promoters50/1024783
tttttttt

SEQ ID NO: 160283 - DNA, 8 bp, Unknown
  misc_feature (1)..( 8): Result.004 file - promoters50/1024783
cttttttt

SEQ ID NO: 160284 - DNA, 8 bp, Unknown
  misc_feature (1)..( 8): Result.004 file - promoters50/1024787
ctttttcc

SEQ ID NO: 160285 - DNA, 7 bp, Unknown
  misc_feature (1)..( 7): Result.004 file - promoters50/1024787
aaaattc

SEQ ID NO: 160286 - DNA, 7 bp, Unknown
  misc_feature (1)..( 7): Result.004 file - promoters50/1024787
aaagttc

SEQ ID NO: 160287 - DNA, 7 bp, Unknown
  misc_feature (1)..( 7): Result.004 file - promoters50/1024787
aaaattc

SEQ ID NO: 160288 - DNA, 8 bp, Unknown
  misc_feature (1)..( 8): Result.004 file - promoters50/1024787
acactttt

SEQ ID NO: 160289 - DNA, 8 bp, Unknown
  misc_feature (1)..( 8): Result.004 file - promoters50/1024787
acagtttc

SEQ ID NO: 160290 - DNA, 8 bp, Unknown
  misc_feature (1)..( 8): Result.004 file - promoters50/1024787
ccaggttc

SEQ ID NO: 160291 - DNA, 7 bp, Unknown
  misc_feature (1)..( 7): Result.004 file - promoters50/1024787
agttttt

SEQ ID NO: 160292 - DNA, 7 bp, Unknown
  misc_feature (1)..( 7): Result.004 file - promoters50/1024787
tgttttt

SEQ ID NO: 160293 - DNA, 7 bp, Unknown
  misc_feature (1)..( 7): Result.004 file - promoters50/1024787
tgttttc

SEQ ID NO: 160294 - DNA, 8 bp, Unknown
  misc_feature (1)..( 8): Result.004 file - promoters50/1024787
gggcttta

SEQ ID NO: 160295 - DNA, 8 bp, Unknown
  misc_feature (1)..( 8): Result.004 file - promoters50/1024787
gggcttta

SEQ ID NO: 160296 - DNA, 8 bp, Unknown
  misc_feature (1)..( 8): Result.004 file - promoters50/1024787
aggctttt

SEQ ID NO: 160297 - DNA, 9 bp, Unknown
  misc_feature (1)..( 9): Result.004 file - promoters50/1024787
acatctctt

SEQ ID NO: 160298 - DNA, 9 bp, Unknown
  misc_feature (1)..( 9): Result.004 file - promoters50/1024787
aattctctt

SEQ ID NO: 160299 - DNA, 9 bp, Unknown
  misc_feature (1)..( 9): Result.004 file - promoters50/1024787
aattatctg

SEQ ID NO: 160300 - DNA, 8 bp, Unknown
  misc_feature (1)..( 8): Result.004 file - promoters50/1024787
ttttttta

SEQ ID NO: 160301 - DNA, 8 bp, Unknown
  misc_feature (1)..( 8): Result.004 file - promoters50/1024787
ttttctta

SEQ ID NO: 160302 - DNA, 8 bp, Unknown
  misc_feature (1)..( 8): Result.004 file - promoters50/1024821
cgttctta

SEQ ID NO: 160303 - DNA, 7 bp, Unknown
  misc_feature (1)..( 7): Result.004 file - promoters50/1024821
ttctttg

SEQ ID NO: 160304 - DNA, 7 bp, Unknown
  misc_feature (1)..( 7): Result.004 file - promoters50/1024821
ttctttt

SEQ ID NO: 160305 - DNA, 8 bp, Unknown
  misc_feature (1)..( 8): Result.004 file - promoters50/1024821
ttcgtttt

SEQ ID NO: 160306 - DNA, 10 bp, Unknown
  misc_feature (1)..( 10): Result.004 file - promoters50/1024821
aagaggaagc

SEQ ID NO: 160307 - DNA, 10 bp, Unknown
  misc_feature (1)..( 10): Result.004 file - promoters50/1024821
aagaagaagc

SEQ ID NO: 160308 - DNA, 10 bp, Unknown
  misc_feature (1)..( 10): Result.004 file - promoters50/1024837
aagaagttga

SEQ ID NO: 160309 - DNA, 9 bp, Unknown
  misc_feature (1)..( 9): Result.004 file - promoters50/1024837
actttggaa

SEQ ID NO: 160310 - DNA, 9 bp, Unknown
  misc_feature (1)..( 9): Result.004 file - promoters50/1024837
tctttggat

SEQ ID NO: 160311 - DNA, 9 bp, Unknown
  misc_feature (1)..( 9): Result.004 file - promoters50/1024837
actttgtct

SEQ ID NO: 160312 - DNA, 9 bp, Unknown
  misc_feature (1)..( 9): Result.004 file - promoters50/1024837
tctttgaat

SEQ ID NO: 160313 - DNA, 9 bp, Unknown
  misc_feature (1)..( 9): Result.004 file - promoters50/1024837
gagttggat

SEQ ID NO: 160314 - DNA, 9 bp, Unknown
  misc_feature (1)..( 9): Result.004 file - promoters50/1024837
tgtttgatt

SEQ ID NO: 160315 - DNA, 14 bp, Unknown
  misc_feature (1)..( 14): Result.004 file - promoters50/1024837
acgttaaaaataaa

SEQ ID NO: 160316 - DNA, 14 bp, Unknown
  misc_feature (1)..( 14): Result.004 file - promoters50/1024837
caagaagaaaaaaa

SEQ ID NO: 160317 - DNA, 14 bp, Unknown
  misc_feature (1)..( 14): Result.004 file - promoters50/1024837
catccacaaacaaa

SEQ ID NO: 160318 - DNA, 14 bp, Unknown
  misc_feature (1)..( 14): Result.004 file - promoters50/1024837
ctatttcaaaaata

SEQ ID NO: 160319 - DNA, 14 bp, Unknown
  misc_feature (1)..( 14): Result.004 file - promoters50/1024837
tatatataaaaatt

SEQ ID NO: 160320 - DNA, 14 bp, Unknown
  misc_feature (1)..( 14): Result.004 file - promoters50/1024837
caagtagaagaaag

SEQ ID NO: 160321 - DNA, 13 bp, Unknown
  misc_feature (1)..( 13): Result.004 file - promoters50/1024837
ccaaaagaatcag

SEQ ID NO: 160322 - DNA, 13 bp, Unknown
  misc_feature (1)..( 13): Result.004 file - promoters50/1024837
acaaaacaattca

SEQ ID NO: 160323 - DNA, 13 bp, Unknown
  misc_feature (1)..( 13): Result.004 file - promoters50/1024837
aataaataatcat

SEQ ID NO: 160324 - DNA, 13 bp, Unknown
  misc_feature (1)..( 13): Result.004 file - promoters50/1024837
tcttcagattcag

SEQ ID NO: 160325 - DNA, 13 bp, Unknown
  misc_feature (1)..( 13): Result.004 file - promoters50/1024837
atcaaataattct

SEQ ID NO: 160326 - DNA, 13 bp, Unknown
  misc_feature (1)..( 13): Result.004 file - promoters50/1024837
tcaaatacgtttc

SEQ ID NO: 160327 - DNA, 13 bp, Unknown
  misc_feature (1)..( 13): Result.004 file - promoters50/1024837
tcaattaatcttt

SEQ ID NO: 160328 - DNA, 13 bp, Unknown
  misc_feature (1)..( 13): Result.004 file - promoters50/1024837
ttgtaataataac

SEQ ID NO: 160329 - DNA, 8 bp, Unknown
  misc_feature (1)..( 8): Result.004 file - promoters50/1024837
taatgttt

SEQ ID NO: 160330 - DNA, 8 bp, Unknown
  misc_feature (1)..( 8): Result.004 file - promoters50/1024837
ccatgttt

SEQ ID NO: 160331 - DNA, 8 bp, Unknown
  misc_feature (1)..( 8): Result.004 file - promoters50/1024837
taatattt

SEQ ID NO: 160332 - DNA, 8 bp, Unknown
  misc_feature (1)..( 8): Result.004 file - promoters50/1024837
aaatattg

SEQ ID NO: 160333 - DNA, 8 bp, Unknown
  misc_feature (1)..( 8): Result.004 file - promoters50/1024837
gaatattg

SEQ ID NO: 160334 - DNA, 8 bp, Unknown
  misc_feature (1)..( 8): Result.004 file - promoters50/1024840
aaatatag

SEQ ID NO: 160335 - DNA, 7 bp, Unknown
  misc_feature (1)..( 7): Result.004 file - promoters50/1024840
cataaga

SEQ ID NO: 160336 - DNA, 7 bp, Unknown
  misc_feature (1)..( 7): Result.004 file - promoters50/1024840
tataaga

SEQ ID NO: 160337 - DNA, 7 bp, Unknown
  misc_feature (1)..( 7): Result.004 file - promoters50/1024840
cataagt

SEQ ID NO: 160338 - DNA, 8 bp, Unknown
  misc_feature (1)..( 8): Result.004 file - promoters50/1024840
aaaatgaa

SEQ ID NO: 160339 - DNA, 8 bp, Unknown
  misc_feature (1)..( 8): Result.004 file - promoters50/1024840
aaaaagaa

SEQ ID NO: 160340 - DNA, 9 bp, Unknown
  misc_feature (1)..( 9): Result.004 file - promoters50/1024840
aagaaagat

SEQ ID NO: 160341 - DNA, 11 bp, Unknown
  misc_feature (1)..( 11): Result.004 file - promoters50/1024840
gaataaagtat

SEQ ID NO: 160342 - DNA, 11 bp, Unknown
  misc_feature (1)..( 11): Result.004 file - promoters50/1024840
gaagaaaaaag

SEQ ID NO: 160343 - DNA, 11 bp, Unknown
  misc_feature (1)..( 11): Result.004 file - promoters50/1024840
agatacagtat

SEQ ID NO: 160344 - DNA, 7 bp, Unknown
  misc_feature (1)..( 7): Result.004 file - promoters50/1024840
gaataat

SEQ ID NO: 160345 - DNA, 7 bp, Unknown
  misc_feature (1)..( 7): Result.004 file - promoters50/1024840
taataat

SEQ ID NO: 160346 - DNA, 7 bp, Unknown
  misc_feature (1)..( 7): Result.004 file - promoters50/1024853
taaaaat

SEQ ID NO: 160347 - DNA, 12 bp, Unknown
  misc_feature (1)..( 12): Result.004 file - promoters50/1024853
tcttatatataa

SEQ ID NO: 160348 - DNA, 12 bp, Unknown
  misc_feature (1)..( 12): Result.004 file - promoters50/1024853
tcttataaataa

SEQ ID NO: 160349 - DNA, 13 bp, Unknown
  misc_feature (1)..( 13): Result.004 file - promoters50/1024853
agccgttatataa

SEQ ID NO: 160350 - DNA, 12 bp, Unknown
  misc_feature (1)..( 12): Result.004 file - promoters50/1024853
ctttataaaacc

SEQ ID NO: 160351 - DNA, 12 bp, Unknown
  misc_feature (1)..( 12): Result.004 file - promoters50/1024853
cactataaaact

SEQ ID NO: 160352 - DNA, 13 bp, Unknown
  misc_feature (1)..( 13): Result.004 file - promoters50/1024853
tactattaaagcc

SEQ ID NO: 160353 - DNA, 13 bp, Unknown
  misc_feature (1)..( 13): Result.004 file - promoters50/1024872
cgctactataaat

SEQ ID NO: 160354 - DNA, 11 bp, Unknown
  misc_feature (1)..( 11): Result.004 file - promoters50/1024872
acatcctaaat

SEQ ID NO: 160355 - DNA, 11 bp, Unknown
  misc_feature (1)..( 11): Result.004 file - promoters50/1024872
aataactaaat

SEQ ID NO: 160356 - DNA, 11 bp, Unknown
  misc_feature (1)..( 11): Result.004 file - promoters50/1024872
aattactaaaa

SEQ ID NO: 160357 - DNA, 7 bp, Unknown
  misc_feature (1)..( 7): Result.004 file - promoters50/1024872
aatattt

SEQ ID NO: 160358 - DNA, 7 bp, Unknown
  misc_feature (1)..( 7): Result.004 file - promoters50/1024872
aatcttt

SEQ ID NO: 160359 - DNA, 7 bp, Unknown
  misc_feature (1)..( 7): Result.004 file - promoters50/1024872
gatcttt

SEQ ID NO: 160360 - DNA, 9 bp, Unknown
  misc_feature (1)..( 9): Result.004 file - promoters50/1024872
tatttatta

SEQ ID NO: 160361 - DNA, 9 bp, Unknown
  misc_feature (1)..( 9): Result.004 file - promoters50/1024872
tctttatta

SEQ ID NO: 160362 - DNA, 9 bp, Unknown
  misc_feature (1)..( 9): Result.004 file - promoters50/1024872
tatgtatta

SEQ ID NO: 160363 - DNA, 11 bp, Unknown
  misc_feature (1)..( 11): Result.004 file - promoters50/1024872
aaggaaaaaaa

SEQ ID NO: 160364 - DNA, 11 bp, Unknown
  misc_feature (1)..( 11): Result.004 file - promoters50/1024872
tgagaaaaaaa

SEQ ID NO: 160365 - DNA, 11 bp, Unknown
  misc_feature (1)..( 11): Result.004 file - promoters50/1024872
aaagaaaaaca

SEQ ID NO: 160366 - DNA, 11 bp, Unknown
  misc_feature (1)..( 11): Result.004 file - promoters50/1024872
gaaaacaagtt

SEQ ID NO: 160367 - DNA, 11 bp, Unknown
  misc_feature (1)..( 11): Result.004 file - promoters50/1024872
taaaataagtt

SEQ ID NO: 160368 - DNA, 11 bp, Unknown
  misc_feature (1)..( 11): Result.004 file - promoters50/1024872
taaaataacta

SEQ ID NO: 160369 - DNA, 11 bp, Unknown
  misc_feature (1)..( 11): Result.004 file - promoters50/1024872
taagaaaggaa

SEQ ID NO: 160370 - DNA, 11 bp, Unknown
  misc_feature (1)..( 11): Result.004 file - promoters50/1024872
aaagaaaaaca

SEQ ID NO: 160371 - DNA, 11 bp, Unknown
  misc_feature (1)..( 11): Result.004 file - promoters50/1024889
aaataaaaaca

SEQ ID NO: 160372 - DNA, 11 bp, Unknown
  misc_feature (1)..( 11): Result.004 file - promoters50/1024889
gaaggttttaa

SEQ ID NO: 160373 - DNA, 11 bp, Unknown
  misc_feature (1)..( 11): Result.004 file - promoters50/1024889
aaagtttttgt

SEQ ID NO: 160374 - DNA, 11 bp, Unknown
  misc_feature (1)..( 11): Result.004 file - promoters50/1024889
gccggttataa

SEQ ID NO: 160375 - DNA, 11 bp, Unknown
  misc_feature (1)..( 11): Result.004 file - promoters50/1024889
aaactttagaa

SEQ ID NO: 160376 - DNA, 11 bp, Unknown
  misc_feature (1)..( 11): Result.004 file - promoters50/1024889
aaaatttagca

SEQ ID NO: 160377 - DNA, 11 bp, Unknown
  misc_feature (1)..( 11): Result.004 file - promoters50/1024889
aaaattggtaa

SEQ ID NO: 160378 - DNA, 11 bp, Unknown
  misc_feature (1)..( 11): Result.004 file - promoters50/1024889
ataatttacga

SEQ ID NO: 160379 - DNA, 11 bp, Unknown
  misc_feature (1)..( 11): Result.004 file - promoters50/1024889
tttgaatttag

SEQ ID NO: 160380 - DNA, 11 bp, Unknown
  misc_feature (1)..( 11): Result.004 file - promoters50/1024889
tttggattaat

SEQ ID NO: 160381 - DNA, 11 bp, Unknown
  misc_feature (1)..( 11): Result.004 file - promoters50/1024889
ttttaattgat

SEQ ID NO: 160382 - DNA, 11 bp, Unknown
  misc_feature (1)..( 11): Result.004 file - promoters50/1024889
ttctaattgca

SEQ ID NO: 160383 - DNA, 11 bp, Unknown
  misc_feature (1)..( 11): Result.004 file - promoters50/1024889
cattatttgtg

SEQ ID NO: 160384 - DNA, 11 bp, Unknown
  misc_feature (1)..( 11): Result.004 file - promoters50/1024889
aaaaatttttt

SEQ ID NO: 160385 - DNA, 11 bp, Unknown
  misc_feature (1)..( 11): Result.004 file - promoters50/1024889
acggataattc

SEQ ID NO: 160386 - DNA, 11 bp, Unknown
  misc_feature (1)..( 11): Result.004 file - promoters50/1024889
ttggaaaattt

SEQ ID NO: 160387 - DNA, 11 bp, Unknown
  misc_feature (1)..( 11): Result.004 file - promoters50/1024889
aacaataattt

SEQ ID NO: 160388 - DNA, 11 bp, Unknown
  misc_feature (1)..( 11): Result.004 file - promoters50/1024889
aaaaaaagttt

SEQ ID NO: 160389 - DNA, 11 bp, Unknown
  misc_feature (1)..( 11): Result.004 file - promoters50/1024889
aataaaaattg

SEQ ID NO: 160390 - DNA, 11 bp, Unknown
  misc_feature (1)..( 11): Result.004 file - promoters50/1024889
ttggaaaaaaa

SEQ ID NO: 160391 - DNA, 14 bp, Unknown
  misc_feature (1)..( 14): Result.004 file - promoters50/1024889
ttgtaataataact

SEQ ID NO: 160392 - DNA, 14 bp, Unknown
  misc_feature (1)..( 14): Result.004 file - promoters50/1024889
tggtaataatgttt

SEQ ID NO: 160393 - DNA, 14 bp, Unknown
  misc_feature (1)..( 14): Result.004 file - promoters50/1024889
cggttataaaaaca

SEQ ID NO: 160394 - DNA, 14 bp, Unknown
  misc_feature (1)..( 14): Result.004 file - promoters50/1024889
ttgtgatattattt

SEQ ID NO: 160395 - DNA, 14 bp, Unknown
  misc_feature (1)..( 14): Result.004 file - promoters50/1024889
aacaaatacaaact

SEQ ID NO: 160396 - DNA, 14 bp, Unknown
  misc_feature (1)..( 14): Result.004 file - promoters50/1024889
ggtgaagaaaaaca

SEQ ID NO: 160397 - DNA, 14 bp, Unknown
  misc_feature (1)..( 14): Result.004 file - promoters50/1024905
ctgtgatttacata

SEQ ID NO: 160398 - DNA, 11 bp, Unknown
  misc_feature (1)..( 11): Result.004 file - promoters50/1024905
gaaaaaggaaa

SEQ ID NO: 160399 - DNA, 11 bp, Unknown
  misc_feature (1)..( 11): Result.004 file - promoters50/1024905
caaaaagactg

SEQ ID NO: 160400 - DNA, 11 bp, Unknown
  misc_feature (1)..( 11): Result.004 file - promoters50/1024905
tcaaaaggaaa

SEQ ID NO: 160401 - DNA, 11 bp, Unknown
  misc_feature (1)..( 11): Result.004 file - promoters50/1024924
caaaaacccaa

SEQ ID NO: 160402 - DNA, 7 bp, Unknown
  misc_feature (1)..( 7): Result.004 file - promoters50/1024924
ttatttt

SEQ ID NO: 160403 - DNA, 7 bp, Unknown
  misc_feature (1)..( 7): Result.004 file - promoters50/1024924
ttaattt

SEQ ID NO: 160404 - DNA, 7 bp, Unknown
  misc_feature (1)..( 7): Result.004 file - promoters50/1024924
ctaattt

SEQ ID NO: 160405 - DNA, 10 bp, Unknown
  misc_feature (1)..( 10): Result.004 file - promoters50/1024924
tttggcatct

SEQ ID NO: 160406 - DNA, 10 bp, Unknown
  misc_feature (1)..( 10): Result.004 file - promoters50/1024924
ttttgcatgc

SEQ ID NO: 160407 - DNA, 10 bp, Unknown
  misc_feature (1)..( 10): Result.004 file - promoters50/1024924
aatggaatct

SEQ ID NO: 160408 - DNA, 7 bp, Unknown
  misc_feature (1)..( 7): Result.004 file - promoters50/1024924
tttattt

SEQ ID NO: 160409 - DNA, 7 bp, Unknown
  misc_feature (1)..( 7): Result.004 file - promoters50/1024924
tttatta

SEQ ID NO: 160410 - DNA, 7 bp, Unknown
  misc_feature (1)..( 7): Result.004 file - promoters50/1024924
attatta

SEQ ID NO: 160411 - DNA, 8 bp, Unknown
  misc_feature (1)..( 8): Result.004 file - promoters50/1024924
atatatat

SEQ ID NO: 160412 - DNA, 8 bp, Unknown
  misc_feature (1)..( 8): Result.004 file - promoters50/1024924
atagatat

SEQ ID NO: 160413 - DNA, 8 bp, Unknown
  misc_feature (1)..( 8): Result.004 file - promoters50/1024924
atatatct

SEQ ID NO: 160414 - DNA, 7 bp, Unknown
  misc_feature (1)..( 7): Result.004 file - promoters50/1024924
tcttatt

SEQ ID NO: 160415 - DNA, 7 bp, Unknown
  misc_feature (1)..( 7): Result.004 file - promoters50/1024924
tctaatt

SEQ ID NO: 160416 - DNA, 7 bp, Unknown
  misc_feature (1)..( 7): Result.004 file - promoters50/1024924
tctaatg

SEQ ID NO: 160417 - DNA, 9 bp, Unknown
  misc_feature (1)..( 9): Result.004 file - promoters50/1024924
catgaaact

SEQ ID NO: 160418 - DNA, 9 bp, Unknown
  misc_feature (1)..( 9): Result.004 file - promoters50/1024924
cattaaatt

SEQ ID NO: 160419 - DNA, 9 bp, Unknown
  misc_feature (1)..( 9): Result.004 file - promoters50/1024924
aattaaatt

SEQ ID NO: 160420 - DNA, 8 bp, Unknown
  misc_feature (1)..( 8): Result.004 file - promoters50/1024924
aattcatg

SEQ ID NO: 160421 - DNA, 8 bp, Unknown
  misc_feature (1)..( 8): Result.004 file - promoters50/1024924
aattcaaa

SEQ ID NO: 160422 - DNA, 8 bp, Unknown
  misc_feature (1)..( 8): Result.004 file - promoters50/1024924
gattaaaa

SEQ ID NO: 160423 - DNA, 7 bp, Unknown
  misc_feature (1)..( 7): Result.004 file - promoters50/1024924
aatttga

SEQ ID NO: 160424 - DNA, 7 bp, Unknown
  misc_feature (1)..( 7): Result.004 file - promoters50/1024924
aatttgt

SEQ ID NO: 160425 - DNA, 7 bp, Unknown
  misc_feature (1)..( 7): Result.004 file - promoters50/1024924
tatttga

SEQ ID NO: 160426 - DNA, 7 bp, Unknown
  misc_feature (1)..( 7): Result.004 file - promoters50/1024924
aaaatat

SEQ ID NO: 160427 - DNA, 7 bp, Unknown
  misc_feature (1)..( 7): Result.004 file - promoters50/1024924
aaactat

SEQ ID NO: 160428 - DNA, 7 bp, Unknown
  misc_feature (1)..( 7): Result.004 file - promoters50/1024958
aaactaa

SEQ ID NO: 160429 - DNA, 8 bp, Unknown
  misc_feature (1)..( 8): Result.004 file - promoters50/1024958
caattatt

SEQ ID NO: 160430 - DNA, 8 bp, Unknown
  misc_feature (1)..( 8): Result.004 file - promoters50/1024958
caattaca

SEQ ID NO: 160431 - DNA, 8 bp, Unknown
  misc_feature (1)..( 8): Result.004 file - promoters50/1024958
aaattatt

SEQ ID NO: 160432 - DNA, 8 bp, Unknown
  misc_feature (1)..( 8): Result.004 file - promoters50/1024958
agatgaaa

SEQ ID NO: 160433 - DNA, 8 bp, Unknown
  misc_feature (1)..( 8): Result.004 file - promoters50/1024958
tgattaaa

SEQ ID NO: 160434 - DNA, 8 bp, Unknown
  misc_feature (1)..( 8): Result.004 file - promoters50/1024958
tgaataat

SEQ ID NO: 160435 - DNA, 8 bp, Unknown
  misc_feature (1)..( 8): Result.004 file - promoters50/1024958
gaaaaagc

SEQ ID NO: 160436 - DNA, 8 bp, Unknown
  misc_feature (1)..( 8): Result.004 file - promoters50/1024958
caaaaagc

SEQ ID NO: 160437 - DNA, 8 bp, Unknown
  misc_feature (1)..( 8): Result.004 file - promoters50/1024958
gaaaaaaa

SEQ ID NO: 160438 - DNA, 8 bp, Unknown
  misc_feature (1)..( 8): Result.004 file - promoters50/1024958
gaataaaa

SEQ ID NO: 160439 - DNA, 8 bp, Unknown
  misc_feature (1)..( 8): Result.004 file - promoters50/1024958
caataaaa

SEQ ID NO: 160440 - DNA, 8 bp, Unknown
  misc_feature (1)..( 8): Result.004 file - promoters50/1024958
gaaaaaaa

SEQ ID NO: 160441 - DNA, 7 bp, Unknown
  misc_feature (1)..( 7): Result.004 file - promoters50/1024958
aaaattg

SEQ ID NO: 160442 - DNA, 7 bp, Unknown
  misc_feature (1)..( 7): Result.004 file - promoters50/1024958
aaagttg

SEQ ID NO: 160443 - DNA, 7 bp, Unknown
  misc_feature (1)..( 7): Result.004 file - promoters50/1024958
aaagtta

SEQ ID NO: 160444 - DNA, 8 bp, Unknown
  misc_feature (1)..( 8): Result.004 file - promoters50/1024958
gatgtttg

SEQ ID NO: 160445 - DNA, 8 bp, Unknown
  misc_feature (1)..( 8): Result.004 file - promoters50/1024958
gatatttg

SEQ ID NO: 160446 - DNA, 8 bp, Unknown
  misc_feature (1)..( 8): Result.004 file - promoters50/1024961
tatatttt

SEQ ID NO: 160447 - DNA, 7 bp, Unknown
  misc_feature (1)..( 7): Result.004 file - promoters50/1024961
aaacaat

SEQ ID NO: 160448 - DNA, 7 bp, Unknown
  misc_feature (1)..( 7): Result.004 file - promoters50/1024961
aaaaaat

SEQ ID NO: 160449 - DNA, 7 bp, Unknown
  misc_feature (1)..( 7): Result.004 file - promoters50/1024961
gaacaat

SEQ ID NO: 160450 - DNA, 14 bp, Unknown
  misc_feature (1)..( 14): Result.004 file - promoters50/1024961
cttggttttgcttg

SEQ ID NO: 160451 - DNA, 14 bp, Unknown
  misc_feature (1)..( 14): Result.004 file - promoters50/1024961
cttgattttacttg

SEQ ID NO: 160452 - DNA, 14 bp, Unknown
  misc_feature (1)..( 14): Result.004 file - promoters50/1024961
cttggtcttgccgt

SEQ ID NO: 160453 - DNA, 7 bp, Unknown
  misc_feature (1)..( 7): Result.004 file - promoters50/1024961
aaaaaag

SEQ ID NO: 160454 - DNA, 7 bp, Unknown
  misc_feature (1)..( 7): Result.004 file - promoters50/1024961
aaaaaat

SEQ ID NO: 160455 - DNA, 7 bp, Unknown
  misc_feature (1)..( 7): Result.004 file - promoters50/1024961
aaataag

SEQ ID NO: 160456 - DNA, 8 bp, Unknown
  misc_feature (1)..( 8): Result.004 file - promoters50/1024961
aaagaaat

SEQ ID NO: 160457 - DNA, 8 bp, Unknown
  misc_feature (1)..( 8): Result.004 file - promoters50/1024961
aaataaat

SEQ ID NO: 160458 - DNA, 8 bp, Unknown
  misc_feature (1)..( 8): Result.004 file - promoters50/1025028
aaataact

SEQ ID NO: 160459 - DNA, 12 bp, Unknown
  misc_feature (1)..( 12): Result.004 file - promoters50/1025028
aattaaccaacc

SEQ ID NO: 160460 - DNA, 12 bp, Unknown
  misc_feature (1)..( 12): Result.004 file - promoters50/1025028
aattaattgtat

SEQ ID NO: 160461 - DNA, 12 bp, Unknown
  misc_feature (1)..( 12): Result.004 file - promoters50/1025028
cattaaccaagc

SEQ ID NO: 160462 - DNA, 12 bp, Unknown
  misc_feature (1)..( 12): Result.004 file - promoters50/1025028
tattaattttat

SEQ ID NO: 160463 - DNA, 12 bp, Unknown
  misc_feature (1)..( 12): Result.004 file - promoters50/1025028
aattatatccac

SEQ ID NO: 160464 - DNA, 8 bp, Unknown
  misc_feature (1)..( 8): Result.004 file - promoters50/1025028
agatatta

SEQ ID NO: 160465 - DNA, 8 bp, Unknown
  misc_feature (1)..( 8): Result.004 file - promoters50/1025028
ctatatta

SEQ ID NO: 160466 - DNA, 8 bp, Unknown
  misc_feature (1)..( 8): Result.004 file - promoters50/1025028
atatattt

SEQ ID NO: 160467 - DNA, 8 bp, Unknown
  misc_feature (1)..( 8): Result.004 file - promoters50/1025028
atatatct

SEQ ID NO: 160468 - DNA, 7 bp, Unknown
  misc_feature (1)..( 7): Result.004 file - promoters50/1025028
aatttta

SEQ ID NO: 160469 - DNA, 7 bp, Unknown
  misc_feature (1)..( 7): Result.004 file - promoters50/1025028
aattttg

SEQ ID NO: 160470 - DNA, 7 bp, Unknown
  misc_feature (1)..( 7): Result.004 file - promoters50/1025028
aatttta

SEQ ID NO: 160471 - DNA, 7 bp, Unknown
  misc_feature (1)..( 7): Result.004 file - promoters50/1025028
aattttg

SEQ ID NO: 160472 - DNA, 9 bp, Unknown
  misc_feature (1)..( 9): Result.004 file - promoters50/1025028
attcaaagt

SEQ ID NO: 160473 - DNA, 9 bp, Unknown
  misc_feature (1)..( 9): Result.004 file - promoters50/1025028
aatcaaagc

SEQ ID NO: 160474 - DNA, 9 bp, Unknown
  misc_feature (1)..( 9): Result.004 file - promoters50/1025028
agtcaaagt

SEQ ID NO: 160475 - DNA, 9 bp, Unknown
  misc_feature (1)..( 9): Result.004 file - promoters50/1025053
agttaaact

SEQ ID NO: 160476 - DNA, 9 bp, Unknown
  misc_feature (1)..( 9): Result.004 file - promoters50/1025053
cgagtctat

SEQ ID NO: 160477 - DNA, 9 bp, Unknown
  misc_feature (1)..( 9): Result.004 file - promoters50/1025053
ctagtctat

SEQ ID NO: 160478 - DNA, 9 bp, Unknown
  misc_feature (1)..( 9): Result.004 file - promoters50/1025087
ctaatcttt

SEQ ID NO: 160479 - DNA, 16 bp, Unknown
  misc_feature (1)..( 16): Result.004 file - promoters50/1025087
cttgtaatacccagta

SEQ ID NO: 160480 - DNA, 16 bp, Unknown
  misc_feature (1)..( 16): Result.004 file - promoters50/1025087
tttgaaattggtagag

SEQ ID NO: 160481 - DNA, 16 bp, Unknown
  misc_feature (1)..( 16): Result.004 file - promoters50/1025087
tttcaaaagagtagaa

SEQ ID NO: 160482 - DNA, 16 bp, Unknown
  misc_feature (1)..( 16): Result.004 file - promoters50/1025087
ttagaaaatgggattt

SEQ ID NO: 160483 - DNA, 16 bp, Unknown
  misc_feature (1)..( 16): Result.004 file - promoters50/1025087
aaccaaaatcggattt

SEQ ID NO: 160484 - DNA, 16 bp, Unknown
  misc_feature (1)..( 16): Result.004 file - promoters50/1025100
aggaatcatcggagcg

SEQ ID NO: 160485 - DNA, 13 bp, Unknown
  misc_feature (1)..( 13): Result.004 file - promoters50/1025100
gataaaaaaaata

SEQ ID NO: 160486 - DNA, 13 bp, Unknown
  misc_feature (1)..( 13): Result.004 file - promoters50/1025100
gataaaaaatata

SEQ ID NO: 160487 - DNA, 13 bp, Unknown
  misc_feature (1)..( 13): Result.004 file - promoters50/1025100
aatagaaatacaa

SEQ ID NO: 160488 - DNA, 8 bp, Unknown
  misc_feature (1)..( 8): Result.004 file - promoters50/1025100
tcaatttt

SEQ ID NO: 160489 - DNA, 8 bp, Unknown
  misc_feature (1)..( 8): Result.004 file - promoters50/1025100
acaatttt

SEQ ID NO: 160490 - DNA, 8 bp, Unknown
  misc_feature (1)..( 8): Result.004 file - promoters50/1025113
acacttta

SEQ ID NO: 160491 - DNA, 11 bp, Unknown
  misc_feature (1)..( 11): Result.004 file - promoters50/1025113
tttaacaaaac

SEQ ID NO: 160492 - DNA, 11 bp, Unknown
  misc_feature (1)..( 11): Result.004 file - promoters50/1025113
tttaagaaaat

SEQ ID NO: 160493 - DNA, 11 bp, Unknown
  misc_feature (1)..( 11): Result.004 file - promoters50/1025113
cttttcaaaac

SEQ ID NO: 160494 - DNA, 12 bp, Unknown
  misc_feature (1)..( 12): Result.004 file - promoters50/1025113
ttaagtatatat

SEQ ID NO: 160495 - DNA, 12 bp, Unknown
  misc_feature (1)..( 12): Result.004 file - promoters50/1025113
gaaaatatatat

SEQ ID NO: 160496 - DNA, 12 bp, Unknown
  misc_feature (1)..( 12): Result.004 file - promoters50/1025113
aaagataaatac

SEQ ID NO: 160497 - DNA, 9 bp, Unknown
  misc_feature (1)..( 9): Result.004 file - promoters50/1025113
atatagctt

SEQ ID NO: 160498 - DNA, 9 bp, Unknown
  misc_feature (1)..( 9): Result.004 file - promoters50/1025113
atacagcta

SEQ ID NO: 160499 - DNA, 9 bp, Unknown
  misc_feature (1)..( 9): Result.004 file - promoters50/1025117
ctttagctt

SEQ ID NO: 160500 - DNA, 10 bp, Unknown
  misc_feature (1)..( 10): Result.004 file - promoters50/1025117
ttttattatg

SEQ ID NO: 160501 - DNA, 10 bp, Unknown
  misc_feature (1)..( 10): Result.004 file - promoters50/1025117
gttttttaat

SEQ ID NO: 160502 - DNA, 10 bp, Unknown
  misc_feature (1)..( 10): Result.004 file - promoters50/1025117
ttttattcta

SEQ ID NO: 160503 - DNA, 10 bp, Unknown
  misc_feature (1)..( 10): Result.004 file - promoters50/1025117
cattagtatt

SEQ ID NO: 160504 - DNA, 10 bp, Unknown
  misc_feature (1)..( 10): Result.004 file - promoters50/1025117
ttttaagcct

SEQ ID NO: 160505 - DNA, 10 bp, Unknown
  misc_feature (1)..( 10): Result.004 file - promoters50/1025117
atttaatcct

SEQ ID NO: 160506 - DNA, 14 bp, Unknown
  misc_feature (1)..( 14): Result.004 file - promoters50/1025117
ttatttcatggcgt

SEQ ID NO: 160507 - DNA, 14 bp, Unknown
  misc_feature (1)..( 14): Result.004 file - promoters50/1025117
ttgtttaatgtttt

SEQ ID NO: 160508 - DNA, 14 bp, Unknown
  misc_feature (1)..( 14): Result.004 file - promoters50/1025117
ttgttcaatatttt

SEQ ID NO: 160509 - DNA, 14 bp, Unknown
  misc_feature (1)..( 14): Result.004 file - promoters50/1025117
gcatttaatcctat

SEQ ID NO: 160510 - DNA, 15 bp, Unknown
  misc_feature (1)..( 15): Result.004 file - promoters50/1025117
ttattctaataattt

SEQ ID NO: 160511 - DNA, 15 bp, Unknown
  misc_feature (1)..( 15): Result.004 file - promoters50/1025117
gtattgtaagatttt

SEQ ID NO: 160512 - DNA, 11 bp, Unknown
  misc_feature (1)..( 11): Result.004 file - promoters50/1025117
atagagtttgg

SEQ ID NO: 160513 - DNA, 11 bp, Unknown
  misc_feature (1)..( 11): Result.004 file - promoters50/1025117
atatagtttta

SEQ ID NO: 160514 - DNA, 11 bp, Unknown
  misc_feature (1)..( 11): Result.004 file - promoters50/1025117
taagattttgt

SEQ ID NO: 160515 - DNA, 11 bp, Unknown
  misc_feature (1)..( 11): Result.004 file - promoters50/1025117
atttagtttgc

SEQ ID NO: 160516 - DNA, 11 bp, Unknown
  misc_feature (1)..( 11): Result.004 file - promoters50/1025117
atttcttttgt

SEQ ID NO: 160517 - DNA, 11 bp, Unknown
  misc_feature (1)..( 11): Result.004 file - promoters50/1025117
tgagatttcat

SEQ ID NO: 160518 - DNA, 12 bp, Unknown
  misc_feature (1)..( 12): Result.004 file - promoters50/1025117
atattaaaatac

SEQ ID NO: 160519 - DNA, 12 bp, Unknown
  misc_feature (1)..( 12): Result.004 file - promoters50/1025117
ttattgaaattt

SEQ ID NO: 160520 - DNA, 12 bp, Unknown
  misc_feature (1)..( 12): Result.004 file - promoters50/1025117
ttgttaatatat

SEQ ID NO: 160521 - DNA, 12 bp, Unknown
  misc_feature (1)..( 12): Result.004 file - promoters50/1025117
atattattaata

SEQ ID NO: 160522 - DNA, 12 bp, Unknown
  misc_feature (1)..( 12): Result.004 file - promoters50/1025178
tttaaaatatat

SEQ ID NO: 160523 - DNA, 7 bp, Unknown
  misc_feature (1)..( 7): Result.004 file - promoters50/1025178
ccaaata

SEQ ID NO: 160524 - DNA, 7 bp, Unknown
  misc_feature (1)..( 7): Result.004 file - promoters50/1025178
ccaaatg

SEQ ID NO: 160525 - DNA, 7 bp, Unknown
  misc_feature (1)..( 7): Result.004 file - promoters50/1025178
acaaatg

SEQ ID NO: 160526 - DNA, 15 bp, Unknown
  misc_feature (1)..( 15): Result.004 file - promoters50/1025178
aaggtatccgaaccg

SEQ ID NO: 160527 - DNA, 15 bp, Unknown
  misc_feature (1)..( 15): Result.004 file - promoters50/1025178
tttgtaaccgagccg

SEQ ID NO: 160528 - DNA, 15 bp, Unknown
  misc_feature (1)..( 15): Result.004 file - promoters50/1025185
aaggaatcacgcagg

SEQ ID NO: 160529 - DNA, 9 bp, Unknown
  misc_feature (1)..( 9): Result.004 file - promoters50/1025185
aagaagaaa

SEQ ID NO: 160530 - DNA, 9 bp, Unknown
  misc_feature (1)..( 9): Result.004 file - promoters50/1025185
ttgaataaa

SEQ ID NO: 160531 - DNA, 9 bp, Unknown
  misc_feature (1)..( 9): Result.004 file - promoters50/1025185
aagcagaca

SEQ ID NO: 160532 - DNA, 11 bp, Unknown
  misc_feature (1)..( 11): Result.004 file - promoters50/1025185
aatgtttgata

SEQ ID NO: 160533 - DNA, 11 bp, Unknown
  misc_feature (1)..( 11): Result.004 file - promoters50/1025185
aatttttgatt

SEQ ID NO: 160534 - DNA, 11 bp, Unknown
  misc_feature (1)..( 11): Result.004 file - promoters50/1025185
gtttttttata

SEQ ID NO: 160535 - DNA, 9 bp, Unknown
  misc_feature (1)..( 9): Result.004 file - promoters50/1025185
ttttatcat

SEQ ID NO: 160536 - DNA, 9 bp, Unknown
  misc_feature (1)..( 9): Result.004 file - promoters50/1025185
taatatcat

SEQ ID NO: 160537 - DNA, 9 bp, Unknown
  misc_feature (1)..( 9): Result.004 file - promoters50/1025194
ttttctcaa

SEQ ID NO: 160538 - DNA, 10 bp, Unknown
  misc_feature (1)..( 10): Result.004 file - promoters50/1025194
cgaatttttc

SEQ ID NO: 160539 - DNA, 10 bp, Unknown
  misc_feature (1)..( 10): Result.004 file - promoters50/1025194
acaatatttc

SEQ ID NO: 160540 - DNA, 10 bp, Unknown
  misc_feature (1)..( 10): Result.004 file - promoters50/1025194
acactatatc

SEQ ID NO: 160541 - DNA, 10 bp, Unknown
  misc_feature (1)..( 10): Result.004 file - promoters50/1025194
taaatttttg

SEQ ID NO: 160542 - DNA, 10 bp, Unknown
  misc_feature (1)..( 10): Result.004 file - promoters50/1025194
aactaacatg

SEQ ID NO: 160543 - DNA, 10 bp, Unknown
  misc_feature (1)..( 10): Result.004 file - promoters50/1025194
cactatcatt

SEQ ID NO: 160544 - DNA, 10 bp, Unknown
  misc_feature (1)..( 10): Result.004 file - promoters50/1025194
tacaaataat

SEQ ID NO: 160545 - DNA, 10 bp, Unknown
  misc_feature (1)..( 10): Result.004 file - promoters50/1025202
acataataat

SEQ ID NO: 160546 - DNA, 8 bp, Unknown
  misc_feature (1)..( 8): Result.004 file - promoters50/1025202
atttctgt

SEQ ID NO: 160547 - DNA, 8 bp, Unknown
  misc_feature (1)..( 8): Result.004 file - promoters50/1025202
atttatgt

SEQ ID NO: 160548 - DNA, 8 bp, Unknown
  misc_feature (1)..( 8): Result.004 file - promoters50/1025202
tgttctgt

SEQ ID NO: 160549 - DNA, 7 bp, Unknown
  misc_feature (1)..( 7): Result.004 file - promoters50/1025202
cttaatt

SEQ ID NO: 160550 - DNA, 7 bp, Unknown
  misc_feature (1)..( 7): Result.004 file - promoters50/1025202
cttaatt

SEQ ID NO: 160551 - DNA, 7 bp, Unknown
  misc_feature (1)..( 7): Result.004 file - promoters50/1025211
tttaatt

SEQ ID NO: 160552 - DNA, 14 bp, Unknown
  misc_feature (1)..( 14): Result.004 file - promoters50/1025211
tataaaatacagta

SEQ ID NO: 160553 - DNA, 14 bp, Unknown
  misc_feature (1)..( 14): Result.004 file - promoters50/1025211
cgaaaaataaataa

SEQ ID NO: 160554 - DNA, 14 bp, Unknown
  misc_feature (1)..( 14): Result.004 file - promoters50/1025211
aataaaattaatat

SEQ ID NO: 160555 - DNA, 14 bp, Unknown
  misc_feature (1)..( 14): Result.004 file - promoters50/1025211
tatataatattttt

SEQ ID NO: 160556 - DNA, 14 bp, Unknown
  misc_feature (1)..( 14): Result.004 file - promoters50/1025211
gagataatatttca

SEQ ID NO: 160557 - DNA, 14 bp, Unknown
  misc_feature (1)..( 14): Result.004 file - promoters50/1025211
atcatgctatttat

SEQ ID NO: 160558 - DNA, 13 bp, Unknown
  misc_feature (1)..( 13): Result.004 file - promoters50/1025211
atataattatttt

SEQ ID NO: 160559 - DNA, 13 bp, Unknown
  misc_feature (1)..( 13): Result.004 file - promoters50/1025211
atattattagtag

SEQ ID NO: 160560 - DNA, 13 bp, Unknown
  misc_feature (1)..( 13): Result.004 file - promoters50/1025211
atattattagcct

SEQ ID NO: 160561 - DNA, 13 bp, Unknown
  misc_feature (1)..( 13): Result.004 file - promoters50/1025211
ccttaattaccga

SEQ ID NO: 160562 - DNA, 13 bp, Unknown
  misc_feature (1)..( 13): Result.004 file - promoters50/1025211
gattaattctttt

SEQ ID NO: 160563 - DNA, 13 bp, Unknown
  misc_feature (1)..( 13): Result.004 file - promoters50/1025211
ttattatattgag

SEQ ID NO: 160564 - DNA, 12 bp, Unknown
  misc_feature (1)..( 12): Result.004 file - promoters50/1025211
ttttgtttctgg

SEQ ID NO: 160565 - DNA, 12 bp, Unknown
  misc_feature (1)..( 12): Result.004 file - promoters50/1025211
gtttgtttaaca

SEQ ID NO: 160566 - DNA, 12 bp, Unknown
  misc_feature (1)..( 12): Result.004 file - promoters50/1025211
ttttatttcttt

SEQ ID NO: 160567 - DNA, 12 bp, Unknown
  misc_feature (1)..( 12): Result.004 file - promoters50/1025211
atatgtctgcgc

SEQ ID NO: 160568 - DNA, 12 bp, Unknown
  misc_feature (1)..( 12): Result.004 file - promoters50/1025211
gattaattcttt

SEQ ID NO: 160569 - DNA, 12 bp, Unknown
  misc_feature (1)..( 12): Result.004 file - promoters50/1025211
caaaaatcctta

SEQ ID NO: 160570 - DNA, 16 bp, Unknown
  misc_feature (1)..( 16): Result.004 file - promoters50/1025211
taacaattctaatttt

SEQ ID NO: 160571 - DNA, 16 bp, Unknown
  misc_feature (1)..( 16): Result.004 file - promoters50/1025211
gaacaagtctctatga

SEQ ID NO: 160572 - DNA, 16 bp, Unknown
  misc_feature (1)..( 16): Result.004 file - promoters50/1025211
taaaaattaaatgcta

SEQ ID NO: 160573 - DNA, 16 bp, Unknown
  misc_feature (1)..( 16): Result.004 file - promoters50/1025211
aaaatattaaccttga

SEQ ID NO: 160574 - DNA, 16 bp, Unknown
  misc_feature (1)..( 16): Result.004 file - promoters50/1025211
agtatattagttaata

SEQ ID NO: 160575 - DNA, 16 bp, Unknown
  misc_feature (1)..( 16): Result.004 file - promoters50/1025211
ccaaaattgaccctga

SEQ ID NO: 160576 - DNA, 16 bp, Unknown
  misc_feature (1)..( 16): Result.004 file - promoters50/1025233
gtaaaatttcataacc

SEQ ID NO: 160577 - DNA, 9 bp, Unknown
  misc_feature (1)..( 9): Result.004 file - promoters50/1025233
acagaatct

SEQ ID NO: 160578 - DNA, 9 bp, Unknown
  misc_feature (1)..( 9): Result.004 file - promoters50/1025233
ttagaatct

SEQ ID NO: 160579 - DNA, 9 bp, Unknown
  misc_feature (1)..( 9): Result.004 file - promoters50/1025233
acaaaatga

SEQ ID NO: 160580 - DNA, 8 bp, Unknown
  misc_feature (1)..( 8): Result.004 file - promoters50/1025233
atttcttt

SEQ ID NO: 160581 - DNA, 8 bp, Unknown
  misc_feature (1)..( 8): Result.004 file - promoters50/1025233
attttttt

SEQ ID NO: 160582 - DNA, 8 bp, Unknown
  misc_feature (1)..( 8): Result.004 file - promoters50/1025262
attgtttt

SEQ ID NO: 160583 - DNA, 7 bp, Unknown
  misc_feature (1)..( 7): Result.004 file - promoters50/1025262
tcagatt

SEQ ID NO: 160584 - DNA, 7 bp, Unknown
  misc_feature (1)..( 7): Result.004 file - promoters50/1025262
tcacatt

SEQ ID NO: 160585 - DNA, 7 bp, Unknown
  misc_feature (1)..( 7): Result.004 file - promoters50/1025262
tcagata

SEQ ID NO: 160586 - DNA, 8 bp, Unknown
  misc_feature (1)..( 8): Result.004 file - promoters50/1025262
aaatgtaa

SEQ ID NO: 160587 - DNA, 8 bp, Unknown
  misc_feature (1)..( 8): Result.004 file - promoters50/1025262
atatgtaa

SEQ ID NO: 160588 - DNA, 8 bp, Unknown
  misc_feature (1)..( 8): Result.004 file - promoters50/1025262
atatataa

SEQ ID NO: 160589 - DNA, 8 bp, Unknown
  misc_feature (1)..( 8): Result.004 file - promoters50/1025262
agaaaaat

SEQ ID NO: 160590 - DNA, 8 bp, Unknown
  misc_feature (1)..( 8): Result.004 file - promoters50/1025262
agaaaaaa

SEQ ID NO: 160591 - DNA, 8 bp, Unknown
  misc_feature (1)..( 8): Result.004 file - promoters50/1025288
ttaaaaaa

SEQ ID NO: 160592 - DNA, 10 bp, Unknown
  misc_feature (1)..( 10): Result.004 file - promoters50/1025288
acatatataa

SEQ ID NO: 160593 - DNA, 10 bp, Unknown
  misc_feature (1)..( 10): Result.004 file - promoters50/1025288
tgataaataa

SEQ ID NO: 160594 - DNA, 10 bp, Unknown
  misc_feature (1)..( 10): Result.004 file - promoters50/1025288
tgagaaagtc

SEQ ID NO: 160595 - DNA, 8 bp, Unknown
  misc_feature (1)..( 8): Result.004 file - promoters50/1025288
tttgatta

SEQ ID NO: 160596 - DNA, 8 bp, Unknown
  misc_feature (1)..( 8): Result.004 file - promoters50/1025288
tttgatca

SEQ ID NO: 160597 - DNA, 8 bp, Unknown
  misc_feature (1)..( 8): Result.004 file - promoters50/1025288
gttggtca

SEQ ID NO: 160598 - DNA, 12 bp, Unknown
  misc_feature (1)..( 12): Result.004 file - promoters50/1025288
tttgatcaaatc

SEQ ID NO: 160599 - DNA, 12 bp, Unknown
  misc_feature (1)..( 12): Result.004 file - promoters50/1025288
ggctgtcaaatg

SEQ ID NO: 160600 - DNA, 12 bp, Unknown
  misc_feature (1)..( 12): Result.004 file - promoters50/1025288
tttggtcatatc

SEQ ID NO: 160601 - DNA, 12 bp, Unknown
  misc_feature (1)..( 12): Result.004 file - promoters50/1025288
gttgttcatagg

SEQ ID NO: 160602 - DNA, 9 bp, Unknown
  misc_feature (1)..( 9): Result.004 file - promoters50/1025288
caaagatga

SEQ ID NO: 160603 - DNA, 9 bp, Unknown
  misc_feature (1)..( 9): Result.004 file - promoters50/1025288
taaatatga

SEQ ID NO: 160604 - DNA, 9 bp, Unknown
  misc_feature (1)..( 9): Result.004 file - promoters50/1025288
taaataagt

SEQ ID NO: 160605 - DNA, 10 bp, Unknown
  misc_feature (1)..( 10): Result.004 file - promoters50/1025288
ttatatgttg

SEQ ID NO: 160606 - DNA, 10 bp, Unknown
  misc_feature (1)..( 10): Result.004 file - promoters50/1025288
ttatttgttc

SEQ ID NO: 160607 - DNA, 10 bp, Unknown
  misc_feature (1)..( 10): Result.004 file - promoters50/1025288
aaatttcttt

SEQ ID NO: 160608 - DNA, 8 bp, Unknown
  misc_feature (1)..( 8): Result.004 file - promoters50/1025288
tttaaaag

SEQ ID NO: 160609 - DNA, 8 bp, Unknown
  misc_feature (1)..( 8): Result.004 file - promoters50/1025288
attaaaat

SEQ ID NO: 160610 - DNA, 8 bp, Unknown
  misc_feature (1)..( 8): Result.004 file - promoters50/1025288
tttaaaag

SEQ ID NO: 160611 - DNA, 8 bp, Unknown
  misc_feature (1)..( 8): Result.004 file - promoters50/1025288
ttatttca

SEQ ID NO: 160612 - DNA, 8 bp, Unknown
  misc_feature (1)..( 8): Result.004 file - promoters50/1025288
ctatttct

SEQ ID NO: 160613 - DNA, 8 bp, Unknown
  misc_feature (1)..( 8): Result.004 file - promoters50/1025288
ctacttct

SEQ ID NO: 160614 - DNA, 8 bp, Unknown
  misc_feature (1)..( 8): Result.004 file - promoters50/1025288
aaattgag

SEQ ID NO: 160615 - DNA, 8 bp, Unknown
  misc_feature (1)..( 8): Result.004 file - promoters50/1025288
aaatggag

SEQ ID NO: 160616 - DNA, 8 bp, Unknown
  misc_feature (1)..( 8): Result.004 file - promoters50/1025288
acatggag

SEQ ID NO: 160617 - DNA, 12 bp, Unknown
  misc_feature (1)..( 12): Result.004 file - promoters50/1025288
ctgtatttttaa

SEQ ID NO: 160618 - DNA, 12 bp, Unknown
  misc_feature (1)..( 12): Result.004 file - promoters50/1025288
ctgaatttattt

SEQ ID NO: 160619 - DNA, 12 bp, Unknown
  misc_feature (1)..( 12): Result.004 file - promoters50/1025322
tcaaatttcttt

SEQ ID NO: 160620 - DNA, 7 bp, Unknown
  misc_feature (1)..( 7): Result.004 file - promoters50/1025322
aaattag

SEQ ID NO: 160621 - DNA, 7 bp, Unknown
  misc_feature (1)..( 7): Result.004 file - promoters50/1025322
aaattag

SEQ ID NO: 160622 - DNA, 7 bp, Unknown
  misc_feature (1)..( 7): Result.004 file - promoters50/1025322
caattag

SEQ ID NO: 160623 - DNA, 8 bp, Unknown
  misc_feature (1)..( 8): Result.004 file - promoters50/1025322
attctttc

SEQ ID NO: 160624 - DNA, 8 bp, Unknown
  misc_feature (1)..( 8): Result.004 file - promoters50/1025322
tttctttc

SEQ ID NO: 160625 - DNA, 8 bp, Unknown
  misc_feature (1)..( 8): Result.004 file - promoters50/1025340
tttgtttg

SEQ ID NO: 160626 - DNA, 9 bp, Unknown
  misc_feature (1)..( 9): Result.004 file - promoters50/1025340
gttagatca

SEQ ID NO: 160627 - DNA, 9 bp, Unknown
  misc_feature (1)..( 9): Result.004 file - promoters50/1025340
gttagatcg

SEQ ID NO: 160628 - DNA, 9 bp, Unknown
  misc_feature (1)..( 9): Result.004 file - promoters50/1025340
agtagttca

SEQ ID NO: 160629 - DNA, 9 bp, Unknown
  misc_feature (1)..( 9): Result.004 file - promoters50/1025340
aaaagttca

SEQ ID NO: 160630 - DNA, 8 bp, Unknown
  misc_feature (1)..( 8): Result.004 file - promoters50/1025340
tatattta

SEQ ID NO: 160631 - DNA, 8 bp, Unknown
  misc_feature (1)..( 8): Result.004 file - promoters50/1025340
catattta

SEQ ID NO: 160632 - DNA, 8 bp, Unknown
  misc_feature (1)..( 8): Result.004 file - promoters50/1025340
tatatatg

SEQ ID NO: 160633 - DNA, 8 bp, Unknown
  misc_feature (1)..( 8): Result.004 file - promoters50/1025348
agtatata

SEQ ID NO: 160634 - DNA, 11 bp, Unknown
  misc_feature (1)..( 11): Result.004 file - promoters50/1025348
ctactttcttt

SEQ ID NO: 160635 - DNA, 11 bp, Unknown
  misc_feature (1)..( 11): Result.004 file - promoters50/1025348
ctagtttgttt

SEQ ID NO: 160636 - DNA, 11 bp, Unknown
  misc_feature (1)..( 11): Result.004 file - promoters50/1025348
atagttttgga

SEQ ID NO: 160637 - DNA, 9 bp, Unknown
  misc_feature (1)..( 9): Result.004 file - promoters50/1025348
gaaaatgtt

SEQ ID NO: 160638 - DNA, 9 bp, Unknown
  misc_feature (1)..( 9): Result.004 file - promoters50/1025348
aaaaacgtt

SEQ ID NO: 160639 - DNA, 10 bp, Unknown
  misc_feature (1)..( 10): Result.004 file - promoters50/1025348
taacaacacc

SEQ ID NO: 160640 - DNA, 12 bp, Unknown
  misc_feature (1)..( 12): Result.004 file - promoters50/1025348
ataattttttat

SEQ ID NO: 160641 - DNA, 12 bp, Unknown
  misc_feature (1)..( 12): Result.004 file - promoters50/1025348
ctaatttaacat

SEQ ID NO: 160642 - DNA, 12 bp, Unknown
  misc_feature (1)..( 12): Result.004 file - promoters50/1025348
atagttttttat

SEQ ID NO: 160643 - DNA, 12 bp, Unknown
  misc_feature (1)..( 12): Result.004 file - promoters50/1025348
gggcttttaata

SEQ ID NO: 160644 - DNA, 10 bp, Unknown
  misc_feature (1)..( 10): Result.004 file - promoters50/1025348
cttccctcag

SEQ ID NO: 160645 - DNA, 10 bp, Unknown
  misc_feature (1)..( 10): Result.004 file - promoters50/1025348
cttcccttta

SEQ ID NO: 160646 - DNA, 10 bp, Unknown
  misc_feature (1)..( 10): Result.004 file - promoters50/1025348
tttcctttta

SEQ ID NO: 160647 - DNA, 8 bp, Unknown
  misc_feature (1)..( 8): Result.004 file - promoters50/1025348
tttatttc

SEQ ID NO: 160648 - DNA, 8 bp, Unknown
  misc_feature (1)..( 8): Result.004 file - promoters50/1025348
attatttt

SEQ ID NO: 160649 - DNA, 8 bp, Unknown
  misc_feature (1)..( 8): Result.004 file - promoters50/1025348
tttgtttc

SEQ ID NO: 160650 - DNA, 7 bp, Unknown
  misc_feature (1)..( 7): Result.004 file - promoters50/1025348
cttttaa

SEQ ID NO: 160651 - DNA, 7 bp, Unknown
  misc_feature (1)..( 7): Result.004 file - promoters50/1025348
cttttaa

SEQ ID NO: 160652 - DNA, 7 bp, Unknown
  misc_feature (1)..( 7): Result.004 file - promoters50/1025348
attttaa

SEQ ID NO: 160653 - DNA, 7 bp, Unknown
  misc_feature (1)..( 7): Result.004 file - promoters50/1025348
taaaaac

SEQ ID NO: 160654 - DNA, 7 bp, Unknown
  misc_feature (1)..( 7): Result.004 file - promoters50/1025348
taaaaaa

SEQ ID NO: 160655 - DNA, 7 bp, Unknown
  misc_feature (1)..( 7): Result.004 file - promoters50/1025372
taacaac

SEQ ID NO: 160656 - DNA, 7 bp, Unknown
  misc_feature (1)..( 7): Result.004 file - promoters50/1025372
gttgaat

SEQ ID NO: 160657 - DNA, 7 bp, Unknown
  misc_feature (1)..( 7): Result.004 file - promoters50/1025372
gttgaaa

SEQ ID NO: 160658 - DNA, 7 bp, Unknown
  misc_feature (1)..( 7): Result.004 file - promoters50/1025372
cttgaaa

SEQ ID NO: 160659 - DNA, 8 bp, Unknown
  misc_feature (1)..( 8): Result.004 file - promoters50/1025372
tatatttt

SEQ ID NO: 160660 - DNA, 8 bp, Unknown
  misc_feature (1)..( 8): Result.004 file - promoters50/1025372
tatttttt

SEQ ID NO: 160661 - DNA, 8 bp, Unknown
  misc_feature (1)..( 8): Result.004 file - promoters50/1025372
tatatttt

SEQ ID NO: 160662 - DNA, 9 bp, Unknown
  misc_feature (1)..( 9): Result.004 file - promoters50/1025372
tcatctgat

SEQ ID NO: 160663 - DNA, 9 bp, Unknown
  misc_feature (1)..( 9): Result.004 file - promoters50/1025372
ccatttgat

SEQ ID NO: 160664 - DNA, 9 bp, Unknown
  misc_feature (1)..( 9): Result.004 file - promoters50/1025372
tcatctttt

SEQ ID NO: 160665 - DNA, 9 bp, Unknown
  misc_feature (1)..( 9): Result.004 file - promoters50/1025372
tttcaatat

SEQ ID NO: 160666 - DNA, 9 bp, Unknown
  misc_feature (1)..( 9): Result.004 file - promoters50/1025372
catcattat

SEQ ID NO: 160667 - DNA, 9 bp, Unknown
  misc_feature (1)..( 9): Result.004 file - promoters50/1025372
catccttat

SEQ ID NO: 160668 - DNA, 7 bp, Unknown
  misc_feature (1)..( 7): Result.004 file - promoters50/1025372
tttttgt

SEQ ID NO: 160669 - DNA, 7 bp, Unknown
  misc_feature (1)..( 7): Result.004 file - promoters50/1025372
tttttgc

SEQ ID NO: 160670 - DNA, 7 bp, Unknown
  misc_feature (1)..( 7): Result.004 file - promoters50/1025372
ttttttt

SEQ ID NO: 160671 - DNA, 7 bp, Unknown
  misc_feature (1)..( 7): Result.004 file - promoters50/1025372
ttttatt

SEQ ID NO: 160672 - DNA, 7 bp, Unknown
  misc_feature (1)..( 7): Result.004 file - promoters50/1025372
ttttata

SEQ ID NO: 160673 - DNA, 7 bp, Unknown
  misc_feature (1)..( 7): Result.004 file - promoters50/1025443
tttgata

SEQ ID NO: 160674 - DNA, 10 bp, Unknown
  misc_feature (1)..( 10): Result.004 file - promoters50/1025443
aaaaaataca

SEQ ID NO: 160675 - DNA, 10 bp, Unknown
  misc_feature (1)..( 10): Result.004 file - promoters50/1025443
acaaaatatg

SEQ ID NO: 160676 - DNA, 10 bp, Unknown
  misc_feature (1)..( 10): Result.004 file - promoters50/1025443
tgaaaataca

SEQ ID NO: 160677 - DNA, 10 bp, Unknown
  misc_feature (1)..( 10): Result.004 file - promoters50/1025443
tgaaaattta

SEQ ID NO: 160678 - DNA, 12 bp, Unknown
  misc_feature (1)..( 12): Result.004 file - promoters50/1025443
aaaaaatacaaa

SEQ ID NO: 160679 - DNA, 12 bp, Unknown
  misc_feature (1)..( 12): Result.004 file - promoters50/1025443
taaccatacaaa

SEQ ID NO: 160680 - DNA, 12 bp, Unknown
  misc_feature (1)..( 12): Result.004 file - promoters50/1025443
tgaaaatacagg

SEQ ID NO: 160681 - DNA, 12 bp, Unknown
  misc_feature (1)..( 12): Result.004 file - promoters50/1025443
tgaaaatttagt

SEQ ID NO: 160682 - DNA, 10 bp, Unknown
  misc_feature (1)..( 10): Result.004 file - promoters50/1025443
tttaggaaat

SEQ ID NO: 160683 - DNA, 10 bp, Unknown
  misc_feature (1)..( 10): Result.004 file - promoters50/1025443
gttgggaaat

SEQ ID NO: 160684 - DNA, 10 bp, Unknown
  misc_feature (1)..( 10): Result.004 file - promoters50/1025443
gttgtgaaat

SEQ ID NO: 160685 - DNA, 12 bp, Unknown
  misc_feature (1)..( 12): Result.004 file - promoters50/1025443
ttttatttctta

SEQ ID NO: 160686 - DNA, 12 bp, Unknown
  misc_feature (1)..( 12): Result.004 file - promoters50/1025443
tttaattattgt

SEQ ID NO: 160687 - DNA, 12 bp, Unknown
  misc_feature (1)..( 12): Result.004 file - promoters50/1025468
cattatctctta

SEQ ID NO: 160688 - DNA, 10 bp, Unknown
  misc_feature (1)..( 10): Result.004 file - promoters50/1025468
gataatgtat

SEQ ID NO: 160689 - DNA, 10 bp, Unknown
  misc_feature (1)..( 10): Result.004 file - promoters50/1025468
gatgatgtac

SEQ ID NO: 160690 - DNA, 10 bp, Unknown
  misc_feature (1)..( 10): Result.004 file - promoters50/1025468
ctaaatatat

SEQ ID NO: 160691 - DNA, 10 bp, Unknown
  misc_feature (1)..( 10): Result.004 file - promoters50/1025468
ttaaaaatag

SEQ ID NO: 160692 - DNA, 10 bp, Unknown
  misc_feature (1)..( 10): Result.004 file - promoters50/1025468
agaaacatga

SEQ ID NO: 160693 - DNA, 10 bp, Unknown
  misc_feature (1)..( 10): Result.004 file - promoters50/1025468
ttgaatatac

SEQ ID NO: 160694 - DNA, 11 bp, Unknown
  misc_feature (1)..( 11): Result.004 file - promoters50/1025468
aaaaaaaacac

SEQ ID NO: 160695 - DNA, 11 bp, Unknown
  misc_feature (1)..( 11): Result.004 file - promoters50/1025468
cttagaaacac

SEQ ID NO: 160696 - DNA, 11 bp, Unknown
  misc_feature (1)..( 11): Result.004 file - promoters50/1025468
aaagaaaacaa

SEQ ID NO: 160697 - DNA, 11 bp, Unknown
  misc_feature (1)..( 11): Result.004 file - promoters50/1025468
gaaaaatacat

SEQ ID NO: 160698 - DNA, 11 bp, Unknown
  misc_feature (1)..( 11): Result.004 file - promoters50/1025468
gtgaaaaacgt

SEQ ID NO: 160699 - DNA, 11 bp, Unknown
  misc_feature (1)..( 11): Result.004 file - promoters50/1025471
aatgaaaatat

SEQ ID NO: 160700 - DNA, 10 bp, Unknown
  misc_feature (1)..( 10): Result.004 file - promoters50/1025471
tataaaaaaa

SEQ ID NO: 160701 - DNA, 10 bp, Unknown
  misc_feature (1)..( 10): Result.004 file - promoters50/1025471
gttaaaaaag

SEQ ID NO: 160702 - DNA, 10 bp, Unknown
  misc_feature (1)..( 10): Result.004 file - promoters50/1025471
attaataaat

SEQ ID NO: 160703 - DNA, 10 bp, Unknown
  misc_feature (1)..( 10): Result.004 file - promoters50/1025471
ttcaaaaaag

SEQ ID NO: 160704 - DNA, 10 bp, Unknown
  misc_feature (1)..( 10): Result.004 file - promoters50/1025471
aagaataaaa

SEQ ID NO: 160705 - DNA, 10 bp, Unknown
  misc_feature (1)..( 10): Result.004 file - promoters50/1025471
tttaacaaac

SEQ ID NO: 160706 - DNA, 10 bp, Unknown
  misc_feature (1)..( 10): Result.004 file - promoters50/1025491
attaatgaat

SEQ ID NO: 160707 - DNA, 11 bp, Unknown
  misc_feature (1)..( 11): Result.004 file - promoters50/1025491
catatctaaat

SEQ ID NO: 160708 - DNA, 11 bp, Unknown
  misc_feature (1)..( 11): Result.004 file - promoters50/1025491
tttttctaaaa

SEQ ID NO: 160709 - DNA, 11 bp, Unknown
  misc_feature (1)..( 11): Result.004 file - promoters50/1025491
ttttgctaaaa

SEQ ID NO: 160710 - DNA, 11 bp, Unknown
  misc_feature (1)..( 11): Result.004 file - promoters50/1025491
atctgctaatg

SEQ ID NO: 160711 - DNA, 10 bp, Unknown
  misc_feature (1)..( 10): Result.004 file - promoters50/1025491
tcgattcttt

SEQ ID NO: 160712 - DNA, 10 bp, Unknown
  misc_feature (1)..( 10): Result.004 file - promoters50/1025491
acaatttttt

SEQ ID NO: 160713 - DNA, 10 bp, Unknown
  misc_feature (1)..( 10): Result.004 file - promoters50/1025491
tcaattttgc

SEQ ID NO: 160714 - DNA, 10 bp, Unknown
  misc_feature (1)..( 10): Result.004 file - promoters50/1025491
acaattttat

SEQ ID NO: 160715 - DNA, 7 bp, Unknown
  misc_feature (1)..( 7): Result.004 file - promoters50/1025491
attctat

SEQ ID NO: 160716 - DNA, 7 bp, Unknown
  misc_feature (1)..( 7): Result.004 file - promoters50/1025491
attctat

SEQ ID NO: 160717 - DNA, 7 bp, Unknown
  misc_feature (1)..( 7): Result.004 file - promoters50/1025491
attatat

SEQ ID NO: 160718 - DNA, 7 bp, Unknown
  misc_feature (1)..( 7): Result.004 file - promoters50/1025491
attatag

SEQ ID NO: 160719 - DNA, 14 bp, Unknown
  misc_feature (1)..( 14): Result.004 file - promoters50/1025491
tatttggaaaattt

SEQ ID NO: 160720 - DNA, 14 bp, Unknown
  misc_feature (1)..( 14): Result.004 file - promoters50/1025491
ttgattcaaaattc

SEQ ID NO: 160721 - DNA, 14 bp, Unknown
  misc_feature (1)..( 14): Result.004 file - promoters50/1025491
ttgaatcaatattt

SEQ ID NO: 160722 - DNA, 14 bp, Unknown
  misc_feature (1)..( 14): Result.004 file - promoters50/1025511
gcataataataaat

SEQ ID NO: 160723 - DNA, 9 bp, Unknown
  misc_feature (1)..( 9): Result.004 file - promoters50/1025511
aaataataa

SEQ ID NO: 160724 - DNA, 9 bp, Unknown
  misc_feature (1)..( 9): Result.004 file - promoters50/1025511
taataataa

SEQ ID NO: 160725 - DNA, 10 bp, Unknown
  misc_feature (1)..( 10): Result.004 file - promoters50/1025511
gaagtaaaga

SEQ ID NO: 160726 - DNA, 10 bp, Unknown
  misc_feature (1)..( 10): Result.004 file - promoters50/1025511
aaaataatca

SEQ ID NO: 160727 - DNA, 10 bp, Unknown
  misc_feature (1)..( 10): Result.004 file - promoters50/1025511
agaatcatgc

SEQ ID NO: 160728 - DNA, 10 bp, Unknown
  misc_feature (1)..( 10): Result.004 file - promoters50/1025515
ttagtaatag

SEQ ID NO: 160729 - DNA, 12 bp, Unknown
  misc_feature (1)..( 12): Result.004 file - promoters50/1025515
cgtttactatat

SEQ ID NO: 160730 - DNA, 12 bp, Unknown
  misc_feature (1)..( 12): Result.004 file - promoters50/1025515
acttggctatat

SEQ ID NO: 160731 - DNA, 12 bp, Unknown
  misc_feature (1)..( 12): Result.004 file - promoters50/1025515
gttttagtatat

SEQ ID NO: 160732 - DNA, 12 bp, Unknown
  misc_feature (1)..( 12): Result.004 file - promoters50/1025515
gttttggtaata

SEQ ID NO: 160733 - DNA, 12 bp, Unknown
  misc_feature (1)..( 12): Result.004 file - promoters50/1025515
gacgagctataa

SEQ ID NO: 160734 - DNA, 12 bp, Unknown
  misc_feature (1)..( 12): Result.004 file - promoters50/1025515
taagaagtgtat

SEQ ID NO: 160735 - DNA, 10 bp, Unknown
  misc_feature (1)..( 10): Result.004 file - promoters50/1025515
ctttttgtta

SEQ ID NO: 160736 - DNA, 10 bp, Unknown
  misc_feature (1)..( 10): Result.004 file - promoters50/1025515
acttttgttc

SEQ ID NO: 160737 - DNA, 10 bp, Unknown
  misc_feature (1)..( 10): Result.004 file - promoters50/1025515
tcttttttag

SEQ ID NO: 160738 - DNA, 10 bp, Unknown
  misc_feature (1)..( 10): Result.004 file - promoters50/1025515
tgttttaggt

SEQ ID NO: 160739 - DNA, 10 bp, Unknown
  misc_feature (1)..( 10): Result.004 file - promoters50/1025515
agttttaaac

SEQ ID NO: 160740 - DNA, 10 bp, Unknown
  misc_feature (1)..( 10): Result.004 file - promoters50/1025540
agtttttccg

SEQ ID NO: 160741 - DNA, 8 bp, Unknown
  misc_feature (1)..( 8): Result.004 file - promoters50/1025540
ttgtttta

SEQ ID NO: 160742 - DNA, 8 bp, Unknown
  misc_feature (1)..( 8): Result.004 file - promoters50/1025540
tcgtttta

SEQ ID NO: 160743 - DNA, 8 bp, Unknown
  misc_feature (1)..( 8): Result.004 file - promoters50/1025642
ttgtctta

SEQ ID NO: 160744 - DNA, 12 bp, Unknown
  misc_feature (1)..( 12): Result.004 file - promoters50/1025642
accattatcgct

SEQ ID NO: 160745 - DNA, 12 bp, Unknown
  misc_feature (1)..( 12): Result.004 file - promoters50/1025642
accaatattcag

SEQ ID NO: 160746 - DNA, 12 bp, Unknown
  misc_feature (1)..( 12): Result.004 file - promoters50/1025642
taaaatatttta

SEQ ID NO: 160747 - DNA, 12 bp, Unknown
  misc_feature (1)..( 12): Result.004 file - promoters50/1025642
taaaagattcga

SEQ ID NO: 160748 - DNA, 12 bp, Unknown
  misc_feature (1)..( 12): Result.004 file - promoters50/1025642
aaaactatatat

SEQ ID NO: 160749 - DNA, 12 bp, Unknown
  misc_feature (1)..( 12): Result.004 file - promoters50/1025642
gggtagattcga

SEQ ID NO: 160750 - DNA, 18 bp, Unknown
  misc_feature (1)..( 18): Result.004 file - promoters50/1025642
taatgatttagtatagag

SEQ ID NO: 160751 - DNA, 18 bp, Unknown
  misc_feature (1)..( 18): Result.004 file - promoters50/1025642
ttttaagaaagtatataa

SEQ ID NO: 160752 - DNA, 18 bp, Unknown
  misc_feature (1)..( 18): Result.004 file - promoters50/1025642
ttgcatattattattcta

SEQ ID NO: 160753 - DNA, 18 bp, Unknown
  misc_feature (1)..( 18): Result.004 file - promoters50/1025642
ttttaaaaaactatatat

SEQ ID NO: 160754 - DNA, 19 bp, Unknown
  misc_feature (1)..( 19): Result.004 file - promoters50/1025642
ttcgataaaagctaatgtt

SEQ ID NO: 160755 - DNA, 19 bp, Unknown
  misc_feature (1)..( 19): Result.004 file - promoters50/1025642
aaaatccatgcctttaaaa

SEQ ID NO: 160756 - DNA, 18 bp, Unknown
  misc_feature (1)..( 18): Result.004 file - promoters50/1025642
taggaaatattttattca

SEQ ID NO: 160757 - DNA, 18 bp, Unknown
  misc_feature (1)..( 18): Result.004 file - promoters50/1025642
tagaacaccatttattaa

SEQ ID NO: 160758 - DNA, 18 bp, Unknown
  misc_feature (1)..( 18): Result.004 file - promoters50/1025642
gaaatcataattaataaa

SEQ ID NO: 160759 - DNA, 18 bp, Unknown
  misc_feature (1)..( 18): Result.004 file - promoters50/1025642
tactatataatgaatatt

SEQ ID NO: 160760 - DNA, 18 bp, Unknown
  misc_feature (1)..( 18): Result.004 file - promoters50/1025642
gaaaacatacttaatcgg

SEQ ID NO: 160761 - DNA, 18 bp, Unknown
  misc_feature (1)..( 18): Result.004 file - promoters50/1025642
atacatgatttgaataaa

SEQ ID NO: 160762 - DNA, 18 bp, Unknown
  misc_feature (1)..( 18): Result.004 file - promoters50/1025642
atgatgatgatgaatgtg

SEQ ID NO: 160763 - DNA, 11 bp, Unknown
  misc_feature (1)..( 11): Result.004 file - promoters50/1025642
attttgaaaaa

SEQ ID NO: 160764 - DNA, 11 bp, Unknown
  misc_feature (1)..( 11): Result.004 file - promoters50/1025642
tcattgaaatg

SEQ ID NO: 160765 - DNA, 11 bp, Unknown
  misc_feature (1)..( 11): Result.004 file - promoters50/1025642
atttttaaatt

SEQ ID NO: 160766 - DNA, 11 bp, Unknown
  misc_feature (1)..( 11): Result.004 file - promoters50/1025642
attcttataac

SEQ ID NO: 160767 - DNA, 11 bp, Unknown
  misc_feature (1)..( 11): Result.004 file - promoters50/1025642
atcttcaattt

SEQ ID NO: 160768 - DNA, 11 bp, Unknown
  misc_feature (1)..( 11): Result.004 file - promoters50/1025642
atttttggctg

SEQ ID NO: 160769 - DNA, 17 bp, Unknown
  misc_feature (1)..( 17): Result.004 file - promoters50/1025642
atattcagaattaatat

SEQ ID NO: 160770 - DNA, 17 bp, Unknown
  misc_feature (1)..( 17): Result.004 file - promoters50/1025642
gaaatcataattaataa

SEQ ID NO: 160771 - DNA, 17 bp, Unknown
  misc_feature (1)..( 17): Result.004 file - promoters50/1025642
tactatataatgaatat

SEQ ID NO: 160772 - DNA, 17 bp, Unknown
  misc_feature (1)..( 17): Result.004 file - promoters50/1025642
acaccatttattaacat

SEQ ID NO: 160773 - DNA, 17 bp, Unknown
  misc_feature (1)..( 17): Result.004 file - promoters50/1025642
gaaaacatacttaatcg

SEQ ID NO: 160774 - DNA, 17 bp, Unknown
  misc_feature (1)..( 17): Result.004 file - promoters50/1025642
gtatacatgatttgaat

SEQ ID NO: 160775 - DNA, 17 bp, Unknown
  misc_feature (1)..( 17): Result.004 file - promoters50/1025642
atgatgatgatgaatgt

SEQ ID NO: 160776 - DNA, 18 bp, Unknown
  misc_feature (1)..( 18): Result.004 file - promoters50/1025642
tagctaacaaataatttt

SEQ ID NO: 160777 - DNA, 18 bp, Unknown
  misc_feature (1)..( 18): Result.004 file - promoters50/1025642
attttaagaaagtatata

SEQ ID NO: 160778 - DNA, 18 bp, Unknown
  misc_feature (1)..( 18): Result.004 file - promoters50/1025642
tttttaaaaaactatata

SEQ ID NO: 160779 - DNA, 18 bp, Unknown
  misc_feature (1)..( 18): Result.004 file - promoters50/1025642
ttcgataaaagctaatgt

SEQ ID NO: 160780 - DNA, 18 bp, Unknown
  misc_feature (1)..( 18): Result.004 file - promoters50/1025642
tttttatctgagaaattt

SEQ ID NO: 160781 - DNA, 18 bp, Unknown
  misc_feature (1)..( 18): Result.004 file - promoters50/1025683
cctttaaaagattcgact

SEQ ID NO: 160782 - DNA, 9 bp, Unknown
  misc_feature (1)..( 9): Result.004 file - promoters50/1025683
agaaaatta

SEQ ID NO: 160783 - DNA, 9 bp, Unknown
  misc_feature (1)..( 9): Result.004 file - promoters50/1025683
agagaatac

SEQ ID NO: 160784 - DNA, 9 bp, Unknown
  misc_feature (1)..( 9): Result.004 file - promoters50/1025683
agaacattg

SEQ ID NO: 160785 - DNA, 9 bp, Unknown
  misc_feature (1)..( 9): Result.004 file - promoters50/1025683
acaaaaaaa

SEQ ID NO: 160786 - DNA, 9 bp, Unknown
  misc_feature (1)..( 9): Result.004 file - promoters50/1025683
tctacattg

SEQ ID NO: 160787 - DNA, 9 bp, Unknown
  misc_feature (1)..( 9): Result.004 file - promoters50/1025683
tgaacatca

SEQ ID NO: 160788 - DNA, 9 bp, Unknown
  misc_feature (1)..( 9): Result.004 file - promoters50/1025683
cgaacatgg

SEQ ID NO: 160789 - DNA, 11 bp, Unknown
  misc_feature (1)..( 11): Result.004 file - promoters50/1025683
cctatatataa

SEQ ID NO: 160790 - DNA, 11 bp, Unknown
  misc_feature (1)..( 11): Result.004 file - promoters50/1025683
cctttataaaa

SEQ ID NO: 160791 - DNA, 11 bp, Unknown
  misc_feature (1)..( 11): Result.004 file - promoters50/1025683
gttatataaat

SEQ ID NO: 160792 - DNA, 11 bp, Unknown
  misc_feature (1)..( 11): Result.004 file - promoters50/1025683
cttataaataa

SEQ ID NO: 160793 - DNA, 11 bp, Unknown
  misc_feature (1)..( 11): Result.004 file - promoters50/1025683
agtatataaat

SEQ ID NO: 160794 - DNA, 11 bp, Unknown
  misc_feature (1)..( 11): Result.004 file - promoters50/1025683
actataaaact

SEQ ID NO: 160795 - DNA, 12 bp, Unknown
  misc_feature (1)..( 12): Result.004 file - promoters50/1025683
aattttaatatt

SEQ ID NO: 160796 - DNA, 12 bp, Unknown
  misc_feature (1)..( 12): Result.004 file - promoters50/1025683
gattataaatca

SEQ ID NO: 160797 - DNA, 13 bp, Unknown
  misc_feature (1)..( 13): Result.004 file - promoters50/1025683
ctctatgaatcat

SEQ ID NO: 160798 - DNA, 13 bp, Unknown
  misc_feature (1)..( 13): Result.004 file - promoters50/1025683
gattatccctaac

SEQ ID NO: 160799 - DNA, 13 bp, Unknown
  misc_feature (1)..( 13): Result.004 file - promoters50/1025683
tggtaataatgta

SEQ ID NO: 160800 - DNA, 9 bp, Unknown
  misc_feature (1)..( 9): Result.004 file - promoters50/1025729
aataattta

SEQ ID NO: 160801 - DNA, 6 bp, Unknown
  misc_feature (1)..( 6): Result.004 file - promoters50/1025729
tatata

SEQ ID NO: 160802 - DNA, 6 bp, Unknown
  misc_feature (1)..( 6): Result.004 file - promoters50/1025729
tatata

SEQ ID NO: 160803 - DNA, 6 bp, Unknown
  misc_feature (1)..( 6): Result.004 file - promoters50/1025744
tatata

SEQ ID NO: 160804 - DNA, 13 bp, Unknown
  misc_feature (1)..( 13): Result.004 file - promoters50/1025744
acagagaatattc

SEQ ID NO: 160805 - DNA, 13 bp, Unknown
  misc_feature (1)..( 13): Result.004 file - promoters50/1025744
tctttgaatcttc

SEQ ID NO: 160806 - DNA, 13 bp, Unknown
  misc_feature (1)..( 13): Result.004 file - promoters50/1025744
ataagtaattttc

SEQ ID NO: 160807 - DNA, 13 bp, Unknown
  misc_feature (1)..( 13): Result.004 file - promoters50/1025744
ttctccaatcttc

SEQ ID NO: 160808 - DNA, 13 bp, Unknown
  misc_feature (1)..( 13): Result.004 file - promoters50/1025744
cttttgagtataa

SEQ ID NO: 160809 - DNA, 13 bp, Unknown
  misc_feature (1)..( 13): Result.004 file - promoters50/1025744
gttttgaagctta

SEQ ID NO: 160810 - DNA, 13 bp, Unknown
  misc_feature (1)..( 13): Result.004 file - promoters50/1025744
gtttagaacatct

SEQ ID NO: 160811 - DNA, 13 bp, Unknown
  misc_feature (1)..( 13): Result.004 file - promoters50/1025744
aattaaaacataa

SEQ ID NO: 160812 - DNA, 13 bp, Unknown
  misc_feature (1)..( 13): Result.004 file - promoters50/1025744
ttataatacaaac

SEQ ID NO: 160813 - DNA, 13 bp, Unknown
  misc_feature (1)..( 13): Result.004 file - promoters50/1025744
gtttagaacatct

SEQ ID NO: 160814 - DNA, 13 bp, Unknown
  misc_feature (1)..( 13): Result.004 file - promoters50/1025744
aaaaaaaaaataa

SEQ ID NO: 160815 - DNA, 13 bp, Unknown
  misc_feature (1)..( 13): Result.004 file - promoters50/1025744
ttgtgaaaaatcg

SEQ ID NO: 160816 - DNA, 13 bp, Unknown
  misc_feature (1)..( 13): Result.004 file - promoters50/1025791
gttttgaagctta

SEQ ID NO: 160817 - DNA, 13 bp, Unknown
  misc_feature (1)..( 13): Result.004 file - promoters50/1025791
cattagtttcctg

SEQ ID NO: 160818 - DNA, 13 bp, Unknown
  misc_feature (1)..( 13): Result.004 file - promoters50/1025791
cccaagtgtccta

SEQ ID NO: 160819 - DNA, 13 bp, Unknown
  misc_feature (1)..( 13): Result.004 file - promoters50/1025791
cattcgtttagtc

SEQ ID NO: 160820 - DNA, 13 bp, Unknown
  misc_feature (1)..( 13): Result.004 file - promoters50/1025791
aattaatttcttc

SEQ ID NO: 160821 - DNA, 13 bp, Unknown
  misc_feature (1)..( 13): Result.004 file - promoters50/1025791
atttactttggaa

SEQ ID NO: 160822 - DNA, 13 bp, Unknown
  misc_feature (1)..( 13): Result.004 file - promoters50/1025791
ttaatgtttgctt

SEQ ID NO: 160823 - DNA, 19 bp, Unknown
  misc_feature (1)..( 19): Result.004 file - promoters50/1025791
ataattgaagctctccctt

SEQ ID NO: 160824 - DNA, 19 bp, Unknown
  misc_feature (1)..( 19): Result.004 file - promoters50/1025791
gtgctaagagctttccatt

SEQ ID NO: 160825 - DNA, 19 bp, Unknown
  misc_feature (1)..( 19): Result.004 file - promoters50/1025791
tgttaaagagcttattaag

SEQ ID NO: 160826 - DNA, 19 bp, Unknown
  misc_feature (1)..( 19): Result.004 file - promoters50/1025791
agaagaagagcgtttaacc

SEQ ID NO: 160827 - DNA, 19 bp, Unknown
  misc_feature (1)..( 19): Result.004 file - promoters50/1025791
agacgaagagaacctgaga

SEQ ID NO: 160828 - DNA, 19 bp, Unknown
  misc_feature (1)..( 19): Result.004 file - promoters50/1025791
ccaagaagaaaaaaattgt

SEQ ID NO: 160829 - DNA, 19 bp, Unknown
  misc_feature (1)..( 19): Result.004 file - promoters50/1025883
tttacgctcactttctatt

SEQ ID NO: 160830 - DNA, 9 bp, Unknown
  misc_feature (1)..( 9): Result.004 file - promoters50/1025883
ctctctata

SEQ ID NO: 160831 - DNA, 9 bp, Unknown
  misc_feature (1)..( 9): Result.004 file - promoters50/1025883
ctcactaag

SEQ ID NO: 160832 - DNA, 9 bp, Unknown
  misc_feature (1)..( 9): Result.004 file - promoters50/1025883
aacacaaag

SEQ ID NO: 160833 - DNA, 8 bp, Unknown
  misc_feature (1)..( 8): Result.004 file - promoters50/1025883
ccacaagg

SEQ ID NO: 160834 - DNA, 8 bp, Unknown
  misc_feature (1)..( 8): Result.004 file - promoters50/1025883
ccagaagg

SEQ ID NO: 160835 - DNA, 8 bp, Unknown
  misc_feature (1)..( 8): Result.004 file - promoters50/1026000
ccagcagg

SEQ ID NO: 160836 - DNA, 7 bp, Unknown
  misc_feature (1)..( 7): Result.004 file - promoters50/1026000
ttgaaaa

SEQ ID NO: 160837 - DNA, 7 bp, Unknown
  misc_feature (1)..( 7): Result.004 file - promoters50/1026000
ttgaaat

SEQ ID NO: 160838 - DNA, 7 bp, Unknown
  misc_feature (1)..( 7): Result.004 file - promoters50/1026000
tttaaaa

SEQ ID NO: 160839 - DNA, 8 bp, Unknown
  misc_feature (1)..( 8): Result.004 file - promoters50/1026000
tttgaaat

SEQ ID NO: 160840 - DNA, 8 bp, Unknown
  misc_feature (1)..( 8): Result.004 file - promoters50/1026000
tttcaaat

SEQ ID NO: 160841 - DNA, 8 bp, Unknown
  misc_feature (1)..( 8): Result.004 file - promoters50/1026000
actcaaat

SEQ ID NO: 160842 - DNA, 9 bp, Unknown
  misc_feature (1)..( 9): Result.004 file - promoters50/1026000
atggatact

SEQ ID NO: 160843 - DNA, 9 bp, Unknown
  misc_feature (1)..( 9): Result.004 file - promoters50/1026000
atggattag

SEQ ID NO: 160844 - DNA, 9 bp, Unknown
  misc_feature (1)..( 9): Result.004 file - promoters50/1026000
atggttact

SEQ ID NO: 160845 - DNA, 8 bp, Unknown
  misc_feature (1)..( 8): Result.004 file - promoters50/1026000
aaagtagc

SEQ ID NO: 160846 - DNA, 8 bp, Unknown
  misc_feature (1)..( 8): Result.004 file - promoters50/1026000
gaaggagc

SEQ ID NO: 160847 - DNA, 8 bp, Unknown
  misc_feature (1)..( 8): Result.004 file - promoters50/1026000
gaaggaaa

SEQ ID NO: 160848 - DNA, 7 bp, Unknown
  misc_feature (1)..( 7): Result.004 file - promoters50/1026000
caaagag

SEQ ID NO: 160849 - DNA, 7 bp, Unknown
  misc_feature (1)..( 7): Result.004 file - promoters50/1026000
taaagag

SEQ ID NO: 160850 - DNA, 7 bp, Unknown
  misc_feature (1)..( 7): Result.004 file - promoters50/1026014
taaagac

SEQ ID NO: 160851 - DNA, 13 bp, Unknown
  misc_feature (1)..( 13): Result.004 file - promoters50/1026014
cactgattttgga

SEQ ID NO: 160852 - DNA, 13 bp, Unknown
  misc_feature (1)..( 13): Result.004 file - promoters50/1026014
aaaagattttata

SEQ ID NO: 160853 - DNA, 13 bp, Unknown
  misc_feature (1)..( 13): Result.004 file - promoters50/1026014
tactgattttaga

SEQ ID NO: 160854 - DNA, 13 bp, Unknown
  misc_feature (1)..( 13): Result.004 file - promoters50/1026014
taataattatata

SEQ ID NO: 160855 - DNA, 13 bp, Unknown
  misc_feature (1)..( 13): Result.004 file - promoters50/1026014
actttattttata

SEQ ID NO: 160856 - DNA, 13 bp, Unknown
  misc_feature (1)..( 13): Result.004 file - promoters50/1026014
taaaaatttacac

SEQ ID NO: 160857 - DNA, 13 bp, Unknown
  misc_feature (1)..( 13): Result.004 file - promoters50/1026014
taaacattaaatt

SEQ ID NO: 160858 - DNA, 15 bp, Unknown
  misc_feature (1)..( 15): Result.004 file - promoters50/1026014
tagatgtcatattcg

SEQ ID NO: 160859 - DNA, 15 bp, Unknown
  misc_feature (1)..( 15): Result.004 file - promoters50/1026014
tttgtgtcacattcc

SEQ ID NO: 160860 - DNA, 15 bp, Unknown
  misc_feature (1)..( 15): Result.004 file - promoters50/1026014
atcttttcaaattgt

SEQ ID NO: 160861 - DNA, 15 bp, Unknown
  misc_feature (1)..( 15): Result.004 file - promoters50/1026014
ttttgctcagatttc

SEQ ID NO: 160862 - DNA, 15 bp, Unknown
  misc_feature (1)..( 15): Result.004 file - promoters50/1026014
tttatgttacattta

SEQ ID NO: 160863 - DNA, 15 bp, Unknown
  misc_feature (1)..( 15): Result.004 file - promoters50/1026014
gatgaattaaatttg

SEQ ID NO: 160864 - DNA, 15 bp, Unknown
  misc_feature (1)..( 15): Result.004 file - promoters50/1026014
ttacataaaaatttg

SEQ ID NO: 160865 - DNA, 15 bp, Unknown
  misc_feature (1)..( 15): Result.004 file - promoters50/1026014
gtaaaaaaaattcac

SEQ ID NO: 160866 - DNA, 15 bp, Unknown
  misc_feature (1)..( 15): Result.004 file - promoters50/1026014
tcaaaataaacccgt

SEQ ID NO: 160867 - DNA, 15 bp, Unknown
  misc_feature (1)..( 15): Result.004 file - promoters50/1026014
ctaaaaaaacatttt

SEQ ID NO: 160868 - DNA, 15 bp, Unknown
  misc_feature (1)..( 15): Result.004 file - promoters50/1026014
gtaaaataaagtcac

SEQ ID NO: 160869 - DNA, 15 bp, Unknown
  misc_feature (1)..( 15): Result.004 file - promoters50/1026014
ccaaaaaagtaaaaa

SEQ ID NO: 160870 - DNA, 15 bp, Unknown
  misc_feature (1)..( 15): Result.004 file - promoters50/1026014
caaaaagaactaact

SEQ ID NO: 160871 - DNA, 13 bp, Unknown
  misc_feature (1)..( 13): Result.004 file - promoters50/1026014
tttcataaatcca

SEQ ID NO: 160872 - DNA, 13 bp, Unknown
  misc_feature (1)..( 13): Result.004 file - promoters50/1026014
ttttataatataa

SEQ ID NO: 160873 - DNA, 13 bp, Unknown
  misc_feature (1)..( 13): Result.004 file - promoters50/1026014
ttttataggtccc

SEQ ID NO: 160874 - DNA, 13 bp, Unknown
  misc_feature (1)..( 13): Result.004 file - promoters50/1026014
atttctaataatt

SEQ ID NO: 160875 - DNA, 13 bp, Unknown
  misc_feature (1)..( 13): Result.004 file - promoters50/1026014
attcgtaaaaatt

SEQ ID NO: 160876 - DNA, 13 bp, Unknown
  misc_feature (1)..( 13): Result.004 file - promoters50/1026014
tcctttaaacatt

SEQ ID NO: 160877 - DNA, 14 bp, Unknown
  misc_feature (1)..( 14): Result.004 file - promoters50/1026014
acttaaaacttggt

SEQ ID NO: 160878 - DNA, 14 bp, Unknown
  misc_feature (1)..( 14): Result.004 file - promoters50/1026014
tattaaaatatttt

SEQ ID NO: 160879 - DNA, 14 bp, Unknown
  misc_feature (1)..( 14): Result.004 file - promoters50/1026014
ctttataatgaaac

SEQ ID NO: 160880 - DNA, 14 bp, Unknown
  misc_feature (1)..( 14): Result.004 file - promoters50/1026014
ctttttaaatggcg

SEQ ID NO: 160881 - DNA, 15 bp, Unknown
  misc_feature (1)..( 15): Result.004 file - promoters50/1026014
tgactaaaattctct

SEQ ID NO: 160882 - DNA, 15 bp, Unknown
  misc_feature (1)..( 15): Result.004 file - promoters50/1026039
ttttgacaaaatttc

SEQ ID NO: 160883 - DNA, 11 bp, Unknown
  misc_feature (1)..( 11): Result.004 file - promoters50/1026039
actagtataca

SEQ ID NO: 160884 - DNA, 11 bp, Unknown
  misc_feature (1)..( 11): Result.004 file - promoters50/1026039
actagttatga

SEQ ID NO: 160885 - DNA, 11 bp, Unknown
  misc_feature (1)..( 11): Result.004 file - promoters50/1026039
tctattatttt

SEQ ID NO: 160886 - DNA, 11 bp, Unknown
  misc_feature (1)..( 11): Result.004 file - promoters50/1026039
tctattatagt

SEQ ID NO: 160887 - DNA, 11 bp, Unknown
  misc_feature (1)..( 11): Result.004 file - promoters50/1026039
atcattttttt

SEQ ID NO: 160888 - DNA, 9 bp, Unknown
  misc_feature (1)..( 9): Result.004 file - promoters50/1026039
gattatatt

SEQ ID NO: 160889 - DNA, 9 bp, Unknown
  misc_feature (1)..( 9): Result.004 file - promoters50/1026039
cattgtatt

SEQ ID NO: 160890 - DNA, 9 bp, Unknown
  misc_feature (1)..( 9): Result.004 file - promoters50/1026039
tattttgtc

SEQ ID NO: 160891 - DNA, 9 bp, Unknown
  misc_feature (1)..( 9): Result.004 file - promoters50/1026039
atttatata

SEQ ID NO: 160892 - DNA, 9 bp, Unknown
  misc_feature (1)..( 9): Result.004 file - promoters50/1026160
cattacata

SEQ ID NO: 160893 - DNA, 11 bp, Unknown
  misc_feature (1)..( 11): Result.004 file - promoters50/1026160
aagaaacaaag

SEQ ID NO: 160894 - DNA, 11 bp, Unknown
  misc_feature (1)..( 11): Result.004 file - promoters50/1026160
gccaaacaaca

SEQ ID NO: 160895 - DNA, 11 bp, Unknown
  misc_feature (1)..( 11): Result.004 file - promoters50/1026160
aagaaaaaaaa

SEQ ID NO: 160896 - DNA, 11 bp, Unknown
  misc_feature (1)..( 11): Result.004 file - promoters50/1026160
tggtaacaaca

SEQ ID NO: 160897 - DNA, 11 bp, Unknown
  misc_feature (1)..( 11): Result.004 file - promoters50/1026160
tgccaaaaacc

SEQ ID NO: 160898 - DNA, 11 bp, Unknown
  misc_feature (1)..( 11): Result.004 file - promoters50/1026160
atcaaaaaatt

SEQ ID NO: 160899 - DNA, 11 bp, Unknown
  misc_feature (1)..( 11): Result.004 file - promoters50/1026160
tataaaaaatt

SEQ ID NO: 160900 - DNA, 13 bp, Unknown
  misc_feature (1)..( 13): Result.004 file - promoters50/1026160
tataaaaattttt

SEQ ID NO: 160901 - DNA, 13 bp, Unknown
  misc_feature (1)..( 13): Result.004 file - promoters50/1026160
aataaaagtttgt

SEQ ID NO: 160902 - DNA, 13 bp, Unknown
  misc_feature (1)..( 13): Result.004 file - promoters50/1026160
acaaagaattttt

SEQ ID NO: 160903 - DNA, 13 bp, Unknown
  misc_feature (1)..( 13): Result.004 file - promoters50/1026160
aataaaccgaggt

SEQ ID NO: 160904 - DNA, 13 bp, Unknown
  misc_feature (1)..( 13): Result.004 file - promoters50/1026160
cataacagttgta

SEQ ID NO: 160905 - DNA, 13 bp, Unknown
  misc_feature (1)..( 13): Result.004 file - promoters50/1026160
gttcaaactttca

SEQ ID NO: 160906 - DNA, 13 bp, Unknown
  misc_feature (1)..( 13): Result.004 file - promoters50/1026235
ttctgaagtttct

SEQ ID NO: 160907 - DNA, 7 bp, Unknown
  misc_feature (1)..( 7): Result.004 file - promoters50/1026235
ttttaaa

SEQ ID NO: 160908 - DNA, 7 bp, Unknown
  misc_feature (1)..( 7): Result.004 file - promoters50/1026235
tttgaaa

SEQ ID NO: 160909 - DNA, 7 bp, Unknown
  misc_feature (1)..( 7): Result.004 file - promoters50/1026235
ttgtaag

SEQ ID NO: 160910 - DNA, 10 bp, Unknown
  misc_feature (1)..( 10): Result.004 file - promoters50/1026235
tctttcttca

SEQ ID NO: 160911 - DNA, 10 bp, Unknown
  misc_feature (1)..( 10): Result.004 file - promoters50/1026235
aaattcttca

SEQ ID NO: 160912 - DNA, 10 bp, Unknown
  misc_feature (1)..( 10): Result.004 file - promoters50/1026412
aaagtcttgg

SEQ ID NO: 160913 - DNA, 13 bp, Unknown
  misc_feature (1)..( 13): Result.004 file - promoters50/1026412
aaaagaactccta

SEQ ID NO: 160914 - DNA, 13 bp, Unknown
  misc_feature (1)..( 13): Result.004 file - promoters50/1026412
taaataacttcta

SEQ ID NO: 160915 - DNA, 14 bp, Unknown
  misc_feature (1)..( 14): Result.004 file - promoters50/1026412
caaacgaaagacac

SEQ ID NO: 160916 - DNA, 14 bp, Unknown
  misc_feature (1)..( 14): Result.004 file - promoters50/1026412
ccacgaaactacta

SEQ ID NO: 160917 - DNA, 14 bp, Unknown
  misc_feature (1)..( 14): Result.004 file - promoters50/1026412
ataacaaactacag

SEQ ID NO: 160918 - DNA, 14 bp, Unknown
  misc_feature (1)..( 14): Result.004 file - promoters50/1026416
accggtcactacac

SEQ ID NO: 160919 - DNA, 9 bp, Unknown
  misc_feature (1)..( 9): Result.004 file - promoters50/1026416
ttttggttt

SEQ ID NO: 160920 - DNA, 9 bp, Unknown
  misc_feature (1)..( 9): Result.004 file - promoters50/1026416
ttttggaga

SEQ ID NO: 160921 - DNA, 9 bp, Unknown
  misc_feature (1)..( 9): Result.004 file - promoters50/1026416
ttttggtga

SEQ ID NO: 160922 - DNA, 9 bp, Unknown
  misc_feature (1)..( 9): Result.004 file - promoters50/1026416
gtttggttt

SEQ ID NO: 160923 - DNA, 6 bp, Unknown
  misc_feature (1)..( 6): Result.004 file - promoters50/1026416
aaagaa

SEQ ID NO: 160924 - DNA, 6 bp, Unknown
  misc_feature (1)..( 6): Result.004 file - promoters50/1026416
aaagaa

SEQ ID NO: 160925 - DNA, 6 bp, Unknown
  misc_feature (1)..( 6): Result.004 file - promoters50/1026416
aaagaa

SEQ ID NO: 160926 - DNA, 7 bp, Unknown
  misc_feature (1)..( 7): Result.004 file - promoters50/1026416
atttaat

SEQ ID NO: 160927 - DNA, 7 bp, Unknown
  misc_feature (1)..( 7): Result.004 file - promoters50/1026416
atttaaa

SEQ ID NO: 160928 - DNA, 7 bp, Unknown
  misc_feature (1)..( 7): Result.004 file - promoters50/1026416
ttttaaa

SEQ ID NO: 160929 - DNA, 11 bp, Unknown
  misc_feature (1)..( 11): Result.004 file - promoters50/1026416
aaaaagaaaga

SEQ ID NO: 160930 - DNA, 11 bp, Unknown
  misc_feature (1)..( 11): Result.004 file - promoters50/1026416
ggaaataaaga

SEQ ID NO: 160931 - DNA, 11 bp, Unknown
  misc_feature (1)..( 11): Result.004 file - promoters50/1026419
aaaaacaaacg

SEQ ID NO: 160932 - DNA, 10 bp, Unknown
  misc_feature (1)..( 10): Result.004 file - promoters50/1026419
gaaacaagta

SEQ ID NO: 160933 - DNA, 10 bp, Unknown
  misc_feature (1)..( 10): Result.004 file - promoters50/1026419
aaaataagta

SEQ ID NO: 160934 - DNA, 10 bp, Unknown
  misc_feature (1)..( 10): Result.004 file - promoters50/1026419
gaaagaagta

SEQ ID NO: 160935 - DNA, 10 bp, Unknown
  misc_feature (1)..( 10): Result.004 file - promoters50/1026419
gaatcaaagt

SEQ ID NO: 160936 - DNA, 9 bp, Unknown
  misc_feature (1)..( 9): Result.004 file - promoters50/1026419
ttgggtcat

SEQ ID NO: 160937 - DNA, 9 bp, Unknown
  misc_feature (1)..( 9): Result.004 file - promoters50/1026419
ctggttcat

SEQ ID NO: 160938 - DNA, 9 bp, Unknown
  misc_feature (1)..( 9): Result.004 file - promoters50/1026419
ttgggtttc

SEQ ID NO: 160939 - DNA, 9 bp, Unknown
  misc_feature (1)..( 9): Result.004 file - promoters50/1026439
gtgggttcg

SEQ ID NO: 160940 - DNA, 9 bp, Unknown
  misc_feature (1)..( 9): Result.004 file - promoters50/1026439
atatttcag

SEQ ID NO: 160941 - DNA, 9 bp, Unknown
  misc_feature (1)..( 9): Result.004 file - promoters50/1026439
aaattacag

SEQ ID NO: 160942 - DNA, 9 bp, Unknown
  misc_feature (1)..( 9): Result.004 file - promoters50/1026514
aaaatacaa

SEQ ID NO: 160943 - DNA, 8 bp, Unknown
  misc_feature (1)..( 8): Result.004 file - promoters50/1026514
cataaaag

SEQ ID NO: 160944 - DNA, 8 bp, Unknown
  misc_feature (1)..( 8): Result.004 file - promoters50/1026514
catcaaat

SEQ ID NO: 160945 - DNA, 8 bp, Unknown
  misc_feature (1)..( 8): Result.004 file - promoters50/1026514
tttcaaat

SEQ ID NO: 160946 - DNA, 14 bp, Unknown
  misc_feature (1)..( 14): Result.004 file - promoters50/1026514
taagttgaataatt

SEQ ID NO: 160947 - DNA, 14 bp, Unknown
  misc_feature (1)..( 14): Result.004 file - promoters50/1026514
taaattgactgatc

SEQ ID NO: 160948 - DNA, 14 bp, Unknown
  misc_feature (1)..( 14): Result.004 file - promoters50/1026514
aaagttgaagaatt

SEQ ID NO: 160949 - DNA, 14 bp, Unknown
  misc_feature (1)..( 14): Result.004 file - promoters50/1026514
atagttgactttga

SEQ ID NO: 160950 - DNA, 8 bp, Unknown
  misc_feature (1)..( 8): Result.004 file - promoters50/1026514
gattgatg

SEQ ID NO: 160951 - DNA, 8 bp, Unknown
  misc_feature (1)..( 8): Result.004 file - promoters50/1026514
cattcatg

SEQ ID NO: 160952 - DNA, 8 bp, Unknown
  misc_feature (1)..( 8): Result.004 file - promoters50/1026514
cattcatc

SEQ ID NO: 160953 - DNA, 11 bp, Unknown
  misc_feature (1)..( 11): Result.004 file - promoters50/1026514
gtcaaaaataa

SEQ ID NO: 160954 - DNA, 11 bp, Unknown
  misc_feature (1)..( 11): Result.004 file - promoters50/1026514
tacaaaattaa

SEQ ID NO: 160955 - DNA, 11 bp, Unknown
  misc_feature (1)..( 11): Result.004 file - promoters50/1026514
tactaaattga

SEQ ID NO: 160956 - DNA, 10 bp, Unknown
  misc_feature (1)..( 10): Result.004 file - promoters50/1026514
ttttataaaa

SEQ ID NO: 160957 - DNA, 10 bp, Unknown
  misc_feature (1)..( 10): Result.004 file - promoters50/1026514
ttttataaat

SEQ ID NO: 160958 - DNA, 10 bp, Unknown
  misc_feature (1)..( 10): Result.004 file - promoters50/1026514
aattaaaaat

SEQ ID NO: 160959 - DNA, 8 bp, Unknown
  misc_feature (1)..( 8): Result.004 file - promoters50/1026514
attgataa

SEQ ID NO: 160960 - DNA, 8 bp, Unknown
  misc_feature (1)..( 8): Result.004 file - promoters50/1026514
attgctaa

SEQ ID NO: 160961 - DNA, 8 bp, Unknown
  misc_feature (1)..( 8): Result.004 file - promoters50/1026514
catgataa

SEQ ID NO: 160962 - DNA, 9 bp, Unknown
  misc_feature (1)..( 9): Result.004 file - promoters50/1026514
aaaaaccca

SEQ ID NO: 160963 - DNA, 9 bp, Unknown
  misc_feature (1)..( 9): Result.004 file - promoters50/1026514
taaaaccca

SEQ ID NO: 160964 - DNA, 9 bp, Unknown
  misc_feature (1)..( 9): Result.004 file - promoters50/1026514
acaaagcca

SEQ ID NO: 160965 - DNA, 9 bp, Unknown
  misc_feature (1)..( 9): Result.004 file - promoters50/1026514
taacaccaa

SEQ ID NO: 160966 - DNA, 7 bp, Unknown
  misc_feature (1)..( 7): Result.004 file - promoters50/1026514
aaccaaa

SEQ ID NO: 160967 - DNA, 7 bp, Unknown
  misc_feature (1)..( 7): Result.004 file - promoters50/1026514
caccaaa

SEQ ID NO: 160968 - DNA, 7 bp, Unknown
  misc_feature (1)..( 7): Result.004 file - promoters50/1026540
caccaac

SEQ ID NO: 160969 - DNA, 9 bp, Unknown
  misc_feature (1)..( 9): Result.004 file - promoters50/1026540
cctctgtaa

SEQ ID NO: 160970 - DNA, 9 bp, Unknown
  misc_feature (1)..( 9): Result.004 file - promoters50/1026540
aatctttaa

SEQ ID NO: 160971 - DNA, 9 bp, Unknown
  misc_feature (1)..( 9): Result.004 file - promoters50/1026540
aatattttt

SEQ ID NO: 160972 - DNA, 10 bp, Unknown
  misc_feature (1)..( 10): Result.004 file - promoters50/1026540
aggaaacaga

SEQ ID NO: 160973 - DNA, 10 bp, Unknown
  misc_feature (1)..( 10): Result.004 file - promoters50/1026540
ttaaaataga

SEQ ID NO: 160974 - DNA, 10 bp, Unknown
  misc_feature (1)..( 10): Result.004 file - promoters50/1026544
ttataatatt

SEQ ID NO: 160975 - DNA, 10 bp, Unknown
  misc_feature (1)..( 10): Result.004 file - promoters50/1026544
gagatttttt

SEQ ID NO: 160976 - DNA, 10 bp, Unknown
  misc_feature (1)..( 10): Result.004 file - promoters50/1026544
tttttttttt

SEQ ID NO: 160977 - DNA, 10 bp, Unknown
  misc_feature (1)..( 10): Result.004 file - promoters50/1026544
gatatttttc

SEQ ID NO: 160978 - DNA, 11 bp, Unknown
  misc_feature (1)..( 11): Result.004 file - promoters50/1026544
aaaaattagta

SEQ ID NO: 160979 - DNA, 11 bp, Unknown
  misc_feature (1)..( 11): Result.004 file - promoters50/1026544
aaaaataagag

SEQ ID NO: 160980 - DNA, 11 bp, Unknown
  misc_feature (1)..( 11): Result.004 file - promoters50/1026544
caaaataataa

SEQ ID NO: 160981 - DNA, 9 bp, Unknown
  misc_feature (1)..( 9): Result.004 file - promoters50/1026544
aaagagaat

SEQ ID NO: 160982 - DNA, 9 bp, Unknown
  misc_feature (1)..( 9): Result.004 file - promoters50/1026544
atagaaaat

SEQ ID NO: 160983 - DNA, 9 bp, Unknown
  misc_feature (1)..( 9): Result.004 file - promoters50/1026544
atacaaagg

SEQ ID NO: 160984 - DNA, 8 bp, Unknown
  misc_feature (1)..( 8): Result.004 file - promoters50/1026544
ggcccatt

SEQ ID NO: 160985 - DNA, 8 bp, Unknown
  misc_feature (1)..( 8): Result.004 file - promoters50/1026544
ggcccaat

SEQ ID NO: 160986 - DNA, 8 bp, Unknown
  misc_feature (1)..( 8): Result.004 file - promoters50/1026544
agcccaat

SEQ ID NO: 160987 - DNA, 10 bp, Unknown
  misc_feature (1)..( 10): Result.004 file - promoters50/1026544
aacataatcc

SEQ ID NO: 160988 - DNA, 10 bp, Unknown
  misc_feature (1)..( 10): Result.004 file - promoters50/1026544
tacaaaataa

SEQ ID NO: 160989 - DNA, 10 bp, Unknown
  misc_feature (1)..( 10): Result.004 file - promoters50/1026551
aaaaaaataa

SEQ ID NO: 160990 - DNA, 10 bp, Unknown
  misc_feature (1)..( 10): Result.004 file - promoters50/1026551
ttaatttata

SEQ ID NO: 160991 - DNA, 10 bp, Unknown
  misc_feature (1)..( 10): Result.004 file - promoters50/1026551
tcaatatata

SEQ ID NO: 160992 - DNA, 10 bp, Unknown
  misc_feature (1)..( 10): Result.004 file - promoters50/1026551
ttagtttgaa

SEQ ID NO: 160993 - DNA, 10 bp, Unknown
  misc_feature (1)..( 10): Result.004 file - promoters50/1026551
ttaagttaag

SEQ ID NO: 160994 - DNA, 10 bp, Unknown
  misc_feature (1)..( 10): Result.004 file - promoters50/1026551
aagatatatc

SEQ ID NO: 160995 - DNA, 11 bp, Unknown
  misc_feature (1)..( 11): Result.004 file - promoters50/1026551
aagtataactt

SEQ ID NO: 160996 - DNA, 11 bp, Unknown
  misc_feature (1)..( 11): Result.004 file - promoters50/1026551
gcatatacctt

SEQ ID NO: 160997 - DNA, 11 bp, Unknown
  misc_feature (1)..( 11): Result.004 file - promoters50/1026551
aagtttaaaat

SEQ ID NO: 160998 - DNA, 11 bp, Unknown
  misc_feature (1)..( 11): Result.004 file - promoters50/1026551
tggtttaaaaa

SEQ ID NO: 160999 - DNA, 17 bp, Unknown
  misc_feature (1)..( 17): Result.004 file - promoters50/1026551
taaaggatgatggacca

SEQ ID NO: 161000 - DNA, 17 bp, Unknown
  misc_feature (1)..( 17): Result.004 file - promoters50/1026551
agaaggatgatggacca

SEQ ID NO: 161001 - DNA, 17 bp, Unknown
  misc_feature (1)..( 17): Result.004 file - promoters50/1026551
taaaggatgctgtgcca

SEQ ID NO: 161002 - DNA, 17 bp, Unknown
  misc_feature (1)..( 17): Result.004 file - promoters50/1026551
taaaagattagataatt

SEQ ID NO: 161003 - DNA, 21 bp, Unknown
  misc_feature (1)..( 21): Result.004 file - promoters50/1026551
tacacattaataacgtggtcg

SEQ ID NO: 161004 - DNA, 21 bp, Unknown
  misc_feature (1)..( 21): Result.004 file - promoters50/1026551
tacacattaataacgtggtcc

SEQ ID NO: 161005 - DNA, 21 bp, Unknown
  misc_feature (1)..( 21): Result.004 file - promoters50/1026551
cccacgtaaataacgtggtcc

SEQ ID NO: 161006 - DNA, 21 bp, Unknown
  misc_feature (1)..( 21): Result.004 file - promoters50/1026551
acaattcaaataattctacgg

SEQ ID NO: 161007 - DNA, 41 bp, Unknown; identical to SEQ ID NO: 100566
  misc_feature (1)..( 41): Result.004 file - promoters50/1026551

SEQ ID NO: 161008 - DNA, 41 bp, Unknown; identical to SEQ ID NO: 100565
  misc_feature (1)..( 41): Result.004 file - promoters50/1026551

SEQ ID NO: 161009 - DNA, 41 bp, Unknown; identical to SEQ ID NO: 100567
  misc_feature (1)..( 41): Result.004 file - promoters50/1026551

SEQ ID NO: 161010 - DNA, 41 bp, Unknown; identical to SEQ ID NO: 100568
  misc_feature (1)..( 41): Result.004 file - promoters50/1026551

SEQ ID NO: 161011 - DNA, 8 bp, Unknown
  misc_feature (1)..( 8): Result.004 file - promoters50/1026551
attatata

SEQ ID NO: 161012 - DNA, 8 bp, Unknown
  misc_feature (1)..( 8): Result.004 file - promoters50/1026551
attttata

SEQ ID NO: 161013 - DNA, 8 bp, Unknown
  misc_feature (1)..( 8): Result.004 file - promoters50/1026551
attttacg

SEQ ID NO: 161014 - DNA, 9 bp, Unknown
  misc_feature (1)..( 9): Result.004 file - promoters50/1026562
attgtttta

SEQ ID NO: 161015 - DNA, 8 bp, Unknown
  misc_feature (1)..( 8): Result.004 file - promoters50/1026562
aaaatcta

SEQ ID NO: 161016 - DNA, 8 bp, Unknown
  misc_feature (1)..( 8): Result.004 file - promoters50/1026562
aaagtctt

SEQ ID NO: 161017 - DNA, 8 bp, Unknown
  misc_feature (1)..( 8): Result.004 file - promoters50/1026562
gaagcctt

SEQ ID NO: 161018 - DNA, 10 bp, Unknown
  misc_feature (1)..( 10): Result.004 file - promoters50/1026562
aattaatatt

SEQ ID NO: 161019 - DNA, 10 bp, Unknown
  misc_feature (1)..( 10): Result.004 file - promoters50/1026562
aatcaattgc

SEQ ID NO: 161020 - DNA, 10 bp, Unknown
  misc_feature (1)..( 10): Result.004 file - promoters50/1026562
gatcaagtgc

SEQ ID NO: 161021 - DNA, 8 bp, Unknown
  misc_feature (1)..( 8): Result.004 file - promoters50/1026562
ttttgtat

SEQ ID NO: 161022 - DNA, 8 bp, Unknown
  misc_feature (1)..( 8): Result.004 file - promoters50/1026562
tttcgtat

SEQ ID NO: 161023 - DNA, 8 bp, Unknown
  misc_feature (1)..( 8): Result.004 file - promoters50/1026562
tttggtag

SEQ ID NO: 161024 - DNA, 8 bp, Unknown
  misc_feature (1)..( 8): Result.004 file - promoters50/1026562
tcaaatgg

SEQ ID NO: 161025 - DNA, 8 bp, Unknown
  misc_feature (1)..( 8): Result.004 file - promoters50/1026562
acaaatgg

SEQ ID NO: 161026 - DNA, 8 bp, Unknown
  misc_feature (1)..( 8): Result.004 file - promoters50/1026562
acaaatct

SEQ ID NO: 161027 - DNA, 8 bp, Unknown
  misc_feature (1)..( 8): Result.004 file - promoters50/1026562
aatattca

SEQ ID NO: 161028 - DNA, 8 bp, Unknown
  misc_feature (1)..( 8): Result.004 file - promoters50/1026562
aatattag

SEQ ID NO: 161029 - DNA, 8 bp, Unknown
  misc_feature (1)..( 8): Result.004 file - promoters50/1026562
tatactag

SEQ ID NO: 161030 - DNA, 7 bp, Unknown
  misc_feature (1)..( 7): Result.004 file - promoters50/1026562
aatttaa

SEQ ID NO: 161031 - DNA, 7 bp, Unknown
  misc_feature (1)..( 7): Result.004 file - promoters50/1026562
aatataa

SEQ ID NO: 161032 - DNA, 7 bp, Unknown
  misc_feature (1)..( 7): Result.004 file - promoters50/1026562
catataa

SEQ ID NO: 161033 - DNA, 8 bp, Unknown
  misc_feature (1)..( 8): Result.004 file - promoters50/1026562
ttcgattc

SEQ ID NO: 161034 - DNA, 8 bp, Unknown
  misc_feature (1)..( 8): Result.004 file - promoters50/1026562
ttccattc

SEQ ID NO: 161035 - DNA, 8 bp, Unknown
  misc_feature (1)..( 8): Result.004 file - promoters50/1026565
ttccatgt

SEQ ID NO: 161036 - DNA, 8 bp, Unknown
  misc_feature (1)..( 8): Result.004 file - promoters50/1026565
tgatgaag

SEQ ID NO: 161037 - DNA, 8 bp, Unknown
  misc_feature (1)..( 8): Result.004 file - promoters50/1026565
tgaagaaa

SEQ ID NO: 161038 - DNA, 8 bp, Unknown
  misc_feature (1)..( 8): Result.004 file - promoters50/1026565
aaaagaaa

SEQ ID NO: 161039 - DNA, 8 bp, Unknown
  misc_feature (1)..( 8): Result.004 file - promoters50/1026565
agagatga

SEQ ID NO: 161040 - DNA, 8 bp, Unknown
  misc_feature (1)..( 8): Result.004 file - promoters50/1026565
agacatga

SEQ ID NO: 161041 - DNA, 8 bp, Unknown
  misc_feature (1)..( 8): Result.004 file - promoters50/1026565
gcacatga

SEQ ID NO: 161042 - DNA, 9 bp, Unknown
  misc_feature (1)..( 9): Result.004 file - promoters50/1026565
caaacaaaa

SEQ ID NO: 161043 - DNA, 9 bp, Unknown
  misc_feature (1)..( 9): Result.004 file - promoters50/1026565
cttacaaaa

SEQ ID NO: 161044 - DNA, 9 bp, Unknown
  misc_feature (1)..( 9): Result.004 file - promoters50/1026574
caaacaaac

SEQ ID NO: 161045 - DNA, 8 bp, Unknown
  misc_feature (1)..( 8): Result.004 file - promoters50/1026574
attttttt

SEQ ID NO: 161046 - DNA, 8 bp, Unknown
  misc_feature (1)..( 8): Result.004 file - promoters50/1026574
gttttttg

SEQ ID NO: 161047 - DNA, 8 bp, Unknown
  misc_feature (1)..( 8): Result.004 file - promoters50/1026574
attttttt

SEQ ID NO: 161048 - DNA, 7 bp, Unknown
  misc_feature (1)..( 7): Result.004 file - promoters50/1026574
gaataaa

SEQ ID NO: 161049 - DNA, 7 bp, Unknown
  misc_feature (1)..( 7): Result.004 file - promoters50/1026574
gaaaaaa

SEQ ID NO: 161050 - DNA, 7 bp, Unknown
  misc_feature (1)..( 7): Result.004 file - promoters50/1026574
gaaaaaa

SEQ ID NO: 161051 - DNA, 10 bp, Unknown
  misc_feature (1)..( 10): Result.004 file - promoters50/1026574
acatttatag

SEQ ID NO: 161052 - DNA, 10 bp, Unknown
  misc_feature (1)..( 10): Result.004 file - promoters50/1026574
tactttgtag

SEQ ID NO: 161053 - DNA, 10 bp, Unknown
  misc_feature (1)..( 10): Result.004 file - promoters50/1026574
acatttataa

SEQ ID NO: 161054 - DNA, 9 bp, Unknown
  misc_feature (1)..( 9): Result.004 file - promoters50/1026574
tatacgttt

SEQ ID NO: 161055 - DNA, 9 bp, Unknown
  misc_feature (1)..( 9): Result.004 file - promoters50/1026574
tattcgtcg

SEQ ID NO: 161056 - DNA, 9 bp, Unknown
  misc_feature (1)..( 9): Result.004 file - promoters50/1026574
gttacattt

SEQ ID NO: 161057 - DNA, 8 bp, Unknown
  misc_feature (1)..( 8): Result.004 file - promoters50/1026574
tggatttt

SEQ ID NO: 161058 - DNA, 8 bp, Unknown
  misc_feature (1)..( 8): Result.004 file - promoters50/1026574
gggacttt

SEQ ID NO: 161059 - DNA, 8 bp, Unknown
  misc_feature (1)..( 8): Result.004 file - promoters50/1026574
tggatttc

SEQ ID NO: 161060 - DNA, 8 bp, Unknown
  misc_feature (1)..( 8): Result.004 file - promoters50/1026578
tggttttt

SEQ ID NO: 161061 - DNA, 8 bp, Unknown
  misc_feature (1)..( 8): Result.004 file - promoters50/1026578
taaaagta

SEQ ID NO: 161062 - DNA, 8 bp, Unknown
  misc_feature (1)..( 8): Result.004 file - promoters50/1026578
taaaagat

SEQ ID NO: 161063 - DNA, 8 bp, Unknown
  misc_feature (1)..( 8): Result.004 file - promoters50/1026578
aaaaagat

SEQ ID NO: 161064 - DNA, 8 bp, Unknown
  misc_feature (1)..( 8): Result.004 file - promoters50/1026618
taagagag

SEQ ID NO: 161065 - DNA, 10 bp, Unknown
  misc_feature (1)..( 10): Result.004 file - promoters50/1026618
taataagtat

SEQ ID NO: 161066 - DNA, 10 bp, Unknown
  misc_feature (1)..( 10): Result.004 file - promoters50/1026618
gaattagtat

SEQ ID NO: 161067 - DNA, 10 bp, Unknown
  misc_feature (1)..( 10): Result.004 file - promoters50/1026618
aaataattat

SEQ ID NO: 161068 - DNA, 10 bp, Unknown
  misc_feature (1)..( 10): Result.004 file - promoters50/1026618
aaaaaaatgg

SEQ ID NO: 161069 - DNA, 10 bp, Unknown
  misc_feature (1)..( 10): Result.004 file - promoters50/1026618
aaaaaaatca

SEQ ID NO: 161070 - DNA, 10 bp, Unknown
  misc_feature (1)..( 10): Result.004 file - promoters50/1026618
tcattatttg

SEQ ID NO: 161071 - DNA, 15 bp, Unknown
  misc_feature (1)..( 15): Result.004 file - promoters50/1026618
acgattataaacaca

SEQ ID NO: 161072 - DNA, 15 bp, Unknown
  misc_feature (1)..( 15): Result.004 file - promoters50/1026618
aaatttaaaaagcac

SEQ ID NO: 161073 - DNA, 15 bp, Unknown
  misc_feature (1)..( 15): Result.004 file - promoters50/1026618
ctacatataaatgaa

SEQ ID NO: 161074 - DNA, 15 bp, Unknown
  misc_feature (1)..( 15): Result.004 file - promoters50/1026618
aattttatatatgtc

SEQ ID NO: 161075 - DNA, 15 bp, Unknown
  misc_feature (1)..( 15): Result.004 file - promoters50/1026618
atttagataaatttg

SEQ ID NO: 161076 - DNA, 15 bp, Unknown
  misc_feature (1)..( 15): Result.004 file - promoters50/1026618
gagatcctaaacagc

SEQ ID NO: 161077 - DNA, 15 bp, Unknown
  misc_feature (1)..( 15): Result.004 file - promoters50/1026667
aaacttaaaagtaaa

SEQ ID NO: 161078 - DNA, 8 bp, Unknown
  misc_feature (1)..( 8): Result.004 file - promoters50/1026667
atatttta

SEQ ID NO: 161079 - DNA, 8 bp, Unknown
  misc_feature (1)..( 8): Result.004 file - promoters50/1026667
atagttta

SEQ ID NO: 161080 - DNA, 8 bp, Unknown
  misc_feature (1)..( 8): Result.004 file - promoters50/1026667
ttattttg

SEQ ID NO: 161081 - DNA, 9 bp, Unknown
  misc_feature (1)..( 9): Result.004 file - promoters50/1026667
ctttatgga

SEQ ID NO: 161082 - DNA, 9 bp, Unknown
  misc_feature (1)..( 9): Result.004 file - promoters50/1026667
gcttatgga

SEQ ID NO: 161083 - DNA, 9 bp, Unknown
  misc_feature (1)..( 9): Result.004 file - promoters50/1026705
gctgatgat

SEQ ID NO: 161084 - DNA, 12 bp, Unknown
  misc_feature (1)..( 12): Result.004 file - promoters50/1026705
aatttcatttga

SEQ ID NO: 161085 - DNA, 12 bp, Unknown
  misc_feature (1)..( 12): Result.004 file - promoters50/1026705
aatttcaataac

SEQ ID NO: 161086 - DNA, 12 bp, Unknown
  misc_feature (1)..( 12): Result.004 file - promoters50/1026705
tattttattgtt

SEQ ID NO: 161087 - DNA, 12 bp, Unknown
  misc_feature (1)..( 12): Result.004 file - promoters50/1026705
cattttagatga

SEQ ID NO: 161088 - DNA, 12 bp, Unknown
  misc_feature (1)..( 12): Result.004 file - promoters50/1026705
tttttctttttt

SEQ ID NO: 161089 - DNA, 12 bp, Unknown
  misc_feature (1)..( 12): Result.004 file - promoters50/1026705
tatttttgatca

SEQ ID NO: 161090 - DNA, 13 bp, Unknown
  misc_feature (1)..( 13): Result.004 file - promoters50/1026705
atttcatttgaac

SEQ ID NO: 161091 - DNA, 13 bp, Unknown
  misc_feature (1)..( 13): Result.004 file - promoters50/1026705
tgatcatttgtgg

SEQ ID NO: 161092 - DNA, 13 bp, Unknown
  misc_feature (1)..( 13): Result.004 file - promoters50/1026705
attctattttatt

SEQ ID NO: 161093 - DNA, 13 bp, Unknown
  misc_feature (1)..( 13): Result.004 file - promoters50/1026705
tgaccattttaga

SEQ ID NO: 161094 - DNA, 13 bp, Unknown
  misc_feature (1)..( 13): Result.004 file - promoters50/1026705
ccgctatttgtaa

SEQ ID NO: 161095 - DNA, 13 bp, Unknown
  misc_feature (1)..( 13): Result.004 file - promoters50/1026742
ttttcttttttga

SEQ ID NO: 161096 - DNA, 10 bp, Unknown
  misc_feature (1)..( 10): Result.004 file - promoters50/1026742
cccttactgt

SEQ ID NO: 161097 - DNA, 10 bp, Unknown
  misc_feature (1)..( 10): Result.004 file - promoters50/1026742
ctcttgctga

SEQ ID NO: 161098 - DNA, 10 bp, Unknown
  misc_feature (1)..( 10): Result.004 file - promoters50/1026742
agtttattgt

SEQ ID NO: 161099 - DNA, 10 bp, Unknown
  misc_feature (1)..( 10): Result.004 file - promoters50/1026742
ctctttctgg

SEQ ID NO: 161100 - DNA, 10 bp, Unknown
  misc_feature (1)..( 10): Result.004 file - promoters50/1026822
tctttatttc

SEQ ID NO: 161101 - DNA, 10 bp, Unknown
  misc_feature (1)..( 10): Result.004 file - promoters50/1026822
acaaaatagg

SEQ ID NO: 161102 - DNA, 10 bp, Unknown
  misc_feature (1)..( 10): Result.004 file - promoters50/1026822
acacaatctt

SEQ ID NO: 161103 - DNA, 10 bp, Unknown
  misc_feature (1)..( 10): Result.004 file - promoters50/1026822
tataaattag

SEQ ID NO: 161104 - DNA, 8 bp, Unknown
  misc_feature (1)..( 8): Result.004 file - promoters50/1026822
aaattcat

SEQ ID NO: 161105 - DNA, 8 bp, Unknown
  misc_feature (1)..( 8): Result.004 file - promoters50/1026822
taatacat

SEQ ID NO: 161106 - DNA, 8 bp, Unknown
  misc_feature (1)..( 8): Result.004 file - promoters50/1026861
taaaacag

SEQ ID NO: 161107 - DNA, 10 bp, Unknown
  misc_feature (1)..( 10): Result.004 file - promoters50/1026861
catcataaaa

SEQ ID NO: 161108 - DNA, 10 bp, Unknown
  misc_feature (1)..( 10): Result.004 file - promoters50/1026861
agttataaaa

SEQ ID NO: 161109 - DNA, 10 bp, Unknown
  misc_feature (1)..( 10): Result.004 file - promoters50/1026861
ccatataaaa

SEQ ID NO: 161110 - DNA, 10 bp, Unknown
  misc_feature (1)..( 10): Result.004 file - promoters50/1026861
atatataaag

SEQ ID NO: 161111 - DNA, 10 bp, Unknown
  misc_feature (1)..( 10): Result.004 file - promoters50/1026861
ctatataagc

SEQ ID NO: 161112 - DNA, 10 bp, Unknown
  misc_feature (1)..( 10): Result.004 file - promoters50/1026861
ttatatagat

SEQ ID NO: 161113 - DNA, 10 bp, Unknown
  misc_feature (1)..( 10): Result.004 file - promoters50/1026880
ttaaatagat

SEQ ID NO: 161114 - DNA, 9 bp, Unknown
  misc_feature (1)..( 9): Result.004 file - promoters50/1026880
ttttgatta

SEQ ID NO: 161115 - DNA, 9 bp, Unknown
  misc_feature (1)..( 9): Result.004 file - promoters50/1026880
cgttgattg

SEQ ID NO: 161116 - DNA, 9 bp, Unknown
  misc_feature (1)..( 9): Result.004 file - promoters50/1026931
ttttgttta

SEQ ID NO: 161117 - DNA, 11 bp, Unknown
  misc_feature (1)..( 11): Result.004 file - promoters50/1026931
ttacaaaaaaa

SEQ ID NO: 161118 - DNA, 11 bp, Unknown
  misc_feature (1)..( 11): Result.004 file - promoters50/1026931
ttataaagaaa

SEQ ID NO: 161119 - DNA, 11 bp, Unknown
  misc_feature (1)..( 11): Result.004 file - promoters50/1026931
gcttcaagaaa

SEQ ID NO: 161120 - DNA, 7 bp, Unknown
  misc_feature (1)..( 7): Result.004 file - promoters50/1026931
tatattt

SEQ ID NO: 161121 - DNA, 7 bp, Unknown
  misc_feature (1)..( 7): Result.004 file - promoters50/1026931
tatattt

SEQ ID NO: 161122 - DNA, 7 bp, Unknown
  misc_feature (1)..( 7): Result.004 file - promoters50/1026976
tatattt

SEQ ID NO: 161123 - DNA, 14 bp, Unknown
  misc_feature (1)..( 14): Result.004 file - promoters50/1026976
gttgaatgtaatct

SEQ ID NO: 161124 - DNA, 14 bp, Unknown
  misc_feature (1)..( 14): Result.004 file - promoters50/1026976
cttgaatcaatatt

SEQ ID NO: 161125 - DNA, 14 bp, Unknown
  misc_feature (1)..( 14): Result.004 file - promoters50/1026976
attgattcaaaatt

SEQ ID NO: 161126 - DNA, 14 bp, Unknown
  misc_feature (1)..( 14): Result.004 file - promoters50/1026976
cttaaatgcttttc

SEQ ID NO: 161127 - DNA, 14 bp, Unknown
  misc_feature (1)..( 14): Result.004 file - promoters50/1026976
taaaaattgtggag

SEQ ID NO: 161128 - DNA, 14 bp, Unknown
  misc_feature (1)..( 14): Result.004 file - promoters50/1026976
ttaaaatctacgca

SEQ ID NO: 161129 - DNA, 14 bp, Unknown
  misc_feature (1)..( 14): Result.004 file - promoters50/1026976
gtataatttactta

SEQ ID NO: 161130 - DNA, 13 bp, Unknown
  misc_feature (1)..( 13): Result.004 file - promoters50/1026976
ttctcttctctct

SEQ ID NO: 161131 - DNA, 13 bp, Unknown
  misc_feature (1)..( 13): Result.004 file - promoters50/1026976
ttcttttctattg

SEQ ID NO: 161132 - DNA, 13 bp, Unknown
  misc_feature (1)..( 13): Result.004 file - promoters50/1026976
tttttttctaaaa

SEQ ID NO: 161133 - DNA, 14 bp, Unknown
  misc_feature (1)..( 14): Result.004 file - promoters50/1026976
caattttgctaaaa

SEQ ID NO: 161134 - DNA, 14 bp, Unknown
  misc_feature (1)..( 14): Result.004 file - promoters50/1026976
tgaatctgctaatg

SEQ ID NO: 161135 - DNA, 14 bp, Unknown
  misc_feature (1)..( 14): Result.004 file - promoters50/1026976
cgaatcagctaaac

SEQ ID NO: 161136 - DNA, 14 bp, Unknown
  misc_feature (1)..( 14): Result.004 file - promoters50/1026976
agaaccagattaaa

SEQ ID NO: 161137 - DNA, 14 bp, Unknown
  misc_feature (1)..( 14): Result.004 file - promoters50/1026987
taatttatttaata

SEQ ID NO: 161138 - DNA, 11 bp, Unknown
  misc_feature (1)..( 11): Result.004 file - promoters50/1026987
tatttaaaaag

SEQ ID NO: 161139 - DNA, 11 bp, Unknown
  misc_feature (1)..( 11): Result.004 file - promoters50/1026987
tatgtaaacgt

SEQ ID NO: 161140 - DNA, 12 bp, Unknown
  misc_feature (1)..( 12): Result.004 file - promoters50/1026987
attttagaaaga

SEQ ID NO: 161141 - DNA, 12 bp, Unknown
  misc_feature (1)..( 12): Result.004 file - promoters50/1026987
tatctaagacct

SEQ ID NO: 161142 - DNA, 12 bp, Unknown
  misc_feature (1)..( 12): Result.004 file - promoters50/1026987
gcattaaaatat

SEQ ID NO: 161143 - DNA, 12 bp, Unknown
  misc_feature (1)..( 12): Result.004 file - promoters50/1026987
ttttttttttag

SEQ ID NO: 161144 - DNA, 12 bp, Unknown
  misc_feature (1)..( 12): Result.004 file - promoters50/1026987
ctagtaaacata

SEQ ID NO: 161145 - DNA, 10 bp, Unknown
  misc_feature (1)..( 10): Result.004 file - promoters50/1026987
ttttagggtt

SEQ ID NO: 161146 - DNA, 9 bp, Unknown
  misc_feature (1)..( 9): Result.004 file - promoters50/1026987
tatttaaac

SEQ ID NO: 161147 - DNA, 9 bp, Unknown
  misc_feature (1)..( 9): Result.004 file - promoters50/1026987
tatataaac

SEQ ID NO: 161148 - DNA, 9 bp, Unknown
  misc_feature (1)..( 9): Result.004 file - promoters50/1026987
tatataaat

SEQ ID NO: 161149 - DNA, 9 bp, Unknown
  misc_feature (1)..( 9): Result.004 file - promoters50/1026987
tatataagc

SEQ ID NO: 161150 - DNA, 9 bp, Unknown
  misc_feature (1)..( 9): Result.004 file - promoters50/1026987
tctataaaa

SEQ ID NO: 161151 - DNA, 9 bp, Unknown
  misc_feature (1)..( 9): Result.004 file - promoters50/1026987
cctataaac

SEQ ID NO: 161152 - DNA, 10 bp, Unknown
  misc_feature (1)..( 10): Result.004 file - promoters50/1026987
cgattttctt

SEQ ID NO: 161153 - DNA, 10 bp, Unknown
  misc_feature (1)..( 10): Result.004 file - promoters50/1026987
attttttctt

SEQ ID NO: 161154 - DNA, 10 bp, Unknown
  misc_feature (1)..( 10): Result.004 file - promoters50/1026987
taattgtctc

SEQ ID NO: 161155 - DNA, 10 bp, Unknown
  misc_feature (1)..( 10): Result.004 file - promoters50/1026987
acggtttctt

SEQ ID NO: 161156 - DNA, 10 bp, Unknown
  misc_feature (1)..( 10): Result.004 file - promoters50/1026987
taattttttc

SEQ ID NO: 161157 - DNA, 10 bp, Unknown
  misc_feature (1)..( 10): Result.004 file - promoters50/1026991
ttggtttcta

SEQ ID NO: 161158 - DNA, 8 bp, Unknown
  misc_feature (1)..( 8): Result.004 file - promoters50/1026991
cataaaaa

SEQ ID NO: 161159 - DNA, 8 bp, Unknown
  misc_feature (1)..( 8): Result.004 file - promoters50/1026991
tataaaaa

SEQ ID NO: 161160 - DNA, 8 bp, Unknown
  misc_feature (1)..( 8): Result.004 file - promoters50/1026991
cattaaat

SEQ ID NO: 161161 - DNA, 9 bp, Unknown
  misc_feature (1)..( 9): Result.004 file - promoters50/1026991
aaaactggt

SEQ ID NO: 161162 - DNA, 9 bp, Unknown
  misc_feature (1)..( 9): Result.004 file - promoters50/1026991
aaaattggt

SEQ ID NO: 161163 - DNA, 10 bp, Unknown
  misc_feature (1)..( 10): Result.004 file - promoters50/1026991
aaacattaaa

SEQ ID NO: 161164 - DNA, 7 bp, Unknown
  misc_feature (1)..( 7): Result.004 file - promoters50/1026991
taaattt

SEQ ID NO: 161165 - DNA, 7 bp, Unknown
  misc_feature (1)..( 7): Result.004 file - promoters50/1026991
taaattg

SEQ ID NO: 161166 - DNA, 7 bp, Unknown
  misc_feature (1)..( 7): Result.004 file - promoters50/1027032
aaaattg

SEQ ID NO: 161167 - DNA, 12 bp, Unknown
  misc_feature (1)..( 12): Result.004 file - promoters50/1027032
ttttaattatat

SEQ ID NO: 161168 - DNA, 12 bp, Unknown
  misc_feature (1)..( 12): Result.004 file - promoters50/1027032
atttaattagat

SEQ ID NO: 161169 - DNA, 12 bp, Unknown
  misc_feature (1)..( 12): Result.004 file - promoters50/1027032
tgtgaatgataa

SEQ ID NO: 161170 - DNA, 12 bp, Unknown
  misc_feature (1)..( 12): Result.004 file - promoters50/1027032
gtaaaattatat

SEQ ID NO: 161171 - DNA, 12 bp, Unknown
  misc_feature (1)..( 12): Result.004 file - promoters50/1027032
cgtgaaggatct

SEQ ID NO: 161172 - DNA, 12 bp, Unknown
  misc_feature (1)..( 12): Result.004 file - promoters50/1027032
atttaagaactc

SEQ ID NO: 161173 - DNA, 12 bp, Unknown
  misc_feature (1)..( 12): Result.004 file - promoters50/1027032
ccgtaattagta

SEQ ID NO: 161174 - DNA, 14 bp, Unknown
  misc_feature (1)..( 14): Result.004 file - promoters50/1027032
agaacgaaatatct

SEQ ID NO: 161175 - DNA, 14 bp, Unknown
  misc_feature (1)..( 14): Result.004 file - promoters50/1027032
ttaacaaaacaatt

SEQ ID NO: 161176 - DNA, 14 bp, Unknown
  misc_feature (1)..( 14): Result.004 file - promoters50/1027032
ccaacgaaacgatt

SEQ ID NO: 161177 - DNA, 14 bp, Unknown
  misc_feature (1)..( 14): Result.004 file - promoters50/1027032
ttatcaaattgact

SEQ ID NO: 161178 - DNA, 14 bp, Unknown
  misc_feature (1)..( 14): Result.004 file - promoters50/1027032
ctttcaatttgagc

SEQ ID NO: 161179 - DNA, 14 bp, Unknown
  misc_feature (1)..( 14): Result.004 file - promoters50/1027032
tcttcaatcgttac

SEQ ID NO: 161180 - DNA, 14 bp, Unknown
  misc_feature (1)..( 14): Result.004 file - promoters50/1027032
ccttcaattggttg

SEQ ID NO: 161181 - DNA, 10 bp, Unknown
  misc_feature (1)..( 10): Result.004 file - promoters50/1027032
tatgtaattt

SEQ ID NO: 161182 - DNA, 10 bp, Unknown
  misc_feature (1)..( 10): Result.004 file - promoters50/1027032
aatggaataa

SEQ ID NO: 161183 - DNA, 10 bp, Unknown
  misc_feature (1)..( 10): Result.004 file - promoters50/1027032
accgtaatta

SEQ ID NO: 161184 - DNA, 10 bp, Unknown
  misc_feature (1)..( 10): Result.004 file - promoters50/1027032
tttggattaa

SEQ ID NO: 161185 - DNA, 10 bp, Unknown
  misc_feature (1)..( 10): Result.004 file - promoters50/1027032
ttttgattgt

SEQ ID NO: 161186 - DNA, 10 bp, Unknown
  misc_feature (1)..( 10): Result.004 file - promoters50/1027040
tccggaattc

SEQ ID NO: 161187 - DNA, 8 bp, Unknown
  misc_feature (1)..( 8): Result.004 file - promoters50/1027040
gattttta

SEQ ID NO: 161188 - DNA, 8 bp, Unknown
  misc_feature (1)..( 8): Result.004 file - promoters50/1027040
gatttttt

SEQ ID NO: 161189 - DNA, 8 bp, Unknown
  misc_feature (1)..( 8): Result.004 file - promoters50/1027040
tattttta

SEQ ID NO: 161190 - DNA, 9 bp, Unknown
  misc_feature (1)..( 9): Result.004 file - promoters50/1027040
tcaaagaat

SEQ ID NO: 161191 - DNA, 9 bp, Unknown
  misc_feature (1)..( 9): Result.004 file - promoters50/1027040
tcaaagagt

SEQ ID NO: 161192 - DNA, 9 bp, Unknown
  misc_feature (1)..( 9): Result.004 file - promoters50/1027040
tgaaaaaat

SEQ ID NO: 161193 - DNA, 12 bp, Unknown
  misc_feature (1)..( 12): Result.004 file - promoters50/1027040
aaaaaaataaat

SEQ ID NO: 161194 - DNA, 12 bp, Unknown
  misc_feature (1)..( 12): Result.004 file - promoters50/1027040
aaaaaaacaaaa

SEQ ID NO: 161195 - DNA, 12 bp, Unknown
  misc_feature (1)..( 12): Result.004 file - promoters50/1027040
catgaaccaaaa

SEQ ID NO: 161196 - DNA, 10 bp, Unknown
  misc_feature (1)..( 10): Result.004 file - promoters50/1027040
tcaatatatt

SEQ ID NO: 161197 - DNA, 10 bp, Unknown
  misc_feature (1)..( 10): Result.004 file - promoters50/1027040
tcaagatatg

SEQ ID NO: 161198 - DNA, 10 bp, Unknown
  misc_feature (1)..( 10): Result.004 file - promoters50/1027040
tttggatatg

SEQ ID NO: 161199 - DNA, 10 bp, Unknown
  misc_feature (1)..( 10): Result.004 file - promoters50/1027040
tttgattttg

SEQ ID NO: 161200 - DNA, 10 bp, Unknown
  misc_feature (1)..( 10): Result.004 file - promoters50/1027040
tttgattttt

SEQ ID NO: 161201 - DNA, 10 bp, Unknown
  misc_feature (1)..( 10): Result.004 file - promoters50/1027064
ttagattttt

SEQ ID NO: 161202 - DNA, 11 bp, Unknown
  misc_feature (1)..( 11): Result.004 file - promoters50/1027064
attagttaaaa

SEQ ID NO: 161203 - DNA, 11 bp, Unknown
  misc_feature (1)..( 11): Result.004 file - promoters50/1027064
tatagttgaaa

SEQ ID NO: 161204 - DNA, 11 bp, Unknown
  misc_feature (1)..( 11): Result.004 file - promoters50/1027064
tattgttatag

SEQ ID NO: 161205 - DNA, 9 bp, Unknown
  misc_feature (1)..( 9): Result.004 file - promoters50/1027064
aagttatgt

SEQ ID NO: 161206 - DNA, 9 bp, Unknown
  misc_feature (1)..( 9): Result.004 file - promoters50/1027064
tggttatgt

SEQ ID NO: 161207 - DNA, 9 bp, Unknown
  misc_feature (1)..( 9): Result.004 file - promoters50/1027108
tggatattt

SEQ ID NO: 161208 - DNA, 10 bp, Unknown
  misc_feature (1)..( 10): Result.004 file - promoters50/1027108
gttaaaacaa

SEQ ID NO: 161209 - DNA, 10 bp, Unknown
  misc_feature (1)..( 10): Result.004 file - promoters50/1027108
gttaagacaa

SEQ ID NO: 161210 - DNA, 10 bp, Unknown
  misc_feature (1)..( 10): Result.004 file - promoters50/1027121
attagaacgg

SEQ ID NO: 161211 - DNA, 10 bp, Unknown
  misc_feature (1)..( 10): Result.004 file - promoters50/1027121
attataataa

SEQ ID NO: 161212 - DNA, 10 bp, Unknown
  misc_feature (1)..( 10): Result.004 file - promoters50/1027121
gttagaataa

SEQ ID NO: 161213 - DNA, 10 bp, Unknown
  misc_feature (1)..( 10): Result.004 file - promoters50/1027125
attatacaag

SEQ ID NO: 161214 - DNA, 9 bp, Unknown
  misc_feature (1)..( 9): Result.004 file - promoters50/1027125
aattgtaaa

SEQ ID NO: 161215 - DNA, 9 bp, Unknown
  misc_feature (1)..( 9): Result.004 file - promoters50/1027125
agctgtaaa

SEQ ID NO: 161216 - DNA, 9 bp, Unknown
  misc_feature (1)..( 9): Result.004 file - promoters50/1027125
ctttgtaaa

SEQ ID NO: 161217 - DNA, 9 bp, Unknown
  misc_feature (1)..( 9): Result.004 file - promoters50/1027125
aatggtaag

SEQ ID NO: 161218 - DNA, 9 bp, Unknown
  misc_feature (1)..( 9): Result.004 file - promoters50/1027125
ttttgtaga

SEQ ID NO: 161219 - DNA, 9 bp, Unknown
  misc_feature (1)..( 9): Result.004 file - promoters50/1027156
ttttttaat

SEQ ID NO: 161220 - DNA, 8 bp, Unknown
  misc_feature (1)..( 8): Result.004 file - promoters50/1027156
atacaaaa

SEQ ID NO: 161221 - DNA, 8 bp, Unknown
  misc_feature (1)..( 8): Result.004 file - promoters50/1027156
atacaata

SEQ ID NO: 161222 - DNA, 8 bp, Unknown
  misc_feature (1)..( 8): Result.004 file - promoters50/1027156
ctacaata

SEQ ID NO: 161223 - DNA, 9 bp, Unknown
  misc_feature (1)..( 9): Result.004 file - promoters50/1027156
ttagtcaac

SEQ ID NO: 161224 - DNA, 9 bp, Unknown
  misc_feature (1)..( 9): Result.004 file - promoters50/1027156
aaagtaaac

SEQ ID NO: 161225 - DNA, 9 bp, Unknown
  misc_feature (1)..( 9): Result.004 file - promoters50/1027156
aaagaaaaa

SEQ ID NO: 161226 - DNA, 10 bp, Unknown
  misc_feature (1)..( 10): Result.004 file - promoters50/1027156
catataggtt

SEQ ID NO: 161227 - DNA, 10 bp, Unknown
  misc_feature (1)..( 10): Result.004 file - promoters50/1027156
aaaataagtt

SEQ ID NO: 161228 - DNA, 10 bp, Unknown
  misc_feature (1)..( 10): Result.004 file - promoters50/1027156
aaactaagaa

SEQ ID NO: 161229 - DNA, 9 bp, Unknown
  misc_feature (1)..( 9): Result.004 file - promoters50/1027156
caacaactt

SEQ ID NO: 161230 - DNA, 9 bp, Unknown
  misc_feature (1)..( 9): Result.004 file - promoters50/1027156
caaaaacta

SEQ ID NO: 161231 - DNA, 9 bp, Unknown
  misc_feature (1)..( 9): Result.004 file - promoters50/1027171
taaaataag

SEQ ID NO: 161232 - DNA, 16 bp, Unknown
  misc_feature (1)..( 16): Result.004 file - promoters50/1027171
caacttttcttagttt

SEQ ID NO: 161233 - DNA, 16 bp, Unknown
  misc_feature (1)..( 16): Result.004 file - promoters50/1027171
taggttttgttatgga

SEQ ID NO: 161234 - DNA, 16 bp, Unknown
  misc_feature (1)..( 16): Result.004 file - promoters50/1027171
tatatcttcttatttt

SEQ ID NO: 161235 - DNA, 16 bp, Unknown
  misc_feature (1)..( 16): Result.004 file - promoters50/1027171
tatattttaggtgtac

SEQ ID NO: 161236 - DNA, 16 bp, Unknown
  misc_feature (1)..( 16): Result.004 file - promoters50/1027171
aatatttttcttattg

SEQ ID NO: 161237 - DNA, 12 bp, Unknown
  misc_feature (1)..( 12): Result.004 file - promoters50/1027171
ttcaaaaatcaa

SEQ ID NO: 161238 - DNA, 12 bp, Unknown
  misc_feature (1)..( 12): Result.004 file - promoters50/1027171
atataaaaacaa

SEQ ID NO: 161239 - DNA, 12 bp, Unknown
  misc_feature (1)..( 12): Result.004 file - promoters50/1027171
gaaataaatcac

SEQ ID NO: 161240 - DNA, 12 bp, Unknown
  misc_feature (1)..( 12): Result.004 file - promoters50/1027171
aaagaaaaacct

SEQ ID NO: 161241 - DNA, 12 bp, Unknown
  misc_feature (1)..( 12): Result.004 file - promoters50/1027171
agataaagtttc

SEQ ID NO: 161242 - DNA, 12 bp, Unknown
  misc_feature (1)..( 12): Result.004 file - promoters50/1027171
aaaataactcac

SEQ ID NO: 161243 - DNA, 12 bp, Unknown
  misc_feature (1)..( 12): Result.004 file - promoters50/1027171
gaaataaatcac

SEQ ID NO: 161244 - DNA, 12 bp, Unknown
  misc_feature (1)..( 12): Result.004 file - promoters50/1027171
aaaatatatcag

SEQ ID NO: 161245 - DNA, 12 bp, Unknown
  misc_feature (1)..( 12): Result.004 file - promoters50/1027171
gagataaatagt

SEQ ID NO: 161246 - DNA, 12 bp, Unknown
  misc_feature (1)..( 12): Result.004 file - promoters50/1027171
tagataaagttt

SEQ ID NO: 161247 - DNA, 13 bp, Unknown
  misc_feature (1)..( 13): Result.004 file - promoters50/1027171
caaaaaataatct

SEQ ID NO: 161248 - DNA, 13 bp, Unknown
  misc_feature (1)..( 13): Result.004 file - promoters50/1027171
caaaacataaatc

SEQ ID NO: 161249 - DNA, 14 bp, Unknown
  misc_feature (1)..( 14): Result.004 file - promoters50/1027171
tatctcatcaatta

SEQ ID NO: 161250 - DNA, 14 bp, Unknown
  misc_feature (1)..( 14): Result.004 file - promoters50/1027171
aatttcatttatat

SEQ ID NO: 161251 - DNA, 12 bp, Unknown
  misc_feature (1)..( 12): Result.004 file - promoters50/1027171
gaaacttaaaaa

SEQ ID NO: 161252 - DNA, 12 bp, Unknown
  misc_feature (1)..( 12): Result.004 file - promoters50/1027171
aaaacttatatt

SEQ ID NO: 161253 - DNA, 12 bp, Unknown
  misc_feature (1)..( 12): Result.004 file - promoters50/1027171
cttactaatatt

SEQ ID NO: 161254 - DNA, 12 bp, Unknown
  misc_feature (1)..( 12): Result.004 file - promoters50/1027175
aaaactccaaaa

SEQ ID NO: 161255 - DNA, 10 bp, Unknown
  misc_feature (1)..( 10): Result.004 file - promoters50/1027175
gttttgacca

SEQ ID NO: 161256 - DNA, 10 bp, Unknown
  misc_feature (1)..( 10): Result.004 file - promoters50/1027175
cttttcacca

SEQ ID NO: 161257 - DNA, 10 bp, Unknown
  misc_feature (1)..( 10): Result.004 file - promoters50/1027175
gttttgtaat

SEQ ID NO: 161258 - DNA, 11 bp, Unknown
  misc_feature (1)..( 11): Result.004 file - promoters50/1027175
tattatgtggc

SEQ ID NO: 161259 - DNA, 11 bp, Unknown
  misc_feature (1)..( 11): Result.004 file - promoters50/1027175
tattttgtggc

SEQ ID NO: 161260 - DNA, 11 bp, Unknown
  misc_feature (1)..( 11): Result.004 file - promoters50/1027175
ttttatgtgag

SEQ ID NO: 161261 - DNA, 11 bp, Unknown
  misc_feature (1)..( 11): Result.004 file - promoters50/1027175
tcttttttttt

SEQ ID NO: 161262 - DNA, 11 bp, Unknown
  misc_feature (1)..( 11): Result.004 file - promoters50/1027175
tctttttcctt

SEQ ID NO: 161263 - DNA, 11 bp, Unknown
  misc_feature (1)..( 11): Result.004 file - promoters50/1027189
gcttttttttt

SEQ ID NO: 161264 - DNA, 9 bp, Unknown
  misc_feature (1)..( 9): Result.004 file - promoters50/1027189
caaaataat

SEQ ID NO: 161265 - DNA, 9 bp, Unknown
  misc_feature (1)..( 9): Result.004 file - promoters50/1027189
ctaaaaaat

SEQ ID NO: 161266 - DNA, 9 bp, Unknown
  misc_feature (1)..( 9): Result.004 file - promoters50/1027189
aaaaacaat

SEQ ID NO: 161267 - DNA, 9 bp, Unknown
  misc_feature (1)..( 9): Result.004 file - promoters50/1027189
tagaaaaat

SEQ ID NO: 161268 - DNA, 9 bp, Unknown
  misc_feature (1)..( 9): Result.004 file - promoters50/1027189
tagagaaac

SEQ ID NO: 161269 - DNA, 6 bp, Unknown
  misc_feature (1)..( 6): Result.004 file - promoters50/1027189
aacaat

SEQ ID NO: 161270 - DNA, 7 bp, Unknown
  misc_feature (1)..( 7): Result.004 file - promoters50/1027189
aaacaaa

SEQ ID NO: 161271 - DNA, 7 bp, Unknown
  misc_feature (1)..( 7): Result.004 file - promoters50/1027189
caacaaa

SEQ ID NO: 161272 - DNA, 7 bp, Unknown
  misc_feature (1)..( 7): Result.004 file - promoters50/1027189
aaacaat

SEQ ID NO: 161273 - DNA, 7 bp, Unknown
  misc_feature (1)..( 7): Result.004 file - promoters50/1027189
aaacaaa

SEQ ID NO: 161274 - DNA, 7 bp, Unknown
  misc_feature (1)..( 7): Result.004 file - promoters50/1027189
caagaaa

SEQ ID NO: 161275 - DNA, 6 bp, Unknown
  misc_feature (1)..( 6): Result.004 file - promoters50/1027189
aacaat

SEQ ID NO: 161276 - DNA, 9 bp, Unknown
  misc_feature (1)..( 9): Result.004 file - promoters50/1027189
tatacatat

SEQ ID NO: 161277 - DNA, 9 bp, Unknown
  misc_feature (1)..( 9): Result.004 file - promoters50/1027189
tatatataa

SEQ ID NO: 161278 - DNA, 9 bp, Unknown
  misc_feature (1)..( 9): Result.004 file - promoters50/1027189
gttacatag

SEQ ID NO: 161279 - DNA, 9 bp, Unknown
  misc_feature (1)..( 9): Result.004 file - promoters50/1027189
tatgcattt

SEQ ID NO: 161280 - DNA, 9 bp, Unknown
  misc_feature (1)..( 9): Result.004 file - promoters50/1027189
tatctaaga

SEQ ID NO: 161281 - DNA, 9 bp, Unknown
  misc_feature (1)..( 9): Result.004 file - promoters50/1027189
aatggattt

SEQ ID NO: 161282 - DNA, 10 bp, Unknown
  misc_feature (1)..( 10): Result.004 file - promoters50/1027189
tggtatcatg

SEQ ID NO: 161283 - DNA, 10 bp, Unknown
  misc_feature (1)..( 10): Result.004 file - promoters50/1027189
ttatatgatg

SEQ ID NO: 161284 - DNA, 10 bp, Unknown
  misc_feature (1)..( 10): Result.004 file - promoters50/1027189
aaatattatg

SEQ ID NO: 161285 - DNA, 10 bp, Unknown
  misc_feature (1)..( 10): Result.004 file - promoters50/1027189
aaatatgaga

SEQ ID NO: 161286 - DNA, 10 bp, Unknown
  misc_feature (1)..( 10): Result.004 file - promoters50/1027189
atatatgaca

SEQ ID NO: 161287 - DNA, 10 bp, Unknown
  misc_feature (1)..( 10): Result.004 file - promoters50/1027189
aaattttata

SEQ ID NO: 161288 - DNA, 16 bp, Unknown
  misc_feature (1)..( 16): Result.004 file - promoters50/1027189
gattagaaacagactt

SEQ ID NO: 161289 - DNA, 16 bp, Unknown
  misc_feature (1)..( 16): Result.004 file - promoters50/1027189
gatgagaaccttattt

SEQ ID NO: 161290 - DNA, 16 bp, Unknown
  misc_feature (1)..( 16): Result.004 file - promoters50/1027189
ttttataaatttggag

SEQ ID NO: 161291 - DNA, 16 bp, Unknown
  misc_feature (1)..( 16): Result.004 file - promoters50/1027189
tatgagataaaaatag

SEQ ID NO: 161292 - DNA, 16 bp, Unknown
  misc_feature (1)..( 16): Result.004 file - promoters50/1027189
aatgggaagcggcgga

SEQ ID NO: 161293 - DNA, 16 bp, Unknown
  misc_feature (1)..( 16): Result.004 file - promoters50/1027201
acacataacttttgag

SEQ ID NO: 161294 - DNA, 9 bp, Unknown
  misc_feature (1)..( 9): Result.004 file - promoters50/1027201
gatgaagaa

SEQ ID NO: 161295 - DNA, 9 bp, Unknown
  misc_feature (1)..( 9): Result.004 file - promoters50/1027201
attgatgaa

SEQ ID NO: 161296 - DNA, 9 bp, Unknown
  misc_feature (1)..( 9): Result.004 file - promoters50/1027201
gatgcagat

SEQ ID NO: 161297 - DNA, 9 bp, Unknown
  misc_feature (1)..( 9): Result.004 file - promoters50/1027201
aagctcgat

SEQ ID NO: 161298 - DNA, 9 bp, Unknown
  misc_feature (1)..( 9): Result.004 file - promoters50/1027201
aaggtcgat

SEQ ID NO: 161299 - DNA, 9 bp, Unknown
  misc_feature (1)..( 9): Result.004 file - promoters50/1027201
aagctcgat

SEQ ID NO: 161300 - DNA, 7 bp, Unknown
  misc_feature (1)..( 7): Result.004 file - promoters50/1027201
aaaaaat

SEQ ID NO: 161301 - DNA, 7 bp, Unknown
  misc_feature (1)..( 7): Result.004 file - promoters50/1027201
aaaaaat

SEQ ID NO: 161302 - DNA, 7 bp, Unknown
  misc_feature (1)..( 7): Result.004 file - promoters50/1027204
aaaaaaa

SEQ ID NO: 161303 - DNA, 8 bp, Unknown
  misc_feature (1)..( 8): Result.004 file - promoters50/1027204
aaataatg

SEQ ID NO: 161304 - DNA, 8 bp, Unknown
  misc_feature (1)..( 8): Result.004 file - promoters50/1027204
aaataaaa

SEQ ID NO: 161305 - DNA, 8 bp, Unknown
  misc_feature (1)..( 8): Result.004 file - promoters50/1027204
aaataatg

SEQ ID NO: 161306 - DNA, 8 bp, Unknown
  misc_feature (1)..( 8): Result.004 file - promoters50/1027204
aaaatttc

SEQ ID NO: 161307 - DNA, 8 bp, Unknown
  misc_feature (1)..( 8): Result.004 file - promoters50/1027204
gaaatttt

SEQ ID NO: 161308 - DNA, 8 bp, Unknown
  misc_feature (1)..( 8): Result.004 file - promoters50/1027204
aaagttta

SEQ ID NO: 161309 - DNA, 7 bp, Unknown
  misc_feature (1)..( 7): Result.004 file - promoters50/1027204
aaaaaat

SEQ ID NO: 161310 - DNA, 7 bp, Unknown
  misc_feature (1)..( 7): Result.004 file - promoters50/1027204
aaaaaaa

SEQ ID NO: 161311 - DNA, 7 bp, Unknown
  misc_feature (1)..( 7): Result.004 file - promoters50/1027204
aaaaatc

SEQ ID NO: 161312 - DNA, 8 bp, Unknown
  misc_feature (1)..( 8): Result.004 file - promoters50/1027204
aaaataat

SEQ ID NO: 161313 - DNA, 13 bp, Unknown
  misc_feature (1)..( 13): Result.004 file - promoters50/1027204
aaataaaaagatt

SEQ ID NO: 161314 - DNA, 13 bp, Unknown
  misc_feature (1)..( 13): Result.004 file - promoters50/1027204
atatacaaatatt

SEQ ID NO: 161315 - DNA, 13 bp, Unknown
  misc_feature (1)..( 13): Result.004 file - promoters50/1027204
aaataaaaagata

SEQ ID NO: 161316 - DNA, 8 bp, Unknown
  misc_feature (1)..( 8): Result.004 file - promoters50/1027204
atatatat

SEQ ID NO: 161317 - DNA, 8 bp, Unknown
  misc_feature (1)..( 8): Result.004 file - promoters50/1027204
atatatat

SEQ ID NO: 161318 - DNA, 8 bp, Unknown
  misc_feature (1)..( 8): Result.004 file - promoters50/1027204
ttatatag

SEQ ID NO: 161319 - DNA, 12 bp, Unknown
  misc_feature (1)..( 12): Result.004 file - promoters50/1027204
tttaaaaatatt

SEQ ID NO: 161320 - DNA, 12 bp, Unknown
  misc_feature (1)..( 12): Result.004 file - promoters50/1027204
gaaaaaaatcca

SEQ ID NO: 161321 - DNA, 12 bp, Unknown
  misc_feature (1)..( 12): Result.004 file - promoters50/1027204
aataaaaagatt

SEQ ID NO: 161322 - DNA, 12 bp, Unknown
  misc_feature (1)..( 12): Result.004 file - promoters50/1027204
aataaaattaat

SEQ ID NO: 161323 - DNA, 8 bp, Unknown
  misc_feature (1)..( 8): Result.004 file - promoters50/1027204
gagagagg

SEQ ID NO: 161324 - DNA, 8 bp, Unknown
  misc_feature (1)..( 8): Result.004 file - promoters50/1027204
gagagatc

SEQ ID NO: 161325 - DNA, 8 bp, Unknown
  misc_feature (1)..( 8): Result.004 file - promoters50/1027204
cagatatc

SEQ ID NO: 161326 - DNA, 7 bp, Unknown
  misc_feature (1)..( 7): Result.004 file - promoters50/1027204
taaggaa

SEQ ID NO: 161327 - DNA, 7 bp, Unknown
  misc_feature (1)..( 7): Result.004 file - promoters50/1027204
taatgaa

SEQ ID NO: 161328 - DNA, 7 bp, Unknown
  misc_feature (1)..( 7): Result.004 file - promoters50/1027204
taacgaa

SEQ ID NO: 161329 - DNA, 7 bp, Unknown
  misc_feature (1)..( 7): Result.004 file - promoters50/1027204
caaatta

SEQ ID NO: 161330 - DNA, 7 bp, Unknown
  misc_feature (1)..( 7): Result.004 file - promoters50/1027204
aaaatta

SEQ ID NO: 161331 - DNA, 7 bp, Unknown
  misc_feature (1)..( 7): Result.004 file - promoters50/1027212
aaaattt

SEQ ID NO: 161332 - DNA, 10 bp, Unknown
  misc_feature (1)..( 10): Result.004 file - promoters50/1027212
atattatgga

SEQ ID NO: 161333 - DNA, 10 bp, Unknown
  misc_feature (1)..( 10): Result.004 file - promoters50/1027212
atattaaaaa

SEQ ID NO: 161334 - DNA, 10 bp, Unknown
  misc_feature (1)..( 10): Result.004 file - promoters50/1027212
atatcaaaaa

SEQ ID NO: 161335 - DNA, 8 bp, Unknown
  misc_feature (1)..( 8): Result.004 file - promoters50/1027212
gaatgcat

SEQ ID NO: 161336 - DNA, 8 bp, Unknown
  misc_feature (1)..( 8): Result.004 file - promoters50/1027212
aaatacat

SEQ ID NO: 161337 - DNA, 8 bp, Unknown
  misc_feature (1)..( 8): Result.004 file - promoters50/1027212
gaaggcag

SEQ ID NO: 161338 - DNA, 9 bp, Unknown
  misc_feature (1)..( 9): Result.004 file - promoters50/1027212
tgtctaaaa

SEQ ID NO: 161339 - DNA, 9 bp, Unknown
  misc_feature (1)..( 9): Result.004 file - promoters50/1027212
tgtttaaaa

SEQ ID NO: 161340 - DNA, 10 bp, Unknown
  misc_feature (1)..( 10): Result.004 file - promoters50/1027212
tttctagaaa

SEQ ID NO: 161341 - DNA, 10 bp, Unknown
  misc_feature (1)..( 10): Result.004 file - promoters50/1027212
accaatataa

SEQ ID NO: 161342 - DNA, 10 bp, Unknown
  misc_feature (1)..( 10): Result.004 file - promoters50/1027212
tactatataa

SEQ ID NO: 161343 - DNA, 10 bp, Unknown
  misc_feature (1)..( 10): Result.004 file - promoters50/1027212
accaatataa

SEQ ID NO: 161344 - DNA, 10 bp, Unknown
  misc_feature (1)..( 10): Result.004 file - promoters50/1027212
atatatataa

SEQ ID NO: 161345 - DNA, 8 bp, Unknown
  misc_feature (1)..( 8): Result.004 file - promoters50/1027212
tttttaat

SEQ ID NO: 161346 - DNA, 8 bp, Unknown
  misc_feature (1)..( 8): Result.004 file - promoters50/1027212
ttttaaat

SEQ ID NO: 161347 - DNA, 8 bp, Unknown
  misc_feature (1)..( 8): Result.004 file - promoters50/1027212
gtttaaaa

SEQ ID NO: 161348 - DNA, 9 bp, Unknown
  misc_feature (1)..( 9): Result.004 file - promoters50/1027212
aagtaaaaa

SEQ ID NO: 161349 - DNA, 9 bp, Unknown
  misc_feature (1)..( 9): Result.004 file - promoters50/1027212
gtttaaaaa

SEQ ID NO: 161350 - DNA, 9 bp, Unknown
  misc_feature (1)..( 9): Result.004 file - promoters50/1027212
ttttaaaca

SEQ ID NO: 161351 - DNA, 9 bp, Unknown
  misc_feature (1)..( 9): Result.004 file - promoters50/1027212
aaaaaaaag

SEQ ID NO: 161352 - DNA, 9 bp, Unknown
  misc_feature (1)..( 9): Result.004 file - promoters50/1027212
aaataaaat

SEQ ID NO: 161353 - DNA, 9 bp, Unknown
  misc_feature (1)..( 9): Result.004 file - promoters50/1027212
gcctaaaat

SEQ ID NO: 161354 - DNA, 7 bp, Unknown
  misc_feature (1)..( 7): Result.004 file - promoters50/1027212
taacatt

SEQ ID NO: 161355 - DNA, 7 bp, Unknown
  misc_feature (1)..( 7): Result.004 file - promoters50/1027212
taaaatt

SEQ ID NO: 161356 - DNA, 7 bp, Unknown
  misc_feature (1)..( 7): Result.004 file - promoters50/1027212
taaaata

SEQ ID NO: 161357 - DNA, 8 bp, Unknown
  misc_feature (1)..( 8): Result.004 file - promoters50/1027212
taaataaa

SEQ ID NO: 161358 - DNA, 8 bp, Unknown
  misc_feature (1)..( 8): Result.004 file - promoters50/1027212
caaaaaaa

SEQ ID NO: 161359 - DNA, 8 bp, Unknown
  misc_feature (1)..( 8): Result.004 file - promoters50/1027212
caaaaaag

SEQ ID NO: 161360 - DNA, 7 bp, Unknown
  misc_feature (1)..( 7): Result.004 file - promoters50/1027212
aaaagag

SEQ ID NO: 161361 - DNA, 7 bp, Unknown
  misc_feature (1)..( 7): Result.004 file - promoters50/1027212
aaaagag

SEQ ID NO: 161362 - DNA, 8 bp, Unknown
  misc_feature (1)..( 8): Result.004 file - promoters50/1027237
aaacagac

SEQ ID NO: 161363 - DNA, 7 bp, Unknown
  misc_feature (1)..( 7): Result.004 file - promoters50/1027237
gaacaag

SEQ ID NO: 161364 - DNA, 7 bp, Unknown
  misc_feature (1)..( 7): Result.004 file - promoters50/1027237
gaataag

SEQ ID NO: 161365 - DNA, 7 bp, Unknown
  misc_feature (1)..( 7): Result.004 file - promoters50/1027237
gaagaag

SEQ ID NO: 161366 - DNA, 12 bp, Unknown
  misc_feature (1)..( 12): Result.004 file - promoters50/1027237
tctaatatttaa

SEQ ID NO: 161367 - DNA, 12 bp, Unknown
  misc_feature (1)..( 12): Result.004 file - promoters50/1027237
tctaatatatag

SEQ ID NO: 161368 - DNA, 12 bp, Unknown
  misc_feature (1)..( 12): Result.004 file - promoters50/1027237
caaaatatataa

SEQ ID NO: 161369 - DNA, 11 bp, Unknown
  misc_feature (1)..( 11): Result.004 file - promoters50/1027237
tttatctctta

SEQ ID NO: 161370 - DNA, 11 bp, Unknown
  misc_feature (1)..( 11): Result.004 file - promoters50/1027237
tttatctttta

SEQ ID NO: 161371 - DNA, 11 bp, Unknown
  misc_feature (1)..( 11): Result.004 file - promoters50/1027237
ttattctgtta

SEQ ID NO: 161372 - DNA, 11 bp, Unknown
  misc_feature (1)..( 11): Result.004 file - promoters50/1027237
tatattttagt

SEQ ID NO: 161373 - DNA, 11 bp, Unknown
  misc_feature (1)..( 11): Result.004 file - promoters50/1027237
tatttttgagt

SEQ ID NO: 161374 - DNA, 11 bp, Unknown
  misc_feature (1)..( 11): Result.004 file - promoters50/1027237
aatatttgggc

SEQ ID NO: 161375 - DNA, 9 bp, Unknown
  misc_feature (1)..( 9): Result.004 file - promoters50/1027237
gaagcagaa

SEQ ID NO: 161376 - DNA, 9 bp, Unknown
  misc_feature (1)..( 9): Result.004 file - promoters50/1027237
gaagaagaa

SEQ ID NO: 161377 - DNA, 9 bp, Unknown
  misc_feature (1)..( 9): Result.004 file - promoters50/1027237
gaataagct

SEQ ID NO: 161378 - DNA, 9 bp, Unknown
  misc_feature (1)..( 9): Result.004 file - promoters50/1027237
tataatttt

SEQ ID NO: 161379 - DNA, 9 bp, Unknown
  misc_feature (1)..( 9): Result.004 file - promoters50/1027237
tattatttt

SEQ ID NO: 161380 - DNA, 9 bp, Unknown
  misc_feature (1)..( 9): Result.004 file - promoters50/1027240
ggttacttt

SEQ ID NO: 161381 - DNA, 9 bp, Unknown
  misc_feature (1)..( 9): Result.004 file - promoters50/1027240
aatcaaaac

SEQ ID NO: 161382 - DNA, 9 bp, Unknown
  misc_feature (1)..( 9): Result.004 file - promoters50/1027240
aatgaaaag

SEQ ID NO: 161383 - DNA, 9 bp, Unknown
  misc_feature (1)..( 9): Result.004 file - promoters50/1027240
tatcaaaag

SEQ ID NO: 161384 - DNA, 9 bp, Unknown
  misc_feature (1)..( 9): Result.004 file - promoters50/1027240
cggcaaaag

SEQ ID NO: 161385 - DNA, 11 bp, Unknown
  misc_feature (1)..( 11): Result.004 file - promoters50/1027240
tcaaaatattt

SEQ ID NO: 161386 - DNA, 11 bp, Unknown
  misc_feature (1)..( 11): Result.004 file - promoters50/1027240
gcaaaatcttt

SEQ ID NO: 161387 - DNA, 11 bp, Unknown
  misc_feature (1)..( 11): Result.004 file - promoters50/1027240
ataaattatat

SEQ ID NO: 161388 - DNA, 11 bp, Unknown
  misc_feature (1)..( 11): Result.004 file - promoters50/1027240
tcaaaaaaaaa

SEQ ID NO: 161389 - DNA, 13 bp, Unknown
  misc_feature (1)..( 13): Result.004 file - promoters50/1027240
taaccctagaagt

SEQ ID NO: 161390 - DNA, 13 bp, Unknown
  misc_feature (1)..( 13): Result.004 file - promoters50/1027240
taaacctaaattt

SEQ ID NO: 161391 - DNA, 13 bp, Unknown
  misc_feature (1)..( 13): Result.004 file - promoters50/1027240
ctacccaaaaaac

SEQ ID NO: 161392 - DNA, 13 bp, Unknown
  misc_feature (1)..( 13): Result.004 file - promoters50/1027240
cttacctacattt

SEQ ID NO: 161393 - DNA, 6 bp, Unknown
  misc_feature (1)..( 6): Result.004 file - promoters50/1027240
aaaaaa

SEQ ID NO: 161394 - DNA, 6 bp, Unknown
  misc_feature (1)..( 6): Result.004 file - promoters50/1027240
aaaaaa

SEQ ID NO: 161395 - DNA, 6 bp, Unknown
  misc_feature (1)..( 6): Result.004 file - promoters50/1027240
aaaaac

SEQ ID NO: 161396 - DNA, 6 bp, Unknown
  misc_feature (1)..( 6): Result.004 file - promoters50/1027240
aaaaaa

SEQ ID NO: 161397 - DNA, 9 bp, Unknown
  misc_feature (1)..( 9): Result.004 file - promoters50/1027240
attaaaata

SEQ ID NO: 161398 - DNA, 9 bp, Unknown
  misc_feature (1)..( 9): Result.004 file - promoters50/1027240
cttaaaaat

SEQ ID NO: 161399 - DNA, 9 bp, Unknown
  misc_feature (1)..( 9): Result.004 file - promoters50/1027240
tttataata

SEQ ID NO: 161400 - DNA, 9 bp, Unknown
  misc_feature (1)..( 9): Result.004 file - promoters50/1027240
tttttaata

SEQ ID NO: 161401 - DNA, 9 bp, Unknown
  misc_feature (1)..( 9): Result.004 file - promoters50/1027240
attaaaata

SEQ ID NO: 161402 - DNA, 9 bp, Unknown
  misc_feature (1)..( 9): Result.004 file - promoters50/1027240
ttaaaaata

SEQ ID NO: 161403 - DNA, 9 bp, Unknown
  misc_feature (1)..( 9): Result.004 file - promoters50/1027240
tttataata

SEQ ID NO: 161404 - DNA, 9 bp, Unknown
  misc_feature (1)..( 9): Result.004 file - promoters50/1027240
tttttaata

SEQ ID NO: 161405 - DNA, 9 bp, Unknown
  misc_feature (1)..( 9): Result.004 file - promoters50/1027240
cgaaaaaat

SEQ ID NO: 161406 - DNA, 9 bp, Unknown
  misc_feature (1)..( 9): Result.004 file - promoters50/1027240
ccaaaaaat

SEQ ID NO: 161407 - DNA, 9 bp, Unknown
  misc_feature (1)..( 9): Result.004 file - promoters50/1027240
tgaaaaaag

SEQ ID NO: 161408 - DNA, 9 bp, Unknown
  misc_feature (1)..( 9): Result.004 file - promoters50/1027243
ccaaaaaac

SEQ ID NO: 161409 - DNA, 11 bp, Unknown
  misc_feature (1)..( 11): Result.004 file - promoters50/1027243
tgatactattt

SEQ ID NO: 161410 - DNA, 11 bp, Unknown
  misc_feature (1)..( 11): Result.004 file - promoters50/1027243
ttatattatta

SEQ ID NO: 161411 - DNA, 11 bp, Unknown
  misc_feature (1)..( 11): Result.004 file - promoters50/1027243
tagtacaattt

SEQ ID NO: 161412 - DNA, 11 bp, Unknown
  misc_feature (1)..( 11): Result.004 file - promoters50/1027243
ttttactaact

SEQ ID NO: 161413 - DNA, 11 bp, Unknown
  misc_feature (1)..( 11): Result.004 file - promoters50/1027243
cttttctattc

SEQ ID NO: 161414 - DNA, 11 bp, Unknown
  misc_feature (1)..( 11): Result.004 file - promoters50/1027276
ttagattagcc

SEQ ID NO: 161415 - DNA, 11 bp, Unknown
  misc_feature (1)..( 11): Result.004 file - promoters50/1027276
acaaatttgtt

SEQ ID NO: 161416 - DNA, 11 bp, Unknown
  misc_feature (1)..( 11): Result.004 file - promoters50/1027276
ttaaattttaa

SEQ ID NO: 161417 - DNA, 11 bp, Unknown
  misc_feature (1)..( 11): Result.004 file - promoters50/1027276
tcaagtttttt

SEQ ID NO: 161418 - DNA, 11 bp, Unknown
  misc_feature (1)..( 11): Result.004 file - promoters50/1027276
ttaaatatgtt

SEQ ID NO: 161419 - DNA, 11 bp, Unknown
  misc_feature (1)..( 11): Result.004 file - promoters50/1027276
atgaattctaa

SEQ ID NO: 161420 - DNA, 11 bp, Unknown
  misc_feature (1)..( 11): Result.004 file - promoters50/1027346
ttaaattattc

SEQ ID NO: 161421 - DNA, 9 bp, Unknown
  misc_feature (1)..( 9): Result.004 file - promoters50/1027346
ttacatgtt

SEQ ID NO: 161422 - DNA, 9 bp, Unknown
  misc_feature (1)..( 9): Result.004 file - promoters50/1027346
ttaaatgtt

SEQ ID NO: 161423 - DNA, 9 bp, Unknown
  misc_feature (1)..( 9): Result.004 file - promoters50/1027346
atgcatgtt

SEQ ID NO: 161424 - DNA, 13 bp, Unknown
  misc_feature (1)..( 13): Result.004 file - promoters50/1027346
aataaaatagtaa

SEQ ID NO: 161425 - DNA, 13 bp, Unknown
  misc_feature (1)..( 13): Result.004 file - promoters50/1027346
aatgaaataataa

SEQ ID NO: 161426 - DNA, 13 bp, Unknown
  misc_feature (1)..( 13): Result.004 file - promoters50/1027346
actaaaataaaac

SEQ ID NO: 161427 - DNA, 9 bp, Unknown
  misc_feature (1)..( 9): Result.004 file - promoters50/1027346
aatcaaaat

SEQ ID NO: 161428 - DNA, 9 bp, Unknown
  misc_feature (1)..( 9): Result.004 file - promoters50/1027346
tttcataat

SEQ ID NO: 161429 - DNA, 9 bp, Unknown
  misc_feature (1)..( 9): Result.004 file - promoters50/1027346
tttcctaag

SEQ ID NO: 161430 - DNA, 8 bp, Unknown
  misc_feature (1)..( 8): Result.004 file - promoters50/1027346
cataaaat

SEQ ID NO: 161431 - DNA, 8 bp, Unknown
  misc_feature (1)..( 8): Result.004 file - promoters50/1027346
gataaaat

SEQ ID NO: 161432 - DNA, 8 bp, Unknown
  misc_feature (1)..( 8): Result.004 file - promoters50/1027346
cataaaat

SEQ ID NO: 161433 - DNA, 8 bp, Unknown
  misc_feature (1)..( 8): Result.004 file - promoters50/1027346
tgttattc

SEQ ID NO: 161434 - DNA, 8 bp, Unknown
  misc_feature (1)..( 8): Result.004 file - promoters50/1027346
tgttattt

SEQ ID NO: 161435 - DNA, 8 bp, Unknown
  misc_feature (1)..( 8): Result.004 file - promoters50/1027346
ggttgttt

SEQ ID NO: 161436 - DNA, 8 bp, Unknown
  misc_feature (1)..( 8): Result.004 file - promoters50/1027346
ctttataa

SEQ ID NO: 161437 - DNA, 8 bp, Unknown
  misc_feature (1)..( 8): Result.004 file - promoters50/1027346
atttataa

SEQ ID NO: 161438 - DNA, 8 bp, Unknown
  misc_feature (1)..( 8): Result.004 file - promoters50/1027346
atttatct

SEQ ID NO: 161439 - DNA, 8 bp, Unknown
  misc_feature (1)..( 8): Result.004 file - promoters50/1027346
aattaaat

SEQ ID NO: 161440 - DNA, 8 bp, Unknown
  misc_feature (1)..( 8): Result.004 file - promoters50/1027346
aatgaaat

SEQ ID NO: 161441 - DNA, 8 bp, Unknown
  misc_feature (1)..( 8): Result.004 file - promoters50/1027346
tgtgaaat

SEQ ID NO: 161442 - DNA, 8 bp, Unknown
  misc_feature (1)..( 8): Result.004 file - promoters50/1027346
attcaaca

SEQ ID NO: 161443 - DNA, 8 bp, Unknown
  misc_feature (1)..( 8): Result.004 file - promoters50/1027346
attaaact

SEQ ID NO: 161444 - DNA, 8 bp, Unknown
  misc_feature (1)..( 8): Result.004 file - promoters50/1027346
attcaact

SEQ ID NO: 161445 - DNA, 9 bp, Unknown
  misc_feature (1)..( 9): Result.004 file - promoters50/1027346
atgtaaaaa

SEQ ID NO: 161446 - DNA, 9 bp, Unknown
  misc_feature (1)..( 9): Result.004 file - promoters50/1027346
atgtgaaat

SEQ ID NO: 161447 - DNA, 9 bp, Unknown
  misc_feature (1)..( 9): Result.004 file - promoters50/1027346
gaatgaaat

SEQ ID NO: 161448 - DNA, 7 bp, Unknown
  misc_feature (1)..( 7): Result.004 file - promoters50/1027346
aatattt

SEQ ID NO: 161449 - DNA, 7 bp, Unknown
  misc_feature (1)..( 7): Result.004 file - promoters50/1027346
aatattt

SEQ ID NO: 161450 - DNA, 7 bp, Unknown
  misc_feature (1)..( 7): Result.004 file - promoters50/1027350
tatcttt

SEQ ID NO: 161451 - DNA, 11 bp, Unknown
  misc_feature (1)..( 11): Result.004 file - promoters50/1027350
aaacaaaatta

SEQ ID NO: 161452 - DNA, 11 bp, Unknown
  misc_feature (1)..( 11): Result.004 file - promoters50/1027350
aaacgaaatta

SEQ ID NO: 161453 - DNA, 11 bp, Unknown
  misc_feature (1)..( 11): Result.004 file - promoters50/1027350
atccaagattc

SEQ ID NO: 161454 - DNA, 11 bp, Unknown
  misc_feature (1)..( 11): Result.004 file - promoters50/1027350
aaacaatgtcc

SEQ ID NO: 161455 - DNA, 15 bp, Unknown
  misc_feature (1)..( 15): Result.004 file - promoters50/1027350
aaaattatacctttt

SEQ ID NO: 161456 - DNA, 15 bp, Unknown
  misc_feature (1)..( 15): Result.004 file - promoters50/1027350
aaaagtatctacact

SEQ ID NO: 161457 - DNA, 15 bp, Unknown
  misc_feature (1)..( 15): Result.004 file - promoters50/1027350
ttcattttacttttt

SEQ ID NO: 161458 - DNA, 15 bp, Unknown
  misc_feature (1)..( 15): Result.004 file - promoters50/1027350
tgtatttttgagtga

SEQ ID NO: 161459 - DNA, 8 bp, Unknown
  misc_feature (1)..( 8): Result.004 file - promoters50/1027350
gttccaat

SEQ ID NO: 161460 - DNA, 8 bp, Unknown
  misc_feature (1)..( 8): Result.004 file - promoters50/1027350
attccaaa

SEQ ID NO: 161461 - DNA, 8 bp, Unknown
  misc_feature (1)..( 8): Result.004 file - promoters50/1027350
tttcgaaa

SEQ ID NO: 161462 - DNA, 8 bp, Unknown
  misc_feature (1)..( 8): Result.004 file - promoters50/1027378
attccacg

SEQ ID NO: 161463 - DNA, 14 bp, Unknown
  misc_feature (1)..( 14): Result.004 file - promoters50/1027378
cttgaatcaatatt

SEQ ID NO: 161464 - DNA, 14 bp, Unknown
  misc_feature (1)..( 14): Result.004 file - promoters50/1027378
gttgaattcatctc

SEQ ID NO: 161465 - DNA, 14 bp, Unknown
  misc_feature (1)..( 14): Result.004 file - promoters50/1027378
attgattcaaaatt

SEQ ID NO: 161466 - DNA, 14 bp, Unknown
  misc_feature (1)..( 14): Result.004 file - promoters50/1027378
gttggattgttgtc

SEQ ID NO: 161467 - DNA, 14 bp, Unknown
  misc_feature (1)..( 14): Result.004 file - promoters50/1027378
gatgattcaataag

SEQ ID NO: 161468 - DNA, 14 bp, Unknown
  misc_feature (1)..( 14): Result.004 file - promoters50/1027378
aatgcttcatgaag

SEQ ID NO: 161469 - DNA, 18 bp, Unknown
  misc_feature (1)..( 18): Result.004 file - promoters50/1027378
ttgaatcaatattttatc

SEQ ID NO: 161470 - DNA, 18 bp, Unknown
  misc_feature (1)..( 18): Result.004 file - promoters50/1027378
acatatgaatatgttaaa

SEQ ID NO: 161471 - DNA, 18 bp, Unknown
  misc_feature (1)..( 18): Result.004 file - promoters50/1027378
atatatatatatttaaaa

SEQ ID NO: 161472 - DNA, 18 bp, Unknown
  misc_feature (1)..( 18): Result.004 file - promoters50/1027378
ttgattcaaaattctcta

SEQ ID NO: 161473 - DNA, 18 bp, Unknown
  misc_feature (1)..( 18): Result.004 file - promoters50/1027378
aagagtttgtattcaaat

SEQ ID NO: 161474 - DNA, 18 bp, Unknown
  misc_feature (1)..( 18): Result.004 file - promoters50/1027378
ttaacggatgattcaata

SEQ ID NO: 161475 - DNA, 18 bp, Unknown
  misc_feature (1)..( 18): Result.004 file - promoters50/1027399
tcatctgaaaaatcaaat

SEQ ID NO: 161476 - DNA, 14 bp, Unknown
  misc_feature (1)..( 14): Result.004 file - promoters50/1027399
ggtgatttttctat

SEQ ID NO: 161477 - DNA, 14 bp, Unknown
  misc_feature (1)..( 14): Result.004 file - promoters50/1027399
caattattttctta

SEQ ID NO: 161478 - DNA, 14 bp, Unknown
  misc_feature (1)..( 14): Result.004 file - promoters50/1027399
attttgttttctaa

SEQ ID NO: 161479 - DNA, 14 bp, Unknown
  misc_feature (1)..( 14): Result.004 file - promoters50/1027399
ataatatattcttg

SEQ ID NO: 161480 - DNA, 14 bp, Unknown
  misc_feature (1)..( 14): Result.004 file - promoters50/1027399
ataatatatgtaat

SEQ ID NO: 161481 - DNA, 14 bp, Unknown
  misc_feature (1)..( 14): Result.004 file - promoters50/1027399
atcttctatgcttg

SEQ ID NO: 161482 - DNA, 13 bp, Unknown
  misc_feature (1)..( 13): Result.004 file - promoters50/1027399
ttatatagaattg

SEQ ID NO: 161483 - DNA, 13 bp, Unknown
  misc_feature (1)..( 13): Result.004 file - promoters50/1027399
atttatagaatta

SEQ ID NO: 161484 - DNA, 13 bp, Unknown
  misc_feature (1)..( 13): Result.004 file - promoters50/1027399
aaagatagtattg

SEQ ID NO: 161485 - DNA, 13 bp, Unknown
  misc_feature (1)..( 13): Result.004 file - promoters50/1027399
ttacatagtaaca

SEQ ID NO: 161486 - DNA, 13 bp, Unknown
  misc_feature (1)..( 13): Result.004 file - promoters50/1027399
cgttatacaatat

SEQ ID NO: 161487 - DNA, 13 bp, Unknown
  misc_feature (1)..( 13): Result.004 file - promoters50/1027399
atttgtagtgaat

SEQ ID NO: 161488 - DNA, 13 bp, Unknown
  misc_feature (1)..( 13): Result.004 file - promoters50/1027399
tcatctatgtaaa

SEQ ID NO: 161489 - DNA, 13 bp, Unknown
  misc_feature (1)..( 13): Result.004 file - promoters50/1027399
aaaaatatataaa

SEQ ID NO: 161490 - DNA, 13 bp, Unknown
  misc_feature (1)..( 13): Result.004 file - promoters50/1027399
agtttaatacaaa

SEQ ID NO: 161491 - DNA, 13 bp, Unknown
  misc_feature (1)..( 13): Result.004 file - promoters50/1027399
agaaatatatata

SEQ ID NO: 161492 - DNA, 13 bp, Unknown
  misc_feature (1)..( 13): Result.004 file - promoters50/1027399
agaaagatagtat

SEQ ID NO: 161493 - DNA, 13 bp, Unknown
  misc_feature (1)..( 13): Result.004 file - promoters50/1027406
tttacgatataat

SEQ ID NO: 161494 - DNA, 16 bp, Unknown
  misc_feature (1)..( 16): Result.004 file - promoters50/1027406
cgataaaagctaatgt

SEQ ID NO: 161495 - DNA, 16 bp, Unknown
  misc_feature (1)..( 16): Result.004 file - promoters50/1027406
tttaaaaaactatata

SEQ ID NO: 161496 - DNA, 17 bp, Unknown
  misc_feature (1)..( 17): Result.004 file - promoters50/1027406
ttttaagaaagtatata

SEQ ID NO: 161497 - DNA, 17 bp, Unknown
  misc_feature (1)..( 17): Result.004 file - promoters50/1027406
tattattattctaagtt

SEQ ID NO: 161498 - DNA, 17 bp, Unknown
  misc_feature (1)..( 17): Result.004 file - promoters50/1027406
acatgaggttttaagga

SEQ ID NO: 161499 - DNA, 17 bp, Unknown
  misc_feature (1)..( 17): Result.004 file - promoters50/1027406
tagaaagaaatcataaa

SEQ ID NO: 161500 - DNA, 9 bp, Unknown
  misc_feature (1)..( 9): Result.004 file - promoters50/1027406
gtttttgaa

SEQ ID NO: 161501 - DNA, 9 bp, Unknown
  misc_feature (1)..( 9): Result.004 file - promoters50/1027406
ttttttgcc

SEQ ID NO: 161502 - DNA, 9 bp, Unknown
  misc_feature (1)..( 9): Result.004 file - promoters50/1027406
aattttgaa

SEQ ID NO: 161503 - DNA, 10 bp, Unknown
  misc_feature (1)..( 10): Result.004 file - promoters50/1027406
cttttctgcc

SEQ ID NO: 161504 - DNA, 10 bp, Unknown
  misc_feature (1)..( 10): Result.004 file - promoters50/1027406
agtttttgaa

SEQ ID NO: 161505 - DNA, 10 bp, Unknown
  misc_feature (1)..( 10): Result.004 file - promoters50/1027406
taatattggt

SEQ ID NO: 161506 - DNA, 10 bp, Unknown
  misc_feature (1)..( 10): Result.004 file - promoters50/1027406
ggattttaag

SEQ ID NO: 161507 - DNA, 10 bp, Unknown
  misc_feature (1)..( 10): Result.004 file - promoters50/1027406
atgttttaat

SEQ ID NO: 161508 - DNA, 10 bp, Unknown
  misc_feature (1)..( 10): Result.004 file - promoters50/1027406
gtattttact

SEQ ID NO: 161509 - DNA, 11 bp, Unknown
  misc_feature (1)..( 11): Result.004 file - promoters50/1027406
ttgtctttaag

SEQ ID NO: 161510 - DNA, 10 bp, Unknown
  misc_feature (1)..( 10): Result.004 file - promoters50/1027406
atgttgtaag

SEQ ID NO: 161511 - DNA, 10 bp, Unknown
  misc_feature (1)..( 10): Result.004 file - promoters50/1027406
aatttttacc

SEQ ID NO: 161512 - DNA, 11 bp, Unknown
  misc_feature (1)..( 11): Result.004 file - promoters50/1027406
aaattcttata

SEQ ID NO: 161513 - DNA, 16 bp, Unknown
  misc_feature (1)..( 16): Result.004 file - promoters50/1027406
tttgaaattggtagag

SEQ ID NO: 161514 - DNA, 16 bp, Unknown
  misc_feature (1)..( 16): Result.004 file - promoters50/1027406
cttgtaatacccagta

SEQ ID NO: 161515 - DNA, 17 bp, Unknown
  misc_feature (1)..( 17): Result.004 file - promoters50/1027406
attagaacttgggagaa

SEQ ID NO: 161516 - DNA, 17 bp, Unknown
  misc_feature (1)..( 17): Result.004 file - promoters50/1027406
tttagaaaatgggattt

SEQ ID NO: 161517 - DNA, 17 bp, Unknown
  misc_feature (1)..( 17): Result.004 file - promoters50/1027406
atcagaaaattacattt

SEQ ID NO: 161518 - DNA, 17 bp, Unknown
  misc_feature (1)..( 17): Result.004 file - promoters50/1027406
gaaccaaaatcggattt

SEQ ID NO: 161519 - DNA, 12 bp, Unknown
  misc_feature (1)..( 12): Result.004 file - promoters50/1027406
ttcgataaaagc

SEQ ID NO: 161520 - DNA, 12 bp, Unknown
  misc_feature (1)..( 12): Result.004 file - promoters50/1027406
aaggataaatta

SEQ ID NO: 161521 - DNA, 12 bp, Unknown
  misc_feature (1)..( 12): Result.004 file - promoters50/1027406
gtatataaaata

SEQ ID NO: 161522 - DNA, 12 bp, Unknown
  misc_feature (1)..( 12): Result.004 file - promoters50/1027406
aactatatatta

SEQ ID NO: 161523 - DNA, 12 bp, Unknown
  misc_feature (1)..( 12): Result.004 file - promoters50/1027406
ctagatagtcac

SEQ ID NO: 161524 - DNA, 12 bp, Unknown
  misc_feature (1)..( 12): Result.004 file - promoters50/1027406
ctatataatgaa

SEQ ID NO: 161525 - DNA, 12 bp, Unknown
  misc_feature (1)..( 12): Result.004 file - promoters50/1027406
attacaacaaaa

SEQ ID NO: 161526 - DNA, 12 bp, Unknown
  misc_feature (1)..( 12): Result.004 file - promoters50/1027406
tattcaaaaaaa

SEQ ID NO: 161527 - DNA, 12 bp, Unknown
  misc_feature (1)..( 12): Result.004 file - promoters50/1027406
tttagaacatct

SEQ ID NO: 161528 - DNA, 12 bp, Unknown
  misc_feature (1)..( 12): Result.004 file - promoters50/1027406
ttatacacaaaa

SEQ ID NO: 161529 - DNA, 12 bp, Unknown
  misc_feature (1)..( 12): Result.004 file - promoters50/1027406
tatacaacaatt

SEQ ID NO: 161530 - DNA, 12 bp, Unknown
  misc_feature (1)..( 12): Result.004 file - promoters50/1027406
tttagagtgaca

SEQ ID NO: 161531 - DNA, 12 bp, Unknown
  misc_feature (1)..( 12): Result.004 file - promoters50/1027406
aatacaaactgt

SEQ ID NO: 161532 - DNA, 14 bp, Unknown
  misc_feature (1)..( 14): Result.004 file - promoters50/1027406
cgacatttttttct

SEQ ID NO: 161533 - DNA, 14 bp, Unknown
  misc_feature (1)..( 14): Result.004 file - promoters50/1027406
aaagatttttctga

SEQ ID NO: 161534 - DNA, 15 bp, Unknown
  misc_feature (1)..( 15): Result.004 file - promoters50/1027406
ataaattcttttctt

SEQ ID NO: 161535 - DNA, 15 bp, Unknown
  misc_feature (1)..( 15): Result.004 file - promoters50/1027406
tattattattctaag

SEQ ID NO: 161536 - DNA, 15 bp, Unknown
  misc_feature (1)..( 15): Result.004 file - promoters50/1027406
tccaattttaagaaa

SEQ ID NO: 161537 - DNA, 15 bp, Unknown
  misc_feature (1)..( 15): Result.004 file - promoters50/1027452
ccaaatttggtgaat

SEQ ID NO: 161538 - DNA, 11 bp, Unknown
  misc_feature (1)..( 11): Result.004 file - promoters50/1027452
taatttcttaa

SEQ ID NO: 161539 - DNA, 11 bp, Unknown
  misc_feature (1)..( 11): Result.004 file - promoters50/1027452
taatttaaccc

SEQ ID NO: 161540 - DNA, 11 bp, Unknown
  misc_feature (1)..( 11): Result.004 file - promoters50/1027452
aaatttcgtaa

SEQ ID NO: 161541 - DNA, 11 bp, Unknown
  misc_feature (1)..( 11): Result.004 file - promoters50/1027456
tgattgcgtct

SEQ ID NO: 161542 - DNA, 10 bp, Unknown
  misc_feature (1)..( 10): Result.004 file - promoters50/1027456
ttaatttctg

SEQ ID NO: 161543 - DNA, 10 bp, Unknown
  misc_feature (1)..( 10): Result.004 file - promoters50/1027456
ttattttctt

SEQ ID NO: 161544 - DNA, 10 bp, Unknown
  misc_feature (1)..( 10): Result.004 file - promoters50/1027456
ataaattcat

SEQ ID NO: 161545 - DNA, 10 bp, Unknown
  misc_feature (1)..( 10): Result.004 file - promoters50/1027456
taaatttcga

SEQ ID NO: 161546 - DNA, 10 bp, Unknown
  misc_feature (1)..( 10): Result.004 file - promoters50/1027456
aatctttctt

SEQ ID NO: 161547 - DNA, 10 bp, Unknown
  misc_feature (1)..( 10): Result.004 file - promoters50/1027456
aaaaattcaa

SEQ ID NO: 161548 - DNA, 9 bp, Unknown
  misc_feature (1)..( 9): Result.004 file - promoters50/1027456
aaaatcaaa

SEQ ID NO: 161549 - DNA, 9 bp, Unknown
  misc_feature (1)..( 9): Result.004 file - promoters50/1027456
taaaacaat

SEQ ID NO: 161550 - DNA, 10 bp, Unknown
  misc_feature (1)..( 10): Result.004 file - promoters50/1027456
taaattcatt

SEQ ID NO: 161551 - DNA, 10 bp, Unknown
  misc_feature (1)..( 10): Result.004 file - promoters50/1027456
aaaattcaaa

SEQ ID NO: 161552 - DNA, 10 bp, Unknown
  misc_feature (1)..( 10): Result.004 file - promoters50/1027456
aaaaaacaat

SEQ ID NO: 161553 - DNA, 10 bp, Unknown
  misc_feature (1)..( 10): Result.004 file - promoters50/1027460
taaatttcga

SEQ ID NO: 161554 - DNA, 13 bp, Unknown
  misc_feature (1)..( 13): Result.004 file - promoters50/1027460
tgaagaatatatc

SEQ ID NO: 161555 - DNA, 13 bp, Unknown
  misc_feature (1)..( 13): Result.004 file - promoters50/1027460
ttttgaatctata

SEQ ID NO: 161556 - DNA, 13 bp, Unknown
  misc_feature (1)..( 13): Result.004 file - promoters50/1027460
agaaaaatatatc

SEQ ID NO: 161557 - DNA, 13 bp, Unknown
  misc_feature (1)..( 13): Result.004 file - promoters50/1027460
acattaatataaa

SEQ ID NO: 161558 - DNA, 13 bp, Unknown
  misc_feature (1)..( 13): Result.004 file - promoters50/1027460
actaaaataactc

SEQ ID NO: 161559 - DNA, 13 bp, Unknown
  misc_feature (1)..( 13): Result.004 file - promoters50/1027460
ggaaaaaaaaatt

SEQ ID NO: 161560 - DNA, 13 bp, Unknown
  misc_feature (1)..( 13): Result.004 file - promoters50/1027460
actgaaattttag

SEQ ID NO: 161561 - DNA, 11 bp, Unknown
  misc_feature (1)..( 11): Result.004 file - promoters50/1027460
taaaatatgat

SEQ ID NO: 161562 - DNA, 11 bp, Unknown
  misc_feature (1)..( 11): Result.004 file - promoters50/1027460
aaaaataaagt

SEQ ID NO: 161563 - DNA, 11 bp, Unknown
  misc_feature (1)..( 11): Result.004 file - promoters50/1027460
taaaagatgat

SEQ ID NO: 161564 - DNA, 11 bp, Unknown
  misc_feature (1)..( 11): Result.004 file - promoters50/1027460
aaaaatagttg

SEQ ID NO: 161565 - DNA, 11 bp, Unknown
  misc_feature (1)..( 11): Result.004 file - promoters50/1027460
taaaataaaaa

SEQ ID NO: 161566 - DNA, 11 bp, Unknown
  misc_feature (1)..( 11): Result.004 file - promoters50/1027460
acaaatagtct

SEQ ID NO: 161567 - DNA, 13 bp, Unknown
  misc_feature (1)..( 13): Result.004 file - promoters50/1027460
cccaaaaacataa

SEQ ID NO: 161568 - DNA, 13 bp, Unknown
  misc_feature (1)..( 13): Result.004 file - promoters50/1027460
tttaaatacaatt

SEQ ID NO: 161569 - DNA, 13 bp, Unknown
  misc_feature (1)..( 13): Result.004 file - promoters50/1027460
gacaaaaatattt

SEQ ID NO: 161570 - DNA, 13 bp, Unknown
  misc_feature (1)..( 13): Result.004 file - promoters50/1027460
cccaaaaaataat

SEQ ID NO: 161571 - DNA, 13 bp, Unknown
  misc_feature (1)..( 13): Result.004 file - promoters50/1027460
aggaaaaatagta

SEQ ID NO: 161572 - DNA, 13 bp, Unknown
  misc_feature (1)..( 13): Result.004 file - promoters50/1027467
acggtatataatt

SEQ ID NO: 161573 - DNA, 6 bp, Unknown
  misc_feature (1)..( 6): Result.004 file - promoters50/1027467
tgtaaa

SEQ ID NO: 161574 - DNA, 6 bp, Unknown
  misc_feature (1)..( 6): Result.004 file - promoters50/1027467
tgtaaa

SEQ ID NO: 161575 - DNA, 7 bp, Unknown
  misc_feature (1)..( 7): Result.004 file - promoters50/1027467
tgtcaaa

SEQ ID NO: 161576 - DNA, 8 bp, Unknown
  misc_feature (1)..( 8): Result.004 file - promoters50/1027467
tgtaaaaa

SEQ ID NO: 161577 - DNA, 8 bp, Unknown
  misc_feature (1)..( 8): Result.004 file - promoters50/1027467
attaaaaa

SEQ ID NO: 161578 - DNA, 8 bp, Unknown
  misc_feature (1)..( 8): Result.004 file - promoters50/1027492
tgtcaaac

SEQ ID NO: 161579 - DNA, 21 bp, Unknown
  misc_feature (1)..( 21): Result.004 file - promoters50/1027492
tcagtatataaatcccttaaa

SEQ ID NO: 161580 - DNA, 21 bp, Unknown
  misc_feature (1)..( 21): Result.004 file - promoters50/1027492
tcttataaataatctcttaaa

SEQ ID NO: 161581 - DNA, 21 bp, Unknown
  misc_feature (1)..( 21): Result.004 file - promoters50/1027492
cttatttatgaatccatataa

SEQ ID NO: 161582 - DNA, 21 bp, Unknown
  misc_feature (1)..( 21): Result.004 file - promoters50/1027492
ccgttatataaatccttcact

SEQ ID NO: 161583 - DNA, 21 bp, Unknown
  misc_feature (1)..( 21): Result.004 file - promoters50/1027492
gttttatactcacagtcaaag

SEQ ID NO: 161584 - DNA, 21 bp, Unknown
  misc_feature (1)..( 21): Result.004 file - promoters50/1027523
tatttatatagataagcaatt

SEQ ID NO: 161585 - DNA, 10 bp, Unknown
  misc_feature (1)..( 10): Result.004 file - promoters50/1027523
ttttcatata

SEQ ID NO: 161586 - DNA, 10 bp, Unknown
  misc_feature (1)..( 10): Result.004 file - promoters50/1027523
ctttcttata

SEQ ID NO: 161587 - DNA, 10 bp, Unknown
  misc_feature (1)..( 10): Result.004 file - promoters50/1027590
ttttaataag

SEQ ID NO: 161588 - DNA, 11 bp, Unknown
  misc_feature (1)..( 11): Result.004 file - promoters50/1027590
tatatttttaa

SEQ ID NO: 161589 - DNA, 11 bp, Unknown
  misc_feature (1)..( 11): Result.004 file - promoters50/1027590
gtgattttttt

SEQ ID NO: 161590 - DNA, 11 bp, Unknown
  misc_feature (1)..( 11): Result.004 file - promoters50/1027590
ataatttaatc

SEQ ID NO: 161591 - DNA, 11 bp, Unknown
  misc_feature (1)..( 11): Result.004 file - promoters50/1027590
atgctttttaa

SEQ ID NO: 161592 - DNA, 12 bp, Unknown
  misc_feature (1)..( 12): Result.004 file - promoters50/1027590
gagattctttgg

SEQ ID NO: 161593 - DNA, 12 bp, Unknown
  misc_feature (1)..( 12): Result.004 file - promoters50/1027590
taaatctttgtt

SEQ ID NO: 161594 - DNA, 14 bp, Unknown
  misc_feature (1)..( 14): Result.004 file - promoters50/1027590
aacattagtagaaa

SEQ ID NO: 161595 - DNA, 14 bp, Unknown
  misc_feature (1)..( 14): Result.004 file - promoters50/1027590
gtttttagtaaacc

SEQ ID NO: 161596 - DNA, 14 bp, Unknown
  misc_feature (1)..( 14): Result.004 file - promoters50/1027590
tatttttgtatcaa

SEQ ID NO: 161597 - DNA, 14 bp, Unknown
  misc_feature (1)..( 14): Result.004 file - promoters50/1027590
tattttttgtatcc

SEQ ID NO: 161598 - DNA, 14 bp, Unknown
  misc_feature (1)..( 14): Result.004 file - promoters50/1027590
tagtttataggaaa

SEQ ID NO: 161599 - DNA, 14 bp, Unknown
  misc_feature (1)..( 14): Result.004 file - promoters50/1027596
cagtttattatgat

SEQ ID NO: 161600 - DNA, 13 bp, Unknown
  misc_feature (1)..( 13): Result.004 file - promoters50/1027596
ttactttctttga

SEQ ID NO: 161601 - DNA, 13 bp, Unknown
  misc_feature (1)..( 13): Result.004 file - promoters50/1027596
tatttttgttttc

SEQ ID NO: 161602 - DNA, 13 bp, Unknown
  misc_feature (1)..( 13): Result.004 file - promoters50/1027596
aaactttctggga

SEQ ID NO: 161603 - DNA, 13 bp, Unknown
  misc_feature (1)..( 13): Result.004 file - promoters50/1027596
ttattttctttat

SEQ ID NO: 161604 - DNA, 13 bp, Unknown
  misc_feature (1)..( 13): Result.004 file - promoters50/1027596
cgattctcttact

SEQ ID NO: 161605 - DNA, 13 bp, Unknown
  misc_feature (1)..( 13): Result.004 file - promoters50/1027596
attcttcctggga

SEQ ID NO: 161606 - DNA, 13 bp, Unknown
  misc_feature (1)..( 13): Result.004 file - promoters50/1027596
ttactttctggca

SEQ ID NO: 161607 - DNA, 11 bp, Unknown
  misc_feature (1)..( 11): Result.004 file - promoters50/1027596
gattagaaaca

SEQ ID NO: 161608 - DNA, 11 bp, Unknown
  misc_feature (1)..( 11): Result.004 file - promoters50/1027596
aatttgaaaca

SEQ ID NO: 161609 - DNA, 11 bp, Unknown
  misc_feature (1)..( 11): Result.004 file - promoters50/1027596
cattcgaaaac

SEQ ID NO: 161610 - DNA, 11 bp, Unknown
  misc_feature (1)..( 11): Result.004 file - promoters50/1027596
aatttgggcct

SEQ ID NO: 161611 - DNA, 11 bp, Unknown
  misc_feature (1)..( 11): Result.004 file - promoters50/1027596
cgattgaaata

SEQ ID NO: 161612 - DNA, 11 bp, Unknown
  misc_feature (1)..( 11): Result.004 file - promoters50/1027652
catttgatgaa

SEQ ID NO: 161613 - DNA, 10 bp, Unknown
  misc_feature (1)..( 10): Result.004 file - promoters50/1027652
atcaattaat

SEQ ID NO: 161614 - DNA, 10 bp, Unknown
  misc_feature (1)..( 10): Result.004 file - promoters50/1027652
cacaactaat

SEQ ID NO: 161615 - DNA, 10 bp, Unknown
  misc_feature (1)..( 10): Result.004 file - promoters50/1027652
atcaattgta

SEQ ID NO: 161616 - DNA, 10 bp, Unknown
  misc_feature (1)..( 10): Result.004 file - promoters50/1027652
atttactaat

SEQ ID NO: 161617 - DNA, 10 bp, Unknown
  misc_feature (1)..( 10): Result.004 file - promoters50/1027652
aattattaaa

SEQ ID NO: 161618 - DNA, 9 bp, Unknown
  misc_feature (1)..( 9): Result.004 file - promoters50/1027652
ttaagaaaa

SEQ ID NO: 161619 - DNA, 9 bp, Unknown
  misc_feature (1)..( 9): Result.004 file - promoters50/1027652
ttaagaagc

SEQ ID NO: 161620 - DNA, 9 bp, Unknown
  misc_feature (1)..( 9): Result.004 file - promoters50/1027652
ataaaaaaa

SEQ ID NO: 161621 - DNA, 9 bp, Unknown
  misc_feature (1)..( 9): Result.004 file - promoters50/1027652
caaaggaaa

SEQ ID NO: 161622 - DNA, 9 bp, Unknown
  misc_feature (1)..( 9): Result.004 file - promoters50/1027652
tcaaaaaag

SEQ ID NO: 161623 - DNA, 12 bp, Unknown
  misc_feature (1)..( 12): Result.004 file - promoters50/1027652
acaaattcaaat

SEQ ID NO: 161624 - DNA, 12 bp, Unknown
  misc_feature (1)..( 12): Result.004 file - promoters50/1027652
acatatttctaa

SEQ ID NO: 161625 - DNA, 12 bp, Unknown
  misc_feature (1)..( 12): Result.004 file - promoters50/1027652
ctaaattcctat

SEQ ID NO: 161626 - DNA, 12 bp, Unknown
  misc_feature (1)..( 12): Result.004 file - promoters50/1027652
tcaaattcgaat

SEQ ID NO: 161627 - DNA, 12 bp, Unknown
  misc_feature (1)..( 12): Result.004 file - promoters50/1027652
ccaaaatatctc

SEQ ID NO: 161628 - DNA, 12 bp, Unknown
  misc_feature (1)..( 12): Result.004 file - promoters50/1027652
tcaaagtccaca

SEQ ID NO: 161629 - DNA, 11 bp, Unknown
  misc_feature (1)..( 11): Result.004 file - promoters50/1027652
aaaaattattt

SEQ ID NO: 161630 - DNA, 11 bp, Unknown
  misc_feature (1)..( 11): Result.004 file - promoters50/1027652
aaaaattaagg

SEQ ID NO: 161631 - DNA, 11 bp, Unknown
  misc_feature (1)..( 11): Result.004 file - promoters50/1027652
caaaatcaaga

SEQ ID NO: 161632 - DNA, 11 bp, Unknown
  misc_feature (1)..( 11): Result.004 file - promoters50/1027652
ttagatctaga

SEQ ID NO: 161633 - DNA, 11 bp, Unknown
  misc_feature (1)..( 11): Result.004 file - promoters50/1027725
gtaaattattg

SEQ ID NO: 161634 - DNA, 10 bp, Unknown
  misc_feature (1)..( 10): Result.004 file - promoters50/1027725
ttgttttatt

SEQ ID NO: 161635 - DNA, 10 bp, Unknown
  misc_feature (1)..( 10): Result.004 file - promoters50/1027725
atgtttttgc

SEQ ID NO: 161636 - DNA, 10 bp, Unknown
  misc_feature (1)..( 10): Result.004 file - promoters50/1027725
gcgtttgatt

SEQ ID NO: 161637 - DNA, 11 bp, Unknown
  misc_feature (1)..( 11): Result.004 file - promoters50/1027725
ttgtatttgga

SEQ ID NO: 161638 - DNA, 11 bp, Unknown
  misc_feature (1)..( 11): Result.004 file - promoters50/1027725
ttggattaatg

SEQ ID NO: 161639 - DNA, 11 bp, Unknown
  misc_feature (1)..( 11): Result.004 file - promoters50/1027725
ttggatagctt

SEQ ID NO: 161640 - DNA, 14 bp, Unknown
  misc_feature (1)..( 14): Result.004 file - promoters50/1027725
atagtagaatagct

SEQ ID NO: 161641 - DNA, 14 bp, Unknown
  misc_feature (1)..( 14): Result.004 file - promoters50/1027725
atagaagaaacaaa

SEQ ID NO: 161642 - DNA, 14 bp, Unknown
  misc_feature (1)..( 14): Result.004 file - promoters50/1027725
gttgtataatttta

SEQ ID NO: 161643 - DNA, 14 bp, Unknown
  misc_feature (1)..( 14): Result.004 file - promoters50/1027725
agttaataaaagtt

SEQ ID NO: 161644 - DNA, 14 bp, Unknown
  misc_feature (1)..( 14): Result.004 file - promoters50/1027725
gagttttaacagtt

SEQ ID NO: 161645 - DNA, 14 bp, Unknown
  misc_feature (1)..( 14): Result.004 file - promoters50/1027725
tttagataaatttg

SEQ ID NO: 161646 - DNA, 14 bp, Unknown
  misc_feature (1)..( 14): Result.004 file - promoters50/1027725
gagacctaagttta

SEQ ID NO: 161647 - DNA, 14 bp, Unknown
  misc_feature (1)..( 14): Result.004 file - promoters50/1027760
atgacataaatttt

SEQ ID NO: 161648 - DNA, 14 bp, Unknown
  misc_feature (1)..( 14): Result.004 file - promoters50/1027760
ataaatgaaatttc

SEQ ID NO: 161649 - DNA, 14 bp, Unknown
  misc_feature (1)..( 14): Result.004 file - promoters50/1027760
ataactgagattga

SEQ ID NO: 161650 - DNA, 14 bp, Unknown
  misc_feature (1)..( 14): Result.004 file - promoters50/1027760
atacatgaatttag

SEQ ID NO: 161651 - DNA, 14 bp, Unknown
  misc_feature (1)..( 14): Result.004 file - promoters50/1027760
agagtcaaaatttc

SEQ ID NO: 161652 - DNA, 14 bp, Unknown
  misc_feature (1)..( 14): Result.004 file - promoters50/1027760
atacttcagaacac

SEQ ID NO: 161653 - DNA, 14 bp, Unknown
  misc_feature (1)..( 14): Result.004 file - promoters50/1027760
atagctgaaaacga

SEQ ID NO: 161654 - DNA, 12 bp, Unknown
  misc_feature (1)..( 12): Result.004 file - promoters50/1027760
atctcactttta

SEQ ID NO: 161655 - DNA, 12 bp, Unknown
  misc_feature (1)..( 12): Result.004 file - promoters50/1027760
atatcatttttc

SEQ ID NO: 161656 - DNA, 12 bp, Unknown
  misc_feature (1)..( 12): Result.004 file - promoters50/1027760
ctttcattcctt

SEQ ID NO: 161657 - DNA, 12 bp, Unknown
  misc_feature (1)..( 12): Result.004 file - promoters50/1027760
ttttcatccaca

SEQ ID NO: 161658 - DNA, 12 bp, Unknown
  misc_feature (1)..( 12): Result.004 file - promoters50/1027760
aaaccattttgg

SEQ ID NO: 161659 - DNA, 12 bp, Unknown
  misc_feature (1)..( 12): Result.004 file - promoters50/1027760
ttagcgtttttc

SEQ ID NO: 161660 - DNA, 14 bp, Unknown
  misc_feature (1)..( 14): Result.004 file - promoters50/1027760
catattttgtaaat

SEQ ID NO: 161661 - DNA, 14 bp, Unknown
  misc_feature (1)..( 14): Result.004 file - promoters50/1027760
aataatttacgaaa

SEQ ID NO: 161662 - DNA, 14 bp, Unknown
  misc_feature (1)..( 14): Result.004 file - promoters50/1027760
cttaagttactacc

SEQ ID NO: 161663 - DNA, 14 bp, Unknown
  misc_feature (1)..( 14): Result.004 file - promoters50/1027760
aatagtttactatt

SEQ ID NO: 161664 - DNA, 15 bp, Unknown
  misc_feature (1)..( 15): Result.004 file - promoters50/1027760
tttaatgttactaat

SEQ ID NO: 161665 - DNA, 15 bp, Unknown
  misc_feature (1)..( 15): Result.004 file - promoters50/1027762
tttattgttacaaat

SEQ ID NO: 161666 - DNA, 8 bp, Unknown
  misc_feature (1)..( 8): Result.004 file - promoters50/1027762
ttgttttg

SEQ ID NO: 161667 - DNA, 8 bp, Unknown
  misc_feature (1)..( 8): Result.004 file - promoters50/1027762
aagttttg

SEQ ID NO: 161668 - DNA, 8 bp, Unknown
  misc_feature (1)..( 8): Result.004 file - promoters50/1027762
ttgattta

SEQ ID NO: 161669 - DNA, 8 bp, Unknown
  misc_feature (1)..( 8): Result.004 file - promoters50/1027762
aattaaaa

SEQ ID NO: 161670 - DNA, 8 bp, Unknown
  misc_feature (1)..( 8): Result.004 file - promoters50/1027762
aataaaaa

SEQ ID NO: 161671 - DNA, 8 bp, Unknown
  misc_feature (1)..( 8): Result.004 file - promoters50/1027762
tataaaat

SEQ ID NO: 161672 - DNA, 7 bp, Unknown
  misc_feature (1)..( 7): Result.004 file - promoters50/1027762
agtaaaa

SEQ ID NO: 161673 - DNA, 7 bp, Unknown
  misc_feature (1)..( 7): Result.004 file - promoters50/1027762
agtaaaa

SEQ ID NO: 161674 - DNA, 7 bp, Unknown
  misc_feature (1)..( 7): Result.004 file - promoters50/1027765
agtaaaa

SEQ ID NO: 161675 - DNA, 9 bp, Unknown
  misc_feature (1)..( 9): Result.004 file - promoters50/1027765
aattacaaa

SEQ ID NO: 161676 - DNA, 9 bp, Unknown
  misc_feature (1)..( 9): Result.004 file - promoters50/1027765
cgttagaaa

SEQ ID NO: 161677 - DNA, 9 bp, Unknown
  misc_feature (1)..( 9): Result.004 file - promoters50/1027765
ccttataaa

SEQ ID NO: 161678 - DNA, 9 bp, Unknown
  misc_feature (1)..( 9): Result.004 file - promoters50/1027765
aaatacaac

SEQ ID NO: 161679 - DNA, 9 bp, Unknown
  misc_feature (1)..( 9): Result.004 file - promoters50/1027765
aaaaacaat

SEQ ID NO: 161680 - DNA, 9 bp, Unknown
  misc_feature (1)..( 9): Result.004 file - promoters50/1027765
tcaaaaaaa

SEQ ID NO: 161681 - DNA, 12 bp, Unknown
  misc_feature (1)..( 12): Result.004 file - promoters50/1027765
ctctaaaaattg

SEQ ID NO: 161682 - DNA, 12 bp, Unknown
  misc_feature (1)..( 12): Result.004 file - promoters50/1027765
aaataaaaattg

SEQ ID NO: 161683 - DNA, 12 bp, Unknown
  misc_feature (1)..( 12): Result.004 file - promoters50/1027765
cattaataatcc

SEQ ID NO: 161684 - DNA, 12 bp, Unknown
  misc_feature (1)..( 12): Result.004 file - promoters50/1027765
ttttaaaaactt

SEQ ID NO: 161685 - DNA, 12 bp, Unknown
  misc_feature (1)..( 12): Result.004 file - promoters50/1027765
gaataaaaaaat

SEQ ID NO: 161686 - DNA, 12 bp, Unknown
  misc_feature (1)..( 12): Result.004 file - promoters50/1027850
aaaaaaaaatat

SEQ ID NO: 161687 - DNA, 16 bp, Unknown
  misc_feature (1)..( 16): Result.004 file - promoters50/1027850
tcgcttctgaacacgg

SEQ ID NO: 161688 - DNA, 16 bp, Unknown
  misc_feature (1)..( 16): Result.004 file - promoters50/1027850
tcgattctgattggag

SEQ ID NO: 161689 - DNA, 16 bp, Unknown
  misc_feature (1)..( 16): Result.004 file - promoters50/1027850
cggcttctgatgagaa

SEQ ID NO: 161690 - DNA, 16 bp, Unknown
  misc_feature (1)..( 16): Result.004 file - promoters50/1027850
cttgctctaattgctt

SEQ ID NO: 161691 - DNA, 16 bp, Unknown
  misc_feature (1)..( 16): Result.004 file - promoters50/1027850
aggatcttaaatgctt

SEQ ID NO: 161692 - DNA, 16 bp, Unknown
  misc_feature (1)..( 16): Result.004 file - promoters50/1027869
tatgatctgattttaa

SEQ ID NO: 161693 - DNA, 16 bp, Unknown
  misc_feature (1)..( 16): Result.004 file - promoters50/1027869
atcgtttacatcaaat

SEQ ID NO: 161694 - DNA, 16 bp, Unknown
  misc_feature (1)..( 16): Result.004 file - promoters50/1027869
atctttttataattta

SEQ ID NO: 161695 - DNA, 16 bp, Unknown
  misc_feature (1)..( 16): Result.004 file - promoters50/1027869
ctcgtctactccttgt

SEQ ID NO: 161696 - DNA, 16 bp, Unknown
  misc_feature (1)..( 16): Result.004 file - promoters50/1027869
ttcttttatttttctt

SEQ ID NO: 161697 - DNA, 16 bp, Unknown
  misc_feature (1)..( 16): Result.004 file - promoters50/1027869
gcattttcttatttta

SEQ ID NO: 161698 - DNA, 9 bp, Unknown
  misc_feature (1)..( 9): Result.004 file - promoters50/1027869
aatttatta

SEQ ID NO: 161699 - DNA, 9 bp, Unknown
  misc_feature (1)..( 9): Result.004 file - promoters50/1027869
atattatta

SEQ ID NO: 161700 - DNA, 9 bp, Unknown
  misc_feature (1)..( 9): Result.004 file - promoters50/1027869
attttctta

SEQ ID NO: 161701 - DNA, 9 bp, Unknown
  misc_feature (1)..( 9): Result.004 file - promoters50/1027873
attttctat

SEQ ID NO: 161702 - DNA, 7 bp, Unknown
  misc_feature (1)..( 7): Result.004 file - promoters50/1027873
ttttggt

SEQ ID NO: 161703 - DNA, 7 bp, Unknown
  misc_feature (1)..( 7): Result.004 file - promoters50/1027873
ttttgga

SEQ ID NO: 161704 - DNA, 7 bp, Unknown
  misc_feature (1)..( 7): Result.004 file - promoters50/1027873
ttttggt

SEQ ID NO: 161705 - DNA, 7 bp, Unknown
  misc_feature (1)..( 7): Result.004 file - promoters50/1027873
ttttggg

SEQ ID NO: 161706 - DNA, 13 bp, Unknown
  misc_feature (1)..( 13): Result.004 file - promoters50/1027873
cgcaaaaacatat

SEQ ID NO: 161707 - DNA, 13 bp, Unknown
  misc_feature (1)..( 13): Result.004 file - promoters50/1027873
accaaaatcatat

SEQ ID NO: 161708 - DNA, 13 bp, Unknown
  misc_feature (1)..( 13): Result.004 file - promoters50/1027873
tcacctaacttat

SEQ ID NO: 161709 - DNA, 13 bp, Unknown
  misc_feature (1)..( 13): Result.004 file - promoters50/1027873
accagaatcgctt

SEQ ID NO: 161710 - DNA, 8 bp, Unknown
  misc_feature (1)..( 8): Result.004 file - promoters50/1027873
gttaacaa

SEQ ID NO: 161711 - DNA, 8 bp, Unknown
  misc_feature (1)..( 8): Result.004 file - promoters50/1027873
tttagcaa

SEQ ID NO: 161712 - DNA, 8 bp, Unknown
  misc_feature (1)..( 8): Result.004 file - promoters50/1027873
attaacaa

SEQ ID NO: 161713 - DNA, 9 bp, Unknown
  misc_feature (1)..( 9): Result.004 file - promoters50/1027873
attcagctg

SEQ ID NO: 161714 - DNA, 15 bp, Unknown
  misc_feature (1)..( 15): Result.004 file - promoters50/1027873
attgtatctttttaa

SEQ ID NO: 161715 - DNA, 15 bp, Unknown
  misc_feature (1)..( 15): Result.004 file - promoters50/1027873
attgtatttttgtaa

SEQ ID NO: 161716 - DNA, 15 bp, Unknown
  misc_feature (1)..( 15): Result.004 file - promoters50/1027873
tatgtataatattaa

SEQ ID NO: 161717 - DNA, 15 bp, Unknown
  misc_feature (1)..( 15): Result.004 file - promoters50/1027877
acaaggtttttggga

SEQ ID NO: 161718 - DNA, 9 bp, Unknown
  misc_feature (1)..( 9): Result.004 file - promoters50/1027877
atcaggaaa

SEQ ID NO: 161719 - DNA, 9 bp, Unknown
  misc_feature (1)..( 9): Result.004 file - promoters50/1027877
atcaagaat

SEQ ID NO: 161720 - DNA, 9 bp, Unknown
  misc_feature (1)..( 9): Result.004 file - promoters50/1027877
ttaaggaaa

SEQ ID NO: 161721 - DNA, 9 bp, Unknown
  misc_feature (1)..( 9): Result.004 file - promoters50/1027877
atcaagagg

SEQ ID NO: 161722 - DNA, 8 bp, Unknown
  misc_feature (1)..( 8): Result.004 file - promoters50/1027877
caagaact

SEQ ID NO: 161723 - DNA, 8 bp, Unknown
  misc_feature (1)..( 8): Result.004 file - promoters50/1027877
caagaatt

SEQ ID NO: 161724 - DNA, 8 bp, Unknown
  misc_feature (1)..( 8): Result.004 file - promoters50/1027877
gaagaatg

SEQ ID NO: 161725 - DNA, 8 bp, Unknown
  misc_feature (1)..( 8): Result.004 file - promoters50/1027885
gaagaatt

SEQ ID NO: 161726 - DNA, 8 bp, Unknown
  misc_feature (1)..( 8): Result.004 file - promoters50/1027885
aaattcaa

SEQ ID NO: 161727 - DNA, 8 bp, Unknown
  misc_feature (1)..( 8): Result.004 file - promoters50/1027885
aaattctt

SEQ ID NO: 161728 - DNA, 8 bp, Unknown
  misc_feature (1)..( 8): Result.004 file - promoters50/1027885
taatactt

SEQ ID NO: 161729 - DNA, 7 bp, Unknown
  misc_feature (1)..( 7): Result.004 file - promoters50/1027885
tttgaaa

SEQ ID NO: 161730 - DNA, 7 bp, Unknown
  misc_feature (1)..( 7): Result.004 file - promoters50/1027885
tttcaaa

SEQ ID NO: 161731 - DNA, 7 bp, Unknown
  misc_feature (1)..( 7): Result.004 file - promoters50/1027914
tttgaat

SEQ ID NO: 161732 - DNA, 7 bp, Unknown
  misc_feature (1)..( 7): Result.004 file - promoters50/1027914
ttgttta

SEQ ID NO: 161733 - DNA, 7 bp, Unknown
  misc_feature (1)..( 7): Result.004 file - promoters50/1027914
ttgatta

SEQ ID NO: 161734 - DNA, 7 bp, Unknown
  misc_feature (1)..( 7): Result.004 file - promoters50/1027914
gtgatta

SEQ ID NO: 161735 - DNA, 8 bp, Unknown
  misc_feature (1)..( 8): Result.004 file - promoters50/1027914
tctcttct

SEQ ID NO: 161736 - DNA, 8 bp, Unknown
  misc_feature (1)..( 8): Result.004 file - promoters50/1027914
tctattct

SEQ ID NO: 161737 - DNA, 8 bp, Unknown
  misc_feature (1)..( 8): Result.004 file - promoters50/1027914
tcttttct

SEQ ID NO: 161738 - DNA, 11 bp, Unknown
  misc_feature (1)..( 11): Result.004 file - promoters50/1027914
attataaaaac

SEQ ID NO: 161739 - DNA, 11 bp, Unknown
  misc_feature (1)..( 11): Result.004 file - promoters50/1027914
tatataataac

SEQ ID NO: 161740 - DNA, 11 bp, Unknown
  misc_feature (1)..( 11): Result.004 file - promoters50/1027928
tatataatcca

SEQ ID NO: 161741 - DNA, 14 bp, Unknown
  misc_feature (1)..( 14): Result.004 file - promoters50/1027928
ataaatatctatat

SEQ ID NO: 161742 - DNA, 14 bp, Unknown
  misc_feature (1)..( 14): Result.004 file - promoters50/1027928
ttccatagctagag

SEQ ID NO: 161743 - DNA, 14 bp, Unknown
  misc_feature (1)..( 14): Result.004 file - promoters50/1027928
caaaatttctcatt

SEQ ID NO: 161744 - DNA, 14 bp, Unknown
  misc_feature (1)..( 14): Result.004 file - promoters50/1027928
gaatccagctagag

SEQ ID NO: 161745 - DNA, 14 bp, Unknown
  misc_feature (1)..( 14): Result.004 file - promoters50/1027928
taaaattagtgaac

SEQ ID NO: 161746 - DNA, 14 bp, Unknown
  misc_feature (1)..( 14): Result.004 file - promoters50/1027928
caaaatttataaat

SEQ ID NO: 161747 - DNA, 16 bp, Unknown
  misc_feature (1)..( 16): Result.004 file - promoters50/1027928
ttttaatttcttttca

SEQ ID NO: 161748 - DNA, 16 bp, Unknown
  misc_feature (1)..( 16): Result.004 file - promoters50/1027928
gtttgattagtaaaag

SEQ ID NO: 161749 - DNA, 16 bp, Unknown
  misc_feature (1)..( 16): Result.004 file - promoters50/1027928
ttttaaatattttata

SEQ ID NO: 161750 - DNA, 16 bp, Unknown
  misc_feature (1)..( 16): Result.004 file - promoters50/1027928
gtgtaatttttttcta

SEQ ID NO: 161751 - DNA, 16 bp, Unknown
  misc_feature (1)..( 16): Result.004 file - promoters50/1027928
taataatgtttttcta

SEQ ID NO: 161752 - DNA, 16 bp, Unknown
  misc_feature (1)..( 16): Result.004 file - promoters50/1027928
taataaattttgatta

SEQ ID NO: 161753 - DNA, 10 bp, Unknown
  misc_feature (1)..( 10): Result.004 file - promoters50/1027928
catatatata

SEQ ID NO: 161754 - DNA, 10 bp, Unknown
  misc_feature (1)..( 10): Result.004 file - promoters50/1027928
tataaatatt

SEQ ID NO: 161755 - DNA, 10 bp, Unknown
  misc_feature (1)..( 10): Result.004 file - promoters50/1027928
aataaaaatt

SEQ ID NO: 161756 - DNA, 10 bp, Unknown
  misc_feature (1)..( 10): Result.004 file - promoters50/1027928
tataaaaaat

SEQ ID NO: 161757 - DNA, 10 bp, Unknown
  misc_feature (1)..( 10): Result.004 file - promoters50/1027928
aataaatttt

SEQ ID NO: 161758 - DNA, 11 bp, Unknown
  misc_feature (1)..( 11): Result.004 file - promoters50/1027928
gatacaaaacc

SEQ ID NO: 161759 - DNA, 11 bp, Unknown
  misc_feature (1)..( 11): Result.004 file - promoters50/1027928
atttatacata

SEQ ID NO: 161760 - DNA, 13 bp, Unknown
  misc_feature (1)..( 13): Result.004 file - promoters50/1027928
ggttttataatcg

SEQ ID NO: 161761 - DNA, 13 bp, Unknown
  misc_feature (1)..( 13): Result.004 file - promoters50/1027928
ctatttttaatta

SEQ ID NO: 161762 - DNA, 13 bp, Unknown
  misc_feature (1)..( 13): Result.004 file - promoters50/1027928
tgatttttttttt

SEQ ID NO: 161763 - DNA, 13 bp, Unknown
  misc_feature (1)..( 13): Result.004 file - promoters50/1027928
gtttttctaattt

SEQ ID NO: 161764 - DNA, 13 bp, Unknown
  misc_feature (1)..( 13): Result.004 file - promoters50/1027928
taatttttttcta

SEQ ID NO: 161765 - DNA, 13 bp, Unknown
  misc_feature (1)..( 13): Result.004 file - promoters50/1027928
taaattttgatta

SEQ ID NO: 161766 - DNA, 10 bp, Unknown
  misc_feature (1)..( 10): Result.004 file - promoters50/1027928
aataaaaatt

SEQ ID NO: 161767 - DNA, 10 bp, Unknown
  misc_feature (1)..( 10): Result.004 file - promoters50/1027928
cataataatg

SEQ ID NO: 161768 - DNA, 10 bp, Unknown
  misc_feature (1)..( 10): Result.004 file - promoters50/1027928
tataaatatt

SEQ ID NO: 161769 - DNA, 10 bp, Unknown
  misc_feature (1)..( 10): Result.004 file - promoters50/1027928
tataaaaaat

SEQ ID NO: 161770 - DNA, 10 bp, Unknown
  misc_feature (1)..( 10): Result.004 file - promoters50/1027928
aataaatttt

SEQ ID NO: 161771 - DNA, 11 bp, Unknown
  misc_feature (1)..( 11): Result.004 file - promoters50/1027943
gatacaaaacc

SEQ ID NO: 161772 - DNA, 10 bp, Unknown
  misc_feature (1)..( 10): Result.004 file - promoters50/1027943
agagcaagac

SEQ ID NO: 161773 - DNA, 10 bp, Unknown
  misc_feature (1)..( 10): Result.004 file - promoters50/1027943
agagaaagag

SEQ ID NO: 161774 - DNA, 10 bp, Unknown
  misc_feature (1)..( 10): Result.004 file - promoters50/1027970
caggaacgag

SEQ ID NO: 161775 - DNA, 8 bp, Unknown
  misc_feature (1)..( 8): Result.004 file - promoters50/1027970
taagattc

SEQ ID NO: 161776 - DNA, 8 bp, Unknown
  misc_feature (1)..( 8): Result.004 file - promoters50/1027970
taaaattg

SEQ ID NO: 161777 - DNA, 8 bp, Unknown
  misc_feature (1)..( 8): Result.004 file - promoters50/1027982
taagcttc

SEQ ID NO: 161778 - DNA, 10 bp, Unknown
  misc_feature (1)..( 10): Result.004 file - promoters50/1027982
aaattttttt

SEQ ID NO: 161779 - DNA, 10 bp, Unknown
  misc_feature (1)..( 10): Result.004 file - promoters50/1027982
tgattgtttt

SEQ ID NO: 161780 - DNA, 10 bp, Unknown
  misc_feature (1)..( 10): Result.004 file - promoters50/1027982
aaactttttg

SEQ ID NO: 161781 - DNA, 8 bp, Unknown
  misc_feature (1)..( 8): Result.004 file - promoters50/1027982
ataaataa

SEQ ID NO: 161782 - DNA, 8 bp, Unknown
  misc_feature (1)..( 8): Result.004 file - promoters50/1027982
atatatat

SEQ ID NO: 161783 - DNA, 9 bp, Unknown
  misc_feature (1)..( 9): Result.004 file - promoters50/1027982
atattatat

SEQ ID NO: 161784 - DNA, 14 bp, Unknown
  misc_feature (1)..( 14): Result.004 file - promoters50/1027982
ttaaaataaataaa

SEQ ID NO: 161785 - DNA, 14 bp, Unknown
  misc_feature (1)..( 14): Result.004 file - promoters50/1027982
ttaaattaattaaa

SEQ ID NO: 161786 - DNA, 14 bp, Unknown
  misc_feature (1)..( 14): Result.004 file - promoters50/1027982
atatcatatataac

SEQ ID NO: 161787 - DNA, 7 bp, Unknown
  misc_feature (1)..( 7): Result.004 file - promoters50/1027982
aaatatt

SEQ ID NO: 161788 - DNA, 7 bp, Unknown
  misc_feature (1)..( 7): Result.004 file - promoters50/1027982
aaagatt

SEQ ID NO: 161789 - DNA, 7 bp, Unknown
  misc_feature (1)..( 7): Result.004 file - promoters50/1027990
aaatata

SEQ ID NO: 161790 - DNA, 16 bp, Unknown
  misc_feature (1)..( 16): Result.004 file - promoters50/1027990
ttctcgattaggcttc

SEQ ID NO: 161791 - DNA, 16 bp, Unknown
  misc_feature (1)..( 16): Result.004 file - promoters50/1027990
actataattaggttat

SEQ ID NO: 161792 - DNA, 16 bp, Unknown
  misc_feature (1)..( 16): Result.004 file - promoters50/1027990
tgtgttcttaggattc

SEQ ID NO: 161793 - DNA, 16 bp, Unknown
  misc_feature (1)..( 16): Result.004 file - promoters50/1027990
tggtgaatttggttaa

SEQ ID NO: 161794 - DNA, 16 bp, Unknown
  misc_feature (1)..( 16): Result.004 file - promoters50/1027990
gtgatgattttccatt

SEQ ID NO: 161795 - DNA, 16 bp, Unknown
  misc_feature (1)..( 16): Result.004 file - promoters50/1027990
acgcatattttgttga

SEQ ID NO: 161796 - DNA, 16 bp, Unknown
  misc_feature (1)..( 16): Result.004 file - promoters50/1027990
tgttgcatttggagta

SEQ ID NO: 161797 - DNA, 10 bp, Unknown
  misc_feature (1)..( 10): Result.004 file - promoters50/1027990
aagagtttga

SEQ ID NO: 161798 - DNA, 10 bp, Unknown
  misc_feature (1)..( 10): Result.004 file - promoters50/1027990
aagattttga

SEQ ID NO: 161799 - DNA, 10 bp, Unknown
  misc_feature (1)..( 10): Result.004 file - promoters50/1027990
gtgtgtttga

SEQ ID NO: 161800 - DNA, 10 bp, Unknown
  misc_feature (1)..( 10): Result.004 file - promoters50/1027990
cagatttaac

SEQ ID NO: 161801 - DNA, 10 bp, Unknown
  misc_feature (1)..( 10): Result.004 file - promoters50/1027990
catattttgt

SEQ ID NO: 161802 - DNA, 10 bp, Unknown
  misc_feature (1)..( 10): Result.004 file - promoters50/1028042
agtattttgt

SEQ ID NO: 161803 - DNA, 7 bp, Unknown
  misc_feature (1)..( 7): Result.004 file - promoters50/1028042
ccatgtt

SEQ ID NO: 161804 - DNA, 7 bp, Unknown
  misc_feature (1)..( 7): Result.004 file - promoters50/1028042
acatgtt

SEQ ID NO: 161805 - DNA, 7 bp, Unknown
  misc_feature (1)..( 7): Result.004 file - promoters50/1028042
acatgta

SEQ ID NO: 161806 - DNA, 7 bp, Unknown
  misc_feature (1)..( 7): Result.004 file - promoters50/1028042
gatgtaa

SEQ ID NO: 161807 - DNA, 7 bp, Unknown
  misc_feature (1)..( 7): Result.004 file - promoters50/1028042
aatgtaa

SEQ ID NO: 161808 - DNA, 7 bp, Unknown
  misc_feature (1)..( 7): Result.004 file - promoters50/1028042
aatctaa

SEQ ID NO: 161809 - DNA, 13 bp, Unknown
  misc_feature (1)..( 13): Result.004 file - promoters50/1028042
accaaaagacaaa

SEQ ID NO: 161810 - DNA, 13 bp, Unknown
  misc_feature (1)..( 13): Result.004 file - promoters50/1028042
cagaaaagaaaaa

SEQ ID NO: 161811 - DNA, 13 bp, Unknown
  misc_feature (1)..( 13): Result.004 file - promoters50/1028042
cagaaaagaagac

SEQ ID NO: 161812 - DNA, 8 bp, Unknown
  misc_feature (1)..( 8): Result.004 file - promoters50/1028042
aaacgaaa

SEQ ID NO: 161813 - DNA, 8 bp, Unknown
  misc_feature (1)..( 8): Result.004 file - promoters50/1028042
agacgaaa

SEQ ID NO: 161814 - DNA, 8 bp, Unknown
  misc_feature (1)..( 8): Result.004 file - promoters50/1028042
agaggaag

SEQ ID NO: 161815 - DNA, 13 bp, Unknown
  misc_feature (1)..( 13): Result.004 file - promoters50/1028042
agatcaattagtg

SEQ ID NO: 161816 - DNA, 13 bp, Unknown
  misc_feature (1)..( 13): Result.004 file - promoters50/1028042
agaacaattaacc

SEQ ID NO: 161817 - DNA, 13 bp, Unknown
  misc_feature (1)..( 13): Result.004 file - promoters50/1028049
actctaatcaacc

SEQ ID NO: 161818 - DNA, 9 bp, Unknown
  misc_feature (1)..( 9): Result.004 file - promoters50/1028049
gagtgttga

SEQ ID NO: 161819 - DNA, 9 bp, Unknown
  misc_feature (1)..( 9): Result.004 file - promoters50/1028049
ttttgttga

SEQ ID NO: 161820 - DNA, 9 bp, Unknown
  misc_feature (1)..( 9): Result.004 file - promoters50/1028049
ttttattgt

SEQ ID NO: 161821 - DNA, 10 bp, Unknown
  misc_feature (1)..( 10): Result.004 file - promoters50/1028049
atttgatttg

SEQ ID NO: 161822 - DNA, 9 bp, Unknown
  misc_feature (1)..( 9): Result.004 file - promoters50/1028049
aatggtgac

SEQ ID NO: 161823 - DNA, 9 bp, Unknown
  misc_feature (1)..( 9): Result.004 file - promoters50/1028049
aatgttgaa

SEQ ID NO: 161824 - DNA, 9 bp, Unknown
  misc_feature (1)..( 9): Result.004 file - promoters50/1028049
tatgtagaa

SEQ ID NO: 161825 - DNA, 10 bp, Unknown
  misc_feature (1)..( 10): Result.004 file - promoters50/1028049
atgaatcctc

SEQ ID NO: 161826 - DNA, 10 bp, Unknown
  misc_feature (1)..( 10): Result.004 file - promoters50/1028049
atgaatatgt

SEQ ID NO: 161827 - DNA, 10 bp, Unknown
  misc_feature (1)..( 10): Result.004 file - promoters50/1028049
ttgaatcaat

SEQ ID NO: 161828 - DNA, 10 bp, Unknown
  misc_feature (1)..( 10): Result.004 file - promoters50/1028049
ttgagtcaat

SEQ ID NO: 161829 - DNA, 9 bp, Unknown
  misc_feature (1)..( 9): Result.004 file - promoters50/1028049
ggttttaac

SEQ ID NO: 161830 - DNA, 9 bp, Unknown
  misc_feature (1)..( 9): Result.004 file - promoters50/1028049
ggttataat

SEQ ID NO: 161831 - DNA, 9 bp, Unknown
  misc_feature (1)..( 9): Result.004 file - promoters50/1028049
acttaaaat

SEQ ID NO: 161832 - DNA, 10 bp, Unknown
  misc_feature (1)..( 10): Result.004 file - promoters50/1028049
cgattttgtt

SEQ ID NO: 161833 - DNA, 10 bp, Unknown
  misc_feature (1)..( 10): Result.004 file - promoters50/1028049
cgatattgta

SEQ ID NO: 161834 - DNA, 10 bp, Unknown
  misc_feature (1)..( 10): Result.004 file - promoters50/1028084
tgatttggtt

SEQ ID NO: 161835 - DNA, 12 bp, Unknown
  misc_feature (1)..( 12): Result.004 file - promoters50/1028084
gaaattttattt

SEQ ID NO: 161836 - DNA, 12 bp, Unknown
  misc_feature (1)..( 12): Result.004 file - promoters50/1028084
tatcttttattt

SEQ ID NO: 161837 - DNA, 12 bp, Unknown
  misc_feature (1)..( 12): Result.004 file - promoters50/1028084
gaaattttagga

SEQ ID NO: 161838 - DNA, 11 bp, Unknown
  misc_feature (1)..( 11): Result.004 file - promoters50/1028084
ataccaatttt

SEQ ID NO: 161839 - DNA, 11 bp, Unknown
  misc_feature (1)..( 11): Result.004 file - promoters50/1028084
gtaacaatttt

SEQ ID NO: 161840 - DNA, 11 bp, Unknown
  misc_feature (1)..( 11): Result.004 file - promoters50/1028095
atatcaattta

SEQ ID NO: 161841 - DNA, 17 bp, Unknown
  misc_feature (1)..( 17): Result.004 file - promoters50/1028095
tattattataaaatatt

SEQ ID NO: 161842 - DNA, 17 bp, Unknown
  misc_feature (1)..( 17): Result.004 file - promoters50/1028095
gaatatgatagattagc

SEQ ID NO: 161843 - DNA, 17 bp, Unknown
  misc_feature (1)..( 17): Result.004 file - promoters50/1028095
ttttagtatacaattat

SEQ ID NO: 161844 - DNA, 17 bp, Unknown
  misc_feature (1)..( 17): Result.004 file - promoters50/1028095
aaaagacctacaaatat

SEQ ID NO: 161845 - DNA, 17 bp, Unknown
  misc_feature (1)..( 17): Result.004 file - promoters50/1028095
aatttgtttgaataatt

SEQ ID NO: 161846 - DNA, 17 bp, Unknown
  misc_feature (1)..( 17): Result.004 file - promoters50/1028095
ggctagaatactttatt

SEQ ID NO: 161847 - DNA, 13 bp, Unknown
  misc_feature (1)..( 13): Result.004 file - promoters50/1028095
taattttcatcaa

SEQ ID NO: 161848 - DNA, 13 bp, Unknown
  misc_feature (1)..( 13): Result.004 file - promoters50/1028095
ttattttcttttt

SEQ ID NO: 161849 - DNA, 13 bp, Unknown
  misc_feature (1)..( 13): Result.004 file - promoters50/1028095
caattttagttat

SEQ ID NO: 161850 - DNA, 13 bp, Unknown
  misc_feature (1)..( 13): Result.004 file - promoters50/1028095
aaatattatatat

SEQ ID NO: 161851 - DNA, 13 bp, Unknown
  misc_feature (1)..( 13): Result.004 file - promoters50/1028095
tcgtttttttttt

SEQ ID NO: 161852 - DNA, 13 bp, Unknown
  misc_feature (1)..( 13): Result.004 file - promoters50/1028095
caatttgttacct

SEQ ID NO: 161853 - DNA, 18 bp, Unknown
  misc_feature (1)..( 18): Result.004 file - promoters50/1028095
ttattataaaatattata

SEQ ID NO: 161854 - DNA, 18 bp, Unknown
  misc_feature (1)..( 18): Result.004 file - promoters50/1028095
ttgctataaaaaaacaaa

SEQ ID NO: 161855 - DNA, 18 bp, Unknown
  misc_feature (1)..( 18): Result.004 file - promoters50/1028095
ttagtatacaattatata

SEQ ID NO: 161856 - DNA, 18 bp, Unknown
  misc_feature (1)..( 18): Result.004 file - promoters50/1028095
aagacctacaaatatgtt

SEQ ID NO: 161857 - DNA, 18 bp, Unknown
  misc_feature (1)..( 18): Result.004 file - promoters50/1028095
acttcatctaatttgttt

SEQ ID NO: 161858 - DNA, 18 bp, Unknown
  misc_feature (1)..( 18): Result.004 file - promoters50/1028095
cgaggctagaatacttta

SEQ ID NO: 161859 - DNA, 12 bp, Unknown
  misc_feature (1)..( 12): Result.004 file - promoters50/1028095
tctttatttgcg

SEQ ID NO: 161860 - DNA, 12 bp, Unknown
  misc_feature (1)..( 12): Result.004 file - promoters50/1028095
aatttgtttgaa

SEQ ID NO: 161861 - DNA, 12 bp, Unknown
  misc_feature (1)..( 12): Result.004 file - promoters50/1028095
actttattttat

SEQ ID NO: 161862 - DNA, 12 bp, Unknown
  misc_feature (1)..( 12): Result.004 file - promoters50/1028095
gatttgttagag

SEQ ID NO: 161863 - DNA, 12 bp, Unknown
  misc_feature (1)..( 12): Result.004 file - promoters50/1028095
aatatgttttgg

SEQ ID NO: 161864 - DNA, 12 bp, Unknown
  misc_feature (1)..( 12): Result.004 file - promoters50/1028151
tgtattttttag

SEQ ID NO: 161865 - DNA, 9 bp, Unknown
  misc_feature (1)..( 9): Result.004 file - promoters50/1028151
gttttattt

SEQ ID NO: 161866 - DNA, 9 bp, Unknown
  misc_feature (1)..( 9): Result.004 file - promoters50/1028151
tgattattt

SEQ ID NO: 161867 - DNA, 9 bp, Unknown
  misc_feature (1)..( 9): Result.004 file - promoters50/1028177
tgagtattc

SEQ ID NO: 161868 - DNA, 12 bp, Unknown
  misc_feature (1)..( 12): Result.004 file - promoters50/1028177
tcttcttacttc

SEQ ID NO: 161869 - DNA, 12 bp, Unknown
  misc_feature (1)..( 12): Result.004 file - promoters50/1028177
tgttctaactga

SEQ ID NO: 161870 - DNA, 12 bp, Unknown
  misc_feature (1)..( 12): Result.004 file - promoters50/1028177
tcttctttaaga

SEQ ID NO: 161871 - DNA, 12 bp, Unknown
  misc_feature (1)..( 12): Result.004 file - promoters50/1028177
ggttctatggtt

SEQ ID NO: 161872 - DNA, 12 bp, Unknown
  misc_feature (1)..( 12): Result.004 file - promoters50/1028177
gctgctaacttc

SEQ ID NO: 161873 - DNA, 12 bp, Unknown
  misc_feature (1)..( 12): Result.004 file - promoters50/1028177
ttcgataattga

SEQ ID NO: 161874 - DNA, 12 bp, Unknown
  misc_feature (1)..( 12): Result.004 file - promoters50/1028216
tctgcttttgat

SEQ ID NO: 161875 - DNA, 8 bp, Unknown
  misc_feature (1)..( 8): Result.004 file - promoters50/1028216
ttcttttt

SEQ ID NO: 161876 - DNA, 8 bp, Unknown
  misc_feature (1)..( 8): Result.004 file - promoters50/1028216
aacttttt

SEQ ID NO: 161877 - DNA, 8 bp, Unknown
  misc_feature (1)..( 8): Result.004 file - promoters50/1028224
ttcttttg

SEQ ID NO: 161878 - DNA, 8 bp, Unknown
  misc_feature (1)..( 8): Result.004 file - promoters50/1028224
taatcagt

SEQ ID NO: 161879 - DNA, 8 bp, Unknown
  misc_feature (1)..( 8): Result.004 file - promoters50/1028224
taatcacg

SEQ ID NO: 161880 - DNA, 8 bp, Unknown
  misc_feature (1)..( 8): Result.004 file - promoters50/1028224
aaattagt

SEQ ID NO: 161881 - DNA, 8 bp, Unknown
  misc_feature (1)..( 8): Result.004 file - promoters50/1028224
atgtttat

SEQ ID NO: 161882 - DNA, 8 bp, Unknown
  misc_feature (1)..( 8): Result.004 file - promoters50/1028224
atgttttg

SEQ ID NO: 161883 - DNA, 8 bp, Unknown
  misc_feature (1)..( 8): Result.004 file - promoters50/1028224
ctgtttat

SEQ ID NO: 161884 - DNA, 8 bp, Unknown
  misc_feature (1)..( 8): Result.004 file - promoters50/1028224
ttatgttt

SEQ ID NO: 161885 - DNA, 8 bp, Unknown
  misc_feature (1)..( 8): Result.004 file - promoters50/1028224
ttatgtat

SEQ ID NO: 161886 - DNA, 8 bp, Unknown
  misc_feature (1)..( 8): Result.004 file - promoters50/1028238
atattttt

SEQ ID NO: 161887 - DNA, 7 bp, Unknown
  misc_feature (1)..( 7): Result.004 file - promoters50/1028238
ctatata

SEQ ID NO: 161888 - DNA, 7 bp, Unknown
  misc_feature (1)..( 7): Result.004 file - promoters50/1028238
ctatatt

SEQ ID NO: 161889 - DNA, 7 bp, Unknown
  misc_feature (1)..( 7): Result.004 file - promoters50/1028238
ttatata

SEQ ID NO: 161890 - DNA, 9 bp, Unknown
  misc_feature (1)..( 9): Result.004 file - promoters50/1028238
ttatatatg

SEQ ID NO: 161891 - DNA, 9 bp, Unknown
  misc_feature (1)..( 9): Result.004 file - promoters50/1028238
atatacatg

SEQ ID NO: 161892 - DNA, 9 bp, Unknown
  misc_feature (1)..( 9): Result.004 file - promoters50/1028238
ttatttatt

SEQ ID NO: 161893 - DNA, 9 bp, Unknown
  misc_feature (1)..( 9): Result.004 file - promoters50/1028238
atatataac

SEQ ID NO: 161894 - DNA, 9 bp, Unknown
  misc_feature (1)..( 9): Result.004 file - promoters50/1028238
gtatttaaa

SEQ ID NO: 161895 - DNA, 9 bp, Unknown
  misc_feature (1)..( 9): Result.004 file - promoters50/1028241
ctatatata

SEQ ID NO: 161896 - DNA, 8 bp, Unknown
  misc_feature (1)..( 8): Result.004 file - promoters50/1028241
aataaatt

SEQ ID NO: 161897 - DNA, 8 bp, Unknown
  misc_feature (1)..( 8): Result.004 file - promoters50/1028241
attaaatt

SEQ ID NO: 161898 - DNA, 8 bp, Unknown
  misc_feature (1)..( 8): Result.004 file - promoters50/1028241
attcaatg

SEQ ID NO: 161899 - DNA, 8 bp, Unknown
  misc_feature (1)..( 8): Result.004 file - promoters50/1028241
cataaaaa

SEQ ID NO: 161900 - DNA, 8 bp, Unknown
  misc_feature (1)..( 8): Result.004 file - promoters50/1028241
cattaaat

SEQ ID NO: 161901 - DNA, 8 bp, Unknown
  misc_feature (1)..( 8): Result.004 file - promoters50/1028241
gattaaaa

SEQ ID NO: 161902 - DNA, 8 bp, Unknown
  misc_feature (1)..( 8): Result.004 file - promoters50/1028241
tattcaat

SEQ ID NO: 161903 - DNA, 9 bp, Unknown
  misc_feature (1)..( 9): Result.004 file - promoters50/1028241
atgtttata

SEQ ID NO: 161904 - DNA, 9 bp, Unknown
  misc_feature (1)..( 9): Result.004 file - promoters50/1028241
ttgttaata

SEQ ID NO: 161905 - DNA, 9 bp, Unknown
  misc_feature (1)..( 9): Result.004 file - promoters50/1028243
gttttttta

SEQ ID NO: 161906 - DNA, 10 bp, Unknown
  misc_feature (1)..( 10): Result.004 file - promoters50/1028243
tgaagaatta

SEQ ID NO: 161907 - DNA, 10 bp, Unknown
  misc_feature (1)..( 10): Result.004 file - promoters50/1028243
ggaataattt

SEQ ID NO: 161908 - DNA, 11 bp, Unknown
  misc_feature (1)..( 11): Result.004 file - promoters50/1028243
aaaataaattg

SEQ ID NO: 161909 - DNA, 11 bp, Unknown
  misc_feature (1)..( 11): Result.004 file - promoters50/1028243
aatttaaattt

SEQ ID NO: 161910 - DNA, 11 bp, Unknown
  misc_feature (1)..( 11): Result.004 file - promoters50/1028243
aaaataaacta

SEQ ID NO: 161911 - DNA, 11 bp, Unknown
  misc_feature (1)..( 11): Result.004 file - promoters50/1028243
gtcataatttt

SEQ ID NO: 161912 - DNA, 12 bp, Unknown
  misc_feature (1)..( 12): Result.004 file - promoters50/1028243
cttttatttcct

SEQ ID NO: 161913 - DNA, 12 bp, Unknown
  misc_feature (1)..( 12): Result.004 file - promoters50/1028243
gtattatttcac

SEQ ID NO: 161914 - DNA, 12 bp, Unknown
  misc_feature (1)..( 12): Result.004 file - promoters50/1028243
tttttgtttcct

SEQ ID NO: 161915 - DNA, 12 bp, Unknown
  misc_feature (1)..( 12): Result.004 file - promoters50/1028243
gtataatttaat

SEQ ID NO: 161916 - DNA, 12 bp, Unknown
  misc_feature (1)..( 12): Result.004 file - promoters50/1028243
ttataatactaa

SEQ ID NO: 161917 - DNA, 12 bp, Unknown
  misc_feature (1)..( 12): Result.004 file - promoters50/1028243
gtataagaattg

SEQ ID NO: 161918 - DNA, 12 bp, Unknown
  misc_feature (1)..( 12): Result.004 file - promoters50/1028243
gttttgttacct

SEQ ID NO: 161919 - DNA, 12 bp, Unknown
  misc_feature (1)..( 12): Result.004 file - promoters50/1028304
tatttacaatgt

SEQ ID NO: 161920 - DNA, 11 bp, Unknown
  misc_feature (1)..( 11): Result.004 file - promoters50/1028304
aaacatttttt

SEQ ID NO: 161921 - DNA, 11 bp, Unknown
  misc_feature (1)..( 11): Result.004 file - promoters50/1028304
agtgatttttt

SEQ ID NO: 161922 - DNA, 11 bp, Unknown
  misc_feature (1)..( 11): Result.004 file - promoters50/1028304
aacaatttcta

SEQ ID NO: 161923 - DNA, 11 bp, Unknown
  misc_feature (1)..( 11): Result.004 file - promoters50/1028304
aaatattttga

SEQ ID NO: 161924 - DNA, 11 bp, Unknown
  misc_feature (1)..( 11): Result.004 file - promoters50/1028304
tttcatttttt

SEQ ID NO: 161925 - DNA, 11 bp, Unknown
  misc_feature (1)..( 11): Result.004 file - promoters50/1028304
cctaatttttc

SEQ ID NO: 161926 - DNA, 12 bp, Unknown
  misc_feature (1)..( 12): Result.004 file - promoters50/1028304
aaacattttttt

SEQ ID NO: 161927 - DNA, 12 bp, Unknown
  misc_feature (1)..( 12): Result.004 file - promoters50/1028304
aaaaattgtgca

SEQ ID NO: 161928 - DNA, 12 bp, Unknown
  misc_feature (1)..( 12): Result.004 file - promoters50/1028304
aacaatttctac

SEQ ID NO: 161929 - DNA, 12 bp, Unknown
  misc_feature (1)..( 12): Result.004 file - promoters50/1028304
aaagatttaaga

SEQ ID NO: 161930 - DNA, 12 bp, Unknown
  misc_feature (1)..( 12): Result.004 file - promoters50/1028304
aaatattttgaa

SEQ ID NO: 161931 - DNA, 12 bp, Unknown
  misc_feature (1)..( 12): Result.004 file - promoters50/1028304
caaaattgagca

SEQ ID NO: 161932 - DNA, 12 bp, Unknown
  misc_feature (1)..( 12): Result.004 file - promoters50/1028304
cgaaaacagatg

SEQ ID NO: 161933 - DNA, 12 bp, Unknown
  misc_feature (1)..( 12): Result.004 file - promoters50/1028304
cgaaaaccatgg

SEQ ID NO: 161934 - DNA, 12 bp, Unknown
  misc_feature (1)..( 12): Result.004 file - promoters50/1028304
agaaaaaagaaa

SEQ ID NO: 161935 - DNA, 13 bp, Unknown
  misc_feature (1)..( 13): Result.004 file - promoters50/1028304
tgaacaaaaccca

SEQ ID NO: 161936 - DNA, 13 bp, Unknown
  misc_feature (1)..( 13): Result.004 file - promoters50/1028304
ttaaaaaagtgac

SEQ ID NO: 161937 - DNA, 13 bp, Unknown
  misc_feature (1)..( 13): Result.004 file - promoters50/1028318
tgatcaataagtt

SEQ ID NO: 161938 - DNA, 11 bp, Unknown
  misc_feature (1)..( 11): Result.004 file - promoters50/1028318
tcttcaagaaa

SEQ ID NO: 161939 - DNA, 11 bp, Unknown
  misc_feature (1)..( 11): Result.004 file - promoters50/1028318
tgtctaagaaa

SEQ ID NO: 161940 - DNA, 11 bp, Unknown
  misc_feature (1)..( 11): Result.004 file - promoters50/1028318
ttttcgagaat

SEQ ID NO: 161941 - DNA, 11 bp, Unknown
  misc_feature (1)..( 11): Result.004 file - promoters50/1028318
ttatggagaat

SEQ ID NO: 161942 - DNA, 11 bp, Unknown
  misc_feature (1)..( 11): Result.004 file - promoters50/1028318
gtttcaagatg

SEQ ID NO: 161943 - DNA, 11 bp, Unknown
  misc_feature (1)..( 11): Result.004 file - promoters50/1028318
ttttcaaaatg

SEQ ID NO: 161944 - DNA, 11 bp, Unknown
  misc_feature (1)..( 11): Result.004 file - promoters50/1028318
gttgcaacttg

SEQ ID NO: 161945 - DNA, 10 bp, Unknown
  misc_feature (1)..( 10): Result.004 file - promoters50/1028318
ttcttcaaga

SEQ ID NO: 161946 - DNA, 10 bp, Unknown
  misc_feature (1)..( 10): Result.004 file - promoters50/1028318
ttcttaaaga

SEQ ID NO: 161947 - DNA, 10 bp, Unknown
  misc_feature (1)..( 10): Result.004 file - promoters50/1028318
ggtttcaaga

SEQ ID NO: 161948 - DNA, 10 bp, Unknown
  misc_feature (1)..( 10): Result.004 file - promoters50/1028318
ctcttaataa

SEQ ID NO: 161949 - DNA, 10 bp, Unknown
  misc_feature (1)..( 10): Result.004 file - promoters50/1028318
ctcttaattt

SEQ ID NO: 161950 - DNA, 10 bp, Unknown
  misc_feature (1)..( 10): Result.004 file - promoters50/1028318
ttctaaatct

SEQ ID NO: 161951 - DNA, 13 bp, Unknown
  misc_feature (1)..( 13): Result.004 file - promoters50/1028318
tattatttcaggt

SEQ ID NO: 161952 - DNA, 13 bp, Unknown
  misc_feature (1)..( 13): Result.004 file - promoters50/1028318
gattattaaaaac

SEQ ID NO: 161953 - DNA, 13 bp, Unknown
  misc_feature (1)..( 13): Result.004 file - promoters50/1028318
tattattatatat

SEQ ID NO: 161954 - DNA, 13 bp, Unknown
  misc_feature (1)..( 13): Result.004 file - promoters50/1028318
aattaataaaaaa

SEQ ID NO: 161955 - DNA, 13 bp, Unknown
  misc_feature (1)..( 13): Result.004 file - promoters50/1028318
acataatgaatgt

SEQ ID NO: 161956 - DNA, 13 bp, Unknown
  misc_feature (1)..( 13): Result.004 file - promoters50/1028318
atctaaaaaaaaa

SEQ ID NO: 161957 - DNA, 11 bp, Unknown
  misc_feature (1)..( 11): Result.004 file - promoters50/1028318
gaaagtttaaa

SEQ ID NO: 161958 - DNA, 11 bp, Unknown
  misc_feature (1)..( 11): Result.004 file - promoters50/1028318
aaaagttagtt

SEQ ID NO: 161959 - DNA, 11 bp, Unknown
  misc_feature (1)..( 11): Result.004 file - promoters50/1028318
gaaactttaat

SEQ ID NO: 161960 - DNA, 11 bp, Unknown
  misc_feature (1)..( 11): Result.004 file - promoters50/1028318
ctccatttaat

SEQ ID NO: 161961 - DNA, 11 bp, Unknown
  misc_feature (1)..( 11): Result.004 file - promoters50/1028318
gttactttctg

SEQ ID NO: 161962 - DNA, 11 bp, Unknown
  misc_feature (1)..( 11): Result.004 file - promoters50/1028331
taaacgttact

SEQ ID NO: 161963 - DNA, 10 bp, Unknown
  misc_feature (1)..( 10): Result.004 file - promoters50/1028331
caaaagagaa

SEQ ID NO: 161964 - DNA, 10 bp, Unknown
  misc_feature (1)..( 10): Result.004 file - promoters50/1028331
caaaagaata

SEQ ID NO: 161965 - DNA, 10 bp, Unknown
  misc_feature (1)..( 10): Result.004 file - promoters50/1028331
caaaaaagaa

SEQ ID NO: 161966 - DNA, 10 bp, Unknown
  misc_feature (1)..( 10): Result.004 file - promoters50/1028331
tgaagaagga

SEQ ID NO: 161967 - DNA, 10 bp, Unknown
  misc_feature (1)..( 10): Result.004 file - promoters50/1028331
tgaagacgga

SEQ ID NO: 161968 - DNA, 10 bp, Unknown
  misc_feature (1)..( 10): Result.004 file - promoters50/1028352
tgatgacgga

SEQ ID NO: 161969 - DNA, 8 bp, Unknown
  misc_feature (1)..( 8): Result.004 file - promoters50/1028352
aaaaaatt

SEQ ID NO: 161970 - DNA, 8 bp, Unknown
  misc_feature (1)..( 8): Result.004 file - promoters50/1028352
aaaacatt

SEQ ID NO: 161971 - DNA, 8 bp, Unknown
  misc_feature (1)..( 8): Result.004 file - promoters50/1028352
gaaaaatg

SEQ ID NO: 161972 - DNA, 12 bp, Unknown
  misc_feature (1)..( 12): Result.004 file - promoters50/1028352
aaataaaaacgg

SEQ ID NO: 161973 - DNA, 12 bp, Unknown
  misc_feature (1)..( 12): Result.004 file - promoters50/1028352
aaagaaagaaaa

SEQ ID NO: 161974 - DNA, 12 bp, Unknown
  misc_feature (1)..( 12): Result.004 file - promoters50/1028352
tgataacaacgg

SEQ ID NO: 161975 - DNA, 7 bp, Unknown
  misc_feature (1)..( 7): Result.004 file - promoters50/1028352
aaaaacc

SEQ ID NO: 161976 - DNA, 7 bp, Unknown
  misc_feature (1)..( 7): Result.004 file - promoters50/1028352
aaacacc

SEQ ID NO: 161977 - DNA, 7 bp, Unknown
  misc_feature (1)..( 7): Result.004 file - promoters50/1028352
aaacact

SEQ ID NO: 161978 - DNA, 8 bp, Unknown
  misc_feature (1)..( 8): Result.004 file - promoters50/1028352
aaaaacct

SEQ ID NO: 161979 - DNA, 8 bp, Unknown
  misc_feature (1)..( 8): Result.004 file - promoters50/1028352
aaaaaccg

SEQ ID NO: 161980 - DNA, 8 bp, Unknown
  misc_feature (1)..( 8): Result.004 file - promoters50/1028352
ctaaaccg

SEQ ID NO: 161981 - DNA, 7 bp, Unknown
  misc_feature (1)..( 7): Result.004 file - promoters50/1028352
caaacaa

SEQ ID NO: 161982 - DNA, 7 bp, Unknown
  misc_feature (1)..( 7): Result.004 file - promoters50/1028352
caaacac

SEQ ID NO: 161983 - DNA, 7 bp, Unknown
  misc_feature (1)..( 7): Result.004 file - promoters50/1028352
taaacac

SEQ ID NO: 161984 - DNA, 9 bp, Unknown
  misc_feature (1)..( 9): Result.004 file - promoters50/1028352
caaacaaaa

SEQ ID NO: 161985 - DNA, 9 bp, Unknown
  misc_feature (1)..( 9): Result.004 file - promoters50/1028352
gaaactaaa

SEQ ID NO: 161986 - DNA, 9 bp, Unknown
  misc_feature (1)..( 9): Result.004 file - promoters50/1028355
gaaactatg

SEQ ID NO: 161987 - DNA, 18 bp, Unknown
  misc_feature (1)..( 18): Result.004 file - promoters50/1028355
tttttattttttatttta

SEQ ID NO: 161988 - DNA, 18 bp, Unknown
  misc_feature (1)..( 18): Result.004 file - promoters50/1028355
atttcattaattatgatt

SEQ ID NO: 161989 - DNA, 19 bp, Unknown
  misc_feature (1)..( 19): Result.004 file - promoters50/1028355
ttttgtattatttatttta

SEQ ID NO: 161990 - DNA, 10 bp, Unknown
  misc_feature (1)..( 10): Result.004 file - promoters50/1028355
cttcaaatat

SEQ ID NO: 161991 - DNA, 10 bp, Unknown
  misc_feature (1)..( 10): Result.004 file - promoters50/1028355
tatcaaatat

SEQ ID NO: 161992 - DNA, 10 bp, Unknown
  misc_feature (1)..( 10): Result.004 file - promoters50/1028368
tatctaatat

SEQ ID NO: 161993 - DNA, 12 bp, Unknown
  misc_feature (1)..( 12): Result.004 file - promoters50/1028368
ttttgttttcta

SEQ ID NO: 161994 - DNA, 12 bp, Unknown
  misc_feature (1)..( 12): Result.004 file - promoters50/1028368
cagcgttttctg

SEQ ID NO: 161995 - DNA, 12 bp, Unknown
  misc_feature (1)..( 12): Result.004 file - promoters50/1028368
tattgttttgaa

SEQ ID NO: 161996 - DNA, 12 bp, Unknown
  misc_feature (1)..( 12): Result.004 file - promoters50/1028368
atctgttttttg

SEQ ID NO: 161997 - DNA, 12 bp, Unknown
  misc_feature (1)..( 12): Result.004 file - promoters50/1028368
actgatttttaa

SEQ ID NO: 161998 - DNA, 12 bp, Unknown
  misc_feature (1)..( 12): Result.004 file - promoters50/1028368
tttagttttctt

SEQ ID NO: 161999 - DNA, 12 bp, Unknown
  misc_feature (1)..( 12): Result.004 file - promoters50/1028368
gagaatttttgt

SEQ ID NO: 162000 - DNA, 10 bp, Unknown
  misc_feature (1)..( 10): Result.004 file - promoters50/1028368
aaaatatata

SEQ ID NO: 162001 - DNA, 10 bp, Unknown
  misc_feature (1)..( 10): Result.004 file - promoters50/1028368
aaagtattca

SEQ ID NO: 162002 - DNA, 10 bp, Unknown
  misc_feature (1)..( 10): Result.004 file - promoters50/1028368
aaaatttata

SEQ ID NO: 162003 - DNA, 10 bp, Unknown
  misc_feature (1)..( 10): Result.004 file - promoters50/1028368
caaatatatc

SEQ ID NO: 162004 - DNA, 10 bp, Unknown
  misc_feature (1)..( 10): Result.004 file - promoters50/1028368
caaatttttg

SEQ ID NO: 162005 - DNA, 10 bp, Unknown
  misc_feature (1)..( 10): Result.004 file - promoters50/1028368
caaatagttc

SEQ ID NO: 162006 - DNA, 18 bp, Unknown
  misc_feature (1)..( 18): Result.004 file - promoters50/1028368
tcattcttttgatacatt

SEQ ID NO: 162007 - DNA, 18 bp, Unknown
  misc_feature (1)..( 18): Result.004 file - promoters50/1028368
cactctttttgatatgat

SEQ ID NO: 162008 - DNA, 18 bp, Unknown
  misc_feature (1)..( 18): Result.004 file - promoters50/1028368
gtaaaagtttgatatatt

SEQ ID NO: 162009 - DNA, 18 bp, Unknown
  misc_feature (1)..( 18): Result.004 file - promoters50/1028368
tcactcttttgttttgtt

SEQ ID NO: 162010 - DNA, 18 bp, Unknown
  misc_feature (1)..( 18): Result.004 file - promoters50/1028368
caaaatcgatgacatgta

SEQ ID NO: 162011 - DNA, 18 bp, Unknown
  misc_feature (1)..( 18): Result.004 file - promoters50/1028368
gaaacgatttgttatagc

SEQ ID NO: 162012 - DNA, 18 bp, Unknown
  misc_feature (1)..( 18): Result.004 file - promoters50/1028382
gtcatgtgttgtagattg

SEQ ID NO: 162013 - DNA, 8 bp, Unknown
  misc_feature (1)..( 8): Result.004 file - promoters50/1028382
tgaagaaa

SEQ ID NO: 162014 - DNA, 8 bp, Unknown
  misc_feature (1)..( 8): Result.004 file - promoters50/1028382
tgaggaaa

SEQ ID NO: 162015 - DNA, 8 bp, Unknown
  misc_feature (1)..( 8): Result.004 file - promoters50/1028382
agaataaa

SEQ ID NO: 162016 - DNA, 8 bp, Unknown
  misc_feature (1)..( 8): Result.004 file - promoters50/1028382
ttggtgac

SEQ ID NO: 162017 - DNA, 8 bp, Unknown
  misc_feature (1)..( 8): Result.004 file - promoters50/1028382
ttggtgtt

SEQ ID NO: 162018 - DNA, 8 bp, Unknown
  misc_feature (1)..( 8): Result.004 file - promoters50/1028402
ttgttgtt

SEQ ID NO: 162019 - DNA, 8 bp, Unknown
  misc_feature (1)..( 8): Result.004 file - promoters50/1028402
aaaaatgg

SEQ ID NO: 162020 - DNA, 8 bp, Unknown
  misc_feature (1)..( 8): Result.004 file - promoters50/1028402
gaaaatgc

SEQ ID NO: 162021 - DNA, 8 bp, Unknown
  misc_feature (1)..( 8): Result.004 file - promoters50/1028402
aaaaatgt

SEQ ID NO: 162022 - DNA, 8 bp, Unknown
  misc_feature (1)..( 8): Result.004 file - promoters50/1028402
acaaatgc

SEQ ID NO: 162023 - DNA, 11 bp, Unknown
  misc_feature (1)..( 11): Result.004 file - promoters50/1028402
taaaagacaac

SEQ ID NO: 162024 - DNA, 11 bp, Unknown
  misc_feature (1)..( 11): Result.004 file - promoters50/1028402
tcaaaggcaaa

SEQ ID NO: 162025 - DNA, 11 bp, Unknown
  misc_feature (1)..( 11): Result.004 file - promoters50/1028402
ccaaagtcaac

SEQ ID NO: 162026 - DNA, 11 bp, Unknown
  misc_feature (1)..( 11): Result.004 file - promoters50/1028413
ccaatgtctcc

SEQ ID NO: 162027 - DNA, 13 bp, Unknown
  misc_feature (1)..( 13): Result.004 file - promoters50/1028413
tttcatttttaaa

SEQ ID NO: 162028 - DNA, 13 bp, Unknown
  misc_feature (1)..( 13): Result.004 file - promoters50/1028413
ctaaattcttata

SEQ ID NO: 162029 - DNA, 13 bp, Unknown
  misc_feature (1)..( 13): Result.004 file - promoters50/1028413
aattatttttggc

SEQ ID NO: 162030 - DNA, 13 bp, Unknown
  misc_feature (1)..( 13): Result.004 file - promoters50/1028413
ttcaatttaactg

SEQ ID NO: 162031 - DNA, 13 bp, Unknown
  misc_feature (1)..( 13): Result.004 file - promoters50/1028413
atatattttgaaa

SEQ ID NO: 162032 - DNA, 13 bp, Unknown
  misc_feature (1)..( 13): Result.004 file - promoters50/1028459
tgacattcttcag

SEQ ID NO: 162033 - DNA, 8 bp, Unknown
  misc_feature (1)..( 8): Result.004 file - promoters50/1028459
atttattc

SEQ ID NO: 162034 - DNA, 8 bp, Unknown
  misc_feature (1)..( 8): Result.004 file - promoters50/1028459
atttatcc

SEQ ID NO: 162035 - DNA, 8 bp, Unknown
  misc_feature (1)..( 8): Result.004 file - promoters50/1028459
gtttcttc

SEQ ID NO: 162036 - DNA, 8 bp, Unknown
  misc_feature (1)..( 8): Result.004 file - promoters50/1028459
gtttatta

SEQ ID NO: 162037 - DNA, 8 bp, Unknown
  misc_feature (1)..( 8): Result.004 file - promoters50/1028459
gcttcttc

SEQ ID NO: 162038 - DNA, 10 bp, Unknown
  misc_feature (1)..( 10): Result.004 file - promoters50/1028459
gttttggcat

SEQ ID NO: 162039 - DNA, 10 bp, Unknown
  misc_feature (1)..( 10): Result.004 file - promoters50/1028459
ttcttggcat

SEQ ID NO: 162040 - DNA, 10 bp, Unknown
  misc_feature (1)..( 10): Result.004 file - promoters50/1028459
attttggcga

SEQ ID NO: 162041 - DNA, 10 bp, Unknown
  misc_feature (1)..( 10): Result.004 file - promoters50/1028459
attttgtttt

SEQ ID NO: 162042 - DNA, 9 bp, Unknown
  misc_feature (1)..( 9): Result.004 file - promoters50/1028459
tatcaaatc

SEQ ID NO: 162043 - DNA, 9 bp, Unknown
  misc_feature (1)..( 9): Result.004 file - promoters50/1028459
caacaaatc

SEQ ID NO: 162044 - DNA, 9 bp, Unknown
  misc_feature (1)..( 9): Result.004 file - promoters50/1028459
tataaaata

SEQ ID NO: 162045 - DNA, 9 bp, Unknown
  misc_feature (1)..( 9): Result.004 file - promoters50/1028459
acacaaatc

SEQ ID NO: 162046 - DNA, 10 bp, Unknown
  misc_feature (1)..( 10): Result.004 file - promoters50/1028459
cgttttggca

SEQ ID NO: 162047 - DNA, 10 bp, Unknown
  misc_feature (1)..( 10): Result.004 file - promoters50/1028459
tgttttgaca

SEQ ID NO: 162048 - DNA, 10 bp, Unknown
  misc_feature (1)..( 10): Result.004 file - promoters50/1028459
gcatttggac

SEQ ID NO: 162049 - DNA, 10 bp, Unknown
  misc_feature (1)..( 10): Result.004 file - promoters50/1028470
tgttttaata

SEQ ID NO: 162050 - DNA, 13 bp, Unknown
  misc_feature (1)..( 13): Result.004 file - promoters50/1028470
tgaatagatatgc

SEQ ID NO: 162051 - DNA, 13 bp, Unknown
  misc_feature (1)..( 13): Result.004 file - promoters50/1028470
gtcctagatatat

SEQ ID NO: 162052 - DNA, 13 bp, Unknown
  misc_feature (1)..( 13): Result.004 file - promoters50/1028470
ttagtagataagt

SEQ ID NO: 162053 - DNA, 13 bp, Unknown
  misc_feature (1)..( 13): Result.004 file - promoters50/1028470
tttctaaatactc

SEQ ID NO: 162054 - DNA, 13 bp, Unknown
  misc_feature (1)..( 13): Result.004 file - promoters50/1028470
aaactacatattc

SEQ ID NO: 162055 - DNA, 13 bp, Unknown
  misc_feature (1)..( 13): Result.004 file - promoters50/1028470
gcaatagagaagc

SEQ ID NO: 162056 - DNA, 13 bp, Unknown
  misc_feature (1)..( 13): Result.004 file - promoters50/1028470
tccgcaaatcctc

SEQ ID NO: 162057 - DNA, 13 bp, Unknown
  misc_feature (1)..( 13): Result.004 file - promoters50/1028470
tttccaaaattca

SEQ ID NO: 162058 - DNA, 9 bp, Unknown
  misc_feature (1)..( 9): Result.004 file - promoters50/1028470
gaatagata

SEQ ID NO: 162059 - DNA, 9 bp, Unknown
  misc_feature (1)..( 9): Result.004 file - promoters50/1028470
tgatatata

SEQ ID NO: 162060 - DNA, 9 bp, Unknown
  misc_feature (1)..( 9): Result.004 file - promoters50/1028470
ctatagatg

SEQ ID NO: 162061 - DNA, 9 bp, Unknown
  misc_feature (1)..( 9): Result.004 file - promoters50/1028470
aaataaata

SEQ ID NO: 162062 - DNA, 9 bp, Unknown
  misc_feature (1)..( 9): Result.004 file - promoters50/1028470
aaatagatc

SEQ ID NO: 162063 - DNA, 9 bp, Unknown
  misc_feature (1)..( 9): Result.004 file - promoters50/1028545
tgatatact

SEQ ID NO: 162064 - DNA, 15 bp, Unknown
  misc_feature (1)..( 15): Result.004 file - promoters50/1028545
ttatattaaaatgtt

SEQ ID NO: 162065 - DNA, 15 bp, Unknown
  misc_feature (1)..( 15): Result.004 file - promoters50/1028545
ttattttaattttgg

SEQ ID NO: 162066 - DNA, 15 bp, Unknown
  misc_feature (1)..( 15): Result.004 file - promoters50/1028545
agttttgaattcatt

SEQ ID NO: 162067 - DNA, 15 bp, Unknown
  misc_feature (1)..( 15): Result.004 file - promoters50/1028545
ttgtttcaatattgg

SEQ ID NO: 162068 - DNA, 15 bp, Unknown
  misc_feature (1)..( 15): Result.004 file - promoters50/1028545
cactttcaaaagaga

SEQ ID NO: 162069 - DNA, 9 bp, Unknown
  misc_feature (1)..( 9): Result.004 file - promoters50/1028545
ctaatttcc

SEQ ID NO: 162070 - DNA, 9 bp, Unknown
  misc_feature (1)..( 9): Result.004 file - promoters50/1028545
ttaatttca

SEQ ID NO: 162071 - DNA, 9 bp, Unknown
  misc_feature (1)..( 9): Result.004 file - promoters50/1028545
aaaatttca

SEQ ID NO: 162072 - DNA, 9 bp, Unknown
  misc_feature (1)..( 9): Result.004 file - promoters50/1028545
ctaatttgt

SEQ ID NO: 162073 - DNA, 9 bp, Unknown
  misc_feature (1)..( 9): Result.004 file - promoters50/1028590
ttaacttca

SEQ ID NO: 162074 - DNA, 8 bp, Unknown
  misc_feature (1)..( 8): Result.004 file - promoters50/1028590
tatgatta

SEQ ID NO: 162075 - DNA, 8 bp, Unknown
  misc_feature (1)..( 8): Result.004 file - promoters50/1028590
tatcattg

SEQ ID NO: 162076 - DNA, 8 bp, Unknown
  misc_feature (1)..( 8): Result.004 file - promoters50/1028590
gatgattg

SEQ ID NO: 162077 - DNA, 8 bp, Unknown
  misc_feature (1)..( 8): Result.004 file - promoters50/1028590
aatgtttg

SEQ ID NO: 162078 - DNA, 8 bp, Unknown
  misc_feature (1)..( 8): Result.004 file - promoters50/1028590
gatggttg

SEQ ID NO: 162079 - DNA, 8 bp, Unknown
  misc_feature (1)..( 8): Result.004 file - promoters50/1028623
actgtttg

SEQ ID NO: 162080 - DNA, 8 bp, Unknown
  misc_feature (1)..( 8): Result.004 file - promoters50/1028623
aaagctca

SEQ ID NO: 162081 - DNA, 8 bp, Unknown
  misc_feature (1)..( 8): Result.004 file - promoters50/1028623
taagatca

SEQ ID NO: 162082 - DNA, 9 bp, Unknown
  misc_feature (1)..( 9): Result.004 file - promoters50/1028623
taatgctta

SEQ ID NO: 162083 - DNA, 8 bp, Unknown
  misc_feature (1)..( 8): Result.004 file - promoters50/1028623
aaaacagc

SEQ ID NO: 162084 - DNA, 8 bp, Unknown
  misc_feature (1)..( 8): Result.004 file - promoters50/1028623
aaatcagc

SEQ ID NO: 162085 - DNA, 8 bp, Unknown
  misc_feature (1)..( 8): Result.004 file - promoters50/1028629
aaaacatt

SEQ ID NO: 162086 - DNA, 8 bp, Unknown
  misc_feature (1)..( 8): Result.004 file - promoters50/1028629
tttgttga

SEQ ID NO: 162087 - DNA, 8 bp, Unknown
  misc_feature (1)..( 8): Result.004 file - promoters50/1028629
attgttga

SEQ ID NO: 162088 - DNA, 8 bp, Unknown
  misc_feature (1)..( 8): Result.004 file - promoters50/1028629
attgttag

SEQ ID NO: 162089 - DNA, 7 bp, Unknown
  misc_feature (1)..( 7): Result.004 file - promoters50/1028629
caaatat

SEQ ID NO: 162090 - DNA, 7 bp, Unknown
  misc_feature (1)..( 7): Result.004 file - promoters50/1028629
caattat

SEQ ID NO: 162091 - DNA, 7 bp, Unknown
  misc_feature (1)..( 7): Result.004 file - promoters50/1028674
caattat

SEQ ID NO: 162092 - DNA, 9 bp, Unknown
  misc_feature (1)..( 9): Result.004 file - promoters50/1028674
ttaaaataa

SEQ ID NO: 162093 - DNA, 9 bp, Unknown
  misc_feature (1)..( 9): Result.004 file - promoters50/1028674
ttataatca

SEQ ID NO: 162094 - DNA, 9 bp, Unknown
  misc_feature (1)..( 9): Result.004 file - promoters50/1028674
tgaaactaa

SEQ ID NO: 162095 - DNA, 9 bp, Unknown
  misc_feature (1)..( 9): Result.004 file - promoters50/1028674
ttataagtt

SEQ ID NO: 162096 - DNA, 12 bp, Unknown
  misc_feature (1)..( 12): Result.004 file - promoters50/1028674
acaaaatttaaa

SEQ ID NO: 162097 - DNA, 12 bp, Unknown
  misc_feature (1)..( 12): Result.004 file - promoters50/1028674
taaaaatttaca

SEQ ID NO: 162098 - DNA, 12 bp, Unknown
  misc_feature (1)..( 12): Result.004 file - promoters50/1028674
aatatatttaat

SEQ ID NO: 162099 - DNA, 12 bp, Unknown
  misc_feature (1)..( 12): Result.004 file - promoters50/1028674
ataatattcaaa

SEQ ID NO: 162100 - DNA, 12 bp, Unknown
  misc_feature (1)..( 12): Result.004 file - promoters50/1028674
taataattatat

SEQ ID NO: 162101 - DNA, 7 bp, Unknown
  misc_feature (1)..( 7): Result.004 file - promoters50/1028674
atttaaa

SEQ ID NO: 162102 - DNA, 7 bp, Unknown
  misc_feature (1)..( 7): Result.004 file - promoters50/1028674
ctttaaa

SEQ ID NO: 162103 - DNA, 7 bp, Unknown
  misc_feature (1)..( 7): Result.004 file - promoters50/1028674
atttaat

SEQ ID NO: 162104 - DNA, 7 bp, Unknown
  misc_feature (1)..( 7): Result.004 file - promoters50/1028674
attcaaa

SEQ ID NO: 162105 - DNA, 8 bp, Unknown
  misc_feature (1)..( 8): Result.004 file - promoters50/1028674
tttctaat

SEQ ID NO: 162106 - DNA, 11 bp, Unknown
  misc_feature (1)..( 11): Result.004 file - promoters50/1028674
ttcattaatta

SEQ ID NO: 162107 - DNA, 11 bp, Unknown
  misc_feature (1)..( 11): Result.004 file - promoters50/1028674
accattaataa

SEQ ID NO: 162108 - DNA, 11 bp, Unknown
  misc_feature (1)..( 11): Result.004 file - promoters50/1028674
aaatttaatta

SEQ ID NO: 162109 - DNA, 12 bp, Unknown
  misc_feature (1)..( 12): Result.004 file - promoters50/1028674
agaatctaaact

SEQ ID NO: 162110 - DNA, 12 bp, Unknown
  misc_feature (1)..( 12): Result.004 file - promoters50/1028674
gcataatatgac

SEQ ID NO: 162111 - DNA, 12 bp, Unknown
  misc_feature (1)..( 12): Result.004 file - promoters50/1028674
atataataatat

SEQ ID NO: 162112 - DNA, 12 bp, Unknown
  misc_feature (1)..( 12): Result.004 file - promoters50/1028674
taataattatat

SEQ ID NO: 162113 - DNA, 12 bp, Unknown
  misc_feature (1)..( 12): Result.004 file - promoters50/1028674
taaaaatttaca

SEQ ID NO: 162114 - DNA, 13 bp, Unknown
  misc_feature (1)..( 13): Result.004 file - promoters50/1028674
aaatatatttaat

SEQ ID NO: 162115 - DNA, 7 bp, Unknown
  misc_feature (1)..( 7): Result.004 file - promoters50/1028674
attcaac

SEQ ID NO: 162116 - DNA, 7 bp, Unknown
  misc_feature (1)..( 7): Result.004 file - promoters50/1028674
attcaaa

SEQ ID NO: 162117 - DNA, 8 bp, Unknown
  misc_feature (1)..( 8): Result.004 file - promoters50/1028674
tttctaat

SEQ ID NO: 162118 - DNA, 8 bp, Unknown
  misc_feature (1)..( 8): Result.004 file - promoters50/1028682
attaaaat

SEQ ID NO: 162119 - DNA, 11 bp, Unknown
  misc_feature (1)..( 11): Result.004 file - promoters50/1028682
aacaaattgag

SEQ ID NO: 162120 - DNA, 11 bp, Unknown
  misc_feature (1)..( 11): Result.004 file - promoters50/1028682
tacatattgag

SEQ ID NO: 162121 - DNA, 11 bp, Unknown
  misc_feature (1)..( 11): Result.004 file - promoters50/1028682
aacaaaattaa

SEQ ID NO: 162122 - DNA, 11 bp, Unknown
  misc_feature (1)..( 11): Result.004 file - promoters50/1028682
cccatattatc

SEQ ID NO: 162123 - DNA, 11 bp, Unknown
  misc_feature (1)..( 11): Result.004 file - promoters50/1028682
ctgatataatc

SEQ ID NO: 162124 - DNA, 11 bp, Unknown
  misc_feature (1)..( 11): Result.004 file - promoters50/1028763
ggcctatatac

SEQ ID NO: 162125 - DNA, 14 bp, Unknown
  misc_feature (1)..( 14): Result.004 file - promoters50/1028763
aaaacccaaacaaa

SEQ ID NO: 162126 - DNA, 14 bp, Unknown
  misc_feature (1)..( 14): Result.004 file - promoters50/1028763
gaattccaaagaaa

SEQ ID NO: 162127 - DNA, 14 bp, Unknown
  misc_feature (1)..( 14): Result.004 file - promoters50/1028763
ctcttctaaaagat

SEQ ID NO: 162128 - DNA, 14 bp, Unknown
  misc_feature (1)..( 14): Result.004 file - promoters50/1028763
agcttttaattaaa

SEQ ID NO: 162129 - DNA, 14 bp, Unknown
  misc_feature (1)..( 14): Result.004 file - promoters50/1028763
ctctactaaagcaa

SEQ ID NO: 162130 - DNA, 14 bp, Unknown
  misc_feature (1)..( 14): Result.004 file - promoters50/1028785
tggaactcaagtgg

SEQ ID NO: 162131 - DNA, 7 bp, Unknown
  misc_feature (1)..( 7): Result.004 file - promoters50/1028785
acatttg

SEQ ID NO: 162132 - DNA, 7 bp, Unknown
  misc_feature (1)..( 7): Result.004 file - promoters50/1028785
acatttt

SEQ ID NO: 162133 - DNA, 7 bp, Unknown
  misc_feature (1)..( 7): Result.004 file - promoters50/1028785
gcatttt

SEQ ID NO: 162134 - DNA, 9 bp, Unknown
  misc_feature (1)..( 9): Result.004 file - promoters50/1028785
atttccaag

SEQ ID NO: 162135 - DNA, 9 bp, Unknown
  misc_feature (1)..( 9): Result.004 file - promoters50/1028785
attaccaca

SEQ ID NO: 162136 - DNA, 9 bp, Unknown
  misc_feature (1)..( 9): Result.004 file - promoters50/1028793
gatacaaca

SEQ ID NO: 162137 - DNA, 7 bp, Unknown
  misc_feature (1)..( 7): Result.004 file - promoters50/1028793
ttttaaa

SEQ ID NO: 162138 - DNA, 7 bp, Unknown
  misc_feature (1)..( 7): Result.004 file - promoters50/1028793
gtttaaa

SEQ ID NO: 162139 - DNA, 7 bp, Unknown
  misc_feature (1)..( 7): Result.004 file - promoters50/1028826
ttttaac

SEQ ID NO: 162140 - DNA, 10 bp, Unknown
  misc_feature (1)..( 10): Result.004 file - promoters50/1028826
atacgttttt

SEQ ID NO: 162141 - DNA, 10 bp, Unknown
  misc_feature (1)..( 10): Result.004 file - promoters50/1028826
aaacgtttag

SEQ ID NO: 162142 - DNA, 10 bp, Unknown
  misc_feature (1)..( 10): Result.004 file - promoters50/1028826
ttacatttgt

SEQ ID NO: 162143 - DNA, 10 bp, Unknown
  misc_feature (1)..( 10): Result.004 file - promoters50/1028826
aaaagtttgt

SEQ ID NO: 162144 - DNA, 10 bp, Unknown
  misc_feature (1)..( 10): Result.004 file - promoters50/1028826
acacgcttac

SEQ ID NO: 162145 - DNA, 10 bp, Unknown
  misc_feature (1)..( 10): Result.004 file - promoters50/1028826
tgtcatgtgt

SEQ ID NO: 162146 - DNA, 12 bp, Unknown
  misc_feature (1)..( 12): Result.004 file - promoters50/1028826
tccttaatctta

SEQ ID NO: 162147 - DNA, 12 bp, Unknown
  misc_feature (1)..( 12): Result.004 file - promoters50/1028826
tgattaatttta

SEQ ID NO: 162148 - DNA, 12 bp, Unknown
  misc_feature (1)..( 12): Result.004 file - promoters50/1028826
ggtttactctat

SEQ ID NO: 162149 - DNA, 12 bp, Unknown
  misc_feature (1)..( 12): Result.004 file - promoters50/1028826
ttcctaattttg

SEQ ID NO: 162150 - DNA, 12 bp, Unknown
  misc_feature (1)..( 12): Result.004 file - promoters50/1028826
aaacaaattttt

SEQ ID NO: 162151 - DNA, 12 bp, Unknown
  misc_feature (1)..( 12): Result.004 file - promoters50/1028826
tgagtaatattc

SEQ ID NO: 162152 - DNA, 11 bp, Unknown
  misc_feature (1)..( 11): Result.004 file - promoters50/1028826
ttattaaaatg

SEQ ID NO: 162153 - DNA, 11 bp, Unknown
  misc_feature (1)..( 11): Result.004 file - promoters50/1028826
taattgaaacc

SEQ ID NO: 162154 - DNA, 11 bp, Unknown
  misc_feature (1)..( 11): Result.004 file - promoters50/1028826
ttatcaaattg

SEQ ID NO: 162155 - DNA, 11 bp, Unknown
  misc_feature (1)..( 11): Result.004 file - promoters50/1028826
tacctgaaaca

SEQ ID NO: 162156 - DNA, 11 bp, Unknown
  misc_feature (1)..( 11): Result.004 file - promoters50/1028826
cttttgataca

SEQ ID NO: 162157 - DNA, 11 bp, Unknown
  misc_feature (1)..( 11): Result.004 file - promoters50/1028826
ctatccaataa

SEQ ID NO: 162158 - DNA, 14 bp, Unknown
  misc_feature (1)..( 14): Result.004 file - promoters50/1028826
caaatttcttaaaa

SEQ ID NO: 162159 - DNA, 14 bp, Unknown
  misc_feature (1)..( 14): Result.004 file - promoters50/1028826
attacaatttaaaa

SEQ ID NO: 162160 - DNA, 14 bp, Unknown
  misc_feature (1)..( 14): Result.004 file - promoters50/1028826
aatgtttattaaaa

SEQ ID NO: 162161 - DNA, 14 bp, Unknown
  misc_feature (1)..( 14): Result.004 file - promoters50/1028826
gaatgggcttaaac

SEQ ID NO: 162162 - DNA, 14 bp, Unknown
  misc_feature (1)..( 14): Result.004 file - promoters50/1028826
aatctttattacgt

SEQ ID NO: 162163 - DNA, 14 bp, Unknown
  misc_feature (1)..( 14): Result.004 file - promoters50/1028835
ggtttttattgctc

SEQ ID NO: 162164 - DNA, 10 bp, Unknown
  misc_feature (1)..( 10): Result.004 file - promoters50/1028835
attaatttgt

SEQ ID NO: 162165 - DNA, 10 bp, Unknown
  misc_feature (1)..( 10): Result.004 file - promoters50/1028835
atttattaat

SEQ ID NO: 162166 - DNA, 10 bp, Unknown
  misc_feature (1)..( 10): Result.004 file - promoters50/1028835
agtaattttt

SEQ ID NO: 162167 - DNA, 10 bp, Unknown
  misc_feature (1)..( 10): Result.004 file - promoters50/1028835
ctttgttaca

SEQ ID NO: 162168 - DNA, 10 bp, Unknown
  misc_feature (1)..( 10): Result.004 file - promoters50/1028835
ttttatgaat

SEQ ID NO: 162169 - DNA, 10 bp, Unknown
  misc_feature (1)..( 10): Result.004 file - promoters50/1028835
ttttcttaaa

SEQ ID NO: 162170 - DNA, 13 bp, Unknown
  misc_feature (1)..( 13): Result.004 file - promoters50/1028835
ctaatgaatctaa

SEQ ID NO: 162171 - DNA, 13 bp, Unknown
  misc_feature (1)..( 13): Result.004 file - promoters50/1028835
tttatgaatgcta

SEQ ID NO: 162172 - DNA, 13 bp, Unknown
  misc_feature (1)..( 13): Result.004 file - promoters50/1028835
aaactgaatctaa

SEQ ID NO: 162173 - DNA, 13 bp, Unknown
  misc_feature (1)..( 13): Result.004 file - promoters50/1028835
tttattaataggt

SEQ ID NO: 162174 - DNA, 13 bp, Unknown
  misc_feature (1)..( 13): Result.004 file - promoters50/1028835
tacattaatgtta

SEQ ID NO: 162175 - DNA, 13 bp, Unknown
  misc_feature (1)..( 13): Result.004 file - promoters50/1028851
tttcttaaaaaaa

SEQ ID NO: 162176 - DNA, 11 bp, Unknown
  misc_feature (1)..( 11): Result.004 file - promoters50/1028851
tatatcaacca

SEQ ID NO: 162177 - DNA, 11 bp, Unknown
  misc_feature (1)..( 11): Result.004 file - promoters50/1028851
agtatctacca

SEQ ID NO: 162178 - DNA, 11 bp, Unknown
  misc_feature (1)..( 11): Result.004 file - promoters50/1028851
cgaatccacca

SEQ ID NO: 162179 - DNA, 11 bp, Unknown
  misc_feature (1)..( 11): Result.004 file - promoters50/1028851
tatttcaattt

SEQ ID NO: 162180 - DNA, 11 bp, Unknown
  misc_feature (1)..( 11): Result.004 file - promoters50/1028851
tatctcaaaat

SEQ ID NO: 162181 - DNA, 11 bp, Unknown
  misc_feature (1)..( 11): Result.004 file - promoters50/1028851
actttctattt

SEQ ID NO: 162182 - DNA, 9 bp, Unknown
  misc_feature (1)..( 9): Result.004 file - promoters50/1028851
ccaaattgt

SEQ ID NO: 162183 - DNA, 9 bp, Unknown
  misc_feature (1)..( 9): Result.004 file - promoters50/1028851
acaaattta

SEQ ID NO: 162184 - DNA, 9 bp, Unknown
  misc_feature (1)..( 9): Result.004 file - promoters50/1028851
caaaattta

SEQ ID NO: 162185 - DNA, 9 bp, Unknown
  misc_feature (1)..( 9): Result.004 file - promoters50/1028851
acaaattat

SEQ ID NO: 162186 - DNA, 9 bp, Unknown
  misc_feature (1)..( 9): Result.004 file - promoters50/1028851
tcaattttt

SEQ ID NO: 162187 - DNA, 9 bp, Unknown
  misc_feature (1)..( 9): Result.004 file - promoters50/1028851
tcactttct

SEQ ID NO: 162188 - DNA, 9 bp, Unknown
  misc_feature (1)..( 9): Result.004 file - promoters50/1028851
tcaaatttc

SEQ ID NO: 162189 - DNA, 9 bp, Unknown
  misc_feature (1)..( 9): Result.004 file - promoters50/1028851
caaaattta

SEQ ID NO: 162190 - DNA, 9 bp, Unknown
  misc_feature (1)..( 9): Result.004 file - promoters50/1028851
acaaattat

SEQ ID NO: 162191 - DNA, 9 bp, Unknown
  misc_feature (1)..( 9): Result.004 file - promoters50/1028851
tcaattttt

SEQ ID NO: 162192 - DNA, 9 bp, Unknown
  misc_feature (1)..( 9): Result.004 file - promoters50/1028851
acaaattta

SEQ ID NO: 162193 - DNA, 9 bp, Unknown
  misc_feature (1)..( 9): Result.004 file - promoters50/1028851
tcactttct

SEQ ID NO: 162194 - DNA, 11 bp, Unknown
  misc_feature (1)..( 11): Result.004 file - promoters50/1028851
acattaaaaat

SEQ ID NO: 162195 - DNA, 11 bp, Unknown
  misc_feature (1)..( 11): Result.004 file - promoters50/1028851
acaataaaagt

SEQ ID NO: 162196 - DNA, 11 bp, Unknown
  misc_feature (1)..( 11): Result.004 file - promoters50/1028851
acgttaaaaat

SEQ ID NO: 162197 - DNA, 11 bp, Unknown
  misc_feature (1)..( 11): Result.004 file - promoters50/1028851
ttaataaagtg

SEQ ID NO: 162198 - DNA, 11 bp, Unknown
  misc_feature (1)..( 11): Result.004 file - promoters50/1028851
gcaacaaattt

SEQ ID NO: 162199 - DNA, 11 bp, Unknown
  misc_feature (1)..( 11): Result.004 file - promoters50/1028859
ttaatcaaata

SEQ ID NO: 162200 - DNA, 11 bp, Unknown
  misc_feature (1)..( 11): Result.004 file - promoters50/1028859
aaagatatatt

SEQ ID NO: 162201 - DNA, 11 bp, Unknown
  misc_feature (1)..( 11): Result.004 file - promoters50/1028859
aaatatatata

SEQ ID NO: 162202 - DNA, 11 bp, Unknown
  misc_feature (1)..( 11): Result.004 file - promoters50/1028859
acggataaatt

SEQ ID NO: 162203 - DNA, 15 bp, Unknown
  misc_feature (1)..( 15): Result.004 file - promoters50/1028859
attatagtttaattc

SEQ ID NO: 162204 - DNA, 15 bp, Unknown
  misc_feature (1)..( 15): Result.004 file - promoters50/1028859
attaaagttcaattt

SEQ ID NO: 162205 - DNA, 15 bp, Unknown
  misc_feature (1)..( 15): Result.004 file - promoters50/1028859
gttaaccattaataa

SEQ ID NO: 162206 - DNA, 9 bp, Unknown
  misc_feature (1)..( 9): Result.004 file - promoters50/1028859
tctcttttt

SEQ ID NO: 162207 - DNA, 9 bp, Unknown
  misc_feature (1)..( 9): Result.004 file - promoters50/1028859
tctcttttt

SEQ ID NO: 162208 - DNA, 9 bp, Unknown
  misc_feature (1)..( 9): Result.004 file - promoters50/1028863
tttcttttc

SEQ ID NO: 162209 - DNA, 13 bp, Unknown
  misc_feature (1)..( 13): Result.004 file - promoters50/1028863
tcaatatgttata

SEQ ID NO: 162210 - DNA, 13 bp, Unknown
  misc_feature (1)..( 13): Result.004 file - promoters50/1028863
tcaatatgtgcaa

SEQ ID NO: 162211 - DNA, 13 bp, Unknown
  misc_feature (1)..( 13): Result.004 file - promoters50/1028863
aatatatgttaat

SEQ ID NO: 162212 - DNA, 13 bp, Unknown
  misc_feature (1)..( 13): Result.004 file - promoters50/1028863
agtgtatgttaat

SEQ ID NO: 162213 - DNA, 13 bp, Unknown
  misc_feature (1)..( 13): Result.004 file - promoters50/1028863
ccaatatgtaaat

SEQ ID NO: 162214 - DNA, 13 bp, Unknown
  misc_feature (1)..( 13): Result.004 file - promoters50/1028863
atcacttgtaaat

SEQ ID NO: 162215 - DNA, 13 bp, Unknown
  misc_feature (1)..( 13): Result.004 file - promoters50/1028863
gattcaaaattct

SEQ ID NO: 162216 - DNA, 13 bp, Unknown
  misc_feature (1)..( 13): Result.004 file - promoters50/1028863
aaaaaaaaattct

SEQ ID NO: 162217 - DNA, 13 bp, Unknown
  misc_feature (1)..( 13): Result.004 file - promoters50/1028863
atagaaaaattaa

SEQ ID NO: 162218 - DNA, 13 bp, Unknown
  misc_feature (1)..( 13): Result.004 file - promoters50/1028863
gcaaataaattaa

SEQ ID NO: 162219 - DNA, 13 bp, Unknown
  misc_feature (1)..( 13): Result.004 file - promoters50/1028863
aaaaaaaaatgga

SEQ ID NO: 162220 - DNA, 13 bp, Unknown
  misc_feature (1)..( 13): Result.004 file - promoters50/1028866
aataaataataac

SEQ ID NO: 162221 - DNA, 11 bp, Unknown
  misc_feature (1)..( 11): Result.004 file - promoters50/1028866
caatcaaattt

SEQ ID NO: 162222 - DNA, 11 bp, Unknown
  misc_feature (1)..( 11): Result.004 file - promoters50/1028866
gatgcaaatta

SEQ ID NO: 162223 - DNA, 11 bp, Unknown
  misc_feature (1)..( 11): Result.004 file - promoters50/1028866
gatgcaaatgt

SEQ ID NO: 162224 - DNA, 11 bp, Unknown
  misc_feature (1)..( 11): Result.004 file - promoters50/1028866
ggggcatattg

SEQ ID NO: 162225 - DNA, 11 bp, Unknown
  misc_feature (1)..( 11): Result.004 file - promoters50/1028866
gatccaaacac

SEQ ID NO: 162226 - DNA, 10 bp, Unknown
  misc_feature (1)..( 10): Result.004 file - promoters50/1028908
tgtgatattg

SEQ ID NO: 162227 - DNA, 11 bp, Unknown
  misc_feature (1)..( 11): Result.004 file - promoters50/1028908
acaaataaagt

SEQ ID NO: 162228 - DNA, 11 bp, Unknown
  misc_feature (1)..( 11): Result.004 file - promoters50/1028908
acaaatacgaa

SEQ ID NO: 162229 - DNA, 11 bp, Unknown
  misc_feature (1)..( 11): Result.004 file - promoters50/1028908
tcaagtacgaa

SEQ ID NO: 162230 - DNA, 13 bp, Unknown
  misc_feature (1)..( 13): Result.004 file - promoters50/1028908
gttggtttatcat

SEQ ID NO: 162231 - DNA, 13 bp, Unknown
  misc_feature (1)..( 13): Result.004 file - promoters50/1028908
aatggttaatcat

SEQ ID NO: 162232 - DNA, 13 bp, Unknown
  misc_feature (1)..( 13): Result.004 file - promoters50/1028937
aatgcttacattg

SEQ ID NO: 162233 - DNA, 14 bp, Unknown
  misc_feature (1)..( 14): Result.004 file - promoters50/1028937
acaataataaacaa

SEQ ID NO: 162234 - DNA, 14 bp, Unknown
  misc_feature (1)..( 14): Result.004 file - promoters50/1028937
tttataatataaat

SEQ ID NO: 162235 - DNA, 14 bp, Unknown
  misc_feature (1)..( 14): Result.004 file - promoters50/1028937
taaatagtaaaaaa

SEQ ID NO: 162236 - DNA, 14 bp, Unknown
  misc_feature (1)..( 14): Result.004 file - promoters50/1028937
acaattatataggt

SEQ ID NO: 162237 - DNA, 14 bp, Unknown
  misc_feature (1)..( 14): Result.004 file - promoters50/1028937
tttttaacaaattt

SEQ ID NO: 162238 - DNA, 14 bp, Unknown
  misc_feature (1)..( 14): Result.004 file - promoters50/1028937
tttattttataggt

SEQ ID NO: 162239 - DNA, 14 bp, Unknown
  misc_feature (1)..( 14): Result.004 file - promoters50/1028937
gagatagtactatc

SEQ ID NO: 162240 - DNA, 13 bp, Unknown
  misc_feature (1)..( 13): Result.004 file - promoters50/1028937
aaattattatatt

SEQ ID NO: 162241 - DNA, 13 bp, Unknown
  misc_feature (1)..( 13): Result.004 file - promoters50/1028937
taattataaagta

SEQ ID NO: 162242 - DNA, 13 bp, Unknown
  misc_feature (1)..( 13): Result.004 file - promoters50/1028937
caattatataggt

SEQ ID NO: 162243 - DNA, 13 bp, Unknown
  misc_feature (1)..( 13): Result.004 file - promoters50/1028937
aaaatatacagtg

SEQ ID NO: 162244 - DNA, 13 bp, Unknown
  misc_feature (1)..( 13): Result.004 file - promoters50/1028937
ttattttataggt

SEQ ID NO: 162245 - DNA, 13 bp, Unknown
  misc_feature (1)..( 13): Result.004 file - promoters50/1028937
aacttttttttta

SEQ ID NO: 162246 - DNA, 13 bp, Unknown
  misc_feature (1)..( 13): Result.004 file - promoters50/1028937
atatttttataaa

SEQ ID NO: 162247 - DNA, 13 bp, Unknown
  misc_feature (1)..( 13): Result.004 file - promoters50/1028937
atataaaaaataa

SEQ ID NO: 162248 - DNA, 13 bp, Unknown
  misc_feature (1)..( 13): Result.004 file - promoters50/1028937
acataaaaatttg

SEQ ID NO: 162249 - DNA, 13 bp, Unknown
  misc_feature (1)..( 13): Result.004 file - promoters50/1028937
tatcaaaaaaaga

SEQ ID NO: 162250 - DNA, 13 bp, Unknown
  misc_feature (1)..( 13): Result.004 file - promoters50/1028937
acaaaaacaataa

SEQ ID NO: 162251 - DNA, 13 bp, Unknown
  misc_feature (1)..( 13): Result.004 file - promoters50/1028937
ctcgaaaatatac

SEQ ID NO: 162252 - DNA, 13 bp, Unknown
  misc_feature (1)..( 13): Result.004 file - promoters50/1028937
aaaaaaaaaatac

SEQ ID NO: 162253 - DNA, 13 bp, Unknown
  misc_feature (1)..( 13): Result.004 file - promoters50/1028937
taaacaaacaaat

SEQ ID NO: 162254 - DNA, 13 bp, Unknown
  misc_feature (1)..( 13): Result.004 file - promoters50/1028937
aaaacaatttata

SEQ ID NO: 162255 - DNA, 13 bp, Unknown
  misc_feature (1)..( 13): Result.004 file - promoters50/1028937
gaaaaaaaaaata

SEQ ID NO: 162256 - DNA, 13 bp, Unknown
  misc_feature (1)..( 13): Result.004 file - promoters50/1028937
aaaagaatttata

SEQ ID NO: 162257 - DNA, 13 bp, Unknown
  misc_feature (1)..( 13): Result.004 file - promoters50/1028937
caaacaaaaacaa

SEQ ID NO: 162258 - DNA, 13 bp, Unknown
  misc_feature (1)..( 13): Result.004 file - promoters50/1028937
tgaagaatctgat

SEQ ID NO: 162259 - DNA, 11 bp, Unknown
  misc_feature (1)..( 11): Result.004 file - promoters50/1028937
tatctattttg

SEQ ID NO: 162260 - DNA, 11 bp, Unknown
  misc_feature (1)..( 11): Result.004 file - promoters50/1028937
aacttatttta

SEQ ID NO: 162261 - DNA, 11 bp, Unknown
  misc_feature (1)..( 11): Result.004 file - promoters50/1028937
aaattatttta

SEQ ID NO: 162262 - DNA, 11 bp, Unknown
  misc_feature (1)..( 11): Result.004 file - promoters50/1028937
aacctaatttc

SEQ ID NO: 162263 - DNA, 11 bp, Unknown
  misc_feature (1)..( 11): Result.004 file - promoters50/1028937
ttcctaatttg

SEQ ID NO: 162264 - DNA, 11 bp, Unknown
  misc_feature (1)..( 11): Result.004 file - promoters50/1028937
tatctgttttt

SEQ ID NO: 162265 - DNA, 11 bp, Unknown
  misc_feature (1)..( 11): Result.004 file - promoters50/1028937
ttattatattg

SEQ ID NO: 162266 - DNA, 11 bp, Unknown
  misc_feature (1)..( 11): Result.004 file - promoters50/1028937
ttattttatag

SEQ ID NO: 162267 - DNA, 11 bp, Unknown
  misc_feature (1)..( 11): Result.004 file - promoters50/1028937
caattatatag

SEQ ID NO: 162268 - DNA, 11 bp, Unknown
  misc_feature (1)..( 11): Result.004 file - promoters50/1028937
agattttataa

SEQ ID NO: 162269 - DNA, 12 bp, Unknown
  misc_feature (1)..( 12): Result.004 file - promoters50/1028937
atatttttataa

SEQ ID NO: 162270 - DNA, 12 bp, Unknown
  misc_feature (1)..( 12): Result.004 file - promoters50/1028937
ctttttttttaa

SEQ ID NO: 162271 - DNA, 12 bp, Unknown
  misc_feature (1)..( 12): Result.004 file - promoters50/1028937
aaatatatttaa

SEQ ID NO: 162272 - DNA, 11 bp, Unknown
  misc_feature (1)..( 11): Result.004 file - promoters50/1028937
atatatataat

SEQ ID NO: 162273 - DNA, 11 bp, Unknown
  misc_feature (1)..( 11): Result.004 file - promoters50/1028937
atatatttaat

SEQ ID NO: 162274 - DNA, 11 bp, Unknown
  misc_feature (1)..( 11): Result.004 file - promoters50/1028937
gtatgtattta

SEQ ID NO: 162275 - DNA, 11 bp, Unknown
  misc_feature (1)..( 11): Result.004 file - promoters50/1028937
atatttttata

SEQ ID NO: 162276 - DNA, 11 bp, Unknown
  misc_feature (1)..( 11): Result.004 file - promoters50/1028937
ttctttttaat

SEQ ID NO: 162277 - DNA, 11 bp, Unknown
  misc_feature (1)..( 11): Result.004 file - promoters50/1028937
caaattttatt

SEQ ID NO: 162278 - DNA, 12 bp, Unknown
  misc_feature (1)..( 12): Result.004 file - promoters50/1028937
agaatactttat

SEQ ID NO: 162279 - DNA, 12 bp, Unknown
  misc_feature (1)..( 12): Result.004 file - promoters50/1028937
gacatattttta

SEQ ID NO: 162280 - DNA, 12 bp, Unknown
  misc_feature (1)..( 12): Result.004 file - promoters50/1028937
tatgtatttttt

SEQ ID NO: 162281 - DNA, 12 bp, Unknown
  misc_feature (1)..( 12): Result.004 file - promoters50/1028937
aatatatttaat

SEQ ID NO: 162282 - DNA, 12 bp, Unknown
  misc_feature (1)..( 12): Result.004 file - promoters50/1028937
tatgtatttaga

SEQ ID NO: 162283 - DNA, 12 bp, Unknown
  misc_feature (1)..( 12): Result.004 file - promoters50/1028955
ttattattgaga

SEQ ID NO: 162284 - DNA, 12 bp, Unknown
  misc_feature (1)..( 12): Result.004 file - promoters50/1028955
atagatgtttca

SEQ ID NO: 162285 - DNA, 12 bp, Unknown
  misc_feature (1)..( 12): Result.004 file - promoters50/1028955
gttgatgtctca

SEQ ID NO: 162286 - DNA, 12 bp, Unknown
  misc_feature (1)..( 12): Result.004 file - promoters50/1028955
atatatgtaaac

SEQ ID NO: 162287 - DNA, 12 bp, Unknown
  misc_feature (1)..( 12): Result.004 file - promoters50/1028955
ttaattgtctcc

SEQ ID NO: 162288 - DNA, 12 bp, Unknown
  misc_feature (1)..( 12): Result.004 file - promoters50/1028955
aaaaataccact

SEQ ID NO: 162289 - DNA, 12 bp, Unknown
  misc_feature (1)..( 12): Result.004 file - promoters50/1028955
aaacataaattt

SEQ ID NO: 162290 - DNA, 8 bp, Unknown
  misc_feature (1)..( 8): Result.004 file - promoters50/1028955
attttcaa

SEQ ID NO: 162291 - DNA, 8 bp, Unknown
  misc_feature (1)..( 8): Result.004 file - promoters50/1028955
atttacaa

SEQ ID NO: 162292 - DNA, 8 bp, Unknown
  misc_feature (1)..( 8): Result.004 file - promoters50/1028955
attttctt

SEQ ID NO: 162293 - DNA, 8 bp, Unknown
  misc_feature (1)..( 8): Result.004 file - promoters50/1028955
attaacaa

SEQ ID NO: 162294 - DNA, 8 bp, Unknown
  misc_feature (1)..( 8): Result.004 file - promoters50/1028955
attaacat

SEQ ID NO: 162295 - DNA, 8 bp, Unknown
  misc_feature (1)..( 8): Result.004 file - promoters50/1028955
attgtctc

SEQ ID NO: 162296 - DNA, 10 bp, Unknown
  misc_feature (1)..( 10): Result.004 file - promoters50/1028955
ttagatagat

SEQ ID NO: 162297 - DNA, 10 bp, Unknown
  misc_feature (1)..( 10): Result.004 file - promoters50/1028955
aaagagagag

SEQ ID NO: 162298 - DNA, 10 bp, Unknown
  misc_feature (1)..( 10): Result.004 file - promoters50/1028955
aaatatatgt

SEQ ID NO: 162299 - DNA, 10 bp, Unknown
  misc_feature (1)..( 10): Result.004 file - promoters50/1028955
gaagagaatt

SEQ ID NO: 162300 - DNA, 10 bp, Unknown
  misc_feature (1)..( 10): Result.004 file - promoters50/1028955
aaaaatacca

SEQ ID NO: 162301 - DNA, 10 bp, Unknown
  misc_feature (1)..( 10): Result.004 file - promoters50/1028963
aaacataaat

SEQ ID NO: 162302 - DNA, 10 bp, Unknown
  misc_feature (1)..( 10): Result.004 file - promoters50/1028963
taatacaatt

SEQ ID NO: 162303 - DNA, 10 bp, Unknown
  misc_feature (1)..( 10): Result.004 file - promoters50/1028963
aaataaaata

SEQ ID NO: 162304 - DNA, 10 bp, Unknown
  misc_feature (1)..( 10): Result.004 file - promoters50/1028963
aaatgaaata

SEQ ID NO: 162305 - DNA, 8 bp, Unknown
  misc_feature (1)..( 8): Result.004 file - promoters50/1028963
tatcttct

SEQ ID NO: 162306 - DNA, 8 bp, Unknown
  misc_feature (1)..( 8): Result.004 file - promoters50/1028963
tattttct

SEQ ID NO: 162307 - DNA, 8 bp, Unknown
  misc_feature (1)..( 8): Result.004 file - promoters50/1028984
tatcttaa

SEQ ID NO: 162308 - DNA, 7 bp, Unknown
  misc_feature (1)..( 7): Result.004 file - promoters50/1028984
taaaatg

SEQ ID NO: 162309 - DNA, 7 bp, Unknown
  misc_feature (1)..( 7): Result.004 file - promoters50/1028984
gaaaatg

SEQ ID NO: 162310 - DNA, 7 bp, Unknown
  misc_feature (1)..( 7): Result.004 file - promoters50/1029005
taaaata

SEQ ID NO: 162311 - DNA, 10 bp, Unknown
  misc_feature (1)..( 10): Result.004 file - promoters50/1029005
aaatttattt

SEQ ID NO: 162312 - DNA, 10 bp, Unknown
  misc_feature (1)..( 10): Result.004 file - promoters50/1029005
tcgttttttt

SEQ ID NO: 162313 - DNA, 10 bp, Unknown
  misc_feature (1)..( 10): Result.004 file - promoters50/1029005
ttttttcttt

SEQ ID NO: 162314 - DNA, 10 bp, Unknown
  misc_feature (1)..( 10): Result.004 file - promoters50/1029005
ctttttgttt

SEQ ID NO: 162315 - DNA, 10 bp, Unknown
  misc_feature (1)..( 10): Result.004 file - promoters50/1029005
aaatttgttt

SEQ ID NO: 162316 - DNA, 10 bp, Unknown
  misc_feature (1)..( 10): Result.004 file - promoters50/1029085
caatttgagt

SEQ ID NO: 162317 - DNA, 13 bp, Unknown
  misc_feature (1)..( 13): Result.004 file - promoters50/1029085
ttttaaagaaccg

SEQ ID NO: 162318 - DNA, 13 bp, Unknown
  misc_feature (1)..( 13): Result.004 file - promoters50/1029085
gtttagagaagaa

SEQ ID NO: 162319 - DNA, 13 bp, Unknown
  misc_feature (1)..( 13): Result.004 file - promoters50/1029085
ttttaaaaattgg

SEQ ID NO: 162320 - DNA, 13 bp, Unknown
  misc_feature (1)..( 13): Result.004 file - promoters50/1029085
tatgacagtatag

SEQ ID NO: 162321 - DNA, 13 bp, Unknown
  misc_feature (1)..( 13): Result.004 file - promoters50/1029085
aattaaaatgaag

SEQ ID NO: 162322 - DNA, 13 bp, Unknown
  misc_feature (1)..( 13): Result.004 file - promoters50/1029085
cattaaattaatt

SEQ ID NO: 162323 - DNA, 13 bp, Unknown
  misc_feature (1)..( 13): Result.004 file - promoters50/1029085
gacaaaattttaa

SEQ ID NO: 162324 - DNA, 13 bp, Unknown
  misc_feature (1)..( 13): Result.004 file - promoters50/1029085
gactaaatcttac

SEQ ID NO: 162325 - DNA, 13 bp, Unknown
  misc_feature (1)..( 13): Result.004 file - promoters50/1029085
tgattaatttttg

SEQ ID NO: 162326 - DNA, 13 bp, Unknown
  misc_feature (1)..( 13): Result.004 file - promoters50/1029085
tgttaaatttacg

SEQ ID NO: 162327 - DNA, 13 bp, Unknown
  misc_feature (1)..( 13): Result.004 file - promoters50/1029085
tccgtaatattag

SEQ ID NO: 162328 - DNA, 13 bp, Unknown
  misc_feature (1)..( 13): Result.004 file - promoters50/1029089
ggagttgtattat

SEQ ID NO: 162329 - DNA, 9 bp, Unknown
  misc_feature (1)..( 9): Result.004 file - promoters50/1029089
ttaatgtat

SEQ ID NO: 162330 - DNA, 9 bp, Unknown
  misc_feature (1)..( 9): Result.004 file - promoters50/1029089
tcaatatat

SEQ ID NO: 162331 - DNA, 9 bp, Unknown
  misc_feature (1)..( 9): Result.004 file - promoters50/1029089
tcaatattt

SEQ ID NO: 162332 - DNA, 7 bp, Unknown
  misc_feature (1)..( 7): Result.004 file - promoters50/1029089
gttaaaa

SEQ ID NO: 162333 - DNA, 7 bp, Unknown
  misc_feature (1)..( 7): Result.004 file - promoters50/1029089
gttaaaa

SEQ ID NO: 162334 - DNA, 7 bp, Unknown
  misc_feature (1)..( 7): Result.004 file - promoters50/1029089
cttaaaa

SEQ ID NO: 162335 - DNA, 9 bp, Unknown
  misc_feature (1)..( 9): Result.004 file - promoters50/1029089
aaataataa

SEQ ID NO: 162336 - DNA, 9 bp, Unknown
  misc_feature (1)..( 9): Result.004 file - promoters50/1029089
aaaaaataa

SEQ ID NO: 162337 - DNA, 9 bp, Unknown
  misc_feature (1)..( 9): Result.004 file - promoters50/1029089
taaaaatag

SEQ ID NO: 162338 - DNA, 9 bp, Unknown
  misc_feature (1)..( 9): Result.004 file - promoters50/1029089
aaaataaaa

SEQ ID NO: 162339 - DNA, 9 bp, Unknown
  misc_feature (1)..( 9): Result.004 file - promoters50/1029089
aaaataaaa

SEQ ID NO: 162340 - DNA, 9 bp, Unknown
  misc_feature (1)..( 9): Result.004 file - promoters50/1029089
aaaaaaaat

SEQ ID NO: 162341 - DNA, 9 bp, Unknown
  misc_feature (1)..( 9): Result.004 file - promoters50/1029089
ttttaatgt

SEQ ID NO: 162342 - DNA, 9 bp, Unknown
  misc_feature (1)..( 9): Result.004 file - promoters50/1029089
tttcaatat

SEQ ID NO: 162343 - DNA, 9 bp, Unknown
  misc_feature (1)..( 9): Result.004 file - promoters50/1029309
agtcaatat

SEQ ID NO: 162344 - DNA, 9 bp, Unknown
  misc_feature (1)..( 9): Result.004 file - promoters50/1029309
tgtgactca

SEQ ID NO: 162345 - DNA, 9 bp, Unknown
  misc_feature (1)..( 9): Result.004 file - promoters50/1029309
cttgaatca

SEQ ID NO: 162346 - DNA, 9 bp, Unknown
  misc_feature (1)..( 9): Result.004 file - promoters50/1029309
tgtgtctcg

SEQ ID NO: 162347 - DNA, 8 bp, Unknown
  misc_feature (1)..( 8): Result.004 file - promoters50/1029309
ttgatgaa

SEQ ID NO: 162348 - DNA, 8 bp, Unknown
  misc_feature (1)..( 8): Result.004 file - promoters50/1029309
ttgttgat

SEQ ID NO: 162349 - DNA, 8 bp, Unknown
  misc_feature (1)..( 8): Result.004 file - promoters50/1029315
cggatgaa

SEQ ID NO: 162350 - DNA, 13 bp, Unknown
  misc_feature (1)..( 13): Result.004 file - promoters50/1029315
tttggtttctcat

SEQ ID NO: 162351 - DNA, 13 bp, Unknown
  misc_feature (1)..( 13): Result.004 file - promoters50/1029315
ggtggattcggtg

SEQ ID NO: 162352 - DNA, 13 bp, Unknown
  misc_feature (1)..( 13): Result.004 file - promoters50/1029315
ttttgattttcag

SEQ ID NO: 162353 - DNA, 13 bp, Unknown
  misc_feature (1)..( 13): Result.004 file - promoters50/1029315
tagggattttcac

SEQ ID NO: 162354 - DNA, 13 bp, Unknown
  misc_feature (1)..( 13): Result.004 file - promoters50/1029315
acactttttaaca

SEQ ID NO: 162355 - DNA, 13 bp, Unknown
  misc_feature (1)..( 13): Result.004 file - promoters50/1029315
aacaatcactctc

SEQ ID NO: 162356 - DNA, 13 bp, Unknown
  misc_feature (1)..( 13): Result.004 file - promoters50/1029315
aacaaacacaaca

SEQ ID NO: 162357 - DNA, 13 bp, Unknown
  misc_feature (1)..( 13): Result.004 file - promoters50/1029315
aacaatcaacgat

SEQ ID NO: 162358 - DNA, 13 bp, Unknown
  misc_feature (1)..( 13): Result.004 file - promoters50/1029315
aacaataatagca

SEQ ID NO: 162359 - DNA, 13 bp, Unknown
  misc_feature (1)..( 13): Result.004 file - promoters50/1029315
atcaatccctctc

SEQ ID NO: 162360 - DNA, 10 bp, Unknown
  misc_feature (1)..( 10): Result.004 file - promoters50/1029315
tctatataat

SEQ ID NO: 162361 - DNA, 10 bp, Unknown
  misc_feature (1)..( 10): Result.004 file - promoters50/1029315
ccaatataat

SEQ ID NO: 162362 - DNA, 10 bp, Unknown
  misc_feature (1)..( 10): Result.004 file - promoters50/1029315
ctaatataaa

SEQ ID NO: 162363 - DNA, 10 bp, Unknown
  misc_feature (1)..( 10): Result.004 file - promoters50/1029315
aatatatata

SEQ ID NO: 162364 - DNA, 10 bp, Unknown
  misc_feature (1)..( 10): Result.004 file - promoters50/1029315
tctatataaa

SEQ ID NO: 162365 - DNA, 12 bp, Unknown
  misc_feature (1)..( 12): Result.004 file - promoters50/1029315
caataaagtagt

SEQ ID NO: 162366 - DNA, 12 bp, Unknown
  misc_feature (1)..( 12): Result.004 file - promoters50/1029315
tgaaaaagtaat

SEQ ID NO: 162367 - DNA, 12 bp, Unknown
  misc_feature (1)..( 12): Result.004 file - promoters50/1029315
attccaagtaaa

SEQ ID NO: 162368 - DNA, 13 bp, Unknown
  misc_feature (1)..( 13): Result.004 file - promoters50/1029315
agcgaaagttaaa

SEQ ID NO: 162369 - DNA, 13 bp, Unknown
  misc_feature (1)..( 13): Result.004 file - promoters50/1029349
tgataaactaatc

SEQ ID NO: 162370 - DNA, 7 bp, Unknown
  misc_feature (1)..( 7): Result.004 file - promoters50/1029349
tatgaat

SEQ ID NO: 162371 - DNA, 7 bp, Unknown
  misc_feature (1)..( 7): Result.004 file - promoters50/1029349
tatgaaa

SEQ ID NO: 162372 - DNA, 7 bp, Unknown
  misc_feature (1)..( 7): Result.004 file - promoters50/1029349
tattaat

SEQ ID NO: 162373 - DNA, 8 bp, Unknown
  misc_feature (1)..( 8): Result.004 file - promoters50/1029349
ttaataac

SEQ ID NO: 162374 - DNA, 8 bp, Unknown
  misc_feature (1)..( 8): Result.004 file - promoters50/1029349
ctaaaaac

SEQ ID NO: 162375 - DNA, 8 bp, Unknown
  misc_feature (1)..( 8): Result.004 file - promoters50/1029395
ctaaaatt

SEQ ID NO: 162376 - DNA, 9 bp, Unknown
  misc_feature (1)..( 9): Result.004 file - promoters50/1029395
aattgatga

SEQ ID NO: 162377 - DNA, 9 bp, Unknown
  misc_feature (1)..( 9): Result.004 file - promoters50/1029395
aatcgatct

SEQ ID NO: 162378 - DNA, 9 bp, Unknown
  misc_feature (1)..( 9): Result.004 file - promoters50/1029395
atttggtga

SEQ ID NO: 162379 - DNA, 9 bp, Unknown
  misc_feature (1)..( 9): Result.004 file - promoters50/1029395
tttatttga

SEQ ID NO: 162380 - DNA, 9 bp, Unknown
  misc_feature (1)..( 9): Result.004 file - promoters50/1029395
tttgtttca

SEQ ID NO: 162381 - DNA, 9 bp, Unknown
  misc_feature (1)..( 9): Result.004 file - promoters50/1029395
tctatttgt

SEQ ID NO: 162382 - DNA, 10 bp, Unknown
  misc_feature (1)..( 10): Result.004 file - promoters50/1029395
attaaggttt

SEQ ID NO: 162383 - DNA, 10 bp, Unknown
  misc_feature (1)..( 10): Result.004 file - promoters50/1029395
tttaaagttt

SEQ ID NO: 162384 - DNA, 10 bp, Unknown
  misc_feature (1)..( 10): Result.004 file - promoters50/1029395
tttcaagctt

SEQ ID NO: 162385 - DNA, 9 bp, Unknown
  misc_feature (1)..( 9): Result.004 file - promoters50/1029395
aaaagacaa

SEQ ID NO: 162386 - DNA, 9 bp, Unknown
  misc_feature (1)..( 9): Result.004 file - promoters50/1029395
aaaagatta

SEQ ID NO: 162387 - DNA, 9 bp, Unknown
  misc_feature (1)..( 9): Result.004 file - promoters50/1029395
aaacgatta

SEQ ID NO: 162388 - DNA, 15 bp, Unknown
  misc_feature (1)..( 15): Result.004 file - promoters50/1029395
tttgtgtctttttac

SEQ ID NO: 162389 - DNA, 15 bp, Unknown
  misc_feature (1)..( 15): Result.004 file - promoters50/1029395
attgtatcttcttac

SEQ ID NO: 162390 - DNA, 15 bp, Unknown
  misc_feature (1)..( 15): Result.004 file - promoters50/1029433
attttataaaaatta

SEQ ID NO: 162391 - DNA, 9 bp, Unknown
  misc_feature (1)..( 9): Result.004 file - promoters50/1029433
tattataaa

SEQ ID NO: 162392 - DNA, 9 bp, Unknown
  misc_feature (1)..( 9): Result.004 file - promoters50/1029433
acttataaa

SEQ ID NO: 162393 - DNA, 9 bp, Unknown
  misc_feature (1)..( 9): Result.004 file - promoters50/1029444
tatgatacg

SEQ ID NO: 162394 - DNA, 11 bp, Unknown
  misc_feature (1)..( 11): Result.004 file - promoters50/1029444
tatattttgca

SEQ ID NO: 162395 - DNA, 11 bp, Unknown
  misc_feature (1)..( 11): Result.004 file - promoters50/1029444
aaaattttgtt

SEQ ID NO: 162396 - DNA, 11 bp, Unknown
  misc_feature (1)..( 11): Result.004 file - promoters50/1029444
ataattttcat

SEQ ID NO: 162397 - DNA, 8 bp, Unknown
  misc_feature (1)..( 8): Result.004 file - promoters50/1029444
tatcattt

SEQ ID NO: 162398 - DNA, 8 bp, Unknown
  misc_feature (1)..( 8): Result.004 file - promoters50/1029444
tataattt

SEQ ID NO: 162399 - DNA, 8 bp, Unknown
  misc_feature (1)..( 8): Result.004 file - promoters50/1029444
actaattt

SEQ ID NO: 162400 - DNA, 10 bp, Unknown
  misc_feature (1)..( 10): Result.004 file - promoters50/1029444
gttaaataaa

SEQ ID NO: 162401 - DNA, 10 bp, Unknown
  misc_feature (1)..( 10): Result.004 file - promoters50/1029444
actaaaaaaa

SEQ ID NO: 162402 - DNA, 10 bp, Unknown
  misc_feature (1)..( 10): Result.004 file - promoters50/1029543
actgaaagat

SEQ ID NO: 162403 - DNA, 8 bp, Unknown
  misc_feature (1)..( 8): Result.004 file - promoters50/1029543
tttattat

SEQ ID NO: 162404 - DNA, 8 bp, Unknown
  misc_feature (1)..( 8): Result.004 file - promoters50/1029543
attactat

SEQ ID NO: 162405 - DNA, 8 bp, Unknown
  misc_feature (1)..( 8): Result.004 file - promoters50/1029543
tttcttat

SEQ ID NO: 162406 - DNA, 8 bp, Unknown
  misc_feature (1)..( 8): Result.004 file - promoters50/1029543
attacttc

SEQ ID NO: 162407 - DNA, 8 bp, Unknown
  misc_feature (1)..( 8): Result.004 file - promoters50/1029543
attaattc

SEQ ID NO: 162408 - DNA, 8 bp, Unknown
  misc_feature (1)..( 8): Result.004 file - promoters50/1029576
attacttt

SEQ ID NO: 162409 - DNA, 9 bp, Unknown
  misc_feature (1)..( 9): Result.004 file - promoters50/1029576
cttaacaca

SEQ ID NO: 162410 - DNA, 9 bp, Unknown
  misc_feature (1)..( 9): Result.004 file - promoters50/1029576
tttaacatt

SEQ ID NO: 162411 - DNA, 9 bp, Unknown
  misc_feature (1)..( 9): Result.004 file - promoters50/1029576
ttttacatt

SEQ ID NO: 162412 - DNA, 11 bp, Unknown
  misc_feature (1)..( 11): Result.004 file - promoters50/1029576
taacacactta

SEQ ID NO: 162413 - DNA, 11 bp, Unknown
  misc_feature (1)..( 11): Result.004 file - promoters50/1029576
tttaacattta

SEQ ID NO: 162414 - DNA, 11 bp, Unknown
  misc_feature (1)..( 11): Result.004 file - promoters50/1029576
ttttacattct

SEQ ID NO: 162415 - DNA, 7 bp, Unknown
  misc_feature (1)..( 7): Result.004 file - promoters50/1029576
aaaaatt

SEQ ID NO: 162416 - DNA, 7 bp, Unknown
  misc_feature (1)..( 7): Result.004 file - promoters50/1029576
taaaatt

SEQ ID NO: 162417 - DNA, 7 bp, Unknown
  misc_feature (1)..( 7): Result.004 file - promoters50/1029576
aaaaatt

SEQ ID NO: 162418 - DNA, 13 bp, Unknown
  misc_feature (1)..( 13): Result.004 file - promoters50/1029576
gagagatgtagac

SEQ ID NO: 162419 - DNA, 13 bp, Unknown
  misc_feature (1)..( 13): Result.004 file - promoters50/1029576
gagaaatgtattt

SEQ ID NO: 162420 - DNA, 13 bp, Unknown
  misc_feature (1)..( 13): Result.004 file - promoters50/1029576
cacagatgaattt

SEQ ID NO: 162421 - DNA, 7 bp, Unknown
  misc_feature (1)..( 7): Result.004 file - promoters50/1029576
ctaaaaa

SEQ ID NO: 162422 - DNA, 7 bp, Unknown
  misc_feature (1)..( 7): Result.004 file - promoters50/1029576
ataaaaa

SEQ ID NO: 162423 - DNA, 7 bp, Unknown
  misc_feature (1)..( 7): Result.004 file - promoters50/1029576
atataaa

SEQ ID NO: 162424 - DNA, 8 bp, Unknown
  misc_feature (1)..( 8): Result.004 file - promoters50/1029576
tatttgag

SEQ ID NO: 162425 - DNA, 8 bp, Unknown
  misc_feature (1)..( 8): Result.004 file - promoters50/1029576
catttgag

SEQ ID NO: 162426 - DNA, 8 bp, Unknown
  misc_feature (1)..( 8): Result.004 file - promoters50/1029590
tatatgat

SEQ ID NO: 162427 - DNA, 7 bp, Unknown
  misc_feature (1)..( 7): Result.004 file - promoters50/1029590
atctgat

SEQ ID NO: 162428 - DNA, 7 bp, Unknown
  misc_feature (1)..( 7): Result.004 file - promoters50/1029590
atctgat

SEQ ID NO: 162429 - DNA, 7 bp, Unknown
  misc_feature (1)..( 7): Result.004 file - promoters50/1029590
atccgat

SEQ ID NO: 162430 - DNA, 9 bp, Unknown
  misc_feature (1)..( 9): Result.004 file - promoters50/1029590
tttacctcc

SEQ ID NO: 162431 - DNA, 9 bp, Unknown
  misc_feature (1)..( 9): Result.004 file - promoters50/1029590
ttttcctaa

SEQ ID NO: 162432 - DNA, 9 bp, Unknown
  misc_feature (1)..( 9): Result.004 file - promoters50/1029636
gtttcttaa

SEQ ID NO: 162433 - DNA, 15 bp, Unknown
  misc_feature (1)..( 15): Result.004 file - promoters50/1029636
attattaaaaataaa

SEQ ID NO: 162434 - DNA, 15 bp, Unknown
  misc_feature (1)..( 15): Result.004 file - promoters50/1029636
attgttataaaaaaa

SEQ ID NO: 162435 - DNA, 15 bp, Unknown
  misc_feature (1)..( 15): Result.004 file - promoters50/1029636
cggtctaaaaacatg

SEQ ID NO: 162436 - DNA, 12 bp, Unknown
  misc_feature (1)..( 12): Result.004 file - promoters50/1029636
gttaggttggat

SEQ ID NO: 162437 - DNA, 12 bp, Unknown
  misc_feature (1)..( 12): Result.004 file - promoters50/1029636
gttcggttcgat

SEQ ID NO: 162438 - DNA, 12 bp, Unknown
  misc_feature (1)..( 12): Result.004 file - promoters50/1029636
atccgggtcggg

SEQ ID NO: 162439 - DNA, 11 bp, Unknown
  misc_feature (1)..( 11): Result.004 file - promoters50/1029636
tataactttat

SEQ ID NO: 162440 - DNA, 11 bp, Unknown
  misc_feature (1)..( 11): Result.004 file - promoters50/1029636
aataaatttat

SEQ ID NO: 162441 - DNA, 11 bp, Unknown
  misc_feature (1)..( 11): Result.004 file - promoters50/1029791
aatcaattgcg

SEQ ID NO: 162442 - DNA, 7 bp, Unknown
  misc_feature (1)..( 7): Result.004 file - promoters50/1029791
gaagaat

SEQ ID NO: 162443 - DNA, 7 bp, Unknown
  misc_feature (1)..( 7): Result.004 file - promoters50/1029791
gaataat

SEQ ID NO: 162444 - DNA, 7 bp, Unknown
  misc_feature (1)..( 7): Result.004 file - promoters50/1029794
gaacaat

SEQ ID NO: 162445 - DNA, 8 bp, Unknown
  misc_feature (1)..( 8): Result.004 file - promoters50/1029794
ttagtaat

SEQ ID NO: 162446 - DNA, 8 bp, Unknown
  misc_feature (1)..( 8): Result.004 file - promoters50/1029794
ttaataaa

SEQ ID NO: 162447 - DNA, 8 bp, Unknown
  misc_feature (1)..( 8): Result.004 file - promoters50/1029837
taaataaa

SEQ ID NO: 162448 - DNA, 11 bp, Unknown
  misc_feature (1)..( 11): Result.004 file - promoters50/1029837
aataatataat

SEQ ID NO: 162449 - DNA, 11 bp, Unknown
  misc_feature (1)..( 11): Result.004 file - promoters50/1029837
cataatagaga

SEQ ID NO: 162450 - DNA, 11 bp, Unknown
  misc_feature (1)..( 11): Result.004 file - promoters50/1029837
aattatatata

SEQ ID NO: 162451 - DNA, 11 bp, Unknown
  misc_feature (1)..( 11): Result.004 file - promoters50/1029837
aagtatatact

SEQ ID NO: 162452 - DNA, 11 bp, Unknown
  misc_feature (1)..( 11): Result.004 file - promoters50/1029837
atacatatact

SEQ ID NO: 162453 - DNA, 10 bp, Unknown
  misc_feature (1)..( 10): Result.004 file - promoters50/1029837
aagatttgta

SEQ ID NO: 162454 - DNA, 10 bp, Unknown
  misc_feature (1)..( 10): Result.004 file - promoters50/1029837
atgattggta

SEQ ID NO: 162455 - DNA, 10 bp, Unknown
  misc_feature (1)..( 10): Result.004 file - promoters50/1029837
aagttttgag

SEQ ID NO: 162456 - DNA, 10 bp, Unknown
  misc_feature (1)..( 10): Result.004 file - promoters50/1029837
aaattttgag

SEQ ID NO: 162457 - DNA, 10 bp, Unknown
  misc_feature (1)..( 10): Result.004 file - promoters50/1029841
aagtttattg

SEQ ID NO: 162458 - DNA, 12 bp, Unknown
  misc_feature (1)..( 12): Result.004 file - promoters50/1029841
acataataatta

SEQ ID NO: 162459 - DNA, 12 bp, Unknown
  misc_feature (1)..( 12): Result.004 file - promoters50/1029841
cttaaatattta

SEQ ID NO: 162460 - DNA, 11 bp, Unknown
  misc_feature (1)..( 11): Result.004 file - promoters50/1029841
attaaaaatca

SEQ ID NO: 162461 - DNA, 12 bp, Unknown
  misc_feature (1)..( 12): Result.004 file - promoters50/1029841
atggaataatcc

SEQ ID NO: 162462 - DNA, 12 bp, Unknown
  misc_feature (1)..( 12): Result.004 file - promoters50/1029892
cttagatattat

SEQ ID NO: 162463 - DNA, 9 bp, Unknown
  misc_feature (1)..( 9): Result.004 file - promoters50/1029892
gaataagaa

SEQ ID NO: 162464 - DNA, 9 bp, Unknown
  misc_feature (1)..( 9): Result.004 file - promoters50/1029892
gaagaagaa

SEQ ID NO: 162465 - DNA, 9 bp, Unknown
  misc_feature (1)..( 9): Result.004 file - promoters50/1029908
gaggtagat

SEQ ID NO: 162466 - DNA, 12 bp, Unknown
  misc_feature (1)..( 12): Result.004 file - promoters50/1029908
tgagaagattta

SEQ ID NO: 162467 - DNA, 12 bp, Unknown
  misc_feature (1)..( 12): Result.004 file - promoters50/1029908
aagaaagattct

SEQ ID NO: 162468 - DNA, 12 bp, Unknown
  misc_feature (1)..( 12): Result.004 file - promoters50/1029908
tcttaagatttc

SEQ ID NO: 162469 - DNA, 12 bp, Unknown
  misc_feature (1)..( 12): Result.004 file - promoters50/1029908
tttcaaggtttg

SEQ ID NO: 162470 - DNA, 12 bp, Unknown
  misc_feature (1)..( 12): Result.004 file - promoters50/1029908
aaaaaagataat

SEQ ID NO: 162471 - DNA, 12 bp, Unknown
  misc_feature (1)..( 12): Result.004 file - promoters50/1029908
aagaaaaattac

SEQ ID NO: 162472 - DNA, 12 bp, Unknown
  misc_feature (1)..( 12): Result.004 file - promoters50/1029908
aaaagaggtttg

SEQ ID NO: 162473 - DNA, 12 bp, Unknown
  misc_feature (1)..( 12): Result.004 file - promoters50/1029908
ccaggaggtttt

SEQ ID NO: 162474 - DNA, 14 bp, Unknown
  misc_feature (1)..( 14): Result.004 file - promoters50/1029908
aatgtattttatgt

SEQ ID NO: 162475 - DNA, 14 bp, Unknown
  misc_feature (1)..( 14): Result.004 file - promoters50/1029908
tttgtgtttgttgt

SEQ ID NO: 162476 - DNA, 14 bp, Unknown
  misc_feature (1)..( 14): Result.004 file - promoters50/1029908
tgattattatatgt

SEQ ID NO: 162477 - DNA, 14 bp, Unknown
  misc_feature (1)..( 14): Result.004 file - promoters50/1029908
aatatatctcaagg

SEQ ID NO: 162478 - DNA, 14 bp, Unknown
  misc_feature (1)..( 14): Result.004 file - promoters50/1029908
catgcattccaaag

SEQ ID NO: 162479 - DNA, 14 bp, Unknown
  misc_feature (1)..( 14): Result.004 file - promoters50/1029952
catatattctatta

SEQ ID NO: 162480 - DNA, 11 bp, Unknown
  misc_feature (1)..( 11): Result.004 file - promoters50/1029952
cttttatatca

SEQ ID NO: 162481 - DNA, 11 bp, Unknown
  misc_feature (1)..( 11): Result.004 file - promoters50/1029952
cttatattctt

SEQ ID NO: 162482 - DNA, 11 bp, Unknown
  misc_feature (1)..( 11): Result.004 file - promoters50/1029952
gttttatactc

SEQ ID NO: 162483 - DNA, 11 bp, Unknown
  misc_feature (1)..( 11): Result.004 file - promoters50/1029952
tatttatatag

SEQ ID NO: 162484 - DNA, 11 bp, Unknown
  misc_feature (1)..( 11): Result.004 file - promoters50/1029952
catatatactt

SEQ ID NO: 162485 - DNA, 11 bp, Unknown
  misc_feature (1)..( 11): Result.004 file - promoters50/1029952
cttaaatagat

SEQ ID NO: 162486 - DNA, 11 bp, Unknown
  misc_feature (1)..( 11): Result.004 file - promoters50/1029952
tggagaaaaaa

SEQ ID NO: 162487 - DNA, 11 bp, Unknown
  misc_feature (1)..( 11): Result.004 file - promoters50/1029952
tggagaaaaaa

SEQ ID NO: 162488 - DNA, 10 bp, Unknown
  misc_feature (1)..( 10): Result.004 file - promoters50/1029952
cgagaaaaga

SEQ ID NO: 162489 - DNA, 11 bp, Unknown
  misc_feature (1)..( 11): Result.004 file - promoters50/1029952
taaagaaaaag

SEQ ID NO: 162490 - DNA, 11 bp, Unknown
  misc_feature (1)..( 11): Result.004 file - promoters50/1029952
acaaggaaaga

SEQ ID NO: 162491 - DNA, 11 bp, Unknown
  misc_feature (1)..( 11): Result.004 file - promoters50/1029952
acaagaagaag

SEQ ID NO: 162492 - DNA, 10 bp, Unknown
  misc_feature (1)..( 10): Result.004 file - promoters50/1029952
aatgggcctt

SEQ ID NO: 162493 - DNA, 10 bp, Unknown
  misc_feature (1)..( 10): Result.004 file - promoters50/1029952
aatgggctgg

SEQ ID NO: 162494 - DNA, 10 bp, Unknown
  misc_feature (1)..( 10): Result.004 file - promoters50/1029952
aataggccca

SEQ ID NO: 162495 - DNA, 10 bp, Unknown
  misc_feature (1)..( 10): Result.004 file - promoters50/1029952
aaaaggccca

SEQ ID NO: 162496 - DNA, 10 bp, Unknown
  misc_feature (1)..( 10): Result.004 file - promoters50/1029952
tatgggcctt

SEQ ID NO: 162497 - DNA, 10 bp, Unknown
  misc_feature (1)..( 10): Result.004 file - promoters50/1030069
aaaaggccca

SEQ ID NO: 162498 - DNA, 8 bp, Unknown
  misc_feature (1)..( 8): Result.004 file - promoters50/1030069
actaataa

SEQ ID NO: 162499 - DNA, 7 bp, Unknown
  misc_feature (1)..( 7): Result.004 file - promoters50/1030069
ataataa

SEQ ID NO: 162500 - DNA, 8 bp, Unknown
  misc_feature (1)..( 8): Result.004 file - promoters50/1030069
aattatac

SEQ ID NO: 162501 - DNA, 7 bp, Unknown
  misc_feature (1)..( 7): Result.004 file - promoters50/1030069
aatgata

SEQ ID NO: 162502 - DNA, 7 bp, Unknown
  misc_feature (1)..( 7): Result.004 file - promoters50/1030069
aataata

SEQ ID NO: 162503 - DNA, 7 bp, Unknown
  misc_feature (1)..( 7): Result.004 file - promoters50/1030069
aattata

SEQ ID NO: 162504 - DNA, 8 bp, Unknown
  misc_feature (1)..( 8): Result.004 file - promoters50/1030069
tatagtgg

SEQ ID NO: 162505 - DNA, 8 bp, Unknown
  misc_feature (1)..( 8): Result.004 file - promoters50/1030069
gataatgg

SEQ ID NO: 162506 - DNA, 8 bp, Unknown
  misc_feature (1)..( 8): Result.004 file - promoters50/1030126
aatagtaa

SEQ ID NO: 162507 - DNA, 10 bp, Unknown
  misc_feature (1)..( 10): Result.004 file - promoters50/1030126
taatcaaaaa

SEQ ID NO: 162508 - DNA, 10 bp, Unknown
  misc_feature (1)..( 10): Result.004 file - promoters50/1030126
taagcaaaaa

SEQ ID NO: 162509 - DNA, 10 bp, Unknown
  misc_feature (1)..( 10): Result.004 file - promoters50/1030126
taaccaaaac

SEQ ID NO: 162510 - DNA, 10 bp, Unknown
  misc_feature (1)..( 10): Result.004 file - promoters50/1030126
aaattaaatg

SEQ ID NO: 162511 - DNA, 10 bp, Unknown
  misc_feature (1)..( 10): Result.004 file - promoters50/1030126
gaagcaagct

SEQ ID NO: 162512 - DNA, 10 bp, Unknown
  misc_feature (1)..( 10): Result.004 file - promoters50/1030126
agattaaaat

SEQ ID NO: 162513 - DNA, 22 bp, Unknown
  misc_feature (1)..( 22): Result.004 file - promoters50/1030126
tttttttgttttgattataata

SEQ ID NO: 162514 - DNA, 22 bp, Unknown
  misc_feature (1)..( 22): Result.004 file - promoters50/1030126
accttggttttcgattaacaaa

SEQ ID NO: 162515 - DNA, 22 bp, Unknown
  misc_feature (1)..( 22): Result.004 file - promoters50/1030126
aaataaatttttgagttaaaaa

SEQ ID NO: 162516 - DNA, 22 bp, Unknown
  misc_feature (1)..( 22): Result.004 file - promoters50/1030126
aacaaaatgtttgaatgttaca

SEQ ID NO: 162517 - DNA, 22 bp, Unknown
  misc_feature (1)..( 22): Result.004 file - promoters50/1030126
gtatgtttaatggattaagaaa

SEQ ID NO: 162518 - DNA, 22 bp, Unknown
  misc_feature (1)..( 22): Result.004 file - promoters50/1030126
aaacaaatgtttgtctttgtta

SEQ ID NO: 162519 - DNA, 13 bp, Unknown
  misc_feature (1)..( 13): Result.004 file - promoters50/1030126
aacctatgattag

SEQ ID NO: 162520 - DNA, 13 bp, Unknown
  misc_feature (1)..( 13): Result.004 file - promoters50/1030126
actgtatgtttaa

SEQ ID NO: 162521 - DNA, 13 bp, Unknown
  misc_feature (1)..( 13): Result.004 file - promoters50/1030126
aaccaatgatatt

SEQ ID NO: 162522 - DNA, 13 bp, Unknown
  misc_feature (1)..( 13): Result.004 file - promoters50/1030126
acaaaatgtttga

SEQ ID NO: 162523 - DNA, 13 bp, Unknown
  misc_feature (1)..( 13): Result.004 file - promoters50/1030126
aataaatttttga

SEQ ID NO: 162524 - DNA, 14 bp, Unknown
  misc_feature (1)..( 14): Result.004 file - promoters50/1030126
gtataatgaattaa

SEQ ID NO: 162525 - DNA, 12 bp, Unknown
  misc_feature (1)..( 12): Result.004 file - promoters50/1030126
aaatgaaaaaaa

SEQ ID NO: 162526 - DNA, 12 bp, Unknown
  misc_feature (1)..( 12): Result.004 file - promoters50/1030126
taatcaaatata

SEQ ID NO: 162527 - DNA, 12 bp, Unknown
  misc_feature (1)..( 12): Result.004 file - promoters50/1030126
taatcaaatttc

SEQ ID NO: 162528 - DNA, 12 bp, Unknown
  misc_feature (1)..( 12): Result.004 file - promoters50/1030126
ctatcatattat

SEQ ID NO: 162529 - DNA, 12 bp, Unknown
  misc_feature (1)..( 12): Result.004 file - promoters50/1030126
ttattatattga

SEQ ID NO: 162530 - DNA, 12 bp, Unknown
  misc_feature (1)..( 12): Result.004 file - promoters50/1030126
taataaaaccgg

SEQ ID NO: 162531 - DNA, 12 bp, Unknown
  misc_feature (1)..( 12): Result.004 file - promoters50/1030126
gtttcacatata

SEQ ID NO: 162532 - DNA, 12 bp, Unknown
  misc_feature (1)..( 12): Result.004 file - promoters50/1030126
atattattagcc

SEQ ID NO: 162533 - DNA, 9 bp, Unknown
  misc_feature (1)..( 9): Result.004 file - promoters50/1030126
attataata

SEQ ID NO: 162534 - DNA, 9 bp, Unknown
  misc_feature (1)..( 9): Result.004 file - promoters50/1030126
actatcata

SEQ ID NO: 162535 - DNA, 9 bp, Unknown
  misc_feature (1)..( 9): Result.004 file - promoters50/1030126
gttattata

SEQ ID NO: 162536 - DNA, 9 bp, Unknown
  misc_feature (1)..( 9): Result.004 file - promoters50/1030126
actatcata

SEQ ID NO: 162537 - DNA, 9 bp, Unknown
  misc_feature (1)..( 9): Result.004 file - promoters50/1030126
cttattaca

SEQ ID NO: 162538 - DNA, 9 bp, Unknown
  misc_feature (1)..( 9): Result.004 file - promoters50/1030126
aatattatt

SEQ ID NO: 162539 - DNA, 9 bp, Unknown
  misc_feature (1)..( 9): Result.004 file - promoters50/1030126
caacaaaat

SEQ ID NO: 162540 - DNA, 9 bp, Unknown
  misc_feature (1)..( 9): Result.004 file - promoters50/1030126
taacaaagt

SEQ ID NO: 162541 - DNA, 9 bp, Unknown
  misc_feature (1)..( 9): Result.004 file - promoters50/1030126
taaaaaaaa

SEQ ID NO: 162542 - DNA, 9 bp, Unknown
  misc_feature (1)..( 9): Result.004 file - promoters50/1030126
acacatagt

SEQ ID NO: 162543 - DNA, 9 bp, Unknown
  misc_feature (1)..( 9): Result.004 file - promoters50/1030126
atacatata

SEQ ID NO: 162544 - DNA, 9 bp, Unknown
  misc_feature (1)..( 9): Result.004 file - promoters50/1030126
ttaaaatgt

SEQ ID NO: 162545 - DNA, 9 bp, Unknown
  misc_feature (1)..( 9): Result.004 file - promoters50/1030139
ataaataaa

SEQ ID NO: 162546 - DNA, 9 bp, Unknown
  misc_feature (1)..( 9): Result.004 file - promoters50/1030139
aaaagaaac

SEQ ID NO: 162547 - DNA, 9 bp, Unknown
  misc_feature (1)..( 9): Result.004 file - promoters50/1030139
ctaagaaac

SEQ ID NO: 162548 - DNA, 9 bp, Unknown
  misc_feature (1)..( 9): Result.004 file - promoters50/1030139
ataagaatt

SEQ ID NO: 162549 - DNA, 9 bp, Unknown
  misc_feature (1)..( 9): Result.004 file - promoters50/1030139
ataagtatt

SEQ ID NO: 162550 - DNA, 10 bp, Unknown
  misc_feature (1)..( 10): Result.004 file - promoters50/1030139
tgattagcaa

SEQ ID NO: 162551 - DNA, 10 bp, Unknown
  misc_feature (1)..( 10): Result.004 file - promoters50/1030139
tgattagtta

SEQ ID NO: 162552 - DNA, 10 bp, Unknown
  misc_feature (1)..( 10): Result.004 file - promoters50/1030139
cgatgagtac

SEQ ID NO: 162553 - DNA, 10 bp, Unknown
  misc_feature (1)..( 10): Result.004 file - promoters50/1030157
tcattagtta

SEQ ID NO: 162554 - DNA, 10 bp, Unknown
  misc_feature (1)..( 10): Result.004 file - promoters50/1030157
taaaaaaata

SEQ ID NO: 162555 - DNA, 10 bp, Unknown
  misc_feature (1)..( 10): Result.004 file - promoters50/1030157
tgaaataata

SEQ ID NO: 162556 - DNA, 10 bp, Unknown
  misc_feature (1)..( 10): Result.004 file - promoters50/1030157
tgaaatatcg

SEQ ID NO: 162557 - DNA, 10 bp, Unknown
  misc_feature (1)..( 10): Result.004 file - promoters50/1030157
tgaaatgtca

SEQ ID NO: 162558 - DNA, 10 bp, Unknown
  misc_feature (1)..( 10): Result.004 file - promoters50/1030192
tgagatatat

SEQ ID NO: 162559 - DNA, 8 bp, Unknown
  misc_feature (1)..( 8): Result.004 file - promoters50/1030192
tcgtttta

SEQ ID NO: 162560 - DNA, 8 bp, Unknown
  misc_feature (1)..( 8): Result.004 file - promoters50/1030192
ttgtttta

SEQ ID NO: 162561 - DNA, 8 bp, Unknown
  misc_feature (1)..( 8): Result.004 file - promoters50/1030223
ttgtctta

SEQ ID NO: 162562 - DNA, 16 bp, Unknown
  misc_feature (1)..( 16): Result.004 file - promoters50/1030223
tataatactctgatac

SEQ ID NO: 162563 - DNA, 16 bp, Unknown
  misc_feature (1)..( 16): Result.004 file - promoters50/1030223
aataatactctgatac

SEQ ID NO: 162564 - DNA, 16 bp, Unknown
  misc_feature (1)..( 16): Result.004 file - promoters50/1030223
tattataaaccctaaa

SEQ ID NO: 162565 - DNA, 27 bp, Unknown
  misc_feature (1)..( 27): Result.004 file - promoters50/1030223
tgtgataaatttcctttaactttactt

SEQ ID NO: 162566 - DNA, 27 bp, Unknown
  misc_feature (1)..( 27): Result.004 file - promoters50/1030223
tgtgataaatttcatttaactttgctt

SEQ ID NO: 162567 - DNA, 27 bp, Unknown
  misc_feature (1)..( 27): Result.004 file - promoters50/1030223
aatataaaatttctttagacatacaat

SEQ ID NO: 162568 - DNA, 15 bp, Unknown
  misc_feature (1)..( 15): Result.004 file - promoters50/1030223
ttttgataaaatatt

SEQ ID NO: 162569 - DNA, 15 bp, Unknown
  misc_feature (1)..( 15): Result.004 file - promoters50/1030223
ttttgataaattatt

SEQ ID NO: 162570 - DNA, 15 bp, Unknown
  misc_feature (1)..( 15): Result.004 file - promoters50/1030223
tagacatacaatata

SEQ ID NO: 162571 - DNA, 9 bp, Unknown
  misc_feature (1)..( 9): Result.004 file - promoters50/1030223
ttcgtttct

SEQ ID NO: 162572 - DNA, 9 bp, Unknown
  misc_feature (1)..( 9): Result.004 file - promoters50/1030223
ttcgttttc

SEQ ID NO: 162573 - DNA, 9 bp, Unknown
  misc_feature (1)..( 9): Result.004 file - promoters50/1030223
cccgtctct

SEQ ID NO: 162574 - DNA, 16 bp, Unknown
  misc_feature (1)..( 16): Result.004 file - promoters50/1030223
cgtttctataaataga

SEQ ID NO: 162575 - DNA, 16 bp, Unknown
  misc_feature (1)..( 16): Result.004 file - promoters50/1030223
gttttctataaataga

SEQ ID NO: 162576 - DNA, 16 bp, Unknown
  misc_feature (1)..( 16): Result.004 file - promoters50/1030223
cgtctctctcttgcta

SEQ ID NO: 162577 - DNA, 11 bp, Unknown
  misc_feature (1)..( 11): Result.004 file - promoters50/1030223
aaatttgatac

SEQ ID NO: 162578 - DNA, 11 bp, Unknown
  misc_feature (1)..( 11): Result.004 file - promoters50/1030223
aaatttgatca

SEQ ID NO: 162579 - DNA, 11 bp, Unknown
  misc_feature (1)..( 11): Result.004 file - promoters50/1030231
actcttgttca

SEQ ID NO: 162580 - DNA, 9 bp, Unknown
  misc_feature (1)..( 9): Result.004 file - promoters50/1030231
caaaaattg

SEQ ID NO: 162581 - DNA, 9 bp, Unknown
  misc_feature (1)..( 9): Result.004 file - promoters50/1030231
caaaaatgg

SEQ ID NO: 162582 - DNA, 9 bp, Unknown
  misc_feature (1)..( 9): Result.004 file - promoters50/1030231
cgaaaatgg

SEQ ID NO: 162583 - DNA, 9 bp, Unknown
  misc_feature (1)..( 9): Result.004 file - promoters50/1030231
cgagaatcc

SEQ ID NO: 162584 - DNA, 9 bp, Unknown
  misc_feature (1)..( 9): Result.004 file - promoters50/1030231
agagaatta

SEQ ID NO: 162585 - DNA, 9 bp, Unknown
  misc_feature (1)..( 9): Result.004 file - promoters50/1030242
atagaattc

SEQ ID NO: 162586 - DNA, 8 bp, Unknown
  misc_feature (1)..( 8): Result.004 file - promoters50/1030242
caattatt

SEQ ID NO: 162587 - DNA, 8 bp, Unknown
  misc_feature (1)..( 8): Result.004 file - promoters50/1030242
caattaca

SEQ ID NO: 162588 - DNA, 8 bp, Unknown
  misc_feature (1)..( 8): Result.004 file - promoters50/1030242
aaattatt

SEQ ID NO: 162589 - DNA, 8 bp, Unknown
  misc_feature (1)..( 8): Result.004 file - promoters50/1030242
taacaaag

SEQ ID NO: 162590 - DNA, 8 bp, Unknown
  misc_feature (1)..( 8): Result.004 file - promoters50/1030242
taaaaaac

SEQ ID NO: 162591 - DNA, 8 bp, Unknown
  misc_feature (1)..( 8): Result.004 file - promoters50/1030283
aaacactt

SEQ ID NO: 162592 - DNA, 15 bp, Unknown
  misc_feature (1)..( 15): Result.004 file - promoters50/1030283
caaatttttactttt

SEQ ID NO: 162593 - DNA, 15 bp, Unknown
  misc_feature (1)..( 15): Result.004 file - promoters50/1030283
caaacttttattttt

SEQ ID NO: 162594 - DNA, 15 bp, Unknown
  misc_feature (1)..( 15): Result.004 file - promoters50/1030283
aacattttttccaga

SEQ ID NO: 162595 - DNA, 15 bp, Unknown
  misc_feature (1)..( 15): Result.004 file - promoters50/1030283
ccgttttttaggtcc

SEQ ID NO: 162596 - DNA, 15 bp, Unknown
  misc_feature (1)..( 15): Result.004 file - promoters50/1030283
ttgttttttaatttc

SEQ ID NO: 162597 - DNA, 15 bp, Unknown
  misc_feature (1)..( 15): Result.004 file - promoters50/1030312
aatatctttcacctt

SEQ ID NO: 162598 - DNA, 12 bp, Unknown
  misc_feature (1)..( 12): Result.004 file - promoters50/1030312
cagcttctgtaa

SEQ ID NO: 162599 - DNA, 12 bp, Unknown
  misc_feature (1)..( 12): Result.004 file - promoters50/1030312
caggttctcaga

SEQ ID NO: 162600 - DNA, 12 bp, Unknown
  misc_feature (1)..( 12): Result.004 file - promoters50/1030312
aagggtctgaga

SEQ ID NO: 162601 - DNA, 11 bp, Unknown
  misc_feature (1)..( 11): Result.004 file - promoters50/1030312
aatgtcagatt

SEQ ID NO: 162602 - DNA, 11 bp, Unknown
  misc_feature (1)..( 11): Result.004 file - promoters50/1030312
gttctcagatt

SEQ ID NO: 162603 - DNA, 11 bp, Unknown
  misc_feature (1)..( 11): Result.004 file - promoters50/1030321
agggtctgaga

SEQ ID NO: 162604 - DNA, 11 bp, Unknown
  misc_feature (1)..( 11): Result.004 file - promoters50/1030321
gccgttgttgt

SEQ ID NO: 162605 - DNA, 11 bp, Unknown
  misc_feature (1)..( 11): Result.004 file - promoters50/1030321
gattttgttgg

SEQ ID NO: 162606 - DNA, 11 bp, Unknown
  misc_feature (1)..( 11): Result.004 file - promoters50/1030321
aaagtttttgt

SEQ ID NO: 162607 - DNA, 11 bp, Unknown
  misc_feature (1)..( 11): Result.004 file - promoters50/1030321
catgtttataa

SEQ ID NO: 162608 - DNA, 11 bp, Unknown
  misc_feature (1)..( 11): Result.004 file - promoters50/1030321
ttgtttgtttc

SEQ ID NO: 162609 - DNA, 11 bp, Unknown
  misc_feature (1)..( 11): Result.004 file - promoters50/1030324
aaggttttaac

SEQ ID NO: 162610 - DNA, 21 bp, Unknown
  misc_feature (1)..( 21): Result.004 file - promoters50/1030324
ttataaataatctcttaaaac

SEQ ID NO: 162611 - DNA, 21 bp, Unknown
  misc_feature (1)..( 21): Result.004 file - promoters50/1030324
agtatataaatcccttaaacc

SEQ ID NO: 162612 - DNA, 21 bp, Unknown
  misc_feature (1)..( 21): Result.004 file - promoters50/1030324
tatttatgaatccatataaag

SEQ ID NO: 162613 - DNA, 21 bp, Unknown
  misc_feature (1)..( 21): Result.004 file - promoters50/1030324
cctttataaaaccctaattcg

SEQ ID NO: 162614 - DNA, 21 bp, Unknown
  misc_feature (1)..( 21): Result.004 file - promoters50/1030324
actataaacaaaccttaaacc

SEQ ID NO: 162615 - DNA, 21 bp, Unknown
  misc_feature (1)..( 21): Result.004 file - promoters50/1030324
gttatataaatccttcactcg

SEQ ID NO: 162616 - DNA, 21 bp, Unknown
  misc_feature (1)..( 21): Result.004 file - promoters50/1030324
gttttatactcacagtcaaag

SEQ ID NO: 162617 - DNA, 15 bp, Unknown
  misc_feature (1)..( 15): Result.004 file - promoters50/1030324
tctatgaatcatgtc

SEQ ID NO: 162618 - DNA, 15 bp, Unknown
  misc_feature (1)..( 15): Result.004 file - promoters50/1030324
tctttgaatattgaa

SEQ ID NO: 162619 - DNA, 15 bp, Unknown
  misc_feature (1)..( 15): Result.004 file - promoters50/1030324
attataaatcatccg

SEQ ID NO: 162620 - DNA, 15 bp, Unknown
  misc_feature (1)..( 15): Result.004 file - promoters50/1030324
ctcttgcatagaaat

SEQ ID NO: 162621 - DNA, 15 bp, Unknown
  misc_feature (1)..( 15): Result.004 file - promoters50/1030324
tctttggattaatgt

SEQ ID NO: 162622 - DNA, 15 bp, Unknown
  misc_feature (1)..( 15): Result.004 file - promoters50/1030324
caaacaaatcaaatc

SEQ ID NO: 162623 - DNA, 15 bp, Unknown
  misc_feature (1)..( 15): Result.004 file - promoters50/1030324
gaaattgatcataaa

SEQ ID NO: 162624 - DNA, 13 bp, Unknown
  misc_feature (1)..( 13): Result.004 file - promoters50/1030324
cttataaataatc

SEQ ID NO: 162625 - DNA, 13 bp, Unknown
  misc_feature (1)..( 13): Result.004 file - promoters50/1030324
tttataaaaccct

SEQ ID NO: 162626 - DNA, 13 bp, Unknown
  misc_feature (1)..( 13): Result.004 file - promoters50/1030324
tatataaatccct

SEQ ID NO: 162627 - DNA, 13 bp, Unknown
  misc_feature (1)..( 13): Result.004 file - promoters50/1030324
actataaacaaac

SEQ ID NO: 162628 - DNA, 13 bp, Unknown
  misc_feature (1)..( 13): Result.004 file - promoters50/1030324
tatataaatcctt

SEQ ID NO: 162629 - DNA, 13 bp, Unknown
  misc_feature (1)..( 13): Result.004 file - promoters50/1030324
tttatactcacag

SEQ ID NO: 162630 - DNA, 14 bp, Unknown
  misc_feature (1)..( 14): Result.004 file - promoters50/1030324
acacataatgtaga

SEQ ID NO: 162631 - DNA, 14 bp, Unknown
  misc_feature (1)..( 14): Result.004 file - promoters50/1030324
tggcttaatgtttg

SEQ ID NO: 162632 - DNA, 14 bp, Unknown
  misc_feature (1)..( 14): Result.004 file - promoters50/1030324
gctcataatttagt

SEQ ID NO: 162633 - DNA, 14 bp, Unknown
  misc_feature (1)..( 14): Result.004 file - promoters50/1030324
gaacttaagttagt

SEQ ID NO: 162634 - DNA, 14 bp, Unknown
  misc_feature (1)..( 14): Result.004 file - promoters50/1030324
gatcataaaaaccc

SEQ ID NO: 162635 - DNA, 14 bp, Unknown
  misc_feature (1)..( 14): Result.004 file - promoters50/1030329
gattataaatcatc

SEQ ID NO: 162636 - DNA, 9 bp, Unknown
  misc_feature (1)..( 9): Result.004 file - promoters50/1030329
tttagaaaa

SEQ ID NO: 162637 - DNA, 9 bp, Unknown
  misc_feature (1)..( 9): Result.004 file - promoters50/1030329
ggtagcaaa

SEQ ID NO: 162638 - DNA, 9 bp, Unknown
  misc_feature (1)..( 9): Result.004 file - promoters50/1030329
tttagaagc

SEQ ID NO: 162639 - DNA, 7 bp, Unknown
  misc_feature (1)..( 7): Result.004 file - promoters50/1030329
tttgaac

SEQ ID NO: 162640 - DNA, 7 bp, Unknown
  misc_feature (1)..( 7): Result.004 file - promoters50/1030329
tttgaaa

SEQ ID NO: 162641 - DNA, 8 bp, Unknown
  misc_feature (1)..( 8): Result.004 file - promoters50/1030336
gttgcaag

SEQ ID NO: 162642 - DNA, 12 bp, Unknown
  misc_feature (1)..( 12): Result.004 file - promoters50/1030336
aggtaaaccaga

SEQ ID NO: 162643 - DNA, 12 bp, Unknown
  misc_feature (1)..( 12): Result.004 file - promoters50/1030336
aggtaaaacaga

SEQ ID NO: 162644 - DNA, 12 bp, Unknown
  misc_feature (1)..( 12): Result.004 file - promoters50/1030336
aggaaaatctag

SEQ ID NO: 162645 - DNA, 12 bp, Unknown
  misc_feature (1)..( 12): Result.004 file - promoters50/1030336
gtcaaaaagaaa

SEQ ID NO: 162646 - DNA, 9 bp, Unknown
  misc_feature (1)..( 9): Result.004 file - promoters50/1030336
ccagaagaa

SEQ ID NO: 162647 - DNA, 9 bp, Unknown
  misc_feature (1)..( 9): Result.004 file - promoters50/1030336
ccaaaagag

SEQ ID NO: 162648 - DNA, 9 bp, Unknown
  misc_feature (1)..( 9): Result.004 file - promoters50/1030336
cttgaagaa

SEQ ID NO: 162649 - DNA, 8 bp, Unknown
  misc_feature (1)..( 8): Result.004 file - promoters50/1030336
aagagaaa

SEQ ID NO: 162650 - DNA, 8 bp, Unknown
  misc_feature (1)..( 8): Result.004 file - promoters50/1030336
aagagatt

SEQ ID NO: 162651 - DNA, 8 bp, Unknown
  misc_feature (1)..( 8): Result.004 file - promoters50/1030336
aagaaatt

SEQ ID NO: 162652 - DNA, 10 bp, Unknown
  misc_feature (1)..( 10): Result.004 file - promoters50/1030336
aatccttcaa

SEQ ID NO: 162653 - DNA, 10 bp, Unknown
  misc_feature (1)..( 10): Result.004 file - promoters50/1030336
aatcattcaa

SEQ ID NO: 162654 - DNA, 10 bp, Unknown
  misc_feature (1)..( 10): Result.004 file - promoters50/1030336
aatacttaaa

SEQ ID NO: 162655 - DNA, 9 bp, Unknown
  misc_feature (1)..( 9): Result.004 file - promoters50/1030336
ttgagataa

SEQ ID NO: 162656 - DNA, 9 bp, Unknown
  misc_feature (1)..( 9): Result.004 file - promoters50/1030336
ttgagaatg

SEQ ID NO: 162657 - DNA, 9 bp, Unknown
  misc_feature (1)..( 9): Result.004 file - promoters50/1030410
atgataatg

SEQ ID NO: 162658 - DNA, 8 bp, Unknown
  misc_feature (1)..( 8): Result.004 file - promoters50/1030410
cttttttc

SEQ ID NO: 162659 - DNA, 8 bp, Unknown
  misc_feature (1)..( 8): Result.004 file - promoters50/1030410
cttttttt

SEQ ID NO: 162660 - DNA, 8 bp, Unknown
  misc_feature (1)..( 8): Result.004 file - promoters50/1030428
gtttcttc

SEQ ID NO: 162661 - DNA, 7 bp, Unknown
  misc_feature (1)..( 7): Result.004 file - promoters50/1030428
tataaag

SEQ ID NO: 162662 - DNA, 7 bp, Unknown
  misc_feature (1)..( 7): Result.004 file - promoters50/1030428
aataaag

SEQ ID NO: 162663 - DNA, 7 bp, Unknown
  misc_feature (1)..( 7): Result.004 file - promoters50/1030428
tataaac

SEQ ID NO: 162664 - DNA, 7 bp, Unknown
  misc_feature (1)..( 7): Result.004 file - promoters50/1030428
tataaat

SEQ ID NO: 162665 - DNA, 7 bp, Unknown
  misc_feature (1)..( 7): Result.004 file - promoters50/1030481
tataaat

SEQ ID NO: 162666 - DNA, 8 bp, Unknown
  misc_feature (1)..( 8): Result.004 file - promoters50/1030481
aaataaaa

SEQ ID NO: 162667 - DNA, 8 bp, Unknown
  misc_feature (1)..( 8): Result.004 file - promoters50/1030481
caataaaa

SEQ ID NO: 162668 - DNA, 8 bp, Unknown
  misc_feature (1)..( 8): Result.004 file - promoters50/1030481
caagaaat

SEQ ID NO: 162669 - DNA, 7 bp, Unknown
  misc_feature (1)..( 7): Result.004 file - promoters50/1030481
taagaaa

SEQ ID NO: 162670 - DNA, 7 bp, Unknown
  misc_feature (1)..( 7): Result.004 file - promoters50/1030481
caagaaa

SEQ ID NO: 162671 - DNA, 7 bp, Unknown
  misc_feature (1)..( 7): Result.004 file - promoters50/1030481
caataaa

SEQ ID NO: 162672 - DNA, 11 bp, Unknown
  misc_feature (1)..( 11): Result.004 file - promoters50/1030481
aattaagagaa

SEQ ID NO: 162673 - DNA, 11 bp, Unknown
  misc_feature (1)..( 11): Result.004 file - promoters50/1030481
cattaacagaa

SEQ ID NO: 162674 - DNA, 11 bp, Unknown
  misc_feature (1)..( 11): Result.004 file - promoters50/1030481
aatcaataaaa

SEQ ID NO: 162675 - DNA, 8 bp, Unknown
  misc_feature (1)..( 8): Result.004 file - promoters50/1030481
tctcatgt

SEQ ID NO: 162676 - DNA, 8 bp, Unknown
  misc_feature (1)..( 8): Result.004 file - promoters50/1030481
tctcatga

SEQ ID NO: 162677 - DNA, 8 bp, Unknown
  misc_feature (1)..( 8): Result.004 file - promoters50/1030481
ggtcatga

SEQ ID NO: 162678 - DNA, 10 bp, Unknown
  misc_feature (1)..( 10): Result.004 file - promoters50/1030481
gacggtattt

SEQ ID NO: 162679 - DNA, 10 bp, Unknown
  misc_feature (1)..( 10): Result.004 file - promoters50/1030481
gacgttatat

SEQ ID NO: 162680 - DNA, 10 bp, Unknown
  misc_feature (1)..( 10): Result.004 file - promoters50/1030481
tgagttatat

SEQ ID NO: 162681 - DNA, 9 bp, Unknown
  misc_feature (1)..( 9): Result.004 file - promoters50/1030481
actaatcgg

SEQ ID NO: 162682 - DNA, 9 bp, Unknown
  misc_feature (1)..( 9): Result.004 file - promoters50/1030481
actcatctt

SEQ ID NO: 162683 - DNA, 9 bp, Unknown
  misc_feature (1)..( 9): Result.004 file - promoters50/1030481
cctcacctt

SEQ ID NO: 162684 - DNA, 9 bp, Unknown
  misc_feature (1)..( 9): Result.004 file - promoters50/1030481
ctcaaccat

SEQ ID NO: 162685 - DNA, 9 bp, Unknown
  misc_feature (1)..( 9): Result.004 file - promoters50/1030481
ctcacccat

SEQ ID NO: 162686 - DNA, 9 bp, Unknown
  misc_feature (1)..( 9): Result.004 file - promoters50/1030519
aaaacccat

SEQ ID NO: 162687 - DNA, 10 bp, Unknown
  misc_feature (1)..( 10): Result.004 file - promoters50/1030519
aagaacaaaa

SEQ ID NO: 162688 - DNA, 10 bp, Unknown
  misc_feature (1)..( 10): Result.004 file - promoters50/1030519
aagaagaaac

SEQ ID NO: 162689 - DNA, 10 bp, Unknown
  misc_feature (1)..( 10): Result.004 file - promoters50/1030519
aaacacaaaa

SEQ ID NO: 162690 - DNA, 8 bp, Unknown
  misc_feature (1)..( 8): Result.004 file - promoters50/1030519
aaaacaat

SEQ ID NO: 162691 - DNA, 8 bp, Unknown
  misc_feature (1)..( 8): Result.004 file - promoters50/1030519
aaaagaat

SEQ ID NO: 162692 - DNA, 9 bp, Unknown
  misc_feature (1)..( 9): Result.004 file - promoters50/1030519
aaacacaaa

SEQ ID NO: 162693 - DNA, 9 bp, Unknown
  misc_feature (1)..( 9): Result.004 file - promoters50/1030519
attcttatc

SEQ ID NO: 162694 - DNA, 9 bp, Unknown
  misc_feature (1)..( 9): Result.004 file - promoters50/1030519
atttttaat

SEQ ID NO: 162695 - DNA, 9 bp, Unknown
  misc_feature (1)..( 9): Result.004 file - promoters50/1030519
tttcatatc

SEQ ID NO: 162696 - DNA, 8 bp, Unknown
  misc_feature (1)..( 8): Result.004 file - promoters50/1030519
aaagcttg

SEQ ID NO: 162697 - DNA, 8 bp, Unknown
  misc_feature (1)..( 8): Result.004 file - promoters50/1030519
aaaccttg

SEQ ID NO: 162698 - DNA, 8 bp, Unknown
  misc_feature (1)..( 8): Result.004 file - promoters50/1030528
tgagcttg

SEQ ID NO: 162699 - DNA, 10 bp, Unknown
  misc_feature (1)..( 10): Result.004 file - promoters50/1030528
tttttaaaaa

SEQ ID NO: 162700 - DNA, 10 bp, Unknown
  misc_feature (1)..( 10): Result.004 file - promoters50/1030528
ttattaaaat

SEQ ID NO: 162701 - DNA, 10 bp, Unknown
  misc_feature (1)..( 10): Result.004 file - promoters50/1030528
gaactaaaaa

SEQ ID NO: 162702 - DNA, 10 bp, Unknown
  misc_feature (1)..( 10): Result.004 file - promoters50/1030528
atcttaaaac

SEQ ID NO: 162703 - DNA, 10 bp, Unknown
  misc_feature (1)..( 10): Result.004 file - promoters50/1030528
ttattaaagt

SEQ ID NO: 162704 - DNA, 10 bp, Unknown
  misc_feature (1)..( 10): Result.004 file - promoters50/1030528
ttactaatag

SEQ ID NO: 162705 - DNA, 10 bp, Unknown
  misc_feature (1)..( 10): Result.004 file - promoters50/1030528
aatactaatt

SEQ ID NO: 162706 - DNA, 10 bp, Unknown
  misc_feature (1)..( 10): Result.004 file - promoters50/1030528
tataataatt

SEQ ID NO: 162707 - DNA, 10 bp, Unknown
  misc_feature (1)..( 10): Result.004 file - promoters50/1030528
tttactaata

SEQ ID NO: 162708 - DNA, 11 bp, Unknown
  misc_feature (1)..( 11): Result.004 file - promoters50/1030528
taagaataatg

SEQ ID NO: 162709 - DNA, 11 bp, Unknown
  misc_feature (1)..( 11): Result.004 file - promoters50/1030528
gagtaatgatg

SEQ ID NO: 162710 - DNA, 10 bp, Unknown
  misc_feature (1)..( 10): Result.004 file - promoters50/1030528
aagaaaaatt

SEQ ID NO: 162711 - DNA, 11 bp, Unknown
  misc_feature (1)..( 11): Result.004 file - promoters50/1030528
actaaatgata

SEQ ID NO: 162712 - DNA, 13 bp, Unknown
  misc_feature (1)..( 13): Result.004 file - promoters50/1030528
attatttttttaa

SEQ ID NO: 162713 - DNA, 13 bp, Unknown
  misc_feature (1)..( 13): Result.004 file - promoters50/1030528
gttatatttttaa

SEQ ID NO: 162714 - DNA, 13 bp, Unknown
  misc_feature (1)..( 13): Result.004 file - promoters50/1030528
tttaattttgtta

SEQ ID NO: 162715 - DNA, 13 bp, Unknown
  misc_feature (1)..( 13): Result.004 file - promoters50/1030528
attattaaagtat

SEQ ID NO: 162716 - DNA, 13 bp, Unknown
  misc_feature (1)..( 13): Result.004 file - promoters50/1030528
tttaaatttatta

SEQ ID NO: 162717 - DNA, 13 bp, Unknown
  misc_feature (1)..( 13): Result.004 file - promoters50/1030528
ctaattcttatct

SEQ ID NO: 162718 - DNA, 13 bp, Unknown
  misc_feature (1)..( 13): Result.004 file - promoters50/1030528
gcaaatcttgttt

SEQ ID NO: 162719 - DNA, 11 bp, Unknown
  misc_feature (1)..( 11): Result.004 file - promoters50/1030528
taatgattatt

SEQ ID NO: 162720 - DNA, 11 bp, Unknown
  misc_feature (1)..( 11): Result.004 file - promoters50/1030528
aaatgatatga

SEQ ID NO: 162721 - DNA, 11 bp, Unknown
  misc_feature (1)..( 11): Result.004 file - promoters50/1030528
aaattattaaa

SEQ ID NO: 162722 - DNA, 12 bp, Unknown
  misc_feature (1)..( 12): Result.004 file - promoters50/1030528
tgtcttattaaa

SEQ ID NO: 162723 - DNA, 11 bp, Unknown
  misc_feature (1)..( 11): Result.004 file - promoters50/1030528
taattgaacta

SEQ ID NO: 162724 - DNA, 12 bp, Unknown
  misc_feature (1)..( 12): Result.004 file - promoters50/1030528
taatagaagagt

SEQ ID NO: 162725 - DNA, 13 bp, Unknown
  misc_feature (1)..( 13): Result.004 file - promoters50/1030528
taatgattatttt

SEQ ID NO: 162726 - DNA, 13 bp, Unknown
  misc_feature (1)..( 13): Result.004 file - promoters50/1030528
ttgggattatctt

SEQ ID NO: 162727 - DNA, 13 bp, Unknown
  misc_feature (1)..( 13): Result.004 file - promoters50/1030528
gaaaaattattaa

SEQ ID NO: 162728 - DNA, 13 bp, Unknown
  misc_feature (1)..( 13): Result.004 file - promoters50/1030528
tgtaaattgtctt

SEQ ID NO: 162729 - DNA, 13 bp, Unknown
  misc_feature (1)..( 13): Result.004 file - promoters50/1030528
gtctaattttaat

SEQ ID NO: 162730 - DNA, 13 bp, Unknown
  misc_feature (1)..( 13): Result.004 file - promoters50/1030528
ctctaattcttat

SEQ ID NO: 162731 - DNA, 11 bp, Unknown
  misc_feature (1)..( 11): Result.004 file - promoters50/1030528
taaattgtctt

SEQ ID NO: 162732 - DNA, 11 bp, Unknown
  misc_feature (1)..( 11): Result.004 file - promoters50/1030528
aaaaatgttat

SEQ ID NO: 162733 - DNA, 11 bp, Unknown
  misc_feature (1)..( 11): Result.004 file - promoters50/1030528
gggattatctt

SEQ ID NO: 162734 - DNA, 11 bp, Unknown
  misc_feature (1)..( 11): Result.004 file - promoters50/1030528
taaatgatatg

SEQ ID NO: 162735 - DNA, 11 bp, Unknown
  misc_feature (1)..( 11): Result.004 file - promoters50/1030528
ctaattttaat

SEQ ID NO: 162736 - DNA, 11 bp, Unknown
  misc_feature (1)..( 11): Result.004 file - promoters50/1030528
aaaaattatta

SEQ ID NO: 162737 - DNA, 11 bp, Unknown
  misc_feature (1)..( 11): Result.004 file - promoters50/1030528
attcttatctt

SEQ ID NO: 162738 - DNA, 13 bp, Unknown
  misc_feature (1)..( 13): Result.004 file - promoters50/1030528
ttatcagagataa

SEQ ID NO: 162739 - DNA, 13 bp, Unknown
  misc_feature (1)..( 13): Result.004 file - promoters50/1030528
ctattagacggac

SEQ ID NO: 162740 - DNA, 13 bp, Unknown
  misc_feature (1)..( 13): Result.004 file - promoters50/1030528
ttatcaacaacgt

SEQ ID NO: 162741 - DNA, 13 bp, Unknown
  misc_feature (1)..( 13): Result.004 file - promoters50/1030528
ttaacaaaagaaa

SEQ ID NO: 162742 - DNA, 13 bp, Unknown
  misc_feature (1)..( 13): Result.004 file - promoters50/1030528
acattaaacgaat

SEQ ID NO: 162743 - DNA, 13 bp, Unknown
  misc_feature (1)..( 13): Result.004 file - promoters50/1030528
attttagtcggtc

SEQ ID NO: 162744 - DNA, 13 bp, Unknown
  misc_feature (1)..( 13): Result.004 file - promoters50/1030530
aaaaaagtctgtc

SEQ ID NO: 162745 - DNA, 9 bp, Unknown
  misc_feature (1)..( 9): Result.004 file - promoters50/1030530
tgaacaaaa

SEQ ID NO: 162746 - DNA, 9 bp, Unknown
  misc_feature (1)..( 9): Result.004 file - promoters50/1030530
ggaaaaaaa

SEQ ID NO: 162747 - DNA, 9 bp, Unknown
  misc_feature (1)..( 9): Result.004 file - promoters50/1030530
tcaacgaaa

SEQ ID NO: 162748 - DNA, 9 bp, Unknown
  misc_feature (1)..( 9): Result.004 file - promoters50/1030530
ttaaaaaat

SEQ ID NO: 162749 - DNA, 9 bp, Unknown
  misc_feature (1)..( 9): Result.004 file - promoters50/1030530
ggagaaacg

SEQ ID NO: 162750 - DNA, 9 bp, Unknown
  misc_feature (1)..( 9): Result.004 file - promoters50/1030530
tcaaacaat

SEQ ID NO: 162751 - DNA, 11 bp, Unknown
  misc_feature (1)..( 11): Result.004 file - promoters50/1030530
gaacaaaatat

SEQ ID NO: 162752 - DNA, 11 bp, Unknown
  misc_feature (1)..( 11): Result.004 file - promoters50/1030530
gagacaaatat

SEQ ID NO: 162753 - DNA, 11 bp, Unknown
  misc_feature (1)..( 11): Result.004 file - promoters50/1030530
ttaaaaaataa

SEQ ID NO: 162754 - DNA, 11 bp, Unknown
  misc_feature (1)..( 11): Result.004 file - promoters50/1030530
ggaaaaaaacg

SEQ ID NO: 162755 - DNA, 11 bp, Unknown
  misc_feature (1)..( 11): Result.004 file - promoters50/1030530
ggagaaacgac

SEQ ID NO: 162756 - DNA, 11 bp, Unknown
  misc_feature (1)..( 11): Result.004 file - promoters50/1030581
tcaaacaatca

SEQ ID NO: 162757 - DNA, 14 bp, Unknown
  misc_feature (1)..( 14): Result.004 file - promoters50/1030581
gaatttgaaagaga

SEQ ID NO: 162758 - DNA, 14 bp, Unknown
  misc_feature (1)..( 14): Result.004 file - promoters50/1030581
ggttttgaagctta

SEQ ID NO: 162759 - DNA, 14 bp, Unknown
  misc_feature (1)..( 14): Result.004 file - promoters50/1030581
aaatgtgaaatgta

SEQ ID NO: 162760 - DNA, 14 bp, Unknown
  misc_feature (1)..( 14): Result.004 file - promoters50/1030581
ttgttggaagggaa

SEQ ID NO: 162761 - DNA, 15 bp, Unknown
  misc_feature (1)..( 15): Result.004 file - promoters50/1030581
tagtttagaacatct

SEQ ID NO: 162762 - DNA, 15 bp, Unknown
  misc_feature (1)..( 15): Result.004 file - promoters50/1030581
aaactgtgaaactgt

SEQ ID NO: 162763 - DNA, 15 bp, Unknown
  misc_feature (1)..( 15): Result.004 file - promoters50/1030581
ggacgtggaatcgac

SEQ ID NO: 162764 - DNA, 12 bp, Unknown
  misc_feature (1)..( 12): Result.004 file - promoters50/1030581
tctaaaatctct

SEQ ID NO: 162765 - DNA, 12 bp, Unknown
  misc_feature (1)..( 12): Result.004 file - promoters50/1030581
atgcaaatatct

SEQ ID NO: 162766 - DNA, 12 bp, Unknown
  misc_feature (1)..( 12): Result.004 file - promoters50/1030581
cccaaaatctga

SEQ ID NO: 162767 - DNA, 12 bp, Unknown
  misc_feature (1)..( 12): Result.004 file - promoters50/1030581
aataaaatcaga

SEQ ID NO: 162768 - DNA, 12 bp, Unknown
  misc_feature (1)..( 12): Result.004 file - promoters50/1030581
cgacaaatatgg

SEQ ID NO: 162769 - DNA, 12 bp, Unknown
  misc_feature (1)..( 12): Result.004 file - promoters50/1030581
atgtaaatagca

SEQ ID NO: 162770 - DNA, 12 bp, Unknown
  misc_feature (1)..( 12): Result.004 file - promoters50/1030591
gttgaaattcac

SEQ ID NO: 162771 - DNA, 8 bp, Unknown
  misc_feature (1)..( 8): Result.004 file - promoters50/1030591
tttattgg

SEQ ID NO: 162772 - DNA, 8 bp, Unknown
  misc_feature (1)..( 8): Result.004 file - promoters50/1030591
gttattgg

SEQ ID NO: 162773 - DNA, 8 bp, Unknown
  misc_feature (1)..( 8): Result.004 file - promoters50/1030591
gttatttg

SEQ ID NO: 162774 - DNA, 8 bp, Unknown
  misc_feature (1)..( 8): Result.004 file - promoters50/1030591
gaatagat

SEQ ID NO: 162775 - DNA, 8 bp, Unknown
  misc_feature (1)..( 8): Result.004 file - promoters50/1030591
aaatagat

SEQ ID NO: 162776 - DNA, 8 bp, Unknown
  misc_feature (1)..( 8): Result.004 file - promoters50/1030605
aaatagct

SEQ ID NO: 162777 - DNA, 14 bp, Unknown
  misc_feature (1)..( 14): Result.004 file - promoters50/1030605
gttttgatcgcttt

SEQ ID NO: 162778 - DNA, 14 bp, Unknown
  misc_feature (1)..( 14): Result.004 file - promoters50/1030605
tatttaatcagaaa

SEQ ID NO: 162779 - DNA, 14 bp, Unknown
  misc_feature (1)..( 14): Result.004 file - promoters50/1030605
attttgacatcata

SEQ ID NO: 162780 - DNA, 14 bp, Unknown
  misc_feature (1)..( 14): Result.004 file - promoters50/1030605
attttgaaatcatg

SEQ ID NO: 162781 - DNA, 14 bp, Unknown
  misc_feature (1)..( 14): Result.004 file - promoters50/1030605
tttttgaacttatg

SEQ ID NO: 162782 - DNA, 14 bp, Unknown
  misc_feature (1)..( 14): Result.004 file - promoters50/1030605
ctatcaaaataatg

SEQ ID NO: 162783 - DNA, 11 bp, Unknown
  misc_feature (1)..( 11): Result.004 file - promoters50/1030605
aaaataataat

SEQ ID NO: 162784 - DNA, 11 bp, Unknown
  misc_feature (1)..( 11): Result.004 file - promoters50/1030605
aaaaaaataca

SEQ ID NO: 162785 - DNA, 11 bp, Unknown
  misc_feature (1)..( 11): Result.004 file - promoters50/1030605
caaataaaaca

SEQ ID NO: 162786 - DNA, 11 bp, Unknown
  misc_feature (1)..( 11): Result.004 file - promoters50/1030605
taaaaaatgtt

SEQ ID NO: 162787 - DNA, 11 bp, Unknown
  misc_feature (1)..( 11): Result.004 file - promoters50/1030605
aaaaaaagaat

SEQ ID NO: 162788 - DNA, 11 bp, Unknown
  misc_feature (1)..( 11): Result.004 file - promoters50/1030605
cgaaaaaggtg

SEQ ID NO: 162789 - DNA, 11 bp, Unknown
  misc_feature (1)..( 11): Result.004 file - promoters50/1030605
caactaatttg

SEQ ID NO: 162790 - DNA, 13 bp, Unknown
  misc_feature (1)..( 13): Result.004 file - promoters50/1030605
gacatatttttat

SEQ ID NO: 162791 - DNA, 13 bp, Unknown
  misc_feature (1)..( 13): Result.004 file - promoters50/1030605
aaaatatatttaa

SEQ ID NO: 162792 - DNA, 13 bp, Unknown
  misc_feature (1)..( 13): Result.004 file - promoters50/1030605
actttttttttaa

SEQ ID NO: 162793 - DNA, 13 bp, Unknown
  misc_feature (1)..( 13): Result.004 file - promoters50/1030605
tgattattttttg

SEQ ID NO: 162794 - DNA, 13 bp, Unknown
  misc_feature (1)..( 13): Result.004 file - promoters50/1030605
tgaatttataagc

SEQ ID NO: 162795 - DNA, 13 bp, Unknown
  misc_feature (1)..( 13): Result.004 file - promoters50/1030605
aaattttattgct

SEQ ID NO: 162796 - DNA, 13 bp, Unknown
  misc_feature (1)..( 13): Result.004 file - promoters50/1030605
ataataaattttg

SEQ ID NO: 162797 - DNA, 11 bp, Unknown
  misc_feature (1)..( 11): Result.004 file - promoters50/1030605
aaaaaaagaat

SEQ ID NO: 162798 - DNA, 11 bp, Unknown
  misc_feature (1)..( 11): Result.004 file - promoters50/1030605
gaatgaagaat

SEQ ID NO: 162799 - DNA, 11 bp, Unknown
  misc_feature (1)..( 11): Result.004 file - promoters50/1030605
aaaaaaaaaat

SEQ ID NO: 162800 - DNA, 11 bp, Unknown
  misc_feature (1)..( 11): Result.004 file - promoters50/1030605
ttacgaaaaag

SEQ ID NO: 162801 - DNA, 11 bp, Unknown
  misc_feature (1)..( 11): Result.004 file - promoters50/1030605
ttttaaaaaat

SEQ ID NO: 162802 - DNA, 11 bp, Unknown
  misc_feature (1)..( 11): Result.004 file - promoters50/1030605
cattaacaaat

SEQ ID NO: 162803 - DNA, 14 bp, Unknown
  misc_feature (1)..( 14): Result.004 file - promoters50/1030605
cgattgacatattt

SEQ ID NO: 162804 - DNA, 14 bp, Unknown
  misc_feature (1)..( 14): Result.004 file - promoters50/1030605
ttattgagatagta

SEQ ID NO: 162805 - DNA, 14 bp, Unknown
  misc_feature (1)..( 14): Result.004 file - promoters50/1030605
attttgacatcata

SEQ ID NO: 162806 - DNA, 14 bp, Unknown
  misc_feature (1)..( 14): Result.004 file - promoters50/1030605
attttgaaatcatg

SEQ ID NO: 162807 - DNA, 14 bp, Unknown
  misc_feature (1)..( 14): Result.004 file - promoters50/1030605
tttttgaacttatg

SEQ ID NO: 162808 - DNA, 14 bp, Unknown
  misc_feature (1)..( 14): Result.004 file - promoters50/1030605
ctatcaaaataatg

SEQ ID NO: 162809 - DNA, 16 bp, Unknown
  misc_feature (1)..( 16): Result.004 file - promoters50/1030605
tttataaattagacga

SEQ ID NO: 162810 - DNA, 16 bp, Unknown
  misc_feature (1)..( 16): Result.004 file - promoters50/1030605
aaaatacattaggaca

SEQ ID NO: 162811 - DNA, 16 bp, Unknown
  misc_feature (1)..( 16): Result.004 file - promoters50/1030605
ataagtaatttttaaa

SEQ ID NO: 162812 - DNA, 16 bp, Unknown
  misc_feature (1)..( 16): Result.004 file - promoters50/1030605
caactaatttgtcaga

SEQ ID NO: 162813 - DNA, 16 bp, Unknown
  misc_feature (1)..( 16): Result.004 file - promoters50/1030605
attcaacaatagaggt

SEQ ID NO: 162814 - DNA, 16 bp, Unknown
  misc_feature (1)..( 16): Result.004 file - promoters50/1030616
ttaacaaataaaacag

SEQ ID NO: 162815 - DNA, 8 bp, Unknown
  misc_feature (1)..( 8): Result.004 file - promoters50/1030616
gaaattat

SEQ ID NO: 162816 - DNA, 8 bp, Unknown
  misc_feature (1)..( 8): Result.004 file - promoters50/1030616
caaaatat

SEQ ID NO: 162817 - DNA, 8 bp, Unknown
  misc_feature (1)..( 8): Result.004 file - promoters50/1030616
gaaatttg

SEQ ID NO: 162818 - DNA, 8 bp, Unknown
  misc_feature (1)..( 8): Result.004 file - promoters50/1030616
gaaaatat

SEQ ID NO: 162819 - DNA, 8 bp, Unknown
  misc_feature (1)..( 8): Result.004 file - promoters50/1030616
caaaatga

SEQ ID NO: 162820 - DNA, 13 bp, Unknown
  misc_feature (1)..( 13): Result.004 file - promoters50/1030616
ttgtaaaacatta

SEQ ID NO: 162821 - DNA, 13 bp, Unknown
  misc_feature (1)..( 13): Result.004 file - promoters50/1030616
ttctaaaatattg

SEQ ID NO: 162822 - DNA, 13 bp, Unknown
  misc_feature (1)..( 13): Result.004 file - promoters50/1030616
acataacagaaat

SEQ ID NO: 162823 - DNA, 13 bp, Unknown
  misc_feature (1)..( 13): Result.004 file - promoters50/1030616
tatgtaaattttg

SEQ ID NO: 162824 - DNA, 13 bp, Unknown
  misc_feature (1)..( 13): Result.004 file - promoters50/1030616
catataaatatac

SEQ ID NO: 162825 - DNA, 14 bp, Unknown
  misc_feature (1)..( 14): Result.004 file - promoters50/1030616
aaactcttaccgaa

SEQ ID NO: 162826 - DNA, 14 bp, Unknown
  misc_feature (1)..( 14): Result.004 file - promoters50/1030616
aaacttttaaaatg

SEQ ID NO: 162827 - DNA, 14 bp, Unknown
  misc_feature (1)..( 14): Result.004 file - promoters50/1030616
tctattttaattcg

SEQ ID NO: 162828 - DNA, 14 bp, Unknown
  misc_feature (1)..( 14): Result.004 file - promoters50/1030616
attaatttaatttt

SEQ ID NO: 162829 - DNA, 14 bp, Unknown
  misc_feature (1)..( 14): Result.004 file - promoters50/1030616
aagaatttaaatgt

SEQ ID NO: 162830 - DNA, 14 bp, Unknown
  misc_feature (1)..( 14): Result.004 file - promoters50/1030616
tacaaattaaattt

SEQ ID NO: 162831 - DNA, 10 bp, Unknown
  misc_feature (1)..( 10): Result.004 file - promoters50/1030616
aaatgaaatg

SEQ ID NO: 162832 - DNA, 10 bp, Unknown
  misc_feature (1)..( 10): Result.004 file - promoters50/1030616
aaatgacacg

SEQ ID NO: 162833 - DNA, 10 bp, Unknown
  misc_feature (1)..( 10): Result.004 file - promoters50/1030616
gaatcaaaaa

SEQ ID NO: 162834 - DNA, 11 bp, Unknown
  misc_feature (1)..( 11): Result.004 file - promoters50/1030616
ttatccaaaaa

SEQ ID NO: 162835 - DNA, 11 bp, Unknown
  misc_feature (1)..( 11): Result.004 file - promoters50/1030616
aaaagacgtag

SEQ ID NO: 162836 - DNA, 13 bp, Unknown
  misc_feature (1)..( 13): Result.004 file - promoters50/1030616
atataattaagag

SEQ ID NO: 162837 - DNA, 13 bp, Unknown
  misc_feature (1)..( 13): Result.004 file - promoters50/1030616
atacaattgcacg

SEQ ID NO: 162838 - DNA, 13 bp, Unknown
  misc_feature (1)..( 13): Result.004 file - promoters50/1030616
acataattatctt

SEQ ID NO: 162839 - DNA, 13 bp, Unknown
  misc_feature (1)..( 13): Result.004 file - promoters50/1030616
gcatcattaaaca

SEQ ID NO: 162840 - DNA, 13 bp, Unknown
  misc_feature (1)..( 13): Result.004 file - promoters50/1030715
atttaaatatgct

SEQ ID NO: 162841 - DNA, 11 bp, Unknown
  misc_feature (1)..( 11): Result.004 file - promoters50/1030715
tattatttcca

SEQ ID NO: 162842 - DNA, 11 bp, Unknown
  misc_feature (1)..( 11): Result.004 file - promoters50/1030715
aaatatttcat

SEQ ID NO: 162843 - DNA, 11 bp, Unknown
  misc_feature (1)..( 11): Result.004 file - promoters50/1030715
ttatattttaa

SEQ ID NO: 162844 - DNA, 11 bp, Unknown
  misc_feature (1)..( 11): Result.004 file - promoters50/1030715
atatattgcta

SEQ ID NO: 162845 - DNA, 12 bp, Unknown
  misc_feature (1)..( 12): Result.004 file - promoters50/1030715
ttatatgttaaa

SEQ ID NO: 162846 - DNA, 10 bp, Unknown
  misc_feature (1)..( 10): Result.004 file - promoters50/1030715
ttctttaaga

SEQ ID NO: 162847 - DNA, 10 bp, Unknown
  misc_feature (1)..( 10): Result.004 file - promoters50/1030715
ttgtttcaga

SEQ ID NO: 162848 - DNA, 10 bp, Unknown
  misc_feature (1)..( 10): Result.004 file - promoters50/1030715
ttcttaaagc

SEQ ID NO: 162849 - DNA, 10 bp, Unknown
  misc_feature (1)..( 10): Result.004 file - promoters50/1030757
ttcttagcgg

SEQ ID NO: 162850 - DNA, 11 bp, Unknown
  misc_feature (1)..( 11): Result.004 file - promoters50/1030757
taaatacattt

SEQ ID NO: 162851 - DNA, 11 bp, Unknown
  misc_feature (1)..( 11): Result.004 file - promoters50/1030757
caaaaacaact

SEQ ID NO: 162852 - DNA, 11 bp, Unknown
  misc_feature (1)..( 11): Result.004 file - promoters50/1030757
caaatacattg

SEQ ID NO: 162853 - DNA, 11 bp, Unknown
  misc_feature (1)..( 11): Result.004 file - promoters50/1030757
ctgataaattt

SEQ ID NO: 162854 - DNA, 11 bp, Unknown
  misc_feature (1)..( 11): Result.004 file - promoters50/1030757
aagatacgttg

SEQ ID NO: 162855 - DNA, 11 bp, Unknown
  misc_feature (1)..( 11): Result.004 file - promoters50/1030757
caaatatttcc

SEQ ID NO: 162856 - DNA, 12 bp, Unknown
  misc_feature (1)..( 12): Result.004 file - promoters50/1030757
caatttattagg

SEQ ID NO: 162857 - DNA, 12 bp, Unknown
  misc_feature (1)..( 12): Result.004 file - promoters50/1030757
gaatatattact

SEQ ID NO: 162858 - DNA, 12 bp, Unknown
  misc_feature (1)..( 12): Result.004 file - promoters50/1030757
tcattttcaaag

SEQ ID NO: 162859 - DNA, 12 bp, Unknown
  misc_feature (1)..( 12): Result.004 file - promoters50/1030757
gtttttcttatc

SEQ ID NO: 162860 - DNA, 12 bp, Unknown
  misc_feature (1)..( 12): Result.004 file - promoters50/1030757
caatttttagtc

SEQ ID NO: 162861 - DNA, 12 bp, Unknown
  misc_feature (1)..( 12): Result.004 file - promoters50/1030757
ttctttcttttt

SEQ ID NO: 162862 - DNA, 15 bp, Unknown
  misc_feature (1)..( 15): Result.004 file - promoters50/1030757
ttacacttttatgtt

SEQ ID NO: 162863 - DNA, 15 bp, Unknown
  misc_feature (1)..( 15): Result.004 file - promoters50/1030757
gaaaacttttatata

SEQ ID NO: 162864 - DNA, 15 bp, Unknown
  misc_feature (1)..( 15): Result.004 file - promoters50/1030757
aatcactttactagg

SEQ ID NO: 162865 - DNA, 15 bp, Unknown
  misc_feature (1)..( 15): Result.004 file - promoters50/1030757
ttttgatttcataca

SEQ ID NO: 162866 - DNA, 15 bp, Unknown
  misc_feature (1)..( 15): Result.004 file - promoters50/1030757
tttcgaatttaaata

SEQ ID NO: 162867 - DNA, 15 bp, Unknown
  misc_feature (1)..( 15): Result.004 file - promoters50/1030757
aatcattttcttttt

SEQ ID NO: 162868 - DNA, 10 bp, Unknown
  misc_feature (1)..( 10): Result.004 file - promoters50/1030757
ccggttttga

SEQ ID NO: 162869 - DNA, 10 bp, Unknown
  misc_feature (1)..( 10): Result.004 file - promoters50/1030757
acggatttac

SEQ ID NO: 162870 - DNA, 10 bp, Unknown
  misc_feature (1)..( 10): Result.004 file - promoters50/1030757
tcagatatac

SEQ ID NO: 162871 - DNA, 10 bp, Unknown
  misc_feature (1)..( 10): Result.004 file - promoters50/1030757
taagaaatag

SEQ ID NO: 162872 - DNA, 10 bp, Unknown
  misc_feature (1)..( 10): Result.004 file - promoters50/1030757
aaagaaattg

SEQ ID NO: 162873 - DNA, 10 bp, Unknown
  misc_feature (1)..( 10): Result.004 file - promoters50/1030757
atggatttga

SEQ ID NO: 162874 - DNA, 10 bp, Unknown
  misc_feature (1)..( 10): Result.004 file - promoters50/1030771
acggatatcg

SEQ ID NO: 162875 - DNA, 9 bp, Unknown
  misc_feature (1)..( 9): Result.004 file - promoters50/1030771
tgaaaaaaa

SEQ ID NO: 162876 - DNA, 9 bp, Unknown
  misc_feature (1)..( 9): Result.004 file - promoters50/1030771
tgaaaaagt

SEQ ID NO: 162877 - DNA, 9 bp, Unknown
  misc_feature (1)..( 9): Result.004 file - promoters50/1030771
ttaaaaaaa

SEQ ID NO: 162878 - DNA, 9 bp, Unknown
  misc_feature (1)..( 9): Result.004 file - promoters50/1030771
taaaagagt

SEQ ID NO: 162879 - DNA, 10 bp, Unknown
  misc_feature (1)..( 10): Result.004 file - promoters50/1030771
tgaaaataaa

SEQ ID NO: 162880 - DNA, 8 bp, Unknown
  misc_feature (1)..( 8): Result.004 file - promoters50/1030771
aaaaaaac

SEQ ID NO: 162881 - DNA, 8 bp, Unknown
  misc_feature (1)..( 8): Result.004 file - promoters50/1030771
tcaaaaac

SEQ ID NO: 162882 - DNA, 9 bp, Unknown
  misc_feature (1)..( 9): Result.004 file - promoters50/1030771
aaaataaac

SEQ ID NO: 162883 - DNA, 9 bp, Unknown
  misc_feature (1)..( 9): Result.004 file - promoters50/1030771
taaaaaaaa

SEQ ID NO: 162884 - DNA, 9 bp, Unknown
  misc_feature (1)..( 9): Result.004 file - promoters50/1030803
aaagtaatt

SEQ ID NO: 162885 - DNA, 9 bp, Unknown
  misc_feature (1)..( 9): Result.004 file - promoters50/1030803
tcggtgaag

SEQ ID NO: 162886 - DNA, 9 bp, Unknown
  misc_feature (1)..( 9): Result.004 file - promoters50/1030803
tcggagaat

SEQ ID NO: 162887 - DNA, 9 bp, Unknown
  misc_feature (1)..( 9): Result.004 file - promoters50/1030821
aatgtgaag

SEQ ID NO: 162888 - DNA, 14 bp, Unknown
  misc_feature (1)..( 14): Result.004 file - promoters50/1030821
aaacaatgtactta

SEQ ID NO: 162889 - DNA, 14 bp, Unknown
  misc_feature (1)..( 14): Result.004 file - promoters50/1030821
aaaaaataatcaga

SEQ ID NO: 162890 - DNA, 14 bp, Unknown
  misc_feature (1)..( 14): Result.004 file - promoters50/1030821
gtacaatctactta

SEQ ID NO: 162891 - DNA, 14 bp, Unknown
  misc_feature (1)..( 14): Result.004 file - promoters50/1030821
catcaataaactta

SEQ ID NO: 162892 - DNA, 14 bp, Unknown
  misc_feature (1)..( 14): Result.004 file - promoters50/1030821
agataatgtactga

SEQ ID NO: 162893 - DNA, 14 bp, Unknown
  misc_feature (1)..( 14): Result.004 file - promoters50/1030821
gtgaaatgtatagg

SEQ ID NO: 162894 - DNA, 9 bp, Unknown
  misc_feature (1)..( 9): Result.004 file - promoters50/1030821
caaaccaat

SEQ ID NO: 162895 - DNA, 9 bp, Unknown
  misc_feature (1)..( 9): Result.004 file - promoters50/1030821
gaaaacaaa

SEQ ID NO: 162896 - DNA, 9 bp, Unknown
  misc_feature (1)..( 9): Result.004 file - promoters50/1030821
caatccaaa

SEQ ID NO: 162897 - DNA, 9 bp, Unknown
  misc_feature (1)..( 9): Result.004 file - promoters50/1030821
taaactaat

SEQ ID NO: 162898 - DNA, 10 bp, Unknown
  misc_feature (1)..( 10): Result.004 file - promoters50/1030821
ctatccgaag

SEQ ID NO: 162899 - DNA, 10 bp, Unknown
  misc_feature (1)..( 10): Result.004 file - promoters50/1030821
atatcgaaaa

SEQ ID NO: 162900 - DNA, 10 bp, Unknown
  misc_feature (1)..( 10): Result.004 file - promoters50/1030821
atattttttt

SEQ ID NO: 162901 - DNA, 10 bp, Unknown
  misc_feature (1)..( 10): Result.004 file - promoters50/1030821
gtattgtttc

SEQ ID NO: 162902 - DNA, 10 bp, Unknown
  misc_feature (1)..( 10): Result.004 file - promoters50/1030821
aaatttttgc

SEQ ID NO: 162903 - DNA, 11 bp, Unknown
  misc_feature (1)..( 11): Result.004 file - promoters50/1030821
ttgttttctta

SEQ ID NO: 162904 - DNA, 11 bp, Unknown
  misc_feature (1)..( 11): Result.004 file - promoters50/1030821
gtattgcagag

SEQ ID NO: 162905 - DNA, 11 bp, Unknown
  misc_feature (1)..( 11): Result.004 file - promoters50/1030916
taattttgcat

SEQ ID NO: 162906 - DNA, 13 bp, Unknown
  misc_feature (1)..( 13): Result.004 file - promoters50/1030916
atttcaaaaacgt

SEQ ID NO: 162907 - DNA, 13 bp, Unknown
  misc_feature (1)..( 13): Result.004 file - promoters50/1030916
gggtcaaaatctg

SEQ ID NO: 162908 - DNA, 13 bp, Unknown
  misc_feature (1)..( 13): Result.004 file - promoters50/1030916
atttccaaagcaa

SEQ ID NO: 162909 - DNA, 13 bp, Unknown
  misc_feature (1)..( 13): Result.004 file - promoters50/1030916
ggagcaaaaacgt

SEQ ID NO: 162910 - DNA, 13 bp, Unknown
  misc_feature (1)..( 13): Result.004 file - promoters50/1030916
aatacaaaataat

SEQ ID NO: 162911 - DNA, 13 bp, Unknown
  misc_feature (1)..( 13): Result.004 file - promoters50/1030916
aaatcataattaa

SEQ ID NO: 162912 - DNA, 16 bp, Unknown
  misc_feature (1)..( 16): Result.004 file - promoters50/1030916
acaagaaagtactaaa

SEQ ID NO: 162913 - DNA, 16 bp, Unknown
  misc_feature (1)..( 16): Result.004 file - promoters50/1030916
gttgttttttactaac

SEQ ID NO: 162914 - DNA, 16 bp, Unknown
  misc_feature (1)..( 16): Result.004 file - promoters50/1030916
aatcaattttaataac

SEQ ID NO: 162915 - DNA, 16 bp, Unknown
  misc_feature (1)..( 16): Result.004 file - promoters50/1030916
ttttccttttaaaaag

SEQ ID NO: 162916 - DNA, 16 bp, Unknown
  misc_feature (1)..( 16): Result.004 file - promoters50/1030916
ttttgcttttaagata

SEQ ID NO: 162917 - DNA, 16 bp, Unknown
  misc_feature (1)..( 16): Result.004 file - promoters50/1030916
taaaccgattgcttca

SEQ ID NO: 162918 - DNA, 12 bp, Unknown
  misc_feature (1)..( 12): Result.004 file - promoters50/1030916
gataactgtcat

SEQ ID NO: 162919 - DNA, 12 bp, Unknown
  misc_feature (1)..( 12): Result.004 file - promoters50/1030916
ggtaattgtagt

SEQ ID NO: 162920 - DNA, 12 bp, Unknown
  misc_feature (1)..( 12): Result.004 file - promoters50/1030916
tttaattgttat

SEQ ID NO: 162921 - DNA, 12 bp, Unknown
  misc_feature (1)..( 12): Result.004 file - promoters50/1030916
gttaattgcagt

SEQ ID NO: 162922 - DNA, 12 bp, Unknown
  misc_feature (1)..( 12): Result.004 file - promoters50/1030916
attacttgattc

SEQ ID NO: 162923 - DNA, 12 bp, Unknown
  misc_feature (1)..( 12): Result.004 file - promoters50/1030916
atttcttcagct

SEQ ID NO: 162924 - DNA, 12 bp, Unknown
  misc_feature (1)..( 12): Result.004 file - promoters50/1030916
aaatattgtaag

SEQ ID NO: 162925 - DNA, 8 bp, Unknown
  misc_feature (1)..( 8): Result.004 file - promoters50/1030916
tcaaaatc

SEQ ID NO: 162926 - DNA, 8 bp, Unknown
  misc_feature (1)..( 8): Result.004 file - promoters50/1030916
ttaaaatc

SEQ ID NO: 162927 - DNA, 8 bp, Unknown
  misc_feature (1)..( 8): Result.004 file - promoters50/1030916
acaaaata

SEQ ID NO: 162928 - DNA, 8 bp, Unknown
  misc_feature (1)..( 8): Result.004 file - promoters50/1030916
tcataatt

SEQ ID NO: 162929 - DNA, 8 bp, Unknown
  misc_feature (1)..( 8): Result.004 file - promoters50/1030916
ttataatg

SEQ ID NO: 162930 - DNA, 8 bp, Unknown
  misc_feature (1)..( 8): Result.004 file - promoters50/1030916
ttacaata

SEQ ID NO: 162931 - DNA, 12 bp, Unknown
  misc_feature (1)..( 12): Result.004 file - promoters50/1030916
gttaattgcagt

SEQ ID NO: 162932 - DNA, 12 bp, Unknown
  misc_feature (1)..( 12): Result.004 file - promoters50/1030916
attacttgattc

SEQ ID NO: 162933 - DNA, 12 bp, Unknown
  misc_feature (1)..( 12): Result.004 file - promoters50/1030916
ggtaattgtagt

SEQ ID NO: 162934 - DNA, 12 bp, Unknown
  misc_feature (1)..( 12): Result.004 file - promoters50/1030916
tttaattgttat

SEQ ID NO: 162935 - DNA, 12 bp, Unknown
  misc_feature (1)..( 12): Result.004 file - promoters50/1030916
atttcttcagct

SEQ ID NO: 162936 - DNA, 12 bp, Unknown
  misc_feature (1)..( 12): Result.004 file - promoters50/1030918
aaatattgtaag

SEQ ID NO: 162937 - DNA, 8 bp, Unknown
  misc_feature (1)..( 8): Result.004 file - promoters50/1030918
cttaatga

SEQ ID NO: 162938 - DNA, 8 bp, Unknown
  misc_feature (1)..( 8): Result.004 file - promoters50/1030918
tttattga

SEQ ID NO: 162939 - DNA, 8 bp, Unknown
  misc_feature (1)..( 8): Result.004 file - promoters50/1030918
tttatttg

SEQ ID NO: 162940 - DNA, 8 bp, Unknown
  misc_feature (1)..( 8): Result.004 file - promoters50/1030933
tttattcg

SEQ ID NO: 162941 - DNA, 14 bp, Unknown
  misc_feature (1)..( 14): Result.004 file - promoters50/1030933
ataagataaggcgg

SEQ ID NO: 162942 - DNA, 14 bp, Unknown
  misc_feature (1)..( 14): Result.004 file - promoters50/1030933
agaagatactaata

SEQ ID NO: 162943 - DNA, 14 bp, Unknown
  misc_feature (1)..( 14): Result.004 file - promoters50/1030933
aaaagatcctattt

SEQ ID NO: 162944 - DNA, 14 bp, Unknown
  misc_feature (1)..( 14): Result.004 file - promoters50/1030933
agaagatgctaaac

SEQ ID NO: 162945 - DNA, 14 bp, Unknown
  misc_feature (1)..( 14): Result.004 file - promoters50/1030933
tttgaatcctataa

SEQ ID NO: 162946 - DNA, 14 bp, Unknown
  misc_feature (1)..( 14): Result.004 file - promoters50/1030940
tgtcaatgctgaac

SEQ ID NO: 162947 - DNA, 10 bp, Unknown
  misc_feature (1)..( 10): Result.004 file - promoters50/1030940
taaaaagtaa

SEQ ID NO: 162948 - DNA, 10 bp, Unknown
  misc_feature (1)..( 10): Result.004 file - promoters50/1030940
acaaatgtat

SEQ ID NO: 162949 - DNA, 10 bp, Unknown
  misc_feature (1)..( 10): Result.004 file - promoters50/1030940
ttcaatttat

SEQ ID NO: 162950 - DNA, 10 bp, Unknown
  misc_feature (1)..( 10): Result.004 file - promoters50/1030940
ccaaatgcga

SEQ ID NO: 162951 - DNA, 10 bp, Unknown
  misc_feature (1)..( 10): Result.004 file - promoters50/1030940
tttaatttat

SEQ ID NO: 162952 - DNA, 10 bp, Unknown
  misc_feature (1)..( 10): Result.004 file - promoters50/1030940
ttaaattatt

SEQ ID NO: 162953 - DNA, 11 bp, Unknown
  misc_feature (1)..( 11): Result.004 file - promoters50/1030940
caagatatttt

SEQ ID NO: 162954 - DNA, 11 bp, Unknown
  misc_feature (1)..( 11): Result.004 file - promoters50/1030940
caaaatatctt

SEQ ID NO: 162955 - DNA, 11 bp, Unknown
  misc_feature (1)..( 11): Result.004 file - promoters50/1030940
taaattatgtt

SEQ ID NO: 162956 - DNA, 11 bp, Unknown
  misc_feature (1)..( 11): Result.004 file - promoters50/1030940
tgaattttgtt

SEQ ID NO: 162957 - DNA, 11 bp, Unknown
  misc_feature (1)..( 11): Result.004 file - promoters50/1030940
ataaagatcct

SEQ ID NO: 162958 - DNA, 11 bp, Unknown
  misc_feature (1)..( 11): Result.004 file - promoters50/1030940
aaaatttttct

SEQ ID NO: 162959 - DNA, 11 bp, Unknown
  misc_feature (1)..( 11): Result.004 file - promoters50/1030940
aaaaataagaa

SEQ ID NO: 162960 - DNA, 10 bp, Unknown
  misc_feature (1)..( 10): Result.004 file - promoters50/1030940
gaaaagagaa

SEQ ID NO: 162961 - DNA, 10 bp, Unknown
  misc_feature (1)..( 10): Result.004 file - promoters50/1030940
aaaaagaaat

SEQ ID NO: 162962 - DNA, 11 bp, Unknown
  misc_feature (1)..( 11): Result.004 file - promoters50/1030940
aaaatagaaat

SEQ ID NO: 162963 - DNA, 11 bp, Unknown
  misc_feature (1)..( 11): Result.004 file - promoters50/1030940
tatatataaaa

SEQ ID NO: 162964 - DNA, 11 bp, Unknown
  misc_feature (1)..( 11): Result.004 file - promoters50/1030940
gaagtatgtgt

SEQ ID NO: 162965 - DNA, 11 bp, Unknown
  misc_feature (1)..( 11): Result.004 file - promoters50/1030940
aaaaaatacag

SEQ ID NO: 162966 - DNA, 12 bp, Unknown
  misc_feature (1)..( 12): Result.004 file - promoters50/1030940
gaagaaatttat

SEQ ID NO: 162967 - DNA, 12 bp, Unknown
  misc_feature (1)..( 12): Result.004 file - promoters50/1030940
aaagaaatgtag

SEQ ID NO: 162968 - DNA, 12 bp, Unknown
  misc_feature (1)..( 12): Result.004 file - promoters50/1030940
atagaaatatgt

SEQ ID NO: 162969 - DNA, 12 bp, Unknown
  misc_feature (1)..( 12): Result.004 file - promoters50/1030940
gaaaaaatacag

SEQ ID NO: 162970 - DNA, 12 bp, Unknown
  misc_feature (1)..( 12): Result.004 file - promoters50/1030940
actgaattttgt

SEQ ID NO: 162971 - DNA, 12 bp, Unknown
  misc_feature (1)..( 12): Result.004 file - promoters50/1030940
atataaaaattt

SEQ ID NO: 162972 - DNA, 12 bp, Unknown
  misc_feature (1)..( 12): Result.004 file - promoters50/1030940
ctggaagtatgt

SEQ ID NO: 162973 - DNA, 20 bp, Unknown
  misc_feature (1)..( 20): Result.004 file - promoters50/1030940
gttattattatatttgaaat

SEQ ID NO: 162974 - DNA, 20 bp, Unknown
  misc_feature (1)..( 20): Result.004 file - promoters50/1030940
caaacttttatttttgttgg

SEQ ID NO: 162975 - DNA, 20 bp, Unknown
  misc_feature (1)..( 20): Result.004 file - promoters50/1030940
ttgggttttagattatgcaa

SEQ ID NO: 162976 - DNA, 20 bp, Unknown
  misc_feature (1)..( 20): Result.004 file - promoters50/1030940
cttttgatttcatttgatca

SEQ ID NO: 162977 - DNA, 20 bp, Unknown
  misc_feature (1)..( 20): Result.004 file - promoters50/1030940
caaatttttacttttaacaa

SEQ ID NO: 162978 - DNA, 20 bp, Unknown
  misc_feature (1)..( 20): Result.004 file - promoters50/1030940
aagaaaaaaccgtttgatca

SEQ ID NO: 162979 - DNA, 17 bp, Unknown
  misc_feature (1)..( 17): Result.004 file - promoters50/1030940
aaattatgttattatta

SEQ ID NO: 162980 - DNA, 17 bp, Unknown
  misc_feature (1)..( 17): Result.004 file - promoters50/1030940
ttcaacacaaattttta

SEQ ID NO: 162981 - DNA, 16 bp, Unknown
  misc_feature (1)..( 16): Result.004 file - promoters50/1030940
caaacttttatttttg

SEQ ID NO: 162982 - DNA, 16 bp, Unknown
  misc_feature (1)..( 16): Result.004 file - promoters50/1030940
atgcttttgatttcat

SEQ ID NO: 162983 - DNA, 17 bp, Unknown
  misc_feature (1)..( 17): Result.004 file - promoters50/1030940
tgggttttagattatgc

SEQ ID NO: 162984 - DNA, 17 bp, Unknown
  misc_feature (1)..( 17): Result.004 file - promoters50/1030956
aaaccgtttgatcatgt

SEQ ID NO: 162985 - DNA, 8 bp, Unknown
  misc_feature (1)..( 8): Result.004 file - promoters50/1030956
tttttaat

SEQ ID NO: 162986 - DNA, 8 bp, Unknown
  misc_feature (1)..( 8): Result.004 file - promoters50/1030956
tttttaac

SEQ ID NO: 162987 - DNA, 8 bp, Unknown
  misc_feature (1)..( 8): Result.004 file - promoters50/1030956
ttttgatc

SEQ ID NO: 162988 - DNA, 9 bp, Unknown
  misc_feature (1)..( 9): Result.004 file - promoters50/1030956
tttcttact

SEQ ID NO: 162989 - DNA, 9 bp, Unknown
  misc_feature (1)..( 9): Result.004 file - promoters50/1030956
aaaacaaaa

SEQ ID NO: 162990 - DNA, 9 bp, Unknown
  misc_feature (1)..( 9): Result.004 file - promoters50/1030956
aaatcaatg

SEQ ID NO: 162991 - DNA, 9 bp, Unknown
  misc_feature (1)..( 9): Result.004 file - promoters50/1030956
taatcaaat

SEQ ID NO: 162992 - DNA, 9 bp, Unknown
  misc_feature (1)..( 9): Result.004 file - promoters50/1030956
caataaaat

SEQ ID NO: 162993 - DNA, 12 bp, Unknown
  misc_feature (1)..( 12): Result.004 file - promoters50/1030956
aattatgacaat

SEQ ID NO: 162994 - DNA, 12 bp, Unknown
  misc_feature (1)..( 12): Result.004 file - promoters50/1030956
aattttgaaaag

SEQ ID NO: 162995 - DNA, 12 bp, Unknown
  misc_feature (1)..( 12): Result.004 file - promoters50/1030956
agatatgacaat

SEQ ID NO: 162996 - DNA, 12 bp, Unknown
  misc_feature (1)..( 12): Result.004 file - promoters50/1030956
ttgtataacaac

SEQ ID NO: 162997 - DNA, 12 bp, Unknown
  misc_feature (1)..( 12): Result.004 file - promoters50/1030956
ccgactaaggta

SEQ ID NO: 162998 - DNA, 12 bp, Unknown
  misc_feature (1)..( 12): Result.004 file - promoters50/1030956
acgaataatgta

SEQ ID NO: 162999 - DNA, 12 bp, Unknown
  misc_feature (1)..( 12): Result.004 file - promoters50/1030956
taaacttaggaa

SEQ ID NO: 163000 - DNA, 12 bp, Unknown
  misc_feature (1)..( 12): Result.004 file - promoters50/1030956
ctaactaattca

SEQ ID NO: 163001 - DNA, 12 bp, Unknown
  misc_feature (1)..( 12): Result.004 file - promoters50/1030956
ctaaataaagca

SEQ ID NO: 163002 - DNA, 7 bp, Unknown
  misc_feature (1)..( 7): Result.004 file - promoters50/1030956
aataaaa

SEQ ID NO: 163003 - DNA, 7 bp, Unknown
  misc_feature (1)..( 7): Result.004 file - promoters50/1030956
aataaaa

SEQ ID NO: 163004 - DNA, 7 bp, Unknown
  misc_feature (1)..( 7): Result.004 file - promoters50/1030956
aatcaaa

SEQ ID NO: 163005 - DNA, 7 bp, Unknown
  misc_feature (1)..( 7): Result.004 file - promoters50/1030956
aatcaat

SEQ ID NO: 163006 - DNA, 7 bp, Unknown
  misc_feature (1)..( 7): Result.004 file - promoters50/1030956
aatataa

SEQ ID NO: 163007 - DNA, 7 bp, Unknown
  misc_feature (1)..( 7): Result.004 file - promoters50/1030956
tatataa

SEQ ID NO: 163008 - DNA, 7 bp, Unknown
  misc_feature (1)..( 7): Result.004 file - promoters50/1030956
aatataa

SEQ ID NO: 163009 - DNA, 7 bp, Unknown
  misc_feature (1)..( 7): Result.004 file - promoters50/1030956
tatatat

SEQ ID NO: 163010 - DNA, 12 bp, Unknown
  misc_feature (1)..( 12): Result.004 file - promoters50/1030956
taatcaactatt

SEQ ID NO: 163011 - DNA, 12 bp, Unknown
  misc_feature (1)..( 12): Result.004 file - promoters50/1030956
aaaacaaatatc

SEQ ID NO: 163012 - DNA, 12 bp, Unknown
  misc_feature (1)..( 12): Result.004 file - promoters50/1030956
aaaacgaataat

SEQ ID NO: 163013 - DNA, 12 bp, Unknown
  misc_feature (1)..( 12): Result.004 file - promoters50/1031035
cggataaataac

SEQ ID NO: 163014 - DNA, 10 bp, Unknown
  misc_feature (1)..( 10): Result.004 file - promoters50/1031035
acaaacaaaa

SEQ ID NO: 163015 - DNA, 10 bp, Unknown
  misc_feature (1)..( 10): Result.004 file - promoters50/1031035
acagacaaaa

SEQ ID NO: 163016 - DNA, 10 bp, Unknown
  misc_feature (1)..( 10): Result.004 file - promoters50/1031035
acttacaaaa

SEQ ID NO: 163017 - DNA, 7 bp, Unknown
  misc_feature (1)..( 7): Result.004 file - promoters50/1031035
tttgatt

SEQ ID NO: 163018 - DNA, 7 bp, Unknown
  misc_feature (1)..( 7): Result.004 file - promoters50/1031035
attgatt

SEQ ID NO: 163019 - DNA, 8 bp, Unknown
  misc_feature (1)..( 8): Result.004 file - promoters50/1031035
tttggatc

SEQ ID NO: 163020 - DNA, 7 bp, Unknown
  misc_feature (1)..( 7): Result.004 file - promoters50/1031035
tcaaaaa

SEQ ID NO: 163021 - DNA, 7 bp, Unknown
  misc_feature (1)..( 7): Result.004 file - promoters50/1031035
acaaaaa

SEQ ID NO: 163022 - DNA, 7 bp, Unknown
  misc_feature (1)..( 7): Result.004 file - promoters50/1031045
acaaaag

SEQ ID NO: 163023 - DNA, 9 bp, Unknown
  misc_feature (1)..( 9): Result.004 file - promoters50/1031045
acatttaaa

SEQ ID NO: 163024 - DNA, 9 bp, Unknown
  misc_feature (1)..( 9): Result.004 file - promoters50/1031045
acattaaaa

SEQ ID NO: 163025 - DNA, 9 bp, Unknown
  misc_feature (1)..( 9): Result.004 file - promoters50/1031045
tcatttatt

SEQ ID NO: 163026 - DNA, 8 bp, Unknown
  misc_feature (1)..( 8): Result.004 file - promoters50/1031045
ttcaaaaa

SEQ ID NO: 163027 - DNA, 8 bp, Unknown
  misc_feature (1)..( 8): Result.004 file - promoters50/1031045
ttccaaaa

SEQ ID NO: 163028 - DNA, 8 bp, Unknown
  misc_feature (1)..( 8): Result.004 file - promoters50/1031048
tcccaaaa

SEQ ID NO: 163029 - DNA, 9 bp, Unknown
  misc_feature (1)..( 9): Result.004 file - promoters50/1031048
aaagttatg

SEQ ID NO: 163030 - DNA, 9 bp, Unknown
  misc_feature (1)..( 9): Result.004 file - promoters50/1031048
aaaattagc

SEQ ID NO: 163031 - DNA, 9 bp, Unknown
  misc_feature (1)..( 9): Result.004 file - promoters50/1031048
aaaatgttg

SEQ ID NO: 163032 - DNA, 9 bp, Unknown
  misc_feature (1)..( 9): Result.004 file - promoters50/1031048
gaaattaaa

SEQ ID NO: 163033 - DNA, 9 bp, Unknown
  misc_feature (1)..( 9): Result.004 file - promoters50/1031052
caaatcaaa

SEQ ID NO: 163034 - DNA, 10 bp, Unknown
  misc_feature (1)..( 10): Result.004 file - promoters50/1031052
ttgataaaag

SEQ ID NO: 163035 - DNA, 10 bp, Unknown
  misc_feature (1)..( 10): Result.004 file - promoters50/1031052
ttgctaaaaa

SEQ ID NO: 163036 - DNA, 10 bp, Unknown
  misc_feature (1)..( 10): Result.004 file - promoters50/1031052
gtgaaaaaaa

SEQ ID NO: 163037 - DNA, 10 bp, Unknown
  misc_feature (1)..( 10): Result.004 file - promoters50/1031052
atcataaaag

SEQ ID NO: 163038 - DNA, 10 bp, Unknown
  misc_feature (1)..( 10): Result.004 file - promoters50/1031052
ctgctaatgt

SEQ ID NO: 163039 - DNA, 11 bp, Unknown
  misc_feature (1)..( 11): Result.004 file - promoters50/1031052
gagaaaacaaa

SEQ ID NO: 163040 - DNA, 17 bp, Unknown
  misc_feature (1)..( 17): Result.004 file - promoters50/1031052
catcttctaaaatctta

SEQ ID NO: 163041 - DNA, 17 bp, Unknown
  misc_feature (1)..( 17): Result.004 file - promoters50/1031052
tgccttctaggctgagt

SEQ ID NO: 163042 - DNA, 17 bp, Unknown
  misc_feature (1)..( 17): Result.004 file - promoters50/1031052
ctatttcaaaaatactt

SEQ ID NO: 163043 - DNA, 17 bp, Unknown
  misc_feature (1)..( 17): Result.004 file - promoters50/1031052
catcttcaaaattatat

SEQ ID NO: 163044 - DNA, 17 bp, Unknown
  misc_feature (1)..( 17): Result.004 file - promoters50/1031052
tgccgtcttggttggaa

SEQ ID NO: 163045 - DNA, 17 bp, Unknown
  misc_feature (1)..( 17): Result.004 file - promoters50/1031070
ttttgctaaaaatcctt

SEQ ID NO: 163046 - DNA, 9 bp, Unknown
  misc_feature (1)..( 9): Result.004 file - promoters50/1031070
tcgatttgg

SEQ ID NO: 163047 - DNA, 9 bp, Unknown
  misc_feature (1)..( 9): Result.004 file - promoters50/1031070
ttgatttgt

SEQ ID NO: 163048 - DNA, 9 bp, Unknown
  misc_feature (1)..( 9): Result.004 file - promoters50/1031070
ttgatctgt

SEQ ID NO: 163049 - DNA, 12 bp, Unknown
  misc_feature (1)..( 12): Result.004 file - promoters50/1031070
tttaaagattaa

SEQ ID NO: 163050 - DNA, 12 bp, Unknown
  misc_feature (1)..( 12): Result.004 file - promoters50/1031070
tttagagatgtt

SEQ ID NO: 163051 - DNA, 12 bp, Unknown
  misc_feature (1)..( 12): Result.004 file - promoters50/1031070
taagcagatatg

SEQ ID NO: 163052 - DNA, 8 bp, Unknown
  misc_feature (1)..( 8): Result.004 file - promoters50/1031070
gtttttct

SEQ ID NO: 163053 - DNA, 8 bp, Unknown
  misc_feature (1)..( 8): Result.004 file - promoters50/1031070
atttctct

SEQ ID NO: 163054 - DNA, 8 bp, Unknown
  misc_feature (1)..( 8): Result.004 file - promoters50/1031074
gttattcg

SEQ ID NO: 163055 - DNA, 8 bp, Unknown
  misc_feature (1)..( 8): Result.004 file - promoters50/1031074
taataaaa

SEQ ID NO: 163056 - DNA, 8 bp, Unknown
  misc_feature (1)..( 8): Result.004 file - promoters50/1031074
taatgaaa

SEQ ID NO: 163057 - DNA, 8 bp, Unknown
  misc_feature (1)..( 8): Result.004 file - promoters50/1031084
gtatgaaa

SEQ ID NO: 163058 - DNA, 9 bp, Unknown
  misc_feature (1)..( 9): Result.004 file - promoters50/1031084
tagagaatg

SEQ ID NO: 163059 - DNA, 9 bp, Unknown
  misc_feature (1)..( 9): Result.004 file - promoters50/1031084
tagacaatg

SEQ ID NO: 163060 - DNA, 9 bp, Unknown
  misc_feature (1)..( 9): Result.004 file - promoters50/1031084
tagagaata

SEQ ID NO: 163061 - DNA, 8 bp, Unknown
  misc_feature (1)..( 8): Result.004 file - promoters50/1031084
taataagt

SEQ ID NO: 163062 - DNA, 8 bp, Unknown
  misc_feature (1)..( 8): Result.004 file - promoters50/1031084
caatgagt

SEQ ID NO: 163063 - DNA, 8 bp, Unknown
  misc_feature (1)..( 8): Result.004 file - promoters50/1031084
taataaaa

SEQ ID NO: 163064 - DNA, 12 bp, Unknown
  misc_feature (1)..( 12): Result.004 file - promoters50/1031084
aaaatagaaaaa

SEQ ID NO: 163065 - DNA, 12 bp, Unknown
  misc_feature (1)..( 12): Result.004 file - promoters50/1031084
gaaacagagaaa

SEQ ID NO: 163066 - DNA, 12 bp, Unknown
  misc_feature (1)..( 12): Result.004 file - promoters50/1031084
aaaatactttaa

SEQ ID NO: 163067 - DNA, 7 bp, Unknown
  misc_feature (1)..( 7): Result.004 file - promoters50/1031084
atcaaaa

SEQ ID NO: 163068 - DNA, 7 bp, Unknown
  misc_feature (1)..( 7): Result.004 file - promoters50/1031084
atcaaag

SEQ ID NO: 163069 - DNA, 7 bp, Unknown
  misc_feature (1)..( 7): Result.004 file - promoters50/1031084
ttcaaaa

SEQ ID NO: 163070 - DNA, 7 bp, Unknown
  misc_feature (1)..( 7): Result.004 file - promoters50/1031084
tcaaaag

SEQ ID NO: 163071 - DNA, 7 bp, Unknown
  misc_feature (1)..( 7): Result.004 file - promoters50/1031084
acaaaag

SEQ ID NO: 163072 - DNA, 7 bp, Unknown
  misc_feature (1)..( 7): Result.004 file - promoters50/1031084
tcaaaaa

SEQ ID NO: 163073 - DNA, 6 bp, Unknown
  misc_feature (1)..( 6): Result.004 file - promoters50/1031084
attaaa

SEQ ID NO: 163074 - DNA, 6 bp, Unknown
  misc_feature (1)..( 6): Result.004 file - promoters50/1031084
attaaa

SEQ ID NO: 163075 - DNA, 7 bp, Unknown
  misc_feature (1)..( 7): Result.004 file - promoters50/1031084
attgaaa

SEQ ID NO: 163076 - DNA, 7 bp, Unknown
  misc_feature (1)..( 7): Result.004 file - promoters50/1031084
aaaacca

SEQ ID NO: 163077 - DNA, 7 bp, Unknown
  misc_feature (1)..( 7): Result.004 file - promoters50/1031084
taaacca

SEQ ID NO: 163078 - DNA, 7 bp, Unknown
  misc_feature (1)..( 7): Result.004 file - promoters50/1031084
taatcca

SEQ ID NO: 163079 - DNA, 9 bp, Unknown
  misc_feature (1)..( 9): Result.004 file - promoters50/1031084
acaagcagt

SEQ ID NO: 163080 - DNA, 9 bp, Unknown
  misc_feature (1)..( 9): Result.004 file - promoters50/1031084
gaaagaagt

SEQ ID NO: 163081 - DNA, 9 bp, Unknown
  misc_feature (1)..( 9): Result.004 file - promoters50/1031103
acatgcatg

SEQ ID NO: 163082 - DNA, 12 bp, Unknown
  misc_feature (1)..( 12): Result.004 file - promoters50/1031103
gtagttatttca

SEQ ID NO: 163083 - DNA, 12 bp, Unknown
  misc_feature (1)..( 12): Result.004 file - promoters50/1031103
tgtgttatttca

SEQ ID NO: 163084 - DNA, 12 bp, Unknown
  misc_feature (1)..( 12): Result.004 file - promoters50/1031198
tgtgatattgat

SEQ ID NO: 163085 - DNA, 8 bp, Unknown
  misc_feature (1)..( 8): Result.004 file - promoters50/1031198
ttactaaa

SEQ ID NO: 163086 - DNA, 8 bp, Unknown
  misc_feature (1)..( 8): Result.004 file - promoters50/1031198
ttactaaa

SEQ ID NO: 163087 - DNA, 8 bp, Unknown
  misc_feature (1)..( 8): Result.004 file - promoters50/1031198
ttactata

SEQ ID NO: 163088 - DNA, 11 bp, Unknown
  misc_feature (1)..( 11): Result.004 file - promoters50/1031198
tcaaatgaaat

SEQ ID NO: 163089 - DNA, 11 bp, Unknown
  misc_feature (1)..( 11): Result.004 file - promoters50/1031198
caaaatgaaca

SEQ ID NO: 163090 - DNA, 11 bp, Unknown
  misc_feature (1)..( 11): Result.004 file - promoters50/1031198
tcatatgaaat

SEQ ID NO: 163091 - DNA, 7 bp, Unknown
  misc_feature (1)..( 7): Result.004 file - promoters50/1031198
aatttgt

SEQ ID NO: 163092 - DNA, 7 bp, Unknown
  misc_feature (1)..( 7): Result.004 file - promoters50/1031198
aatatgt

SEQ ID NO: 163093 - DNA, 7 bp, Unknown
  misc_feature (1)..( 7): Result.004 file - promoters50/1031198
aatttgg

SEQ ID NO: 163094 - DNA, 9 bp, Unknown
  misc_feature (1)..( 9): Result.004 file - promoters50/1031198
tttgaatat

SEQ ID NO: 163095 - DNA, 9 bp, Unknown
  misc_feature (1)..( 9): Result.004 file - promoters50/1031198
aacgaatat

SEQ ID NO: 163096 - DNA, 9 bp, Unknown
  misc_feature (1)..( 9): Result.004 file - promoters50/1031198
tttgtataa

SEQ ID NO: 163097 - DNA, 14 bp, Unknown
  misc_feature (1)..( 14): Result.004 file - promoters50/1031198
ataagttattaaat

SEQ ID NO: 163098 - DNA, 14 bp, Unknown
  misc_feature (1)..( 14): Result.004 file - promoters50/1031198
ataatttaatcacg

SEQ ID NO: 163099 - DNA, 14 bp, Unknown
  misc_feature (1)..( 14): Result.004 file - promoters50/1031198
gacagttattaatc

SEQ ID NO: 163100 - DNA, 14 bp, Unknown
  misc_feature (1)..( 14): Result.004 file - promoters50/1031198
attagtgattcatc

SEQ ID NO: 163101 - DNA, 11 bp, Unknown
  misc_feature (1)..( 11): Result.004 file - promoters50/1031198
agttattaaat

SEQ ID NO: 163102 - DNA, 11 bp, Unknown
  misc_feature (1)..( 11): Result.004 file - promoters50/1031198
gactatgaaaa

SEQ ID NO: 163103 - DNA, 11 bp, Unknown
  misc_feature (1)..( 11): Result.004 file - promoters50/1031198
agttattaatc

SEQ ID NO: 163104 - DNA, 11 bp, Unknown
  misc_feature (1)..( 11): Result.004 file - promoters50/1031198
agtgattcatc

SEQ ID NO: 163105 - DNA, 8 bp, Unknown
  misc_feature (1)..( 8): Result.004 file - promoters50/1031198
taatatta

SEQ ID NO: 163106 - DNA, 8 bp, Unknown
  misc_feature (1)..( 8): Result.004 file - promoters50/1031198
taagatta

SEQ ID NO: 163107 - DNA, 8 bp, Unknown
  misc_feature (1)..( 8): Result.004 file - promoters50/1031198
taagattt

SEQ ID NO: 163108 - DNA, 9 bp, Unknown
  misc_feature (1)..( 9): Result.004 file - promoters50/1031198
ctaacaaga

SEQ ID NO: 163109 - DNA, 9 bp, Unknown
  misc_feature (1)..( 9): Result.004 file - promoters50/1031198
aaaacgaga

SEQ ID NO: 163110 - DNA, 9 bp, Unknown
  misc_feature (1)..( 9): Result.004 file - promoters50/1031198
ctaacaact

SEQ ID NO: 163111 - DNA, 8 bp, Unknown
  misc_feature (1)..( 8): Result.004 file - promoters50/1031198
acaagttt

SEQ ID NO: 163112 - DNA, 8 bp, Unknown
  misc_feature (1)..( 8): Result.004 file - promoters50/1031198
aaaagttt

SEQ ID NO: 163113 - DNA, 8 bp, Unknown
  misc_feature (1)..( 8): Result.004 file - promoters50/1031198
aaaagttc

SEQ ID NO: 163114 - DNA, 13 bp, Unknown
  misc_feature (1)..( 13): Result.004 file - promoters50/1031198
ataatttaatcac

SEQ ID NO: 163115 - DNA, 13 bp, Unknown
  misc_feature (1)..( 13): Result.004 file - promoters50/1031198
agttattaatcac

SEQ ID NO: 163116 - DNA, 13 bp, Unknown
  misc_feature (1)..( 13): Result.004 file - promoters50/1031198
agtgattcatctt

SEQ ID NO: 163117 - DNA, 12 bp, Unknown
  misc_feature (1)..( 12): Result.004 file - promoters50/1031198
caaacttcatct

SEQ ID NO: 163118 - DNA, 12 bp, Unknown
  misc_feature (1)..( 12): Result.004 file - promoters50/1031198
aaaagttcatct

SEQ ID NO: 163119 - DNA, 12 bp, Unknown
  misc_feature (1)..( 12): Result.004 file - promoters50/1031198
aaaagttttatt

SEQ ID NO: 163120 - DNA, 8 bp, Unknown
  misc_feature (1)..( 8): Result.004 file - promoters50/1031198
attgtttt

SEQ ID NO: 163121 - DNA, 8 bp, Unknown
  misc_feature (1)..( 8): Result.004 file - promoters50/1031198
attttttt

SEQ ID NO: 163122 - DNA, 8 bp, Unknown
  misc_feature (1)..( 8): Result.004 file - promoters50/1031208
ctttctta

SEQ ID NO: 163123 - DNA, 7 bp, Unknown
  misc_feature (1)..( 7): Result.004 file - promoters50/1031208
atttgtt

SEQ ID NO: 163124 - DNA, 7 bp, Unknown
  misc_feature (1)..( 7): Result.004 file - promoters50/1031208
ttttgtt

SEQ ID NO: 163125 - DNA, 7 bp, Unknown
  misc_feature (1)..( 7): Result.004 file - promoters50/1031208
ttttgta

SEQ ID NO: 163126 - DNA, 7 bp, Unknown
  misc_feature (1)..( 7): Result.004 file - promoters50/1031208
atatttg

SEQ ID NO: 163127 - DNA, 7 bp, Unknown
  misc_feature (1)..( 7): Result.004 file - promoters50/1031208
ttatttg

SEQ ID NO: 163128 - DNA, 7 bp, Unknown
  misc_feature (1)..( 7): Result.004 file - promoters50/1031208
ttatttc

SEQ ID NO: 163129 - DNA, 10 bp, Unknown
  misc_feature (1)..( 10): Result.004 file - promoters50/1031208
ttattcttaa

SEQ ID NO: 163130 - DNA, 10 bp, Unknown
  misc_feature (1)..( 10): Result.004 file - promoters50/1031208
ttattctcta

SEQ ID NO: 163131 - DNA, 10 bp, Unknown
  misc_feature (1)..( 10): Result.004 file - promoters50/1031208
tcattctcta

SEQ ID NO: 163132 - DNA, 11 bp, Unknown
  misc_feature (1)..( 11): Result.004 file - promoters50/1031208
aaaagaaaaaa

SEQ ID NO: 163133 - DNA, 11 bp, Unknown
  misc_feature (1)..( 11): Result.004 file - promoters50/1031208
tcaagtaaaga

SEQ ID NO: 163134 - DNA, 11 bp, Unknown
  misc_feature (1)..( 11): Result.004 file - promoters50/1031208
aaaaataaaaa

SEQ ID NO: 163135 - DNA, 8 bp, Unknown
  misc_feature (1)..( 8): Result.004 file - promoters50/1031208
aatttttg

SEQ ID NO: 163136 - DNA, 8 bp, Unknown
  misc_feature (1)..( 8): Result.004 file - promoters50/1031208
aatttttt

SEQ ID NO: 163137 - DNA, 8 bp, Unknown
  misc_feature (1)..( 8): Result.004 file - promoters50/1031208
cgtttttt

SEQ ID NO: 163138 - DNA, 10 bp, Unknown
  misc_feature (1)..( 10): Result.004 file - promoters50/1031208
tcaattacac

SEQ ID NO: 163139 - DNA, 10 bp, Unknown
  misc_feature (1)..( 10): Result.004 file - promoters50/1031208
tcaattaaaa

SEQ ID NO: 163140 - DNA, 10 bp, Unknown
  misc_feature (1)..( 10): Result.004 file - promoters50/1031225
ccaattcaaa

SEQ ID NO: 163141 - DNA, 7 bp, Unknown
  misc_feature (1)..( 7): Result.004 file - promoters50/1031225
ttttgaa

SEQ ID NO: 163142 - DNA, 7 bp, Unknown
  misc_feature (1)..( 7): Result.004 file - promoters50/1031225
ttttgat

SEQ ID NO: 163143 - DNA, 7 bp, Unknown
  misc_feature (1)..( 7): Result.004 file - promoters50/1031225
gtttgat

SEQ ID NO: 163144 - DNA, 10 bp, Unknown
  misc_feature (1)..( 10): Result.004 file - promoters50/1031225
aaaaatctac

SEQ ID NO: 163145 - DNA, 10 bp, Unknown
  misc_feature (1)..( 10): Result.004 file - promoters50/1031225
gattatctac

SEQ ID NO: 163146 - DNA, 10 bp, Unknown
  misc_feature (1)..( 10): Result.004 file - promoters50/1031267
gattagctaa

SEQ ID NO: 163147 - DNA, 9 bp, Unknown
  misc_feature (1)..( 9): Result.004 file - promoters50/1031267
tttgcttct

SEQ ID NO: 163148 - DNA, 9 bp, Unknown
  misc_feature (1)..( 9): Result.004 file - promoters50/1031267
tttgctgat

SEQ ID NO: 163149 - DNA, 9 bp, Unknown
  misc_feature (1)..( 9): Result.004 file - promoters50/1031267
tttactttg

SEQ ID NO: 163150 - DNA, 9 bp, Unknown
  misc_feature (1)..( 9): Result.004 file - promoters50/1031267
tttgatgat

SEQ ID NO: 163151 - DNA, 9 bp, Unknown
  misc_feature (1)..( 9): Result.004 file - promoters50/1031267
attaatttc

SEQ ID NO: 163152 - DNA, 9 bp, Unknown
  misc_feature (1)..( 9): Result.004 file - promoters50/1031267
attacttca

SEQ ID NO: 163153 - DNA, 8 bp, Unknown
  misc_feature (1)..( 8): Result.004 file - promoters50/1031267
ttaatttc

SEQ ID NO: 163154 - DNA, 10 bp, Unknown
  misc_feature (1)..( 10): Result.004 file - promoters50/1031267
gtttgattaa

SEQ ID NO: 163155 - DNA, 10 bp, Unknown
  misc_feature (1)..( 10): Result.004 file - promoters50/1031267
cttttattat

SEQ ID NO: 163156 - DNA, 10 bp, Unknown
  misc_feature (1)..( 10): Result.004 file - promoters50/1031267
gtttgatttg

SEQ ID NO: 163157 - DNA, 10 bp, Unknown
  misc_feature (1)..( 10): Result.004 file - promoters50/1031267
tgtttcttac

SEQ ID NO: 163158 - DNA, 10 bp, Unknown
  misc_feature (1)..( 10): Result.004 file - promoters50/1031267
tttacattta

SEQ ID NO: 163159 - DNA, 10 bp, Unknown
  misc_feature (1)..( 10): Result.004 file - promoters50/1031267
gtttgacata

SEQ ID NO: 163160 - DNA, 12 bp, Unknown
  misc_feature (1)..( 12): Result.004 file - promoters50/1031267
aaaaattgtaat

SEQ ID NO: 163161 - DNA, 12 bp, Unknown
  misc_feature (1)..( 12): Result.004 file - promoters50/1031267
aaaaatttttct

SEQ ID NO: 163162 - DNA, 12 bp, Unknown
  misc_feature (1)..( 12): Result.004 file - promoters50/1031267
tgaaattgaaat

SEQ ID NO: 163163 - DNA, 12 bp, Unknown
  misc_feature (1)..( 12): Result.004 file - promoters50/1031267
ttaaatttacgc

SEQ ID NO: 163164 - DNA, 12 bp, Unknown
  misc_feature (1)..( 12): Result.004 file - promoters50/1031267
taaacttttaaa

SEQ ID NO: 163165 - DNA, 12 bp, Unknown
  misc_feature (1)..( 12): Result.004 file - promoters50/1031267
aaaacttcgtct

SEQ ID NO: 163166 - DNA, 13 bp, Unknown
  misc_feature (1)..( 13): Result.004 file - promoters50/1031267
ttaacaaaacaat

SEQ ID NO: 163167 - DNA, 13 bp, Unknown
  misc_feature (1)..( 13): Result.004 file - promoters50/1031267
ttaagaaaataaa

SEQ ID NO: 163168 - DNA, 13 bp, Unknown
  misc_feature (1)..( 13): Result.004 file - promoters50/1031267
caaccaaaagaat

SEQ ID NO: 163169 - DNA, 13 bp, Unknown
  misc_feature (1)..( 13): Result.004 file - promoters50/1031267
ttaacatgggtga

SEQ ID NO: 163170 - DNA, 13 bp, Unknown
  misc_feature (1)..( 13): Result.004 file - promoters50/1031267
gaaacaaagaaac

SEQ ID NO: 163171 - DNA, 13 bp, Unknown
  misc_feature (1)..( 13): Result.004 file - promoters50/1031267
ttacgaaattgtg

SEQ ID NO: 163172 - DNA, 14 bp, Unknown
  misc_feature (1)..( 14): Result.004 file - promoters50/1031267
aatgacataaattt

SEQ ID NO: 163173 - DNA, 14 bp, Unknown
  misc_feature (1)..( 14): Result.004 file - promoters50/1031267
tgagacctaagttt

SEQ ID NO: 163174 - DNA, 14 bp, Unknown
  misc_feature (1)..( 14): Result.004 file - promoters50/1031267
tgcaacaaaaacaa

SEQ ID NO: 163175 - DNA, 14 bp, Unknown
  misc_feature (1)..( 14): Result.004 file - promoters50/1031267
aataacatatgact

SEQ ID NO: 163176 - DNA, 14 bp, Unknown
  misc_feature (1)..( 14): Result.004 file - promoters50/1031267
tttaacaaaacaat

SEQ ID NO: 163177 - DNA, 14 bp, Unknown
  misc_feature (1)..( 14): Result.004 file - promoters50/1031267
tcaaacgaaaccaa

SEQ ID NO: 163178 - DNA, 19 bp, Unknown
  misc_feature (1)..( 19): Result.004 file - promoters50/1031267
tcaacacaaatttttactt

SEQ ID NO: 163179 - DNA, 19 bp, Unknown
  misc_feature (1)..( 19): Result.004 file - promoters50/1031267
atctagtttattgttacaa

SEQ ID NO: 163180 - DNA, 19 bp, Unknown
  misc_feature (1)..( 19): Result.004 file - promoters50/1031267
caaacttttatttttgttg

SEQ ID NO: 163181 - DNA, 19 bp, Unknown
  misc_feature (1)..( 19): Result.004 file - promoters50/1031267
tgaagtcatattcttaagc

SEQ ID NO: 163182 - DNA, 19 bp, Unknown
  misc_feature (1)..( 19): Result.004 file - promoters50/1031267
cccatattatcttttaagt

SEQ ID NO: 163183 - DNA, 19 bp, Unknown
  misc_feature (1)..( 19): Result.004 file - promoters50/1031267
gattcacgaggtttgaagt

SEQ ID NO: 163184 - DNA, 19 bp, Unknown
  misc_feature (1)..( 19): Result.004 file - promoters50/1031267
tttttgatgcttttgattt

SEQ ID NO: 163185 - DNA, 16 bp, Unknown
  misc_feature (1)..( 16): Result.004 file - promoters50/1031267
acaaatttttactttt

SEQ ID NO: 163186 - DNA, 16 bp, Unknown
  misc_feature (1)..( 16): Result.004 file - promoters50/1031267
acaaatctatcctttt

SEQ ID NO: 163187 - DNA, 16 bp, Unknown
  misc_feature (1)..( 16): Result.004 file - promoters50/1031267
tcaaacttttattttt

SEQ ID NO: 163188 - DNA, 16 bp, Unknown
  misc_feature (1)..( 16): Result.004 file - promoters50/1031267
attatcttttaagtat

SEQ ID NO: 163189 - DNA, 16 bp, Unknown
  misc_feature (1)..( 16): Result.004 file - promoters50/1031267
cgaggtttgaagtttg

SEQ ID NO: 163190 - DNA, 16 bp, Unknown
  misc_feature (1)..( 16): Result.004 file - promoters50/1031267
gatgcttttgatttca

SEQ ID NO: 163191 - DNA, 12 bp, Unknown
  misc_feature (1)..( 12): Result.004 file - promoters50/1031267
ttgttgttactt

SEQ ID NO: 163192 - DNA, 12 bp, Unknown
  misc_feature (1)..( 12): Result.004 file - promoters50/1031267
aggtttttattt

SEQ ID NO: 163193 - DNA, 12 bp, Unknown
  misc_feature (1)..( 12): Result.004 file - promoters50/1031267
aaatttttactt

SEQ ID NO: 163194 - DNA, 12 bp, Unknown
  misc_feature (1)..( 12): Result.004 file - promoters50/1031267
aaacttttaaat

SEQ ID NO: 163195 - DNA, 12 bp, Unknown
  misc_feature (1)..( 12): Result.004 file - promoters50/1031267
cactttctattt

SEQ ID NO: 163196 - DNA, 12 bp, Unknown
  misc_feature (1)..( 12): Result.004 file - promoters50/1031299
aaacttcgtctt

SEQ ID NO: 163197 - DNA, 7 bp, Unknown
  misc_feature (1)..( 7): Result.004 file - promoters50/1031299
taaacat

SEQ ID NO: 163198 - DNA, 7 bp, Unknown
  misc_feature (1)..( 7): Result.004 file - promoters50/1031299
taaacat

SEQ ID NO: 163199 - DNA, 7 bp, Unknown
  misc_feature (1)..( 7): Result.004 file - promoters50/1031299
aaaacat

SEQ ID NO: 163200 - DNA, 16 bp, Unknown
  misc_feature (1)..( 16): Result.004 file - promoters50/1031299
ttaactttacgttctt

SEQ ID NO: 163201 - DNA, 16 bp, Unknown
  misc_feature (1)..( 16): Result.004 file - promoters50/1031299
ttaactgataaaatat

SEQ ID NO: 163202 - DNA, 17 bp, Unknown
  misc_feature (1)..( 17): Result.004 file - promoters50/1031299
ataatctaattgataaa

SEQ ID NO: 163203 - DNA, 17 bp, Unknown
  misc_feature (1)..( 17): Result.004 file - promoters50/1031299
ttaatataagactaatc

SEQ ID NO: 163204 - DNA, 8 bp, Unknown
  misc_feature (1)..( 8): Result.004 file - promoters50/1031299
agatttta

SEQ ID NO: 163205 - DNA, 8 bp, Unknown
  misc_feature (1)..( 8): Result.004 file - promoters50/1031299
agatttta

SEQ ID NO: 163206 - DNA, 8 bp, Unknown
  misc_feature (1)..( 8): Result.004 file - promoters50/1031299
aaatttta

SEQ ID NO: 163207 - DNA, 8 bp, Unknown
  misc_feature (1)..( 8): Result.004 file - promoters50/1031299
aaatatat

SEQ ID NO: 163208 - DNA, 8 bp, Unknown
  misc_feature (1)..( 8): Result.004 file - promoters50/1031299
taatatat

SEQ ID NO: 163209 - DNA, 8 bp, Unknown
  misc_feature (1)..( 8): Result.004 file - promoters50/1031299
aaatatgc

SEQ ID NO: 163210 - DNA, 10 bp, Unknown
  misc_feature (1)..( 10): Result.004 file - promoters50/1031299
acactttttc

SEQ ID NO: 163211 - DNA, 10 bp, Unknown
  misc_feature (1)..( 10): Result.004 file - promoters50/1031299
acaattttta

SEQ ID NO: 163212 - DNA, 10 bp, Unknown
  misc_feature (1)..( 10): Result.004 file - promoters50/1031299
ttggttttta

SEQ ID NO: 163213 - DNA, 8 bp, Unknown
  misc_feature (1)..( 8): Result.004 file - promoters50/1031299
tttaaaat

SEQ ID NO: 163214 - DNA, 8 bp, Unknown
  misc_feature (1)..( 8): Result.004 file - promoters50/1031299
tgtaaaat

SEQ ID NO: 163215 - DNA, 8 bp, Unknown
  misc_feature (1)..( 8): Result.004 file - promoters50/1031299
tttaaaac

SEQ ID NO: 163216 - DNA, 7 bp, Unknown
  misc_feature (1)..( 7): Result.004 file - promoters50/1031299
aatgtta

SEQ ID NO: 163217 - DNA, 7 bp, Unknown
  misc_feature (1)..( 7): Result.004 file - promoters50/1031299
aatgttt

SEQ ID NO: 163218 - DNA, 7 bp, Unknown
  misc_feature (1)..( 7): Result.004 file - promoters50/1031299
aatctta

SEQ ID NO: 163219 - DNA, 16 bp, Unknown
  misc_feature (1)..( 16): Result.004 file - promoters50/1031299
taatttaactgataaa

SEQ ID NO: 163220 - DNA, 16 bp, Unknown
  misc_feature (1)..( 16): Result.004 file - promoters50/1031299
aaatttaatataagac

SEQ ID NO: 163221 - DNA, 16 bp, Unknown
  misc_feature (1)..( 16): Result.004 file - promoters50/1031299
taatctaattgataaa

SEQ ID NO: 163222 - DNA, 8 bp, Unknown
  misc_feature (1)..( 8): Result.004 file - promoters50/1031299
tataaata

SEQ ID NO: 163223 - DNA, 8 bp, Unknown
  misc_feature (1)..( 8): Result.004 file - promoters50/1031299
gatatata

SEQ ID NO: 163224 - DNA, 8 bp, Unknown
  misc_feature (1)..( 8): Result.004 file - promoters50/1031332
tataaata

SEQ ID NO: 163225 - DNA, 8 bp, Unknown
  misc_feature (1)..( 8): Result.004 file - promoters50/1031332
acatatgt

SEQ ID NO: 163226 - DNA, 8 bp, Unknown
  misc_feature (1)..( 8): Result.004 file - promoters50/1031332
acatttgt

SEQ ID NO: 163227 - DNA, 8 bp, Unknown
  misc_feature (1)..( 8): Result.004 file - promoters50/1031332
acatataa

SEQ ID NO: 163228 - DNA, 7 bp, Unknown
  misc_feature (1)..( 7): Result.004 file - promoters50/1031332
cattttc

SEQ ID NO: 163229 - DNA, 7 bp, Unknown
  misc_feature (1)..( 7): Result.004 file - promoters50/1031332
gattttc

SEQ ID NO: 163230 - DNA, 7 bp, Unknown
  misc_feature (1)..( 7): Result.004 file - promoters50/1031332
cattttg

SEQ ID NO: 163231 - DNA, 8 bp, Unknown
  misc_feature (1)..( 8): Result.004 file - promoters50/1031332
cggtataa

SEQ ID NO: 163232 - DNA, 8 bp, Unknown
  misc_feature (1)..( 8): Result.004 file - promoters50/1031332
aagtataa

SEQ ID NO: 163233 - DNA, 8 bp, Unknown
  misc_feature (1)..( 8): Result.004 file - promoters50/1031336
tattatat

SEQ ID NO: 163234 - DNA, 10 bp, Unknown
  misc_feature (1)..( 10): Result.004 file - promoters50/1031336
ttcttcttta

SEQ ID NO: 163235 - DNA, 10 bp, Unknown
  misc_feature (1)..( 10): Result.004 file - promoters50/1031336
ttcttgtttc

SEQ ID NO: 163236 - DNA, 10 bp, Unknown
  misc_feature (1)..( 10): Result.004 file - promoters50/1031336
aagatcttta

SEQ ID NO: 163237 - DNA, 10 bp, Unknown
  misc_feature (1)..( 10): Result.004 file - promoters50/1031336
aaaacaaaaa

SEQ ID NO: 163238 - DNA, 10 bp, Unknown
  misc_feature (1)..( 10): Result.004 file - promoters50/1031336
aaaacaaaat

SEQ ID NO: 163239 - DNA, 10 bp, Unknown
  misc_feature (1)..( 10): Result.004 file - promoters50/1031336
tcaacaaaaa

SEQ ID NO: 163240 - DNA, 10 bp, Unknown
  misc_feature (1)..( 10): Result.004 file - promoters50/1031336
agtaagggaa

SEQ ID NO: 163241 - DNA, 10 bp, Unknown
  misc_feature (1)..( 10): Result.004 file - promoters50/1031336
attaaaggaa

SEQ ID NO: 163242 - DNA, 10 bp, Unknown
  misc_feature (1)..( 10): Result.004 file - promoters50/1031344
attaaagaaa

SEQ ID NO: 163243 - DNA, 9 bp, Unknown
  misc_feature (1)..( 9): Result.004 file - promoters50/1031344
taattatta

SEQ ID NO: 163244 - DNA, 9 bp, Unknown
  misc_feature (1)..( 9): Result.004 file - promoters50/1031344
tgattttta

SEQ ID NO: 163245 - DNA, 9 bp, Unknown
  misc_feature (1)..( 9): Result.004 file - promoters50/1031344
taagtatta

SEQ ID NO: 163246 - DNA, 7 bp, Unknown
  misc_feature (1)..( 7): Result.004 file - promoters50/1031344
aaaattg

SEQ ID NO: 163247 - DNA, 7 bp, Unknown
  misc_feature (1)..( 7): Result.004 file - promoters50/1031344
aaatttg

SEQ ID NO: 163248 - DNA, 7 bp, Unknown
  misc_feature (1)..( 7): Result.004 file - promoters50/1031344
aaaatta

SEQ ID NO: 163249 - DNA, 9 bp, Unknown
  misc_feature (1)..( 9): Result.004 file - promoters50/1031344
ttaataaat

SEQ ID NO: 163250 - DNA, 9 bp, Unknown
  misc_feature (1)..( 9): Result.004 file - promoters50/1031344
ctaaaaaaa

SEQ ID NO: 163251 - DNA, 9 bp, Unknown
  misc_feature (1)..( 9): Result.004 file - promoters50/1031344
gtaattaat

SEQ ID NO: 163252 - DNA, 9 bp, Unknown
  misc_feature (1)..( 9): Result.004 file - promoters50/1031344
ctacgaaaa

SEQ ID NO: 163253 - DNA, 14 bp, Unknown
  misc_feature (1)..( 14): Result.004 file - promoters50/1031344
aaaaaattcatttc

SEQ ID NO: 163254 - DNA, 14 bp, Unknown
  misc_feature (1)..( 14): Result.004 file - promoters50/1031344
gtgatattcatttg

SEQ ID NO: 163255 - DNA, 14 bp, Unknown
  misc_feature (1)..( 14): Result.004 file - promoters50/1031344
gtgacattcagttg

SEQ ID NO: 163256 - DNA, 11 bp, Unknown
  misc_feature (1)..( 11): Result.004 file - promoters50/1031344
aaaactattta

SEQ ID NO: 163257 - DNA, 11 bp, Unknown
  misc_feature (1)..( 11): Result.004 file - promoters50/1031344
aaaactattta

SEQ ID NO: 163258 - DNA, 11 bp, Unknown
  misc_feature (1)..( 11): Result.004 file - promoters50/1031344
gaaactatctg

SEQ ID NO: 163259 - DNA, 8 bp, Unknown
  misc_feature (1)..( 8): Result.004 file - promoters50/1031344
ataagaag

SEQ ID NO: 163260 - DNA, 8 bp, Unknown
  misc_feature (1)..( 8): Result.004 file - promoters50/1031344
ataaaaag

SEQ ID NO: 163261 - DNA, 8 bp, Unknown
  misc_feature (1)..( 8): Result.004 file - promoters50/1031368
acaaaaag

SEQ ID NO: 163262 - DNA, 12 bp, Unknown
  misc_feature (1)..( 12): Result.004 file - promoters50/1031368
ttcgtggacaca

SEQ ID NO: 163263 - DNA, 12 bp, Unknown
  misc_feature (1)..( 12): Result.004 file - promoters50/1031368
gatttggagaca

SEQ ID NO: 163264 - DNA, 12 bp, Unknown
  misc_feature (1)..( 12): Result.004 file - promoters50/1031368
ttcgttgactaa

SEQ ID NO: 163265 - DNA, 7 bp, Unknown
  misc_feature (1)..( 7): Result.004 file - promoters50/1031368
ggactat

SEQ ID NO: 163266 - DNA, 7 bp, Unknown
  misc_feature (1)..( 7): Result.004 file - promoters50/1031368
tgactat

SEQ ID NO: 163267 - DNA, 7 bp, Unknown
  misc_feature (1)..( 7): Result.004 file - promoters50/1031368
tgattat

SEQ ID NO: 163268 - DNA, 9 bp, Unknown
  misc_feature (1)..( 9): Result.004 file - promoters50/1031368
cataaattc

SEQ ID NO: 163269 - DNA, 9 bp, Unknown
  misc_feature (1)..( 9): Result.004 file - promoters50/1031368
cataaattt

SEQ ID NO: 163270 - DNA, 9 bp, Unknown
  misc_feature (1)..( 9): Result.004 file - promoters50/1031386
tatatattt

SEQ ID NO: 163271 - DNA, 8 bp, Unknown
  misc_feature (1)..( 8): Result.004 file - promoters50/1031386
tatatatt

SEQ ID NO: 163272 - DNA, 8 bp, Unknown
  misc_feature (1)..( 8): Result.004 file - promoters50/1031386
tatatatc

SEQ ID NO: 163273 - DNA, 8 bp, Unknown
  misc_feature (1)..( 8): Result.004 file - promoters50/1031386
tatataaa

SEQ ID NO: 163274 - DNA, 8 bp, Unknown
  misc_feature (1)..( 8): Result.004 file - promoters50/1031386
tatttaaa

SEQ ID NO: 163275 - DNA, 8 bp, Unknown
  misc_feature (1)..( 8): Result.004 file - promoters50/1031390
tatataaa

SEQ ID NO: 163276 - DNA, 15 bp, Unknown
  misc_feature (1)..( 15): Result.004 file - promoters50/1031390
ggcggaaaatttttt

SEQ ID NO: 163277 - DNA, 15 bp, Unknown
  misc_feature (1)..( 15): Result.004 file - promoters50/1031390
atttgaaactttaat

SEQ ID NO: 163278 - DNA, 15 bp, Unknown
  misc_feature (1)..( 15): Result.004 file - promoters50/1031390
ataagaaaatgggtc

SEQ ID NO: 163279 - DNA, 15 bp, Unknown
  misc_feature (1)..( 15): Result.004 file - promoters50/1031390
tcaagaaagtttaaa

SEQ ID NO: 163280 - DNA, 15 bp, Unknown
  misc_feature (1)..( 15): Result.004 file - promoters50/1031390
tccatttaatttttt

SEQ ID NO: 163281 - DNA, 15 bp, Unknown
  misc_feature (1)..( 15): Result.004 file - promoters50/1031390
tcatgaaagacattg

SEQ ID NO: 163282 - DNA, 15 bp, Unknown
  misc_feature (1)..( 15): Result.004 file - promoters50/1031390
agtatttttaaaaat

SEQ ID NO: 163283 - DNA, 15 bp, Unknown
  misc_feature (1)..( 15): Result.004 file - promoters50/1031390
tctgttttcaaaatg

SEQ ID NO: 163284 - DNA, 15 bp, Unknown
  misc_feature (1)..( 15): Result.004 file - promoters50/1031390
actaattgtaaaaac

SEQ ID NO: 163285 - DNA, 15 bp, Unknown
  misc_feature (1)..( 15): Result.004 file - promoters50/1031390
agtgttttcaaacca

SEQ ID NO: 163286 - DNA, 15 bp, Unknown
  misc_feature (1)..( 15): Result.004 file - promoters50/1031390
aaaatcttcaaaaat

SEQ ID NO: 163287 - DNA, 15 bp, Unknown
  misc_feature (1)..( 15): Result.004 file - promoters50/1031390
tacggtttcaagatg

SEQ ID NO: 163288 - DNA, 15 bp, Unknown
  misc_feature (1)..( 15): Result.004 file - promoters50/1031390
tctaagaaaaaaaac

SEQ ID NO: 163289 - DNA, 15 bp, Unknown
  misc_feature (1)..( 15): Result.004 file - promoters50/1031390
ttcattttcgagaat

SEQ ID NO: 163290 - DNA, 15 bp, Unknown
  misc_feature (1)..( 15): Result.004 file - promoters50/1031390
taaaaacattggtaa

SEQ ID NO: 163291 - DNA, 15 bp, Unknown
  misc_feature (1)..( 15): Result.004 file - promoters50/1031390
tcaaaccatttggag

SEQ ID NO: 163292 - DNA, 15 bp, Unknown
  misc_feature (1)..( 15): Result.004 file - promoters50/1031390
ctgaaatatttgtaa

SEQ ID NO: 163293 - DNA, 15 bp, Unknown
  misc_feature (1)..( 15): Result.004 file - promoters50/1031390
aaaaaacttttgagc

SEQ ID NO: 163294 - DNA, 15 bp, Unknown
  misc_feature (1)..( 15): Result.004 file - promoters50/1031390
cactaccattaggcc

SEQ ID NO: 163295 - DNA, 15 bp, Unknown
  misc_feature (1)..( 15): Result.004 file - promoters50/1031429
cactaacatatgtgg

SEQ ID NO: 163296 - DNA, 17 bp, Unknown
  misc_feature (1)..( 17): Result.004 file - promoters50/1031429
ctttcgaccaataacta

SEQ ID NO: 163297 - DNA, 17 bp, Unknown
  misc_feature (1)..( 17): Result.004 file - promoters50/1031429
ctttcgaccaataacta

SEQ ID NO: 163298 - DNA, 17 bp, Unknown
  misc_feature (1)..( 17): Result.004 file - promoters50/1031429
agctaccggaattactt

SEQ ID NO: 163299 - DNA, 9 bp, Unknown
  misc_feature (1)..( 9): Result.004 file - promoters50/1031429
actttactt

SEQ ID NO: 163300 - DNA, 8 bp, Unknown
  misc_feature (1)..( 8): Result.004 file - promoters50/1031429
aaaaaaaa

SEQ ID NO: 163301 - DNA, 8 bp, Unknown
  misc_feature (1)..( 8): Result.004 file - promoters50/1031429
aaaaaaaa

SEQ ID NO: 163302 - DNA, 8 bp, Unknown
  misc_feature (1)..( 8): Result.004 file - promoters50/1031429
aaacaaaa

SEQ ID NO: 163303 - DNA, 8 bp, Unknown
  misc_feature (1)..( 8): Result.004 file - promoters50/1031429
ggacaaaa

SEQ ID NO: 163304 - DNA, 10 bp, Unknown
  misc_feature (1)..( 10): Result.004 file - promoters50/1031429
aatacaaatc

SEQ ID NO: 163305 - DNA, 10 bp, Unknown
  misc_feature (1)..( 10): Result.004 file - promoters50/1031429
aataccaatc

SEQ ID NO: 163306 - DNA, 10 bp, Unknown
  misc_feature (1)..( 10): Result.004 file - promoters50/1031429
tatacaatcc

SEQ ID NO: 163307 - DNA, 10 bp, Unknown
  misc_feature (1)..( 10): Result.004 file - promoters50/1031429
ctaaccaata

SEQ ID NO: 163308 - DNA, 12 bp, Unknown
  misc_feature (1)..( 12): Result.004 file - promoters50/1031429
tgatgattcttt

SEQ ID NO: 163309 - DNA, 12 bp, Unknown
  misc_feature (1)..( 12): Result.004 file - promoters50/1031429
tcaacatttttt

SEQ ID NO: 163310 - DNA, 12 bp, Unknown
  misc_feature (1)..( 12): Result.004 file - promoters50/1031429
aaatgattctac

SEQ ID NO: 163311 - DNA, 12 bp, Unknown
  misc_feature (1)..( 12): Result.004 file - promoters50/1031429
aaatgatgattc

SEQ ID NO: 163312 - DNA, 12 bp, Unknown
  misc_feature (1)..( 12): Result.004 file - promoters50/1031429
aatcaatttttc

SEQ ID NO: 163313 - DNA, 11 bp, Unknown
  misc_feature (1)..( 11): Result.004 file - promoters50/1031429
tctattctaac

SEQ ID NO: 163314 - DNA, 11 bp, Unknown
  misc_feature (1)..( 11): Result.004 file - promoters50/1031429
ctcattttaac

SEQ ID NO: 163315 - DNA, 11 bp, Unknown
  misc_feature (1)..( 11): Result.004 file - promoters50/1031429
atgattctaca

SEQ ID NO: 163316 - DNA, 11 bp, Unknown
  misc_feature (1)..( 11): Result.004 file - promoters50/1031429
atgattctttg

SEQ ID NO: 163317 - DNA, 11 bp, Unknown
  misc_feature (1)..( 11): Result.004 file - promoters50/1031429
atcattttcat

SEQ ID NO: 163318 - DNA, 10 bp, Unknown
  misc_feature (1)..( 10): Result.004 file - promoters50/1031429
caacttttta

SEQ ID NO: 163319 - DNA, 10 bp, Unknown
  misc_feature (1)..( 10): Result.004 file - promoters50/1031429
aatcttttta

SEQ ID NO: 163320 - DNA, 10 bp, Unknown
  misc_feature (1)..( 10): Result.004 file - promoters50/1031429
caacttttta

SEQ ID NO: 163321 - DNA, 10 bp, Unknown
  misc_feature (1)..( 10): Result.004 file - promoters50/1031484
aatcttttaa

SEQ ID NO: 163322 - DNA, 8 bp, Unknown
  misc_feature (1)..( 8): Result.004 file - promoters50/1031484
aaaataaa

SEQ ID NO: 163323 - DNA, 8 bp, Unknown
  misc_feature (1)..( 8): Result.004 file - promoters50/1031484
aaaaaaaa

SEQ ID NO: 163324 - DNA, 8 bp, Unknown
  misc_feature (1)..( 8): Result.004 file - promoters50/1031484
tgaataaa

SEQ ID NO: 163325 - DNA, 6 bp, Unknown
  misc_feature (1)..( 6): Result.004 file - promoters50/1031484
aataaa

SEQ ID NO: 163326 - DNA, 6 bp, Unknown
  misc_feature (1)..( 6): Result.004 file - promoters50/1031484
aataaa

SEQ ID NO: 163327 - DNA, 6 bp, Unknown
  misc_feature (1)..( 6): Result.004 file - promoters50/1031484
aataaa

SEQ ID NO: 163328 - DNA, 7 bp, Unknown
  misc_feature (1)..( 7): Result.004 file - promoters50/1031484
tataaaa

SEQ ID NO: 163329 - DNA, 7 bp, Unknown
  misc_feature (1)..( 7): Result.004 file - promoters50/1031484
aataaaa

SEQ ID NO: 163330 - DNA, 7 bp, Unknown
  misc_feature (1)..( 7): Result.004 file - promoters50/1031484
aataaat

SEQ ID NO: 163331 - DNA, 7 bp, Unknown
  misc_feature (1)..( 7): Result.004 file - promoters50/1031484
aaagaaa

SEQ ID NO: 163332 - DNA, 7 bp, Unknown
  misc_feature (1)..( 7): Result.004 file - promoters50/1031484
aaagaaa

SEQ ID NO: 163333 - DNA, 7 bp, Unknown
  misc_feature (1)..( 7): Result.004 file - promoters50/1031488
aaataaa

SEQ ID NO: 163334 - DNA, 13 bp, Unknown
  misc_feature (1)..( 13): Result.004 file - promoters50/1031488
gatataaacacaa

SEQ ID NO: 163335 - DNA, 13 bp, Unknown
  misc_feature (1)..( 13): Result.004 file - promoters50/1031488
aatagaaatacaa

SEQ ID NO: 163336 - DNA, 13 bp, Unknown
  misc_feature (1)..( 13): Result.004 file - promoters50/1031488
gataaaaaatata

SEQ ID NO: 163337 - DNA, 9 bp, Unknown
  misc_feature (1)..( 9): Result.004 file - promoters50/1031488
caacaaaca

SEQ ID NO: 163338 - DNA, 9 bp, Unknown
  misc_feature (1)..( 9): Result.004 file - promoters50/1031488
taacataca

SEQ ID NO: 163339 - DNA, 9 bp, Unknown
  misc_feature (1)..( 9): Result.004 file - promoters50/1031563
caaccaaaa

SEQ ID NO: 163340 - DNA, 7 bp, Unknown
  misc_feature (1)..( 7): Result.004 file - promoters50/1031563
caatagt

SEQ ID NO: 163341 - DNA, 7 bp, Unknown
  misc_feature (1)..( 7): Result.004 file - promoters50/1031563
caaaagt

SEQ ID NO: 163342 - DNA, 7 bp, Unknown
  misc_feature (1)..( 7): Result.004 file - promoters50/1031563
caaaagc

SEQ ID NO: 163343 - DNA, 8 bp, Unknown
  misc_feature (1)..( 8): Result.004 file - promoters50/1031563
tcttaaac

SEQ ID NO: 163344 - DNA, 8 bp, Unknown
  misc_feature (1)..( 8): Result.004 file - promoters50/1031563
acttaaac

SEQ ID NO: 163345 - DNA, 8 bp, Unknown
  misc_feature (1)..( 8): Result.004 file - promoters50/1031563
actgaaat

SEQ ID NO: 163346 - DNA, 8 bp, Unknown
  misc_feature (1)..( 8): Result.004 file - promoters50/1031563
ctatagat

SEQ ID NO: 163347 - DNA, 8 bp, Unknown
  misc_feature (1)..( 8): Result.004 file - promoters50/1031563
ctaaagag

SEQ ID NO: 163348 - DNA, 8 bp, Unknown
  misc_feature (1)..( 8): Result.004 file - promoters50/1031576
aaaaagag

SEQ ID NO: 163349 - DNA, 7 bp, Unknown
  misc_feature (1)..( 7): Result.004 file - promoters50/1031576
aaaaatt

SEQ ID NO: 163350 - DNA, 7 bp, Unknown
  misc_feature (1)..( 7): Result.004 file - promoters50/1031576
aaaaatc

SEQ ID NO: 163351 - DNA, 7 bp, Unknown
  misc_feature (1)..( 7): Result.004 file - promoters50/1031576
aaaaaaa

SEQ ID NO: 163352 - DNA, 9 bp, Unknown
  misc_feature (1)..( 9): Result.004 file - promoters50/1031576
caaaaatca

SEQ ID NO: 163353 - DNA, 9 bp, Unknown
  misc_feature (1)..( 9): Result.004 file - promoters50/1031576
ataaactca

SEQ ID NO: 163354 - DNA, 9 bp, Unknown
  misc_feature (1)..( 9): Result.004 file - promoters50/1031576
ataaactgg

SEQ ID NO: 163355 - DNA, 9 bp, Unknown
  misc_feature (1)..( 9): Result.004 file - promoters50/1031576
tctataaac

SEQ ID NO: 163356 - DNA, 9 bp, Unknown
  misc_feature (1)..( 9): Result.004 file - promoters50/1031576
acaataaac

SEQ ID NO: 163357 - DNA, 9 bp, Unknown
  misc_feature (1)..( 9): Result.004 file - promoters50/1031576
acaacaaaa

SEQ ID NO: 163358 - DNA, 8 bp, Unknown
  misc_feature (1)..( 8): Result.004 file - promoters50/1031576
acaataaa

SEQ ID NO: 163359 - DNA, 8 bp, Unknown
  misc_feature (1)..( 8): Result.004 file - promoters50/1031576
ggaataaa

SEQ ID NO: 163360 - DNA, 8 bp, Unknown
  misc_feature (1)..( 8): Result.004 file - promoters50/1031576
acaataag

SEQ ID NO: 163361 - DNA, 10 bp, Unknown
  misc_feature (1)..( 10): Result.004 file - promoters50/1031576
catctctaag

SEQ ID NO: 163362 - DNA, 10 bp, Unknown
  misc_feature (1)..( 10): Result.004 file - promoters50/1031576
attctcaaag

SEQ ID NO: 163363 - DNA, 10 bp, Unknown
  misc_feature (1)..( 10): Result.004 file - promoters50/1031576
catcactata

SEQ ID NO: 163364 - DNA, 8 bp, Unknown
  misc_feature (1)..( 8): Result.004 file - promoters50/1031576
acaccaat

SEQ ID NO: 163365 - DNA, 8 bp, Unknown
  misc_feature (1)..( 8): Result.004 file - promoters50/1031576
acaacaaa

SEQ ID NO: 163366 - DNA, 8 bp, Unknown
  misc_feature (1)..( 8): Result.004 file - promoters50/1031638
acaataaa

SEQ ID NO: 163367 - DNA, 9 bp, Unknown
  misc_feature (1)..( 9): Result.004 file - promoters50/1031638
aataaaaaa

SEQ ID NO: 163368 - DNA, 9 bp, Unknown
  misc_feature (1)..( 9): Result.004 file - promoters50/1031638
aatcaaaac

SEQ ID NO: 163369 - DNA, 9 bp, Unknown
  misc_feature (1)..( 9): Result.004 file - promoters50/1031638
aagcaaaac

SEQ ID NO: 163370 - DNA, 7 bp, Unknown
  misc_feature (1)..( 7): Result.004 file - promoters50/1031638
aaaacaa

SEQ ID NO: 163371 - DNA, 7 bp, Unknown
  misc_feature (1)..( 7): Result.004 file - promoters50/1031638
aaaacaa

SEQ ID NO: 163372 - DNA, 7 bp, Unknown
  misc_feature (1)..( 7): Result.004 file - promoters50/1031638
aaaacac

SEQ ID NO: 163373 - DNA, 8 bp, Unknown
  misc_feature (1)..( 8): Result.004 file - promoters50/1031638
aaaagcaa

SEQ ID NO: 163374 - DNA, 9 bp, Unknown
  misc_feature (1)..( 9): Result.004 file - promoters50/1031638
aaaacaaat

SEQ ID NO: 163375 - DNA, 9 bp, Unknown
  misc_feature (1)..( 9): Result.004 file - promoters50/1031638
taaaaaaat

SEQ ID NO: 163376 - DNA, 9 bp, Unknown
  misc_feature (1)..( 9): Result.004 file - promoters50/1031638
aaaataaaa

SEQ ID NO: 163377 - DNA, 9 bp, Unknown
  misc_feature (1)..( 9): Result.004 file - promoters50/1031638
caaacttac

SEQ ID NO: 163378 - DNA, 9 bp, Unknown
  misc_feature (1)..( 9): Result.004 file - promoters50/1031638
ttttttaaa

SEQ ID NO: 163379 - DNA, 9 bp, Unknown
  misc_feature (1)..( 9): Result.004 file - promoters50/1031638
tttcttaaa

SEQ ID NO: 163380 - DNA, 9 bp, Unknown
  misc_feature (1)..( 9): Result.004 file - promoters50/1031638
ttttttttc

SEQ ID NO: 163381 - DNA, 7 bp, Unknown
  misc_feature (1)..( 7): Result.004 file - promoters50/1031638
gtaaaaa

SEQ ID NO: 163382 - DNA, 7 bp, Unknown
  misc_feature (1)..( 7): Result.004 file - promoters50/1031638
gtaaaat

SEQ ID NO: 163383 - DNA, 7 bp, Unknown
  misc_feature (1)..( 7): Result.004 file - promoters50/1031638
ataaaat

SEQ ID NO: 163384 - DNA, 11 bp, Unknown
  misc_feature (1)..( 11): Result.004 file - promoters50/1031638
aatttataata

SEQ ID NO: 163385 - DNA, 11 bp, Unknown
  misc_feature (1)..( 11): Result.004 file - promoters50/1031638
aatatataata

SEQ ID NO: 163386 - DNA, 11 bp, Unknown
  misc_feature (1)..( 11): Result.004 file - promoters50/1031638
cgaataaaata

SEQ ID NO: 163387 - DNA, 9 bp, Unknown
  misc_feature (1)..( 9): Result.004 file - promoters50/1031638
ttaaaatag

SEQ ID NO: 163388 - DNA, 9 bp, Unknown
  misc_feature (1)..( 9): Result.004 file - promoters50/1031638
ttaaaaata

SEQ ID NO: 163389 - DNA, 9 bp, Unknown
  misc_feature (1)..( 9): Result.004 file - promoters50/1031638
ttaaacata

SEQ ID NO: 163390 - DNA, 9 bp, Unknown
  misc_feature (1)..( 9): Result.004 file - promoters50/1031638
ctaaacact

SEQ ID NO: 163391 - DNA, 8 bp, Unknown
  misc_feature (1)..( 8): Result.004 file - promoters50/1031638
ttaaaata

SEQ ID NO: 163392 - DNA, 8 bp, Unknown
  misc_feature (1)..( 8): Result.004 file - promoters50/1031638
taaaaata

SEQ ID NO: 163393 - DNA, 9 bp, Unknown
  misc_feature (1)..( 9): Result.004 file - promoters50/1031638
ttaaacata

SEQ ID NO: 163394 - DNA, 9 bp, Unknown
  misc_feature (1)..( 9): Result.004 file - promoters50/1031638
ctaaacact

SEQ ID NO: 163395 - DNA, 8 bp, Unknown
  misc_feature (1)..( 8): Result.004 file - promoters50/1031638
agtatttt

SEQ ID NO: 163396 - DNA, 8 bp, Unknown
  misc_feature (1)..( 8): Result.004 file - promoters50/1031638
aatatttt

SEQ ID NO: 163397 - DNA, 8 bp, Unknown
  misc_feature (1)..( 8): Result.004 file - promoters50/1031638
aatatttc

SEQ ID NO: 163398 - DNA, 6 bp, Unknown
  misc_feature (1)..( 6): Result.004 file - promoters50/1031638
ttcaaa

SEQ ID NO: 163399 - DNA, 6 bp, Unknown
  misc_feature (1)..( 6): Result.004 file - promoters50/1031638
ttcaaa

SEQ ID NO: 163400 - DNA, 6 bp, Unknown
  misc_feature (1)..( 6): Result.004 file - promoters50/1031638
ttcaaa

SEQ ID NO: 163401 - DNA, 7 bp, Unknown
  misc_feature (1)..( 7): Result.004 file - promoters50/1031638
tccaaaa

SEQ ID NO: 163402 - DNA, 7 bp, Unknown
  misc_feature (1)..( 7): Result.004 file - promoters50/1031638
tccaaac

SEQ ID NO: 163403 - DNA, 7 bp, Unknown
  misc_feature (1)..( 7): Result.004 file - promoters50/1031638
tccaaaa

SEQ ID NO: 163404 - DNA, 10 bp, Unknown
  misc_feature (1)..( 10): Result.004 file - promoters50/1031638
attgatgttc

SEQ ID NO: 163405 - DNA, 10 bp, Unknown
  misc_feature (1)..( 10): Result.004 file - promoters50/1031638
attaatgttc

SEQ ID NO: 163406 - DNA, 10 bp, Unknown
  misc_feature (1)..( 10): Result.004 file - promoters50/1031638
attaattcca

SEQ ID NO: 163407 - DNA, 7 bp, Unknown
  misc_feature (1)..( 7): Result.004 file - promoters50/1031638
tccacga

SEQ ID NO: 163408 - DNA, 7 bp, Unknown
  misc_feature (1)..( 7): Result.004 file - promoters50/1031638
cccacga

SEQ ID NO: 163409 - DNA, 7 bp, Unknown
  misc_feature (1)..( 7): Result.004 file - promoters50/1031638
cccacgt

SEQ ID NO: 163410 - DNA, 8 bp, Unknown
  misc_feature (1)..( 8): Result.004 file - promoters50/1031638
aaaatatc

SEQ ID NO: 163411 - DNA, 8 bp, Unknown
  misc_feature (1)..( 8): Result.004 file - promoters50/1031638
aaattata

SEQ ID NO: 163412 - DNA, 8 bp, Unknown
  misc_feature (1)..( 8): Result.004 file - promoters50/1031638
taatcata

SEQ ID NO: 163413 - DNA, 10 bp, Unknown
  misc_feature (1)..( 10): Result.004 file - promoters50/1031638
aaaaatttat

SEQ ID NO: 163414 - DNA, 10 bp, Unknown
  misc_feature (1)..( 10): Result.004 file - promoters50/1031638
aaatattgaa

SEQ ID NO: 163415 - DNA, 10 bp, Unknown
  misc_feature (1)..( 10): Result.004 file - promoters50/1031638
atatataata

SEQ ID NO: 163416 - DNA, 9 bp, Unknown
  misc_feature (1)..( 9): Result.004 file - promoters50/1031638
attttgtaa

SEQ ID NO: 163417 - DNA, 9 bp, Unknown
  misc_feature (1)..( 9): Result.004 file - promoters50/1031638
cgtttataa

SEQ ID NO: 163418 - DNA, 9 bp, Unknown
  misc_feature (1)..( 9): Result.004 file - promoters50/1031642
attttgtag

SEQ ID NO: 163419 - DNA, 9 bp, Unknown
  misc_feature (1)..( 9): Result.004 file - promoters50/1031642
gtccaaaga

SEQ ID NO: 163420 - DNA, 9 bp, Unknown
  misc_feature (1)..( 9): Result.004 file - promoters50/1031642
gtcaaaaaa

SEQ ID NO: 163421 - DNA, 9 bp, Unknown
  misc_feature (1)..( 9): Result.004 file - promoters50/1031642
ctcaaaaaa

SEQ ID NO: 163422 - DNA, 13 bp, Unknown
  misc_feature (1)..( 13): Result.004 file - promoters50/1031642
gtttggctaaaaa

SEQ ID NO: 163423 - DNA, 13 bp, Unknown
  misc_feature (1)..( 13): Result.004 file - promoters50/1031642
gttcggcttaaac

SEQ ID NO: 163424 - DNA, 13 bp, Unknown
  misc_feature (1)..( 13): Result.004 file - promoters50/1031646
tgcggtataaaaa

SEQ ID NO: 163425 - DNA, 9 bp, Unknown
  misc_feature (1)..( 9): Result.004 file - promoters50/1031646
acaaaatta

SEQ ID NO: 163426 - DNA, 9 bp, Unknown
  misc_feature (1)..( 9): Result.004 file - promoters50/1031646
ttaaaattg

SEQ ID NO: 163427 - DNA, 9 bp, Unknown
  misc_feature (1)..( 9): Result.004 file - promoters50/1031646
caaaaataa

SEQ ID NO: 163428 - DNA, 8 bp, Unknown
  misc_feature (1)..( 8): Result.004 file - promoters50/1031646
aaaaccca

SEQ ID NO: 163429 - DNA, 8 bp, Unknown
  misc_feature (1)..( 8): Result.004 file - promoters50/1031646
taaacccg

SEQ ID NO: 163430 - DNA, 8 bp, Unknown
  misc_feature (1)..( 8): Result.004 file - promoters50/1031646
aaaaccca

SEQ ID NO: 163431 - DNA, 9 bp, Unknown
  misc_feature (1)..( 9): Result.004 file - promoters50/1031646
cattgctaa

SEQ ID NO: 163432 - DNA, 9 bp, Unknown
  misc_feature (1)..( 9): Result.004 file - promoters50/1031646
aattgataa

SEQ ID NO: 163433 - DNA, 9 bp, Unknown
  misc_feature (1)..( 9): Result.004 file - promoters50/1031706
aattgagaa

SEQ ID NO: 163434 - DNA, 15 bp, Unknown
  misc_feature (1)..( 15): Result.004 file - promoters50/1031706
atttgaataatcttt

SEQ ID NO: 163435 - DNA, 15 bp, Unknown
  misc_feature (1)..( 15): Result.004 file - promoters50/1031706
aactacatattctga

SEQ ID NO: 163436 - DNA, 15 bp, Unknown
  misc_feature (1)..( 15): Result.004 file - promoters50/1031706
tcatcgttaattttt

SEQ ID NO: 163437 - DNA, 15 bp, Unknown
  misc_feature (1)..( 15): Result.004 file - promoters50/1031706
atttgaataattcca

SEQ ID NO: 163438 - DNA, 15 bp, Unknown
  misc_feature (1)..( 15): Result.004 file - promoters50/1031706
ataaacatattgagc

SEQ ID NO: 163439 - DNA, 15 bp, Unknown
  misc_feature (1)..( 15): Result.004 file - promoters50/1031706
atgtttatatgacca

SEQ ID NO: 163440 - DNA, 15 bp, Unknown
  misc_feature (1)..( 15): Result.004 file - promoters50/1031706
attattatatctaga

SEQ ID NO: 163441 - DNA, 15 bp, Unknown
  misc_feature (1)..( 15): Result.004 file - promoters50/1031706
ttatttttaattcaa

SEQ ID NO: 163442 - DNA, 14 bp, Unknown
  misc_feature (1)..( 14): Result.004 file - promoters50/1031706
tggtctatataaac

SEQ ID NO: 163443 - DNA, 14 bp, Unknown
  misc_feature (1)..( 14): Result.004 file - promoters50/1031706
tcttgtatatatac

SEQ ID NO: 163444 - DNA, 14 bp, Unknown
  misc_feature (1)..( 14): Result.004 file - promoters50/1031706
ccaaccatataaat

SEQ ID NO: 163445 - DNA, 14 bp, Unknown
  misc_feature (1)..( 14): Result.004 file - promoters50/1031706
tccattatatatag

SEQ ID NO: 163446 - DNA, 14 bp, Unknown
  misc_feature (1)..( 14): Result.004 file - promoters50/1031706
tcctttatattctc

SEQ ID NO: 163447 - DNA, 14 bp, Unknown
  misc_feature (1)..( 14): Result.004 file - promoters50/1031706
gtatctatatatag

SEQ ID NO: 163448 - DNA, 13 bp, Unknown
  misc_feature (1)..( 13): Result.004 file - promoters50/1031706
ttcgatttatgtc

SEQ ID NO: 163449 - DNA, 13 bp, Unknown
  misc_feature (1)..( 13): Result.004 file - promoters50/1031706
gtaattttaagtc

SEQ ID NO: 163450 - DNA, 14 bp, Unknown
  misc_feature (1)..( 14): Result.004 file - promoters50/1031706
attcattataaaaa

SEQ ID NO: 163451 - DNA, 14 bp, Unknown
  misc_feature (1)..( 14): Result.004 file - promoters50/1031706
gttgattttaaact

SEQ ID NO: 163452 - DNA, 14 bp, Unknown
  misc_feature (1)..( 14): Result.004 file - promoters50/1031706
gttaatttttgact

SEQ ID NO: 163453 - DNA, 14 bp, Unknown
  misc_feature (1)..( 14): Result.004 file - promoters50/1031706
aacaattctaattt

SEQ ID NO: 163454 - DNA, 10 bp, Unknown
  misc_feature (1)..( 10): Result.004 file - promoters50/1031706
taagaaaaag

SEQ ID NO: 163455 - DNA, 10 bp, Unknown
  misc_feature (1)..( 10): Result.004 file - promoters50/1031706
aaagaaacat

SEQ ID NO: 163456 - DNA, 10 bp, Unknown
  misc_feature (1)..( 10): Result.004 file - promoters50/1031706
aaagcaacta

SEQ ID NO: 163457 - DNA, 10 bp, Unknown
  misc_feature (1)..( 10): Result.004 file - promoters50/1031706
tcagaaactt

SEQ ID NO: 163458 - DNA, 10 bp, Unknown
  misc_feature (1)..( 10): Result.004 file - promoters50/1031706
tcacaaattg

SEQ ID NO: 163459 - DNA, 10 bp, Unknown
  misc_feature (1)..( 10): Result.004 file - promoters50/1031706
tatgaaactt

SEQ ID NO: 163460 - DNA, 10 bp, Unknown
  misc_feature (1)..( 10): Result.004 file - promoters50/1031706
acaccaatgt

SEQ ID NO: 163461 - DNA, 12 bp, Unknown
  misc_feature (1)..( 12): Result.004 file - promoters50/1031706
ccatttgaataa

SEQ ID NO: 163462 - DNA, 12 bp, Unknown
  misc_feature (1)..( 12): Result.004 file - promoters50/1031706
tatttttaattc

SEQ ID NO: 163463 - DNA, 12 bp, Unknown
  misc_feature (1)..( 12): Result.004 file - promoters50/1031706
tatgtttatatg

SEQ ID NO: 163464 - DNA, 12 bp, Unknown
  misc_feature (1)..( 12): Result.004 file - promoters50/1031706
aaccgttaattc

SEQ ID NO: 163465 - DNA, 12 bp, Unknown
  misc_feature (1)..( 12): Result.004 file - promoters50/1031706
gtatttgaataa

SEQ ID NO: 163466 - DNA, 12 bp, Unknown
  misc_feature (1)..( 12): Result.004 file - promoters50/1031706
tattattattat

SEQ ID NO: 163467 - DNA, 13 bp, Unknown
  misc_feature (1)..( 13): Result.004 file - promoters50/1031706
aactatccaaaat

SEQ ID NO: 163468 - DNA, 13 bp, Unknown
  misc_feature (1)..( 13): Result.004 file - promoters50/1031706
aaatatacaaact

SEQ ID NO: 163469 - DNA, 13 bp, Unknown
  misc_feature (1)..( 13): Result.004 file - promoters50/1031706
aaaagaccaaaac

SEQ ID NO: 163470 - DNA, 13 bp, Unknown
  misc_feature (1)..( 13): Result.004 file - promoters50/1031706
aaataaacaaact

SEQ ID NO: 163471 - DNA, 13 bp, Unknown
  misc_feature (1)..( 13): Result.004 file - promoters50/1031706
gacggaacaaaac

SEQ ID NO: 163472 - DNA, 13 bp, Unknown
  misc_feature (1)..( 13): Result.004 file - promoters50/1031706
aaaagaagaaaaa

SEQ ID NO: 163473 - DNA, 10 bp, Unknown
  misc_feature (1)..( 10): Result.004 file - promoters50/1031706
aaaaacaaac

SEQ ID NO: 163474 - DNA, 10 bp, Unknown
  misc_feature (1)..( 10): Result.004 file - promoters50/1031706
caaaacaatt

SEQ ID NO: 163475 - DNA, 10 bp, Unknown
  misc_feature (1)..( 10): Result.004 file - promoters50/1031706
cggaacaaaa

SEQ ID NO: 163476 - DNA, 10 bp, Unknown
  misc_feature (1)..( 10): Result.004 file - promoters50/1031706
ataaacaaac

SEQ ID NO: 163477 - DNA, 10 bp, Unknown
  misc_feature (1)..( 10): Result.004 file - promoters50/1031706
taaaaaaaga

SEQ ID NO: 163478 - DNA, 10 bp, Unknown
  misc_feature (1)..( 10): Result.004 file - promoters50/1031752
caaaaccacg

SEQ ID NO: 163479 - DNA, 12 bp, Unknown
  misc_feature (1)..( 12): Result.004 file - promoters50/1031752
ttttctttgtca

SEQ ID NO: 163480 - DNA, 12 bp, Unknown
  misc_feature (1)..( 12): Result.004 file - promoters50/1031752
tttacttaataa

SEQ ID NO: 163481 - DNA, 12 bp, Unknown
  misc_feature (1)..( 12): Result.004 file - promoters50/1031752
tttaattaatta

SEQ ID NO: 163482 - DNA, 8 bp, Unknown
  misc_feature (1)..( 8): Result.004 file - promoters50/1031752
ttcaagag

SEQ ID NO: 163483 - DNA, 8 bp, Unknown
  misc_feature (1)..( 8): Result.004 file - promoters50/1031752
ttcaagac

SEQ ID NO: 163484 - DNA, 8 bp, Unknown
  misc_feature (1)..( 8): Result.004 file - promoters50/1031752
atcacgag

SEQ ID NO: 163485 - DNA, 9 bp, Unknown
  misc_feature (1)..( 9): Result.004 file - promoters50/1031752
atttaactt

SEQ ID NO: 163486 - DNA, 9 bp, Unknown
  misc_feature (1)..( 9): Result.004 file - promoters50/1031752
ttttatctt

SEQ ID NO: 163487 - DNA, 9 bp, Unknown
  misc_feature (1)..( 9): Result.004 file - promoters50/1031777
ttttatgca

SEQ ID NO: 163488 - DNA, 9 bp, Unknown
  misc_feature (1)..( 9): Result.004 file - promoters50/1031777
aagaaaata

SEQ ID NO: 163489 - DNA, 9 bp, Unknown
  misc_feature (1)..( 9): Result.004 file - promoters50/1031777
tgtaaaata

SEQ ID NO: 163490 - DNA, 9 bp, Unknown
  misc_feature (1)..( 9): Result.004 file - promoters50/1031781
aagagaatc

SEQ ID NO: 163491 - DNA, 8 bp, Unknown
  misc_feature (1)..( 8): Result.004 file - promoters50/1031781
ataattac

SEQ ID NO: 163492 - DNA, 8 bp, Unknown
  misc_feature (1)..( 8): Result.004 file - promoters50/1031781
atatttat

SEQ ID NO: 163493 - DNA, 8 bp, Unknown
  misc_feature (1)..( 8): Result.004 file - promoters50/1031781
aaatttat

SEQ ID NO: 163494 - DNA, 7 bp, Unknown
  misc_feature (1)..( 7): Result.004 file - promoters50/1031781
ttttatt

SEQ ID NO: 163495 - DNA, 7 bp, Unknown
  misc_feature (1)..( 7): Result.004 file - promoters50/1031781
atttatt

SEQ ID NO: 163496 - DNA, 7 bp, Unknown
  misc_feature (1)..( 7): Result.004 file - promoters50/1031781
atttatc

SEQ ID NO: 163497 - DNA, 9 bp, Unknown
  misc_feature (1)..( 9): Result.004 file - promoters50/1031781
caaataata

SEQ ID NO: 163498 - DNA, 9 bp, Unknown
  misc_feature (1)..( 9): Result.004 file - promoters50/1031781
gaaagaata

SEQ ID NO: 163499 - DNA, 10 bp, Unknown
  misc_feature (1)..( 10): Result.004 file - promoters50/1031781
gaagagagat

SEQ ID NO: 163500 - DNA, 8 bp, Unknown
  misc_feature (1)..( 8): Result.004 file - promoters50/1031781
tagaatta

SEQ ID NO: 163501 - DNA, 8 bp, Unknown
  misc_feature (1)..( 8): Result.004 file - promoters50/1031781
tagaatgc

SEQ ID NO: 163502 - DNA, 8 bp, Unknown
  misc_feature (1)..( 8): Result.004 file - promoters50/1031781
taggatgc

SEQ ID NO: 163503 - DNA, 8 bp, Unknown
  misc_feature (1)..( 8): Result.004 file - promoters50/1031781
attaaaag

SEQ ID NO: 163504 - DNA, 8 bp, Unknown
  misc_feature (1)..( 8): Result.004 file - promoters50/1031781
tttaaaac

SEQ ID NO: 163505 - DNA, 8 bp, Unknown
  misc_feature (1)..( 8): Result.004 file - promoters50/1031799
attaaaaa

SEQ ID NO: 163506 - DNA, 12 bp, Unknown
  misc_feature (1)..( 12): Result.004 file - promoters50/1031799
tttgtgagtgat

SEQ ID NO: 163507 - DNA, 12 bp, Unknown
  misc_feature (1)..( 12): Result.004 file - promoters50/1031799
tttgttagttca

SEQ ID NO: 163508 - DNA, 12 bp, Unknown
  misc_feature (1)..( 12): Result.004 file - promoters50/1031799
tggttgattgat

SEQ ID NO: 163509 - DNA, 12 bp, Unknown
  misc_feature (1)..( 12): Result.004 file - promoters50/1031799
ttttttaggtcc

SEQ ID NO: 163510 - DNA, 12 bp, Unknown
  misc_feature (1)..( 12): Result.004 file - promoters50/1031799
atttttactttt

SEQ ID NO: 163511 - DNA, 12 bp, Unknown
  misc_feature (1)..( 12): Result.004 file - promoters50/1031799
atttttggttaa

SEQ ID NO: 163512 - DNA, 11 bp, Unknown
  misc_feature (1)..( 11): Result.004 file - promoters50/1031799
gatctttagat

SEQ ID NO: 163513 - DNA, 11 bp, Unknown
  misc_feature (1)..( 11): Result.004 file - promoters50/1031799
cttctttggat

SEQ ID NO: 163514 - DNA, 11 bp, Unknown
  misc_feature (1)..( 11): Result.004 file - promoters50/1031799
tagagttggat

SEQ ID NO: 163515 - DNA, 11 bp, Unknown
  misc_feature (1)..( 11): Result.004 file - promoters50/1031799
ttactttggaa

SEQ ID NO: 163516 - DNA, 11 bp, Unknown
  misc_feature (1)..( 11): Result.004 file - promoters50/1031799
attctttcaaa

SEQ ID NO: 163517 - DNA, 11 bp, Unknown
  misc_feature (1)..( 11): Result.004 file - promoters50/1031799
attcttacaac

SEQ ID NO: 163518 - DNA, 11 bp, Unknown
  misc_feature (1)..( 11): Result.004 file - promoters50/1031806
ggtattactct

SEQ ID NO: 163519 - DNA, 13 bp, Unknown
  misc_feature (1)..( 13): Result.004 file - promoters50/1031806
actcttgtttcat

SEQ ID NO: 163520 - DNA, 13 bp, Unknown
  misc_feature (1)..( 13): Result.004 file - promoters50/1031806
cttcttgttttgt

SEQ ID NO: 163521 - DNA, 13 bp, Unknown
  misc_feature (1)..( 13): Result.004 file - promoters50/1031806
cctcttgttctga

SEQ ID NO: 163522 - DNA, 13 bp, Unknown
  misc_feature (1)..( 13): Result.004 file - promoters50/1031806
aaacttttttttt

SEQ ID NO: 163523 - DNA, 13 bp, Unknown
  misc_feature (1)..( 13): Result.004 file - promoters50/1031806
ctttttgattcgt

SEQ ID NO: 163524 - DNA, 13 bp, Unknown
  misc_feature (1)..( 13): Result.004 file - promoters50/1031806
gagtttgatttga

SEQ ID NO: 163525 - DNA, 13 bp, Unknown
  misc_feature (1)..( 13): Result.004 file - promoters50/1031806
aatatttttcatt

SEQ ID NO: 163526 - DNA, 8 bp, Unknown
  misc_feature (1)..( 8): Result.004 file - promoters50/1031806
acttaaaa

SEQ ID NO: 163527 - DNA, 8 bp, Unknown
  misc_feature (1)..( 8): Result.004 file - promoters50/1031806
acttaaaa

SEQ ID NO: 163528 - DNA, 9 bp, Unknown
  misc_feature (1)..( 9): Result.004 file - promoters50/1031806
gattagaaa

SEQ ID NO: 163529 - DNA, 9 bp, Unknown
  misc_feature (1)..( 9): Result.004 file - promoters50/1031806
atttagaaa

SEQ ID NO: 163530 - DNA, 9 bp, Unknown
  misc_feature (1)..( 9): Result.004 file - promoters50/1031806
tattaaaat

SEQ ID NO: 163531 - DNA, 9 bp, Unknown
  misc_feature (1)..( 9): Result.004 file - promoters50/1031806
attgagaaa

SEQ ID NO: 163532 - DNA, 14 bp, Unknown
  misc_feature (1)..( 14): Result.004 file - promoters50/1031806
ttaaagtttctgac

SEQ ID NO: 163533 - DNA, 14 bp, Unknown
  misc_feature (1)..( 14): Result.004 file - promoters50/1031806
cctcttgttctgat

SEQ ID NO: 163534 - DNA, 14 bp, Unknown
  misc_feature (1)..( 14): Result.004 file - promoters50/1031806
ggaatctttttgat

SEQ ID NO: 163535 - DNA, 14 bp, Unknown
  misc_feature (1)..( 14): Result.004 file - promoters50/1031806
tttcttcttcttgt

SEQ ID NO: 163536 - DNA, 14 bp, Unknown
  misc_feature (1)..( 14): Result.004 file - promoters50/1031806
aatatttttcattt

SEQ ID NO: 163537 - DNA, 14 bp, Unknown
  misc_feature (1)..( 14): Result.004 file - promoters50/1031806
gagtttgatttgat

SEQ ID NO: 163538 - DNA, 16 bp, Unknown
  misc_feature (1)..( 16): Result.004 file - promoters50/1031806
agagaaatctccgacc

SEQ ID NO: 163539 - DNA, 16 bp, Unknown
  misc_feature (1)..( 16): Result.004 file - promoters50/1031806
gaagaaattaaaggaa

SEQ ID NO: 163540 - DNA, 16 bp, Unknown
  misc_feature (1)..( 16): Result.004 file - promoters50/1031806
gttgaaatgaaaagaa

SEQ ID NO: 163541 - DNA, 16 bp, Unknown
  misc_feature (1)..( 16): Result.004 file - promoters50/1031806
taagaataaccgttgg

SEQ ID NO: 163542 - DNA, 16 bp, Unknown
  misc_feature (1)..( 16): Result.004 file - promoters50/1031806
tgtgaacttagtctgt

SEQ ID NO: 163543 - DNA, 16 bp, Unknown
  misc_feature (1)..( 16): Result.004 file - promoters50/1032149
taacaatcagtatcca

SEQ ID NO: 163544 - DNA, 7 bp, Unknown
  misc_feature (1)..( 7): Result.004 file - promoters50/1032149
gatagtt

SEQ ID NO: 163545 - DNA, 7 bp, Unknown
  misc_feature (1)..( 7): Result.004 file - promoters50/1032149
tatagtt

SEQ ID NO: 163546 - DNA, 7 bp, Unknown
  misc_feature (1)..( 7): Result.004 file - promoters50/1032149
tattgtt

SEQ ID NO: 163547 - DNA, 12 bp, Unknown
  misc_feature (1)..( 12): Result.004 file - promoters50/1032149
tttgcataatca

SEQ ID NO: 163548 - DNA, 12 bp, Unknown
  misc_feature (1)..( 12): Result.004 file - promoters50/1032149
agttattaatca

SEQ ID NO: 163549 - DNA, 12 bp, Unknown
  misc_feature (1)..( 12): Result.004 file - promoters50/1032149
ataatttaatca

SEQ ID NO: 163550 - DNA, 12 bp, Unknown
  misc_feature (1)..( 12): Result.004 file - promoters50/1032149
agtgattcatct

SEQ ID NO: 163551 - DNA, 11 bp, Unknown
  misc_feature (1)..( 11): Result.004 file - promoters50/1032149
tcatattaagc

SEQ ID NO: 163552 - DNA, 11 bp, Unknown
  misc_feature (1)..( 11): Result.004 file - promoters50/1032149
agttattaatc

SEQ ID NO: 163553 - DNA, 11 bp, Unknown
  misc_feature (1)..( 11): Result.004 file - promoters50/1032149
agtgattcatc

SEQ ID NO: 163554 - DNA, 7 bp, Unknown
  misc_feature (1)..( 7): Result.004 file - promoters50/1032149
attttac

SEQ ID NO: 163555 - DNA, 7 bp, Unknown
  misc_feature (1)..( 7): Result.004 file - promoters50/1032149
tttttac

SEQ ID NO: 163556 - DNA, 7 bp, Unknown
  misc_feature (1)..( 7): Result.004 file - promoters50/1032149
attttaa

SEQ ID NO: 163557 - DNA, 10 bp, Unknown
  misc_feature (1)..( 10): Result.004 file - promoters50/1032149
aacaattaaa

SEQ ID NO: 163558 - DNA, 10 bp, Unknown
  misc_feature (1)..( 10): Result.004 file - promoters50/1032149
tccaactaac

SEQ ID NO: 163559 - DNA, 10 bp, Unknown
  misc_feature (1)..( 10): Result.004 file - promoters50/1032149
aacacttaaa

SEQ ID NO: 163560 - DNA, 9 bp, Unknown
  misc_feature (1)..( 9): Result.004 file - promoters50/1032149
catgaaaaa

SEQ ID NO: 163561 - DNA, 9 bp, Unknown
  misc_feature (1)..( 9): Result.004 file - promoters50/1032149
tatgaaaaa

SEQ ID NO: 163562 - DNA, 9 bp, Unknown
  misc_feature (1)..( 9): Result.004 file - promoters50/1032149
tattaaagt

SEQ ID NO: 163563 - DNA, 8 bp, Unknown
  misc_feature (1)..( 8): Result.004 file - promoters50/1032149
atatatga

SEQ ID NO: 163564 - DNA, 8 bp, Unknown
  misc_feature (1)..( 8): Result.004 file - promoters50/1032149
atatatgt

SEQ ID NO: 163565 - DNA, 8 bp, Unknown
  misc_feature (1)..( 8): Result.004 file - promoters50/1032149
ttatgtgt

SEQ ID NO: 163566 - DNA, 13 bp, Unknown
  misc_feature (1)..( 13): Result.004 file - promoters50/1032149
aaattatttttaa

SEQ ID NO: 163567 - DNA, 13 bp, Unknown
  misc_feature (1)..( 13): Result.004 file - promoters50/1032149
aaattgtttttaa

SEQ ID NO: 163568 - DNA, 13 bp, Unknown
  misc_feature (1)..( 13): Result.004 file - promoters50/1032149
atatttttttaat

SEQ ID NO: 163569 - DNA, 8 bp, Unknown
  misc_feature (1)..( 8): Result.004 file - promoters50/1032149
aaaaatta

SEQ ID NO: 163570 - DNA, 8 bp, Unknown
  misc_feature (1)..( 8): Result.004 file - promoters50/1032149
aaatattt

SEQ ID NO: 163571 - DNA, 8 bp, Unknown
  misc_feature (1)..( 8): Result.004 file - promoters50/1032149
caattttt

SEQ ID NO: 163572 - DNA, 9 bp, Unknown
  misc_feature (1)..( 9): Result.004 file - promoters50/1032149
ttttttaaa

SEQ ID NO: 163573 - DNA, 9 bp, Unknown
  misc_feature (1)..( 9): Result.004 file - promoters50/1032149
tttattaaa

SEQ ID NO: 163574 - DNA, 9 bp, Unknown
  misc_feature (1)..( 9): Result.004 file - promoters50/1032149
actatgaaa

SEQ ID NO: 163575 - DNA, 12 bp, Unknown
  misc_feature (1)..( 12): Result.004 file - promoters50/1032149
aaaagttcatct

SEQ ID NO: 163576 - DNA, 12 bp, Unknown
  misc_feature (1)..( 12): Result.004 file - promoters50/1032149
aaaagttttatt

SEQ ID NO: 163577 - DNA, 12 bp, Unknown
  misc_feature (1)..( 12): Result.004 file - promoters50/1032149
caaacttcatct

SEQ ID NO: 163578 - DNA, 8 bp, Unknown
  misc_feature (1)..( 8): Result.004 file - promoters50/1032149
ttttttta

SEQ ID NO: 163579 - DNA, 8 bp, Unknown
  misc_feature (1)..( 8): Result.004 file - promoters50/1032149
ctttctta

SEQ ID NO: 163580 - DNA, 9 bp, Unknown
  misc_feature (1)..( 9): Result.004 file - promoters50/1032160
attgttttt

SEQ ID NO: 163581 - DNA, 12 bp, Unknown
  misc_feature (1)..( 12): Result.004 file - promoters50/1032160
aattttaagata

SEQ ID NO: 163582 - DNA, 12 bp, Unknown
  misc_feature (1)..( 12): Result.004 file - promoters50/1032160
aattttgctaaa

SEQ ID NO: 163583 - DNA, 12 bp, Unknown
  misc_feature (1)..( 12): Result.004 file - promoters50/1032160
aatattacgttt

SEQ ID NO: 163584 - DNA, 12 bp, Unknown
  misc_feature (1)..( 12): Result.004 file - promoters50/1032160
aatttatttaat

SEQ ID NO: 163585 - DNA, 12 bp, Unknown
  misc_feature (1)..( 12): Result.004 file - promoters50/1032160
gattttgctgtg

SEQ ID NO: 163586 - DNA, 12 bp, Unknown
  misc_feature (1)..( 12): Result.004 file - promoters50/1032160
cttattatgttt

SEQ ID NO: 163587 - DNA, 16 bp, Unknown
  misc_feature (1)..( 16): Result.004 file - promoters50/1032160
cacagagacttttttt

SEQ ID NO: 163588 - DNA, 16 bp, Unknown
  misc_feature (1)..( 16): Result.004 file - promoters50/1032160
cacacagaatccagct

SEQ ID NO: 163589 - DNA, 16 bp, Unknown
  misc_feature (1)..( 16): Result.004 file - promoters50/1032160
ttgagagacttctttt

SEQ ID NO: 163590 - DNA, 16 bp, Unknown
  misc_feature (1)..( 16): Result.004 file - promoters50/1032160
gcaagagacagtggag

SEQ ID NO: 163591 - DNA, 16 bp, Unknown
  misc_feature (1)..( 16): Result.004 file - promoters50/1032160
aacaaagaaacatacc

SEQ ID NO: 163592 - DNA, 16 bp, Unknown
  misc_feature (1)..( 16): Result.004 file - promoters50/1032160
cagacagaaagaacgt

SEQ ID NO: 163593 - DNA, 13 bp, Unknown
  misc_feature (1)..( 13): Result.004 file - promoters50/1032160
tatttataaaatt

SEQ ID NO: 163594 - DNA, 13 bp, Unknown
  misc_feature (1)..( 13): Result.004 file - promoters50/1032160
caattaaaaaaat

SEQ ID NO: 163595 - DNA, 13 bp, Unknown
  misc_feature (1)..( 13): Result.004 file - promoters50/1032160
tatttatattaga

SEQ ID NO: 163596 - DNA, 13 bp, Unknown
  misc_feature (1)..( 13): Result.004 file - promoters50/1032160
ttagtaaaagaat

SEQ ID NO: 163597 - DNA, 13 bp, Unknown
  misc_feature (1)..( 13): Result.004 file - promoters50/1032160
catcaccaagaat

SEQ ID NO: 163598 - DNA, 13 bp, Unknown
  misc_feature (1)..( 13): Result.004 file - promoters50/1032266
caattatttcgtt

SEQ ID NO: 163599 - DNA, 12 bp, Unknown
  misc_feature (1)..( 12): Result.004 file - promoters50/1032266
agtgtttggtgt

SEQ ID NO: 163600 - DNA, 12 bp, Unknown
  misc_feature (1)..( 12): Result.004 file - promoters50/1032266
agtctttttacg

SEQ ID NO: 163601 - DNA, 12 bp, Unknown
  misc_feature (1)..( 12): Result.004 file - promoters50/1032266
tatgttaggtgt

SEQ ID NO: 163602 - DNA, 10 bp, Unknown
  misc_feature (1)..( 10): Result.004 file - promoters50/1032266
atatcttcta

SEQ ID NO: 163603 - DNA, 10 bp, Unknown
  misc_feature (1)..( 10): Result.004 file - promoters50/1032266
atattttcaa

SEQ ID NO: 163604 - DNA, 10 bp, Unknown
  misc_feature (1)..( 10): Result.004 file - promoters50/1032274
ttctttacaa

SEQ ID NO: 163605 - DNA, 13 bp, Unknown
  misc_feature (1)..( 13): Result.004 file - promoters50/1032274
ttatatttaaaat

SEQ ID NO: 163606 - DNA, 13 bp, Unknown
  misc_feature (1)..( 13): Result.004 file - promoters50/1032274
ttacatttagtag

SEQ ID NO: 163607 - DNA, 13 bp, Unknown
  misc_feature (1)..( 13): Result.004 file - promoters50/1032274
ctatatctaattt

SEQ ID NO: 163608 - DNA, 13 bp, Unknown
  misc_feature (1)..( 13): Result.004 file - promoters50/1032274
ttatatgacttgt

SEQ ID NO: 163609 - DNA, 13 bp, Unknown
  misc_feature (1)..( 13): Result.004 file - promoters50/1032274
aactatttgactt

SEQ ID NO: 163610 - DNA, 10 bp, Unknown
  misc_feature (1)..( 10): Result.004 file - promoters50/1032274
tgttttgata

SEQ ID NO: 163611 - DNA, 10 bp, Unknown
  misc_feature (1)..( 10): Result.004 file - promoters50/1032274
gaattttata

SEQ ID NO: 163612 - DNA, 10 bp, Unknown
  misc_feature (1)..( 10): Result.004 file - promoters50/1032274
ttatttgatt

SEQ ID NO: 163613 - DNA, 10 bp, Unknown
  misc_feature (1)..( 10): Result.004 file - promoters50/1032274
gaggttgatt

SEQ ID NO: 163614 - DNA, 10 bp, Unknown
  misc_feature (1)..( 10): Result.004 file - promoters50/1032291
ttaattgatg

SEQ ID NO: 163615 - DNA, 7 bp, Unknown
  misc_feature (1)..( 7): Result.004 file - promoters50/1032291
attcgtt

SEQ ID NO: 163616 - DNA, 7 bp, Unknown
  misc_feature (1)..( 7): Result.004 file - promoters50/1032291
attagtt

SEQ ID NO: 163617 - DNA, 7 bp, Unknown
  misc_feature (1)..( 7): Result.004 file - promoters50/1032291
atttgtt

SEQ ID NO: 163618 - DNA, 7 bp, Unknown
  misc_feature (1)..( 7): Result.004 file - promoters50/1032313
atttgta

SEQ ID NO: 163619 - DNA, 13 bp, Unknown
  misc_feature (1)..( 13): Result.004 file - promoters50/1032313
taaaaaagtgttg

SEQ ID NO: 163620 - DNA, 13 bp, Unknown
  misc_feature (1)..( 13): Result.004 file - promoters50/1032313
cgctaaagtgatc

SEQ ID NO: 163621 - DNA, 13 bp, Unknown
  misc_feature (1)..( 13): Result.004 file - promoters50/1032313
aaaaaaagttttt

SEQ ID NO: 163622 - DNA, 13 bp, Unknown
  misc_feature (1)..( 13): Result.004 file - promoters50/1032313
tcataaaatgtta

SEQ ID NO: 163623 - DNA, 13 bp, Unknown
  misc_feature (1)..( 13): Result.004 file - promoters50/1032313
ctaaaaaatatta

SEQ ID NO: 163624 - DNA, 13 bp, Unknown
  misc_feature (1)..( 13): Result.004 file - promoters50/1032313
taataaattttga

SEQ ID NO: 163625 - DNA, 15 bp, Unknown
  misc_feature (1)..( 15): Result.004 file - promoters50/1032313
agggttctcgaaaga

SEQ ID NO: 163626 - DNA, 15 bp, Unknown
  misc_feature (1)..( 15): Result.004 file - promoters50/1032313
cattttctagaaata

SEQ ID NO: 163627 - DNA, 15 bp, Unknown
  misc_feature (1)..( 15): Result.004 file - promoters50/1032313
catcttctaaaatct

SEQ ID NO: 163628 - DNA, 15 bp, Unknown
  misc_feature (1)..( 15): Result.004 file - promoters50/1032313
ctatttcaaaaatac

SEQ ID NO: 163629 - DNA, 15 bp, Unknown
  misc_feature (1)..( 15): Result.004 file - promoters50/1032313
taagtacaataatac

SEQ ID NO: 163630 - DNA, 15 bp, Unknown
  misc_feature (1)..( 15): Result.004 file - promoters50/1032313
gtgcttcaaacaaaa

SEQ ID NO: 163631 - DNA, 14 bp, Unknown
  misc_feature (1)..( 14): Result.004 file - promoters50/1032313
catcttcaaaatta

SEQ ID NO: 163632 - DNA, 14 bp, Unknown
  misc_feature (1)..( 14): Result.004 file - promoters50/1032313
ctatttcaaaaata

SEQ ID NO: 163633 - DNA, 14 bp, Unknown
  misc_feature (1)..( 14): Result.004 file - promoters50/1032313
gtgcttcaaacaaa

SEQ ID NO: 163634 - DNA, 15 bp, Unknown
  misc_feature (1)..( 15): Result.004 file - promoters50/1032313
catcttctaaaatct

SEQ ID NO: 163635 - DNA, 16 bp, Unknown
  misc_feature (1)..( 16): Result.004 file - promoters50/1032313
gtgcttccaacaaatg

SEQ ID NO: 163636 - DNA, 16 bp, Unknown
  misc_feature (1)..( 16): Result.004 file - promoters50/1032316
gtaagtacaataatac

SEQ ID NO: 163637 - DNA, 15 bp, Unknown
  misc_feature (1)..( 15): Result.004 file - promoters50/1032316
tttcttaaattaaaa

SEQ ID NO: 163638 - DNA, 15 bp, Unknown
  misc_feature (1)..( 15): Result.004 file - promoters50/1032316
gttcttcaattgaaa

SEQ ID NO: 163639 - DNA, 16 bp, Unknown
  misc_feature (1)..( 16): Result.004 file - promoters50/1032316
aaatctgaaaaattca

SEQ ID NO: 163640 - DNA, 16 bp, Unknown
  misc_feature (1)..( 16): Result.004 file - promoters50/1032316
tttactttttttttcc

SEQ ID NO: 163641 - DNA, 16 bp, Unknown
  misc_feature (1)..( 16): Result.004 file - promoters50/1032316
cgttcttgtactgagc

SEQ ID NO: 163642 - DNA, 16 bp, Unknown
  misc_feature (1)..( 16): Result.004 file - promoters50/1032381
tttgcttattacagta

SEQ ID NO: 163643 - DNA, 9 bp, Unknown
  misc_feature (1)..( 9): Result.004 file - promoters50/1032381
tttactttg

SEQ ID NO: 163644 - DNA, 9 bp, Unknown
  misc_feature (1)..( 9): Result.004 file - promoters50/1032381
attaatttt

SEQ ID NO: 163645 - DNA, 9 bp, Unknown
  misc_feature (1)..( 9): Result.004 file - promoters50/1032381
taaactttg

SEQ ID NO: 163646 - DNA, 9 bp, Unknown
  misc_feature (1)..( 9): Result.004 file - promoters50/1032381
gttaccttg

SEQ ID NO: 163647 - DNA, 9 bp, Unknown
  misc_feature (1)..( 9): Result.004 file - promoters50/1032381
tttgcttct

SEQ ID NO: 163648 - DNA, 9 bp, Unknown
  misc_feature (1)..( 9): Result.004 file - promoters50/1032381
tataaatat

SEQ ID NO: 163649 - DNA, 11 bp, Unknown
  misc_feature (1)..( 11): Result.004 file - promoters50/1032381
tcaatccaaag

SEQ ID NO: 163650 - DNA, 11 bp, Unknown
  misc_feature (1)..( 11): Result.004 file - promoters50/1032381
aaaatcaaaat

SEQ ID NO: 163651 - DNA, 11 bp, Unknown
  misc_feature (1)..( 11): Result.004 file - promoters50/1032381
ttaataaaaag

SEQ ID NO: 163652 - DNA, 11 bp, Unknown
  misc_feature (1)..( 11): Result.004 file - promoters50/1032381
caaattaaaaa

SEQ ID NO: 163653 - DNA, 11 bp, Unknown
  misc_feature (1)..( 11): Result.004 file - promoters50/1032381
tttttaaaaag

SEQ ID NO: 163654 - DNA, 11 bp, Unknown
  misc_feature (1)..( 11): Result.004 file - promoters50/1032381
caaattacaaa

SEQ ID NO: 163655 - DNA, 11 bp, Unknown
  misc_feature (1)..( 11): Result.004 file - promoters50/1032381
cgtattaaagt

SEQ ID NO: 163656 - DNA, 16 bp, Unknown
  misc_feature (1)..( 16): Result.004 file - promoters50/1032381
ttccactataaaactt

SEQ ID NO: 163657 - DNA, 16 bp, Unknown
  misc_feature (1)..( 16): Result.004 file - promoters50/1032381
cctaactatataacct

SEQ ID NO: 163658 - DNA, 16 bp, Unknown
  misc_feature (1)..( 16): Result.004 file - promoters50/1032381
acggactataaaaagg

SEQ ID NO: 163659 - DNA, 16 bp, Unknown
  misc_feature (1)..( 16): Result.004 file - promoters50/1032381
accctatataaagata

SEQ ID NO: 163660 - DNA, 16 bp, Unknown
  misc_feature (1)..( 16): Result.004 file - promoters50/1032381
attcctaataaaacct

SEQ ID NO: 163661 - DNA, 16 bp, Unknown
  misc_feature (1)..( 16): Result.004 file - promoters50/1032381
cattactattaaagcc

SEQ ID NO: 163662 - DNA, 12 bp, Unknown
  misc_feature (1)..( 12): Result.004 file - promoters50/1032381
tttcttacgcca

SEQ ID NO: 163663 - DNA, 12 bp, Unknown
  misc_feature (1)..( 12): Result.004 file - promoters50/1032381
ttttttagtttt

SEQ ID NO: 163664 - DNA, 12 bp, Unknown
  misc_feature (1)..( 12): Result.004 file - promoters50/1032381
agttttactttt

SEQ ID NO: 163665 - DNA, 12 bp, Unknown
  misc_feature (1)..( 12): Result.004 file - promoters50/1032381
ctttttgttgtt

SEQ ID NO: 163666 - DNA, 12 bp, Unknown
  misc_feature (1)..( 12): Result.004 file - promoters50/1032381
atttttggacca

SEQ ID NO: 163667 - DNA, 12 bp, Unknown
  misc_feature (1)..( 12): Result.004 file - promoters50/1032381
gtttttgctgat

SEQ ID NO: 163668 - DNA, 10 bp, Unknown
  misc_feature (1)..( 10): Result.004 file - promoters50/1032381
caaaagaatc

SEQ ID NO: 163669 - DNA, 10 bp, Unknown
  misc_feature (1)..( 10): Result.004 file - promoters50/1032381
acaaaaaata

SEQ ID NO: 163670 - DNA, 10 bp, Unknown
  misc_feature (1)..( 10): Result.004 file - promoters50/1032381
caaaacaatt

SEQ ID NO: 163671 - DNA, 11 bp, Unknown
  misc_feature (1)..( 11): Result.004 file - promoters50/1032381
aaaaagtaatt

SEQ ID NO: 163672 - DNA, 11 bp, Unknown
  misc_feature (1)..( 11): Result.004 file - promoters50/1032381
aaaaagttttt

SEQ ID NO: 163673 - DNA, 11 bp, Unknown
  misc_feature (1)..( 11): Result.004 file - promoters50/1032381
aactagtgatt

SEQ ID NO: 163674 - DNA, 8 bp, Unknown
  misc_feature (1)..( 8): Result.004 file - promoters50/1032381
tgtttttg

SEQ ID NO: 163675 - DNA, 8 bp, Unknown
  misc_feature (1)..( 8): Result.004 file - promoters50/1032381
agtttttt

SEQ ID NO: 163676 - DNA, 8 bp, Unknown
  misc_feature (1)..( 8): Result.004 file - promoters50/1032381
gatttttg

SEQ ID NO: 163677 - DNA, 8 bp, Unknown
  misc_feature (1)..( 8): Result.004 file - promoters50/1032381
tctttttg

SEQ ID NO: 163678 - DNA, 8 bp, Unknown
  misc_feature (1)..( 8): Result.004 file - promoters50/1032381
agttttac

SEQ ID NO: 163679 - DNA, 8 bp, Unknown
  misc_feature (1)..( 8): Result.004 file - promoters50/1032381
tgtttttg

SEQ ID NO: 163680 - DNA, 11 bp, Unknown
  misc_feature (1)..( 11): Result.004 file - promoters50/1032381
tatttaaatta

SEQ ID NO: 163681 - DNA, 11 bp, Unknown
  misc_feature (1)..( 11): Result.004 file - promoters50/1032381
aatttgaattt

SEQ ID NO: 163682 - DNA, 11 bp, Unknown
  misc_feature (1)..( 11): Result.004 file - promoters50/1032381
tttgtaaattt

SEQ ID NO: 163683 - DNA, 11 bp, Unknown
  misc_feature (1)..( 11): Result.004 file - promoters50/1032381
tatctaatgaa

SEQ ID NO: 163684 - DNA, 11 bp, Unknown
  misc_feature (1)..( 11): Result.004 file - promoters50/1032381
tgtaaaaatta

SEQ ID NO: 163685 - DNA, 11 bp, Unknown
  misc_feature (1)..( 11): Result.004 file - promoters50/1032389
tgagtagatta

SEQ ID NO: 163686 - DNA, 12 bp, Unknown
  misc_feature (1)..( 12): Result.004 file - promoters50/1032389
gtttggttcatt

SEQ ID NO: 163687 - DNA, 12 bp, Unknown
  misc_feature (1)..( 12): Result.004 file - promoters50/1032389
aaaaggttaatt

SEQ ID NO: 163688 - DNA, 12 bp, Unknown
  misc_feature (1)..( 12): Result.004 file - promoters50/1032389
ttttgtttcaga

SEQ ID NO: 163689 - DNA, 12 bp, Unknown
  misc_feature (1)..( 12): Result.004 file - promoters50/1032389
tgttgtttcgtg

SEQ ID NO: 163690 - DNA, 12 bp, Unknown
  misc_feature (1)..( 12): Result.004 file - promoters50/1032389
atttttttattt

SEQ ID NO: 163691 - DNA, 12 bp, Unknown
  misc_feature (1)..( 12): Result.004 file - promoters50/1032389
attttgtgtttt

SEQ ID NO: 163692 - DNA, 9 bp, Unknown
  misc_feature (1)..( 9): Result.004 file - promoters50/1032389
tattttttt

SEQ ID NO: 163693 - DNA, 9 bp, Unknown
  misc_feature (1)..( 9): Result.004 file - promoters50/1032389
aatttttat

SEQ ID NO: 163694 - DNA, 9 bp, Unknown
  misc_feature (1)..( 9): Result.004 file - promoters50/1032389
cattttttt

SEQ ID NO: 163695 - DNA, 9 bp, Unknown
  misc_feature (1)..( 9): Result.004 file - promoters50/1032389
tattttgtt

SEQ ID NO: 163696 - DNA, 10 bp, Unknown
  misc_feature (1)..( 10): Result.004 file - promoters50/1032389
gttttgtttg

SEQ ID NO: 163697 - DNA, 10 bp, Unknown
  misc_feature (1)..( 10): Result.004 file - promoters50/1032400
aattttgtgt

SEQ ID NO: 163698 - DNA, 8 bp, Unknown
  misc_feature (1)..( 8): Result.004 file - promoters50/1032400
aatttatt

SEQ ID NO: 163699 - DNA, 8 bp, Unknown
  misc_feature (1)..( 8): Result.004 file - promoters50/1032400
aattgatt

SEQ ID NO: 163700 - DNA, 8 bp, Unknown
  misc_feature (1)..( 8): Result.004 file - promoters50/1032436
ctttgatt

SEQ ID NO: 163701 - DNA, 10 bp, Unknown
  misc_feature (1)..( 10): Result.004 file - promoters50/1032436
tgtactgaaa

SEQ ID NO: 163702 - DNA, 10 bp, Unknown
  misc_feature (1)..( 10): Result.004 file - promoters50/1032436
aatactcaaa

SEQ ID NO: 163703 - DNA, 10 bp, Unknown
  misc_feature (1)..( 10): Result.004 file - promoters50/1032436
acaactcaat

SEQ ID NO: 163704 - DNA, 10 bp, Unknown
  misc_feature (1)..( 10): Result.004 file - promoters50/1032436
aattctctct

SEQ ID NO: 163705 - DNA, 7 bp, Unknown
  misc_feature (1)..( 7): Result.004 file - promoters50/1032436
attattc

SEQ ID NO: 163706 - DNA, 7 bp, Unknown
  misc_feature (1)..( 7): Result.004 file - promoters50/1032436
attattt

SEQ ID NO: 163707 - DNA, 7 bp, Unknown
  misc_feature (1)..( 7): Result.004 file - promoters50/1032436
atttttt

SEQ ID NO: 163708 - DNA, 14 bp, Unknown
  misc_feature (1)..( 14): Result.004 file - promoters50/1032436
ctccgtgaagactt

SEQ ID NO: 163709 - DNA, 14 bp, Unknown
  misc_feature (1)..( 14): Result.004 file - promoters50/1032436
tcaaatgaagaaaa

SEQ ID NO: 163710 - DNA, 14 bp, Unknown
  misc_feature (1)..( 14): Result.004 file - promoters50/1032436
tcaaaagaagtaaa

SEQ ID NO: 163711 - DNA, 9 bp, Unknown
  misc_feature (1)..( 9): Result.004 file - promoters50/1032436
aataatgtt

SEQ ID NO: 163712 - DNA, 9 bp, Unknown
  misc_feature (1)..( 9): Result.004 file - promoters50/1032436
aataattcc

SEQ ID NO: 163713 - DNA, 9 bp, Unknown
  misc_feature (1)..( 9): Result.004 file - promoters50/1032436
aataaagtt

SEQ ID NO: 163714 - DNA, 8 bp, Unknown
  misc_feature (1)..( 8): Result.004 file - promoters50/1032436
acttttca

SEQ ID NO: 163715 - DNA, 8 bp, Unknown
  misc_feature (1)..( 8): Result.004 file - promoters50/1032436
actgttcc

SEQ ID NO: 163716 - DNA, 8 bp, Unknown
  misc_feature (1)..( 8): Result.004 file - promoters50/1032498
agttttca

SEQ ID NO: 163717 - DNA, 15 bp, Unknown
  misc_feature (1)..( 15): Result.004 file - promoters50/1032498
aatataaagcccaaa

SEQ ID NO: 163718 - DNA, 15 bp, Unknown
  misc_feature (1)..( 15): Result.004 file - promoters50/1032498
atttacaagcccaaa

SEQ ID NO: 163719 - DNA, 15 bp, Unknown
  misc_feature (1)..( 15): Result.004 file - promoters50/1032498
aataaaaagcccatg

SEQ ID NO: 163720 - DNA, 15 bp, Unknown
  misc_feature (1)..( 15): Result.004 file - promoters50/1032498
tgggccaagccgtat

SEQ ID NO: 163721 - DNA, 15 bp, Unknown
  misc_feature (1)..( 15): Result.004 file - promoters50/1032498
tttaaaaaagggaag

SEQ ID NO: 163722 - DNA, 15 bp, Unknown
  misc_feature (1)..( 15): Result.004 file - promoters50/1032498
aatcaaaatctaaaa

SEQ ID NO: 163723 - DNA, 10 bp, Unknown
  misc_feature (1)..( 10): Result.004 file - promoters50/1032498
gagttggata

SEQ ID NO: 163724 - DNA, 10 bp, Unknown
  misc_feature (1)..( 10): Result.004 file - promoters50/1032498
gagatggatc

SEQ ID NO: 163725 - DNA, 10 bp, Unknown
  misc_feature (1)..( 10): Result.004 file - promoters50/1032498
tctttggatt

SEQ ID NO: 163726 - DNA, 10 bp, Unknown
  misc_feature (1)..( 10): Result.004 file - promoters50/1032498
tttttgaata

SEQ ID NO: 163727 - DNA, 10 bp, Unknown
  misc_feature (1)..( 10): Result.004 file - promoters50/1032498
gagattgatt

SEQ ID NO: 163728 - DNA, 10 bp, Unknown
  misc_feature (1)..( 10): Result.004 file - promoters50/1032614
ggtttcgata

SEQ ID NO: 163729 - DNA, 11 bp, Unknown
  misc_feature (1)..( 11): Result.004 file - promoters50/1032614
ctctgaagctt

SEQ ID NO: 163730 - DNA, 11 bp, Unknown
  misc_feature (1)..( 11): Result.004 file - promoters50/1032614
tcttgaagctt

SEQ ID NO: 163731 - DNA, 11 bp, Unknown
  misc_feature (1)..( 11): Result.004 file - promoters50/1032614
atttgaagcga

SEQ ID NO: 163732 - DNA, 11 bp, Unknown
  misc_feature (1)..( 11): Result.004 file - promoters50/1032668
tctcgaagttc

SEQ ID NO: 163733 - DNA, 11 bp, Unknown
  misc_feature (1)..( 11): Result.004 file - promoters50/1032668
tttttaaaaga

SEQ ID NO: 163734 - DNA, 11 bp, Unknown
  misc_feature (1)..( 11): Result.004 file - promoters50/1032668
attttaataaa

SEQ ID NO: 163735 - DNA, 11 bp, Unknown
  misc_feature (1)..( 11): Result.004 file - promoters50/1032668
tttttaaaaca

SEQ ID NO: 163736 - DNA, 12 bp, Unknown
  misc_feature (1)..( 12): Result.004 file - promoters50/1032668
tttattaacaaa

SEQ ID NO: 163737 - DNA, 12 bp, Unknown
  misc_feature (1)..( 12): Result.004 file - promoters50/1032668
tcgtttgatata

SEQ ID NO: 163738 - DNA, 12 bp, Unknown
  misc_feature (1)..( 12): Result.004 file - promoters50/1032668
ggttgtgatata

SEQ ID NO: 163739 - DNA, 12 bp, Unknown
  misc_feature (1)..( 12): Result.004 file - promoters50/1032668
tcttttaatatg

SEQ ID NO: 163740 - DNA, 15 bp, Unknown
  misc_feature (1)..( 15): Result.004 file - promoters50/1032668
cgaatattaagaaag

SEQ ID NO: 163741 - DNA, 15 bp, Unknown
  misc_feature (1)..( 15): Result.004 file - promoters50/1032668
cgaaaatttagactt

SEQ ID NO: 163742 - DNA, 15 bp, Unknown
  misc_feature (1)..( 15): Result.004 file - promoters50/1032668
ggataattgagagca

SEQ ID NO: 163743 - DNA, 15 bp, Unknown
  misc_feature (1)..( 15): Result.004 file - promoters50/1032668
aaaaaaatgatagca

SEQ ID NO: 163744 - DNA, 15 bp, Unknown
  misc_feature (1)..( 15): Result.004 file - promoters50/1032668
taaaactttagtcca

SEQ ID NO: 163745 - DNA, 15 bp, Unknown
  misc_feature (1)..( 15): Result.004 file - promoters50/1032676
attcgatttagtcat

SEQ ID NO: 163746 - DNA, 10 bp, Unknown
  misc_feature (1)..( 10): Result.004 file - promoters50/1032676
agatattact

SEQ ID NO: 163747 - DNA, 10 bp, Unknown
  misc_feature (1)..( 10): Result.004 file - promoters50/1032676
cgatattaat

SEQ ID NO: 163748 - DNA, 10 bp, Unknown
  misc_feature (1)..( 10): Result.004 file - promoters50/1032676
agacattttt

SEQ ID NO: 163749 - DNA, 10 bp, Unknown
  misc_feature (1)..( 10): Result.004 file - promoters50/1032676
tgatattatt

SEQ ID NO: 163750 - DNA, 10 bp, Unknown
  misc_feature (1)..( 10): Result.004 file - promoters50/1032676
taataataac

SEQ ID NO: 163751 - DNA, 10 bp, Unknown
  misc_feature (1)..( 10): Result.004 file - promoters50/1032676
cgttattaat

SEQ ID NO: 163752 - DNA, 10 bp, Unknown
  misc_feature (1)..( 10): Result.004 file - promoters50/1032676
tgatatggcc

SEQ ID NO: 163753 - DNA, 12 bp, Unknown
  misc_feature (1)..( 12): Result.004 file - promoters50/1032676
gtctgaacgaag

SEQ ID NO: 163754 - DNA, 12 bp, Unknown
  misc_feature (1)..( 12): Result.004 file - promoters50/1032676
aaaagaaagaaa

SEQ ID NO: 163755 - DNA, 12 bp, Unknown
  misc_feature (1)..( 12): Result.004 file - promoters50/1032676
aaaaaaaagacc

SEQ ID NO: 163756 - DNA, 12 bp, Unknown
  misc_feature (1)..( 12): Result.004 file - promoters50/1032676
gtaacaaaaaag

SEQ ID NO: 163757 - DNA, 12 bp, Unknown
  misc_feature (1)..( 12): Result.004 file - promoters50/1032676
cttcaaacaaaa

SEQ ID NO: 163758 - DNA, 12 bp, Unknown
  misc_feature (1)..( 12): Result.004 file - promoters50/1032676
acccgagaaatc

SEQ ID NO: 163759 - DNA, 12 bp, Unknown
  misc_feature (1)..( 12): Result.004 file - promoters50/1032676
tttcaaaaatac

SEQ ID NO: 163760 - DNA, 12 bp, Unknown
  misc_feature (1)..( 12): Result.004 file - promoters50/1032676
agtcaaaagtga

SEQ ID NO: 163761 - DNA, 13 bp, Unknown
  misc_feature (1)..( 13): Result.004 file - promoters50/1032676
ttactaatagatt

SEQ ID NO: 163762 - DNA, 13 bp, Unknown
  misc_feature (1)..( 13): Result.004 file - promoters50/1032676
ttattaataaatt

SEQ ID NO: 163763 - DNA, 13 bp, Unknown
  misc_feature (1)..( 13): Result.004 file - promoters50/1032676
atattaatcattg

SEQ ID NO: 163764 - DNA, 13 bp, Unknown
  misc_feature (1)..( 13): Result.004 file - promoters50/1032676
tttttaacaaaag

SEQ ID NO: 163765 - DNA, 13 bp, Unknown
  misc_feature (1)..( 13): Result.004 file - promoters50/1032676
agagcaacaaaag

SEQ ID NO: 163766 - DNA, 13 bp, Unknown
  misc_feature (1)..( 13): Result.004 file - promoters50/1032678
gtaataataactc

SEQ ID NO: 163767 - DNA, 9 bp, Unknown
  misc_feature (1)..( 9): Result.004 file - promoters50/1032678
gaaaaagag

SEQ ID NO: 163768 - DNA, 9 bp, Unknown
  misc_feature (1)..( 9): Result.004 file - promoters50/1032678
gaaaaacct

SEQ ID NO: 163769 - DNA, 9 bp, Unknown
  misc_feature (1)..( 9): Result.004 file - promoters50/1032698
taaaatcct

SEQ ID NO: 163770 - DNA, 10 bp, Unknown
  misc_feature (1)..( 10): Result.004 file - promoters50/1032698
tattttttgg

SEQ ID NO: 163771 - DNA, 10 bp, Unknown
  misc_feature (1)..( 10): Result.004 file - promoters50/1032698
acttttttaa

SEQ ID NO: 163772 - DNA, 10 bp, Unknown
  misc_feature (1)..( 10): Result.004 file - promoters50/1032698
tatatttaat

SEQ ID NO: 163773 - DNA, 10 bp, Unknown
  misc_feature (1)..( 10): Result.004 file - promoters50/1032698
tatttttcta

SEQ ID NO: 163774 - DNA, 10 bp, Unknown
  misc_feature (1)..( 10): Result.004 file - promoters50/1032698
aattttacta

SEQ ID NO: 163775 - DNA, 10 bp, Unknown
  misc_feature (1)..( 10): Result.004 file - promoters50/1032698
gaatttataa

SEQ ID NO: 163776 - DNA, 10 bp, Unknown
  misc_feature (1)..( 10): Result.004 file - promoters50/1032698
tcttttttcg

SEQ ID NO: 163777 - DNA, 10 bp, Unknown
  misc_feature (1)..( 10): Result.004 file - promoters50/1032698
ctaaatgata

SEQ ID NO: 163778 - DNA, 10 bp, Unknown
  misc_feature (1)..( 10): Result.004 file - promoters50/1032698
aaaaaagatt

SEQ ID NO: 163779 - DNA, 10 bp, Unknown
  misc_feature (1)..( 10): Result.004 file - promoters50/1032698
aaaaataata

SEQ ID NO: 163780 - DNA, 11 bp, Unknown
  misc_feature (1)..( 11): Result.004 file - promoters50/1032698
aaaaatagata

SEQ ID NO: 163781 - DNA, 11 bp, Unknown
  misc_feature (1)..( 11): Result.004 file - promoters50/1032698
taaaatattcg

SEQ ID NO: 163782 - DNA, 11 bp, Unknown
  misc_feature (1)..( 11): Result.004 file - promoters50/1032698
aaaaattaaaa

SEQ ID NO: 163783 - DNA, 14 bp, Unknown
  misc_feature (1)..( 14): Result.004 file - promoters50/1032698
ttttgaacttatga

SEQ ID NO: 163784 - DNA, 14 bp, Unknown
  misc_feature (1)..( 14): Result.004 file - promoters50/1032698
taatgaatttataa

SEQ ID NO: 163785 - DNA, 9 bp, Unknown
  misc_feature (1)..( 9): Result.004 file - promoters50/1032698
aacttagca

SEQ ID NO: 163786 - DNA, 14 bp, Unknown
  misc_feature (1)..( 14): Result.004 file - promoters50/1032698
tcttgaattgccct

SEQ ID NO: 163787 - DNA, 14 bp, Unknown
  misc_feature (1)..( 14): Result.004 file - promoters50/1032698
tttttaaagttcca

SEQ ID NO: 163788 - DNA, 8 bp, Unknown
  misc_feature (1)..( 8): Result.004 file - promoters50/1032698
tctttttt

SEQ ID NO: 163789 - DNA, 16 bp, Unknown
  misc_feature (1)..( 16): Result.004 file - promoters50/1032698
aatttaatttcttcac

SEQ ID NO: 163790 - DNA, 16 bp, Unknown
  misc_feature (1)..( 16): Result.004 file - promoters50/1032698
accttattttatgaaa

SEQ ID NO: 163791 - DNA, 16 bp, Unknown
  misc_feature (1)..( 16): Result.004 file - promoters50/1032698
aacctaattctctaac

SEQ ID NO: 163792 - DNA, 16 bp, Unknown
  misc_feature (1)..( 16): Result.004 file - promoters50/1032698
aatttatattataaaa

SEQ ID NO: 163793 - DNA, 16 bp, Unknown
  misc_feature (1)..( 16): Result.004 file - promoters50/1032698
tatatatactatgtat

SEQ ID NO: 163794 - DNA, 16 bp, Unknown
  misc_feature (1)..( 16): Result.004 file - promoters50/1032698
tctctatttttagtta

SEQ ID NO: 163795 - DNA, 16 bp, Unknown
  misc_feature (1)..( 16): Result.004 file - promoters50/1032698
caactaatttgtcaga

SEQ ID NO: 163796 - DNA, 11 bp, Unknown
  misc_feature (1)..( 11): Result.004 file - promoters50/1032698
tatctgaaaaa

SEQ ID NO: 163797 - DNA, 11 bp, Unknown
  misc_feature (1)..( 11): Result.004 file - promoters50/1032698
aatcagaaatt

SEQ ID NO: 163798 - DNA, 11 bp, Unknown
  misc_feature (1)..( 11): Result.004 file - promoters50/1032698
aatcataaaaa

SEQ ID NO: 163799 - DNA, 11 bp, Unknown
  misc_feature (1)..( 11): Result.004 file - promoters50/1032698
tataaaaaaaa

SEQ ID NO: 163800 - DNA, 11 bp, Unknown
  misc_feature (1)..( 11): Result.004 file - promoters50/1032698
aatacaaatat

SEQ ID NO: 163801 - DNA, 11 bp, Unknown
  misc_feature (1)..( 11): Result.004 file - promoters50/1032698
accaagaaatt

SEQ ID NO: 163802 - DNA, 8 bp, Unknown
  misc_feature (1)..( 8): Result.004 file - promoters50/1032698
ctttcaaa

SEQ ID NO: 163803 - DNA, 8 bp, Unknown
  misc_feature (1)..( 8): Result.004 file - promoters50/1032698
aattcaaa

SEQ ID NO: 163804 - DNA, 8 bp, Unknown
  misc_feature (1)..( 8): Result.004 file - promoters50/1032698
aatacaaa

SEQ ID NO: 163805 - DNA, 8 bp, Unknown
  misc_feature (1)..( 8): Result.004 file - promoters50/1032698
tatataaa

SEQ ID NO: 163806 - DNA, 8 bp, Unknown
  misc_feature (1)..( 8): Result.004 file - promoters50/1032698
aattaaaa

SEQ ID NO: 163807 - DNA, 8 bp, Unknown
  misc_feature (1)..( 8): Result.004 file - promoters50/1032698
aataaaaa

SEQ ID NO: 163808 - DNA, 13 bp, Unknown
  misc_feature (1)..( 13): Result.004 file - promoters50/1032698
cataaaaaaagat

SEQ ID NO: 163809 - DNA, 13 bp, Unknown
  misc_feature (1)..( 13): Result.004 file - promoters50/1032698
aatacaaatatag

SEQ ID NO: 163810 - DNA, 13 bp, Unknown
  misc_feature (1)..( 13): Result.004 file - promoters50/1032698
tataaaaccaaga

SEQ ID NO: 163811 - DNA, 14 bp, Unknown
  misc_feature (1)..( 14): Result.004 file - promoters50/1032698
aatcagaaattaga

SEQ ID NO: 163812 - DNA, 14 bp, Unknown
  misc_feature (1)..( 14): Result.004 file - promoters50/1032698
tgacaaaaatagat

SEQ ID NO: 163813 - DNA, 14 bp, Unknown
  misc_feature (1)..( 14): Result.004 file - promoters50/1032698
aattcaaaccttcg

SEQ ID NO: 163814 - DNA, 17 bp, Unknown
  misc_feature (1)..( 17): Result.004 file - promoters50/1032698
tttataatataaataat

SEQ ID NO: 163815 - DNA, 17 bp, Unknown
  misc_feature (1)..( 17): Result.004 file - promoters50/1032698
atacaaatataggcgcc

SEQ ID NO: 163816 - DNA, 17 bp, Unknown
  misc_feature (1)..( 17): Result.004 file - promoters50/1032698
tatccaataaaaataat

SEQ ID NO: 163817 - DNA, 17 bp, Unknown
  misc_feature (1)..( 17): Result.004 file - promoters50/1032698
ttttctatataaaaaaa

SEQ ID NO: 163818 - DNA, 17 bp, Unknown
  misc_feature (1)..( 17): Result.004 file - promoters50/1032698
attaaaatatatttaat

SEQ ID NO: 163819 - DNA, 17 bp, Unknown
  misc_feature (1)..( 17): Result.004 file - promoters50/1032713
attaaaatattcgaaat

SEQ ID NO: 163820 - DNA, 9 bp, Unknown
  misc_feature (1)..( 9): Result.004 file - promoters50/1032713
aaacgccaa

SEQ ID NO: 163821 - DNA, 9 bp, Unknown
  misc_feature (1)..( 9): Result.004 file - promoters50/1032713
aaaagccat

SEQ ID NO: 163822 - DNA, 9 bp, Unknown
  misc_feature (1)..( 9): Result.004 file - promoters50/1032713
acacggcaa

SEQ ID NO: 163823 - DNA, 9 bp, Unknown
  misc_feature (1)..( 9): Result.004 file - promoters50/1032713
taaatccat

SEQ ID NO: 163824 - DNA, 7 bp, Unknown
  misc_feature (1)..( 7): Result.004 file - promoters50/1032713
caaaata

SEQ ID NO: 163825 - DNA, 7 bp, Unknown
  misc_feature (1)..( 7): Result.004 file - promoters50/1032713
caaaata

SEQ ID NO: 163826 - DNA, 7 bp, Unknown
  misc_feature (1)..( 7): Result.004 file - promoters50/1032713
caacata

SEQ ID NO: 163827 - DNA, 10 bp, Unknown
  misc_feature (1)..( 10): Result.004 file - promoters50/1032713
attacttact

SEQ ID NO: 163828 - DNA, 10 bp, Unknown
  misc_feature (1)..( 10): Result.004 file - promoters50/1032713
attgcttata

SEQ ID NO: 163829 - DNA, 10 bp, Unknown
  misc_feature (1)..( 10): Result.004 file - promoters50/1032713
tgtactaact

SEQ ID NO: 163830 - DNA, 9 bp, Unknown
  misc_feature (1)..( 9): Result.004 file - promoters50/1032713
attgaaaca

SEQ ID NO: 163831 - DNA, 9 bp, Unknown
  misc_feature (1)..( 9): Result.004 file - promoters50/1032713
tttgaaaca

SEQ ID NO: 163832 - DNA, 9 bp, Unknown
  misc_feature (1)..( 9): Result.004 file - promoters50/1032730
tttcaaaac

SEQ ID NO: 163833 - DNA, 10 bp, Unknown
  misc_feature (1)..( 10): Result.004 file - promoters50/1032730
tataatttga

SEQ ID NO: 163834 - DNA, 10 bp, Unknown
  misc_feature (1)..( 10): Result.004 file - promoters50/1032730
gttaatttca

SEQ ID NO: 163835 - DNA, 10 bp, Unknown
  misc_feature (1)..( 10): Result.004 file - promoters50/1032730
aattatttta

SEQ ID NO: 163836 - DNA, 10 bp, Unknown
  misc_feature (1)..( 10): Result.004 file - promoters50/1032730
gattatactg

SEQ ID NO: 163837 - DNA, 10 bp, Unknown
  misc_feature (1)..( 10): Result.004 file - promoters50/1032730
gttaattact

SEQ ID NO: 163838 - DNA, 10 bp, Unknown
  misc_feature (1)..( 10): Result.004 file - promoters50/1032730
ccaaatttca

SEQ ID NO: 163839 - DNA, 11 bp, Unknown
  misc_feature (1)..( 11): Result.004 file - promoters50/1032730
aattattttgc

SEQ ID NO: 163840 - DNA, 11 bp, Unknown
  misc_feature (1)..( 11): Result.004 file - promoters50/1032730
aatgatttaat

SEQ ID NO: 163841 - DNA, 11 bp, Unknown
  misc_feature (1)..( 11): Result.004 file - promoters50/1032730
aattatataaa

SEQ ID NO: 163842 - DNA, 12 bp, Unknown
  misc_feature (1)..( 12): Result.004 file - promoters50/1032730
atttagtttcta

SEQ ID NO: 163843 - DNA, 12 bp, Unknown
  misc_feature (1)..( 12): Result.004 file - promoters50/1032730
tgtggatttata

SEQ ID NO: 163844 - DNA, 12 bp, Unknown
  misc_feature (1)..( 12): Result.004 file - promoters50/1032752
caatcctttagt

SEQ ID NO: 163845 - DNA, 9 bp, Unknown
  misc_feature (1)..( 9): Result.004 file - promoters50/1032752
gatttatac

SEQ ID NO: 163846 - DNA, 9 bp, Unknown
  misc_feature (1)..( 9): Result.004 file - promoters50/1032752
aatttattc

SEQ ID NO: 163847 - DNA, 9 bp, Unknown
  misc_feature (1)..( 9): Result.004 file - promoters50/1032752
catttatca

SEQ ID NO: 163848 - DNA, 9 bp, Unknown
  misc_feature (1)..( 9): Result.004 file - promoters50/1032752
aatatatta

SEQ ID NO: 163849 - DNA, 9 bp, Unknown
  misc_feature (1)..( 9): Result.004 file - promoters50/1032752
tatgtatat

SEQ ID NO: 163850 - DNA, 11 bp, Unknown
  misc_feature (1)..( 11): Result.004 file - promoters50/1032752
acagtatgaga

SEQ ID NO: 163851 - DNA, 11 bp, Unknown
  misc_feature (1)..( 11): Result.004 file - promoters50/1032752
catttatcaga

SEQ ID NO: 163852 - DNA, 11 bp, Unknown
  misc_feature (1)..( 11): Result.004 file - promoters50/1032752
cattaatcatt

SEQ ID NO: 163853 - DNA, 11 bp, Unknown
  misc_feature (1)..( 11): Result.004 file - promoters50/1032752
catgaatatat

SEQ ID NO: 163854 - DNA, 11 bp, Unknown
  misc_feature (1)..( 11): Result.004 file - promoters50/1032752
tatgtatatct

SEQ ID NO: 163855 - DNA, 12 bp, Unknown
  misc_feature (1)..( 12): Result.004 file - promoters50/1032752
aaaaatttattc

SEQ ID NO: 163856 - DNA, 12 bp, Unknown
  misc_feature (1)..( 12): Result.004 file - promoters50/1032752
aaaaatggctat

SEQ ID NO: 163857 - DNA, 13 bp, Unknown
  misc_feature (1)..( 13): Result.004 file - promoters50/1032752
aaacaatacctta

SEQ ID NO: 163858 - DNA, 13 bp, Unknown
  misc_feature (1)..( 13): Result.004 file - promoters50/1032752
gaacaatatagca

SEQ ID NO: 163859 - DNA, 13 bp, Unknown
  misc_feature (1)..( 13): Result.004 file - promoters50/1032756
aaaaactaagaat

SEQ ID NO: 163860 - DNA, 9 bp, Unknown
  misc_feature (1)..( 9): Result.004 file - promoters50/1032756
tttattttt

SEQ ID NO: 163861 - DNA, 9 bp, Unknown
  misc_feature (1)..( 9): Result.004 file - promoters50/1032756
cttactttt

SEQ ID NO: 163862 - DNA, 9 bp, Unknown
  misc_feature (1)..( 9): Result.004 file - promoters50/1032756
tttattttc

SEQ ID NO: 163863 - DNA, 9 bp, Unknown
  misc_feature (1)..( 9): Result.004 file - promoters50/1032756
ttaactttt

SEQ ID NO: 163864 - DNA, 11 bp, Unknown
  misc_feature (1)..( 11): Result.004 file - promoters50/1032756
caacatttcga

SEQ ID NO: 163865 - DNA, 11 bp, Unknown
  misc_feature (1)..( 11): Result.004 file - promoters50/1032756
caatatttaat

SEQ ID NO: 163866 - DNA, 11 bp, Unknown
  misc_feature (1)..( 11): Result.004 file - promoters50/1032756
tcatatttgta

SEQ ID NO: 163867 - DNA, 11 bp, Unknown
  misc_feature (1)..( 11): Result.004 file - promoters50/1032756
cagtatctaat

SEQ ID NO: 163868 - DNA, 14 bp, Unknown
  misc_feature (1)..( 14): Result.004 file - promoters50/1032756
tcgataattcatta

SEQ ID NO: 163869 - DNA, 14 bp, Unknown
  misc_feature (1)..( 14): Result.004 file - promoters50/1032756
tcgaaaattaattc

SEQ ID NO: 163870 - DNA, 14 bp, Unknown
  misc_feature (1)..( 14): Result.004 file - promoters50/1032756
tttgtaattaatta

SEQ ID NO: 163871 - DNA, 11 bp, Unknown
  misc_feature (1)..( 11): Result.004 file - promoters50/1032756
ttttcttatta

SEQ ID NO: 163872 - DNA, 11 bp, Unknown
  misc_feature (1)..( 11): Result.004 file - promoters50/1032756
ttttcatattt

SEQ ID NO: 163873 - DNA, 11 bp, Unknown
  misc_feature (1)..( 11): Result.004 file - promoters50/1032756
atccaatattt

SEQ ID NO: 163874 - DNA, 11 bp, Unknown
  misc_feature (1)..( 11): Result.004 file - promoters50/1032756
gtatctaatgg

SEQ ID NO: 163875 - DNA, 10 bp, Unknown
  misc_feature (1)..( 10): Result.004 file - promoters50/1032756
tttggaactt

SEQ ID NO: 163876 - DNA, 10 bp, Unknown
  misc_feature (1)..( 10): Result.004 file - promoters50/1032756
tttgaaactt

SEQ ID NO: 163877 - DNA, 10 bp, Unknown
  misc_feature (1)..( 10): Result.004 file - promoters50/1032756
tttcaaatgg

SEQ ID NO: 163878 - DNA, 8 bp, Unknown
  misc_feature (1)..( 8): Result.004 file - promoters50/1032756
tttcattc

SEQ ID NO: 163879 - DNA, 8 bp, Unknown
  misc_feature (1)..( 8): Result.004 file - promoters50/1032756
ttttattt

SEQ ID NO: 163880 - DNA, 8 bp, Unknown
  misc_feature (1)..( 8): Result.004 file - promoters50/1032788
atttatat

SEQ ID NO: 163881 - DNA, 8 bp, Unknown
  misc_feature (1)..( 8): Result.004 file - promoters50/1032788
ttacaaac

SEQ ID NO: 163882 - DNA, 8 bp, Unknown
  misc_feature (1)..( 8): Result.004 file - promoters50/1032788
ctacaaat

SEQ ID NO: 163883 - DNA, 8 bp, Unknown
  misc_feature (1)..( 8): Result.004 file - promoters50/1032788
ttataaaa

SEQ ID NO: 163884 - DNA, 8 bp, Unknown
  misc_feature (1)..( 8): Result.004 file - promoters50/1032788
ttagaaaa

SEQ ID NO: 163885 - DNA, 8 bp, Unknown
  misc_feature (1)..( 8): Result.004 file - promoters50/1032788
aaataaaa

SEQ ID NO: 163886 - DNA, 8 bp, Unknown
  misc_feature (1)..( 8): Result.004 file - promoters50/1032788
atatcaaa

SEQ ID NO: 163887 - DNA, 8 bp, Unknown
  misc_feature (1)..( 8): Result.004 file - promoters50/1032788
caagaaaa

SEQ ID NO: 163888 - DNA, 10 bp, Unknown
  misc_feature (1)..( 10): Result.004 file - promoters50/1032788
ttcaaataat

SEQ ID NO: 163889 - DNA, 10 bp, Unknown
  misc_feature (1)..( 10): Result.004 file - promoters50/1032788
gacaaataaa

SEQ ID NO: 163890 - DNA, 10 bp, Unknown
  misc_feature (1)..( 10): Result.004 file - promoters50/1032788
tttaaaaaaa

SEQ ID NO: 163891 - DNA, 10 bp, Unknown
  misc_feature (1)..( 10): Result.004 file - promoters50/1032788
tacaaaaaaa

SEQ ID NO: 163892 - DNA, 10 bp, Unknown
  misc_feature (1)..( 10): Result.004 file - promoters50/1032788
tgcaaaaaac

SEQ ID NO: 163893 - DNA, 10 bp, Unknown
  misc_feature (1)..( 10): Result.004 file - promoters50/1032788
tacaaaacta

SEQ ID NO: 163894 - DNA, 11 bp, Unknown
  misc_feature (1)..( 11): Result.004 file - promoters50/1032788
aaaacaattct

SEQ ID NO: 163895 - DNA, 11 bp, Unknown
  misc_feature (1)..( 11): Result.004 file - promoters50/1032788
gaaaaaatagt

SEQ ID NO: 163896 - DNA, 11 bp, Unknown
  misc_feature (1)..( 11): Result.004 file - promoters50/1032788
aaaacaaacgt

SEQ ID NO: 163897 - DNA, 11 bp, Unknown
  misc_feature (1)..( 11): Result.004 file - promoters50/1032788
aagaaaatata

SEQ ID NO: 163898 - DNA, 11 bp, Unknown
  misc_feature (1)..( 11): Result.004 file - promoters50/1032788
taaaaaatatt

SEQ ID NO: 163899 - DNA, 11 bp, Unknown
  misc_feature (1)..( 11): Result.004 file - promoters50/1032788
taatatatatt

SEQ ID NO: 163900 - DNA, 13 bp, Unknown
  misc_feature (1)..( 13): Result.004 file - promoters50/1032788
tacatttttttca

SEQ ID NO: 163901 - DNA, 13 bp, Unknown
  misc_feature (1)..( 13): Result.004 file - promoters50/1032788
ataattattttgc

SEQ ID NO: 163902 - DNA, 13 bp, Unknown
  misc_feature (1)..( 13): Result.004 file - promoters50/1032788
ctttttatttctt

SEQ ID NO: 163903 - DNA, 13 bp, Unknown
  misc_feature (1)..( 13): Result.004 file - promoters50/1032788
ttatttatttact

SEQ ID NO: 163904 - DNA, 13 bp, Unknown
  misc_feature (1)..( 13): Result.004 file - promoters50/1032788
catattattagta

SEQ ID NO: 163905 - DNA, 13 bp, Unknown
  misc_feature (1)..( 13): Result.004 file - promoters50/1032788
ccatatatgtctg

SEQ ID NO: 163906 - DNA, 13 bp, Unknown
  misc_feature (1)..( 13): Result.004 file - promoters50/1032788
tcacttatatctt

SEQ ID NO: 163907 - DNA, 11 bp, Unknown
  misc_feature (1)..( 11): Result.004 file - promoters50/1032788
tttgaaaaaac

SEQ ID NO: 163908 - DNA, 11 bp, Unknown
  misc_feature (1)..( 11): Result.004 file - promoters50/1032788
ttagaaaaatg

SEQ ID NO: 163909 - DNA, 11 bp, Unknown
  misc_feature (1)..( 11): Result.004 file - promoters50/1032788
aacgaaaaata

SEQ ID NO: 163910 - DNA, 11 bp, Unknown
  misc_feature (1)..( 11): Result.004 file - promoters50/1032788
aattaaacata

SEQ ID NO: 163911 - DNA, 11 bp, Unknown
  misc_feature (1)..( 11): Result.004 file - promoters50/1032788
ttataaaatac

SEQ ID NO: 163912 - DNA, 11 bp, Unknown
  misc_feature (1)..( 11): Result.004 file - promoters50/1032788
atatcaaacaa

SEQ ID NO: 163913 - DNA, 11 bp, Unknown
  misc_feature (1)..( 11): Result.004 file - promoters50/1032788
caagaaaacga

SEQ ID NO: 163914 - DNA, 11 bp, Unknown
  misc_feature (1)..( 11): Result.004 file - promoters50/1032788
ttatttattta

SEQ ID NO: 163915 - DNA, 11 bp, Unknown
  misc_feature (1)..( 11): Result.004 file - promoters50/1032788
acttttgtttc

SEQ ID NO: 163916 - DNA, 11 bp, Unknown
  misc_feature (1)..( 11): Result.004 file - promoters50/1032788
atgtttgttta

SEQ ID NO: 163917 - DNA, 11 bp, Unknown
  misc_feature (1)..( 11): Result.004 file - promoters50/1032788
ttatttcttta

SEQ ID NO: 163918 - DNA, 11 bp, Unknown
  misc_feature (1)..( 11): Result.004 file - promoters50/1032788
atatatgtctg

SEQ ID NO: 163919 - DNA, 11 bp, Unknown
  misc_feature (1)..( 11): Result.004 file - promoters50/1032788
ttatatcttat

SEQ ID NO: 163920 - DNA, 12 bp, Unknown
  misc_feature (1)..( 12): Result.004 file - promoters50/1032788
atttaagtctag

SEQ ID NO: 163921 - DNA, 12 bp, Unknown
  misc_feature (1)..( 12): Result.004 file - promoters50/1032788
gaacaagtctct

SEQ ID NO: 163922 - DNA, 12 bp, Unknown
  misc_feature (1)..( 12): Result.004 file - promoters50/1032788
ccttgagtttag

SEQ ID NO: 163923 - DNA, 12 bp, Unknown
  misc_feature (1)..( 12): Result.004 file - promoters50/1032788
taacaattctaa

SEQ ID NO: 163924 - DNA, 12 bp, Unknown
  misc_feature (1)..( 12): Result.004 file - promoters50/1032788
acacaattaact

SEQ ID NO: 163925 - DNA, 12 bp, Unknown
  misc_feature (1)..( 12): Result.004 file - promoters50/1032788
ttagaatactaa

SEQ ID NO: 163926 - DNA, 12 bp, Unknown
  misc_feature (1)..( 12): Result.004 file - promoters50/1032788
taaaaattaaat

SEQ ID NO: 163927 - DNA, 16 bp, Unknown
  misc_feature (1)..( 16): Result.004 file - promoters50/1032788
aaaaaatttaattaac

SEQ ID NO: 163928 - DNA, 16 bp, Unknown
  misc_feature (1)..( 16): Result.004 file - promoters50/1032788
ttcctattttatttta

SEQ ID NO: 163929 - DNA, 16 bp, Unknown
  misc_feature (1)..( 16): Result.004 file - promoters50/1032788
tccaaaattaaaatca

SEQ ID NO: 163930 - DNA, 16 bp, Unknown
  misc_feature (1)..( 16): Result.004 file - promoters50/1032788
accaatgtttatttaa

SEQ ID NO: 163931 - DNA, 16 bp, Unknown
  misc_feature (1)..( 16): Result.004 file - promoters50/1032788
aacaacatttatgaaa

SEQ ID NO: 163932 - DNA, 16 bp, Unknown
  misc_feature (1)..( 16): Result.004 file - promoters50/1032788
aacaatattgcagtca

SEQ ID NO: 163933 - DNA, 10 bp, Unknown
  misc_feature (1)..( 10): Result.004 file - promoters50/1032788
tatgtatata

SEQ ID NO: 163934 - DNA, 10 bp, Unknown
  misc_feature (1)..( 10): Result.004 file - promoters50/1032788
tatatatata

SEQ ID NO: 163935 - DNA, 10 bp, Unknown
  misc_feature (1)..( 10): Result.004 file - promoters50/1032788
tatatatttg

SEQ ID NO: 163936 - DNA, 10 bp, Unknown
  misc_feature (1)..( 10): Result.004 file - promoters50/1032788
aataaatttt

SEQ ID NO: 163937 - DNA, 10 bp, Unknown
  misc_feature (1)..( 10): Result.004 file - promoters50/1032788
taaaaaaaga

SEQ ID NO: 163938 - DNA, 10 bp, Unknown
  misc_feature (1)..( 10): Result.004 file - promoters50/1032788
aaaacaaacg

SEQ ID NO: 163939 - DNA, 13 bp, Unknown
  misc_feature (1)..( 13): Result.004 file - promoters50/1032788
ttaataatatata

SEQ ID NO: 163940 - DNA, 13 bp, Unknown
  misc_feature (1)..( 13): Result.004 file - promoters50/1032788
aagaaaatataca

SEQ ID NO: 163941 - DNA, 13 bp, Unknown
  misc_feature (1)..( 13): Result.004 file - promoters50/1032788
agcgtcatattat

SEQ ID NO: 163942 - DNA, 13 bp, Unknown
  misc_feature (1)..( 13): Result.004 file - promoters50/1032788
tagttaatatata

SEQ ID NO: 163943 - DNA, 13 bp, Unknown
  misc_feature (1)..( 13): Result.004 file - promoters50/1032788
taaaaaatattat

SEQ ID NO: 163944 - DNA, 13 bp, Unknown
  misc_feature (1)..( 13): Result.004 file - promoters50/1032788
aagaaaaaatagt

SEQ ID NO: 163945 - DNA, 9 bp, Unknown
  misc_feature (1)..( 9): Result.004 file - promoters50/1032788
tatatatta

SEQ ID NO: 163946 - DNA, 9 bp, Unknown
  misc_feature (1)..( 9): Result.004 file - promoters50/1032788
gtcatatta

SEQ ID NO: 163947 - DNA, 9 bp, Unknown
  misc_feature (1)..( 9): Result.004 file - promoters50/1032788
tatatattt

SEQ ID NO: 163948 - DNA, 9 bp, Unknown
  misc_feature (1)..( 9): Result.004 file - promoters50/1032788
aataaattt

SEQ ID NO: 163949 - DNA, 10 bp, Unknown
  misc_feature (1)..( 10): Result.004 file - promoters50/1032788
gatataatta

SEQ ID NO: 163950 - DNA, 10 bp, Unknown
  misc_feature (1)..( 10): Result.004 file - promoters50/1032815
aaaataaact

SEQ ID NO: 163951 - DNA, 10 bp, Unknown
  misc_feature (1)..( 10): Result.004 file - promoters50/1032815
gaagattcta

SEQ ID NO: 163952 - DNA, 10 bp, Unknown
  misc_feature (1)..( 10): Result.004 file - promoters50/1032815
gaagtttcta

SEQ ID NO: 163953 - DNA, 10 bp, Unknown
  misc_feature (1)..( 10): Result.004 file - promoters50/1032844
tcagtttcat

SEQ ID NO: 163954 - DNA, 13 bp, Unknown
  misc_feature (1)..( 13): Result.004 file - promoters50/1032844
gctataatttcat

SEQ ID NO: 163955 - DNA, 13 bp, Unknown
  misc_feature (1)..( 13): Result.004 file - promoters50/1032844
atgtgaatatcat

SEQ ID NO: 163956 - DNA, 13 bp, Unknown
  misc_feature (1)..( 13): Result.004 file - promoters50/1032844
attctaattttct

SEQ ID NO: 163957 - DNA, 13 bp, Unknown
  misc_feature (1)..( 13): Result.004 file - promoters50/1032844
gctataatttcat

SEQ ID NO: 163958 - DNA, 13 bp, Unknown
  misc_feature (1)..( 13): Result.004 file - promoters50/1032884
atcctaatcgggt

SEQ ID NO: 163959 - DNA, 9 bp, Unknown
  misc_feature (1)..( 9): Result.004 file - promoters50/1032884
acatgcgaa

SEQ ID NO: 163960 - DNA, 9 bp, Unknown
  misc_feature (1)..( 9): Result.004 file - promoters50/1032884
agatgagaa

SEQ ID NO: 163961 - DNA, 9 bp, Unknown
  misc_feature (1)..( 9): Result.004 file - promoters50/1032884
agacgagaa

SEQ ID NO: 163962 - DNA, 9 bp, Unknown
  misc_feature (1)..( 9): Result.004 file - promoters50/1032884
ataattatc

SEQ ID NO: 163963 - DNA, 9 bp, Unknown
  misc_feature (1)..( 9): Result.004 file - promoters50/1032884
ataataatc

SEQ ID NO: 163964 - DNA, 9 bp, Unknown
  misc_feature (1)..( 9): Result.004 file - promoters50/1032884
gcaataatt

SEQ ID NO: 163965 - DNA, 8 bp, Unknown
  misc_feature (1)..( 8): Result.004 file - promoters50/1032884
agattatg

SEQ ID NO: 163966 - DNA, 8 bp, Unknown
  misc_feature (1)..( 8): Result.004 file - promoters50/1032884
gtattatg

SEQ ID NO: 163967 - DNA, 8 bp, Unknown
  misc_feature (1)..( 8): Result.004 file - promoters50/1032884
gtagtata

SEQ ID NO: 163968 - DNA, 11 bp, Unknown
  misc_feature (1)..( 11): Result.004 file - promoters50/1032884
aacagaagatg

SEQ ID NO: 163969 - DNA, 11 bp, Unknown
  misc_feature (1)..( 11): Result.004 file - promoters50/1032884
tgaagaagatg

SEQ ID NO: 163970 - DNA, 11 bp, Unknown
  misc_feature (1)..( 11): Result.004 file - promoters50/1032884
tgatgaagaag

SEQ ID NO: 163971 - DNA, 9 bp, Unknown
  misc_feature (1)..( 9): Result.004 file - promoters50/1032884
gatctctct

SEQ ID NO: 163972 - DNA, 9 bp, Unknown
  misc_feature (1)..( 9): Result.004 file - promoters50/1032884
gatctcttc

SEQ ID NO: 163973 - DNA, 9 bp, Unknown
  misc_feature (1)..( 9): Result.004 file - promoters50/1032884
actctttct

SEQ ID NO: 163974 - DNA, 11 bp, Unknown
  misc_feature (1)..( 11): Result.004 file - promoters50/1032884
taggcttttta

SEQ ID NO: 163975 - DNA, 11 bp, Unknown
  misc_feature (1)..( 11): Result.004 file - promoters50/1032884
tacacttttta

SEQ ID NO: 163976 - DNA, 11 bp, Unknown
  misc_feature (1)..( 11): Result.004 file - promoters50/1032884
tacactctttc

SEQ ID NO: 163977 - DNA, 8 bp, Unknown
  misc_feature (1)..( 8): Result.004 file - promoters50/1032884
aagtaatt

SEQ ID NO: 163978 - DNA, 8 bp, Unknown
  misc_feature (1)..( 8): Result.004 file - promoters50/1032884
atgtaatt

SEQ ID NO: 163979 - DNA, 8 bp, Unknown
  misc_feature (1)..( 8): Result.004 file - promoters50/1032897
atgtgatt

SEQ ID NO: 163980 - DNA, 9 bp, Unknown
  misc_feature (1)..( 9): Result.004 file - promoters50/1032897
agaaaaagg

SEQ ID NO: 163981 - DNA, 9 bp, Unknown
  misc_feature (1)..( 9): Result.004 file - promoters50/1032897
gaaaatagg

SEQ ID NO: 163982 - DNA, 9 bp, Unknown
  misc_feature (1)..( 9): Result.004 file - promoters50/1032897
ggaagaaga

SEQ ID NO: 163983 - DNA, 9 bp, Unknown
  misc_feature (1)..( 9): Result.004 file - promoters50/1032897
gaaaataga

SEQ ID NO: 163984 - DNA, 9 bp, Unknown
  misc_feature (1)..( 9): Result.004 file - promoters50/1032897
agtaataga

SEQ ID NO: 163985 - DNA, 9 bp, Unknown
  misc_feature (1)..( 9): Result.004 file - promoters50/1032897
gataagaga

SEQ ID NO: 163986 - DNA, 11 bp, Unknown
  misc_feature (1)..( 11): Result.004 file - promoters50/1032897
gtatctcttta

SEQ ID NO: 163987 - DNA, 11 bp, Unknown
  misc_feature (1)..( 11): Result.004 file - promoters50/1032897
gtatctcaaaa

SEQ ID NO: 163988 - DNA, 11 bp, Unknown
  misc_feature (1)..( 11): Result.004 file - promoters50/1032897
ttatttcttgg

SEQ ID NO: 163989 - DNA, 11 bp, Unknown
  misc_feature (1)..( 11): Result.004 file - promoters50/1032897
ttattttttaa

SEQ ID NO: 163990 - DNA, 12 bp, Unknown
  misc_feature (1)..( 12): Result.004 file - promoters50/1032897
ttacttttatta

SEQ ID NO: 163991 - DNA, 12 bp, Unknown
  misc_feature (1)..( 12): Result.004 file - promoters50/1032929
tttttttcttgg

SEQ ID NO: 163992 - DNA, 8 bp, Unknown
  misc_feature (1)..( 8): Result.004 file - promoters50/1032929
ataattat

SEQ ID NO: 163993 - DNA, 8 bp, Unknown
  misc_feature (1)..( 8): Result.004 file - promoters50/1032929
ataattga

SEQ ID NO: 163994 - DNA, 8 bp, Unknown
  misc_feature (1)..( 8): Result.004 file - promoters50/1032940
atatttat

SEQ ID NO: 163995 - DNA, 12 bp, Unknown
  misc_feature (1)..( 12): Result.004 file - promoters50/1032940
tagaatctttga

SEQ ID NO: 163996 - DNA, 12 bp, Unknown
  misc_feature (1)..( 12): Result.004 file - promoters50/1032940
attaatgtttga

SEQ ID NO: 163997 - DNA, 12 bp, Unknown
  misc_feature (1)..( 12): Result.004 file - promoters50/1032940
gtaaatgtttct

SEQ ID NO: 163998 - DNA, 12 bp, Unknown
  misc_feature (1)..( 12): Result.004 file - promoters50/1032940
ttttctgtttgg

SEQ ID NO: 163999 - DNA, 12 bp, Unknown
  misc_feature (1)..( 12): Result.004 file - promoters50/1032940
catgctgtttct

SEQ ID NO: 164000 - DNA, 12 bp, Unknown
  misc_feature (1)..( 12): Result.004 file - promoters50/1032940
ttttctcttttc

SEQ ID NO: 164001 - DNA, 8 bp, Unknown
  misc_feature (1)..( 8): Result.004 file - promoters50/1032940
gaaacttt

SEQ ID NO: 164002 - DNA, 8 bp, Unknown
  misc_feature (1)..( 8): Result.004 file - promoters50/1032940
taaagttt

SEQ ID NO: 164003 - DNA, 8 bp, Unknown
  misc_feature (1)..( 8): Result.004 file - promoters50/1032940
caaaattt

SEQ ID NO: 164004 - DNA, 8 bp, Unknown
  misc_feature (1)..( 8): Result.004 file - promoters50/1032940
taacgttt

SEQ ID NO: 164005 - DNA, 8 bp, Unknown
  misc_feature (1)..( 8): Result.004 file - promoters50/1032940
caaaattt

SEQ ID NO: 164006 - DNA, 8 bp, Unknown
  misc_feature (1)..( 8): Result.004 file - promoters50/1032940
caaatttt

SEQ ID NO: 164007 - DNA, 8 bp, Unknown
  misc_feature (1)..( 8): Result.004 file - promoters50/1032940
gaaaattc

SEQ ID NO: 164008 - DNA, 10 bp, Unknown
  misc_feature (1)..( 10): Result.004 file - promoters50/1032940
ttataaattt

SEQ ID NO: 164009 - DNA, 10 bp, Unknown
  misc_feature (1)..( 10): Result.004 file - promoters50/1032940
ttcaaaattt

SEQ ID NO: 164010 - DNA, 10 bp, Unknown
  misc_feature (1)..( 10): Result.004 file - promoters50/1032940
tccaaaattt

SEQ ID NO: 164011 - DNA, 10 bp, Unknown
  misc_feature (1)..( 10): Result.004 file - promoters50/1032940
aaacaaattt

SEQ ID NO: 164012 - DNA, 10 bp, Unknown
  misc_feature (1)..( 10): Result.004 file - promoters50/1032940
ttcgaaattg

SEQ ID NO: 164013 - DNA, 10 bp, Unknown
  misc_feature (1)..( 10): Result.004 file - promoters50/1032940
gagaaaattc

SEQ ID NO: 164014 - DNA, 10 bp, Unknown
  misc_feature (1)..( 10): Result.004 file - promoters50/1032940
atataataaa

SEQ ID NO: 164015 - DNA, 10 bp, Unknown
  misc_feature (1)..( 10): Result.004 file - promoters50/1032940
atataatata

SEQ ID NO: 164016 - DNA, 11 bp, Unknown
  misc_feature (1)..( 11): Result.004 file - promoters50/1032940
atactaaaagc

SEQ ID NO: 164017 - DNA, 11 bp, Unknown
  misc_feature (1)..( 11): Result.004 file - promoters50/1032940
cacacaatata

SEQ ID NO: 164018 - DNA, 11 bp, Unknown
  misc_feature (1)..( 11): Result.004 file - promoters50/1032940
cttccaatatc

SEQ ID NO: 164019 - DNA, 11 bp, Unknown
  misc_feature (1)..( 11): Result.004 file - promoters50/1032996
aacccaataaa

SEQ ID NO: 164020 - DNA, 7 bp, Unknown
  misc_feature (1)..( 7): Result.004 file - promoters50/1032996
attttaa

SEQ ID NO: 164021 - DNA, 7 bp, Unknown
  misc_feature (1)..( 7): Result.004 file - promoters50/1032996
attataa

SEQ ID NO: 164022 - DNA, 7 bp, Unknown
  misc_feature (1)..( 7): Result.004 file - promoters50/1032996
attttat

SEQ ID NO: 164023 - DNA, 12 bp, Unknown
  misc_feature (1)..( 12): Result.004 file - promoters50/1032996
tatataataatg

SEQ ID NO: 164024 - DNA, 12 bp, Unknown
  misc_feature (1)..( 12): Result.004 file - promoters50/1032996
tatatcatattt

SEQ ID NO: 164025 - DNA, 12 bp, Unknown
  misc_feature (1)..( 12): Result.004 file - promoters50/1032996
tagttcatgttt

SEQ ID NO: 164026 - DNA, 9 bp, Unknown
  misc_feature (1)..( 9): Result.004 file - promoters50/1032996
ctctattta

SEQ ID NO: 164027 - DNA, 9 bp, Unknown
  misc_feature (1)..( 9): Result.004 file - promoters50/1032996
tcatattta

SEQ ID NO: 164028 - DNA, 9 bp, Unknown
  misc_feature (1)..( 9): Result.004 file - promoters50/1033013
tcatgtttt

SEQ ID NO: 164029 - DNA, 10 bp, Unknown
  misc_feature (1)..( 10): Result.004 file - promoters50/1033013
agaaaattga

SEQ ID NO: 164030 - DNA, 10 bp, Unknown
  misc_feature (1)..( 10): Result.004 file - promoters50/1033013
agagaatctt

SEQ ID NO: 164031 - DNA, 10 bp, Unknown
  misc_feature (1)..( 10): Result.004 file - promoters50/1033013
agaaatttga

SEQ ID NO: 164032 - DNA, 10 bp, Unknown
  misc_feature (1)..( 10): Result.004 file - promoters50/1033013
agagtctagt

SEQ ID NO: 164033 - DNA, 11 bp, Unknown
  misc_feature (1)..( 11): Result.004 file - promoters50/1033013
ttttagaacat

SEQ ID NO: 164034 - DNA, 11 bp, Unknown
  misc_feature (1)..( 11): Result.004 file - promoters50/1033013
tttgagaaaag

SEQ ID NO: 164035 - DNA, 11 bp, Unknown
  misc_feature (1)..( 11): Result.004 file - promoters50/1033013
ttttagggggg

SEQ ID NO: 164036 - DNA, 11 bp, Unknown
  misc_feature (1)..( 11): Result.004 file - promoters50/1033176
gtagagataag

SEQ ID NO: 164037 - DNA, 6 bp, Unknown
  misc_feature (1)..( 6): Result.004 file - promoters50/1033176
aacaag

SEQ ID NO: 164038 - DNA, 6 bp, Unknown
  misc_feature (1)..( 6): Result.004 file - promoters50/1033176
aacaag

SEQ ID NO: 164039 - DNA, 6 bp, Unknown
  misc_feature (1)..( 6): Result.004 file - promoters50/1033176
aacaag

SEQ ID NO: 164040 - DNA, 6 bp, Unknown
  misc_feature (1)..( 6): Result.004 file - promoters50/1033176
ttaaaa

SEQ ID NO: 164041 - DNA, 6 bp, Unknown
  misc_feature (1)..( 6): Result.004 file - promoters50/1033176
ttaaaa

SEQ ID NO: 164042 - DNA, 6 bp, Unknown
  misc_feature (1)..( 6): Result.004 file - promoters50/1033176
ttaaaa

SEQ ID NO: 164043 - DNA, 9 bp, Unknown
  misc_feature (1)..( 9): Result.004 file - promoters50/1033176
ctaatttat

SEQ ID NO: 164044 - DNA, 9 bp, Unknown
  misc_feature (1)..( 9): Result.004 file - promoters50/1033176
ataatttaa

SEQ ID NO: 164045 - DNA, 9 bp, Unknown
  misc_feature (1)..( 9): Result.004 file - promoters50/1033176
tagatttat

SEQ ID NO: 164046 - DNA, 9 bp, Unknown
  misc_feature (1)..( 9): Result.004 file - promoters50/1033176
ataattaaa

SEQ ID NO: 164047 - DNA, 17 bp, Unknown
  misc_feature (1)..( 17): Result.004 file - promoters50/1033176
gaatgtaatcagtgcca

SEQ ID NO: 164048 - DNA, 17 bp, Unknown
  misc_feature (1)..( 17): Result.004 file - promoters50/1033176
aaatcatctcaatgcca

SEQ ID NO: 164049 - DNA, 17 bp, Unknown
  misc_feature (1)..( 17): Result.004 file - promoters50/1033176
aaatcatctcaatgcca

SEQ ID NO: 164050 - DNA, 7 bp, Unknown
  misc_feature (1)..( 7): Result.004 file - promoters50/1033176
tttctca

SEQ ID NO: 164051 - DNA, 7 bp, Unknown
  misc_feature (1)..( 7): Result.004 file - promoters50/1033176
tttctca

SEQ ID NO: 164052 - DNA, 7 bp, Unknown
  misc_feature (1)..( 7): Result.004 file - promoters50/1033176
tttctca

SEQ ID NO: 164053 - DNA, 7 bp, Unknown
  misc_feature (1)..( 7): Result.004 file - promoters50/1033176
cgtttga

SEQ ID NO: 164054 - DNA, 7 bp, Unknown
  misc_feature (1)..( 7): Result.004 file - promoters50/1033176
cgtctga

SEQ ID NO: 164055 - DNA, 7 bp, Unknown
  misc_feature (1)..( 7): Result.004 file - promoters50/1033176
cgtttga

SEQ ID NO: 164056 - DNA, 8 bp, Unknown
  misc_feature (1)..( 8): Result.004 file - promoters50/1033176
aattaagc

SEQ ID NO: 164057 - DNA, 8 bp, Unknown
  misc_feature (1)..( 8): Result.004 file - promoters50/1033176
cattaagc

SEQ ID NO: 164058 - DNA, 8 bp, Unknown
  misc_feature (1)..( 8): Result.004 file - promoters50/1033176
aattaaaa

SEQ ID NO: 164059 - DNA, 10 bp, Unknown
  misc_feature (1)..( 10): Result.004 file - promoters50/1033176
tgatgaagaa

SEQ ID NO: 164060 - DNA, 10 bp, Unknown
  misc_feature (1)..( 10): Result.004 file - promoters50/1033176
gattgatgaa

SEQ ID NO: 164061 - DNA, 10 bp, Unknown
  misc_feature (1)..( 10): Result.004 file - promoters50/1033184
gatcgatgaa

SEQ ID NO: 164062 - DNA, 14 bp, Unknown
  misc_feature (1)..( 14): Result.004 file - promoters50/1033184
aaatatatgcttgc

SEQ ID NO: 164063 - DNA, 14 bp, Unknown
  misc_feature (1)..( 14): Result.004 file - promoters50/1033184
ctatatataaacat

SEQ ID NO: 164064 - DNA, 14 bp, Unknown
  misc_feature (1)..( 14): Result.004 file - promoters50/1033184
taatttattttcca

SEQ ID NO: 164065 - DNA, 14 bp, Unknown
  misc_feature (1)..( 14): Result.004 file - promoters50/1033184
aaagataataaagc

SEQ ID NO: 164066 - DNA, 14 bp, Unknown
  misc_feature (1)..( 14): Result.004 file - promoters50/1033184
tgattaatttctct

SEQ ID NO: 164067 - DNA, 14 bp, Unknown
  misc_feature (1)..( 14): Result.004 file - promoters50/1033184
agatttatttgatt

SEQ ID NO: 164068 - DNA, 14 bp, Unknown
  misc_feature (1)..( 14): Result.004 file - promoters50/1033184
ggattaatgtctct

SEQ ID NO: 164069 - DNA, 12 bp, Unknown
  misc_feature (1)..( 12): Result.004 file - promoters50/1033184
caaaaaaaatta

SEQ ID NO: 164070 - DNA, 12 bp, Unknown
  misc_feature (1)..( 12): Result.004 file - promoters50/1033184
taaaataaattg

SEQ ID NO: 164071 - DNA, 12 bp, Unknown
  misc_feature (1)..( 12): Result.004 file - promoters50/1033184
ctcaaaacattg

SEQ ID NO: 164072 - DNA, 12 bp, Unknown
  misc_feature (1)..( 12): Result.004 file - promoters50/1033184
caaaaatactta

SEQ ID NO: 164073 - DNA, 12 bp, Unknown
  misc_feature (1)..( 12): Result.004 file - promoters50/1033184
atgtaaaaatta

SEQ ID NO: 164074 - DNA, 12 bp, Unknown
  misc_feature (1)..( 12): Result.004 file - promoters50/1033184
gtgaattaatta

SEQ ID NO: 164075 - DNA, 11 bp, Unknown
  misc_feature (1)..( 11): Result.004 file - promoters50/1033184
tttgttaaaag

SEQ ID NO: 164076 - DNA, 11 bp, Unknown
  misc_feature (1)..( 11): Result.004 file - promoters50/1033184
tttcttaaaaa

SEQ ID NO: 164077 - DNA, 11 bp, Unknown
  misc_feature (1)..( 11): Result.004 file - promoters50/1033184
aatgtgaaatg

SEQ ID NO: 164078 - DNA, 11 bp, Unknown
  misc_feature (1)..( 11): Result.004 file - promoters50/1033184
tttgttagttc

SEQ ID NO: 164079 - DNA, 11 bp, Unknown
  misc_feature (1)..( 11): Result.004 file - promoters50/1033184
atatataaaaa

SEQ ID NO: 164080 - DNA, 11 bp, Unknown
  misc_feature (1)..( 11): Result.004 file - promoters50/1033184
ttagataaaat

SEQ ID NO: 164081 - DNA, 11 bp, Unknown
  misc_feature (1)..( 11): Result.004 file - promoters50/1033184
atctataaaaa

SEQ ID NO: 164082 - DNA, 10 bp, Unknown
  misc_feature (1)..( 10): Result.004 file - promoters50/1033184
tttaacttac

SEQ ID NO: 164083 - DNA, 10 bp, Unknown
  misc_feature (1)..( 10): Result.004 file - promoters50/1033184
gttaactttg

SEQ ID NO: 164084 - DNA, 10 bp, Unknown
  misc_feature (1)..( 10): Result.004 file - promoters50/1033184
tttaaatttt

SEQ ID NO: 164085 - DNA, 10 bp, Unknown
  misc_feature (1)..( 10): Result.004 file - promoters50/1033184
tgtaaatttt

SEQ ID NO: 164086 - DNA, 10 bp, Unknown
  misc_feature (1)..( 10): Result.004 file - promoters50/1033184
attaaaatgt

SEQ ID NO: 164087 - DNA, 10 bp, Unknown
  misc_feature (1)..( 10): Result.004 file - promoters50/1033194
attaaagttt

SEQ ID NO: 164088 - DNA, 7 bp, Unknown
  misc_feature (1)..( 7): Result.004 file - promoters50/1033194
aaaatgt

SEQ ID NO: 164089 - DNA, 7 bp, Unknown
  misc_feature (1)..( 7): Result.004 file - promoters50/1033194
aaactgt

SEQ ID NO: 164090 - DNA, 7 bp, Unknown
  misc_feature (1)..( 7): Result.004 file - promoters50/1033217
caaatgt

SEQ ID NO: 164091 - DNA, 9 bp, Unknown
  misc_feature (1)..( 9): Result.004 file - promoters50/1033217
tgagtattc

SEQ ID NO: 164092 - DNA, 9 bp, Unknown
  misc_feature (1)..( 9): Result.004 file - promoters50/1033217
tgattattt

SEQ ID NO: 164093 - DNA, 9 bp, Unknown
  misc_feature (1)..( 9): Result.004 file - promoters50/1033262
tatttattt

SEQ ID NO: 164094 - DNA, 10 bp, Unknown
  misc_feature (1)..( 10): Result.004 file - promoters50/1033262
tgatctgcgg

SEQ ID NO: 164095 - DNA, 10 bp, Unknown
  misc_feature (1)..( 10): Result.004 file - promoters50/1033262
tgatttgcaa

SEQ ID NO: 164096 - DNA, 10 bp, Unknown
  misc_feature (1)..( 10): Result.004 file - promoters50/1033262
tgacttgtct

SEQ ID NO: 164097 - DNA, 10 bp, Unknown
  misc_feature (1)..( 10): Result.004 file - promoters50/1033262
ttttttccaa

SEQ ID NO: 164098 - DNA, 10 bp, Unknown
  misc_feature (1)..( 10): Result.004 file - promoters50/1033262
ggagttcact

SEQ ID NO: 164099 - DNA, 10 bp, Unknown
  misc_feature (1)..( 10): Result.004 file - promoters50/1033340
caacttgttt

SEQ ID NO: 164100 - DNA, 9 bp, Unknown
  misc_feature (1)..( 9): Result.004 file - promoters50/1033340
tgataaaca

SEQ ID NO: 164101 - DNA, 9 bp, Unknown
  misc_feature (1)..( 9): Result.004 file - promoters50/1033340
tgatcaaca

SEQ ID NO: 164102 - DNA, 9 bp, Unknown
  misc_feature (1)..( 9): Result.004 file - promoters50/1033340
tgatcattt

SEQ ID NO: 164103 - DNA, 7 bp, Unknown
  misc_feature (1)..( 7): Result.004 file - promoters50/1033340
atctttt

SEQ ID NO: 164104 - DNA, 7 bp, Unknown
  misc_feature (1)..( 7): Result.004 file - promoters50/1033340
ttctttt

SEQ ID NO: 164105 - DNA, 7 bp, Unknown
  misc_feature (1)..( 7): Result.004 file - promoters50/1033360
atcattt

SEQ ID NO: 164106 - DNA, 8 bp, Unknown
  misc_feature (1)..( 8): Result.004 file - promoters50/1033360
gttgattt

SEQ ID NO: 164107 - DNA, 8 bp, Unknown
  misc_feature (1)..( 8): Result.004 file - promoters50/1033360
agtgattt

SEQ ID NO: 164108 - DNA, 8 bp, Unknown
  misc_feature (1)..( 8): Result.004 file - promoters50/1033360
gtttattc

SEQ ID NO: 164109 - DNA, 8 bp, Unknown
  misc_feature (1)..( 8): Result.004 file - promoters50/1033360
attggttt

SEQ ID NO: 164110 - DNA, 8 bp, Unknown
  misc_feature (1)..( 8): Result.004 file - promoters50/1033360
gaggatta

SEQ ID NO: 164111 - DNA, 8 bp, Unknown
  misc_feature (1)..( 8): Result.004 file - promoters50/1033408
atttgttt

SEQ ID NO: 164112 - DNA, 10 bp, Unknown
  misc_feature (1)..( 10): Result.004 file - promoters50/1033408
aatagaaaca

SEQ ID NO: 164113 - DNA, 10 bp, Unknown
  misc_feature (1)..( 10): Result.004 file - promoters50/1033408
aattgaactt

SEQ ID NO: 164114 - DNA, 10 bp, Unknown
  misc_feature (1)..( 10): Result.004 file - promoters50/1033408
ctttgaactt

SEQ ID NO: 164115 - DNA, 8 bp, Unknown
  misc_feature (1)..( 8): Result.004 file - promoters50/1033408
aatagaaa

SEQ ID NO: 164116 - DNA, 8 bp, Unknown
  misc_feature (1)..( 8): Result.004 file - promoters50/1033408
tatataaa

SEQ ID NO: 164117 - DNA, 8 bp, Unknown
  misc_feature (1)..( 8): Result.004 file - promoters50/1033430
tatttaac

SEQ ID NO: 164118 - DNA, 14 bp, Unknown
  misc_feature (1)..( 14): Result.004 file - promoters50/1033430
attggatcaacaat

SEQ ID NO: 164119 - DNA, 14 bp, Unknown
  misc_feature (1)..( 14): Result.004 file - promoters50/1033430
cttgaatcaatatt

SEQ ID NO: 164120 - DNA, 14 bp, Unknown
  misc_feature (1)..( 14): Result.004 file - promoters50/1033430
attcgatagaaaca

SEQ ID NO: 164121 - DNA, 14 bp, Unknown
  misc_feature (1)..( 14): Result.004 file - promoters50/1033430
gtgagatcaagttt

SEQ ID NO: 164122 - DNA, 14 bp, Unknown
  misc_feature (1)..( 14): Result.004 file - promoters50/1033430
attgattcaaaatt

SEQ ID NO: 164123 - DNA, 14 bp, Unknown
  misc_feature (1)..( 14): Result.004 file - promoters50/1033430
tccgattcaattcc

SEQ ID NO: 164124 - DNA, 14 bp, Unknown
  misc_feature (1)..( 14): Result.004 file - promoters50/1033540
atgcattccaaagt

SEQ ID NO: 164125 - DNA, 7 bp, Unknown
  misc_feature (1)..( 7): Result.004 file - promoters50/1033540
ttatttt

SEQ ID NO: 164126 - DNA, 7 bp, Unknown
  misc_feature (1)..( 7): Result.004 file - promoters50/1033540
ttatttg

SEQ ID NO: 164127 - DNA, 7 bp, Unknown
  misc_feature (1)..( 7): Result.004 file - promoters50/1033540
atatttt

SEQ ID NO: 164128 - DNA, 10 bp, Unknown
  misc_feature (1)..( 10): Result.004 file - promoters50/1033540
acaaaattat

SEQ ID NO: 164129 - DNA, 10 bp, Unknown
  misc_feature (1)..( 10): Result.004 file - promoters50/1033540
acataattat

SEQ ID NO: 164130 - DNA, 10 bp, Unknown
  misc_feature (1)..( 10): Result.004 file - promoters50/1033540
atgaaattag

SEQ ID NO: 164131 - DNA, 7 bp, Unknown
  misc_feature (1)..( 7): Result.004 file - promoters50/1033540
cttttcc

SEQ ID NO: 164132 - DNA, 7 bp, Unknown
  misc_feature (1)..( 7): Result.004 file - promoters50/1033540
tttttcc

SEQ ID NO: 164133 - DNA, 7 bp, Unknown
  misc_feature (1)..( 7): Result.004 file - promoters50/1033540
cttttca

SEQ ID NO: 164134 - DNA, 12 bp, Unknown
  misc_feature (1)..( 12): Result.004 file - promoters50/1033540
tccaacacctga

SEQ ID NO: 164135 - DNA, 12 bp, Unknown
  misc_feature (1)..( 12): Result.004 file - promoters50/1033540
cacaacacgtga

SEQ ID NO: 164136 - DNA, 12 bp, Unknown
  misc_feature (1)..( 12): Result.004 file - promoters50/1033596
cacgacagtcaa

SEQ ID NO: 164137 - DNA, 9 bp, Unknown
  misc_feature (1)..( 9): Result.004 file - promoters50/1033596
tgaatctgc

SEQ ID NO: 164138 - DNA, 9 bp, Unknown
  misc_feature (1)..( 9): Result.004 file - promoters50/1033596
aatatctgc

SEQ ID NO: 164139 - DNA, 9 bp, Unknown
  misc_feature (1)..( 9): Result.004 file - promoters50/1033679
tgaatctga

SEQ ID NO: 164140 - DNA, 12 bp, Unknown
  misc_feature (1)..( 12): Result.004 file - promoters50/1033679
gagagttgtatg

SEQ ID NO: 164141 - DNA, 12 bp, Unknown
  misc_feature (1)..( 12): Result.004 file - promoters50/1033679
tcttgttgtaat

SEQ ID NO: 164142 - DNA, 12 bp, Unknown
  misc_feature (1)..( 12): Result.004 file - promoters50/1033679
tcttcttgtctt

SEQ ID NO: 164143 - DNA, 12 bp, Unknown
  misc_feature (1)..( 12): Result.004 file - promoters50/1033679
ttcatttggaat

SEQ ID NO: 164144 - DNA, 12 bp, Unknown
  misc_feature (1)..( 12): Result.004 file - promoters50/1033679
ctttcttcacta

SEQ ID NO: 164145 - DNA, 12 bp, Unknown
  misc_feature (1)..( 12): Result.004 file - promoters50/1033679
ctttcttgtttc

SEQ ID NO: 164146 - DNA, 16 bp, Unknown
  misc_feature (1)..( 16): Result.004 file - promoters50/1033679
gcatatagtaaaaata

SEQ ID NO: 164147 - DNA, 16 bp, Unknown
  misc_feature (1)..( 16): Result.004 file - promoters50/1033679
ttcttacgtaaaaatt

SEQ ID NO: 164148 - DNA, 16 bp, Unknown
  misc_feature (1)..( 16): Result.004 file - promoters50/1033679
aactgggaccaaaata

SEQ ID NO: 164149 - DNA, 16 bp, Unknown
  misc_feature (1)..( 16): Result.004 file - promoters50/1033679
gcatttagtaaaccgt

SEQ ID NO: 164150 - DNA, 16 bp, Unknown
  misc_feature (1)..( 16): Result.004 file - promoters50/1033679
acataccgtagaccag

SEQ ID NO: 164151 - DNA, 16 bp, Unknown
  misc_feature (1)..( 16): Result.004 file - promoters50/1033716
ttccaagtgaaatatt

SEQ ID NO: 164152 - DNA, 10 bp, Unknown
  misc_feature (1)..( 10): Result.004 file - promoters50/1033716
gagattcttt

SEQ ID NO: 164153 - DNA, 10 bp, Unknown
  misc_feature (1)..( 10): Result.004 file - promoters50/1033716
aagattctag

SEQ ID NO: 164154 - DNA, 10 bp, Unknown
  misc_feature (1)..( 10): Result.004 file - promoters50/1033716
aggattctta

SEQ ID NO: 164155 - DNA, 10 bp, Unknown
  misc_feature (1)..( 10): Result.004 file - promoters50/1033716
aagattttag

SEQ ID NO: 164156 - DNA, 10 bp, Unknown
  misc_feature (1)..( 10): Result.004 file - promoters50/1033716
aaaattatag

SEQ ID NO: 164157 - DNA, 10 bp, Unknown
  misc_feature (1)..( 10): Result.004 file - promoters50/1033723
tatattataa

SEQ ID NO: 164158 - DNA, 8 bp, Unknown
  misc_feature (1)..( 8): Result.004 file - promoters50/1033723
atgatgaa

SEQ ID NO: 164159 - DNA, 8 bp, Unknown
  misc_feature (1)..( 8): Result.004 file - promoters50/1033723
ctgaagaa

SEQ ID NO: 164160 - DNA, 8 bp, Unknown
  misc_feature (1)..( 8): Result.004 file - promoters50/1033781
atgaagag

SEQ ID NO: 164161 - DNA, 11 bp, Unknown
  misc_feature (1)..( 11): Result.004 file - promoters50/1033781
tcttattatcg

SEQ ID NO: 164162 - DNA, 11 bp, Unknown
  misc_feature (1)..( 11): Result.004 file - promoters50/1033781
tcttattaggt

SEQ ID NO: 164163 - DNA, 11 bp, Unknown
  misc_feature (1)..( 11): Result.004 file - promoters50/1033781
agttattaatg

SEQ ID NO: 164164 - DNA, 12 bp, Unknown
  misc_feature (1)..( 12): Result.004 file - promoters50/1033781
atttacttaatc

SEQ ID NO: 164165 - DNA, 12 bp, Unknown
  misc_feature (1)..( 12): Result.004 file - promoters50/1033781
ctatcatccatg

SEQ ID NO: 164166 - DNA, 12 bp, Unknown
  misc_feature (1)..( 12): Result.004 file - promoters50/1033781
gattactaacac

SEQ ID NO: 164167 - DNA, 9 bp, Unknown
  misc_feature (1)..( 9): Result.004 file - promoters50/1033781
gtggaattg

SEQ ID NO: 164168 - DNA, 9 bp, Unknown
  misc_feature (1)..( 9): Result.004 file - promoters50/1033781
catgaattg

SEQ ID NO: 164169 - DNA, 9 bp, Unknown
  misc_feature (1)..( 9): Result.004 file - promoters50/1033781
gaagaattg

SEQ ID NO: 164170 - DNA, 9 bp, Unknown
  misc_feature (1)..( 9): Result.004 file - promoters50/1033781
catgtattt

SEQ ID NO: 164171 - DNA, 9 bp, Unknown
  misc_feature (1)..( 9): Result.004 file - promoters50/1033781
tatgatttg

SEQ ID NO: 164172 - DNA, 9 bp, Unknown
  misc_feature (1)..( 9): Result.004 file - promoters50/1033781
cctgaattt

SEQ ID NO: 164173 - DNA, 9 bp, Unknown
  misc_feature (1)..( 9): Result.004 file - promoters50/1033781
tataattta

SEQ ID NO: 164174 - DNA, 11 bp, Unknown
  misc_feature (1)..( 11): Result.004 file - promoters50/1033781
aacaaacaaat

SEQ ID NO: 164175 - DNA, 11 bp, Unknown
  misc_feature (1)..( 11): Result.004 file - promoters50/1033781
aagaaacgaat

SEQ ID NO: 164176 - DNA, 11 bp, Unknown
  misc_feature (1)..( 11): Result.004 file - promoters50/1033781
ttccaacaaat

SEQ ID NO: 164177 - DNA, 11 bp, Unknown
  misc_feature (1)..( 11): Result.004 file - promoters50/1033781
tagaaatgaaa

SEQ ID NO: 164178 - DNA, 11 bp, Unknown
  misc_feature (1)..( 11): Result.004 file - promoters50/1033781
tcgaaacgaca

SEQ ID NO: 164179 - DNA, 11 bp, Unknown
  misc_feature (1)..( 11): Result.004 file - promoters50/1033781
tagatatgata

SEQ ID NO: 164180 - DNA, 10 bp, Unknown
  misc_feature (1)..( 10): Result.004 file - promoters50/1033781
aataacaaac

SEQ ID NO: 164181 - DNA, 10 bp, Unknown
  misc_feature (1)..( 10): Result.004 file - promoters50/1033781
tttaaaaaat

SEQ ID NO: 164182 - DNA, 10 bp, Unknown
  misc_feature (1)..( 10): Result.004 file - promoters50/1033781
aatatcaaag

SEQ ID NO: 164183 - DNA, 10 bp, Unknown
  misc_feature (1)..( 10): Result.004 file - promoters50/1033781
aagaaaaaaa

SEQ ID NO: 164184 - DNA, 11 bp, Unknown
  misc_feature (1)..( 11): Result.004 file - promoters50/1033781
tctaaaataat

SEQ ID NO: 164185 - DNA, 11 bp, Unknown
  misc_feature (1)..( 11): Result.004 file - promoters50/1033837
aataaaaacag

SEQ ID NO: 164186 - DNA, 13 bp, Unknown
  misc_feature (1)..( 13): Result.004 file - promoters50/1033837
ttttattggtttt

SEQ ID NO: 164187 - DNA, 13 bp, Unknown
  misc_feature (1)..( 13): Result.004 file - promoters50/1033837
cattattgttttt

SEQ ID NO: 164188 - DNA, 13 bp, Unknown
  misc_feature (1)..( 13): Result.004 file - promoters50/1033837
gtttatgttggtc

SEQ ID NO: 164189 - DNA, 9 bp, Unknown
  misc_feature (1)..( 9): Result.004 file - promoters50/1033837
aaaaaaaaa

SEQ ID NO: 164190 - DNA, 9 bp, Unknown
  misc_feature (1)..( 9): Result.004 file - promoters50/1033837
aaataaaaa

SEQ ID NO: 164191 - DNA, 9 bp, Unknown
  misc_feature (1)..( 9): Result.004 file - promoters50/1033837
aaagatggg

SEQ ID NO: 164192 - DNA, 13 bp, Unknown
  misc_feature (1)..( 13): Result.004 file - promoters50/1033837
cattatgggacca

SEQ ID NO: 164193 - DNA, 13 bp, Unknown
  misc_feature (1)..( 13): Result.004 file - promoters50/1033837
cataatgggacca

SEQ ID NO: 164194 - DNA, 13 bp, Unknown
  misc_feature (1)..( 13): Result.004 file - promoters50/1033849
ttccatgggaaag

SEQ ID NO: 164195 - DNA, 7 bp, Unknown
  misc_feature (1)..( 7): Result.004 file - promoters50/1033849
gaaaaag

SEQ ID NO: 164196 - DNA, 7 bp, Unknown
  misc_feature (1)..( 7): Result.004 file - promoters50/1033849
caaaaag

SEQ ID NO: 164197 - DNA, 7 bp, Unknown
  misc_feature (1)..( 7): Result.004 file - promoters50/1033865
caaaaat

SEQ ID NO: 164198 - DNA, 11 bp, Unknown
  misc_feature (1)..( 11): Result.004 file - promoters50/1033865
tttttaaattt

SEQ ID NO: 164199 - DNA, 11 bp, Unknown
  misc_feature (1)..( 11): Result.004 file - promoters50/1033865
attttacattt

SEQ ID NO: 164200 - DNA, 11 bp, Unknown
  misc_feature (1)..( 11): Result.004 file - promoters50/1033865
tttttatatat

SEQ ID NO: 164201 - DNA, 11 bp, Unknown
  misc_feature (1)..( 11): Result.004 file - promoters50/1033865
tttttaaccgt

SEQ ID NO: 164202 - DNA, 11 bp, Unknown
  misc_feature (1)..( 11): Result.004 file - promoters50/1033865
ttttgacacaa

SEQ ID NO: 164203 - DNA, 11 bp, Unknown
  misc_feature (1)..( 11): Result.004 file - promoters50/1033865
cgtctacatta

SEQ ID NO: 164204 - DNA, 17 bp, Unknown
  misc_feature (1)..( 17): Result.004 file - promoters50/1033865
gatagaagcatatccaa

SEQ ID NO: 164205 - DNA, 17 bp, Unknown
  misc_feature (1)..( 17): Result.004 file - promoters50/1033865
taaaataaattatccaa

SEQ ID NO: 164206 - DNA, 17 bp, Unknown
  misc_feature (1)..( 17): Result.004 file - promoters50/1033865
agatacttcaaatccaa

SEQ ID NO: 164207 - DNA, 17 bp, Unknown
  misc_feature (1)..( 17): Result.004 file - promoters50/1033865
gagataaccttatccta

SEQ ID NO: 164208 - DNA, 17 bp, Unknown
  misc_feature (1)..( 17): Result.004 file - promoters50/1033865
gagatagccttatcttt

SEQ ID NO: 164209 - DNA, 17 bp, Unknown
  misc_feature (1)..( 17): Result.004 file - promoters50/1033869
cgtggacagatatagtt

SEQ ID NO: 164210 - DNA, 8 bp, Unknown
  misc_feature (1)..( 8): Result.004 file - promoters50/1033869
atctattt

SEQ ID NO: 164211 - DNA, 8 bp, Unknown
  misc_feature (1)..( 8): Result.004 file - promoters50/1033869
ttcttttt

SEQ ID NO: 164212 - DNA, 8 bp, Unknown
  misc_feature (1)..( 8): Result.004 file - promoters50/1034030
ttcttttg

SEQ ID NO: 164213 - DNA, 12 bp, Unknown
  misc_feature (1)..( 12): Result.004 file - promoters50/1034030
ttaaaaatcaaa

SEQ ID NO: 164214 - DNA, 12 bp, Unknown
  misc_feature (1)..( 12): Result.004 file - promoters50/1034030
gagaaagtcacg

SEQ ID NO: 164215 - DNA, 12 bp, Unknown
  misc_feature (1)..( 12): Result.004 file - promoters50/1034030
aaagaaaccaaa

SEQ ID NO: 164216 - DNA, 12 bp, Unknown
  misc_feature (1)..( 12): Result.004 file - promoters50/1034030
gaaaaaatggaa

SEQ ID NO: 164217 - DNA, 12 bp, Unknown
  misc_feature (1)..( 12): Result.004 file - promoters50/1034030
ccacaagcgtaa

SEQ ID NO: 164218 - DNA, 12 bp, Unknown
  misc_feature (1)..( 12): Result.004 file - promoters50/1034030
ccaaaataacgc

SEQ ID NO: 164219 - DNA, 10 bp, Unknown
  misc_feature (1)..( 10): Result.004 file - promoters50/1034030
tatagagttt

SEQ ID NO: 164220 - DNA, 10 bp, Unknown
  misc_feature (1)..( 10): Result.004 file - promoters50/1034030
ataagacttt

SEQ ID NO: 164221 - DNA, 10 bp, Unknown
  misc_feature (1)..( 10): Result.004 file - promoters50/1034030
tataaagtta

SEQ ID NO: 164222 - DNA, 10 bp, Unknown
  misc_feature (1)..( 10): Result.004 file - promoters50/1034030
aatagaaact

SEQ ID NO: 164223 - DNA, 10 bp, Unknown
  misc_feature (1)..( 10): Result.004 file - promoters50/1034030
tatagaatat

SEQ ID NO: 164224 - DNA, 10 bp, Unknown
  misc_feature (1)..( 10): Result.004 file - promoters50/1034066
cataaggttt

SEQ ID NO: 164225 - DNA, 8 bp, Unknown
  misc_feature (1)..( 8): Result.004 file - promoters50/1034066
ttacagag

SEQ ID NO: 164226 - DNA, 8 bp, Unknown
  misc_feature (1)..( 8): Result.004 file - promoters50/1034066
gaacagag

SEQ ID NO: 164227 - DNA, 8 bp, Unknown
  misc_feature (1)..( 8): Result.004 file - promoters50/1034066
gaagagag

SEQ ID NO: 164228 - DNA, 11 bp, Unknown
  misc_feature (1)..( 11): Result.004 file - promoters50/1034066
aatgtttgaat

SEQ ID NO: 164229 - DNA, 11 bp, Unknown
  misc_feature (1)..( 11): Result.004 file - promoters50/1034066
aatatttcctt

SEQ ID NO: 164230 - DNA, 11 bp, Unknown
  misc_feature (1)..( 11): Result.004 file - promoters50/1034066
tttgtttgaat

SEQ ID NO: 164231 - DNA, 7 bp, Unknown
  misc_feature (1)..( 7): Result.004 file - promoters50/1034066
taaaaaa

SEQ ID NO: 164232 - DNA, 7 bp, Unknown
  misc_feature (1)..( 7): Result.004 file - promoters50/1034066
taacaaa

SEQ ID NO: 164233 - DNA, 7 bp, Unknown
  misc_feature (1)..( 7): Result.004 file - promoters50/1034066
taaaaaa

SEQ ID NO: 164234 - DNA, 10 bp, Unknown
  misc_feature (1)..( 10): Result.004 file - promoters50/1034066
gcgagatgcg

SEQ ID NO: 164235 - DNA, 10 bp, Unknown
  misc_feature (1)..( 10): Result.004 file - promoters50/1034066
aagagttgcg

SEQ ID NO: 164236 - DNA, 10 bp, Unknown
  misc_feature (1)..( 10): Result.004 file - promoters50/1034066
aagagttctc

SEQ ID NO: 164237 - DNA, 15 bp, Unknown
  misc_feature (1)..( 15): Result.004 file - promoters50/1034066
aaaaaaaatccaaaa

SEQ ID NO: 164238 - DNA, 15 bp, Unknown
  misc_feature (1)..( 15): Result.004 file - promoters50/1034066
aaccaaactcccaaa

SEQ ID NO: 164239 - DNA, 15 bp, Unknown
  misc_feature (1)..( 15): Result.004 file - promoters50/1034066
aaccaaactcggtat

SEQ ID NO: 164240 - DNA, 8 bp, Unknown
  misc_feature (1)..( 8): Result.004 file - promoters50/1034066
tttataaa

SEQ ID NO: 164241 - DNA, 8 bp, Unknown
  misc_feature (1)..( 8): Result.004 file - promoters50/1034066
tttaaaaa

SEQ ID NO: 164242 - DNA, 8 bp, Unknown
  misc_feature (1)..( 8): Result.004 file - promoters50/1034137
tgtataaa

SEQ ID NO: 164243 - DNA, 29 bp, Unknown
  misc_feature (1)..( 29): Result.004 file - promoters50/1034137
aagctttaagtctatcgctagactgtcca

SEQ ID NO: 164244 - DNA, 29 bp, Unknown
  misc_feature (1)..( 29): Result.004 file - promoters50/1034137
agcttttaagtctctcgctagactgtcca

SEQ ID NO: 164245 - DNA, 29 bp, Unknown
  misc_feature (1)..( 29): Result.004 file - promoters50/1034137
atcatccaccgagatatcaagactgctaa

SEQ ID NO: 164246 - DNA, 29 bp, Unknown
  misc_feature (1)..( 29): Result.004 file - promoters50/1034137
agactaaaagtctaccacatttgtctgtt

SEQ ID NO: 164247 - DNA, 29 bp, Unknown
  misc_feature (1)..( 29): Result.004 file - promoters50/1034137
atggtttaagcacgttacctgtaacgtat

SEQ ID NO: 164248 - DNA, 29 bp, Unknown
  misc_feature (1)..( 29): Result.004 file - promoters50/1034145
agcatttaatgatgataacgatttggaag

SEQ ID NO: 164249 - DNA, 12 bp, Unknown
  misc_feature (1)..( 12): Result.004 file - promoters50/1034145
gataataagttc

SEQ ID NO: 164250 - DNA, 12 bp, Unknown
  misc_feature (1)..( 12): Result.004 file - promoters50/1034145
agtaaaaagtca

SEQ ID NO: 164251 - DNA, 12 bp, Unknown
  misc_feature (1)..( 12): Result.004 file - promoters50/1034145
cttaataagtgg

SEQ ID NO: 164252 - DNA, 12 bp, Unknown
  misc_feature (1)..( 12): Result.004 file - promoters50/1034145
ttcaataacttc

SEQ ID NO: 164253 - DNA, 12 bp, Unknown
  misc_feature (1)..( 12): Result.004 file - promoters50/1034188
gatgatatgatt

SEQ ID NO: 164254 - DNA, 9 bp, Unknown
  misc_feature (1)..( 9): Result.004 file - promoters50/1034188
gcccatttg

SEQ ID NO: 164255 - DNA, 9 bp, Unknown
  misc_feature (1)..( 9): Result.004 file - promoters50/1034188
gcccattta

SEQ ID NO: 164256 - DNA, 9 bp, Unknown
  misc_feature (1)..( 9): Result.004 file - promoters50/1034188
gttcattta

SEQ ID NO: 164257 - DNA, 7 bp, Unknown
  misc_feature (1)..( 7): Result.004 file - promoters50/1034188
atttttt

SEQ ID NO: 164258 - DNA, 7 bp, Unknown
  misc_feature (1)..( 7): Result.004 file - promoters50/1034188
atttttt

SEQ ID NO: 164259 - DNA, 7 bp, Unknown
  misc_feature (1)..( 7): Result.004 file - promoters50/1034212
atttttg

SEQ ID NO: 164260 - DNA, 7 bp, Unknown
  misc_feature (1)..( 7): Result.004 file - promoters50/1034212
aatataa

SEQ ID NO: 164261 - DNA, 7 bp, Unknown
  misc_feature (1)..( 7): Result.004 file - promoters50/1034212
aatatag

SEQ ID NO: 164262 - DNA, 7 bp, Unknown
  misc_feature (1)..( 7): Result.004 file - promoters50/1034306
aatttag

SEQ ID NO: 164263 - DNA, 11 bp, Unknown
  misc_feature (1)..( 11): Result.004 file - promoters50/1034306
gaaataaatta

SEQ ID NO: 164264 - DNA, 11 bp, Unknown
  misc_feature (1)..( 11): Result.004 file - promoters50/1034306
tgaataaattg

SEQ ID NO: 164265 - DNA, 12 bp, Unknown
  misc_feature (1)..( 12): Result.004 file - promoters50/1034306
tgaagtaaccgt

SEQ ID NO: 164266 - DNA, 12 bp, Unknown
  misc_feature (1)..( 12): Result.004 file - promoters50/1034306
tcaaataaacaa

SEQ ID NO: 164267 - DNA, 12 bp, Unknown
  misc_feature (1)..( 12): Result.004 file - promoters50/1034306
ataaataaattt

SEQ ID NO: 164268 - DNA, 12 bp, Unknown
  misc_feature (1)..( 12): Result.004 file - promoters50/1034306
atacatacatat

SEQ ID NO: 164269 - DNA, 12 bp, Unknown
  misc_feature (1)..( 12): Result.004 file - promoters50/1034306
aaaaatatataa

SEQ ID NO: 164270 - DNA, 10 bp, Unknown
  misc_feature (1)..( 10): Result.004 file - promoters50/1034306
gaagaaatta

SEQ ID NO: 164271 - DNA, 10 bp, Unknown
  misc_feature (1)..( 10): Result.004 file - promoters50/1034306
taagatattt

SEQ ID NO: 164272 - DNA, 10 bp, Unknown
  misc_feature (1)..( 10): Result.004 file - promoters50/1034306
gaagaaacca

SEQ ID NO: 164273 - DNA, 10 bp, Unknown
  misc_feature (1)..( 10): Result.004 file - promoters50/1034306
cgttaaatta

SEQ ID NO: 164274 - DNA, 10 bp, Unknown
  misc_feature (1)..( 10): Result.004 file - promoters50/1034306
aaagaaaaat

SEQ ID NO: 164275 - DNA, 10 bp, Unknown
  misc_feature (1)..( 10): Result.004 file - promoters50/1034306
aaaaataaaa

SEQ ID NO: 164276 - DNA, 11 bp, Unknown
  misc_feature (1)..( 11): Result.004 file - promoters50/1034306
cagaattaaaa

SEQ ID NO: 164277 - DNA, 11 bp, Unknown
  misc_feature (1)..( 11): Result.004 file - promoters50/1034306
gtgaattagtt

SEQ ID NO: 164278 - DNA, 11 bp, Unknown
  misc_feature (1)..( 11): Result.004 file - promoters50/1034306
cagtatttgaa

SEQ ID NO: 164279 - DNA, 11 bp, Unknown
  misc_feature (1)..( 11): Result.004 file - promoters50/1034306
tagatttaaat

SEQ ID NO: 164280 - DNA, 11 bp, Unknown
  misc_feature (1)..( 11): Result.004 file - promoters50/1034306
ataaattaaaa

SEQ ID NO: 164281 - DNA, 11 bp, Unknown
  misc_feature (1)..( 11): Result.004 file - promoters50/1034306
atagtttaaaa

SEQ ID NO: 164282 - DNA, 11 bp, Unknown
  misc_feature (1)..( 11): Result.004 file - promoters50/1034306
attttaatata

SEQ ID NO: 164283 - DNA, 11 bp, Unknown
  misc_feature (1)..( 11): Result.004 file - promoters50/1034306
gttttaaatca

SEQ ID NO: 164284 - DNA, 11 bp, Unknown
  misc_feature (1)..( 11): Result.004 file - promoters50/1034306
attttaccctc

SEQ ID NO: 164285 - DNA, 11 bp, Unknown
  misc_feature (1)..( 11): Result.004 file - promoters50/1034306
catttaatcaa

SEQ ID NO: 164286 - DNA, 11 bp, Unknown
  misc_feature (1)..( 11): Result.004 file - promoters50/1034306
attttaacgga

SEQ ID NO: 164287 - DNA, 11 bp, Unknown
  misc_feature (1)..( 11): Result.004 file - promoters50/1034306
gcattaaacaa

SEQ ID NO: 164288 - DNA, 11 bp, Unknown
  misc_feature (1)..( 11): Result.004 file - promoters50/1034306
tgattaaattg

SEQ ID NO: 164289 - DNA, 11 bp, Unknown
  misc_feature (1)..( 11): Result.004 file - promoters50/1034306
tgttagataat

SEQ ID NO: 164290 - DNA, 11 bp, Unknown
  misc_feature (1)..( 11): Result.004 file - promoters50/1034306
cgtttgatata

SEQ ID NO: 164291 - DNA, 11 bp, Unknown
  misc_feature (1)..( 11): Result.004 file - promoters50/1034306
agagagaaaat

SEQ ID NO: 164292 - DNA, 11 bp, Unknown
  misc_feature (1)..( 11): Result.004 file - promoters50/1034306
tgtaagaaaag

SEQ ID NO: 164293 - DNA, 11 bp, Unknown
  misc_feature (1)..( 11): Result.004 file - promoters50/1034306
cttttaatatg

SEQ ID NO: 164294 - DNA, 11 bp, Unknown
  misc_feature (1)..( 11): Result.004 file - promoters50/1034322
ttaaagaaaaa

SEQ ID NO: 164295 - DNA, 35 bp, Unknown; identical to SEQ ID NO: 133958
  misc_feature (1)..( 35): Result.004 file - promoters50/1034322

SEQ ID NO: 164296 - DNA, 35 bp, Unknown; identical to SEQ ID NO: 133959
  misc_feature (1)..( 35): Result.004 file - promoters50/1034322

SEQ ID NO: 164297 - DNA, 35 bp, Unknown; identical to SEQ ID NO: 133957
  misc_feature (1)..( 35): Result.004 file - promoters50/1034322

SEQ ID NO: 164298 - DNA, 35 bp, Unknown
  misc_feature (1)..( 35): Result.004 file - promoters50/1034322
tcaatgacgctcttcactccaaagagaccaccgtt

SEQ ID NO: 164299 - DNA, 35 bp, Unknown
  misc_feature (1)..( 35): Result.004 file - promoters50/1034322
taatatttttgtcgctgttctattttaagaacgag

SEQ ID NO: 164300 - DNA, 35 bp, Unknown
  misc_feature (1)..( 35): Result.004 file - promoters50/1034322
ttggatttcgagcgaatgaaatagtttggttatgc

SEQ ID NO: 164301 - DNA, 10 bp, Unknown
  misc_feature (1)..( 10): Result.004 file - promoters50/1034322
tatataaata

SEQ ID NO: 164302 - DNA, 10 bp, Unknown
  misc_feature (1)..( 10): Result.004 file - promoters50/1034322
tatacaaatc

SEQ ID NO: 164303 - DNA, 10 bp, Unknown
  misc_feature (1)..( 10): Result.004 file - promoters50/1034322
tatatataga

SEQ ID NO: 164304 - DNA, 10 bp, Unknown
  misc_feature (1)..( 10): Result.004 file - promoters50/1034322
tttataaact

SEQ ID NO: 164305 - DNA, 10 bp, Unknown
  misc_feature (1)..( 10): Result.004 file - promoters50/1034322
agtataaata

SEQ ID NO: 164306 - DNA, 10 bp, Unknown
  misc_feature (1)..( 10): Result.004 file - promoters50/1034322
tatataaaca

SEQ ID NO: 164307 - DNA, 10 bp, Unknown
  misc_feature (1)..( 10): Result.004 file - promoters50/1034322
cttaaaaacc

SEQ ID NO: 164308 - DNA, 10 bp, Unknown
  misc_feature (1)..( 10): Result.004 file - promoters50/1034322
aagtttaacg

SEQ ID NO: 164309 - DNA, 10 bp, Unknown
  misc_feature (1)..( 10): Result.004 file - promoters50/1034322
gagtttaggc

SEQ ID NO: 164310 - DNA, 10 bp, Unknown
  misc_feature (1)..( 10): Result.004 file - promoters50/1034322
aggtttaaga

SEQ ID NO: 164311 - DNA, 10 bp, Unknown
  misc_feature (1)..( 10): Result.004 file - promoters50/1034322
taattttcta

SEQ ID NO: 164312 - DNA, 10 bp, Unknown
  misc_feature (1)..( 10): Result.004 file - promoters50/1034322
aagtctagta

SEQ ID NO: 164313 - DNA, 10 bp, Unknown
  misc_feature (1)..( 10): Result.004 file - promoters50/1034322
tgttttcaga

SEQ ID NO: 164314 - DNA, 8 bp, Unknown
  misc_feature (1)..( 8): Result.004 file - promoters50/1034322
aaacatat

SEQ ID NO: 164315 - DNA, 8 bp, Unknown
  misc_feature (1)..( 8): Result.004 file - promoters50/1034322
aaaaataa

SEQ ID NO: 164316 - DNA, 8 bp, Unknown
  misc_feature (1)..( 8): Result.004 file - promoters50/1034322
acaaatag

SEQ ID NO: 164317 - DNA, 8 bp, Unknown
  misc_feature (1)..( 8): Result.004 file - promoters50/1034322
acagatag

SEQ ID NO: 164318 - DNA, 8 bp, Unknown
  misc_feature (1)..( 8): Result.004 file - promoters50/1034322
aaacatat

SEQ ID NO: 164319 - DNA, 8 bp, Unknown
  misc_feature (1)..( 8): Result.004 file - promoters50/1034349
taaaatac

SEQ ID NO: 164320 - DNA, 14 bp, Unknown
  misc_feature (1)..( 14): Result.004 file - promoters50/1034349
gaggctataaatac

SEQ ID NO: 164321 - DNA, 14 bp, Unknown
  misc_feature (1)..( 14): Result.004 file - promoters50/1034349
acctttataaactc

SEQ ID NO: 164322 - DNA, 14 bp, Unknown
  misc_feature (1)..( 14): Result.004 file - promoters50/1034349
acatgtatatatac

SEQ ID NO: 164323 - DNA, 14 bp, Unknown
  misc_feature (1)..( 14): Result.004 file - promoters50/1034349
caaaatataaataa

SEQ ID NO: 164324 - DNA, 14 bp, Unknown
  misc_feature (1)..( 14): Result.004 file - promoters50/1034349
ctctatataaacct

SEQ ID NO: 164325 - DNA, 14 bp, Unknown
  misc_feature (1)..( 14): Result.004 file - promoters50/1034349
acatatatttatac

SEQ ID NO: 164326 - DNA, 9 bp, Unknown
  misc_feature (1)..( 9): Result.004 file - promoters50/1034349
tatagaact

SEQ ID NO: 164327 - DNA, 9 bp, Unknown
  misc_feature (1)..( 9): Result.004 file - promoters50/1034349
aatataact

SEQ ID NO: 164328 - DNA, 9 bp, Unknown
  misc_feature (1)..( 9): Result.004 file - promoters50/1034349
gatataaca

SEQ ID NO: 164329 - DNA, 9 bp, Unknown
  misc_feature (1)..( 9): Result.004 file - promoters50/1034349
aatttaact

SEQ ID NO: 164330 - DNA, 9 bp, Unknown
  misc_feature (1)..( 9): Result.004 file - promoters50/1034349
taaataaat

SEQ ID NO: 164331 - DNA, 9 bp, Unknown
  misc_feature (1)..( 9): Result.004 file - promoters50/1034349
aatatatgt

SEQ ID NO: 164332 - DNA, 12 bp, Unknown
  misc_feature (1)..( 12): Result.004 file - promoters50/1034349
tattactatata

SEQ ID NO: 164333 - DNA, 12 bp, Unknown
  misc_feature (1)..( 12): Result.004 file - promoters50/1034349
gtcgactataga

SEQ ID NO: 164334 - DNA, 12 bp, Unknown
  misc_feature (1)..( 12): Result.004 file - promoters50/1034349
atttaatatttt

SEQ ID NO: 164335 - DNA, 12 bp, Unknown
  misc_feature (1)..( 12): Result.004 file - promoters50/1034349
atcatctataga

SEQ ID NO: 164336 - DNA, 12 bp, Unknown
  misc_feature (1)..( 12): Result.004 file - promoters50/1034349
atttaattaacc

SEQ ID NO: 164337 - DNA, 12 bp, Unknown
  misc_feature (1)..( 12): Result.004 file - promoters50/1034349
tcctattttatt

SEQ ID NO: 164338 - DNA, 9 bp, Unknown
  misc_feature (1)..( 9): Result.004 file - promoters50/1034349
gtcaaaaaa

SEQ ID NO: 164339 - DNA, 9 bp, Unknown
  misc_feature (1)..( 9): Result.004 file - promoters50/1034349
gtcacaaaa

SEQ ID NO: 164340 - DNA, 9 bp, Unknown
  misc_feature (1)..( 9): Result.004 file - promoters50/1034349
aacaataaa

SEQ ID NO: 164341 - DNA, 9 bp, Unknown
  misc_feature (1)..( 9): Result.004 file - promoters50/1034349
agcaaaaat

SEQ ID NO: 164342 - DNA, 9 bp, Unknown
  misc_feature (1)..( 9): Result.004 file - promoters50/1034349
actaaaaat

SEQ ID NO: 164343 - DNA, 10 bp, Unknown
  misc_feature (1)..( 10): Result.004 file - promoters50/1034353
tttaattaaa

SEQ ID NO: 164344 - DNA, 13 bp, Unknown
  misc_feature (1)..( 13): Result.004 file - promoters50/1034353
taaatatttgtgt

SEQ ID NO: 164345 - DNA, 13 bp, Unknown
  misc_feature (1)..( 13): Result.004 file - promoters50/1034353
caaatttttggtt

SEQ ID NO: 164346 - DNA, 13 bp, Unknown
  misc_feature (1)..( 13): Result.004 file - promoters50/1034353
taaaaattgtgtg

SEQ ID NO: 164347 - DNA, 13 bp, Unknown
  misc_feature (1)..( 13): Result.004 file - promoters50/1034353
acaattttgatcc

SEQ ID NO: 164348 - DNA, 13 bp, Unknown
  misc_feature (1)..( 13): Result.004 file - promoters50/1034353
gaggtttttcgtt

SEQ ID NO: 164349 - DNA, 13 bp, Unknown
  misc_feature (1)..( 13): Result.004 file - promoters50/1034463
gagattgtgacgg

SEQ ID NO: 164350 - DNA, 9 bp, Unknown
  misc_feature (1)..( 9): Result.004 file - promoters50/1034463
taatatttt

SEQ ID NO: 164351 - DNA, 9 bp, Unknown
  misc_feature (1)..( 9): Result.004 file - promoters50/1034463
taatatctc

SEQ ID NO: 164352 - DNA, 9 bp, Unknown
  misc_feature (1)..( 9): Result.004 file - promoters50/1034497
aaatttttt

SEQ ID NO: 164353 - DNA, 8 bp, Unknown
  misc_feature (1)..( 8): Result.004 file - promoters50/1034497
ctttattc

SEQ ID NO: 164354 - DNA, 8 bp, Unknown
  misc_feature (1)..( 8): Result.004 file - promoters50/1034497
ctttattt

SEQ ID NO: 164355 - DNA, 8 bp, Unknown
  misc_feature (1)..( 8): Result.004 file - promoters50/1034497
atttatta

SEQ ID NO: 164356 - DNA, 8 bp, Unknown
  misc_feature (1)..( 8): Result.004 file - promoters50/1034497
tcttattt

SEQ ID NO: 164357 - DNA, 14 bp, Unknown
  misc_feature (1)..( 14): Result.004 file - promoters50/1034497
attgattcaattct

SEQ ID NO: 164358 - DNA, 14 bp, Unknown
  misc_feature (1)..( 14): Result.004 file - promoters50/1034497
catatttcatttct

SEQ ID NO: 164359 - DNA, 14 bp, Unknown
  misc_feature (1)..( 14): Result.004 file - promoters50/1034497
acaaattaaatatt

SEQ ID NO: 164360 - DNA, 14 bp, Unknown
  misc_feature (1)..( 14): Result.004 file - promoters50/1034497
atttattctattaa

SEQ ID NO: 164361 - DNA, 8 bp, Unknown
  misc_feature (1)..( 8): Result.004 file - promoters50/1034497
tttaaata

SEQ ID NO: 164362 - DNA, 8 bp, Unknown
  misc_feature (1)..( 8): Result.004 file - promoters50/1034497
attaaata

SEQ ID NO: 164363 - DNA, 8 bp, Unknown
  misc_feature (1)..( 8): Result.004 file - promoters50/1034497
ttttaatc

SEQ ID NO: 164364 - DNA, 8 bp, Unknown
  misc_feature (1)..( 8): Result.004 file - promoters50/1034497
attaaata

SEQ ID NO: 164365 - DNA, 8 bp, Unknown
  misc_feature (1)..( 8): Result.004 file - promoters50/1034497
cttactcg

SEQ ID NO: 164366 - DNA, 12 bp, Unknown
  misc_feature (1)..( 12): Result.004 file - promoters50/1034497
aaataattgatt

SEQ ID NO: 164367 - DNA, 12 bp, Unknown
  misc_feature (1)..( 12): Result.004 file - promoters50/1034497
ttttaatcgatc

SEQ ID NO: 164368 - DNA, 12 bp, Unknown
  misc_feature (1)..( 12): Result.004 file - promoters50/1034497
atttattctatt

SEQ ID NO: 164369 - DNA, 12 bp, Unknown
  misc_feature (1)..( 12): Result.004 file - promoters50/1034497
tcttactcggta

SEQ ID NO: 164370 - DNA, 9 bp, Unknown
  misc_feature (1)..( 9): Result.004 file - promoters50/1034497
agattttaa

SEQ ID NO: 164371 - DNA, 9 bp, Unknown
  misc_feature (1)..( 9): Result.004 file - promoters50/1034497
aaattgtaa

SEQ ID NO: 164372 - DNA, 9 bp, Unknown
  misc_feature (1)..( 9): Result.004 file - promoters50/1034497
agattttct

SEQ ID NO: 164373 - DNA, 9 bp, Unknown
  misc_feature (1)..( 9): Result.004 file - promoters50/1034652
tcattatct

SEQ ID NO: 164374 - DNA, 10 bp, Unknown
  misc_feature (1)..( 10): Result.004 file - promoters50/1034652
tcttcttctt

SEQ ID NO: 164375 - DNA, 10 bp, Unknown
  misc_feature (1)..( 10): Result.004 file - promoters50/1034652
tcttgttctg

SEQ ID NO: 164376 - DNA, 10 bp, Unknown
  misc_feature (1)..( 10): Result.004 file - promoters50/1034652
tttgcttctc

SEQ ID NO: 164377 - DNA, 10 bp, Unknown
  misc_feature (1)..( 10): Result.004 file - promoters50/1034652
ccttctttaa

SEQ ID NO: 164378 - DNA, 10 bp, Unknown
  misc_feature (1)..( 10): Result.004 file - promoters50/1034652
agttggtctg

SEQ ID NO: 164379 - DNA, 10 bp, Unknown
  misc_feature (1)..( 10): Result.004 file - promoters50/1034692
aattcttttg

SEQ ID NO: 164380 - DNA, 9 bp, Unknown
  misc_feature (1)..( 9): Result.004 file - promoters50/1034692
aaaatcaac

SEQ ID NO: 164381 - DNA, 9 bp, Unknown
  misc_feature (1)..( 9): Result.004 file - promoters50/1034692
caaatcaac

SEQ ID NO: 164382 - DNA, 9 bp, Unknown
  misc_feature (1)..( 9): Result.004 file - promoters50/1034692
aaaaacaat

SEQ ID NO: 164383 - DNA, 8 bp, Unknown
  misc_feature (1)..( 8): Result.004 file - promoters50/1034692
aaatggaa

SEQ ID NO: 164384 - DNA, 8 bp, Unknown
  misc_feature (1)..( 8): Result.004 file - promoters50/1034692
aaaaggaa

SEQ ID NO: 164385 - DNA, 8 bp, Unknown
  misc_feature (1)..( 8): Result.004 file - promoters50/1034692
aaaacgaa

SEQ ID NO: 164386 - DNA, 10 bp, Unknown
  misc_feature (1)..( 10): Result.004 file - promoters50/1034692
tcacttgcac

SEQ ID NO: 164387 - DNA, 10 bp, Unknown
  misc_feature (1)..( 10): Result.004 file - promoters50/1034692
attcttacac

SEQ ID NO: 164388 - DNA, 10 bp, Unknown
  misc_feature (1)..( 10): Result.004 file - promoters50/1034834
atttttactt

SEQ ID NO: 164389 - DNA, 10 bp, Unknown
  misc_feature (1)..( 10): Result.004 file - promoters50/1034834
ttttattata

SEQ ID NO: 164390 - DNA, 10 bp, Unknown
  misc_feature (1)..( 10): Result.004 file - promoters50/1034834
tttaattata

SEQ ID NO: 164391 - DNA, 10 bp, Unknown
  misc_feature (1)..( 10): Result.004 file - promoters50/1034834
ttgtatttta

SEQ ID NO: 164392 - DNA, 11 bp, Unknown
  misc_feature (1)..( 11): Result.004 file - promoters50/1034834
atatatataaa

SEQ ID NO: 164393 - DNA, 11 bp, Unknown
  misc_feature (1)..( 11): Result.004 file - promoters50/1034834
atatctataaa

SEQ ID NO: 164394 - DNA, 11 bp, Unknown
  misc_feature (1)..( 11): Result.004 file - promoters50/1034837
ttatataccca

SEQ ID NO: 164395 - DNA, 12 bp, Unknown
  misc_feature (1)..( 12): Result.004 file - promoters50/1034837
agatattttaaa

SEQ ID NO: 164396 - DNA, 12 bp, Unknown
  misc_feature (1)..( 12): Result.004 file - promoters50/1034837
caataatttaca

SEQ ID NO: 164397 - DNA, 12 bp, Unknown
  misc_feature (1)..( 12): Result.004 file - promoters50/1034837
acacaatataca

SEQ ID NO: 164398 - DNA, 12 bp, Unknown
  misc_feature (1)..( 12): Result.004 file - promoters50/1034837
tgaaaatttata

SEQ ID NO: 164399 - DNA, 12 bp, Unknown
  misc_feature (1)..( 12): Result.004 file - promoters50/1034837
caacaatgtaca

SEQ ID NO: 164400 - DNA, 12 bp, Unknown
  misc_feature (1)..( 12): Result.004 file - promoters50/1034837
ttaaaatttaat

SEQ ID NO: 164401 - DNA, 12 bp, Unknown
  misc_feature (1)..( 12): Result.004 file - promoters50/1034837
aaaaaatataca

SEQ ID NO: 164402 - DNA, 12 bp, Unknown
  misc_feature (1)..( 12): Result.004 file - promoters50/1034837
acacaatataca

SEQ ID NO: 164403 - DNA, 12 bp, Unknown
  misc_feature (1)..( 12): Result.004 file - promoters50/1034837
caataatttaca

SEQ ID NO: 164404 - DNA, 12 bp, Unknown
  misc_feature (1)..( 12): Result.004 file - promoters50/1034837
tgaaaatttata

SEQ ID NO: 164405 - DNA, 12 bp, Unknown
  misc_feature (1)..( 12): Result.004 file - promoters50/1034837
caacaatgtaca

SEQ ID NO: 164406 - DNA, 12 bp, Unknown
  misc_feature (1)..( 12): Result.004 file - promoters50/1034837
ttaaaatttaat

SEQ ID NO: 164407 - DNA, 10 bp, Unknown
  misc_feature (1)..( 10): Result.004 file - promoters50/1034837
tcaacaaaat

SEQ ID NO: 164408 - DNA, 10 bp, Unknown
  misc_feature (1)..( 10): Result.004 file - promoters50/1034837
aaaacaaatc

SEQ ID NO: 164409 - DNA, 10 bp, Unknown
  misc_feature (1)..( 10): Result.004 file - promoters50/1034837
tcaataaact

SEQ ID NO: 164410 - DNA, 10 bp, Unknown
  misc_feature (1)..( 10): Result.004 file - promoters50/1034837
ggaaaaaaat

SEQ ID NO: 164411 - DNA, 10 bp, Unknown
  misc_feature (1)..( 10): Result.004 file - promoters50/1034837
ataacaaata

SEQ ID NO: 164412 - DNA, 10 bp, Unknown
  misc_feature (1)..( 10): Result.004 file - promoters50/1034841
agaacaaatg

SEQ ID NO: 164413 - DNA, 8 bp, Unknown
  misc_feature (1)..( 8): Result.004 file - promoters50/1034841
ttgaaaat

SEQ ID NO: 164414 - DNA, 8 bp, Unknown
  misc_feature (1)..( 8): Result.004 file - promoters50/1034841
ttgaaatg

SEQ ID NO: 164415 - DNA, 8 bp, Unknown
  misc_feature (1)..( 8): Result.004 file - promoters50/1034841
ttgcaatg

SEQ ID NO: 164416 - DNA, 9 bp, Unknown
  misc_feature (1)..( 9): Result.004 file - promoters50/1034841
ttgattatt

SEQ ID NO: 164417 - DNA, 9 bp, Unknown
  misc_feature (1)..( 9): Result.004 file - promoters50/1034841
ttgattatt

SEQ ID NO: 164418 - DNA, 9 bp, Unknown
  misc_feature (1)..( 9): Result.004 file - promoters50/1034841
atgattatt

SEQ ID NO: 164419 - DNA, 7 bp, Unknown
  misc_feature (1)..( 7): Result.004 file - promoters50/1034841
aatgaaa

SEQ ID NO: 164420 - DNA, 7 bp, Unknown
  misc_feature (1)..( 7): Result.004 file - promoters50/1034841
aattaaa

SEQ ID NO: 164421 - DNA, 7 bp, Unknown
  misc_feature (1)..( 7): Result.004 file - promoters50/1034841
gatgaaa

SEQ ID NO: 164422 - DNA, 8 bp, Unknown
  misc_feature (1)..( 8): Result.004 file - promoters50/1034841
taaattac

SEQ ID NO: 164423 - DNA, 8 bp, Unknown
  misc_feature (1)..( 8): Result.004 file - promoters50/1034841
taatttat

SEQ ID NO: 164424 - DNA, 8 bp, Unknown
  misc_feature (1)..( 8): Result.004 file - promoters50/1034841
taagttat

SEQ ID NO: 164425 - DNA, 11 bp, Unknown
  misc_feature (1)..( 11): Result.004 file - promoters50/1034841
aaacttaaaag

SEQ ID NO: 164426 - DNA, 11 bp, Unknown
  misc_feature (1)..( 11): Result.004 file - promoters50/1034841
caacttcaaag

SEQ ID NO: 164427 - DNA, 11 bp, Unknown
  misc_feature (1)..( 11): Result.004 file - promoters50/1034870
caacttttttt

SEQ ID NO: 164428 - DNA, 16 bp, Unknown
  misc_feature (1)..( 16): Result.004 file - promoters50/1034870
tttagtgtaatgaaat

SEQ ID NO: 164429 - DNA, 16 bp, Unknown
  misc_feature (1)..( 16): Result.004 file - promoters50/1034870
cctaacagaataaaaa

SEQ ID NO: 164430 - DNA, 16 bp, Unknown
  misc_feature (1)..( 16): Result.004 file - promoters50/1034870
attaaattaattaaaa

SEQ ID NO: 164431 - DNA, 16 bp, Unknown
  misc_feature (1)..( 16): Result.004 file - promoters50/1034870
aatagtacaatgcaat

SEQ ID NO: 164432 - DNA, 16 bp, Unknown
  misc_feature (1)..( 16): Result.004 file - promoters50/1034870
attccagccatgaaag

SEQ ID NO: 164433 - DNA, 16 bp, Unknown
  misc_feature (1)..( 16): Result.004 file - promoters50/1034870
aacagagtaattgatg

SEQ ID NO: 164434 - DNA, 16 bp, Unknown
  misc_feature (1)..( 16): Result.004 file - promoters50/1034870
aaattgccaaagagag

SEQ ID NO: 164435 - DNA, 13 bp, Unknown
  misc_feature (1)..( 13): Result.004 file - promoters50/1034870
ttaacaatttttt

SEQ ID NO: 164436 - DNA, 13 bp, Unknown
  misc_feature (1)..( 13): Result.004 file - promoters50/1034870
acatcaattttgc

SEQ ID NO: 164437 - DNA, 14 bp, Unknown
  misc_feature (1)..( 14): Result.004 file - promoters50/1034870
catatgattgtttt

SEQ ID NO: 164438 - DNA, 14 bp, Unknown
  misc_feature (1)..( 14): Result.004 file - promoters50/1034870
ttaataatttattt

SEQ ID NO: 164439 - DNA, 14 bp, Unknown
  misc_feature (1)..( 14): Result.004 file - promoters50/1034870
gattagattttggt

SEQ ID NO: 164440 - DNA, 14 bp, Unknown
  misc_feature (1)..( 14): Result.004 file - promoters50/1034870
gtaataagttaaca

SEQ ID NO: 164441 - DNA, 26 bp, Unknown
  misc_feature (1)..( 26): Result.004 file - promoters50/1034870
attaacaatttttttctaaaagatta

SEQ ID NO: 164442 - DNA, 26 bp, Unknown
  misc_feature (1)..( 26): Result.004 file - promoters50/1034870
gagacatcaattttgctaaaaatcct

SEQ ID NO: 164443 - DNA, 26 bp, Unknown
  misc_feature (1)..( 26): Result.004 file - promoters50/1034870
catatgattgttttggttgaaatgaa

SEQ ID NO: 164444 - DNA, 26 bp, Unknown
  misc_feature (1)..( 26): Result.004 file - promoters50/1034870
ttaataatttatttaatatttttact

SEQ ID NO: 164445 - DNA, 26 bp, Unknown
  misc_feature (1)..( 26): Result.004 file - promoters50/1034870
tagtgattagattttggtgagaagat

SEQ ID NO: 164446 - DNA, 26 bp, Unknown
  misc_feature (1)..( 26): Result.004 file - promoters50/1034870
cagtttatgaatctgctaatgtgaac

SEQ ID NO: 164447 - DNA, 26 bp, Unknown
  misc_feature (1)..( 26): Result.004 file - promoters50/1034870
gattttacatacacggtaataagtta

SEQ ID NO: 164448 - DNA, 14 bp, Unknown
  misc_feature (1)..( 14): Result.004 file - promoters50/1034870
cttgaatcaatatt

SEQ ID NO: 164449 - DNA, 14 bp, Unknown
  misc_feature (1)..( 14): Result.004 file - promoters50/1034870
cttaaatatttttc

SEQ ID NO: 164450 - DNA, 14 bp, Unknown
  misc_feature (1)..( 14): Result.004 file - promoters50/1034870
attgattcaaaatt

SEQ ID NO: 164451 - DNA, 14 bp, Unknown
  misc_feature (1)..( 14): Result.004 file - promoters50/1034870
cttagatatgataa

SEQ ID NO: 164452 - DNA, 14 bp, Unknown
  misc_feature (1)..( 14): Result.004 file - promoters50/1034870
tttcaaacaaagtt

SEQ ID NO: 164453 - DNA, 14 bp, Unknown
  misc_feature (1)..( 14): Result.004 file - promoters50/1034870
tttaaaacaattat

SEQ ID NO: 164454 - DNA, 15 bp, Unknown
  misc_feature (1)..( 15): Result.004 file - promoters50/1034870
ttgaatcaatatttt

SEQ ID NO: 164455 - DNA, 15 bp, Unknown
  misc_feature (1)..( 15): Result.004 file - promoters50/1034870
cctcttaaatatttt

SEQ ID NO: 164456 - DNA, 15 bp, Unknown
  misc_feature (1)..( 15): Result.004 file - promoters50/1034870
ttgattcaaaattct

SEQ ID NO: 164457 - DNA, 15 bp, Unknown
  misc_feature (1)..( 15): Result.004 file - promoters50/1034870
atatatatatattta

SEQ ID NO: 164458 - DNA, 15 bp, Unknown
  misc_feature (1)..( 15): Result.004 file - promoters50/1034870
gagcttagatatgat

SEQ ID NO: 164459 - DNA, 16 bp, Unknown
  misc_feature (1)..( 16): Result.004 file - promoters50/1034870
cgtggggtatagtttt

SEQ ID NO: 164460 - DNA, 16 bp, Unknown
  misc_feature (1)..( 16): Result.004 file - promoters50/1034962
ggctttcaaacaaagt

SEQ ID NO: 164461 - DNA, 8 bp, Unknown
  misc_feature (1)..( 8): Result.004 file - promoters50/1034962
atttttaa

SEQ ID NO: 164462 - DNA, 8 bp, Unknown
  misc_feature (1)..( 8): Result.004 file - promoters50/1034962
attttttt

SEQ ID NO: 164463 - DNA, 9 bp, Unknown
  misc_feature (1)..( 9): Result.004 file - promoters50/1034962
ttttgtttc

SEQ ID NO: 164464 - DNA, 9 bp, Unknown
  misc_feature (1)..( 9): Result.004 file - promoters50/1034962
aaatcattt

SEQ ID NO: 164465 - DNA, 9 bp, Unknown
  misc_feature (1)..( 9): Result.004 file - promoters50/1034962
caatgattt

SEQ ID NO: 164466 - DNA, 9 bp, Unknown
  misc_feature (1)..( 9): Result.004 file - promoters50/1034970
caattattc

SEQ ID NO: 164467 - DNA, 11 bp, Unknown
  misc_feature (1)..( 11): Result.004 file - promoters50/1034970
gaagacatggt

SEQ ID NO: 164468 - DNA, 11 bp, Unknown
  misc_feature (1)..( 11): Result.004 file - promoters50/1034970
agagaaatggt

SEQ ID NO: 164469 - DNA, 11 bp, Unknown
  misc_feature (1)..( 11): Result.004 file - promoters50/1034970
agagaaagatg

SEQ ID NO: 164470 - DNA, 7 bp, Unknown
  misc_feature (1)..( 7): Result.004 file - promoters50/1034970
tttcttt

SEQ ID NO: 164471 - DNA, 7 bp, Unknown
  misc_feature (1)..( 7): Result.004 file - promoters50/1034970
tttgttt

SEQ ID NO: 164472 - DNA, 7 bp, Unknown
  misc_feature (1)..( 7): Result.004 file - promoters50/1034970
ttttttt

SEQ ID NO: 164473 - DNA, 7 bp, Unknown
  misc_feature (1)..( 7): Result.004 file - promoters50/1034970
attgaca

SEQ ID NO: 164474 - DNA, 7 bp, Unknown
  misc_feature (1)..( 7): Result.004 file - promoters50/1034970
attgact

SEQ ID NO: 164475 - DNA, 7 bp, Unknown
  misc_feature (1)..( 7): Result.004 file - promoters50/1034982
atttact

SEQ ID NO: 164476 - DNA, 8 bp, Unknown
  misc_feature (1)..( 8): Result.004 file - promoters50/1034982
ttcttagt

SEQ ID NO: 164477 - DNA, 8 bp, Unknown
  misc_feature (1)..( 8): Result.004 file - promoters50/1034982
ttcttaaa

SEQ ID NO: 164478 - DNA, 8 bp, Unknown
  misc_feature (1)..( 8): Result.004 file - promoters50/1034982
ttcatagt

SEQ ID NO: 164479 - DNA, 7 bp, Unknown
  misc_feature (1)..( 7): Result.004 file - promoters50/1034982
atagatt

SEQ ID NO: 164480 - DNA, 7 bp, Unknown
  misc_feature (1)..( 7): Result.004 file - promoters50/1034982
gtagatt

SEQ ID NO: 164481 - DNA, 7 bp, Unknown
  misc_feature (1)..( 7): Result.004 file - promoters50/1034982
gtagatg

SEQ ID NO: 164482 - DNA, 9 bp, Unknown
  misc_feature (1)..( 9): Result.004 file - promoters50/1034982
ttttatctc

SEQ ID NO: 164483 - DNA, 9 bp, Unknown
  misc_feature (1)..( 9): Result.004 file - promoters50/1034982
tttaatcag

SEQ ID NO: 164484 - DNA, 9 bp, Unknown
  misc_feature (1)..( 9): Result.004 file - promoters50/1034982
cctaagcag

SEQ ID NO: 164485 - DNA, 9 bp, Unknown
  misc_feature (1)..( 9): Result.004 file - promoters50/1034982
aaaattaat

SEQ ID NO: 164486 - DNA, 9 bp, Unknown
  misc_feature (1)..( 9): Result.004 file - promoters50/1034982
aaaatgaat

SEQ ID NO: 164487 - DNA, 10 bp, Unknown
  misc_feature (1)..( 10): Result.004 file - promoters50/1035027
aaagatgtgg

SEQ ID NO: 164488 - DNA, 8 bp, Unknown
  misc_feature (1)..( 8): Result.004 file - promoters50/1035027
atatatat

SEQ ID NO: 164489 - DNA, 8 bp, Unknown
  misc_feature (1)..( 8): Result.004 file - promoters50/1035027
gtatatac

SEQ ID NO: 164490 - DNA, 8 bp, Unknown
  misc_feature (1)..( 8): Result.004 file - promoters50/1035027
gtatataa

SEQ ID NO: 164491 - DNA, 8 bp, Unknown
  misc_feature (1)..( 8): Result.004 file - promoters50/1035027
tgatataa

SEQ ID NO: 164492 - DNA, 8 bp, Unknown
  misc_feature (1)..( 8): Result.004 file - promoters50/1035027
gtatattc

SEQ ID NO: 164493 - DNA, 13 bp, Unknown
  misc_feature (1)..( 13): Result.004 file - promoters50/1035027
tatttatcaaaaa

SEQ ID NO: 164494 - DNA, 13 bp, Unknown
  misc_feature (1)..( 13): Result.004 file - promoters50/1035027
tatttaatttcat

SEQ ID NO: 164495 - DNA, 13 bp, Unknown
  misc_feature (1)..( 13): Result.004 file - promoters50/1035027
aatttaataccct

SEQ ID NO: 164496 - DNA, 13 bp, Unknown
  misc_feature (1)..( 13): Result.004 file - promoters50/1035027
attttcataacaa

SEQ ID NO: 164497 - DNA, 13 bp, Unknown
  misc_feature (1)..( 13): Result.004 file - promoters50/1035083
gagttaatagcct

SEQ ID NO: 164498 - DNA, 14 bp, Unknown
  misc_feature (1)..( 14): Result.004 file - promoters50/1035083
atctttatacaaaa

SEQ ID NO: 164499 - DNA, 14 bp, Unknown
  misc_feature (1)..( 14): Result.004 file - promoters50/1035083
catattatacgttt

SEQ ID NO: 164500 - DNA, 14 bp, Unknown
  misc_feature (1)..( 14): Result.004 file - promoters50/1035083
atctttataagtat

SEQ ID NO: 164501 - DNA, 14 bp, Unknown
  misc_feature (1)..( 14): Result.004 file - promoters50/1035083
aaacttataattat

SEQ ID NO: 164502 - DNA, 14 bp, Unknown
  misc_feature (1)..( 14): Result.004 file - promoters50/1035083
aaatttgtaacttc

SEQ ID NO: 164503 - DNA, 14 bp, Unknown
  misc_feature (1)..( 14): Result.004 file - promoters50/1035083
aatgatattattat

SEQ ID NO: 164504 - DNA, 11 bp, Unknown
  misc_feature (1)..( 11): Result.004 file - promoters50/1035083
cgataaatatc

SEQ ID NO: 164505 - DNA, 11 bp, Unknown
  misc_feature (1)..( 11): Result.004 file - promoters50/1035083
gtatatataat

SEQ ID NO: 164506 - DNA, 11 bp, Unknown
  misc_feature (1)..( 11): Result.004 file - promoters50/1035083
ctataaatatc

SEQ ID NO: 164507 - DNA, 11 bp, Unknown
  misc_feature (1)..( 11): Result.004 file - promoters50/1035083
tcttatataaa

SEQ ID NO: 164508 - DNA, 11 bp, Unknown
  misc_feature (1)..( 11): Result.004 file - promoters50/1035083
ctataaaaacc

SEQ ID NO: 164509 - DNA, 11 bp, Unknown
  misc_feature (1)..( 11): Result.004 file - promoters50/1035083
ccataaaagca

SEQ ID NO: 164510 - DNA, 13 bp, Unknown
  misc_feature (1)..( 13): Result.004 file - promoters50/1035083
tattttaattcat

SEQ ID NO: 164511 - DNA, 13 bp, Unknown
  misc_feature (1)..( 13): Result.004 file - promoters50/1035083
acttttgattagg

SEQ ID NO: 164512 - DNA, 13 bp, Unknown
  misc_feature (1)..( 13): Result.004 file - promoters50/1035083
gattttacaccac

SEQ ID NO: 164513 - DNA, 13 bp, Unknown
  misc_feature (1)..( 13): Result.004 file - promoters50/1035083
tattttacttaat

SEQ ID NO: 164514 - DNA, 13 bp, Unknown
  misc_feature (1)..( 13): Result.004 file - promoters50/1035083
aaatataaatcat

SEQ ID NO: 164515 - DNA, 13 bp, Unknown
  misc_feature (1)..( 13): Result.004 file - promoters50/1035083
aaagttggttatt

SEQ ID NO: 164516 - DNA, 13 bp, Unknown
  misc_feature (1)..( 13): Result.004 file - promoters50/1035083
gttttaaaagtaa

SEQ ID NO: 164517 - DNA, 13 bp, Unknown
  misc_feature (1)..( 13): Result.004 file - promoters50/1035083
ttttgaaaagagt

SEQ ID NO: 164518 - DNA, 13 bp, Unknown
  misc_feature (1)..( 13): Result.004 file - promoters50/1035083
tctttataagtat

SEQ ID NO: 164519 - DNA, 13 bp, Unknown
  misc_feature (1)..( 13): Result.004 file - promoters50/1035083
ttttgaaataatt

SEQ ID NO: 164520 - DNA, 13 bp, Unknown
  misc_feature (1)..( 13): Result.004 file - promoters50/1035083
aacttataattat

SEQ ID NO: 164521 - DNA, 13 bp, Unknown
  misc_feature (1)..( 13): Result.004 file - promoters50/1035083
ctaatataagtaa

SEQ ID NO: 164522 - DNA, 13 bp, Unknown
  misc_feature (1)..( 13): Result.004 file - promoters50/1035083
atgatattattat

SEQ ID NO: 164523 - DNA, 17 bp, Unknown
  misc_feature (1)..( 17): Result.004 file - promoters50/1035083
taaattttaaaattatt

SEQ ID NO: 164524 - DNA, 17 bp, Unknown
  misc_feature (1)..( 17): Result.004 file - promoters50/1035083
ttgattctaaaatattg

SEQ ID NO: 164525 - DNA, 17 bp, Unknown
  misc_feature (1)..( 17): Result.004 file - promoters50/1035083
aaaatgttagataggaa

SEQ ID NO: 164526 - DNA, 17 bp, Unknown
  misc_feature (1)..( 17): Result.004 file - promoters50/1035083
cagaaactaagattata

SEQ ID NO: 164527 - DNA, 17 bp, Unknown
  misc_feature (1)..( 17): Result.004 file - promoters50/1035083
taaattttgaaataatt

SEQ ID NO: 164528 - DNA, 17 bp, Unknown
  misc_feature (1)..( 17): Result.004 file - promoters50/1035083
tgtgttttgaaaagagt

SEQ ID NO: 164529 - DNA, 20 bp, Unknown
  misc_feature (1)..( 20): Result.004 file - promoters50/1035083
taaattttaaaattattcat

SEQ ID NO: 164530 - DNA, 20 bp, Unknown
  misc_feature (1)..( 20): Result.004 file - promoters50/1035083
gattctaaaatattgttcat

SEQ ID NO: 164531 - DNA, 20 bp, Unknown
  misc_feature (1)..( 20): Result.004 file - promoters50/1035083
cagaaactaagattataatt

SEQ ID NO: 164532 - DNA, 20 bp, Unknown
  misc_feature (1)..( 20): Result.004 file - promoters50/1035083
taaattttgaaataatttca

SEQ ID NO: 164533 - DNA, 20 bp, Unknown
  misc_feature (1)..( 20): Result.004 file - promoters50/1035083
actcgaagaaattgattcat

SEQ ID NO: 164534 - DNA, 20 bp, Unknown
  misc_feature (1)..( 20): Result.004 file - promoters50/1035097
tgtgttttgaaaagagtttt

SEQ ID NO: 164535 - DNA, 9 bp, Unknown
  misc_feature (1)..( 9): Result.004 file - promoters50/1035097
gaaaaaatg

SEQ ID NO: 164536 - DNA, 9 bp, Unknown
  misc_feature (1)..( 9): Result.004 file - promoters50/1035097
gaagaaaga

SEQ ID NO: 164537 - DNA, 9 bp, Unknown
  misc_feature (1)..( 9): Result.004 file - promoters50/1035097
caaaaaatc

SEQ ID NO: 164538 - DNA, 9 bp, Unknown
  misc_feature (1)..( 9): Result.004 file - promoters50/1035097
caaaaaaat

SEQ ID NO: 164539 - DNA, 9 bp, Unknown
  misc_feature (1)..( 9): Result.004 file - promoters50/1035097
gaaaaaaat

SEQ ID NO: 164540 - DNA, 9 bp, Unknown
  misc_feature (1)..( 9): Result.004 file - promoters50/1035117
taaaaaatt

SEQ ID NO: 164541 - DNA, 10 bp, Unknown
  misc_feature (1)..( 10): Result.004 file - promoters50/1035117
tattttttgg

SEQ ID NO: 164542 - DNA, 10 bp, Unknown
  misc_feature (1)..( 10): Result.004 file - promoters50/1035117
tgttttttct

SEQ ID NO: 164543 - DNA, 10 bp, Unknown
  misc_feature (1)..( 10): Result.004 file - promoters50/1035117
tattctttga

SEQ ID NO: 164544 - DNA, 10 bp, Unknown
  misc_feature (1)..( 10): Result.004 file - promoters50/1035117
tcttttttag

SEQ ID NO: 164545 - DNA, 10 bp, Unknown
  misc_feature (1)..( 10): Result.004 file - promoters50/1035117
actttctctc

SEQ ID NO: 164546 - DNA, 10 bp, Unknown
  misc_feature (1)..( 10): Result.004 file - promoters50/1035117
ggttctttgc

SEQ ID NO: 164547 - DNA, 10 bp, Unknown
  misc_feature (1)..( 10): Result.004 file - promoters50/1035117
cctttttata

SEQ ID NO: 164548 - DNA, 10 bp, Unknown
  misc_feature (1)..( 10): Result.004 file - promoters50/1035117
gtctctatga

SEQ ID NO: 164549 - DNA, 9 bp, Unknown
  misc_feature (1)..( 9): Result.004 file - promoters50/1035117
acttttata

SEQ ID NO: 164550 - DNA, 9 bp, Unknown
  misc_feature (1)..( 9): Result.004 file - promoters50/1035117
tcttttaaa

SEQ ID NO: 164551 - DNA, 9 bp, Unknown
  misc_feature (1)..( 9): Result.004 file - promoters50/1035117
tgttttatt

SEQ ID NO: 164552 - DNA, 9 bp, Unknown
  misc_feature (1)..( 9): Result.004 file - promoters50/1035117
tcttttgtc

SEQ ID NO: 164553 - DNA, 9 bp, Unknown
  misc_feature (1)..( 9): Result.004 file - promoters50/1035117
acttttact

SEQ ID NO: 164554 - DNA, 9 bp, Unknown
  misc_feature (1)..( 9): Result.004 file - promoters50/1035117
tttttcatt

SEQ ID NO: 164555 - DNA, 9 bp, Unknown
  misc_feature (1)..( 9): Result.004 file - promoters50/1035117
tgtattaca

SEQ ID NO: 164556 - DNA, 11 bp, Unknown
  misc_feature (1)..( 11): Result.004 file - promoters50/1035117
ctttgttatat

SEQ ID NO: 164557 - DNA, 11 bp, Unknown
  misc_feature (1)..( 11): Result.004 file - promoters50/1035117
atttgatattt

SEQ ID NO: 164558 - DNA, 11 bp, Unknown
  misc_feature (1)..( 11): Result.004 file - promoters50/1035117
tttttttagtt

SEQ ID NO: 164559 - DNA, 11 bp, Unknown
  misc_feature (1)..( 11): Result.004 file - promoters50/1035117
ctttgtaagta

SEQ ID NO: 164560 - DNA, 11 bp, Unknown
  misc_feature (1)..( 11): Result.004 file - promoters50/1035117
ttttaataaat

SEQ ID NO: 164561 - DNA, 11 bp, Unknown
  misc_feature (1)..( 11): Result.004 file - promoters50/1035117
attttatttta

SEQ ID NO: 164562 - DNA, 13 bp, Unknown
  misc_feature (1)..( 13): Result.004 file - promoters50/1035117
aaaaacaacaaat

SEQ ID NO: 164563 - DNA, 13 bp, Unknown
  misc_feature (1)..( 13): Result.004 file - promoters50/1035117
ccaaataacaaat

SEQ ID NO: 164564 - DNA, 13 bp, Unknown
  misc_feature (1)..( 13): Result.004 file - promoters50/1035117
agtaacaacgcat

SEQ ID NO: 164565 - DNA, 13 bp, Unknown
  misc_feature (1)..( 13): Result.004 file - promoters50/1035117
aaaaacaacagaa

SEQ ID NO: 164566 - DNA, 13 bp, Unknown
  misc_feature (1)..( 13): Result.004 file - promoters50/1035117
gcaaagaaaatag

SEQ ID NO: 164567 - DNA, 13 bp, Unknown
  misc_feature (1)..( 13): Result.004 file - promoters50/1035117
gcaaagagagttg

SEQ ID NO: 164568 - DNA, 17 bp, Unknown
  misc_feature (1)..( 17): Result.004 file - promoters50/1035117
acttatttccaataaaa

SEQ ID NO: 164569 - DNA, 17 bp, Unknown
  misc_feature (1)..( 17): Result.004 file - promoters50/1035117
ttttatttctcctactt

SEQ ID NO: 164570 - DNA, 17 bp, Unknown
  misc_feature (1)..( 17): Result.004 file - promoters50/1035117
ttttctttagatttttc

SEQ ID NO: 164571 - DNA, 17 bp, Unknown
  misc_feature (1)..( 17): Result.004 file - promoters50/1035117
aactctatagaaagtct

SEQ ID NO: 164572 - DNA, 17 bp, Unknown
  misc_feature (1)..( 17): Result.004 file - promoters50/1035117
ctttcttttaataaatg

SEQ ID NO: 164573 - DNA, 17 bp, Unknown
  misc_feature (1)..( 17): Result.004 file - promoters50/1035117
ccttcataaaatctata

SEQ ID NO: 164574 - DNA, 17 bp, Unknown
  misc_feature (1)..( 17): Result.004 file - promoters50/1035155
atcactagatttcatac

SEQ ID NO: 164575 - DNA, 11 bp, Unknown
  misc_feature (1)..( 11): Result.004 file - promoters50/1035155
aaaattgttgg

SEQ ID NO: 164576 - DNA, 11 bp, Unknown
  misc_feature (1)..( 11): Result.004 file - promoters50/1035155
caaattgctag

SEQ ID NO: 164577 - DNA, 12 bp, Unknown
  misc_feature (1)..( 12): Result.004 file - promoters50/1035155
aaacatttttta

SEQ ID NO: 164578 - DNA, 12 bp, Unknown
  misc_feature (1)..( 12): Result.004 file - promoters50/1035155
aaatattatata

SEQ ID NO: 164579 - DNA, 12 bp, Unknown
  misc_feature (1)..( 12): Result.004 file - promoters50/1035155
aaacacaataca

SEQ ID NO: 164580 - DNA, 9 bp, Unknown
  misc_feature (1)..( 9): Result.004 file - promoters50/1035155
ttttcatag

SEQ ID NO: 164581 - DNA, 9 bp, Unknown
  misc_feature (1)..( 9): Result.004 file - promoters50/1035155
ttttcattt

SEQ ID NO: 164582 - DNA, 9 bp, Unknown
  misc_feature (1)..( 9): Result.004 file - promoters50/1035155
atttaattt

SEQ ID NO: 164583 - DNA, 9 bp, Unknown
  misc_feature (1)..( 9): Result.004 file - promoters50/1035155
ccttacttt

SEQ ID NO: 164584 - DNA, 7 bp, Unknown
  misc_feature (1)..( 7): Result.004 file - promoters50/1035155
tatgtag

SEQ ID NO: 164585 - DNA, 7 bp, Unknown
  misc_feature (1)..( 7): Result.004 file - promoters50/1035155
tatgtat

SEQ ID NO: 164586 - DNA, 7 bp, Unknown
  misc_feature (1)..( 7): Result.004 file - promoters50/1035155
tatttag

SEQ ID NO: 164587 - DNA, 7 bp, Unknown
  misc_feature (1)..( 7): Result.004 file - promoters50/1035155
cattttt

SEQ ID NO: 164588 - DNA, 11 bp, Unknown
  misc_feature (1)..( 11): Result.004 file - promoters50/1035155
aaatcaaattg

SEQ ID NO: 164589 - DNA, 11 bp, Unknown
  misc_feature (1)..( 11): Result.004 file - promoters50/1035155
aaaacaaaaca

SEQ ID NO: 164590 - DNA, 12 bp, Unknown
  misc_feature (1)..( 12): Result.004 file - promoters50/1035155
aaacacaataca

SEQ ID NO: 164591 - DNA, 12 bp, Unknown
  misc_feature (1)..( 12): Result.004 file - promoters50/1035160
cgacacaaatat

SEQ ID NO: 164592 - DNA, 10 bp, Unknown
  misc_feature (1)..( 10): Result.004 file - promoters50/1035160
ataatttatt

SEQ ID NO: 164593 - DNA, 10 bp, Unknown
  misc_feature (1)..( 10): Result.004 file - promoters50/1035160
ttaatttcat

SEQ ID NO: 164594 - DNA, 10 bp, Unknown
  misc_feature (1)..( 10): Result.004 file - promoters50/1035160
gcaatttaga

SEQ ID NO: 164595 - DNA, 10 bp, Unknown
  misc_feature (1)..( 10): Result.004 file - promoters50/1035160
ttaagttata

SEQ ID NO: 164596 - DNA, 10 bp, Unknown
  misc_feature (1)..( 10): Result.004 file - promoters50/1035160
ttaagtcaat

SEQ ID NO: 164597 - DNA, 10 bp, Unknown
  misc_feature (1)..( 10): Result.004 file - promoters50/1035172
caaatttcat

SEQ ID NO: 164598 - DNA, 8 bp, Unknown
  misc_feature (1)..( 8): Result.004 file - promoters50/1035172
aaaaatta

SEQ ID NO: 164599 - DNA, 8 bp, Unknown
  misc_feature (1)..( 8): Result.004 file - promoters50/1035172
gaaaatta

SEQ ID NO: 164600 - DNA, 8 bp, Unknown
  misc_feature (1)..( 8): Result.004 file - promoters50/1035172
aaaaatag

SEQ ID NO: 164601 - DNA, 8 bp, Unknown
  misc_feature (1)..( 8): Result.004 file - promoters50/1035172
aataataa

SEQ ID NO: 164602 - DNA, 8 bp, Unknown
  misc_feature (1)..( 8): Result.004 file - promoters50/1035172
aataatta

SEQ ID NO: 164603 - DNA, 8 bp, Unknown
  misc_feature (1)..( 8): Result.004 file - promoters50/1035172
aaacatag

SEQ ID NO: 164604 - DNA, 17 bp, Unknown
  misc_feature (1)..( 17): Result.004 file - promoters50/1035172
tcttttctctctataaa

SEQ ID NO: 164605 - DNA, 17 bp, Unknown
  misc_feature (1)..( 17): Result.004 file - promoters50/1035172
acttttgtctatataac

SEQ ID NO: 164606 - DNA, 17 bp, Unknown
  misc_feature (1)..( 17): Result.004 file - promoters50/1035172
tctcttcttcattgaac

SEQ ID NO: 164607 - DNA, 17 bp, Unknown
  misc_feature (1)..( 17): Result.004 file - promoters50/1035172
cactagtgtcctataaa

SEQ ID NO: 164608 - DNA, 17 bp, Unknown
  misc_feature (1)..( 17): Result.004 file - promoters50/1035172
gcttatcttttataatt

SEQ ID NO: 164609 - DNA, 17 bp, Unknown
  misc_feature (1)..( 17): Result.004 file - promoters50/1035172
tattttgtatatttata

SEQ ID NO: 164610 - DNA, 17 bp, Unknown
  misc_feature (1)..( 17): Result.004 file - promoters50/1035194
cccttcctatatttaaa

SEQ ID NO: 164611 - DNA, 10 bp, Unknown
  misc_feature (1)..( 10): Result.004 file - promoters50/1035194
aaaataaaat

SEQ ID NO: 164612 - DNA, 10 bp, Unknown
  misc_feature (1)..( 10): Result.004 file - promoters50/1035194
tgtatataat

SEQ ID NO: 164613 - DNA, 10 bp, Unknown
  misc_feature (1)..( 10): Result.004 file - promoters50/1035194
tgaatacaat

SEQ ID NO: 164614 - DNA, 10 bp, Unknown
  misc_feature (1)..( 10): Result.004 file - promoters50/1035194
aaaataaaat

SEQ ID NO: 164615 - DNA, 10 bp, Unknown
  misc_feature (1)..( 10): Result.004 file - promoters50/1035267
aaaaaaaaaa

SEQ ID NO: 164616 - DNA, 8 bp, Unknown
  misc_feature (1)..( 8): Result.004 file - promoters50/1035267
tcaaataa

SEQ ID NO: 164617 - DNA, 8 bp, Unknown
  misc_feature (1)..( 8): Result.004 file - promoters50/1035267
aaaaataa

SEQ ID NO: 164618 - DNA, 8 bp, Unknown
  misc_feature (1)..( 8): Result.004 file - promoters50/1035267
tcacatag

SEQ ID NO: 164619 - DNA, 10 bp, Unknown
  misc_feature (1)..( 10): Result.004 file - promoters50/1035267
ccacagaaac

SEQ ID NO: 164620 - DNA, 10 bp, Unknown
  misc_feature (1)..( 10): Result.004 file - promoters50/1035267
ccacagcgtt

SEQ ID NO: 164621 - DNA, 10 bp, Unknown
  misc_feature (1)..( 10): Result.004 file - promoters50/1035267
tcacagatgt

SEQ ID NO: 164622 - DNA, 10 bp, Unknown
  misc_feature (1)..( 10): Result.004 file - promoters50/1035306
acacatcaca

SEQ ID NO: 164623 - DNA, 13 bp, Unknown
  misc_feature (1)..( 13): Result.004 file - promoters50/1035306
ttcatattaaaaa

SEQ ID NO: 164624 - DNA, 13 bp, Unknown
  misc_feature (1)..( 13): Result.004 file - promoters50/1035306
cggataataagag

SEQ ID NO: 164625 - DNA, 13 bp, Unknown
  misc_feature (1)..( 13): Result.004 file - promoters50/1035306
cgtatattatgga

SEQ ID NO: 164626 - DNA, 13 bp, Unknown
  misc_feature (1)..( 13): Result.004 file - promoters50/1035306
ttcatactaaaaa

SEQ ID NO: 164627 - DNA, 13 bp, Unknown
  misc_feature (1)..( 13): Result.004 file - promoters50/1035306
gatctttaaaaaa

SEQ ID NO: 164628 - DNA, 13 bp, Unknown
  misc_feature (1)..( 13): Result.004 file - promoters50/1035306
ttactttaaaaaa

SEQ ID NO: 164629 - DNA, 13 bp, Unknown
  misc_feature (1)..( 13): Result.004 file - promoters50/1035306
aatcattagtcga

SEQ ID NO: 164630 - DNA, 13 bp, Unknown
  misc_feature (1)..( 13): Result.004 file - promoters50/1035306
aataattgacgtt

SEQ ID NO: 164631 - DNA, 13 bp, Unknown
  misc_feature (1)..( 13): Result.004 file - promoters50/1035306
aaatttataaaat

SEQ ID NO: 164632 - DNA, 13 bp, Unknown
  misc_feature (1)..( 13): Result.004 file - promoters50/1035306
ttatttataaaat

SEQ ID NO: 164633 - DNA, 13 bp, Unknown
  misc_feature (1)..( 13): Result.004 file - promoters50/1035306
ctaaaaataaaaa

SEQ ID NO: 164634 - DNA, 13 bp, Unknown
  misc_feature (1)..( 13): Result.004 file - promoters50/1035312
ttacttattttcg

SEQ ID NO: 164635 - DNA, 11 bp, Unknown
  misc_feature (1)..( 11): Result.004 file - promoters50/1035312
tatatcaaaaa

SEQ ID NO: 164636 - DNA, 11 bp, Unknown
  misc_feature (1)..( 11): Result.004 file - promoters50/1035312
tgaatcaaaac

SEQ ID NO: 164637 - DNA, 11 bp, Unknown
  misc_feature (1)..( 11): Result.004 file - promoters50/1035312
gaaaccaaaac

SEQ ID NO: 164638 - DNA, 11 bp, Unknown
  misc_feature (1)..( 11): Result.004 file - promoters50/1035312
ctaatgaaaat

SEQ ID NO: 164639 - DNA, 11 bp, Unknown
  misc_feature (1)..( 11): Result.004 file - promoters50/1035312
catgtcaaaaa

SEQ ID NO: 164640 - DNA, 11 bp, Unknown
  misc_feature (1)..( 11): Result.004 file - promoters50/1035312
ctagtgataca

SEQ ID NO: 164641 - DNA, 12 bp, Unknown
  misc_feature (1)..( 12): Result.004 file - promoters50/1035312
attcggcccata

SEQ ID NO: 164642 - DNA, 12 bp, Unknown
  misc_feature (1)..( 12): Result.004 file - promoters50/1035312
attgggcccaat

SEQ ID NO: 164643 - DNA, 12 bp, Unknown
  misc_feature (1)..( 12): Result.004 file - promoters50/1035312
ccctggcccata

SEQ ID NO: 164644 - DNA, 12 bp, Unknown
  misc_feature (1)..( 12): Result.004 file - promoters50/1035312
attaggctttaa

SEQ ID NO: 164645 - DNA, 12 bp, Unknown
  misc_feature (1)..( 12): Result.004 file - promoters50/1035312
tatgggccttat

SEQ ID NO: 164646 - DNA, 12 bp, Unknown
  misc_feature (1)..( 12): Result.004 file - promoters50/1035312
actaggcctaat

SEQ ID NO: 164647 - DNA, 8 bp, Unknown
  misc_feature (1)..( 8): Result.004 file - promoters50/1035312
atttgagc

SEQ ID NO: 164648 - DNA, 8 bp, Unknown
  misc_feature (1)..( 8): Result.004 file - promoters50/1035312
atttgatt

SEQ ID NO: 164649 - DNA, 8 bp, Unknown
  misc_feature (1)..( 8): Result.004 file - promoters50/1035312
atttgatc

SEQ ID NO: 164650 - DNA, 8 bp, Unknown
  misc_feature (1)..( 8): Result.004 file - promoters50/1035312
atttgaaa

SEQ ID NO: 164651 - DNA, 8 bp, Unknown
  misc_feature (1)..( 8): Result.004 file - promoters50/1035312
ttttgaaa

SEQ ID NO: 164652 - DNA, 8 bp, Unknown
  misc_feature (1)..( 8): Result.004 file - promoters50/1035315
gtttgata

SEQ ID NO: 164653 - DNA, 8 bp, Unknown
  misc_feature (1)..( 8): Result.004 file - promoters50/1035315
tattgatt

SEQ ID NO: 164654 - DNA, 8 bp, Unknown
  misc_feature (1)..( 8): Result.004 file - promoters50/1035315
aattgatt

SEQ ID NO: 164655 - DNA, 8 bp, Unknown
  misc_feature (1)..( 8): Result.004 file - promoters50/1035507
aattgaga

SEQ ID NO: 164656 - DNA, 11 bp, Unknown
  misc_feature (1)..( 11): Result.004 file - promoters50/1035507
tttcagtttcc

SEQ ID NO: 164657 - DNA, 11 bp, Unknown
  misc_feature (1)..( 11): Result.004 file - promoters50/1035507
tttcatttttt

SEQ ID NO: 164658 - DNA, 12 bp, Unknown
  misc_feature (1)..( 12): Result.004 file - promoters50/1035507
gctaattatttt

SEQ ID NO: 164659 - DNA, 12 bp, Unknown
  misc_feature (1)..( 12): Result.004 file - promoters50/1035507
caagatttttca

SEQ ID NO: 164660 - DNA, 11 bp, Unknown
  misc_feature (1)..( 11): Result.004 file - promoters50/1035507
ttgaagaatgt

SEQ ID NO: 164661 - DNA, 11 bp, Unknown
  misc_feature (1)..( 11): Result.004 file - promoters50/1035507
gtgatgaatca

SEQ ID NO: 164662 - DNA, 11 bp, Unknown
  misc_feature (1)..( 11): Result.004 file - promoters50/1035507
gtgttgagcta

SEQ ID NO: 164663 - DNA, 11 bp, Unknown
  misc_feature (1)..( 11): Result.004 file - promoters50/1035507
ccattgagtca

SEQ ID NO: 164664 - DNA, 8 bp, Unknown
  misc_feature (1)..( 8): Result.004 file - promoters50/1035507
cataaaac

SEQ ID NO: 164665 - DNA, 8 bp, Unknown
  misc_feature (1)..( 8): Result.004 file - promoters50/1035507
cattaaag

SEQ ID NO: 164666 - DNA, 8 bp, Unknown
  misc_feature (1)..( 8): Result.004 file - promoters50/1035507
tataaaaa

SEQ ID NO: 164667 - DNA, 8 bp, Unknown
  misc_feature (1)..( 8): Result.004 file - promoters50/1035507
tctaaaaa

SEQ ID NO: 164668 - DNA, 8 bp, Unknown
  misc_feature (1)..( 8): Result.004 file - promoters50/1035507
ttcaattg

SEQ ID NO: 164669 - DNA, 8 bp, Unknown
  misc_feature (1)..( 8): Result.004 file - promoters50/1035507
ttcaattt

SEQ ID NO: 164670 - DNA, 8 bp, Unknown
  misc_feature (1)..( 8): Result.004 file - promoters50/1035507
acaaattg

SEQ ID NO: 164671 - DNA, 8 bp, Unknown
  misc_feature (1)..( 8): Result.004 file - promoters50/1035632
acaaatgg

SEQ ID NO: 164672 - DNA, 11 bp, Unknown
  misc_feature (1)..( 11): Result.004 file - promoters50/1035632
ctagagagaat

SEQ ID NO: 164673 - DNA, 11 bp, Unknown
  misc_feature (1)..( 11): Result.004 file - promoters50/1035632
ctacagatgtc

SEQ ID NO: 164674 - DNA, 11 bp, Unknown
  misc_feature (1)..( 11): Result.004 file - promoters50/1035632
atagaaagaaa

SEQ ID NO: 164675 - DNA, 11 bp, Unknown
  misc_feature (1)..( 11): Result.004 file - promoters50/1035632
atataaattag

SEQ ID NO: 164676 - DNA, 11 bp, Unknown
  misc_feature (1)..( 11): Result.004 file - promoters50/1035632
atataaagaaa

SEQ ID NO: 164677 - DNA, 11 bp, Unknown
  misc_feature (1)..( 11): Result.004 file - promoters50/1035636
taataaagtgt

SEQ ID NO: 164678 - DNA, 12 bp, Unknown
  misc_feature (1)..( 12): Result.004 file - promoters50/1035636
atgataacagtc

SEQ ID NO: 164679 - DNA, 12 bp, Unknown
  misc_feature (1)..( 12): Result.004 file - promoters50/1035636
atggtaaccact

SEQ ID NO: 164680 - DNA, 12 bp, Unknown
  misc_feature (1)..( 12): Result.004 file - promoters50/1035636
aatataacggtc

SEQ ID NO: 164681 - DNA, 12 bp, Unknown
  misc_feature (1)..( 12): Result.004 file - promoters50/1035636
atgatatataga

SEQ ID NO: 164682 - DNA, 10 bp, Unknown
  misc_feature (1)..( 10): Result.004 file - promoters50/1035636
cagtctgatg

SEQ ID NO: 164683 - DNA, 10 bp, Unknown
  misc_feature (1)..( 10): Result.004 file - promoters50/1035636
gagtttgaat

SEQ ID NO: 164684 - DNA, 10 bp, Unknown
  misc_feature (1)..( 10): Result.004 file - promoters50/1035636
gagttttaat

SEQ ID NO: 164685 - DNA, 9 bp, Unknown
  misc_feature (1)..( 9): Result.004 file - promoters50/1035636
aaaataaaa

SEQ ID NO: 164686 - DNA, 9 bp, Unknown
  misc_feature (1)..( 9): Result.004 file - promoters50/1035636
aaaattaaa

SEQ ID NO: 164687 - DNA, 9 bp, Unknown
  misc_feature (1)..( 9): Result.004 file - promoters50/1035636
aaaagaaaa

SEQ ID NO: 164688 - DNA, 8 bp, Unknown
  misc_feature (1)..( 8): Result.004 file - promoters50/1035636
ttttgttt

SEQ ID NO: 164689 - DNA, 8 bp, Unknown
  misc_feature (1)..( 8): Result.004 file - promoters50/1035636
cttttttt

SEQ ID NO: 164690 - DNA, 8 bp, Unknown
  misc_feature (1)..( 8): Result.004 file - promoters50/1035636
cttttttt

SEQ ID NO: 164691 - DNA, 9 bp, Unknown
  misc_feature (1)..( 9): Result.004 file - promoters50/1035636
aatatattg

SEQ ID NO: 164692 - DNA, 9 bp, Unknown
  misc_feature (1)..( 9): Result.004 file - promoters50/1035636
aatttattt

SEQ ID NO: 164693 - DNA, 9 bp, Unknown
  misc_feature (1)..( 9): Result.004 file - promoters50/1035636
agttttttt

SEQ ID NO: 164694 - DNA, 9 bp, Unknown
  misc_feature (1)..( 9): Result.004 file - promoters50/1035636
aaaagatgt

SEQ ID NO: 164695 - DNA, 9 bp, Unknown
  misc_feature (1)..( 9): Result.004 file - promoters50/1035636
aaaaaatgt

SEQ ID NO: 164696 - DNA, 9 bp, Unknown
  misc_feature (1)..( 9): Result.004 file - promoters50/1035636
aaaaaaaaa

SEQ ID NO: 164697 - DNA, 8 bp, Unknown
  misc_feature (1)..( 8): Result.004 file - promoters50/1035636
gatcaaaa

SEQ ID NO: 164698 - DNA, 8 bp, Unknown
  misc_feature (1)..( 8): Result.004 file - promoters50/1035636
gattaaat

SEQ ID NO: 164699 - DNA, 8 bp, Unknown
  misc_feature (1)..( 8): Result.004 file - promoters50/1035636
attcaaaa

SEQ ID NO: 164700 - DNA, 7 bp, Unknown
  misc_feature (1)..( 7): Result.004 file - promoters50/1035636
ttacaaa

SEQ ID NO: 164701 - DNA, 7 bp, Unknown
  misc_feature (1)..( 7): Result.004 file - promoters50/1035636
ttacaac

SEQ ID NO: 164702 - DNA, 7 bp, Unknown
  misc_feature (1)..( 7): Result.004 file - promoters50/1035636
ttaaaac

SEQ ID NO: 164703 - DNA, 9 bp, Unknown
  misc_feature (1)..( 9): Result.004 file - promoters50/1035636
ataaaaact

SEQ ID NO: 164704 - DNA, 9 bp, Unknown
  misc_feature (1)..( 9): Result.004 file - promoters50/1035636
ataaaagaa

SEQ ID NO: 164705 - DNA, 9 bp, Unknown
  misc_feature (1)..( 9): Result.004 file - promoters50/1035636
ttaaatgaa

SEQ ID NO: 164706 - DNA, 11 bp, Unknown
  misc_feature (1)..( 11): Result.004 file - promoters50/1035636
cgaataaatta

SEQ ID NO: 164707 - DNA, 11 bp, Unknown
  misc_feature (1)..( 11): Result.004 file - promoters50/1035636
tccataaattc

SEQ ID NO: 164708 - DNA, 11 bp, Unknown
  misc_feature (1)..( 11): Result.004 file - promoters50/1035651
aaaagaaaaaa

SEQ ID NO: 164709 - DNA, 9 bp, Unknown
  misc_feature (1)..( 9): Result.004 file - promoters50/1035651
tttcttctc

SEQ ID NO: 164710 - DNA, 9 bp, Unknown
  misc_feature (1)..( 9): Result.004 file - promoters50/1035651
tttcttcca

SEQ ID NO: 164711 - DNA, 9 bp, Unknown
  misc_feature (1)..( 9): Result.004 file - promoters50/1035651
catcttctc

SEQ ID NO: 164712 - DNA, 11 bp, Unknown
  misc_feature (1)..( 11): Result.004 file - promoters50/1035651
gatggttcaca

SEQ ID NO: 164713 - DNA, 11 bp, Unknown
  misc_feature (1)..( 11): Result.004 file - promoters50/1035651
gatggttcaca

SEQ ID NO: 164714 - DNA, 11 bp, Unknown
  misc_feature (1)..( 11): Result.004 file - promoters50/1035665
tttggttctac

SEQ ID NO: 164715 - DNA, 8 bp, Unknown
  misc_feature (1)..( 8): Result.004 file - promoters50/1035665
taagttaa

SEQ ID NO: 164716 - DNA, 8 bp, Unknown
  misc_feature (1)..( 8): Result.004 file - promoters50/1035665
taaattat

SEQ ID NO: 164717 - DNA, 8 bp, Unknown
  misc_feature (1)..( 8): Result.004 file - promoters50/1035665
taatttat

SEQ ID NO: 164718 - DNA, 8 bp, Unknown
  misc_feature (1)..( 8): Result.004 file - promoters50/1035665
gaagttac

SEQ ID NO: 164719 - DNA, 8 bp, Unknown
  misc_feature (1)..( 8): Result.004 file - promoters50/1035665
taatttat

SEQ ID NO: 164720 - DNA, 8 bp, Unknown
  misc_feature (1)..( 8): Result.004 file - promoters50/1035665
taatatat

SEQ ID NO: 164721 - DNA, 8 bp, Unknown
  misc_feature (1)..( 8): Result.004 file - promoters50/1035665
tatatgag

SEQ ID NO: 164722 - DNA, 9 bp, Unknown
  misc_feature (1)..( 9): Result.004 file - promoters50/1035665
ccatcttaa

SEQ ID NO: 164723 - DNA, 9 bp, Unknown
  misc_feature (1)..( 9): Result.004 file - promoters50/1035665
acatgttat

SEQ ID NO: 164724 - DNA, 9 bp, Unknown
  misc_feature (1)..( 9): Result.004 file - promoters50/1035665
tcatcttct

SEQ ID NO: 164725 - DNA, 9 bp, Unknown
  misc_feature (1)..( 9): Result.004 file - promoters50/1035665
ccatattaa

SEQ ID NO: 164726 - DNA, 9 bp, Unknown
  misc_feature (1)..( 9): Result.004 file - promoters50/1035665
atatcttct

SEQ ID NO: 164727 - DNA, 9 bp, Unknown
  misc_feature (1)..( 9): Result.004 file - promoters50/1035665
aaataataa

SEQ ID NO: 164728 - DNA, 12 bp, Unknown
  misc_feature (1)..( 12): Result.004 file - promoters50/1035665
atgcattttaat

SEQ ID NO: 164729 - DNA, 12 bp, Unknown
  misc_feature (1)..( 12): Result.004 file - promoters50/1035665
ttgcgtttacat

SEQ ID NO: 164730 - DNA, 13 bp, Unknown
  misc_feature (1)..( 13): Result.004 file - promoters50/1035665
atccatattaacc

SEQ ID NO: 164731 - DNA, 13 bp, Unknown
  misc_feature (1)..( 13): Result.004 file - promoters50/1035665
ttgtgtttactag

SEQ ID NO: 164732 - DNA, 13 bp, Unknown
  misc_feature (1)..( 13): Result.004 file - promoters50/1035665
tcgtgtttaatat

SEQ ID NO: 164733 - DNA, 13 bp, Unknown
  misc_feature (1)..( 13): Result.004 file - promoters50/1375217
aatgaaataataa

SEQ ID NO: 164734 - DNA, 11 bp, Unknown
  misc_feature (1)..( 11): Result.004 file - promoters50/1375217
gtgtttttttc

SEQ ID NO: 164735 - DNA, 11 bp, Unknown
  misc_feature (1)..( 11): Result.004 file - promoters50/1375217
atgtttgttta

SEQ ID NO: 164736 - DNA, 11 bp, Unknown
  misc_feature (1)..( 11): Result.004 file - promoters50/1375217
gtttctgtttc

SEQ ID NO: 164737 - DNA, 11 bp, Unknown
  misc_feature (1)..( 11): Result.004 file - promoters50/1375217
acttttgtttc

SEQ ID NO: 164738 - DNA, 11 bp, Unknown
  misc_feature (1)..( 11): Result.004 file - promoters50/1375217
cactttttttg

SEQ ID NO: 164739 - DNA, 11 bp, Unknown
  misc_feature (1)..( 11): Result.004 file - promoters50/1375217
ttatttcttta

SEQ ID NO: 164740 - DNA, 11 bp, Unknown
  misc_feature (1)..( 11): Result.004 file - promoters50/1375217
acatttttttc

SEQ ID NO: 164741 - DNA, 11 bp, Unknown
  misc_feature (1)..( 11): Result.004 file - promoters50/1375217
ttatatcttat

SEQ ID NO: 164742 - DNA, 10 bp, Unknown
  misc_feature (1)..( 10): Result.004 file - promoters50/1375217
ttaatcaatg

SEQ ID NO: 164743 - DNA, 10 bp, Unknown
  misc_feature (1)..( 10): Result.004 file - promoters50/1375217
aaaatcaaga

SEQ ID NO: 164744 - DNA, 10 bp, Unknown
  misc_feature (1)..( 10): Result.004 file - promoters50/1375217
aaaatcaaat

SEQ ID NO: 164745 - DNA, 10 bp, Unknown
  misc_feature (1)..( 10): Result.004 file - promoters50/1375217
ataataaaga

SEQ ID NO: 164746 - DNA, 10 bp, Unknown
  misc_feature (1)..( 10): Result.004 file - promoters50/1375217
gaaaacaatc

SEQ ID NO: 164747 - DNA, 10 bp, Unknown
  misc_feature (1)..( 10): Result.004 file - promoters50/1375217
ataataaaaa

SEQ ID NO: 164748 - DNA, 10 bp, Unknown
  misc_feature (1)..( 10): Result.004 file - promoters50/1375217
taaaccaatg

SEQ ID NO: 164749 - DNA, 9 bp, Unknown
  misc_feature (1)..( 9): Result.004 file - promoters50/1375217
aaatttaca

SEQ ID NO: 164750 - DNA, 9 bp, Unknown
  misc_feature (1)..( 9): Result.004 file - promoters50/1375217
aaagttaaa

SEQ ID NO: 164751 - DNA, 9 bp, Unknown
  misc_feature (1)..( 9): Result.004 file - promoters50/1375217
aaatttttg

SEQ ID NO: 164752 - DNA, 9 bp, Unknown
  misc_feature (1)..( 9): Result.004 file - promoters50/1375217
atagttaaa

SEQ ID NO: 164753 - DNA, 9 bp, Unknown
  misc_feature (1)..( 9): Result.004 file - promoters50/1375217
ctagttaat

SEQ ID NO: 164754 - DNA, 10 bp, Unknown
  misc_feature (1)..( 10): Result.004 file - promoters50/1375217
taatctttac

SEQ ID NO: 164755 - DNA, 11 bp, Unknown
  misc_feature (1)..( 11): Result.004 file - promoters50/1375217
gaaaaacaaac

SEQ ID NO: 164756 - DNA, 11 bp, Unknown
  misc_feature (1)..( 11): Result.004 file - promoters50/1375217
tttaaaaaaag

SEQ ID NO: 164757 - DNA, 11 bp, Unknown
  misc_feature (1)..( 11): Result.004 file - promoters50/1375217
tcaaaacaatt

SEQ ID NO: 164758 - DNA, 11 bp, Unknown
  misc_feature (1)..( 11): Result.004 file - promoters50/1375217
tataaataaat

SEQ ID NO: 164759 - DNA, 11 bp, Unknown
  misc_feature (1)..( 11): Result.004 file - promoters50/1375217
ttaagaaaagc

SEQ ID NO: 164760 - DNA, 11 bp, Unknown
  misc_feature (1)..( 11): Result.004 file - promoters50/1375252
tggtcataaat

SEQ ID NO: 164761 - DNA, 19 bp, Unknown
  misc_feature (1)..( 19): Result.004 file - promoters50/1375252
ttcttgatgtaaatgcaga

SEQ ID NO: 164762 - DNA, 19 bp, Unknown
  misc_feature (1)..( 19): Result.004 file - promoters50/1375252
cctcaaatgcaaacgcagc

SEQ ID NO: 164763 - DNA, 19 bp, Unknown
  misc_feature (1)..( 19): Result.004 file - promoters50/1375252
ttcatgatttaaattatta

SEQ ID NO: 164764 - DNA, 19 bp, Unknown
  misc_feature (1)..( 19): Result.004 file - promoters50/1375252
ctattgatttgttcctcca

SEQ ID NO: 164765 - DNA, 19 bp, Unknown
  misc_feature (1)..( 19): Result.004 file - promoters50/1375252
tctagtcttgaattgttcc

SEQ ID NO: 164766 - DNA, 19 bp, Unknown
  misc_feature (1)..( 19): Result.004 file - promoters50/1375255
tttgtgatttggtgacata

SEQ ID NO: 164767 - DNA, 10 bp, Unknown
  misc_feature (1)..( 10): Result.004 file - promoters50/1375255
gtttaaaaag

SEQ ID NO: 164768 - DNA, 10 bp, Unknown
  misc_feature (1)..( 10): Result.004 file - promoters50/1375255
tattaacaag

SEQ ID NO: 164769 - DNA, 10 bp, Unknown
  misc_feature (1)..( 10): Result.004 file - promoters50/1375255
ttttaaagta

SEQ ID NO: 164770 - DNA, 10 bp, Unknown
  misc_feature (1)..( 10): Result.004 file - promoters50/1375305
gtttgaagat

SEQ ID NO: 164771 - DNA, 10 bp, Unknown
  misc_feature (1)..( 10): Result.004 file - promoters50/1375305
attggttaat

SEQ ID NO: 164772 - DNA, 10 bp, Unknown
  misc_feature (1)..( 10): Result.004 file - promoters50/1375305
attggataat

SEQ ID NO: 164773 - DNA, 10 bp, Unknown
  misc_feature (1)..( 10): Result.004 file - promoters50/1375305
attggagaga

SEQ ID NO: 164774 - DNA, 8 bp, Unknown
  misc_feature (1)..( 8): Result.004 file - promoters50/1375305
caaagaaa

SEQ ID NO: 164775 - DNA, 8 bp, Unknown
  misc_feature (1)..( 8): Result.004 file - promoters50/1375305
caaataaa

SEQ ID NO: 164776 - DNA, 8 bp, Unknown
  misc_feature (1)..( 8): Result.004 file - promoters50/1375347
gagagaga

SEQ ID NO: 164777 - DNA, 7 bp, Unknown
  misc_feature (1)..( 7): Result.004 file - promoters50/1375347
tcatatg

SEQ ID NO: 164778 - DNA, 7 bp, Unknown
  misc_feature (1)..( 7): Result.004 file - promoters50/1375347
tcatata

SEQ ID NO: 164779 - DNA, 7 bp, Unknown
  misc_feature (1)..( 7): Result.004 file - promoters50/1375456
acatata

SEQ ID NO: 164780 - DNA, 9 bp, Unknown
  misc_feature (1)..( 9): Result.004 file - promoters50/1375456
ttggaacaa

SEQ ID NO: 164781 - DNA, 9 bp, Unknown
  misc_feature (1)..( 9): Result.004 file - promoters50/1375456
ttggaaaag

SEQ ID NO: 164782 - DNA, 9 bp, Unknown
  misc_feature (1)..( 9): Result.004 file - promoters50/1375456
ttgaaacaa

SEQ ID NO: 164783 - DNA, 9 bp, Unknown
  misc_feature (1)..( 9): Result.004 file - promoters50/1375456
agaaagaag

SEQ ID NO: 164784 - DNA, 9 bp, Unknown
  misc_feature (1)..( 9): Result.004 file - promoters50/1375456
agaaagctt

SEQ ID NO: 164785 - DNA, 9 bp, Unknown
  misc_feature (1)..( 9): Result.004 file - promoters50/1375456
tgaaacaaa

SEQ ID NO: 164786 - DNA, 9 bp, Unknown
  misc_feature (1)..( 9): Result.004 file - promoters50/1375456
agaaagaag

SEQ ID NO: 164787 - DNA, 9 bp, Unknown
  misc_feature (1)..( 9): Result.004 file - promoters50/1375456
gaaaagaaa

SEQ ID NO: 164788 - DNA, 10 bp, Unknown
  misc_feature (1)..( 10): Result.004 file - promoters50/1375456
ggaaatgaaa

SEQ ID NO: 164789 - DNA, 11 bp, Unknown
  misc_feature (1)..( 11): Result.004 file - promoters50/1375456
gaagtatagaa

SEQ ID NO: 164790 - DNA, 11 bp, Unknown
  misc_feature (1)..( 11): Result.004 file - promoters50/1375456
gaaatatctta

SEQ ID NO: 164791 - DNA, 11 bp, Unknown
  misc_feature (1)..( 11): Result.004 file - promoters50/1375471
aaaataaaata

SEQ ID NO: 164792 - DNA, 12 bp, Unknown
  misc_feature (1)..( 12): Result.004 file - promoters50/1375471
tacaaaataaaa

SEQ ID NO: 164793 - DNA, 12 bp, Unknown
  misc_feature (1)..( 12): Result.004 file - promoters50/1375471
tctaaaataata

SEQ ID NO: 164794 - DNA, 12 bp, Unknown
  misc_feature (1)..( 12): Result.004 file - promoters50/1375471
tacaaaatctcc

SEQ ID NO: 164795 - DNA, 12 bp, Unknown
  misc_feature (1)..( 12): Result.004 file - promoters50/1375471
aacagaataaaa

SEQ ID NO: 164796 - DNA, 12 bp, Unknown
  misc_feature (1)..( 12): Result.004 file - promoters50/1375471
taagaaataaat

SEQ ID NO: 164797 - DNA, 12 bp, Unknown
  misc_feature (1)..( 12): Result.004 file - promoters50/1375474
aagaaaaaaatt

SEQ ID NO: 164798 - DNA, 10 bp, Unknown
  misc_feature (1)..( 10): Result.004 file - promoters50/1375474
ttatttgttc

SEQ ID NO: 164799 - DNA, 10 bp, Unknown
  misc_feature (1)..( 10): Result.004 file - promoters50/1375474
cactttcttc

SEQ ID NO: 164800 - DNA, 10 bp, Unknown
  misc_feature (1)..( 10): Result.004 file - promoters50/1375474
cactctctta

SEQ ID NO: 164801 - DNA, 10 bp, Unknown
  misc_feature (1)..( 10): Result.004 file - promoters50/1375474
aaacataaaa

SEQ ID NO: 164802 - DNA, 10 bp, Unknown
  misc_feature (1)..( 10): Result.004 file - promoters50/1375474
aaacctaaat

SEQ ID NO: 164803 - DNA, 10 bp, Unknown
  misc_feature (1)..( 10): Result.004 file - promoters50/1375547
ccgcctcaat

SEQ ID NO: 164804 - DNA, 7 bp, Unknown
  misc_feature (1)..( 7): Result.004 file - promoters50/1375547
gtttatt

SEQ ID NO: 164805 - DNA, 7 bp, Unknown
  misc_feature (1)..( 7): Result.004 file - promoters50/1375547
ctttatt

SEQ ID NO: 164806 - DNA, 7 bp, Unknown
  misc_feature (1)..( 7): Result.004 file - promoters50/1375547
ctttatt

SEQ ID NO: 164807 - DNA, 7 bp, Unknown
  misc_feature (1)..( 7): Result.004 file - promoters50/1375615
gttgatt

SEQ ID NO: 164808 - DNA, 8 bp, Unknown
  misc_feature (1)..( 8): Result.004 file - promoters50/1375615
atcatatt

SEQ ID NO: 164809 - DNA, 8 bp, Unknown
  misc_feature (1)..( 8): Result.004 file - promoters50/1375615
atcatatt

SEQ ID NO: 164810 - DNA, 8 bp, Unknown
  misc_feature (1)..( 8): Result.004 file - promoters50/1375615
atcatatt

SEQ ID NO: 164811 - DNA, 7 bp, Unknown
  misc_feature (1)..( 7): Result.004 file - promoters50/1375615
gatatgt

SEQ ID NO: 164812 - DNA, 7 bp, Unknown
  misc_feature (1)..( 7): Result.004 file - promoters50/1375615
gatttgt

SEQ ID NO: 164813 - DNA, 7 bp, Unknown
  misc_feature (1)..( 7): Result.004 file - promoters50/1375615
gatttgt

SEQ ID NO: 164814 - DNA, 12 bp, Unknown
  misc_feature (1)..( 12): Result.004 file - promoters50/1375615
agtatgttgttg

SEQ ID NO: 164815 - DNA, 12 bp, Unknown
  misc_feature (1)..( 12): Result.004 file - promoters50/1375615
agtttgttcaat

SEQ ID NO: 164816 - DNA, 12 bp, Unknown
  misc_feature (1)..( 12): Result.004 file - promoters50/1375615
gatttgttcaat

SEQ ID NO: 164817 - DNA, 7 bp, Unknown
  misc_feature (1)..( 7): Result.004 file - promoters50/1375615
tgtttgt

SEQ ID NO: 164818 - DNA, 7 bp, Unknown
  misc_feature (1)..( 7): Result.004 file - promoters50/1375615
tgtttgg

SEQ ID NO: 164819 - DNA, 7 bp, Unknown
  misc_feature (1)..( 7): Result.004 file - promoters50/1375615
agtttgt

SEQ ID NO: 164820 - DNA, 7 bp, Unknown
  misc_feature (1)..( 7): Result.004 file - promoters50/1375615
gtttgtt

SEQ ID NO: 164821 - DNA, 7 bp, Unknown
  misc_feature (1)..( 7): Result.004 file - promoters50/1375615
ttttgtt

SEQ ID NO: 164822 - DNA, 7 bp, Unknown
  misc_feature (1)..( 7): Result.004 file - promoters50/1375615
gtttgtt

SEQ ID NO: 164823 - DNA, 9 bp, Unknown
  misc_feature (1)..( 9): Result.004 file - promoters50/1375615
attgtagct

SEQ ID NO: 164824 - DNA, 9 bp, Unknown
  misc_feature (1)..( 9): Result.004 file - promoters50/1375615
tttgtagtg

SEQ ID NO: 164825 - DNA, 9 bp, Unknown
  misc_feature (1)..( 9): Result.004 file - promoters50/1375634
tttgttgtg

SEQ ID NO: 164826 - DNA, 14 bp, Unknown
  misc_feature (1)..( 14): Result.004 file - promoters50/1375634
gaagtaagcatttt

SEQ ID NO: 164827 - DNA, 14 bp, Unknown
  misc_feature (1)..( 14): Result.004 file - promoters50/1375634
tttgtatgcatggt

SEQ ID NO: 164828 - DNA, 14 bp, Unknown
  misc_feature (1)..( 14): Result.004 file - promoters50/1375634
aaaggaagaagcta

SEQ ID NO: 164829 - DNA, 14 bp, Unknown
  misc_feature (1)..( 14): Result.004 file - promoters50/1375634
accacaagcatttt

SEQ ID NO: 164830 - DNA, 14 bp, Unknown
  misc_feature (1)..( 14): Result.004 file - promoters50/1375634
cctgtatggtgaag

SEQ ID NO: 164831 - DNA, 14 bp, Unknown
  misc_feature (1)..( 14): Result.004 file - promoters50/1375642
aaaggacaaaaatg

SEQ ID NO: 164832 - DNA, 8 bp, Unknown
  misc_feature (1)..( 8): Result.004 file - promoters50/1375642
ttaaaaat

SEQ ID NO: 164833 - DNA, 8 bp, Unknown
  misc_feature (1)..( 8): Result.004 file - promoters50/1375642
ttataaat

SEQ ID NO: 164834 - DNA, 8 bp, Unknown
  misc_feature (1)..( 8): Result.004 file - promoters50/1375642
agataaat

SEQ ID NO: 164835 - DNA, 11 bp, Unknown
  misc_feature (1)..( 11): Result.004 file - promoters50/1375642
ttctatttaag

SEQ ID NO: 164836 - DNA, 11 bp, Unknown
  misc_feature (1)..( 11): Result.004 file - promoters50/1375642
ctctatataat

SEQ ID NO: 164837 - DNA, 11 bp, Unknown
  misc_feature (1)..( 11): Result.004 file - promoters50/1375642
ctctataaaac

SEQ ID NO: 164838 - DNA, 11 bp, Unknown
  misc_feature (1)..( 11): Result.004 file - promoters50/1375642
caatataaaat

SEQ ID NO: 164839 - DNA, 8 bp, Unknown
  misc_feature (1)..( 8): Result.004 file - promoters50/1375642
atttaaag

SEQ ID NO: 164840 - DNA, 8 bp, Unknown
  misc_feature (1)..( 8): Result.004 file - promoters50/1375642
attaaaat

SEQ ID NO: 164841 - DNA, 8 bp, Unknown
  misc_feature (1)..( 8): Result.004 file - promoters50/1375642
aataaaat

SEQ ID NO: 164842 - DNA, 8 bp, Unknown
  misc_feature (1)..( 8): Result.004 file - promoters50/1375642
agagaatt

SEQ ID NO: 164843 - DNA, 8 bp, Unknown
  misc_feature (1)..( 8): Result.004 file - promoters50/1375642
aaagaatt

SEQ ID NO: 164844 - DNA, 8 bp, Unknown
  misc_feature (1)..( 8): Result.004 file - promoters50/1375642
aaaaaata

SEQ ID NO: 164845 - DNA, 6 bp, Unknown
  misc_feature (1)..( 6): Result.004 file - promoters50/1375642
aggaaa

SEQ ID NO: 164846 - DNA, 6 bp, Unknown
  misc_feature (1)..( 6): Result.004 file - promoters50/1375642
aggaaa

SEQ ID NO: 164847 - DNA, 7 bp, Unknown
  misc_feature (1)..( 7): Result.004 file - promoters50/1375675
aggtaaa

SEQ ID NO: 164848 - DNA, 8 bp, Unknown
  misc_feature (1)..( 8): Result.004 file - promoters50/1375675
aatcctaa

SEQ ID NO: 164849 - DNA, 8 bp, Unknown
  misc_feature (1)..( 8): Result.004 file - promoters50/1375675
aattctaa

SEQ ID NO: 164850 - DNA, 8 bp, Unknown
  misc_feature (1)..( 8): Result.004 file - promoters50/1375793
aatcttaa

SEQ ID NO: 164851 - DNA, 9 bp, Unknown
  misc_feature (1)..( 9): Result.004 file - promoters50/1375793
tgtttgttt

SEQ ID NO: 164852 - DNA, 9 bp, Unknown
  misc_feature (1)..( 9): Result.004 file - promoters50/1375793
ggtttgtaa

SEQ ID NO: 164853 - DNA, 9 bp, Unknown
  misc_feature (1)..( 9): Result.004 file - promoters50/1375801
tgttagttt

SEQ ID NO: 164854 - DNA, 9 bp, Unknown
  misc_feature (1)..( 9): Result.004 file - promoters50/1375801
gctgtgatc

SEQ ID NO: 164855 - DNA, 9 bp, Unknown
  misc_feature (1)..( 9): Result.004 file - promoters50/1375801
tttgtgatt

SEQ ID NO: 164856 - DNA, 9 bp, Unknown
  misc_feature (1)..( 9): Result.004 file - promoters50/1375801
tttgttatt

SEQ ID NO: 164857 - DNA, 9 bp, Unknown
  misc_feature (1)..( 9): Result.004 file - promoters50/1375801
aaagcaaat

SEQ ID NO: 164858 - DNA, 9 bp, Unknown
  misc_feature (1)..( 9): Result.004 file - promoters50/1375801
aaatcaaat

SEQ ID NO: 164859 - DNA, 9 bp, Unknown
  misc_feature (1)..( 9): Result.004 file - promoters50/1375801
aaaccaaac

SEQ ID NO: 164860 - DNA, 9 bp, Unknown
  misc_feature (1)..( 9): Result.004 file - promoters50/1375801
ttttatgtc

SEQ ID NO: 164861 - DNA, 9 bp, Unknown
  misc_feature (1)..( 9): Result.004 file - promoters50/1375801
ttttatgca

SEQ ID NO: 164862 - DNA, 9 bp, Unknown
  misc_feature (1)..( 9): Result.004 file - promoters50/1375832
agttaggtc

SEQ ID NO: 164863 - DNA, 9 bp, Unknown
  misc_feature (1)..( 9): Result.004 file - promoters50/1375832
ccaagaaaa

SEQ ID NO: 164864 - DNA, 9 bp, Unknown
  misc_feature (1)..( 9): Result.004 file - promoters50/1375832
ccaacaaaa

SEQ ID NO: 164865 - DNA, 9 bp, Unknown
  misc_feature (1)..( 9): Result.004 file - promoters50/1375832
agaagaaaa

SEQ ID NO: 164866 - DNA, 8 bp, Unknown
  misc_feature (1)..( 8): Result.004 file - promoters50/1375832
tgaatttt

SEQ ID NO: 164867 - DNA, 8 bp, Unknown
  misc_feature (1)..( 8): Result.004 file - promoters50/1375832
agaaattt

SEQ ID NO: 164868 - DNA, 8 bp, Unknown
  misc_feature (1)..( 8): Result.004 file - promoters50/1375832
agatattt

SEQ ID NO: 164869 - DNA, 7 bp, Unknown
  misc_feature (1)..( 7): Result.004 file - promoters50/1375832
aaataaa

SEQ ID NO: 164870 - DNA, 7 bp, Unknown
  misc_feature (1)..( 7): Result.004 file - promoters50/1375832
aaataaa

SEQ ID NO: 164871 - DNA, 7 bp, Unknown
  misc_feature (1)..( 7): Result.004 file - promoters50/1375832
aaataat

SEQ ID NO: 164872 - DNA, 8 bp, Unknown
  misc_feature (1)..( 8): Result.004 file - promoters50/1375832
caaataaa

SEQ ID NO: 164873 - DNA, 8 bp, Unknown
  misc_feature (1)..( 8): Result.004 file - promoters50/1375832
aaaataaa

SEQ ID NO: 164874 - DNA, 8 bp, Unknown
  misc_feature (1)..( 8): Result.004 file - promoters50/1375832
caagtaaa

SEQ ID NO: 164875 - DNA, 8 bp, Unknown
  misc_feature (1)..( 8): Result.004 file - promoters50/1375832
ataatagc

SEQ ID NO: 164876 - DNA, 8 bp, Unknown
  misc_feature (1)..( 8): Result.004 file - promoters50/1375832
ataataat

SEQ ID NO: 164877 - DNA, 8 bp, Unknown
  misc_feature (1)..( 8): Result.004 file - promoters50/1375832
ataacaat

SEQ ID NO: 164878 - DNA, 8 bp, Unknown
  misc_feature (1)..( 8): Result.004 file - promoters50/1375832
gaatgaac

SEQ ID NO: 164879 - DNA, 8 bp, Unknown
  misc_feature (1)..( 8): Result.004 file - promoters50/1375832
gaaagaat

SEQ ID NO: 164880 - DNA, 8 bp, Unknown
  misc_feature (1)..( 8): Result.004 file - promoters50/1375838
caaacaat

SEQ ID NO: 164881 - DNA, 9 bp, Unknown
  misc_feature (1)..( 9): Result.004 file - promoters50/1375838
taaaaataa

SEQ ID NO: 164882 - DNA, 9 bp, Unknown
  misc_feature (1)..( 9): Result.004 file - promoters50/1375838
taaacataa

SEQ ID NO: 164883 - DNA, 9 bp, Unknown
  misc_feature (1)..( 9): Result.004 file - promoters50/1375957
taaacagac

SEQ ID NO: 164884 - DNA, 16 bp, Unknown
  misc_feature (1)..( 16): Result.004 file - promoters50/1375957
taattatgatatttaa

SEQ ID NO: 164885 - DNA, 16 bp, Unknown
  misc_feature (1)..( 16): Result.004 file - promoters50/1375957
atacagtgaaattgaa

SEQ ID NO: 164886 - DNA, 16 bp, Unknown
  misc_feature (1)..( 16): Result.004 file - promoters50/1375957
aaattttgatttttaa

SEQ ID NO: 164887 - DNA, 16 bp, Unknown
  misc_feature (1)..( 16): Result.004 file - promoters50/1375957
aaattatgattaaggc

SEQ ID NO: 164888 - DNA, 16 bp, Unknown
  misc_feature (1)..( 16): Result.004 file - promoters50/1375957
tccatttaattttttg

SEQ ID NO: 164889 - DNA, 16 bp, Unknown
  misc_feature (1)..( 16): Result.004 file - promoters50/1375957
aaaggcttcttttttg

SEQ ID NO: 164890 - DNA, 16 bp, Unknown
  misc_feature (1)..( 16): Result.004 file - promoters50/1375957
ctctgtgcctttttca

SEQ ID NO: 164891 - DNA, 12 bp, Unknown
  misc_feature (1)..( 12): Result.004 file - promoters50/1375957
aataaacatagt

SEQ ID NO: 164892 - DNA, 12 bp, Unknown
  misc_feature (1)..( 12): Result.004 file - promoters50/1375957
gctaaacattag

SEQ ID NO: 164893 - DNA, 12 bp, Unknown
  misc_feature (1)..( 12): Result.004 file - promoters50/1375957
ttaaaacatgtt

SEQ ID NO: 164894 - DNA, 12 bp, Unknown
  misc_feature (1)..( 12): Result.004 file - promoters50/1375957
agataacataga

SEQ ID NO: 164895 - DNA, 12 bp, Unknown
  misc_feature (1)..( 12): Result.004 file - promoters50/1375957
aattaactctaa

SEQ ID NO: 164896 - DNA, 12 bp, Unknown
  misc_feature (1)..( 12): Result.004 file - promoters50/1375957
gttggacataga

SEQ ID NO: 164897 - DNA, 12 bp, Unknown
  misc_feature (1)..( 12): Result.004 file - promoters50/1375957
acttaactgtaa

SEQ ID NO: 164898 - DNA, 8 bp, Unknown
  misc_feature (1)..( 8): Result.004 file - promoters50/1375957
ataaaata

SEQ ID NO: 164899 - DNA, 8 bp, Unknown
  misc_feature (1)..( 8): Result.004 file - promoters50/1375957
ttaaaatg

SEQ ID NO: 164900 - DNA, 8 bp, Unknown
  misc_feature (1)..( 8): Result.004 file - promoters50/1375957
ataaaaaa

SEQ ID NO: 164901 - DNA, 8 bp, Unknown
  misc_feature (1)..( 8): Result.004 file - promoters50/1375957
ccaaaatg

SEQ ID NO: 164902 - DNA, 8 bp, Unknown
  misc_feature (1)..( 8): Result.004 file - promoters50/1375957
tcaaaatt

SEQ ID NO: 164903 - DNA, 8 bp, Unknown
  misc_feature (1)..( 8): Result.004 file - promoters50/1375957
ccaaaatt

SEQ ID NO: 164904 - DNA, 13 bp, Unknown
  misc_feature (1)..( 13): Result.004 file - promoters50/1375957
taatatattttcg

SEQ ID NO: 164905 - DNA, 13 bp, Unknown
  misc_feature (1)..( 13): Result.004 file - promoters50/1375957
aaatatatggata

SEQ ID NO: 164906 - DNA, 13 bp, Unknown
  misc_feature (1)..( 13): Result.004 file - promoters50/1375957
gtataaatttaat

SEQ ID NO: 164907 - DNA, 14 bp, Unknown
  misc_feature (1)..( 14): Result.004 file - promoters50/1375957
taatattataacct

SEQ ID NO: 164908 - DNA, 14 bp, Unknown
  misc_feature (1)..( 14): Result.004 file - promoters50/1375957
tatataaatatgcc

SEQ ID NO: 164909 - DNA, 14 bp, Unknown
  misc_feature (1)..( 14): Result.004 file - promoters50/1375957
taggcatattttaa

SEQ ID NO: 164910 - DNA, 21 bp, Unknown
  misc_feature (1)..( 21): Result.004 file - promoters50/1375957
aattatgatatttaaaataaa

SEQ ID NO: 164911 - DNA, 21 bp, Unknown
  misc_feature (1)..( 21): Result.004 file - promoters50/1375957
tgattaaggctttaaaacatg

SEQ ID NO: 164912 - DNA, 21 bp, Unknown
  misc_feature (1)..( 21): Result.004 file - promoters50/1375957
ttggtccatagataacataga

SEQ ID NO: 164913 - DNA, 21 bp, Unknown
  misc_feature (1)..( 21): Result.004 file - promoters50/1375957
aattttgatttttaatgaatt

SEQ ID NO: 164914 - DNA, 21 bp, Unknown
  misc_feature (1)..( 21): Result.004 file - promoters50/1375957
ctgtaacaattgtaaaatgtt

SEQ ID NO: 164915 - DNA, 21 bp, Unknown
  misc_feature (1)..( 21): Result.004 file - promoters50/1375957
aaagacattgttggacataga

SEQ ID NO: 164916 - DNA, 21 bp, Unknown
  misc_feature (1)..( 21): Result.004 file - promoters50/1375957
gtccttcttcaagaaagttta

SEQ ID NO: 164917 - DNA, 12 bp, Unknown
  misc_feature (1)..( 12): Result.004 file - promoters50/1375957
gtttaatgttat

SEQ ID NO: 164918 - DNA, 12 bp, Unknown
  misc_feature (1)..( 12): Result.004 file - promoters50/1375957
accaaatcttaa

SEQ ID NO: 164919 - DNA, 12 bp, Unknown
  misc_feature (1)..( 12): Result.004 file - promoters50/1375957
gttaaatgtata

SEQ ID NO: 164920 - DNA, 12 bp, Unknown
  misc_feature (1)..( 12): Result.004 file - promoters50/1375957
atttattgtttg

SEQ ID NO: 164921 - DNA, 12 bp, Unknown
  misc_feature (1)..( 12): Result.004 file - promoters50/1375957
gtaaaatgtttt

SEQ ID NO: 164922 - DNA, 12 bp, Unknown
  misc_feature (1)..( 12): Result.004 file - promoters50/1375957
agacattgttgg

SEQ ID NO: 164923 - DNA, 12 bp, Unknown
  misc_feature (1)..( 12): Result.004 file - promoters50/1375988
ttatattttaaa

SEQ ID NO: 164924 - DNA, 14 bp, Unknown
  misc_feature (1)..( 14): Result.004 file - promoters50/1375988
taattattttaaat

SEQ ID NO: 164925 - DNA, 14 bp, Unknown
  misc_feature (1)..( 14): Result.004 file - promoters50/1375988
tcaagattttaaca

SEQ ID NO: 164926 - DNA, 14 bp, Unknown
  misc_feature (1)..( 14): Result.004 file - promoters50/1375988
tcaaagttttaatt

SEQ ID NO: 164927 - DNA, 14 bp, Unknown
  misc_feature (1)..( 14): Result.004 file - promoters50/1375988
tatgaatttaaaaa

SEQ ID NO: 164928 - DNA, 14 bp, Unknown
  misc_feature (1)..( 14): Result.004 file - promoters50/1375988
tcaagattttttcc

SEQ ID NO: 164929 - DNA, 14 bp, Unknown
  misc_feature (1)..( 14): Result.004 file - promoters50/1375988
attgtatttttatt

SEQ ID NO: 164930 - DNA, 14 bp, Unknown
  misc_feature (1)..( 14): Result.004 file - promoters50/1375995
aagagcgtttaacc

SEQ ID NO: 164931 - DNA, 8 bp, Unknown
  misc_feature (1)..( 8): Result.004 file - promoters50/1375995
agtaatta

SEQ ID NO: 164932 - DNA, 8 bp, Unknown
  misc_feature (1)..( 8): Result.004 file - promoters50/1375995
agtaatta

SEQ ID NO: 164933 - DNA, 8 bp, Unknown
  misc_feature (1)..( 8): Result.004 file - promoters50/1375995
ggtattta

SEQ ID NO: 164934 - DNA, 9 bp, Unknown
  misc_feature (1)..( 9): Result.004 file - promoters50/1375995
ttaaaaaaa

SEQ ID NO: 164935 - DNA, 9 bp, Unknown
  misc_feature (1)..( 9): Result.004 file - promoters50/1375995
gaaaataaa

SEQ ID NO: 164936 - DNA, 9 bp, Unknown
  misc_feature (1)..( 9): Result.004 file - promoters50/1375995
tttaataaa

SEQ ID NO: 164937 - DNA, 6 bp, Unknown
  misc_feature (1)..( 6): Result.004 file - promoters50/1375995
taataa

SEQ ID NO: 164938 - DNA, 6 bp, Unknown
  misc_feature (1)..( 6): Result.004 file - promoters50/1375995
taataa

SEQ ID NO: 164939 - DNA, 6 bp, Unknown
  misc_feature (1)..( 6): Result.004 file - promoters50/1375995
taataa

SEQ ID NO: 164940 - DNA, 10 bp, Unknown
  misc_feature (1)..( 10): Result.004 file - promoters50/1375995
aatattaata

SEQ ID NO: 164941 - DNA, 10 bp, Unknown
  misc_feature (1)..( 10): Result.004 file - promoters50/1375995
aataataata

SEQ ID NO: 164942 - DNA, 10 bp, Unknown
  misc_feature (1)..( 10): Result.004 file - promoters50/1376069
agtaataact

SEQ ID NO: 164943 - DNA, 10 bp, Unknown
  misc_feature (1)..( 10): Result.004 file - promoters50/1376069
taatataaga

SEQ ID NO: 164944 - DNA, 10 bp, Unknown
  misc_feature (1)..( 10): Result.004 file - promoters50/1376069
taatctaatt

SEQ ID NO: 164945 - DNA, 10 bp, Unknown
  misc_feature (1)..( 10): Result.004 file - promoters50/1376069
gtttcttatt

SEQ ID NO: 164946 - DNA, 8 bp, Unknown
  misc_feature (1)..( 8): Result.004 file - promoters50/1376069
ggaataaa

SEQ ID NO: 164947 - DNA, 8 bp, Unknown
  misc_feature (1)..( 8): Result.004 file - promoters50/1376069
agaataaa

SEQ ID NO: 164948 - DNA, 8 bp, Unknown
  misc_feature (1)..( 8): Result.004 file - promoters50/1376069
agagtaat

SEQ ID NO: 164949 - DNA, 9 bp, Unknown
  misc_feature (1)..( 9): Result.004 file - promoters50/1376069
aaataatta

SEQ ID NO: 164950 - DNA, 9 bp, Unknown
  misc_feature (1)..( 9): Result.004 file - promoters50/1376069
aaagaataa

SEQ ID NO: 164951 - DNA, 9 bp, Unknown
  misc_feature (1)..( 9): Result.004 file - promoters50/1376069
ggagagtaa

SEQ ID NO: 164952 - DNA, 7 bp, Unknown
  misc_feature (1)..( 7): Result.004 file - promoters50/1376069
aaaattt

SEQ ID NO: 164953 - DNA, 7 bp, Unknown
  misc_feature (1)..( 7): Result.004 file - promoters50/1376069
aaacttt

SEQ ID NO: 164954 - DNA, 7 bp, Unknown
  misc_feature (1)..( 7): Result.004 file - promoters50/1376069
caacttt

SEQ ID NO: 164955 - DNA, 7 bp, Unknown
  misc_feature (1)..( 7): Result.004 file - promoters50/1376069
taatcta

SEQ ID NO: 164956 - DNA, 7 bp, Unknown
  misc_feature (1)..( 7): Result.004 file - promoters50/1376069
taaacta

SEQ ID NO: 164957 - DNA, 7 bp, Unknown
  misc_feature (1)..( 7): Result.004 file - promoters50/1376069
taatcta

SEQ ID NO: 164958 - DNA, 7 bp, Unknown
  misc_feature (1)..( 7): Result.004 file - promoters50/1376069
gttcttt

SEQ ID NO: 164959 - DNA, 7 bp, Unknown
  misc_feature (1)..( 7): Result.004 file - promoters50/1376069
attcttt

SEQ ID NO: 164960 - DNA, 7 bp, Unknown
  misc_feature (1)..( 7): Result.004 file - promoters50/1376069
attattt

SEQ ID NO: 164961 - DNA, 8 bp, Unknown
  misc_feature (1)..( 8): Result.004 file - promoters50/1376069
attgtgaa

SEQ ID NO: 164962 - DNA, 8 bp, Unknown
  misc_feature (1)..( 8): Result.004 file - promoters50/1376069
gttgagaa

SEQ ID NO: 164963 - DNA, 8 bp, Unknown
  misc_feature (1)..( 8): Result.004 file - promoters50/1376069
attctgaa

SEQ ID NO: 164964 - DNA, 11 bp, Unknown
  misc_feature (1)..( 11): Result.004 file - promoters50/1376069
taataaaaaat

SEQ ID NO: 164965 - DNA, 11 bp, Unknown
  misc_feature (1)..( 11): Result.004 file - promoters50/1376069
atctaaaaaaa

SEQ ID NO: 164966 - DNA, 11 bp, Unknown
  misc_feature (1)..( 11): Result.004 file - promoters50/1376340
taataaaaaat

SEQ ID NO: 164967 - DNA, 6 bp, Unknown
  misc_feature (1)..( 6): Result.004 file - promoters50/1376340
aaaaat

SEQ ID NO: 164968 - DNA, 6 bp, Unknown
  misc_feature (1)..( 6): Result.004 file - promoters50/1376340
aaaaat

SEQ ID NO: 164969 - DNA, 6 bp, Unknown
  misc_feature (1)..( 6): Result.004 file - promoters50/1376361
aaaaat

SEQ ID NO: 164970 - DNA, 11 bp, Unknown
  misc_feature (1)..( 11): Result.004 file - promoters50/1376361
tgatactattt

SEQ ID NO: 164971 - DNA, 11 bp, Unknown
  misc_feature (1)..( 11): Result.004 file - promoters50/1376361
ttatattatta

SEQ ID NO: 164972 - DNA, 11 bp, Unknown
  misc_feature (1)..( 11): Result.004 file - promoters50/1376361
tagtacaattt

SEQ ID NO: 164973 - DNA, 11 bp, Unknown
  misc_feature (1)..( 11): Result.004 file - promoters50/1376361
ttttactaact

SEQ ID NO: 164974 - DNA, 11 bp, Unknown
  misc_feature (1)..( 11): Result.004 file - promoters50/1376361
ttagattagcc

SEQ ID NO: 164975 - DNA, 11 bp, Unknown
  misc_feature (1)..( 11): Result.004 file - promoters50/1376455
tagcacaacag

SEQ ID NO: 164976 - DNA, 12 bp, Unknown
  misc_feature (1)..( 12): Result.004 file - promoters50/1376455
ctaaataaattt

SEQ ID NO: 164977 - DNA, 12 bp, Unknown
  misc_feature (1)..( 12): Result.004 file - promoters50/1376455
ttaaaaaaagaa

SEQ ID NO: 164978 - DNA, 12 bp, Unknown
  misc_feature (1)..( 12): Result.004 file - promoters50/1376455
agaaatgaattt

SEQ ID NO: 164979 - DNA, 12 bp, Unknown
  misc_feature (1)..( 12): Result.004 file - promoters50/1376455
aaaaacaaacgt

SEQ ID NO: 164980 - DNA, 12 bp, Unknown
  misc_feature (1)..( 12): Result.004 file - promoters50/1376455
ttaaaatcatcc

SEQ ID NO: 164981 - DNA, 12 bp, Unknown
  misc_feature (1)..( 12): Result.004 file - promoters50/1376455
agaaaaaggatg

SEQ ID NO: 164982 - DNA, 10 bp, Unknown
  misc_feature (1)..( 10): Result.004 file - promoters50/1376455
ttgaacaaac

SEQ ID NO: 164983 - DNA, 10 bp, Unknown
  misc_feature (1)..( 10): Result.004 file - promoters50/1376455
gtgaccaatg

SEQ ID NO: 164984 - DNA, 10 bp, Unknown
  misc_feature (1)..( 10): Result.004 file - promoters50/1376455
tcaaccaact

SEQ ID NO: 164985 - DNA, 10 bp, Unknown
  misc_feature (1)..( 10): Result.004 file - promoters50/1376455
ccgaccaagt

SEQ ID NO: 164986 - DNA, 10 bp, Unknown
  misc_feature (1)..( 10): Result.004 file - promoters50/1376455
tcaaccaatt

SEQ ID NO: 164987 - DNA, 10 bp, Unknown
  misc_feature (1)..( 10): Result.004 file - promoters50/1376455
tcaaacaatc

SEQ ID NO: 164988 - DNA, 12 bp, Unknown
  misc_feature (1)..( 12): Result.004 file - promoters50/1376455
acattgatttat

SEQ ID NO: 164989 - DNA, 12 bp, Unknown
  misc_feature (1)..( 12): Result.004 file - promoters50/1376455
caattgacttag

SEQ ID NO: 164990 - DNA, 12 bp, Unknown
  misc_feature (1)..( 12): Result.004 file - promoters50/1376455
ggattaattctt

SEQ ID NO: 164991 - DNA, 12 bp, Unknown
  misc_feature (1)..( 12): Result.004 file - promoters50/1376455
taattattttgc

SEQ ID NO: 164992 - DNA, 13 bp, Unknown
  misc_feature (1)..( 13): Result.004 file - promoters50/1376455
tcatattattagt

SEQ ID NO: 164993 - DNA, 13 bp, Unknown
  misc_feature (1)..( 13): Result.004 file - promoters50/1376455
ggcacccattaat

SEQ ID NO: 164994 - DNA, 13 bp, Unknown
  misc_feature (1)..( 13): Result.004 file - promoters50/1376455
tagtgctattatg

SEQ ID NO: 164995 - DNA, 10 bp, Unknown
  misc_feature (1)..( 10): Result.004 file - promoters50/1376455
gagaaaatta

SEQ ID NO: 164996 - DNA, 10 bp, Unknown
  misc_feature (1)..( 10): Result.004 file - promoters50/1376455
tagaaaatgc

SEQ ID NO: 164997 - DNA, 10 bp, Unknown
  misc_feature (1)..( 10): Result.004 file - promoters50/1376455
tcgaaactgc

SEQ ID NO: 164998 - DNA, 10 bp, Unknown
  misc_feature (1)..( 10): Result.004 file - promoters50/1376455
tagacaattc

SEQ ID NO: 164999 - DNA, 10 bp, Unknown
  misc_feature (1)..( 10): Result.004 file - promoters50/1376455
atgaaaatga

SEQ ID NO: 165000 - DNA, 10 bp, Unknown
  misc_feature (1)..( 10): Result.004 file - promoters50/1376490
aacaaacgaa

SEQ ID NO: 165001 - DNA, 11 bp, Unknown
  misc_feature (1)..( 11): Result.004 file - promoters50/1376490
agataaattaa

SEQ ID NO: 165002 - DNA, 11 bp, Unknown
  misc_feature (1)..( 11): Result.004 file - promoters50/1376490
taatagattat

SEQ ID NO: 165003 - DNA, 11 bp, Unknown
  misc_feature (1)..( 11): Result.004 file - promoters50/1376490
atataaattaa

SEQ ID NO: 165004 - DNA, 11 bp, Unknown
  misc_feature (1)..( 11): Result.004 file - promoters50/1376490
taatagagtcg

SEQ ID NO: 165005 - DNA, 11 bp, Unknown
  misc_feature (1)..( 11): Result.004 file - promoters50/1376490
cgatacattct

SEQ ID NO: 165006 - DNA, 10 bp, Unknown
  misc_feature (1)..( 10): Result.004 file - promoters50/1376490
catagagtac

SEQ ID NO: 165007 - DNA, 10 bp, Unknown
  misc_feature (1)..( 10): Result.004 file - promoters50/1376490
aatagattac

SEQ ID NO: 165008 - DNA, 10 bp, Unknown
  misc_feature (1)..( 10): Result.004 file - promoters50/1376490
aatagattta

SEQ ID NO: 165009 - DNA, 10 bp, Unknown
  misc_feature (1)..( 10): Result.004 file - promoters50/1376559
cataaattta

SEQ ID NO: 165010 - DNA, 10 bp, Unknown
  misc_feature (1)..( 10): Result.004 file - promoters50/1376559
gcagaggaag

SEQ ID NO: 165011 - DNA, 10 bp, Unknown
  misc_feature (1)..( 10): Result.004 file - promoters50/1376559
gcagaagaag

SEQ ID NO: 165012 - DNA, 10 bp, Unknown
  misc_feature (1)..( 10): Result.004 file - promoters50/1376650
taagaggaag

SEQ ID NO: 165013 - DNA, 12 bp, Unknown
  misc_feature (1)..( 12): Result.004 file - promoters50/1376650
aaatgaaatatc

SEQ ID NO: 165014 - DNA, 12 bp, Unknown
  misc_feature (1)..( 12): Result.004 file - promoters50/1376650
aaataaaataaa

SEQ ID NO: 165015 - DNA, 12 bp, Unknown
  misc_feature (1)..( 12): Result.004 file - promoters50/1376650
aaatggaataaa

SEQ ID NO: 165016 - DNA, 12 bp, Unknown
  misc_feature (1)..( 12): Result.004 file - promoters50/1376650
taacaaaatatt

SEQ ID NO: 165017 - DNA, 12 bp, Unknown
  misc_feature (1)..( 12): Result.004 file - promoters50/1376650
aatttaaatatt

SEQ ID NO: 165018 - DNA, 12 bp, Unknown
  misc_feature (1)..( 12): Result.004 file - promoters50/1376726
ttgaagaagatg

SEQ ID NO: 165019 - DNA, 8 bp, Unknown
  misc_feature (1)..( 8): Result.004 file - promoters50/1376726
tattttct

SEQ ID NO: 165020 - DNA, 8 bp, Unknown
  misc_feature (1)..( 8): Result.004 file - promoters50/1376726
tattctct

SEQ ID NO: 165021 - DNA, 8 bp, Unknown
  misc_feature (1)..( 8): Result.004 file - promoters50/1376726
tattttgt

SEQ ID NO: 165022 - DNA, 8 bp, Unknown
  misc_feature (1)..( 8): Result.004 file - promoters50/1376726
cattttga

SEQ ID NO: 165023 - DNA, 8 bp, Unknown
  misc_feature (1)..( 8): Result.004 file - promoters50/1376726
taataatc

SEQ ID NO: 165024 - DNA, 8 bp, Unknown
  misc_feature (1)..( 8): Result.004 file - promoters50/1376726
aaattatc

SEQ ID NO: 165025 - DNA, 8 bp, Unknown
  misc_feature (1)..( 8): Result.004 file - promoters50/1376726
taaaaata

SEQ ID NO: 165026 - DNA, 8 bp, Unknown
  misc_feature (1)..( 8): Result.004 file - promoters50/1376726
caaaaatt

SEQ ID NO: 165027 - DNA, 9 bp, Unknown
  misc_feature (1)..( 9): Result.004 file - promoters50/1376726
attagaaaa

SEQ ID NO: 165028 - DNA, 9 bp, Unknown
  misc_feature (1)..( 9): Result.004 file - promoters50/1376726
attagaact

SEQ ID NO: 165029 - DNA, 9 bp, Unknown
  misc_feature (1)..( 9): Result.004 file - promoters50/1376726
cttataaaa

SEQ ID NO: 165030 - DNA, 9 bp, Unknown
  misc_feature (1)..( 9): Result.004 file - promoters50/1376733
attataagg

SEQ ID NO: 165031 - DNA, 10 bp, Unknown
  misc_feature (1)..( 10): Result.004 file - promoters50/1376733
actttttgta

SEQ ID NO: 165032 - DNA, 10 bp, Unknown
  misc_feature (1)..( 10): Result.004 file - promoters50/1376733
actatttcta

SEQ ID NO: 165033 - DNA, 10 bp, Unknown
  misc_feature (1)..( 10): Result.004 file - promoters50/1376733
tctttttctt

SEQ ID NO: 165034 - DNA, 10 bp, Unknown
  misc_feature (1)..( 10): Result.004 file - promoters50/1376733
tttttttgta

SEQ ID NO: 165035 - DNA, 8 bp, Unknown
  misc_feature (1)..( 8): Result.004 file - promoters50/1376733
aaactgtc

SEQ ID NO: 165036 - DNA, 8 bp, Unknown
  misc_feature (1)..( 8): Result.004 file - promoters50/1376733
aaattgtc

SEQ ID NO: 165037 - DNA, 8 bp, Unknown
  misc_feature (1)..( 8): Result.004 file - promoters50/1376733
caatagtc

SEQ ID NO: 165038 - DNA, 9 bp, Unknown
  misc_feature (1)..( 9): Result.004 file - promoters50/1376733
aaagttgtc

SEQ ID NO: 165039 - DNA, 7 bp, Unknown
  misc_feature (1)..( 7): Result.004 file - promoters50/1376733
tattttc

SEQ ID NO: 165040 - DNA, 7 bp, Unknown
  misc_feature (1)..( 7): Result.004 file - promoters50/1376733
tattttt

SEQ ID NO: 165041 - DNA, 7 bp, Unknown
  misc_feature (1)..( 7): Result.004 file - promoters50/1376733
tatcttc

SEQ ID NO: 165042 - DNA, 7 bp, Unknown
  misc_feature (1)..( 7): Result.004 file - promoters50/1376737
aattttt

SEQ ID NO: 165043 - DNA, 8 bp, Unknown
  misc_feature (1)..( 8): Result.004 file - promoters50/1376737
ggtctatc

SEQ ID NO: 165044 - DNA, 8 bp, Unknown
  misc_feature (1)..( 8): Result.004 file - promoters50/1376737
ggtttatt

SEQ ID NO: 165045 - DNA, 8 bp, Unknown
  misc_feature (1)..( 8): Result.004 file - promoters50/1376737
tctttatt

SEQ ID NO: 165046 - DNA, 8 bp, Unknown
  misc_feature (1)..( 8): Result.004 file - promoters50/1376737
gtacaaag

SEQ ID NO: 165047 - DNA, 8 bp, Unknown
  misc_feature (1)..( 8): Result.004 file - promoters50/1376737
ctacaaaa

SEQ ID NO: 165048 - DNA, 8 bp, Unknown
  misc_feature (1)..( 8): Result.004 file - promoters50/1376737
ctaaaaaa

SEQ ID NO: 165049 - DNA, 10 bp, Unknown
  misc_feature (1)..( 10): Result.004 file - promoters50/1376737
taacgcatag

SEQ ID NO: 165050 - DNA, 10 bp, Unknown
  misc_feature (1)..( 10): Result.004 file - promoters50/1376737
taaagcaaaa

SEQ ID NO: 165051 - DNA, 10 bp, Unknown
  misc_feature (1)..( 10): Result.004 file - promoters50/1376859
gaaaccaaaa

SEQ ID NO: 165052 - DNA, 8 bp, Unknown
  misc_feature (1)..( 8): Result.004 file - promoters50/1376859
atcttttt

SEQ ID NO: 165053 - DNA, 8 bp, Unknown
  misc_feature (1)..( 8): Result.004 file - promoters50/1376859
atcattta

SEQ ID NO: 165054 - DNA, 8 bp, Unknown
  misc_feature (1)..( 8): Result.004 file - promoters50/1376881
atcagtta

SEQ ID NO: 165055 - DNA, 10 bp, Unknown
  misc_feature (1)..( 10): Result.004 file - promoters50/1376881
tcaacaaaaa

SEQ ID NO: 165056 - DNA, 10 bp, Unknown
  misc_feature (1)..( 10): Result.004 file - promoters50/1376881
gaaacaaaaa

SEQ ID NO: 165057 - DNA, 10 bp, Unknown
  misc_feature (1)..( 10): Result.004 file - promoters50/1376881
gaaagaaagc

SEQ ID NO: 165058 - DNA, 6 bp, Unknown
  misc_feature (1)..( 6): Result.004 file - promoters50/1376881
agtaaa

SEQ ID NO: 165059 - DNA, 6 bp, Unknown
  misc_feature (1)..( 6): Result.004 file - promoters50/1376881
agtaaa

SEQ ID NO: 165060 - DNA, 6 bp, Unknown
  misc_feature (1)..( 6): Result.004 file - promoters50/1376958
agtaaa

SEQ ID NO: 165061 - DNA, 11 bp, Unknown
  misc_feature (1)..( 11): Result.004 file - promoters50/1376958
atacatagaaa

SEQ ID NO: 165062 - DNA, 11 bp, Unknown
  misc_feature (1)..( 11): Result.004 file - promoters50/1376958
aatgatacaaa

SEQ ID NO: 165063 - DNA, 11 bp, Unknown
  misc_feature (1)..( 11): Result.004 file - promoters50/1376958
aatcatacaac

SEQ ID NO: 165064 - DNA, 11 bp, Unknown
  misc_feature (1)..( 11): Result.004 file - promoters50/1376958
gataattaaga

SEQ ID NO: 165065 - DNA, 11 bp, Unknown
  misc_feature (1)..( 11): Result.004 file - promoters50/1376958
acacattaagt

SEQ ID NO: 165066 - DNA, 11 bp, Unknown
  misc_feature (1)..( 11): Result.004 file - promoters50/1376980
acacgttaagt

SEQ ID NO: 165067 - DNA, 7 bp, Unknown
  misc_feature (1)..( 7): Result.004 file - promoters50/1376980
aaaattt

SEQ ID NO: 165068 - DNA, 7 bp, Unknown
  misc_feature (1)..( 7): Result.004 file - promoters50/1376980
aaaattt

SEQ ID NO: 165069 - DNA, 7 bp, Unknown
  misc_feature (1)..( 7): Result.004 file - promoters50/1376980
taaattt

SEQ ID NO: 165070 - DNA, 8 bp, Unknown
  misc_feature (1)..( 8): Result.004 file - promoters50/1376980
tatctaaa

SEQ ID NO: 165071 - DNA, 8 bp, Unknown
  misc_feature (1)..( 8): Result.004 file - promoters50/1376980
tatataaa

SEQ ID NO: 165072 - DNA, 8 bp, Unknown
  misc_feature (1)..( 8): Result.004 file - promoters50/1376980
tttataaa

SEQ ID NO: 165073 - DNA, 7 bp, Unknown
  misc_feature (1)..( 7): Result.004 file - promoters50/1376980
atttaat

SEQ ID NO: 165074 - DNA, 7 bp, Unknown
  misc_feature (1)..( 7): Result.004 file - promoters50/1376980
attaaat

SEQ ID NO: 165075 - DNA, 7 bp, Unknown
  misc_feature (1)..( 7): Result.004 file - promoters50/1376992
attaaac

SEQ ID NO: 165076 - DNA, 13 bp, Unknown
  misc_feature (1)..( 13): Result.004 file - promoters50/1376992
atattaatcatta

SEQ ID NO: 165077 - DNA, 13 bp, Unknown
  misc_feature (1)..( 13): Result.004 file - promoters50/1376992
ttataaatcatta

SEQ ID NO: 165078 - DNA, 13 bp, Unknown
  misc_feature (1)..( 13): Result.004 file - promoters50/1376992
atattatcacctt

SEQ ID NO: 165079 - DNA, 7 bp, Unknown
  misc_feature (1)..( 7): Result.004 file - promoters50/1376992
attaaac

SEQ ID NO: 165080 - DNA, 7 bp, Unknown
  misc_feature (1)..( 7): Result.004 file - promoters50/1376992
attaaat

SEQ ID NO: 165081 - DNA, 7 bp, Unknown
  misc_feature (1)..( 7): Result.004 file - promoters50/1376992
cttaaat

SEQ ID NO: 165082 - DNA, 7 bp, Unknown
  misc_feature (1)..( 7): Result.004 file - promoters50/1376992
gttaaat

SEQ ID NO: 165083 - DNA, 7 bp, Unknown
  misc_feature (1)..( 7): Result.004 file - promoters50/1376992
cttaaat

SEQ ID NO: 165084 - DNA, 7 bp, Unknown
  misc_feature (1)..( 7): Result.004 file - promoters50/1376992
gttaaat

SEQ ID NO: 165085 - DNA, 6 bp, Unknown
  misc_feature (1)..( 6): Result.004 file - promoters50/1376992
aataaa

SEQ ID NO: 165086 - DNA, 6 bp, Unknown
  misc_feature (1)..( 6): Result.004 file - promoters50/1376992
aataaa

SEQ ID NO: 165087 - DNA, 7 bp, Unknown
  misc_feature (1)..( 7): Result.004 file - promoters50/1376992
aattaaa

SEQ ID NO: 165088 - DNA, 10 bp, Unknown
  misc_feature (1)..( 10): Result.004 file - promoters50/1376992
aaacataact

SEQ ID NO: 165089 - DNA, 10 bp, Unknown
  misc_feature (1)..( 10): Result.004 file - promoters50/1376992
aaaaatagaa

SEQ ID NO: 165090 - DNA, 10 bp, Unknown
  misc_feature (1)..( 10): Result.004 file - promoters50/1377007
gaacacaact

SEQ ID NO: 165091 - DNA, 8 bp, Unknown
  misc_feature (1)..( 8): Result.004 file - promoters50/1377007
ctaaatga

SEQ ID NO: 165092 - DNA, 8 bp, Unknown
  misc_feature (1)..( 8): Result.004 file - promoters50/1377007
ctaaatgg

SEQ ID NO: 165093 - DNA, 8 bp, Unknown
  misc_feature (1)..( 8): Result.004 file - promoters50/1377007
ttaactga

SEQ ID NO: 165094 - DNA, 8 bp, Unknown
  misc_feature (1)..( 8): Result.004 file - promoters50/1377007
acaactga

SEQ ID NO: 165095 - DNA, 12 bp, Unknown
  misc_feature (1)..( 12): Result.004 file - promoters50/1377007
ctcaatgtctaa

SEQ ID NO: 165096 - DNA, 12 bp, Unknown
  misc_feature (1)..( 12): Result.004 file - promoters50/1377007
ctcactgtcttt

SEQ ID NO: 165097 - DNA, 12 bp, Unknown
  misc_feature (1)..( 12): Result.004 file - promoters50/1377007
gtatgtgtgttt

SEQ ID NO: 165098 - DNA, 7 bp, Unknown
  misc_feature (1)..( 7): Result.004 file - promoters50/1377007
gtttgaa

SEQ ID NO: 165099 - DNA, 7 bp, Unknown
  misc_feature (1)..( 7): Result.004 file - promoters50/1377007
gtttgat

SEQ ID NO: 165100 - DNA, 7 bp, Unknown
  misc_feature (1)..( 7): Result.004 file - promoters50/1377007
ctttgaa

SEQ ID NO: 165101 - DNA, 8 bp, Unknown
  misc_feature (1)..( 8): Result.004 file - promoters50/1377007
tcaaaatt

SEQ ID NO: 165102 - DNA, 8 bp, Unknown
  misc_feature (1)..( 8): Result.004 file - promoters50/1377007
gtaaaatt

SEQ ID NO: 165103 - DNA, 8 bp, Unknown
  misc_feature (1)..( 8): Result.004 file - promoters50/1377007
tcagaatt

SEQ ID NO: 165104 - DNA, 10 bp, Unknown
  misc_feature (1)..( 10): Result.004 file - promoters50/1377007
tttgaatcaa

SEQ ID NO: 165105 - DNA, 10 bp, Unknown
  misc_feature (1)..( 10): Result.004 file - promoters50/1377007
attgattcaa

SEQ ID NO: 165106 - DNA, 10 bp, Unknown
  misc_feature (1)..( 10): Result.004 file - promoters50/1377007
tttgaaacat

SEQ ID NO: 165107 - DNA, 10 bp, Unknown
  misc_feature (1)..( 10): Result.004 file - promoters50/1377007
tttgattcca

SEQ ID NO: 165108 - DNA, 9 bp, Unknown
  misc_feature (1)..( 9): Result.004 file - promoters50/1377007
tttcttatt

SEQ ID NO: 165109 - DNA, 9 bp, Unknown
  misc_feature (1)..( 9): Result.004 file - promoters50/1377007
tttattact

SEQ ID NO: 165110 - DNA, 9 bp, Unknown
  misc_feature (1)..( 9): Result.004 file - promoters50/1377045
tctattact

SEQ ID NO: 165111 - DNA, 11 bp, Unknown
  misc_feature (1)..( 11): Result.004 file - promoters50/1377045
attcaaccaaa

SEQ ID NO: 165112 - DNA, 11 bp, Unknown
  misc_feature (1)..( 11): Result.004 file - promoters50/1377045
caagcaccaaa

SEQ ID NO: 165113 - DNA, 11 bp, Unknown
  misc_feature (1)..( 11): Result.004 file - promoters50/1377045
attctaccaag

SEQ ID NO: 165114 - DNA, 10 bp, Unknown
  misc_feature (1)..( 10): Result.004 file - promoters50/1377045
aaaagaaaga

SEQ ID NO: 165115 - DNA, 10 bp, Unknown
  misc_feature (1)..( 10): Result.004 file - promoters50/1377045
aaaaaaaaga

SEQ ID NO: 165116 - DNA, 10 bp, Unknown
  misc_feature (1)..( 10): Result.004 file - promoters50/1377045
gtcaaaaagc

SEQ ID NO: 165117 - DNA, 6 bp, Unknown
  misc_feature (1)..( 6): Result.004 file - promoters50/1377045
aaaaac

SEQ ID NO: 165118 - DNA, 6 bp, Unknown
  misc_feature (1)..( 6): Result.004 file - promoters50/1377045
aaaaac

SEQ ID NO: 165119 - DNA, 7 bp, Unknown
  misc_feature (1)..( 7): Result.004 file - promoters50/1377139
aaagaaa

SEQ ID NO: 165120 - DNA, 10 bp, Unknown
  misc_feature (1)..( 10): Result.004 file - promoters50/1377139
tcaatttaaa

SEQ ID NO: 165121 - DNA, 10 bp, Unknown
  misc_feature (1)..( 10): Result.004 file - promoters50/1377139
tcatttttca

SEQ ID NO: 165122 - DNA, 10 bp, Unknown
  misc_feature (1)..( 10): Result.004 file - promoters50/1377139
tcaagttaaa

SEQ ID NO: 165123 - DNA, 10 bp, Unknown
  misc_feature (1)..( 10): Result.004 file - promoters50/1377139
gaatttttcg

SEQ ID NO: 165124 - DNA, 10 bp, Unknown
  misc_feature (1)..( 10): Result.004 file - promoters50/1377139
aaaagttacg

SEQ ID NO: 165125 - DNA, 10 bp, Unknown
  misc_feature (1)..( 10): Result.004 file - promoters50/1377192
acaagttggg

SEQ ID NO: 165126 - DNA, 16 bp, Unknown
  misc_feature (1)..( 16): Result.004 file - promoters50/1377192
tttactaaaccaaaaa

SEQ ID NO: 165127 - DNA, 16 bp, Unknown
  misc_feature (1)..( 16): Result.004 file - promoters50/1377192
tttactcaacagcttg

SEQ ID NO: 165128 - DNA, 16 bp, Unknown
  misc_feature (1)..( 16): Result.004 file - promoters50/1377192
ataacccaaaattgac

SEQ ID NO: 165129 - DNA, 16 bp, Unknown
  misc_feature (1)..( 16): Result.004 file - promoters50/1377192
ttttttcaaaagcttg

SEQ ID NO: 165130 - DNA, 16 bp, Unknown
  misc_feature (1)..( 16): Result.004 file - promoters50/1377192
tggaagcaatagctgg

SEQ ID NO: 165131 - DNA, 16 bp, Unknown
  misc_feature (1)..( 16): Result.004 file - promoters50/1377192
gattttaaactattcc

SEQ ID NO: 165132 - DNA, 16 bp, Unknown
  misc_feature (1)..( 16): Result.004 file - promoters50/1377192
taattttaagtcgagc

SEQ ID NO: 165133 - DNA, 18 bp, Unknown
  misc_feature (1)..( 18): Result.004 file - promoters50/1377192
tcgtcttcactaatttag

SEQ ID NO: 165134 - DNA, 18 bp, Unknown
  misc_feature (1)..( 18): Result.004 file - promoters50/1377192
tgacattccctatgagcc

SEQ ID NO: 165135 - DNA, 18 bp, Unknown
  misc_feature (1)..( 18): Result.004 file - promoters50/1377192
caaaggtcaataaatata

SEQ ID NO: 165136 - DNA, 18 bp, Unknown
  misc_feature (1)..( 18): Result.004 file - promoters50/1377192
ccgttttcacactatgag

SEQ ID NO: 165137 - DNA, 18 bp, Unknown
  misc_feature (1)..( 18): Result.004 file - promoters50/1377192
ccgtttgagtttcacgat

SEQ ID NO: 165138 - DNA, 18 bp, Unknown
  misc_feature (1)..( 18): Result.004 file - promoters50/1377192
tcgtttttagtagtctct

SEQ ID NO: 165139 - DNA, 18 bp, Unknown
  misc_feature (1)..( 18): Result.004 file - promoters50/1377192
aaacattcaacggtcaat

SEQ ID NO: 165140 - DNA, 14 bp, Unknown
  misc_feature (1)..( 14): Result.004 file - promoters50/1377192
tactcaacagcttg

SEQ ID NO: 165141 - DNA, 14 bp, Unknown
  misc_feature (1)..( 14): Result.004 file - promoters50/1377192
gaagcaatagctgg

SEQ ID NO: 165142 - DNA, 14 bp, Unknown
  misc_feature (1)..( 14): Result.004 file - promoters50/1377192
ttttcaaaagcttg

SEQ ID NO: 165143 - DNA, 14 bp, Unknown
  misc_feature (1)..( 14): Result.004 file - promoters50/1377192
attttaaactattc

SEQ ID NO: 165144 - DNA, 14 bp, Unknown
  misc_feature (1)..( 14): Result.004 file - promoters50/1377192
attttaagtcgagc

SEQ ID NO: 165145 - DNA, 14 bp, Unknown
  misc_feature (1)..( 14): Result.004 file - promoters50/1377197
gcggccaaaccttt

SEQ ID NO: 165146 - DNA, 9 bp, Unknown
  misc_feature (1)..( 9): Result.004 file - promoters50/1377197
tgaaagaag

SEQ ID NO: 165147 - DNA, 9 bp, Unknown
  misc_feature (1)..( 9): Result.004 file - promoters50/1377197
aaaaataag

SEQ ID NO: 165148 - DNA, 9 bp, Unknown
  misc_feature (1)..( 9): Result.004 file - promoters50/1377197
aaaaagaaa

SEQ ID NO: 165149 - DNA, 9 bp, Unknown
  misc_feature (1)..( 9): Result.004 file - promoters50/1377197
aaaaaaaag

SEQ ID NO: 165150 - DNA, 9 bp, Unknown
  misc_feature (1)..( 9): Result.004 file - promoters50/1377197
cgaaggaac

SEQ ID NO: 165151 - DNA, 9 bp, Unknown
  misc_feature (1)..( 9): Result.004 file - promoters50/1377249
atatgtaaa

SEQ ID NO: 165152 - DNA, 8 bp, Unknown
  misc_feature (1)..( 8): Result.004 file - promoters50/1377249
taaataac

SEQ ID NO: 165153 - DNA, 8 bp, Unknown
  misc_feature (1)..( 8): Result.004 file - promoters50/1377249
taaataac

SEQ ID NO: 165154 - DNA, 8 bp, Unknown
  misc_feature (1)..( 8): Result.004 file - promoters50/1377268
taaataaa

SEQ ID NO: 165155 - DNA, 10 bp, Unknown
  misc_feature (1)..( 10): Result.004 file - promoters50/1377268
aaactactta

SEQ ID NO: 165156 - DNA, 10 bp, Unknown
  misc_feature (1)..( 10): Result.004 file - promoters50/1377268
aaactaaaac

SEQ ID NO: 165157 - DNA, 10 bp, Unknown
  misc_feature (1)..( 10): Result.004 file - promoters50/1377268
aaactacaac

SEQ ID NO: 165158 - DNA, 10 bp, Unknown
  misc_feature (1)..( 10): Result.004 file - promoters50/1377268
taacgtggca

SEQ ID NO: 165159 - DNA, 10 bp, Unknown
  misc_feature (1)..( 10): Result.004 file - promoters50/1377268
aaacgtgaaa

SEQ ID NO: 165160 - DNA, 10 bp, Unknown
  misc_feature (1)..( 10): Result.004 file - promoters50/1377268
aaacgtaaaa

SEQ ID NO: 165161 - DNA, 9 bp, Unknown
  misc_feature (1)..( 9): Result.004 file - promoters50/1377268
ctatattta

SEQ ID NO: 165162 - DNA, 9 bp, Unknown
  misc_feature (1)..( 9): Result.004 file - promoters50/1377268
aactattta

SEQ ID NO: 165163 - DNA, 9 bp, Unknown
  misc_feature (1)..( 9): Result.004 file - promoters50/1377268
aaccattta

SEQ ID NO: 165164 - DNA, 8 bp, Unknown
  misc_feature (1)..( 8): Result.004 file - promoters50/1377268
ctacttat

SEQ ID NO: 165165 - DNA, 8 bp, Unknown
  misc_feature (1)..( 8): Result.004 file - promoters50/1377268
caacttat

SEQ ID NO: 165166 - DNA, 8 bp, Unknown
  misc_feature (1)..( 8): Result.004 file - promoters50/1377268
caatttat

SEQ ID NO: 165167 - DNA, 11 bp, Unknown
  misc_feature (1)..( 11): Result.004 file - promoters50/1377268
tatatataaag

SEQ ID NO: 165168 - DNA, 11 bp, Unknown
  misc_feature (1)..( 11): Result.004 file - promoters50/1377268
tatatataaag

SEQ ID NO: 165169 - DNA, 11 bp, Unknown
  misc_feature (1)..( 11): Result.004 file - promoters50/1377268
tttatttaacg

SEQ ID NO: 165170 - DNA, 11 bp, Unknown
  misc_feature (1)..( 11): Result.004 file - promoters50/1377268
acaatataaac

SEQ ID NO: 165171 - DNA, 9 bp, Unknown
  misc_feature (1)..( 9): Result.004 file - promoters50/1377268
acttgtttt

SEQ ID NO: 165172 - DNA, 9 bp, Unknown
  misc_feature (1)..( 9): Result.004 file - promoters50/1377268
acttgtata

SEQ ID NO: 165173 - DNA, 9 bp, Unknown
  misc_feature (1)..( 9): Result.004 file - promoters50/1377417
acttgaata

SEQ ID NO: 165174 - DNA, 8 bp, Unknown
  misc_feature (1)..( 8): Result.004 file - promoters50/1377417
caataacc

SEQ ID NO: 165175 - DNA, 8 bp, Unknown
  misc_feature (1)..( 8): Result.004 file - promoters50/1377417
tcataacc

SEQ ID NO: 165176 - DNA, 8 bp, Unknown
  misc_feature (1)..( 8): Result.004 file - promoters50/1377417
caaaaaca

SEQ ID NO: 165177 - DNA, 8 bp, Unknown
  misc_feature (1)..( 8): Result.004 file - promoters50/1377472
taaaaaca

SEQ ID NO: 165178 - DNA, 14 bp, Unknown
  misc_feature (1)..( 14): Result.004 file - promoters50/1377472
tcattttcgagaat

SEQ ID NO: 165179 - DNA, 14 bp, Unknown
  misc_feature (1)..( 14): Result.004 file - promoters50/1377472
acggtttcaagatg

SEQ ID NO: 165180 - DNA, 14 bp, Unknown
  misc_feature (1)..( 14): Result.004 file - promoters50/1377472
ccttcttcaagaaa

SEQ ID NO: 165181 - DNA, 14 bp, Unknown
  misc_feature (1)..( 14): Result.004 file - promoters50/1377472
tatgttgcaacttg

SEQ ID NO: 165182 - DNA, 14 bp, Unknown
  misc_feature (1)..( 14): Result.004 file - promoters50/1377472
ttgtgtctaagaaa

SEQ ID NO: 165183 - DNA, 14 bp, Unknown
  misc_feature (1)..( 14): Result.004 file - promoters50/1377472
ctgctttcacgatt

SEQ ID NO: 165184 - DNA, 14 bp, Unknown
  misc_feature (1)..( 14): Result.004 file - promoters50/1377472
ctgttttcaaaatg

SEQ ID NO: 165185 - DNA, 13 bp, Unknown
  misc_feature (1)..( 13): Result.004 file - promoters50/1377472
agattctcttatt

SEQ ID NO: 165186 - DNA, 13 bp, Unknown
  misc_feature (1)..( 13): Result.004 file - promoters50/1377472
cgattctttaaat

SEQ ID NO: 165187 - DNA, 13 bp, Unknown
  misc_feature (1)..( 13): Result.004 file - promoters50/1377472
agattcaatttta

SEQ ID NO: 165188 - DNA, 13 bp, Unknown
  misc_feature (1)..( 13): Result.004 file - promoters50/1377472
aaattcttttatt

SEQ ID NO: 165189 - DNA, 13 bp, Unknown
  misc_feature (1)..( 13): Result.004 file - promoters50/1377472
gtattatttcagg

SEQ ID NO: 165190 - DNA, 13 bp, Unknown
  misc_feature (1)..( 13): Result.004 file - promoters50/1377472
atattataggaaa

SEQ ID NO: 165191 - DNA, 13 bp, Unknown
  misc_feature (1)..( 13): Result.004 file - promoters50/1377506
aatttgttttagt

SEQ ID NO: 165192 - DNA, 10 bp, Unknown
  misc_feature (1)..( 10): Result.004 file - promoters50/1377506
gaatatgtaa

SEQ ID NO: 165193 - DNA, 10 bp, Unknown
  misc_feature (1)..( 10): Result.004 file - promoters50/1377506
ttctatataa

SEQ ID NO: 165194 - DNA, 10 bp, Unknown
  misc_feature (1)..( 10): Result.004 file - promoters50/1377506
gaatttgttt

SEQ ID NO: 165195 - DNA, 10 bp, Unknown
  misc_feature (1)..( 10): Result.004 file - promoters50/1377506
gaatttgatt

SEQ ID NO: 165196 - DNA, 9 bp, Unknown
  misc_feature (1)..( 9): Result.004 file - promoters50/1377506
tcttcctcc

SEQ ID NO: 165197 - DNA, 9 bp, Unknown
  misc_feature (1)..( 9): Result.004 file - promoters50/1377506
agctcctcc

SEQ ID NO: 165198 - DNA, 9 bp, Unknown
  misc_feature (1)..( 9): Result.004 file - promoters50/1377506
tcttcctcc

SEQ ID NO: 165199 - DNA, 8 bp, Unknown
  misc_feature (1)..( 8): Result.004 file - promoters50/1377506
tcttctcc

SEQ ID NO: 165200 - DNA, 8 bp, Unknown
  misc_feature (1)..( 8): Result.004 file - promoters50/1377506
acttatcc

SEQ ID NO: 165201 - DNA, 8 bp, Unknown
  misc_feature (1)..( 8): Result.004 file - promoters50/1377506
tcttctta

SEQ ID NO: 165202 - DNA, 8 bp, Unknown
  misc_feature (1)..( 8): Result.004 file - promoters50/1377506
tctggttt

SEQ ID NO: 165203 - DNA, 8 bp, Unknown
  misc_feature (1)..( 8): Result.004 file - promoters50/1377506
tctggttt

SEQ ID NO: 165204 - DNA, 8 bp, Unknown
  misc_feature (1)..( 8): Result.004 file - promoters50/1377522
tctggttt

SEQ ID NO: 165205 - DNA, 9 bp, Unknown
  misc_feature (1)..( 9): Result.004 file - promoters50/1377522
tgatatctc

SEQ ID NO: 165206 - DNA, 9 bp, Unknown
  misc_feature (1)..( 9): Result.004 file - promoters50/1377522
ccatacctc

SEQ ID NO: 165207 - DNA, 9 bp, Unknown
  misc_feature (1)..( 9): Result.004 file - promoters50/1377522
tgatgtctt

SEQ ID NO: 165208 - DNA, 9 bp, Unknown
  misc_feature (1)..( 9): Result.004 file - promoters50/1377522
atatgtctc

SEQ ID NO: 165209 - DNA, 8 bp, Unknown
  misc_feature (1)..( 8): Result.004 file - promoters50/1377522
cgacatgt

SEQ ID NO: 165210 - DNA, 8 bp, Unknown
  misc_feature (1)..( 8): Result.004 file - promoters50/1377522
cgacatgt

SEQ ID NO: 165211 - DNA, 8 bp, Unknown
  misc_feature (1)..( 8): Result.004 file - promoters50/1377522
cgacatta

SEQ ID NO: 165212 - DNA, 8 bp, Unknown
  misc_feature (1)..( 8): Result.004 file - promoters50/1377540
acacatgt

SEQ ID NO: 165213 - DNA, 10 bp, Unknown
  misc_feature (1)..( 10): Result.004 file - promoters50/1377540
caaaattcta

SEQ ID NO: 165214 - DNA, 10 bp, Unknown
  misc_feature (1)..( 10): Result.004 file - promoters50/1377540
caaaataaat

SEQ ID NO: 165215 - DNA, 10 bp, Unknown
  misc_feature (1)..( 10): Result.004 file - promoters50/1377540
aaaaatctct

SEQ ID NO: 165216 - DNA, 10 bp, Unknown
  misc_feature (1)..( 10): Result.004 file - promoters50/1377540
gataatgtct

SEQ ID NO: 165217 - DNA, 10 bp, Unknown
  misc_feature (1)..( 10): Result.004 file - promoters50/1377540
ataatttaaa

SEQ ID NO: 165218 - DNA, 10 bp, Unknown
  misc_feature (1)..( 10): Result.004 file - promoters50/1377540
atatttttgt

SEQ ID NO: 165219 - DNA, 10 bp, Unknown
  misc_feature (1)..( 10): Result.004 file - promoters50/1377540
tgatttttgc

SEQ ID NO: 165220 - DNA, 10 bp, Unknown
  misc_feature (1)..( 10): Result.004 file - promoters50/1377540
ttattttttt

SEQ ID NO: 165221 - DNA, 10 bp, Unknown
  misc_feature (1)..( 10): Result.004 file - promoters50/1377540
aattacatga

SEQ ID NO: 165222 - DNA, 10 bp, Unknown
  misc_feature (1)..( 10): Result.004 file - promoters50/1377540
gattaaatgt

SEQ ID NO: 165223 - DNA, 10 bp, Unknown
  misc_feature (1)..( 10): Result.004 file - promoters50/1377540
ttacaaatgt

SEQ ID NO: 165224 - DNA, 10 bp, Unknown
  misc_feature (1)..( 10): Result.004 file - promoters50/1377564
gattaaacaa

SEQ ID NO: 165225 - DNA, 7 bp, Unknown
  misc_feature (1)..( 7): Result.004 file - promoters50/1377564
attttac

SEQ ID NO: 165226 - DNA, 7 bp, Unknown
  misc_feature (1)..( 7): Result.004 file - promoters50/1377564
tttttac

SEQ ID NO: 165227 - DNA, 7 bp, Unknown
  misc_feature (1)..( 7): Result.004 file - promoters50/1377564
attttaa

SEQ ID NO: 165228 - DNA, 9 bp, Unknown
  misc_feature (1)..( 9): Result.004 file - promoters50/1377564
ttgtattaa

SEQ ID NO: 165229 - DNA, 9 bp, Unknown
  misc_feature (1)..( 9): Result.004 file - promoters50/1377564
aagtaataa

SEQ ID NO: 165230 - DNA, 9 bp, Unknown
  misc_feature (1)..( 9): Result.004 file - promoters50/1377564
aagaaatga

SEQ ID NO: 165231 - DNA, 7 bp, Unknown
  misc_feature (1)..( 7): Result.004 file - promoters50/1377564
caaaatt

SEQ ID NO: 165232 - DNA, 7 bp, Unknown
  misc_feature (1)..( 7): Result.004 file - promoters50/1377564
caaaatc

SEQ ID NO: 165233 - DNA, 7 bp, Unknown
  misc_feature (1)..( 7): Result.004 file - promoters50/1377564
taaaatc

SEQ ID NO: 165234 - DNA, 8 bp, Unknown
  misc_feature (1)..( 8): Result.004 file - promoters50/1377564
ttatgtca

SEQ ID NO: 165235 - DNA, 8 bp, Unknown
  misc_feature (1)..( 8): Result.004 file - promoters50/1377564
ttatgtct

SEQ ID NO: 165236 - DNA, 8 bp, Unknown
  misc_feature (1)..( 8): Result.004 file - promoters50/1377564
acatgtct

SEQ ID NO: 165237 - DNA, 7 bp, Unknown
  misc_feature (1)..( 7): Result.004 file - promoters50/1377564
gatggat

SEQ ID NO: 165238 - DNA, 7 bp, Unknown
  misc_feature (1)..( 7): Result.004 file - promoters50/1377564
gatcgat

SEQ ID NO: 165239 - DNA, 7 bp, Unknown
  misc_feature (1)..( 7): Result.004 file - promoters50/1377613
gatcgaa

SEQ ID NO: 165240 - DNA, 10 bp, Unknown
  misc_feature (1)..( 10): Result.004 file - promoters50/1377613
caaattatcc

SEQ ID NO: 165241 - DNA, 10 bp, Unknown
  misc_feature (1)..( 10): Result.004 file - promoters50/1377613
gcaattataa

SEQ ID NO: 165242 - DNA, 10 bp, Unknown
  misc_feature (1)..( 10): Result.004 file - promoters50/1377613
caaatcatcc

SEQ ID NO: 165243 - DNA, 9 bp, Unknown
  misc_feature (1)..( 9): Result.004 file - promoters50/1377613
tacaaaaaa

SEQ ID NO: 165244 - DNA, 9 bp, Unknown
  misc_feature (1)..( 9): Result.004 file - promoters50/1377613
tacaaaata

SEQ ID NO: 165245 - DNA, 9 bp, Unknown
  misc_feature (1)..( 9): Result.004 file - promoters50/1377613
accaaaaaa

SEQ ID NO: 165246 - DNA, 9 bp, Unknown
  misc_feature (1)..( 9): Result.004 file - promoters50/1377613
aaaaataaa

SEQ ID NO: 165247 - DNA, 9 bp, Unknown
  misc_feature (1)..( 9): Result.004 file - promoters50/1377613
aaatataaa

SEQ ID NO: 165248 - DNA, 9 bp, Unknown
  misc_feature (1)..( 9): Result.004 file - promoters50/1377613
aaaaatcat

SEQ ID NO: 165249 - DNA, 9 bp, Unknown
  misc_feature (1)..( 9): Result.004 file - promoters50/1377613
gataaaact

SEQ ID NO: 165250 - DNA, 9 bp, Unknown
  misc_feature (1)..( 9): Result.004 file - promoters50/1377613
tataaaacc

SEQ ID NO: 165251 - DNA, 9 bp, Unknown
  misc_feature (1)..( 9): Result.004 file - promoters50/1377613
tataaaacc

SEQ ID NO: 165252 - DNA, 9 bp, Unknown
  misc_feature (1)..( 9): Result.004 file - promoters50/1377613
atcaaaacc

SEQ ID NO: 165253 - DNA, 9 bp, Unknown
  misc_feature (1)..( 9): Result.004 file - promoters50/1377613
tataaaacc

SEQ ID NO: 165254 - DNA, 9 bp, Unknown
  misc_feature (1)..( 9): Result.004 file - promoters50/1377642
tataaaacc

SEQ ID NO: 165255 - DNA, 8 bp, Unknown
  misc_feature (1)..( 8): Result.004 file - promoters50/1377642
atttatgt

SEQ ID NO: 165256 - DNA, 8 bp, Unknown
  misc_feature (1)..( 8): Result.004 file - promoters50/1377642
atttattt

SEQ ID NO: 165257 - DNA, 8 bp, Unknown
  misc_feature (1)..( 8): Result.004 file - promoters50/1377642
atttattt

SEQ ID NO: 165258 - DNA, 8 bp, Unknown
  misc_feature (1)..( 8): Result.004 file - promoters50/1377642
gtttgttt

SEQ ID NO: 165259 - DNA, 8 bp, Unknown
  misc_feature (1)..( 8): Result.004 file - promoters50/1377642
atttgttt

SEQ ID NO: 165260 - DNA, 8 bp, Unknown
  misc_feature (1)..( 8): Result.004 file - promoters50/1377642
atatatat

SEQ ID NO: 165261 - DNA, 12 bp, Unknown
  misc_feature (1)..( 12): Result.004 file - promoters50/1377642
gatccaaacacg

SEQ ID NO: 165262 - DNA, 12 bp, Unknown
  misc_feature (1)..( 12): Result.004 file - promoters50/1377642
tatcctaactat

SEQ ID NO: 165263 - DNA, 12 bp, Unknown
  misc_feature (1)..( 12): Result.004 file - promoters50/1377642
aatcaaaagatt

SEQ ID NO: 165264 - DNA, 12 bp, Unknown
  misc_feature (1)..( 12): Result.004 file - promoters50/1377642
tacactaactat

SEQ ID NO: 165265 - DNA, 12 bp, Unknown
  misc_feature (1)..( 12): Result.004 file - promoters50/1377642
aatcaaattaat

SEQ ID NO: 165266 - DNA, 12 bp, Unknown
  misc_feature (1)..( 12): Result.004 file - promoters50/1377642
tttcaaatacta

SEQ ID NO: 165267 - DNA, 9 bp, Unknown
  misc_feature (1)..( 9): Result.004 file - promoters50/1377642
ttactttac

SEQ ID NO: 165268 - DNA, 9 bp, Unknown
  misc_feature (1)..( 9): Result.004 file - promoters50/1377642
aaactatac

SEQ ID NO: 165269 - DNA, 9 bp, Unknown
  misc_feature (1)..( 9): Result.004 file - promoters50/1377642
aatctttac

SEQ ID NO: 165270 - DNA, 9 bp, Unknown
  misc_feature (1)..( 9): Result.004 file - promoters50/1377642
ttaattttt

SEQ ID NO: 165271 - DNA, 9 bp, Unknown
  misc_feature (1)..( 9): Result.004 file - promoters50/1377642
atacttttt

SEQ ID NO: 165272 - DNA, 9 bp, Unknown
  misc_feature (1)..( 9): Result.004 file - promoters50/1377642
atacttttt

SEQ ID NO: 165273 - DNA, 14 bp, Unknown
  misc_feature (1)..( 14): Result.004 file - promoters50/1377642
aattattatacttc

SEQ ID NO: 165274 - DNA, 14 bp, Unknown
  misc_feature (1)..( 14): Result.004 file - promoters50/1377642
atatataataaata

SEQ ID NO: 165275 - DNA, 14 bp, Unknown
  misc_feature (1)..( 14): Result.004 file - promoters50/1377642
aaatataataacat

SEQ ID NO: 165276 - DNA, 14 bp, Unknown
  misc_feature (1)..( 14): Result.004 file - promoters50/1377642
tcatataattatct

SEQ ID NO: 165277 - DNA, 14 bp, Unknown
  misc_feature (1)..( 14): Result.004 file - promoters50/1377642
tcatataacaattt

SEQ ID NO: 165278 - DNA, 14 bp, Unknown
  misc_feature (1)..( 14): Result.004 file - promoters50/1377642
aagcataaaaaata

SEQ ID NO: 165279 - DNA, 14 bp, Unknown
  misc_feature (1)..( 14): Result.004 file - promoters50/1377642
cagtttaataacaa

SEQ ID NO: 165280 - DNA, 11 bp, Unknown
  misc_feature (1)..( 11): Result.004 file - promoters50/1377642
taattttgtat

SEQ ID NO: 165281 - DNA, 11 bp, Unknown
  misc_feature (1)..( 11): Result.004 file - promoters50/1377642
tgtttttgttt

SEQ ID NO: 165282 - DNA, 11 bp, Unknown
  misc_feature (1)..( 11): Result.004 file - promoters50/1377642
taaatttgttt

SEQ ID NO: 165283 - DNA, 11 bp, Unknown
  misc_feature (1)..( 11): Result.004 file - promoters50/1377642
ctgatttattt

SEQ ID NO: 165284 - DNA, 11 bp, Unknown
  misc_feature (1)..( 11): Result.004 file - promoters50/1377642
tgactttgttg

SEQ ID NO: 165285 - DNA, 11 bp, Unknown
  misc_feature (1)..( 11): Result.004 file - promoters50/1377642
tttgtttgttg

SEQ ID NO: 165286 - DNA, 11 bp, Unknown
  misc_feature (1)..( 11): Result.004 file - promoters50/1377642
gtaagaattag

SEQ ID NO: 165287 - DNA, 11 bp, Unknown
  misc_feature (1)..( 11): Result.004 file - promoters50/1377642
gtaagaactgg

SEQ ID NO: 165288 - DNA, 11 bp, Unknown
  misc_feature (1)..( 11): Result.004 file - promoters50/1377642
ataagaatatg

SEQ ID NO: 165289 - DNA, 11 bp, Unknown
  misc_feature (1)..( 11): Result.004 file - promoters50/1377642
accagaacatg

SEQ ID NO: 165290 - DNA, 11 bp, Unknown
  misc_feature (1)..( 11): Result.004 file - promoters50/1377642
cgaagaatagt

SEQ ID NO: 165291 - DNA, 11 bp, Unknown
  misc_feature (1)..( 11): Result.004 file - promoters50/1377642
cacagaataat

SEQ ID NO: 165292 - DNA, 12 bp, Unknown
  misc_feature (1)..( 12): Result.004 file - promoters50/1377642
atctcaaataac

SEQ ID NO: 165293 - DNA, 12 bp, Unknown
  misc_feature (1)..( 12): Result.004 file - promoters50/1377642
ataaaaaataaa

SEQ ID NO: 165294 - DNA, 12 bp, Unknown
  misc_feature (1)..( 12): Result.004 file - promoters50/1377642
ataataaatagg

SEQ ID NO: 165295 - DNA, 12 bp, Unknown
  misc_feature (1)..( 12): Result.004 file - promoters50/1377642
cagtttaataac

SEQ ID NO: 165296 - DNA, 13 bp, Unknown
  misc_feature (1)..( 13): Result.004 file - promoters50/1377642
catcacaatgaat

SEQ ID NO: 165297 - DNA, 13 bp, Unknown
  misc_feature (1)..( 13): Result.004 file - promoters50/1377642
ggcctaaaatata

SEQ ID NO: 165298 - DNA, 10 bp, Unknown
  misc_feature (1)..( 10): Result.004 file - promoters50/1377642
ttttatcaca

SEQ ID NO: 165299 - DNA, 10 bp, Unknown
  misc_feature (1)..( 10): Result.004 file - promoters50/1377642
ttttgtcaac

SEQ ID NO: 165300 - DNA, 10 bp, Unknown
  misc_feature (1)..( 10): Result.004 file - promoters50/1377642
gtataacaat

SEQ ID NO: 165301 - DNA, 10 bp, Unknown
  misc_feature (1)..( 10): Result.004 file - promoters50/1377642
ctttatccta

SEQ ID NO: 165302 - DNA, 10 bp, Unknown
  misc_feature (1)..( 10): Result.004 file - promoters50/1377642
gtgtaaacga

SEQ ID NO: 165303 - DNA, 10 bp, Unknown
  misc_feature (1)..( 10): Result.004 file - promoters50/1377664
ttttgtcctc

SEQ ID NO: 165304 - DNA, 9 bp, Unknown
  misc_feature (1)..( 9): Result.004 file - promoters50/1377664
gttcatagc

SEQ ID NO: 165305 - DNA, 9 bp, Unknown
  misc_feature (1)..( 9): Result.004 file - promoters50/1377664
tgtcaaagc

SEQ ID NO: 165306 - DNA, 9 bp, Unknown
  misc_feature (1)..( 9): Result.004 file - promoters50/1377664
gttcgtaga

SEQ ID NO: 165307 - DNA, 9 bp, Unknown
  misc_feature (1)..( 9): Result.004 file - promoters50/1377664
acaaaaggg

SEQ ID NO: 165308 - DNA, 9 bp, Unknown
  misc_feature (1)..( 9): Result.004 file - promoters50/1377664
aaaaaagga

SEQ ID NO: 165309 - DNA, 10 bp, Unknown
  misc_feature (1)..( 10): Result.004 file - promoters50/1377664
aaaataagga

SEQ ID NO: 165310 - DNA, 10 bp, Unknown
  misc_feature (1)..( 10): Result.004 file - promoters50/1377664
aaaataaaac

SEQ ID NO: 165311 - DNA, 11 bp, Unknown
  misc_feature (1)..( 11): Result.004 file - promoters50/1377664
ctaaaaaaatg

SEQ ID NO: 165312 - DNA, 11 bp, Unknown
  misc_feature (1)..( 11): Result.004 file - promoters50/1377664
ctataaatcat

SEQ ID NO: 165313 - DNA, 11 bp, Unknown
  misc_feature (1)..( 11): Result.004 file - promoters50/1377664
ggaaaataatg

SEQ ID NO: 165314 - DNA, 8 bp, Unknown
  misc_feature (1)..( 8): Result.004 file - promoters50/1377664
aaaaaatg

SEQ ID NO: 165315 - DNA, 8 bp, Unknown
  misc_feature (1)..( 8): Result.004 file - promoters50/1377664
aaaaaagt

SEQ ID NO: 165316 - DNA, 9 bp, Unknown
  misc_feature (1)..( 9): Result.004 file - promoters50/1377680
aaaataatg

SEQ ID NO: 165317 - DNA, 10 bp, Unknown
  misc_feature (1)..( 10): Result.004 file - promoters50/1377680
aaatcatttt

SEQ ID NO: 165318 - DNA, 10 bp, Unknown
  misc_feature (1)..( 10): Result.004 file - promoters50/1377680
aaataatttt

SEQ ID NO: 165319 - DNA, 10 bp, Unknown
  misc_feature (1)..( 10): Result.004 file - promoters50/1377680
caatcatatt

SEQ ID NO: 165320 - DNA, 10 bp, Unknown
  misc_feature (1)..( 10): Result.004 file - promoters50/1377680
aaataaagtg

SEQ ID NO: 165321 - DNA, 10 bp, Unknown
  misc_feature (1)..( 10): Result.004 file - promoters50/1377680
ctatcataat

SEQ ID NO: 165322 - DNA, 10 bp, Unknown
  misc_feature (1)..( 10): Result.004 file - promoters50/1377680
atatgatata

SEQ ID NO: 165323 - DNA, 11 bp, Unknown
  misc_feature (1)..( 11): Result.004 file - promoters50/1377680
gtgacaaaaca

SEQ ID NO: 165324 - DNA, 11 bp, Unknown
  misc_feature (1)..( 11): Result.004 file - promoters50/1377680
gtgataaatac

SEQ ID NO: 165325 - DNA, 11 bp, Unknown
  misc_feature (1)..( 11): Result.004 file - promoters50/1377680
ttaataaattt

SEQ ID NO: 165326 - DNA, 11 bp, Unknown
  misc_feature (1)..( 11): Result.004 file - promoters50/1377680
ctaattaattt

SEQ ID NO: 165327 - DNA, 11 bp, Unknown
  misc_feature (1)..( 11): Result.004 file - promoters50/1377680
gagatttattc

SEQ ID NO: 165328 - DNA, 11 bp, Unknown
  misc_feature (1)..( 11): Result.004 file - promoters50/1377687
ctaagaaacat

SEQ ID NO: 165329 - DNA, 15 bp, Unknown
  misc_feature (1)..( 15): Result.004 file - promoters50/1377687
actaaaataactcac

SEQ ID NO: 165330 - DNA, 15 bp, Unknown
  misc_feature (1)..( 15): Result.004 file - promoters50/1377687
acagaaataaatcac

SEQ ID NO: 165331 - DNA, 15 bp, Unknown
  misc_feature (1)..( 15): Result.004 file - promoters50/1377687
acacaaatatgccaa

SEQ ID NO: 165332 - DNA, 8 bp, Unknown
  misc_feature (1)..( 8): Result.004 file - promoters50/1377687
aaaacaat

SEQ ID NO: 165333 - DNA, 8 bp, Unknown
  misc_feature (1)..( 8): Result.004 file - promoters50/1377687
aaaccaag

SEQ ID NO: 165334 - DNA, 8 bp, Unknown
  misc_feature (1)..( 8): Result.004 file - promoters50/1377687
aaaaaaat

SEQ ID NO: 165335 - DNA, 7 bp, Unknown
  misc_feature (1)..( 7): Result.004 file - promoters50/1377687
cttttct

SEQ ID NO: 165336 - DNA, 7 bp, Unknown
  misc_feature (1)..( 7): Result.004 file - promoters50/1377687
cttatct

SEQ ID NO: 165337 - DNA, 7 bp, Unknown
  misc_feature (1)..( 7): Result.004 file - promoters50/1377714
gttatct

SEQ ID NO: 165338 - DNA, 15 bp, Unknown
  misc_feature (1)..( 15): Result.004 file - promoters50/1377714
gttacaattttttgt

SEQ ID NO: 165339 - DNA, 15 bp, Unknown
  misc_feature (1)..( 15): Result.004 file - promoters50/1377714
gttataatttttttg

SEQ ID NO: 165340 - DNA, 15 bp, Unknown
  misc_feature (1)..( 15): Result.004 file - promoters50/1377714
ctcaagatttgttgg

SEQ ID NO: 165341 - DNA, 15 bp, Unknown
  misc_feature (1)..( 15): Result.004 file - promoters50/1377714
ttattaattttaatt

SEQ ID NO: 165342 - DNA, 15 bp, Unknown
  misc_feature (1)..( 15): Result.004 file - promoters50/1377714
gaggtactttcttgt

SEQ ID NO: 165343 - DNA, 15 bp, Unknown
  misc_feature (1)..( 15): Result.004 file - promoters50/1377714
gttatgatttcttca

SEQ ID NO: 165344 - DNA, 15 bp, Unknown
  misc_feature (1)..( 15): Result.004 file - promoters50/1377714
tttatgcttttaaaa

SEQ ID NO: 165345 - DNA, 13 bp, Unknown
  misc_feature (1)..( 13): Result.004 file - promoters50/1377714
atcttgttatgtt

SEQ ID NO: 165346 - DNA, 13 bp, Unknown
  misc_feature (1)..( 13): Result.004 file - promoters50/1377714
atattgatataat

SEQ ID NO: 165347 - DNA, 13 bp, Unknown
  misc_feature (1)..( 13): Result.004 file - promoters50/1377714
gttttgttaatat

SEQ ID NO: 165348 - DNA, 13 bp, Unknown
  misc_feature (1)..( 13): Result.004 file - promoters50/1377714
tatatgagatagt

SEQ ID NO: 165349 - DNA, 13 bp, Unknown
  misc_feature (1)..( 13): Result.004 file - promoters50/1377714
gatgtgatattaa

SEQ ID NO: 165350 - DNA, 13 bp, Unknown
  misc_feature (1)..( 13): Result.004 file - promoters50/1377714
gaatcgagataca

SEQ ID NO: 165351 - DNA, 13 bp, Unknown
  misc_feature (1)..( 13): Result.004 file - promoters50/1377718
cggttgctaaata

SEQ ID NO: 165352 - DNA, 10 bp, Unknown
  misc_feature (1)..( 10): Result.004 file - promoters50/1377718
taaatttgct

SEQ ID NO: 165353 - DNA, 10 bp, Unknown
  misc_feature (1)..( 10): Result.004 file - promoters50/1377718
tgaatctgct

SEQ ID NO: 165354 - DNA, 10 bp, Unknown
  misc_feature (1)..( 10): Result.004 file - promoters50/1377734
taaatttaaa

SEQ ID NO: 165355 - DNA, 7 bp, Unknown
  misc_feature (1)..( 7): Result.004 file - promoters50/1377734
gtgactc

SEQ ID NO: 165356 - DNA, 7 bp, Unknown
  misc_feature (1)..( 7): Result.004 file - promoters50/1377734
ttgactc

SEQ ID NO: 165357 - DNA, 7 bp, Unknown
  misc_feature (1)..( 7): Result.004 file - promoters50/1377740
ttgacta

SEQ ID NO: 165358 - DNA, 7 bp, Unknown
  misc_feature (1)..( 7): Result.004 file - promoters50/1377740
gaaaatg

SEQ ID NO: 165359 - DNA, 7 bp, Unknown
  misc_feature (1)..( 7): Result.004 file - promoters50/1377740
taaaatg

SEQ ID NO: 165360 - DNA, 7 bp, Unknown
  misc_feature (1)..( 7): Result.004 file - promoters50/1377740
taatatg

SEQ ID NO: 165361 - DNA, 10 bp, Unknown
  misc_feature (1)..( 10): Result.004 file - promoters50/1377740
cacatattca

SEQ ID NO: 165362 - DNA, 10 bp, Unknown
  misc_feature (1)..( 10): Result.004 file - promoters50/1377740
cacatattta

SEQ ID NO: 165363 - DNA, 11 bp, Unknown
  misc_feature (1)..( 11): Result.004 file - promoters50/1377740
tgaatagttag

SEQ ID NO: 165364 - DNA, 11 bp, Unknown
  misc_feature (1)..( 11): Result.004 file - promoters50/1377740
ctgtcataatc

SEQ ID NO: 165365 - DNA, 11 bp, Unknown
  misc_feature (1)..( 11): Result.004 file - promoters50/1377740
atatcatcatc

SEQ ID NO: 165366 - DNA, 11 bp, Unknown
  misc_feature (1)..( 11): Result.004 file - promoters50/1377740
ctgtaatatgg

SEQ ID NO: 165367 - DNA, 9 bp, Unknown
  misc_feature (1)..( 9): Result.004 file - promoters50/1377740
ttaaaaaat

SEQ ID NO: 165368 - DNA, 9 bp, Unknown
  misc_feature (1)..( 9): Result.004 file - promoters50/1377740
acaaagaat

SEQ ID NO: 165369 - DNA, 9 bp, Unknown
  misc_feature (1)..( 9): Result.004 file - promoters50/1377835
ttaataaat

SEQ ID NO: 165370 - DNA, 7 bp, Unknown
  misc_feature (1)..( 7): Result.004 file - promoters50/1377835
aaaagaa

SEQ ID NO: 165371 - DNA, 7 bp, Unknown
  misc_feature (1)..( 7): Result.004 file - promoters50/1377835
aaaagat

SEQ ID NO: 165372 - DNA, 7 bp, Unknown
  misc_feature (1)..( 7): Result.004 file - promoters50/1377835
aaaaatt

SEQ ID NO: 165373 - DNA, 10 bp, Unknown
  misc_feature (1)..( 10): Result.004 file - promoters50/1377835
tgcttcctcc

SEQ ID NO: 165374 - DNA, 10 bp, Unknown
  misc_feature (1)..( 10): Result.004 file - promoters50/1377835
tttttcttcc

SEQ ID NO: 165375 - DNA, 10 bp, Unknown
  misc_feature (1)..( 10): Result.004 file - promoters50/1377835
tttttgttcg

SEQ ID NO: 165376 - DNA, 10 bp, Unknown
  misc_feature (1)..( 10): Result.004 file - promoters50/1377835
ctaaatattt

SEQ ID NO: 165377 - DNA, 10 bp, Unknown
  misc_feature (1)..( 10): Result.004 file - promoters50/1377835
gtaaaaattt

SEQ ID NO: 165378 - DNA, 10 bp, Unknown
  misc_feature (1)..( 10): Result.004 file - promoters50/1377835
gtacaaagta

SEQ ID NO: 165379 - DNA, 11 bp, Unknown
  misc_feature (1)..( 11): Result.004 file - promoters50/1377835
caaagtaattg

SEQ ID NO: 165380 - DNA, 11 bp, Unknown
  misc_feature (1)..( 11): Result.004 file - promoters50/1377835
caaactaattt

SEQ ID NO: 165381 - DNA, 11 bp, Unknown
  misc_feature (1)..( 11): Result.004 file - promoters50/1377835
atcactaattt

SEQ ID NO: 165382 - DNA, 12 bp, Unknown
  misc_feature (1)..( 12): Result.004 file - promoters50/1377835
agaaaacaaaat

SEQ ID NO: 165383 - DNA, 12 bp, Unknown
  misc_feature (1)..( 12): Result.004 file - promoters50/1377835
ttagaactaaat

SEQ ID NO: 165384 - DNA, 12 bp, Unknown
  misc_feature (1)..( 12): Result.004 file - promoters50/1377835
agaaaacaatca

SEQ ID NO: 165385 - DNA, 8 bp, Unknown
  misc_feature (1)..( 8): Result.004 file - promoters50/1377835
acaaaaac

SEQ ID NO: 165386 - DNA, 8 bp, Unknown
  misc_feature (1)..( 8): Result.004 file - promoters50/1377835
acaaaaca

SEQ ID NO: 165387 - DNA, 8 bp, Unknown
  misc_feature (1)..( 8): Result.004 file - promoters50/1377835
acacaaca

SEQ ID NO: 165388 - DNA, 19 bp, Unknown
  misc_feature (1)..( 19): Result.004 file - promoters50/1377835
tttaattggtcaaaagaaa

SEQ ID NO: 165389 - DNA, 19 bp, Unknown
  misc_feature (1)..( 19): Result.004 file - promoters50/1377835
tctttttgctcagatttct

SEQ ID NO: 165390 - DNA, 19 bp, Unknown
  misc_feature (1)..( 19): Result.004 file - promoters50/1377835
tttaattggtcaacagaaa

SEQ ID NO: 165391 - DNA, 7 bp, Unknown
  misc_feature (1)..( 7): Result.004 file - promoters50/1377835
ccactaa

SEQ ID NO: 165392 - DNA, 7 bp, Unknown
  misc_feature (1)..( 7): Result.004 file - promoters50/1377835
ccattaa

SEQ ID NO: 165393 - DNA, 7 bp, Unknown
  misc_feature (1)..( 7): Result.004 file - promoters50/1377835
tcactaa

SEQ ID NO: 165394 - DNA, 9 bp, Unknown
  misc_feature (1)..( 9): Result.004 file - promoters50/1377835
agataaaaa

SEQ ID NO: 165395 - DNA, 9 bp, Unknown
  misc_feature (1)..( 9): Result.004 file - promoters50/1377835
ttataaaac

SEQ ID NO: 165396 - DNA, 9 bp, Unknown
  misc_feature (1)..( 9): Result.004 file - promoters50/1377835
agagaaaaa

SEQ ID NO: 165397 - DNA, 9 bp, Unknown
  misc_feature (1)..( 9): Result.004 file - promoters50/1377835
cttattttt

SEQ ID NO: 165398 - DNA, 9 bp, Unknown
  misc_feature (1)..( 9): Result.004 file - promoters50/1377835
cttagtttt

SEQ ID NO: 165399 - DNA, 9 bp, Unknown
  misc_feature (1)..( 9): Result.004 file - promoters50/1377847
atcattttt

SEQ ID NO: 165400 - DNA, 11 bp, Unknown
  misc_feature (1)..( 11): Result.004 file - promoters50/1377847
aaaaccaaacc

SEQ ID NO: 165401 - DNA, 11 bp, Unknown
  misc_feature (1)..( 11): Result.004 file - promoters50/1377847
ttgaccaaacg

SEQ ID NO: 165402 - DNA, 11 bp, Unknown
  misc_feature (1)..( 11): Result.004 file - promoters50/1377847
aaaatcaaacc

SEQ ID NO: 165403 - DNA, 11 bp, Unknown
  misc_feature (1)..( 11): Result.004 file - promoters50/1377847
cacaccaaatg

SEQ ID NO: 165404 - DNA, 11 bp, Unknown
  misc_feature (1)..( 11): Result.004 file - promoters50/1377847
gtgatataatt

SEQ ID NO: 165405 - DNA, 11 bp, Unknown
  misc_feature (1)..( 11): Result.004 file - promoters50/1377847
tatttaaaatc

SEQ ID NO: 165406 - DNA, 14 bp, Unknown
  misc_feature (1)..( 14): Result.004 file - promoters50/1377847
aattctcttccttt

SEQ ID NO: 165407 - DNA, 14 bp, Unknown
  misc_feature (1)..( 14): Result.004 file - promoters50/1377847
ttttctctttcatc

SEQ ID NO: 165408 - DNA, 14 bp, Unknown
  misc_feature (1)..( 14): Result.004 file - promoters50/1377847
tggtctctttttct

SEQ ID NO: 165409 - DNA, 14 bp, Unknown
  misc_feature (1)..( 14): Result.004 file - promoters50/1377847
atgcttcttttaca

SEQ ID NO: 165410 - DNA, 14 bp, Unknown
  misc_feature (1)..( 14): Result.004 file - promoters50/1377847
tttcctcttaaaac

SEQ ID NO: 165411 - DNA, 14 bp, Unknown
  misc_feature (1)..( 14): Result.004 file - promoters50/1377847
ctttctctcattcc

SEQ ID NO: 165412 - DNA, 14 bp, Unknown
  misc_feature (1)..( 14): Result.004 file - promoters50/1377847
aattctctgatcaa

SEQ ID NO: 165413 - DNA, 14 bp, Unknown
  misc_feature (1)..( 14): Result.004 file - promoters50/1377847
tccgctcctaagaa

SEQ ID NO: 165414 - DNA, 10 bp, Unknown
  misc_feature (1)..( 10): Result.004 file - promoters50/1377847
ttaatcaatg

SEQ ID NO: 165415 - DNA, 10 bp, Unknown
  misc_feature (1)..( 10): Result.004 file - promoters50/1377847
ccaatgaatc

SEQ ID NO: 165416 - DNA, 10 bp, Unknown
  misc_feature (1)..( 10): Result.004 file - promoters50/1377847
aaaatcaaga

SEQ ID NO: 165417 - DNA, 10 bp, Unknown
  misc_feature (1)..( 10): Result.004 file - promoters50/1377847
ataataaaga

SEQ ID NO: 165418 - DNA, 10 bp, Unknown
  misc_feature (1)..( 10): Result.004 file - promoters50/1377847
aaaaagaaat

SEQ ID NO: 165419 - DNA, 10 bp, Unknown
  misc_feature (1)..( 10): Result.004 file - promoters50/1377847
taaataagaa

SEQ ID NO: 165420 - DNA, 10 bp, Unknown
  misc_feature (1)..( 10): Result.004 file - promoters50/1377847
gaaaacaatc

SEQ ID NO: 165421 - DNA, 13 bp, Unknown
  misc_feature (1)..( 13): Result.004 file - promoters50/1377847
ctaaaaaagtcac

SEQ ID NO: 165422 - DNA, 13 bp, Unknown
  misc_feature (1)..( 13): Result.004 file - promoters50/1377847
atcacaaagtcga

SEQ ID NO: 165423 - DNA, 13 bp, Unknown
  misc_feature (1)..( 13): Result.004 file - promoters50/1377847
aaattaaaatcaa

SEQ ID NO: 165424 - DNA, 12 bp, Unknown
  misc_feature (1)..( 12): Result.004 file - promoters50/1377847
taataaagagaa

SEQ ID NO: 165425 - DNA, 12 bp, Unknown
  misc_feature (1)..( 12): Result.004 file - promoters50/1377847
aaaaaaagaaat

SEQ ID NO: 165426 - DNA, 13 bp, Unknown
  misc_feature (1)..( 13): Result.004 file - promoters50/1377847
ttaaataagaata

SEQ ID NO: 165427 - DNA, 14 bp, Unknown
  misc_feature (1)..( 14): Result.004 file - promoters50/1377847
aatcacaatgtcga

SEQ ID NO: 165428 - DNA, 13 bp, Unknown
  misc_feature (1)..( 13): Result.004 file - promoters50/1377847
tcctttatatata

SEQ ID NO: 165429 - DNA, 13 bp, Unknown
  misc_feature (1)..( 13): Result.004 file - promoters50/1377847
atgtgtataaata

SEQ ID NO: 165430 - DNA, 13 bp, Unknown
  misc_feature (1)..( 13): Result.004 file - promoters50/1377847
tccattatatata

SEQ ID NO: 165431 - DNA, 13 bp, Unknown
  misc_feature (1)..( 13): Result.004 file - promoters50/1377847
acatgtatatata

SEQ ID NO: 165432 - DNA, 13 bp, Unknown
  misc_feature (1)..( 13): Result.004 file - promoters50/1377847
acctttataaact

SEQ ID NO: 165433 - DNA, 13 bp, Unknown
  misc_feature (1)..( 13): Result.004 file - promoters50/1377893
cgccttaaaaacc

SEQ ID NO: 165434 - DNA, 7 bp, Unknown
  misc_feature (1)..( 7): Result.004 file - promoters50/1377893
gttaaag

SEQ ID NO: 165435 - DNA, 7 bp, Unknown
  misc_feature (1)..( 7): Result.004 file - promoters50/1377893
attaaag

SEQ ID NO: 165436 - DNA, 7 bp, Unknown
  misc_feature (1)..( 7): Result.004 file - promoters50/1377929
tataaaa

SEQ ID NO: 165437 - DNA, 11 bp, Unknown
  misc_feature (1)..( 11): Result.004 file - promoters50/1377929
atacttatgtg

SEQ ID NO: 165438 - DNA, 11 bp, Unknown
  misc_feature (1)..( 11): Result.004 file - promoters50/1377929
ttacttaataa

SEQ ID NO: 165439 - DNA, 11 bp, Unknown
  misc_feature (1)..( 11): Result.004 file - promoters50/1378049
ttaattactaa

SEQ ID NO: 165440 - DNA, 13 bp, Unknown
  misc_feature (1)..( 13): Result.004 file - promoters50/1378049
aaacaaatgtttg

SEQ ID NO: 165441 - DNA, 13 bp, Unknown
  misc_feature (1)..( 13): Result.004 file - promoters50/1378049
aaacaaacgtgga

SEQ ID NO: 165442 - DNA, 13 bp, Unknown
  misc_feature (1)..( 13): Result.004 file - promoters50/1378049
aaataaatttttg

SEQ ID NO: 165443 - DNA, 13 bp, Unknown
  misc_feature (1)..( 13): Result.004 file - promoters50/1378049
taactgatttttc

SEQ ID NO: 165444 - DNA, 13 bp, Unknown
  misc_feature (1)..( 13): Result.004 file - promoters50/1378049
atacatatactgt

SEQ ID NO: 165445 - DNA, 13 bp, Unknown
  misc_feature (1)..( 13): Result.004 file - promoters50/1378049
aaataaactcatt

SEQ ID NO: 165446 - DNA, 8 bp, Unknown
  misc_feature (1)..( 8): Result.004 file - promoters50/1378049
aaaatttc

SEQ ID NO: 165447 - DNA, 8 bp, Unknown
  misc_feature (1)..( 8): Result.004 file - promoters50/1378049
aaaattga

SEQ ID NO: 165448 - DNA, 8 bp, Unknown
  misc_feature (1)..( 8): Result.004 file - promoters50/1378049
aaaattaa

SEQ ID NO: 165449 - DNA, 8 bp, Unknown
  misc_feature (1)..( 8): Result.004 file - promoters50/1378049
aaacttta

SEQ ID NO: 165450 - DNA, 9 bp, Unknown
  misc_feature (1)..( 9): Result.004 file - promoters50/1378049
aaatattaa

SEQ ID NO: 165451 - DNA, 9 bp, Unknown
  misc_feature (1)..( 9): Result.004 file - promoters50/1378049
taaagttaa

SEQ ID NO: 165452 - DNA, 11 bp, Unknown
  misc_feature (1)..( 11): Result.004 file - promoters50/1378049
taatatttcat

SEQ ID NO: 165453 - DNA, 11 bp, Unknown
  misc_feature (1)..( 11): Result.004 file - promoters50/1378049
atttatttcct

SEQ ID NO: 165454 - DNA, 11 bp, Unknown
  misc_feature (1)..( 11): Result.004 file - promoters50/1378049
aagaattttta

SEQ ID NO: 165455 - DNA, 11 bp, Unknown
  misc_feature (1)..( 11): Result.004 file - promoters50/1378049
taatatttaga

SEQ ID NO: 165456 - DNA, 11 bp, Unknown
  misc_feature (1)..( 11): Result.004 file - promoters50/1378049
aaaaataaata

SEQ ID NO: 165457 - DNA, 11 bp, Unknown
  misc_feature (1)..( 11): Result.004 file - promoters50/1378049
tgttatttttt

SEQ ID NO: 165458 - DNA, 11 bp, Unknown
  misc_feature (1)..( 11): Result.004 file - promoters50/1378049
tgtgattcgtt

SEQ ID NO: 165459 - DNA, 13 bp, Unknown
  misc_feature (1)..( 13): Result.004 file - promoters50/1378049
atcacttggtaaa

SEQ ID NO: 165460 - DNA, 13 bp, Unknown
  misc_feature (1)..( 13): Result.004 file - promoters50/1378049
cagcggtgggaaa

SEQ ID NO: 165461 - DNA, 13 bp, Unknown
  misc_feature (1)..( 13): Result.004 file - promoters50/1378049
ttaactttgtact

SEQ ID NO: 165462 - DNA, 13 bp, Unknown
  misc_feature (1)..( 13): Result.004 file - promoters50/1378049
ttaaccttgagtt

SEQ ID NO: 165463 - DNA, 13 bp, Unknown
  misc_feature (1)..( 13): Result.004 file - promoters50/1378049
gtcaacttgtaca

SEQ ID NO: 165464 - DNA, 13 bp, Unknown
  misc_feature (1)..( 13): Result.004 file - promoters50/1378049
gaaactttatgaa

SEQ ID NO: 165465 - DNA, 10 bp, Unknown
  misc_feature (1)..( 10): Result.004 file - promoters50/1378049
caatgatatt

SEQ ID NO: 165466 - DNA, 10 bp, Unknown
  misc_feature (1)..( 10): Result.004 file - promoters50/1378049
gtttgatata

SEQ ID NO: 165467 - DNA, 10 bp, Unknown
  misc_feature (1)..( 10): Result.004 file - promoters50/1378049
aaatgttatt

SEQ ID NO: 165468 - DNA, 10 bp, Unknown
  misc_feature (1)..( 10): Result.004 file - promoters50/1378049
aaatgtcaac

SEQ ID NO: 165469 - DNA, 10 bp, Unknown
  misc_feature (1)..( 10): Result.004 file - promoters50/1378049
atttgctatc

SEQ ID NO: 165470 - DNA, 10 bp, Unknown
  misc_feature (1)..( 10): Result.004 file - promoters50/1378049
tttttctata

SEQ ID NO: 165471 - DNA, 9 bp, Unknown
  misc_feature (1)..( 9): Result.004 file - promoters50/1378049
gataatatt

SEQ ID NO: 165472 - DNA, 9 bp, Unknown
  misc_feature (1)..( 9): Result.004 file - promoters50/1378049
aataataac

SEQ ID NO: 165473 - DNA, 9 bp, Unknown
  misc_feature (1)..( 9): Result.004 file - promoters50/1378049
aataaaatt

SEQ ID NO: 165474 - DNA, 9 bp, Unknown
  misc_feature (1)..( 9): Result.004 file - promoters50/1378049
aaaaataaa

SEQ ID NO: 165475 - DNA, 9 bp, Unknown
  misc_feature (1)..( 9): Result.004 file - promoters50/1378049
taaattaga

SEQ ID NO: 165476 - DNA, 9 bp, Unknown
  misc_feature (1)..( 9): Result.004 file - promoters50/1378061
agtactaat

SEQ ID NO: 165477 - DNA, 9 bp, Unknown
  misc_feature (1)..( 9): Result.004 file - promoters50/1378061
tttgttttc

SEQ ID NO: 165478 - DNA, 9 bp, Unknown
  misc_feature (1)..( 9): Result.004 file - promoters50/1378061
tttattttt

SEQ ID NO: 165479 - DNA, 9 bp, Unknown
  misc_feature (1)..( 9): Result.004 file - promoters50/1378061
ttttttttc

SEQ ID NO: 165480 - DNA, 9 bp, Unknown
  misc_feature (1)..( 9): Result.004 file - promoters50/1378061
aagtaaatt

SEQ ID NO: 165481 - DNA, 9 bp, Unknown
  misc_feature (1)..( 9): Result.004 file - promoters50/1378061
atgtatatt

SEQ ID NO: 165482 - DNA, 9 bp, Unknown
  misc_feature (1)..( 9): Result.004 file - promoters50/1378061
atgtatata

SEQ ID NO: 165483 - DNA, 10 bp, Unknown
  misc_feature (1)..( 10): Result.004 file - promoters50/1378061
tattagattt

SEQ ID NO: 165484 - DNA, 10 bp, Unknown
  misc_feature (1)..( 10): Result.004 file - promoters50/1378061
tattaaattt

SEQ ID NO: 165485 - DNA, 10 bp, Unknown
  misc_feature (1)..( 10): Result.004 file - promoters50/1378061
gagaaaattg

SEQ ID NO: 165486 - DNA, 9 bp, Unknown
  misc_feature (1)..( 9): Result.004 file - promoters50/1378061
aaccatata

SEQ ID NO: 165487 - DNA, 9 bp, Unknown
  misc_feature (1)..( 9): Result.004 file - promoters50/1378061
aacaataaa

SEQ ID NO: 165488 - DNA, 9 bp, Unknown
  misc_feature (1)..( 9): Result.004 file - promoters50/1378061
ctccaaata

SEQ ID NO: 165489 - DNA, 9 bp, Unknown
  misc_feature (1)..( 9): Result.004 file - promoters50/1378061
aacatttat

SEQ ID NO: 165490 - DNA, 9 bp, Unknown
  misc_feature (1)..( 9): Result.004 file - promoters50/1378061
gttatttat

SEQ ID NO: 165491 - DNA, 9 bp, Unknown
  misc_feature (1)..( 9): Result.004 file - promoters50/1378061
aacttttaa

SEQ ID NO: 165492 - DNA, 14 bp, Unknown
  misc_feature (1)..( 14): Result.004 file - promoters50/1378061
gtgacattcagttg

SEQ ID NO: 165493 - DNA, 14 bp, Unknown
  misc_feature (1)..( 14): Result.004 file - promoters50/1378061
gtgatattcatttg

SEQ ID NO: 165494 - DNA, 14 bp, Unknown
  misc_feature (1)..( 14): Result.004 file - promoters50/1378078
aaaaaattcatttc

SEQ ID NO: 165495 - DNA, 9 bp, Unknown
  misc_feature (1)..( 9): Result.004 file - promoters50/1378078
taatttttg

SEQ ID NO: 165496 - DNA, 9 bp, Unknown
  misc_feature (1)..( 9): Result.004 file - promoters50/1378078
taatttttg

SEQ ID NO: 165497 - DNA, 9 bp, Unknown
  misc_feature (1)..( 9): Result.004 file - promoters50/1378088
taaatttta

SEQ ID NO: 165498 - DNA, 10 bp, Unknown
  misc_feature (1)..( 10): Result.004 file - promoters50/1378088
caaaatttta

SEQ ID NO: 165499 - DNA, 10 bp, Unknown
  misc_feature (1)..( 10): Result.004 file - promoters50/1378088
aaaaattggg

SEQ ID NO: 165500 - DNA, 10 bp, Unknown
  misc_feature (1)..( 10): Result.004 file - promoters50/1378088
taaagtttta

SEQ ID NO: 165501 - DNA, 11 bp, Unknown
  misc_feature (1)..( 11): Result.004 file - promoters50/1378088
taataatcctt

SEQ ID NO: 165502 - DNA, 11 bp, Unknown
  misc_feature (1)..( 11): Result.004 file - promoters50/1378088
caaacattaca

SEQ ID NO: 165503 - DNA, 11 bp, Unknown
  misc_feature (1)..( 11): Result.004 file - promoters50/1378088
actacagtact

SEQ ID NO: 165504 - DNA, 12 bp, Unknown
  misc_feature (1)..( 12): Result.004 file - promoters50/1378088
aaaaattcggat

SEQ ID NO: 165505 - DNA, 12 bp, Unknown
  misc_feature (1)..( 12): Result.004 file - promoters50/1378088
caaaattgaatc

SEQ ID NO: 165506 - DNA, 12 bp, Unknown
  misc_feature (1)..( 12): Result.004 file - promoters50/1378088
aaaaatccttta

SEQ ID NO: 165507 - DNA, 12 bp, Unknown
  misc_feature (1)..( 12): Result.004 file - promoters50/1378088
gcaaattgtttt

SEQ ID NO: 165508 - DNA, 12 bp, Unknown
  misc_feature (1)..( 12): Result.004 file - promoters50/1378088
gtaaattatttt

SEQ ID NO: 165509 - DNA, 12 bp, Unknown
  misc_feature (1)..( 12): Result.004 file - promoters50/1378088
gtagatttggga

SEQ ID NO: 165510 - DNA, 10 bp, Unknown
  misc_feature (1)..( 10): Result.004 file - promoters50/1378088
aaaatctgga

SEQ ID NO: 165511 - DNA, 10 bp, Unknown
  misc_feature (1)..( 10): Result.004 file - promoters50/1378088
aaaatcatta

SEQ ID NO: 165512 - DNA, 10 bp, Unknown
  misc_feature (1)..( 10): Result.004 file - promoters50/1378088
aaaaacattg

SEQ ID NO: 165513 - DNA, 10 bp, Unknown
  misc_feature (1)..( 10): Result.004 file - promoters50/1378088
aaaaacatat

SEQ ID NO: 165514 - DNA, 10 bp, Unknown
  misc_feature (1)..( 10): Result.004 file - promoters50/1378088
caaattatta

SEQ ID NO: 165515 - DNA, 10 bp, Unknown
  misc_feature (1)..( 10): Result.004 file - promoters50/1378088
taaaacaatt

SEQ ID NO: 165516 - DNA, 10 bp, Unknown
  misc_feature (1)..( 10): Result.004 file - promoters50/1378088
aaaaaaagaa

SEQ ID NO: 165517 - DNA, 11 bp, Unknown
  misc_feature (1)..( 11): Result.004 file - promoters50/1378088
taaaaatctat

SEQ ID NO: 165518 - DNA, 11 bp, Unknown
  misc_feature (1)..( 11): Result.004 file - promoters50/1378088
taaaaattaga

SEQ ID NO: 165519 - DNA, 11 bp, Unknown
  misc_feature (1)..( 11): Result.004 file - promoters50/1378088
acaaaattaac

SEQ ID NO: 165520 - DNA, 11 bp, Unknown
  misc_feature (1)..( 11): Result.004 file - promoters50/1378088
actaaattagt

SEQ ID NO: 165521 - DNA, 11 bp, Unknown
  misc_feature (1)..( 11): Result.004 file - promoters50/1378088
gcttaatttaa

SEQ ID NO: 165522 - DNA, 11 bp, Unknown
  misc_feature (1)..( 11): Result.004 file - promoters50/1378088
ttttaatcaac

SEQ ID NO: 165523 - DNA, 10 bp, Unknown
  misc_feature (1)..( 10): Result.004 file - promoters50/1378088
aaaattttac

SEQ ID NO: 165524 - DNA, 10 bp, Unknown
  misc_feature (1)..( 10): Result.004 file - promoters50/1378088
ttaattttgg

SEQ ID NO: 165525 - DNA, 11 bp, Unknown
  misc_feature (1)..( 11): Result.004 file - promoters50/1378088
taaagttttaa

SEQ ID NO: 165526 - DNA, 11 bp, Unknown
  misc_feature (1)..( 11): Result.004 file - promoters50/1378088
tactattttac

SEQ ID NO: 165527 - DNA, 11 bp, Unknown
  misc_feature (1)..( 11): Result.004 file - promoters50/1378088
actaatttagc

SEQ ID NO: 165528 - DNA, 11 bp, Unknown
  misc_feature (1)..( 11): Result.004 file - promoters50/1378088
taaagtcacat

SEQ ID NO: 165529 - DNA, 10 bp, Unknown
  misc_feature (1)..( 10): Result.004 file - promoters50/1378088
attttataat

SEQ ID NO: 165530 - DNA, 10 bp, Unknown
  misc_feature (1)..( 10): Result.004 file - promoters50/1378088
tctttttaat

SEQ ID NO: 165531 - DNA, 10 bp, Unknown
  misc_feature (1)..( 10): Result.004 file - promoters50/1378088
actttaaaat

SEQ ID NO: 165532 - DNA, 10 bp, Unknown
  misc_feature (1)..( 10): Result.004 file - promoters50/1378088
attttatagg

SEQ ID NO: 165533 - DNA, 10 bp, Unknown
  misc_feature (1)..( 10): Result.004 file - promoters50/1378088
tagttataac

SEQ ID NO: 165534 - DNA, 10 bp, Unknown
  misc_feature (1)..( 10): Result.004 file - promoters50/1378088
cctttaaaca

SEQ ID NO: 165535 - DNA, 13 bp, Unknown
  misc_feature (1)..( 13): Result.004 file - promoters50/1378088
gttagaaataaaa

SEQ ID NO: 165536 - DNA, 13 bp, Unknown
  misc_feature (1)..( 13): Result.004 file - promoters50/1378088
gttaaaaactaaa

SEQ ID NO: 165537 - DNA, 13 bp, Unknown
  misc_feature (1)..( 13): Result.004 file - promoters50/1378088
cttataaaacaat

SEQ ID NO: 165538 - DNA, 13 bp, Unknown
  misc_feature (1)..( 13): Result.004 file - promoters50/1378088
agtaaaaaaacaa

SEQ ID NO: 165539 - DNA, 13 bp, Unknown
  misc_feature (1)..( 13): Result.004 file - promoters50/1378088
gcgtgaaatacta

SEQ ID NO: 165540 - DNA, 13 bp, Unknown
  misc_feature (1)..( 13): Result.004 file - promoters50/1378088
attataagaagaa

SEQ ID NO: 165541 - DNA, 13 bp, Unknown
  misc_feature (1)..( 13): Result.004 file - promoters50/1378088
attacaaaaagaa

SEQ ID NO: 165542 - DNA, 13 bp, Unknown
  misc_feature (1)..( 13): Result.004 file - promoters50/1378088
taaaaattgggtt

SEQ ID NO: 165543 - DNA, 13 bp, Unknown
  misc_feature (1)..( 13): Result.004 file - promoters50/1378088
taaaaagagaaaa

SEQ ID NO: 165544 - DNA, 13 bp, Unknown
  misc_feature (1)..( 13): Result.004 file - promoters50/1378088
taataatccttat

SEQ ID NO: 165545 - DNA, 13 bp, Unknown
  misc_feature (1)..( 13): Result.004 file - promoters50/1378088
taaaaaaacaatt

SEQ ID NO: 165546 - DNA, 13 bp, Unknown
  misc_feature (1)..( 13): Result.004 file - promoters50/1378088
caaacattacaaa

SEQ ID NO: 165547 - DNA, 13 bp, Unknown
  misc_feature (1)..( 13): Result.004 file - promoters50/1378088
taagaagaaaaaa

SEQ ID NO: 165548 - DNA, 13 bp, Unknown
  misc_feature (1)..( 13): Result.004 file - promoters50/1378088
actacagtactat

SEQ ID NO: 165549 - DNA, 8 bp, Unknown
  misc_feature (1)..( 8): Result.004 file - promoters50/1378088
aatcatat

SEQ ID NO: 165550 - DNA, 8 bp, Unknown
  misc_feature (1)..( 8): Result.004 file - promoters50/1378088
tttcatat

SEQ ID NO: 165551 - DNA, 8 bp, Unknown
  misc_feature (1)..( 8): Result.004 file - promoters50/1378088
aattataa

SEQ ID NO: 165552 - DNA, 8 bp, Unknown
  misc_feature (1)..( 8): Result.004 file - promoters50/1378088
acttataa

SEQ ID NO: 165553 - DNA, 8 bp, Unknown
  misc_feature (1)..( 8): Result.004 file - promoters50/1378088
tttaatag

SEQ ID NO: 165554 - DNA, 9 bp, Unknown
  misc_feature (1)..( 9): Result.004 file - promoters50/1378088
gattagtag

SEQ ID NO: 165555 - DNA, 13 bp, Unknown
  misc_feature (1)..( 13): Result.004 file - promoters50/1378088
ttagaagaagtta

SEQ ID NO: 165556 - DNA, 13 bp, Unknown
  misc_feature (1)..( 13): Result.004 file - promoters50/1378088
ttataagaagaaa

SEQ ID NO: 165557 - DNA, 13 bp, Unknown
  misc_feature (1)..( 13): Result.004 file - promoters50/1378088
taaaaagagaaaa

SEQ ID NO: 165558 - DNA, 13 bp, Unknown
  misc_feature (1)..( 13): Result.004 file - promoters50/1378088
taaaaactttgtt

SEQ ID NO: 165559 - DNA, 13 bp, Unknown
  misc_feature (1)..( 13): Result.004 file - promoters50/1378088
caaaaagaaaaaa

SEQ ID NO: 165560 - DNA, 13 bp, Unknown
  misc_feature (1)..( 13): Result.004 file - promoters50/1378287
ttataaaacaatt

SEQ ID NO: 165561 - DNA, 20 bp, Unknown
  misc_feature (1)..( 20): Result.004 file - promoters50/1378287
aaaattgaaactttttagaa

SEQ ID NO: 165562 - DNA, 20 bp, Unknown
  misc_feature (1)..( 20): Result.004 file - promoters50/1378287
tgaatttaaagcttcacatt

SEQ ID NO: 165563 - DNA, 20 bp, Unknown
  misc_feature (1)..( 20): Result.004 file - promoters50/1378287
caaatcgaagaaagcagagg

SEQ ID NO: 165564 - DNA, 20 bp, Unknown
  misc_feature (1)..( 20): Result.004 file - promoters50/1378287
tgaatttgtaattaaccaat

SEQ ID NO: 165565 - DNA, 20 bp, Unknown
  misc_feature (1)..( 20): Result.004 file - promoters50/1378287
cttttttaaaaaactatata

SEQ ID NO: 165566 - DNA, 20 bp, Unknown
  misc_feature (1)..( 20): Result.004 file - promoters50/1378333
caattttaagaaagtatata

SEQ ID NO: 165567 - DNA, 7 bp, Unknown
  misc_feature (1)..( 7): Result.004 file - promoters50/1378333
gctaaaa

SEQ ID NO: 165568 - DNA, 7 bp, Unknown
  misc_feature (1)..( 7): Result.004 file - promoters50/1378333
gctgaaa

SEQ ID NO: 165569 - DNA, 7 bp, Unknown
  misc_feature (1)..( 7): Result.004 file - promoters50/1378357
tctgaaa

SEQ ID NO: 165570 - DNA, 9 bp, Unknown
  misc_feature (1)..( 9): Result.004 file - promoters50/1378357
gaggtagat

SEQ ID NO: 165571 - DNA, 9 bp, Unknown
  misc_feature (1)..( 9): Result.004 file - promoters50/1378357
gaggaagaa

SEQ ID NO: 165572 - DNA, 9 bp, Unknown
  misc_feature (1)..( 9): Result.004 file - promoters50/1378393
gaataagaa

SEQ ID NO: 165573 - DNA, 12 bp, Unknown
  misc_feature (1)..( 12): Result.004 file - promoters50/1378393
cggataagcaaa

SEQ ID NO: 165574 - DNA, 12 bp, Unknown
  misc_feature (1)..( 12): Result.004 file - promoters50/1378393
tagataagtaaa

SEQ ID NO: 165575 - DNA, 12 bp, Unknown
  misc_feature (1)..( 12): Result.004 file - promoters50/1378393
cagaaaagaaat

SEQ ID NO: 165576 - DNA, 12 bp, Unknown
  misc_feature (1)..( 12): Result.004 file - promoters50/1378393
aaaaaaaataaa

SEQ ID NO: 165577 - DNA, 12 bp, Unknown
  misc_feature (1)..( 12): Result.004 file - promoters50/1378393
ttgtaaagattt

SEQ ID NO: 165578 - DNA, 12 bp, Unknown
  misc_feature (1)..( 12): Result.004 file - promoters50/1378393
aagaaaagaaag

SEQ ID NO: 165579 - DNA, 12 bp, Unknown
  misc_feature (1)..( 12): Result.004 file - promoters50/1378393
aagaaaatctgc

SEQ ID NO: 165580 - DNA, 9 bp, Unknown
  misc_feature (1)..( 9): Result.004 file - promoters50/1378393
taaaataaa

SEQ ID NO: 165581 - DNA, 9 bp, Unknown
  misc_feature (1)..( 9): Result.004 file - promoters50/1378393
aaaaagaaa

SEQ ID NO: 165582 - DNA, 9 bp, Unknown
  misc_feature (1)..( 9): Result.004 file - promoters50/1378393
caaactaaa

SEQ ID NO: 165583 - DNA, 9 bp, Unknown
  misc_feature (1)..( 9): Result.004 file - promoters50/1378393
caatctata

SEQ ID NO: 165584 - DNA, 10 bp, Unknown
  misc_feature (1)..( 10): Result.004 file - promoters50/1378393
caaaatgaaa

SEQ ID NO: 165585 - DNA, 10 bp, Unknown
  misc_feature (1)..( 10): Result.004 file - promoters50/1378400
ataaattaat

SEQ ID NO: 165586 - DNA, 8 bp, Unknown
  misc_feature (1)..( 8): Result.004 file - promoters50/1378400
gaaaagaa

SEQ ID NO: 165587 - DNA, 8 bp, Unknown
  misc_feature (1)..( 8): Result.004 file - promoters50/1378400
gaagagaa

SEQ ID NO: 165588 - DNA, 8 bp, Unknown
  misc_feature (1)..( 8): Result.004 file - promoters50/1378400
gaaaagaa

SEQ ID NO: 165589 - DNA, 14 bp, Unknown
  misc_feature (1)..( 14): Result.004 file - promoters50/1378400
agagagagagagag

SEQ ID NO: 165590 - DNA, 14 bp, Unknown
  misc_feature (1)..( 14): Result.004 file - promoters50/1378400
agagagagaggtga

SEQ ID NO: 165591 - DNA, 14 bp, Unknown
  misc_feature (1)..( 14): Result.004 file - promoters50/1378400
agagagagagagag

SEQ ID NO: 165592 - DNA, 8 bp, Unknown
  misc_feature (1)..( 8): Result.004 file - promoters50/1378400
gaagagaa

SEQ ID NO: 165593 - DNA, 8 bp, Unknown
  misc_feature (1)..( 8): Result.004 file - promoters50/1378400
gaaaagaa

SEQ ID NO: 165594 - DNA, 8 bp, Unknown
  misc_feature (1)..( 8): Result.004 file - promoters50/1378458
gaagagaa

SEQ ID NO: 165595 - DNA, 8 bp, Unknown
  misc_feature (1)..( 8): Result.004 file - promoters50/1378458
gaagcaaa

SEQ ID NO: 165596 - DNA, 8 bp, Unknown
  misc_feature (1)..( 8): Result.004 file - promoters50/1378458
aaagaaaa

SEQ ID NO: 165597 - DNA, 8 bp, Unknown
  misc_feature (1)..( 8): Result.004 file - promoters50/1378528
aaagaata

SEQ ID NO: 165598 - DNA, 13 bp, Unknown
  misc_feature (1)..( 13): Result.004 file - promoters50/1378528
tcttgtaaataat

SEQ ID NO: 165599 - DNA, 7 bp, Unknown
  misc_feature (1)..( 7): Result.004 file - promoters50/1378528
aaataaa

SEQ ID NO: 165600 - DNA, 13 bp, Unknown
  misc_feature (1)..( 13): Result.004 file - promoters50/1378528
tcttttaattaaa

SEQ ID NO: 165601 - DNA, 13 bp, Unknown
  misc_feature (1)..( 13): Result.004 file - promoters50/1378528
gatattaaataat

SEQ ID NO: 165602 - DNA, 13 bp, Unknown
  misc_feature (1)..( 13): Result.004 file - promoters50/1378528
gcttttaattaaa

SEQ ID NO: 165603 - DNA, 13 bp, Unknown
  misc_feature (1)..( 13): Result.004 file - promoters50/1378528
tttttgaattcca

SEQ ID NO: 165604 - DNA, 13 bp, Unknown
  misc_feature (1)..( 13): Result.004 file - promoters50/1378528
taattttgaaaag

SEQ ID NO: 165605 - DNA, 13 bp, Unknown
  misc_feature (1)..( 13): Result.004 file - promoters50/1378528
aaaaaatgaaaaa

SEQ ID NO: 165606 - DNA, 13 bp, Unknown
  misc_feature (1)..( 13): Result.004 file - promoters50/1378528
ttttaattaaatg

SEQ ID NO: 165607 - DNA, 11 bp, Unknown
  misc_feature (1)..( 11): Result.004 file - promoters50/1378528
ttatcgaaaaa

SEQ ID NO: 165608 - DNA, 13 bp, Unknown
  misc_feature (1)..( 13): Result.004 file - promoters50/1378528
aaataatcaaata

SEQ ID NO: 165609 - DNA, 13 bp, Unknown
  misc_feature (1)..( 13): Result.004 file - promoters50/1378528
ttttaattaaacc

SEQ ID NO: 165610 - DNA, 13 bp, Unknown
  misc_feature (1)..( 13): Result.004 file - promoters50/1378528
aaataattttgaa

SEQ ID NO: 165611 - DNA, 13 bp, Unknown
  misc_feature (1)..( 13): Result.004 file - promoters50/1378528
tagtaatattggt

SEQ ID NO: 165612 - DNA, 13 bp, Unknown
  misc_feature (1)..( 13): Result.004 file - promoters50/1378528
aaaagtttttgaa

SEQ ID NO: 165613 - DNA, 13 bp, Unknown
  misc_feature (1)..( 13): Result.004 file - promoters50/1378528
ttttaattaaatg

SEQ ID NO: 165614 - DNA, 13 bp, Unknown
  misc_feature (1)..( 13): Result.004 file - promoters50/1378528
atttaatgatatt

SEQ ID NO: 165615 - DNA, 13 bp, Unknown
  misc_feature (1)..( 13): Result.004 file - promoters50/1378528
ttttaattaaacc

SEQ ID NO: 165616 - DNA, 11 bp, Unknown
  misc_feature (1)..( 11): Result.004 file - promoters50/1378528
ataatttaaca

SEQ ID NO: 165617 - DNA, 11 bp, Unknown
  misc_feature (1)..( 11): Result.004 file - promoters50/1378528
gtaattttctt

SEQ ID NO: 165618 - DNA, 11 bp, Unknown
  misc_feature (1)..( 11): Result.004 file - promoters50/1378528
atagtttagaa

SEQ ID NO: 165619 - DNA, 11 bp, Unknown
  misc_feature (1)..( 11): Result.004 file - promoters50/1378528
atattttgatt

SEQ ID NO: 165620 - DNA, 11 bp, Unknown
  misc_feature (1)..( 11): Result.004 file - promoters50/1378528
atattgtgatt

SEQ ID NO: 165621 - DNA, 11 bp, Unknown
  misc_feature (1)..( 11): Result.004 file - promoters50/1378528
tgagtttatat

SEQ ID NO: 165622 - DNA, 9 bp, Unknown
  misc_feature (1)..( 9): Result.004 file - promoters50/1378528
aatttttac

SEQ ID NO: 165623 - DNA, 9 bp, Unknown
  misc_feature (1)..( 9): Result.004 file - promoters50/1378528
aattcttat

SEQ ID NO: 165624 - DNA, 9 bp, Unknown
  misc_feature (1)..( 9): Result.004 file - promoters50/1378528
aattttcta

SEQ ID NO: 165625 - DNA, 9 bp, Unknown
  misc_feature (1)..( 9): Result.004 file - promoters50/1378528
aattttgat

SEQ ID NO: 165626 - DNA, 9 bp, Unknown
  misc_feature (1)..( 9): Result.004 file - promoters50/1378528
gattgtctt

SEQ ID NO: 165627 - DNA, 9 bp, Unknown
  misc_feature (1)..( 9): Result.004 file - promoters50/1378558
tattctgat

SEQ ID NO: 165628 - DNA, 10 bp, Unknown
  misc_feature (1)..( 10): Result.004 file - promoters50/1378558
attttatttt

SEQ ID NO: 165629 - DNA, 10 bp, Unknown
  misc_feature (1)..( 10): Result.004 file - promoters50/1378558
attttgtttt

SEQ ID NO: 165630 - DNA, 10 bp, Unknown
  misc_feature (1)..( 10): Result.004 file - promoters50/1378558
aggttgttta

SEQ ID NO: 165631 - DNA, 9 bp, Unknown
  misc_feature (1)..( 9): Result.004 file - promoters50/1378558
acattttta

SEQ ID NO: 165632 - DNA, 9 bp, Unknown
  misc_feature (1)..( 9): Result.004 file - promoters50/1378558
gtattttta

SEQ ID NO: 165633 - DNA, 9 bp, Unknown
  misc_feature (1)..( 9): Result.004 file - promoters50/1378577
gtatcttta

SEQ ID NO: 165634 - DNA, 10 bp, Unknown
  misc_feature (1)..( 10): Result.004 file - promoters50/1378577
ttagcttctt

SEQ ID NO: 165635 - DNA, 10 bp, Unknown
  misc_feature (1)..( 10): Result.004 file - promoters50/1378577
ttatcttctt

SEQ ID NO: 165636 - DNA, 10 bp, Unknown
  misc_feature (1)..( 10): Result.004 file - promoters50/1378592
ttagctttaa

SEQ ID NO: 165637 - DNA, 13 bp, Unknown
  misc_feature (1)..( 13): Result.004 file - promoters50/1378592
tcatagtaagata

SEQ ID NO: 165638 - DNA, 13 bp, Unknown
  misc_feature (1)..( 13): Result.004 file - promoters50/1378592
tgatattaaatca

SEQ ID NO: 165639 - DNA, 13 bp, Unknown
  misc_feature (1)..( 13): Result.004 file - promoters50/1378592
atatactaatgat

SEQ ID NO: 165640 - DNA, 13 bp, Unknown
  misc_feature (1)..( 13): Result.004 file - promoters50/1378592
cagtagtgagatc

SEQ ID NO: 165641 - DNA, 13 bp, Unknown
  misc_feature (1)..( 13): Result.004 file - promoters50/1378592
gaatattaaatca

SEQ ID NO: 165642 - DNA, 13 bp, Unknown
  misc_feature (1)..( 13): Result.004 file - promoters50/1378592
gaacattggattt

SEQ ID NO: 165643 - DNA, 13 bp, Unknown
  misc_feature (1)..( 13): Result.004 file - promoters50/1378592
taactttaccaaa

SEQ ID NO: 165644 - DNA, 13 bp, Unknown
  misc_feature (1)..( 13): Result.004 file - promoters50/1378592
tggctttactata

SEQ ID NO: 165645 - DNA, 13 bp, Unknown
  misc_feature (1)..( 13): Result.004 file - promoters50/1378592
taaatttaaaact

SEQ ID NO: 165646 - DNA, 13 bp, Unknown
  misc_feature (1)..( 13): Result.004 file - promoters50/1378592
aaattttcccaaa

SEQ ID NO: 165647 - DNA, 13 bp, Unknown
  misc_feature (1)..( 13): Result.004 file - promoters50/1378592
taaatttaatttg

SEQ ID NO: 165648 - DNA, 13 bp, Unknown
  misc_feature (1)..( 13): Result.004 file - promoters50/1378622
aaaccctaattat

SEQ ID NO: 165649 - DNA, 14 bp, Unknown
  misc_feature (1)..( 14): Result.004 file - promoters50/1378622
ataaagatttaacc

SEQ ID NO: 165650 - DNA, 14 bp, Unknown
  misc_feature (1)..( 14): Result.004 file - promoters50/1378622
gataagattgccgt

SEQ ID NO: 165651 - DNA, 14 bp, Unknown
  misc_feature (1)..( 14): Result.004 file - promoters50/1378622
taaaagatttgatt

SEQ ID NO: 165652 - DNA, 14 bp, Unknown
  misc_feature (1)..( 14): Result.004 file - promoters50/1378622
cttgagataaaatt

SEQ ID NO: 165653 - DNA, 14 bp, Unknown
  misc_feature (1)..( 14): Result.004 file - promoters50/1378622
gatgagattagctg

SEQ ID NO: 165654 - DNA, 15 bp, Unknown
  misc_feature (1)..( 15): Result.004 file - promoters50/1378622
ttaaaaacttcttgc

SEQ ID NO: 165655 - DNA, 11 bp, Unknown
  misc_feature (1)..( 11): Result.004 file - promoters50/1378622
tttacaataat

SEQ ID NO: 165656 - DNA, 11 bp, Unknown
  misc_feature (1)..( 11): Result.004 file - promoters50/1378622
gttataattat

SEQ ID NO: 165657 - DNA, 11 bp, Unknown
  misc_feature (1)..( 11): Result.004 file - promoters50/1378622
gaaataattat

SEQ ID NO: 165658 - DNA, 11 bp, Unknown
  misc_feature (1)..( 11): Result.004 file - promoters50/1378622
gttttaactta

SEQ ID NO: 165659 - DNA, 11 bp, Unknown
  misc_feature (1)..( 11): Result.004 file - promoters50/1378622
gttttaacgag

SEQ ID NO: 165660 - DNA, 13 bp, Unknown
  misc_feature (1)..( 13): Result.004 file - promoters50/1378622
ataaaattataaa

SEQ ID NO: 165661 - DNA, 13 bp, Unknown
  misc_feature (1)..( 13): Result.004 file - promoters50/1378622
ccggaattttaac

SEQ ID NO: 165662 - DNA, 13 bp, Unknown
  misc_feature (1)..( 13): Result.004 file - promoters50/1378622
atacaatgatatt

SEQ ID NO: 165663 - DNA, 14 bp, Unknown
  misc_feature (1)..( 14): Result.004 file - promoters50/1378622
atccacttattaat

SEQ ID NO: 165664 - DNA, 14 bp, Unknown
  misc_feature (1)..( 14): Result.004 file - promoters50/1378622
ttaacctttgacca

SEQ ID NO: 165665 - DNA, 13 bp, Unknown
  misc_feature (1)..( 13): Result.004 file - promoters50/1378622
acaaataaaaatt

SEQ ID NO: 165666 - DNA, 13 bp, Unknown
  misc_feature (1)..( 13): Result.004 file - promoters50/1378622
cctcttaaatatt

SEQ ID NO: 165667 - DNA, 13 bp, Unknown
  misc_feature (1)..( 13): Result.004 file - promoters50/1378622
caaattaaagtcg

SEQ ID NO: 165668 - DNA, 13 bp, Unknown
  misc_feature (1)..( 13): Result.004 file - promoters50/1378622
tagcttgaatcaa

SEQ ID NO: 165669 - DNA, 13 bp, Unknown
  misc_feature (1)..( 13): Result.004 file - promoters50/1378622
atcgatgaatcct

SEQ ID NO: 165670 - DNA, 12 bp, Unknown
  misc_feature (1)..( 12): Result.004 file - promoters50/1378622
aaatacaataaa

SEQ ID NO: 165671 - DNA, 12 bp, Unknown
  misc_feature (1)..( 12): Result.004 file - promoters50/1378622
agataaaatttc

SEQ ID NO: 165672 - DNA, 12 bp, Unknown
  misc_feature (1)..( 12): Result.004 file - promoters50/1378622
agataagattgc

SEQ ID NO: 165673 - DNA, 12 bp, Unknown
  misc_feature (1)..( 12): Result.004 file - promoters50/1378622
tgatgagattag

SEQ ID NO: 165674 - DNA, 13 bp, Unknown
  misc_feature (1)..( 13): Result.004 file - promoters50/1378622
tttaaaaacttct

SEQ ID NO: 165675 - DNA, 16 bp, Unknown
  misc_feature (1)..( 16): Result.004 file - promoters50/1378622
attgattcaaaattct

SEQ ID NO: 165676 - DNA, 16 bp, Unknown
  misc_feature (1)..( 16): Result.004 file - promoters50/1378622
cttgaatcaatatttt

SEQ ID NO: 165677 - DNA, 16 bp, Unknown
  misc_feature (1)..( 16): Result.004 file - promoters50/1378622
gtgacaataaaagtct

SEQ ID NO: 165678 - DNA, 16 bp, Unknown
  misc_feature (1)..( 16): Result.004 file - promoters50/1378622
cttaaatatttttcat

SEQ ID NO: 165679 - DNA, 16 bp, Unknown
  misc_feature (1)..( 16): Result.004 file - promoters50/1378636
tttccatccatatgtt

SEQ ID NO: 165680 - DNA, 7 bp, Unknown
  misc_feature (1)..( 7): Result.004 file - promoters50/1378636
tttactt

SEQ ID NO: 165681 - DNA, 7 bp, Unknown
  misc_feature (1)..( 7): Result.004 file - promoters50/1378636
tttactc

SEQ ID NO: 165682 - DNA, 7 bp, Unknown
  misc_feature (1)..( 7): Result.004 file - promoters50/1378636
attactt

SEQ ID NO: 165683 - DNA, 8 bp, Unknown
  misc_feature (1)..( 8): Result.004 file - promoters50/1378636
tcaaattt

SEQ ID NO: 165684 - DNA, 8 bp, Unknown
  misc_feature (1)..( 8): Result.004 file - promoters50/1378636
ttaaattt

SEQ ID NO: 165685 - DNA, 8 bp, Unknown
  misc_feature (1)..( 8): Result.004 file - promoters50/1378636
tcatattg

SEQ ID NO: 165686 - DNA, 7 bp, Unknown
  misc_feature (1)..( 7): Result.004 file - promoters50/1378636
tgagaaa

SEQ ID NO: 165687 - DNA, 7 bp, Unknown
  misc_feature (1)..( 7): Result.004 file - promoters50/1378636
tgacaaa

SEQ ID NO: 165688 - DNA, 7 bp, Unknown
  misc_feature (1)..( 7): Result.004 file - promoters50/1378636
tgaaaaa

SEQ ID NO: 165689 - DNA, 8 bp, Unknown
  misc_feature (1)..( 8): Result.004 file - promoters50/1378636
aaaagaaa

SEQ ID NO: 165690 - DNA, 8 bp, Unknown
  misc_feature (1)..( 8): Result.004 file - promoters50/1378636
caaagaag

SEQ ID NO: 165691 - DNA, 8 bp, Unknown
  misc_feature (1)..( 8): Result.004 file - promoters50/1378692
aaaacaaa

SEQ ID NO: 165692 - DNA, 10 bp, Unknown
  misc_feature (1)..( 10): Result.004 file - promoters50/1378692
attttataat

SEQ ID NO: 165693 - DNA, 10 bp, Unknown
  misc_feature (1)..( 10): Result.004 file - promoters50/1378692
ctttcataaa

SEQ ID NO: 165694 - DNA, 11 bp, Unknown
  misc_feature (1)..( 11): Result.004 file - promoters50/1378692
tttctaataat

SEQ ID NO: 165695 - DNA, 11 bp, Unknown
  misc_feature (1)..( 11): Result.004 file - promoters50/1378692
tgatttataat

SEQ ID NO: 165696 - DNA, 11 bp, Unknown
  misc_feature (1)..( 11): Result.004 file - promoters50/1378692
ttattcataga

SEQ ID NO: 165697 - DNA, 11 bp, Unknown
  misc_feature (1)..( 11): Result.004 file - promoters50/1378788
ggatgtatgca

SEQ ID NO: 165698 - DNA, 7 bp, Unknown
  misc_feature (1)..( 7): Result.004 file - promoters50/1378788
attgaac

SEQ ID NO: 165699 - DNA, 7 bp, Unknown
  misc_feature (1)..( 7): Result.004 file - promoters50/1378788
tttgaac

SEQ ID NO: 165700 - DNA, 7 bp, Unknown
  misc_feature (1)..( 7): Result.004 file - promoters50/1378788
atttaac

SEQ ID NO: 165701 - DNA, 10 bp, Unknown
  misc_feature (1)..( 10): Result.004 file - promoters50/1378788
gattttctaa

SEQ ID NO: 165702 - DNA, 10 bp, Unknown
  misc_feature (1)..( 10): Result.004 file - promoters50/1378788
aatttactaa

SEQ ID NO: 165703 - DNA, 10 bp, Unknown
  misc_feature (1)..( 10): Result.004 file - promoters50/1378788
aatttagact

SEQ ID NO: 165704 - DNA, 9 bp, Unknown
  misc_feature (1)..( 9): Result.004 file - promoters50/1378788
cgtgtgttt

SEQ ID NO: 165705 - DNA, 9 bp, Unknown
  misc_feature (1)..( 9): Result.004 file - promoters50/1378788
cgtgtgtaa

SEQ ID NO: 165706 - DNA, 9 bp, Unknown
  misc_feature (1)..( 9): Result.004 file - promoters50/1378788
attgttttt

SEQ ID NO: 165707 - DNA, 12 bp, Unknown
  misc_feature (1)..( 12): Result.004 file - promoters50/1378788
cccatattttat

SEQ ID NO: 165708 - DNA, 12 bp, Unknown
  misc_feature (1)..( 12): Result.004 file - promoters50/1378788
tttataatttat

SEQ ID NO: 165709 - DNA, 12 bp, Unknown
  misc_feature (1)..( 12): Result.004 file - promoters50/1378800
tttattatttga

SEQ ID NO: 165710 - DNA, 8 bp, Unknown
  misc_feature (1)..( 8): Result.004 file - promoters50/1378800
gtttcttt

SEQ ID NO: 165711 - DNA, 8 bp, Unknown
  misc_feature (1)..( 8): Result.004 file - promoters50/1378800
gttttttt

SEQ ID NO: 165712 - DNA, 8 bp, Unknown
  misc_feature (1)..( 8): Result.004 file - promoters50/1378800
ttttcttt

SEQ ID NO: 165713 - DNA, 7 bp, Unknown
  misc_feature (1)..( 7): Result.004 file - promoters50/1378800
ctttctt

SEQ ID NO: 165714 - DNA, 7 bp, Unknown
  misc_feature (1)..( 7): Result.004 file - promoters50/1378800
ctttctt

SEQ ID NO: 165715 - DNA, 7 bp, Unknown
  misc_feature (1)..( 7): Result.004 file - promoters50/1378800
ttttctt

SEQ ID NO: 165716 - DNA, 8 bp, Unknown
  misc_feature (1)..( 8): Result.004 file - promoters50/1378800
tttaaaaa

SEQ ID NO: 165717 - DNA, 8 bp, Unknown
  misc_feature (1)..( 8): Result.004 file - promoters50/1378800
cataaaaa

SEQ ID NO: 165718 - DNA, 8 bp, Unknown
  misc_feature (1)..( 8): Result.004 file - promoters50/1378800
catataaa

SEQ ID NO: 165719 - DNA, 6 bp, Unknown
  misc_feature (1)..( 6): Result.004 file - promoters50/1378800
gttttt

SEQ ID NO: 165720 - DNA, 6 bp, Unknown
  misc_feature (1)..( 6): Result.004 file - promoters50/1378800
gttttt

SEQ ID NO: 165721 - DNA, 6 bp, Unknown
  misc_feature (1)..( 6): Result.004 file - promoters50/1378800
gttttt

SEQ ID NO: 165722 - DNA, 10 bp, Unknown
  misc_feature (1)..( 10): Result.004 file - promoters50/1378800
attttttaaa

SEQ ID NO: 165723 - DNA, 10 bp, Unknown
  misc_feature (1)..( 10): Result.004 file - promoters50/1378800
atttttctta

SEQ ID NO: 165724 - DNA, 10 bp, Unknown
  misc_feature (1)..( 10): Result.004 file - promoters50/1378823
gtttttttta

SEQ ID NO: 165725 - DNA, 8 bp, Unknown
  misc_feature (1)..( 8): Result.004 file - promoters50/1378823
ctatctct

SEQ ID NO: 165726 - DNA, 8 bp, Unknown
  misc_feature (1)..( 8): Result.004 file - promoters50/1378823
ttatatct

SEQ ID NO: 165727 - DNA, 8 bp, Unknown
  misc_feature (1)..( 8): Result.004 file - promoters50/1378823
ttagatcg

SEQ ID NO: 165728 - DNA, 8 bp, Unknown
  misc_feature (1)..( 8): Result.004 file - promoters50/1378823
atcatttt

SEQ ID NO: 165729 - DNA, 9 bp, Unknown
  misc_feature (1)..( 9): Result.004 file - promoters50/1378823
tatcatttt

SEQ ID NO: 165730 - DNA, 9 bp, Unknown
  misc_feature (1)..( 9): Result.004 file - promoters50/1378876
tatgattaa

SEQ ID NO: 165731 - DNA, 9 bp, Unknown
  misc_feature (1)..( 9): Result.004 file - promoters50/1378876
tgtatggct

SEQ ID NO: 165732 - DNA, 9 bp, Unknown
  misc_feature (1)..( 9): Result.004 file - promoters50/1378876
tgtatggat

SEQ ID NO: 165733 - DNA, 9 bp, Unknown
  misc_feature (1)..( 9): Result.004 file - promoters50/1378876
tctatcgct

SEQ ID NO: 165734 - DNA, 8 bp, Unknown
  misc_feature (1)..( 8): Result.004 file - promoters50/1378876
aagaaacc

SEQ ID NO: 165735 - DNA, 8 bp, Unknown
  misc_feature (1)..( 8): Result.004 file - promoters50/1378876
aagaaagt

SEQ ID NO: 165736 - DNA, 8 bp, Unknown
  misc_feature (1)..( 8): Result.004 file - promoters50/1378888
gagacagt

SEQ ID NO: 165737 - DNA, 11 bp, Unknown
  misc_feature (1)..( 11): Result.004 file - promoters50/1378888
caagtatctga

SEQ ID NO: 165738 - DNA, 11 bp, Unknown
  misc_feature (1)..( 11): Result.004 file - promoters50/1378888
caattattttc

SEQ ID NO: 165739 - DNA, 11 bp, Unknown
  misc_feature (1)..( 11): Result.004 file - promoters50/1378888
aaagtttctga

SEQ ID NO: 165740 - DNA, 8 bp, Unknown
  misc_feature (1)..( 8): Result.004 file - promoters50/1378888
atatttca

SEQ ID NO: 165741 - DNA, 8 bp, Unknown
  misc_feature (1)..( 8): Result.004 file - promoters50/1378888
atatttgt

SEQ ID NO: 165742 - DNA, 8 bp, Unknown
  misc_feature (1)..( 8): Result.004 file - promoters50/1379005
gtatctgt

SEQ ID NO: 165743 - DNA, 9 bp, Unknown
  misc_feature (1)..( 9): Result.004 file - promoters50/1379005
ttacagtta

SEQ ID NO: 165744 - DNA, 9 bp, Unknown
  misc_feature (1)..( 9): Result.004 file - promoters50/1379005
aaacattta

SEQ ID NO: 165745 - DNA, 9 bp, Unknown
  misc_feature (1)..( 9): Result.004 file - promoters50/1379005
ttatagtca

SEQ ID NO: 165746 - DNA, 9 bp, Unknown
  misc_feature (1)..( 9): Result.004 file - promoters50/1379005
aaacactta

SEQ ID NO: 165747 - DNA, 9 bp, Unknown
  misc_feature (1)..( 9): Result.004 file - promoters50/1379005
tttcattta

SEQ ID NO: 165748 - DNA, 9 bp, Unknown
  misc_feature (1)..( 9): Result.004 file - promoters50/1379005
attcactta

SEQ ID NO: 165749 - DNA, 12 bp, Unknown
  misc_feature (1)..( 12): Result.004 file - promoters50/1379005
ttttaattcttt

SEQ ID NO: 165750 - DNA, 12 bp, Unknown
  misc_feature (1)..( 12): Result.004 file - promoters50/1379005
tataaattctga

SEQ ID NO: 165751 - DNA, 12 bp, Unknown
  misc_feature (1)..( 12): Result.004 file - promoters50/1379005
ttttacttcaac

SEQ ID NO: 165752 - DNA, 13 bp, Unknown
  misc_feature (1)..( 13): Result.004 file - promoters50/1379005
ttagtgattttac

SEQ ID NO: 165753 - DNA, 13 bp, Unknown
  misc_feature (1)..( 13): Result.004 file - promoters50/1379005
aattaagttctat

SEQ ID NO: 165754 - DNA, 13 bp, Unknown
  misc_feature (1)..( 13): Result.004 file - promoters50/1379005
ccagaaattctac

SEQ ID NO: 165755 - DNA, 13 bp, Unknown
  misc_feature (1)..( 13): Result.004 file - promoters50/1379014
aagtaaataagtt

SEQ ID NO: 165756 - DNA, 7 bp, Unknown
  misc_feature (1)..( 7): Result.004 file - promoters50/1379014
catgcaa

SEQ ID NO: 165757 - DNA, 7 bp, Unknown
  misc_feature (1)..( 7): Result.004 file - promoters50/1379014
catacaa

SEQ ID NO: 165758 - DNA, 7 bp, Unknown
  misc_feature (1)..( 7): Result.004 file - promoters50/1379014
gatgcaa

SEQ ID NO: 165759 - DNA, 8 bp, Unknown
  misc_feature (1)..( 8): Result.004 file - promoters50/1379014
aatttacc

SEQ ID NO: 165760 - DNA, 8 bp, Unknown
  misc_feature (1)..( 8): Result.004 file - promoters50/1379014
aatttaaa

SEQ ID NO: 165761 - DNA, 8 bp, Unknown
  misc_feature (1)..( 8): Result.004 file - promoters50/1379037
aattcaaa

SEQ ID NO: 165762 - DNA, 11 bp, Unknown
  misc_feature (1)..( 11): Result.004 file - promoters50/1379037
tttaaataaaa

SEQ ID NO: 165763 - DNA, 11 bp, Unknown
  misc_feature (1)..( 11): Result.004 file - promoters50/1379037
ttcaaataaaa

SEQ ID NO: 165764 - DNA, 11 bp, Unknown
  misc_feature (1)..( 11): Result.004 file - promoters50/1379037
ttctaatatcc

SEQ ID NO: 165765 - DNA, 10 bp, Unknown
  misc_feature (1)..( 10): Result.004 file - promoters50/1379037
ctaaaatagt

SEQ ID NO: 165766 - DNA, 10 bp, Unknown
  misc_feature (1)..( 10): Result.004 file - promoters50/1379037
tcaaaatagc

SEQ ID NO: 165767 - DNA, 10 bp, Unknown
  misc_feature (1)..( 10): Result.004 file - promoters50/1379037
ctacaatttt

SEQ ID NO: 165768 - DNA, 10 bp, Unknown
  misc_feature (1)..( 10): Result.004 file - promoters50/1379037
tcaaaaagca

SEQ ID NO: 165769 - DNA, 9 bp, Unknown
  misc_feature (1)..( 9): Result.004 file - promoters50/1379037
aagaaaaaa

SEQ ID NO: 165770 - DNA, 9 bp, Unknown
  misc_feature (1)..( 9): Result.004 file - promoters50/1379037
aagaaacct

SEQ ID NO: 165771 - DNA, 9 bp, Unknown
  misc_feature (1)..( 9): Result.004 file - promoters50/1379037
aagaaaaaa

SEQ ID NO: 165772 - DNA, 11 bp, Unknown
  misc_feature (1)..( 11): Result.004 file - promoters50/1379037
aaaaaactcaa

SEQ ID NO: 165773 - DNA, 11 bp, Unknown
  misc_feature (1)..( 11): Result.004 file - promoters50/1379037
agaaacctcaa

SEQ ID NO: 165774 - DNA, 11 bp, Unknown
  misc_feature (1)..( 11): Result.004 file - promoters50/1379037
aaaaaacttag

SEQ ID NO: 165775 - DNA, 12 bp, Unknown
  misc_feature (1)..( 12): Result.004 file - promoters50/1379037
aaataaatggaa

SEQ ID NO: 165776 - DNA, 12 bp, Unknown
  misc_feature (1)..( 12): Result.004 file - promoters50/1379037
taataattggcg

SEQ ID NO: 165777 - DNA, 12 bp, Unknown
  misc_feature (1)..( 12): Result.004 file - promoters50/1379037
aaagaaagggaa

SEQ ID NO: 165778 - DNA, 8 bp, Unknown
  misc_feature (1)..( 8): Result.004 file - promoters50/1379037
gacaaaaa

SEQ ID NO: 165779 - DNA, 8 bp, Unknown
  misc_feature (1)..( 8): Result.004 file - promoters50/1379037
aacaaaaa

SEQ ID NO: 165780 - DNA, 8 bp, Unknown
  misc_feature (1)..( 8): Result.004 file - promoters50/1379037
gaaagaaa

SEQ ID NO: 165781 - DNA, 9 bp, Unknown
  misc_feature (1)..( 9): Result.004 file - promoters50/1379037
caagtaaga

SEQ ID NO: 165782 - DNA, 9 bp, Unknown
  misc_feature (1)..( 9): Result.004 file - promoters50/1379037
aaagtaaag

SEQ ID NO: 165783 - DNA, 9 bp, Unknown
  misc_feature (1)..( 9): Result.004 file - promoters50/1379037
aaagaaaag

SEQ ID NO: 165784 - DNA, 9 bp, Unknown
  misc_feature (1)..( 9): Result.004 file - promoters50/1379037
agaaagtaa

SEQ ID NO: 165785 - DNA, 9 bp, Unknown
  misc_feature (1)..( 9): Result.004 file - promoters50/1379037
agaaagaaa

SEQ ID NO: 165786 - DNA, 9 bp, Unknown
  misc_feature (1)..( 9): Result.004 file - promoters50/1379037
tgaaacaaa

SEQ ID NO: 165787 - DNA, 10 bp, Unknown
  misc_feature (1)..( 10): Result.004 file - promoters50/1379037
aataagaaaa

SEQ ID NO: 165788 - DNA, 10 bp, Unknown
  misc_feature (1)..( 10): Result.004 file - promoters50/1379037
gaaaagaaaa

SEQ ID NO: 165789 - DNA, 11 bp, Unknown
  misc_feature (1)..( 11): Result.004 file - promoters50/1379037
ggaaatgaaat

SEQ ID NO: 165790 - DNA, 9 bp, Unknown
  misc_feature (1)..( 9): Result.004 file - promoters50/1379037
aaataaatg

SEQ ID NO: 165791 - DNA, 9 bp, Unknown
  misc_feature (1)..( 9): Result.004 file - promoters50/1379037
aaataaaat

SEQ ID NO: 165792 - DNA, 10 bp, Unknown
  misc_feature (1)..( 10): Result.004 file - promoters50/1379043
aaatgaaata

SEQ ID NO: 165793 - DNA, 9 bp, Unknown
  misc_feature (1)..( 9): Result.004 file - promoters50/1379043
gtatataac

SEQ ID NO: 165794 - DNA, 9 bp, Unknown
  misc_feature (1)..( 9): Result.004 file - promoters50/1379043
gtatatata

SEQ ID NO: 165795 - DNA, 9 bp, Unknown
  misc_feature (1)..( 9): Result.004 file - promoters50/1379043
ttatttatt

SEQ ID NO: 165796 - DNA, 9 bp, Unknown
  misc_feature (1)..( 9): Result.004 file - promoters50/1379050
gtataaata

SEQ ID NO: 165797 - DNA, 11 bp, Unknown
  misc_feature (1)..( 11): Result.004 file - promoters50/1379050
tgaaggaaaat

SEQ ID NO: 165798 - DNA, 11 bp, Unknown
  misc_feature (1)..( 11): Result.004 file - promoters50/1379050
tgaatgaaatc

SEQ ID NO: 165799 - DNA, 11 bp, Unknown
  misc_feature (1)..( 11): Result.004 file - promoters50/1379050
tgagtgaaaaa

SEQ ID NO: 165800 - DNA, 11 bp, Unknown
  misc_feature (1)..( 11): Result.004 file - promoters50/1379050
attttgaaaaa

SEQ ID NO: 165801 - DNA, 12 bp, Unknown
  misc_feature (1)..( 12): Result.004 file - promoters50/1379050
ttgttgtaaagt

SEQ ID NO: 165802 - DNA, 9 bp, Unknown
  misc_feature (1)..( 9): Result.004 file - promoters50/1379050
aaggaaaat

SEQ ID NO: 165803 - DNA, 9 bp, Unknown
  misc_feature (1)..( 9): Result.004 file - promoters50/1379050
attgaaaat

SEQ ID NO: 165804 - DNA, 9 bp, Unknown
  misc_feature (1)..( 9): Result.004 file - promoters50/1379050
aattaaaaa

SEQ ID NO: 165805 - DNA, 9 bp, Unknown
  misc_feature (1)..( 9): Result.004 file - promoters50/1379050
aattaagtt

SEQ ID NO: 165806 - DNA, 9 bp, Unknown
  misc_feature (1)..( 9): Result.004 file - promoters50/1379075
gttgacaat

SEQ ID NO: 165807 - DNA, 9 bp, Unknown
  misc_feature (1)..( 9): Result.004 file - promoters50/1379075
taaattaaa

SEQ ID NO: 165808 - DNA, 9 bp, Unknown
  misc_feature (1)..( 9): Result.004 file - promoters50/1379075
ataattaaa

SEQ ID NO: 165809 - DNA, 9 bp, Unknown
  misc_feature (1)..( 9): Result.004 file - promoters50/1379075
aaaaataac

SEQ ID NO: 165810 - DNA, 9 bp, Unknown
  misc_feature (1)..( 9): Result.004 file - promoters50/1379075
taagttatt

SEQ ID NO: 165811 - DNA, 12 bp, Unknown
  misc_feature (1)..( 12): Result.004 file - promoters50/1379075
attaaaaaataa

SEQ ID NO: 165812 - DNA, 12 bp, Unknown
  misc_feature (1)..( 12): Result.004 file - promoters50/1379075
atttaaaattaa

SEQ ID NO: 165813 - DNA, 12 bp, Unknown
  misc_feature (1)..( 12): Result.004 file - promoters50/1379075
ttgtaatatttg

SEQ ID NO: 165814 - DNA, 12 bp, Unknown
  misc_feature (1)..( 12): Result.004 file - promoters50/1379075
tcatcatattta

SEQ ID NO: 165815 - DNA, 10 bp, Unknown
  misc_feature (1)..( 10): Result.004 file - promoters50/1379075
agaataaaca

SEQ ID NO: 165816 - DNA, 10 bp, Unknown
  misc_feature (1)..( 10): Result.004 file - promoters50/1379075
accataaaca

SEQ ID NO: 165817 - DNA, 10 bp, Unknown
  misc_feature (1)..( 10): Result.004 file - promoters50/1379075
taaataaaaa

SEQ ID NO: 165818 - DNA, 10 bp, Unknown
  misc_feature (1)..( 10): Result.004 file - promoters50/1379075
ccaaaaagga

SEQ ID NO: 165819 - DNA, 10 bp, Unknown
  misc_feature (1)..( 10): Result.004 file - promoters50/1379075
cttttaaata

SEQ ID NO: 165820 - DNA, 10 bp, Unknown
  misc_feature (1)..( 10): Result.004 file - promoters50/1379075
ctttttaatg

SEQ ID NO: 165821 - DNA, 10 bp, Unknown
  misc_feature (1)..( 10): Result.004 file - promoters50/1379075
catttatata

SEQ ID NO: 165822 - DNA, 10 bp, Unknown
  misc_feature (1)..( 10): Result.004 file - promoters50/1379075
attttatatc

SEQ ID NO: 165823 - DNA, 17 bp, Unknown
  misc_feature (1)..( 17): Result.004 file - promoters50/1379075
agtttaattctcagttt

SEQ ID NO: 165824 - DNA, 17 bp, Unknown
  misc_feature (1)..( 17): Result.004 file - promoters50/1379075
cttttcattttcaattt

SEQ ID NO: 165825 - DNA, 17 bp, Unknown
  misc_feature (1)..( 17): Result.004 file - promoters50/1379075
ttattaattgtaaaaga

SEQ ID NO: 165826 - DNA, 17 bp, Unknown
  misc_feature (1)..( 17): Result.004 file - promoters50/1379075
cttttcatatgtgagac

SEQ ID NO: 165827 - DNA, 11 bp, Unknown
  misc_feature (1)..( 11): Result.004 file - promoters50/1379075
ttctttttctt

SEQ ID NO: 165828 - DNA, 11 bp, Unknown
  misc_feature (1)..( 11): Result.004 file - promoters50/1379075
ttctttttgta

SEQ ID NO: 165829 - DNA, 11 bp, Unknown
  misc_feature (1)..( 11): Result.004 file - promoters50/1379075
ttttttatcta

SEQ ID NO: 165830 - DNA, 11 bp, Unknown
  misc_feature (1)..( 11): Result.004 file - promoters50/1379075
aactttttcta

SEQ ID NO: 165831 - DNA, 11 bp, Unknown
  misc_feature (1)..( 11): Result.004 file - promoters50/1379075
tgcatttatga

SEQ ID NO: 165832 - DNA, 11 bp, Unknown
  misc_feature (1)..( 11): Result.004 file - promoters50/1379075
ttcatttatat

SEQ ID NO: 165833 - DNA, 11 bp, Unknown
  misc_feature (1)..( 11): Result.004 file - promoters50/1379075
ttctttttaat

SEQ ID NO: 165834 - DNA, 11 bp, Unknown
  misc_feature (1)..( 11): Result.004 file - promoters50/1379141
agattttatat

SEQ ID NO: 165835 - DNA, 7 bp, Unknown
  misc_feature (1)..( 7): Result.004 file - promoters50/1379141
atataat

SEQ ID NO: 165836 - DNA, 7 bp, Unknown
  misc_feature (1)..( 7): Result.004 file - promoters50/1379141
ataaaat

SEQ ID NO: 165837 - DNA, 7 bp, Unknown
  misc_feature (1)..( 7): Result.004 file - promoters50/1379141
ataaaat

SEQ ID NO: 165838 - DNA, 8 bp, Unknown
  misc_feature (1)..( 8): Result.004 file - promoters50/1379141
aagttgat

SEQ ID NO: 165839 - DNA, 8 bp, Unknown
  misc_feature (1)..( 8): Result.004 file - promoters50/1379141
aagttgtt

SEQ ID NO: 165840 - DNA, 8 bp, Unknown
  misc_feature (1)..( 8): Result.004 file - promoters50/1379166
tagttgat

SEQ ID NO: 165841 - DNA, 9 bp, Unknown
  misc_feature (1)..( 9): Result.004 file - promoters50/1379166
attaaataa

SEQ ID NO: 165842 - DNA, 9 bp, Unknown
  misc_feature (1)..( 9): Result.004 file - promoters50/1379166
tctaaataa

SEQ ID NO: 165843 - DNA, 9 bp, Unknown
  misc_feature (1)..( 9): Result.004 file - promoters50/1379166
tctaaattg

SEQ ID NO: 165844 - DNA, 7 bp, Unknown
  misc_feature (1)..( 7): Result.004 file - promoters50/1379166
agaagag

SEQ ID NO: 165845 - DNA, 7 bp, Unknown
  misc_feature (1)..( 7): Result.004 file - promoters50/1379166
agaagaa

SEQ ID NO: 165846 - DNA, 7 bp, Unknown
  misc_feature (1)..( 7): Result.004 file - promoters50/1379166
agaagag

SEQ ID NO: 165847 - DNA, 8 bp, Unknown
  misc_feature (1)..( 8): Result.004 file - promoters50/1379166
atcgcgaa

SEQ ID NO: 165848 - DNA, 8 bp, Unknown
  misc_feature (1)..( 8): Result.004 file - promoters50/1379166
atcgagaa

SEQ ID NO: 165849 - DNA, 8 bp, Unknown
  misc_feature (1)..( 8): Result.004 file - promoters50/1379166
cccgagaa

SEQ ID NO: 165850 - DNA, 8 bp, Unknown
  misc_feature (1)..( 8): Result.004 file - promoters50/1379166
taaaccaa

SEQ ID NO: 165851 - DNA, 8 bp, Unknown
  misc_feature (1)..( 8): Result.004 file - promoters50/1379166
caaaacaa

SEQ ID NO: 165852 - DNA, 8 bp, Unknown
  misc_feature (1)..( 8): Result.004 file - promoters50/1379166
taacccaa

SEQ ID NO: 165853 - DNA, 11 bp, Unknown
  misc_feature (1)..( 11): Result.004 file - promoters50/1379166
aagagtaaaaa

SEQ ID NO: 165854 - DNA, 11 bp, Unknown
  misc_feature (1)..( 11): Result.004 file - promoters50/1379166
gagagtaaaaa

SEQ ID NO: 165855 - DNA, 11 bp, Unknown
  misc_feature (1)..( 11): Result.004 file - promoters50/1379166
gagagcaaaga

SEQ ID NO: 165856 - DNA, 8 bp, Unknown
  misc_feature (1)..( 8): Result.004 file - promoters50/1379166
gaaagata

SEQ ID NO: 165857 - DNA, 8 bp, Unknown
  misc_feature (1)..( 8): Result.004 file - promoters50/1379166
gaaagaag

SEQ ID NO: 165858 - DNA, 8 bp, Unknown
  misc_feature (1)..( 8): Result.004 file - promoters50/1379166
gaaggaag

SEQ ID NO: 165859 - DNA, 9 bp, Unknown
  misc_feature (1)..( 9): Result.004 file - promoters50/1379166
aacccacta

SEQ ID NO: 165860 - DNA, 9 bp, Unknown
  misc_feature (1)..( 9): Result.004 file - promoters50/1379166
aacccaaaa

SEQ ID NO: 165861 - DNA, 9 bp, Unknown
  misc_feature (1)..( 9): Result.004 file - promoters50/1379201
aaccgaaaa

SEQ ID NO: 165862 - DNA, 9 bp, Unknown
  misc_feature (1)..( 9): Result.004 file - promoters50/1379201
tgcatttgc

SEQ ID NO: 165863 - DNA, 9 bp, Unknown
  misc_feature (1)..( 9): Result.004 file - promoters50/1379201
caaatttgc

SEQ ID NO: 165864 - DNA, 9 bp, Unknown
  misc_feature (1)..( 9): Result.004 file - promoters50/1379201
aaaatttgt

SEQ ID NO: 165865 - DNA, 9 bp, Unknown
  misc_feature (1)..( 9): Result.004 file - promoters50/1379201
caattttga

SEQ ID NO: 165866 - DNA, 10 bp, Unknown
  misc_feature (1)..( 10): Result.004 file - promoters50/1379201
gctattggtt

SEQ ID NO: 165867 - DNA, 10 bp, Unknown
  misc_feature (1)..( 10): Result.004 file - promoters50/1379201
aaaatttgtt

SEQ ID NO: 165868 - DNA, 10 bp, Unknown
  misc_feature (1)..( 10): Result.004 file - promoters50/1379201
caaatttgcc

SEQ ID NO: 165869 - DNA, 10 bp, Unknown
  misc_feature (1)..( 10): Result.004 file - promoters50/1379201
caattttgaa

SEQ ID NO: 165870 - DNA, 11 bp, Unknown
  misc_feature (1)..( 11): Result.004 file - promoters50/1379201
gaagaacacac

SEQ ID NO: 165871 - DNA, 11 bp, Unknown
  misc_feature (1)..( 11): Result.004 file - promoters50/1379201
gaaaaacacac

SEQ ID NO: 165872 - DNA, 11 bp, Unknown
  misc_feature (1)..( 11): Result.004 file - promoters50/1379201
gggaaacccac

SEQ ID NO: 165873 - DNA, 11 bp, Unknown
  misc_feature (1)..( 11): Result.004 file - promoters50/1379201
tcaaaacactt

SEQ ID NO: 165874 - DNA, 8 bp, Unknown
  misc_feature (1)..( 8): Result.004 file - promoters50/1379201
tttactta

SEQ ID NO: 165875 - DNA, 8 bp, Unknown
  misc_feature (1)..( 8): Result.004 file - promoters50/1379201
attattta

SEQ ID NO: 165876 - DNA, 8 bp, Unknown
  misc_feature (1)..( 8): Result.004 file - promoters50/1379201
tataatta

SEQ ID NO: 165877 - DNA, 8 bp, Unknown
  misc_feature (1)..( 8): Result.004 file - promoters50/1379201
tatatatt

SEQ ID NO: 165878 - DNA, 9 bp, Unknown
  misc_feature (1)..( 9): Result.004 file - promoters50/1379201
acataatta

SEQ ID NO: 165879 - DNA, 9 bp, Unknown
  misc_feature (1)..( 9): Result.004 file - promoters50/1379201
acattattt

SEQ ID NO: 165880 - DNA, 9 bp, Unknown
  misc_feature (1)..( 9): Result.004 file - promoters50/1379201
tcattatta

SEQ ID NO: 165881 - DNA, 9 bp, Unknown
  misc_feature (1)..( 9): Result.004 file - promoters50/1379201
atataatta

SEQ ID NO: 165882 - DNA, 8 bp, Unknown
  misc_feature (1)..( 8): Result.004 file - promoters50/1379201
aactaaaa

SEQ ID NO: 165883 - DNA, 8 bp, Unknown
  misc_feature (1)..( 8): Result.004 file - promoters50/1379201
tacttaaa

SEQ ID NO: 165884 - DNA, 8 bp, Unknown
  misc_feature (1)..( 8): Result.004 file - promoters50/1379201
aacaaaaa

SEQ ID NO: 165885 - DNA, 8 bp, Unknown
  misc_feature (1)..( 8): Result.004 file - promoters50/1379213
cacatcaa

SEQ ID NO: 165886 - DNA, 8 bp, Unknown
  misc_feature (1)..( 8): Result.004 file - promoters50/1379213
atattttt

SEQ ID NO: 165887 - DNA, 8 bp, Unknown
  misc_feature (1)..( 8): Result.004 file - promoters50/1379213
ataatttc

SEQ ID NO: 165888 - DNA, 8 bp, Unknown
  misc_feature (1)..( 8): Result.004 file - promoters50/1379229
ggattttt

SEQ ID NO: 165889 - DNA, 8 bp, Unknown
  misc_feature (1)..( 8): Result.004 file - promoters50/1379229
gaagaaag

SEQ ID NO: 165890 - DNA, 8 bp, Unknown
  misc_feature (1)..( 8): Result.004 file - promoters50/1379229
aaagaaaa

SEQ ID NO: 165891 - DNA, 8 bp, Unknown
  misc_feature (1)..( 8): Result.004 file - promoters50/1379229
gaaaaaag

SEQ ID NO: 165892 - DNA, 9 bp, Unknown
  misc_feature (1)..( 9): Result.004 file - promoters50/1379229
aaaacaaac

SEQ ID NO: 165893 - DNA, 8 bp, Unknown
  misc_feature (1)..( 8): Result.004 file - promoters50/1379229
taaaagaa

SEQ ID NO: 165894 - DNA, 8 bp, Unknown
  misc_feature (1)..( 8): Result.004 file - promoters50/1379229
taatagat

SEQ ID NO: 165895 - DNA, 8 bp, Unknown
  misc_feature (1)..( 8): Result.004 file - promoters50/1379229
gaaaagaa

SEQ ID NO: 165896 - DNA, 8 bp, Unknown
  misc_feature (1)..( 8): Result.004 file - promoters50/1379229
taacagat

SEQ ID NO: 165897 - DNA, 8 bp, Unknown
  misc_feature (1)..( 8): Result.004 file - promoters50/1379229
aaagacac

SEQ ID NO: 165898 - DNA, 8 bp, Unknown
  misc_feature (1)..( 8): Result.004 file - promoters50/1379229
aaaaacac

SEQ ID NO: 165899 - DNA, 8 bp, Unknown
  misc_feature (1)..( 8): Result.004 file - promoters50/1379229
aaacaaac

SEQ ID NO: 165900 - DNA, 8 bp, Unknown
  misc_feature (1)..( 8): Result.004 file - promoters50/1379239
aaaaaaga

SEQ ID NO: 165901 - DNA, 8 bp, Unknown
  misc_feature (1)..( 8): Result.004 file - promoters50/1379239
gaaagaaa

SEQ ID NO: 165902 - DNA, 8 bp, Unknown
  misc_feature (1)..( 8): Result.004 file - promoters50/1379239
taaacaaa

SEQ ID NO: 165903 - DNA, 8 bp, Unknown
  misc_feature (1)..( 8): Result.004 file - promoters50/1379239
acaacaaa

SEQ ID NO: 165904 - DNA, 9 bp, Unknown
  misc_feature (1)..( 9): Result.004 file - promoters50/1379239
aaattaaac

SEQ ID NO: 165905 - DNA, 9 bp, Unknown
  misc_feature (1)..( 9): Result.004 file - promoters50/1379239
ctattaaac

SEQ ID NO: 165906 - DNA, 9 bp, Unknown
  misc_feature (1)..( 9): Result.004 file - promoters50/1379239
aaatcaaat

SEQ ID NO: 165907 - DNA, 9 bp, Unknown
  misc_feature (1)..( 9): Result.004 file - promoters50/1379239
tataaaaac

SEQ ID NO: 165908 - DNA, 9 bp, Unknown
  misc_feature (1)..( 9): Result.004 file - promoters50/1379239
gataaaaac

SEQ ID NO: 165909 - DNA, 9 bp, Unknown
  misc_feature (1)..( 9): Result.004 file - promoters50/1379295
tataaacac

SEQ ID NO: 165910 - DNA, 12 bp, Unknown
  misc_feature (1)..( 12): Result.004 file - promoters50/1379295
aaaaaagaaaaa

SEQ ID NO: 165911 - DNA, 12 bp, Unknown
  misc_feature (1)..( 12): Result.004 file - promoters50/1379295
aaaaaagaaaaa

SEQ ID NO: 165912 - DNA, 12 bp, Unknown
  misc_feature (1)..( 12): Result.004 file - promoters50/1379313
gaaaaagaaaag

SEQ ID NO: 165913 - DNA, 7 bp, Unknown
  misc_feature (1)..( 7): Result.004 file - promoters50/1379313
gtcaaac

SEQ ID NO: 165914 - DNA, 7 bp, Unknown
  misc_feature (1)..( 7): Result.004 file - promoters50/1379313
atcaaac

SEQ ID NO: 165915 - DNA, 7 bp, Unknown
  misc_feature (1)..( 7): Result.004 file - promoters50/1379362
atcaaag

SEQ ID NO: 165916 - DNA, 9 bp, Unknown
  misc_feature (1)..( 9): Result.004 file - promoters50/1379362
atacttttt

SEQ ID NO: 165917 - DNA, 9 bp, Unknown
  misc_feature (1)..( 9): Result.004 file - promoters50/1379362
ataatttaa

SEQ ID NO: 165918 - DNA, 9 bp, Unknown
  misc_feature (1)..( 9): Result.004 file - promoters50/1379362
ataatataa

SEQ ID NO: 165919 - DNA, 8 bp, Unknown
  misc_feature (1)..( 8): Result.004 file - promoters50/1379362
aaacatac

SEQ ID NO: 165920 - DNA, 8 bp, Unknown
  misc_feature (1)..( 8): Result.004 file - promoters50/1379362
aaaaataa

SEQ ID NO: 165921 - DNA, 8 bp, Unknown
  misc_feature (1)..( 8): Result.004 file - promoters50/1379362
aaaattaa

SEQ ID NO: 165922 - DNA, 7 bp, Unknown
  misc_feature (1)..( 7): Result.004 file - promoters50/1379362
gatatat

SEQ ID NO: 165923 - DNA, 7 bp, Unknown
  misc_feature (1)..( 7): Result.004 file - promoters50/1379362
aatatat

SEQ ID NO: 165924 - DNA, 7 bp, Unknown
  misc_feature (1)..( 7): Result.004 file - promoters50/1379366
aatataa

SEQ ID NO: 165925 - DNA, 8 bp, Unknown
  misc_feature (1)..( 8): Result.004 file - promoters50/1379366
ttaaaaaa

SEQ ID NO: 165926 - DNA, 8 bp, Unknown
  misc_feature (1)..( 8): Result.004 file - promoters50/1379366
ttaagaaa

SEQ ID NO: 165927 - DNA, 8 bp, Unknown
  misc_feature (1)..( 8): Result.004 file - promoters50/1379366
ttaacaaa

SEQ ID NO: 165928 - DNA, 7 bp, Unknown
  misc_feature (1)..( 7): Result.004 file - promoters50/1379366
agagaaa

SEQ ID NO: 165929 - DNA, 7 bp, Unknown
  misc_feature (1)..( 7): Result.004 file - promoters50/1379366
agagaaa

SEQ ID NO: 165930 - DNA, 7 bp, Unknown
  misc_feature (1)..( 7): Result.004 file - promoters50/1379366
cgagaaa

SEQ ID NO: 165931 - DNA, 8 bp, Unknown
  misc_feature (1)..( 8): Result.004 file - promoters50/1379366
acgaagaa

SEQ ID NO: 165932 - DNA, 8 bp, Unknown
  misc_feature (1)..( 8): Result.004 file - promoters50/1379366
acgatgaa

SEQ ID NO: 165933 - DNA, 8 bp, Unknown
  misc_feature (1)..( 8): Result.004 file - promoters50/1379366
tagatgaa

SEQ ID NO: 165934 - DNA, 7 bp, Unknown
  misc_feature (1)..( 7): Result.004 file - promoters50/1379366
agaggaa

SEQ ID NO: 165935 - DNA, 7 bp, Unknown
  misc_feature (1)..( 7): Result.004 file - promoters50/1379366
agatgaa

SEQ ID NO: 165936 - DNA, 7 bp, Unknown
  misc_feature (1)..( 7): Result.004 file - promoters50/1379366
cgatgaa

SEQ ID NO: 165937 - DNA, 8 bp, Unknown
  misc_feature (1)..( 8): Result.004 file - promoters50/1379366
tctccaca

SEQ ID NO: 165938 - DNA, 8 bp, Unknown
  misc_feature (1)..( 8): Result.004 file - promoters50/1379366
tcttcact

SEQ ID NO: 165939 - DNA, 8 bp, Unknown
  misc_feature (1)..( 8): Result.004 file - promoters50/1379366
tctacaca

SEQ ID NO: 165940 - DNA, 9 bp, Unknown
  misc_feature (1)..( 9): Result.004 file - promoters50/1379366
tgtctcatt

SEQ ID NO: 165941 - DNA, 9 bp, Unknown
  misc_feature (1)..( 9): Result.004 file - promoters50/1379366
tgtgtcata

SEQ ID NO: 165942 - DNA, 9 bp, Unknown
  misc_feature (1)..( 9): Result.004 file - promoters50/1379450
gatctaatt

SEQ ID NO: 165943 - DNA, 10 bp, Unknown
  misc_feature (1)..( 10): Result.004 file - promoters50/1379450
agacgaagga

SEQ ID NO: 165944 - DNA, 10 bp, Unknown
  misc_feature (1)..( 10): Result.004 file - promoters50/1379450
agaggaagaa

SEQ ID NO: 165945 - DNA, 10 bp, Unknown
  misc_feature (1)..( 10): Result.004 file - promoters50/1379450
ttagggagaa

SEQ ID NO: 165946 - DNA, 11 bp, Unknown
  misc_feature (1)..( 11): Result.004 file - promoters50/1379450
gagaaagaaag

SEQ ID NO: 165947 - DNA, 11 bp, Unknown
  misc_feature (1)..( 11): Result.004 file - promoters50/1379450
gagaaagaaag

SEQ ID NO: 165948 - DNA, 11 bp, Unknown
  misc_feature (1)..( 11): Result.004 file - promoters50/1379496
gacaaaaaaaa

SEQ ID NO: 165949 - DNA, 10 bp, Unknown
  misc_feature (1)..( 10): Result.004 file - promoters50/1379496
actaaatttt

SEQ ID NO: 165950 - DNA, 10 bp, Unknown
  misc_feature (1)..( 10): Result.004 file - promoters50/1379496
actaaatcac

SEQ ID NO: 165951 - DNA, 10 bp, Unknown
  misc_feature (1)..( 10): Result.004 file - promoters50/1379496
aataaattag

SEQ ID NO: 165952 - DNA, 10 bp, Unknown
  misc_feature (1)..( 10): Result.004 file - promoters50/1379496
cctacatttt

SEQ ID NO: 165953 - DNA, 10 bp, Unknown
  misc_feature (1)..( 10): Result.004 file - promoters50/1379496
tttacttttt

SEQ ID NO: 165954 - DNA, 10 bp, Unknown
  misc_feature (1)..( 10): Result.004 file - promoters50/1379496
gattcatttt

SEQ ID NO: 165955 - DNA, 14 bp, Unknown
  misc_feature (1)..( 14): Result.004 file - promoters50/1379496
atttttcttctttt

SEQ ID NO: 165956 - DNA, 14 bp, Unknown
  misc_feature (1)..( 14): Result.004 file - promoters50/1379496
cattttcttatttt

SEQ ID NO: 165957 - DNA, 14 bp, Unknown
  misc_feature (1)..( 14): Result.004 file - promoters50/1379496
gtttttccttatat

SEQ ID NO: 165958 - DNA, 14 bp, Unknown
  misc_feature (1)..( 14): Result.004 file - promoters50/1379496
gtctttctctactg

SEQ ID NO: 165959 - DNA, 14 bp, Unknown
  misc_feature (1)..( 14): Result.004 file - promoters50/1379496
catattcgtaaaaa

SEQ ID NO: 165960 - DNA, 14 bp, Unknown
  misc_feature (1)..( 14): Result.004 file - promoters50/1379496
gattttataatata

SEQ ID NO: 165961 - DNA, 9 bp, Unknown
  misc_feature (1)..( 9): Result.004 file - promoters50/1379496
tataaatta

SEQ ID NO: 165962 - DNA, 9 bp, Unknown
  misc_feature (1)..( 9): Result.004 file - promoters50/1379496
tcaaaatta

SEQ ID NO: 165963 - DNA, 9 bp, Unknown
  misc_feature (1)..( 9): Result.004 file - promoters50/1379496
taaaaattg

SEQ ID NO: 165964 - DNA, 9 bp, Unknown
  misc_feature (1)..( 9): Result.004 file - promoters50/1379496
tcaaaattt

SEQ ID NO: 165965 - DNA, 9 bp, Unknown
  misc_feature (1)..( 9): Result.004 file - promoters50/1379496
ccaaaatgc

SEQ ID NO: 165966 - DNA, 9 bp, Unknown
  misc_feature (1)..( 9): Result.004 file - promoters50/1379496
taataatcc

SEQ ID NO: 165967 - DNA, 12 bp, Unknown
  misc_feature (1)..( 12): Result.004 file - promoters50/1379496
tttaaaaattaa

SEQ ID NO: 165968 - DNA, 12 bp, Unknown
  misc_feature (1)..( 12): Result.004 file - promoters50/1379496
tctaaaaatgta

SEQ ID NO: 165969 - DNA, 12 bp, Unknown
  misc_feature (1)..( 12): Result.004 file - promoters50/1379496
cccaaaaattcg

SEQ ID NO: 165970 - DNA, 12 bp, Unknown
  misc_feature (1)..( 12): Result.004 file - promoters50/1379496
atacaaaattga

SEQ ID NO: 165971 - DNA, 12 bp, Unknown
  misc_feature (1)..( 12): Result.004 file - promoters50/1379496
aataaaaatctt

SEQ ID NO: 165972 - DNA, 12 bp, Unknown
  misc_feature (1)..( 12): Result.004 file - promoters50/1379496
gtcaaaaaaggc

SEQ ID NO: 165973 - DNA, 12 bp, Unknown
  misc_feature (1)..( 12): Result.004 file - promoters50/1379496
gaagcaaattgt

SEQ ID NO: 165974 - DNA, 12 bp, Unknown
  misc_feature (1)..( 12): Result.004 file - promoters50/1379496
aataaagatgct

SEQ ID NO: 165975 - DNA, 10 bp, Unknown
  misc_feature (1)..( 10): Result.004 file - promoters50/1379496
aattttcata

SEQ ID NO: 165976 - DNA, 10 bp, Unknown
  misc_feature (1)..( 10): Result.004 file - promoters50/1379496
ccgtttaata

SEQ ID NO: 165977 - DNA, 10 bp, Unknown
  misc_feature (1)..( 10): Result.004 file - promoters50/1379496
atccttcata

SEQ ID NO: 165978 - DNA, 10 bp, Unknown
  misc_feature (1)..( 10): Result.004 file - promoters50/1379496
cattttcaaa

SEQ ID NO: 165979 - DNA, 10 bp, Unknown
  misc_feature (1)..( 10): Result.004 file - promoters50/1379496
atatttcatg

SEQ ID NO: 165980 - DNA, 10 bp, Unknown
  misc_feature (1)..( 10): Result.004 file - promoters50/1379496
cattttctta

SEQ ID NO: 165981 - DNA, 10 bp, Unknown
  misc_feature (1)..( 10): Result.004 file - promoters50/1379496
ttttttaaag

SEQ ID NO: 165982 - DNA, 11 bp, Unknown
  misc_feature (1)..( 11): Result.004 file - promoters50/1379496
gaatattattc

SEQ ID NO: 165983 - DNA, 11 bp, Unknown
  misc_feature (1)..( 11): Result.004 file - promoters50/1379496
tacaattattc

SEQ ID NO: 165984 - DNA, 11 bp, Unknown
  misc_feature (1)..( 11): Result.004 file - promoters50/1379496
ttatattataa

SEQ ID NO: 165985 - DNA, 11 bp, Unknown
  misc_feature (1)..( 11): Result.004 file - promoters50/1379496
tttaataattt

SEQ ID NO: 165986 - DNA, 11 bp, Unknown
  misc_feature (1)..( 11): Result.004 file - promoters50/1379496
atttgtaattt

SEQ ID NO: 165987 - DNA, 11 bp, Unknown
  misc_feature (1)..( 11): Result.004 file - promoters50/1379586
ttaaattcttc

SEQ ID NO: 165988 - DNA, 11 bp, Unknown
  misc_feature (1)..( 11): Result.004 file - promoters50/1379586
aatataaaatt

SEQ ID NO: 165989 - DNA, 11 bp, Unknown
  misc_feature (1)..( 11): Result.004 file - promoters50/1379586
aatatatagaa

SEQ ID NO: 165990 - DNA, 11 bp, Unknown
  misc_feature (1)..( 11): Result.004 file - promoters50/1379586
catatacaatg

SEQ ID NO: 165991 - DNA, 11 bp, Unknown
  misc_feature (1)..( 11): Result.004 file - promoters50/1379586
aatatagagac

SEQ ID NO: 165992 - DNA, 11 bp, Unknown
  misc_feature (1)..( 11): Result.004 file - promoters50/1379586
tctctacaata

SEQ ID NO: 165993 - DNA, 11 bp, Unknown
  misc_feature (1)..( 11): Result.004 file - promoters50/1379607
ttgtaacaatg

SEQ ID NO: 165994 - DNA, 18 bp, Unknown
  misc_feature (1)..( 18): Result.004 file - promoters50/1379607
tatctctgatatattaat

SEQ ID NO: 165995 - DNA, 18 bp, Unknown
  misc_feature (1)..( 18): Result.004 file - promoters50/1379607
ttgaatcaatattttatc

SEQ ID NO: 165996 - DNA, 18 bp, Unknown
  misc_feature (1)..( 18): Result.004 file - promoters50/1379607
tcttttgtatattttaca

SEQ ID NO: 165997 - DNA, 18 bp, Unknown
  misc_feature (1)..( 18): Result.004 file - promoters50/1379607
aataacttctattatatc

SEQ ID NO: 165998 - DNA, 18 bp, Unknown
  misc_feature (1)..( 18): Result.004 file - promoters50/1379607
ttgattcaaaattctcta

SEQ ID NO: 165999 - DNA, 18 bp, Unknown
  misc_feature (1)..( 18): Result.004 file - promoters50/1379691
tcaagagaaaatttgatg

SEQ ID NO: 166000 - DNA, 8 bp, Unknown
  misc_feature (1)..( 8): Result.004 file - promoters50/1379691
cttttaag

SEQ ID NO: 166001 - DNA, 8 bp, Unknown
  misc_feature (1)..( 8): Result.004 file - promoters50/1379691
cttgtaag

SEQ ID NO: 166002 - DNA, 8 bp, Unknown
  misc_feature (1)..( 8): Result.004 file - promoters50/1379691
aatttaag

SEQ ID NO: 166003 - DNA, 9 bp, Unknown
  misc_feature (1)..( 9): Result.004 file - promoters50/1379691
aattaataa

SEQ ID NO: 166004 - DNA, 9 bp, Unknown
  misc_feature (1)..( 9): Result.004 file - promoters50/1379691
ttttattaa

SEQ ID NO: 166005 - DNA, 9 bp, Unknown
  misc_feature (1)..( 9): Result.004 file - promoters50/1379691
aattagtaa

SEQ ID NO: 166006 - DNA, 9 bp, Unknown
  misc_feature (1)..( 9): Result.004 file - promoters50/1379691
tcagaagaa

SEQ ID NO: 166007 - DNA, 9 bp, Unknown
  misc_feature (1)..( 9): Result.004 file - promoters50/1379691
tcataagaa

SEQ ID NO: 166008 - DNA, 9 bp, Unknown
  misc_feature (1)..( 9): Result.004 file - promoters50/1379719
taataaacg

SEQ ID NO: 166009 - DNA, 10 bp, Unknown
  misc_feature (1)..( 10): Result.004 file - promoters50/1379719
gatttgtggt

SEQ ID NO: 166010 - DNA, 10 bp, Unknown
  misc_feature (1)..( 10): Result.004 file - promoters50/1379719
tttttttggt

SEQ ID NO: 166011 - DNA, 10 bp, Unknown
  misc_feature (1)..( 10): Result.004 file - promoters50/1379777
gatatgtatc

SEQ ID NO: 166012 - DNA, 9 bp, Unknown
  misc_feature (1)..( 9): Result.004 file - promoters50/1379777
aaacaaaac

SEQ ID NO: 166013 - DNA, 9 bp, Unknown
  misc_feature (1)..( 9): Result.004 file - promoters50/1379777
tgacacaac

SEQ ID NO: 166014 - DNA, 9 bp, Unknown
  misc_feature (1)..( 9): Result.004 file - promoters50/1379893
tgacacaac

SEQ ID NO: 166015 - DNA, 9 bp, Unknown
  misc_feature (1)..( 9): Result.004 file - promoters50/1379893
attttgatc

SEQ ID NO: 166016 - DNA, 9 bp, Unknown
  misc_feature (1)..( 9): Result.004 file - promoters50/1379893
aatttcatc

SEQ ID NO: 166017 - DNA, 9 bp, Unknown
  misc_feature (1)..( 9): Result.004 file - promoters50/1379893
aatttcata

SEQ ID NO: 166018 - DNA, 8 bp, Unknown
  misc_feature (1)..( 8): Result.004 file - promoters50/1379893
tttgtatt

SEQ ID NO: 166019 - DNA, 8 bp, Unknown
  misc_feature (1)..( 8): Result.004 file - promoters50/1379893
tatgtatt

SEQ ID NO: 166020 - DNA, 8 bp, Unknown
  misc_feature (1)..( 8): Result.004 file - promoters50/1379916
tttgtatt

SEQ ID NO: 166021 - DNA, 10 bp, Unknown
  misc_feature (1)..( 10): Result.004 file - promoters50/1379916
cttgttcttt

SEQ ID NO: 166022 - DNA, 10 bp, Unknown
  misc_feature (1)..( 10): Result.004 file - promoters50/1379916
tttgtttttt

SEQ ID NO: 166023 - DNA, 10 bp, Unknown
  misc_feature (1)..( 10): Result.004 file - promoters50/1379916
gttggttact

SEQ ID NO: 166024 - DNA, 10 bp, Unknown
  misc_feature (1)..( 10): Result.004 file - promoters50/1379916
cttaacaaaa

SEQ ID NO: 166025 - DNA, 10 bp, Unknown
  misc_feature (1)..( 10): Result.004 file - promoters50/1379916
tataataaaa

SEQ ID NO: 166026 - DNA, 10 bp, Unknown
  misc_feature (1)..( 10): Result.004 file - promoters50/1379916
tatagtaaga

SEQ ID NO: 166027 - DNA, 8 bp, Unknown
  misc_feature (1)..( 8): Result.004 file - promoters50/1379916
ctttcttg

SEQ ID NO: 166028 - DNA, 8 bp, Unknown
  misc_feature (1)..( 8): Result.004 file - promoters50/1379916
gttttttg

SEQ ID NO: 166029 - DNA, 8 bp, Unknown
  misc_feature (1)..( 8): Result.004 file - promoters50/1379916
gttatttg

SEQ ID NO: 166030 - DNA, 10 bp, Unknown
  misc_feature (1)..( 10): Result.004 file - promoters50/1379916
tctttttctt

SEQ ID NO: 166031 - DNA, 10 bp, Unknown
  misc_feature (1)..( 10): Result.004 file - promoters50/1379916
tctttttcga

SEQ ID NO: 166032 - DNA, 10 bp, Unknown
  misc_feature (1)..( 10): Result.004 file - promoters50/1379916
gattttggat

SEQ ID NO: 166033 - DNA, 9 bp, Unknown
  misc_feature (1)..( 9): Result.004 file - promoters50/1379916
aattatttc

SEQ ID NO: 166034 - DNA, 9 bp, Unknown
  misc_feature (1)..( 9): Result.004 file - promoters50/1379916
aattgtttt

SEQ ID NO: 166035 - DNA, 9 bp, Unknown
  misc_feature (1)..( 9): Result.004 file - promoters50/1379928
gtttgtttt

SEQ ID NO: 166036 - DNA, 11 bp, Unknown
  misc_feature (1)..( 11): Result.004 file - promoters50/1379928
aaaagaaattg

SEQ ID NO: 166037 - DNA, 11 bp, Unknown
  misc_feature (1)..( 11): Result.004 file - promoters50/1379928
aaaacaaaaaa

SEQ ID NO: 166038 - DNA, 11 bp, Unknown
  misc_feature (1)..( 11): Result.004 file - promoters50/1379928
ggaagaaattg

SEQ ID NO: 166039 - DNA, 11 bp, Unknown
  misc_feature (1)..( 11): Result.004 file - promoters50/1379981
cgaagaacgaa

SEQ ID NO: 166040 - DNA, 8 bp, Unknown
  misc_feature (1)..( 8): Result.004 file - promoters50/1379981
ttttttaa

SEQ ID NO: 166041 - DNA, 8 bp, Unknown
  misc_feature (1)..( 8): Result.004 file - promoters50/1379981
tttattat

SEQ ID NO: 166042 - DNA, 8 bp, Unknown
  misc_feature (1)..( 8): Result.004 file - promoters50/1379981
cattttaa

SEQ ID NO: 166043 - DNA, 9 bp, Unknown
  misc_feature (1)..( 9): Result.004 file - promoters50/1379981
taaattaaa

SEQ ID NO: 166044 - DNA, 9 bp, Unknown
  misc_feature (1)..( 9): Result.004 file - promoters50/1379981
aaaagtaaa

SEQ ID NO: 166045 - DNA, 9 bp, Unknown
  misc_feature (1)..( 9): Result.004 file - promoters50/1379981
taaatttat

SEQ ID NO: 166046 - DNA, 8 bp, Unknown
  misc_feature (1)..( 8): Result.004 file - promoters50/1379981
ttaaaaag

SEQ ID NO: 166047 - DNA, 8 bp, Unknown
  misc_feature (1)..( 8): Result.004 file - promoters50/1379981
gaaaaaag

SEQ ID NO: 166048 - DNA, 8 bp, Unknown
  misc_feature (1)..( 8): Result.004 file - promoters50/1379981
ttataaag

SEQ ID NO: 166049 - DNA, 10 bp, Unknown
  misc_feature (1)..( 10): Result.004 file - promoters50/1379981
cttaaataat

SEQ ID NO: 166050 - DNA, 10 bp, Unknown
  misc_feature (1)..( 10): Result.004 file - promoters50/1379981
cacaaagaat

SEQ ID NO: 166051 - DNA, 10 bp, Unknown
  misc_feature (1)..( 10): Result.004 file - promoters50/1380020
cttaaatatt

SEQ ID NO: 166052 - DNA, 9 bp, Unknown
  misc_feature (1)..( 9): Result.004 file - promoters50/1380020
tcaaattga

SEQ ID NO: 166053 - DNA, 9 bp, Unknown
  misc_feature (1)..( 9): Result.004 file - promoters50/1380020
tcatatttt

SEQ ID NO: 166054 - DNA, 9 bp, Unknown
  misc_feature (1)..( 9): Result.004 file - promoters50/1380020
acaaattgc

SEQ ID NO: 166055 - DNA, 9 bp, Unknown
  misc_feature (1)..( 9): Result.004 file - promoters50/1380085
aaaaaatga

SEQ ID NO: 166056 - DNA, 11 bp, Unknown
  misc_feature (1)..( 11): Result.004 file - promoters50/1380085
atttttgaatg

SEQ ID NO: 166057 - DNA, 11 bp, Unknown
  misc_feature (1)..( 11): Result.004 file - promoters50/1380085
gattttaaatg

SEQ ID NO: 166058 - DNA, 12 bp, Unknown
  misc_feature (1)..( 12): Result.004 file - promoters50/1380135
aattattggatc

SEQ ID NO: 166059 - DNA, 8 bp, Unknown
  misc_feature (1)..( 8): Result.004 file - promoters50/1380135
aacaataa

SEQ ID NO: 166060 - DNA, 8 bp, Unknown
  misc_feature (1)..( 8): Result.004 file - promoters50/1380135
tacaatat

SEQ ID NO: 166061 - DNA, 8 bp, Unknown
  misc_feature (1)..( 8): Result.004 file - promoters50/1380135
caaaatta

SEQ ID NO: 166062 - DNA, 8 bp, Unknown
  misc_feature (1)..( 8): Result.004 file - promoters50/1380135
atcaatat

SEQ ID NO: 166063 - DNA, 8 bp, Unknown
  misc_feature (1)..( 8): Result.004 file - promoters50/1380135
aataatag

SEQ ID NO: 166064 - DNA, 8 bp, Unknown
  misc_feature (1)..( 8): Result.004 file - promoters50/1380135
aattatat

SEQ ID NO: 166065 - DNA, 8 bp, Unknown
  misc_feature (1)..( 8): Result.004 file - promoters50/1380135
aattgtat

SEQ ID NO: 166066 - DNA, 8 bp, Unknown
  misc_feature (1)..( 8): Result.004 file - promoters50/1380135
tattgtat

SEQ ID NO: 166067 - DNA, 9 bp, Unknown
  misc_feature (1)..( 9): Result.004 file - promoters50/1380135
gaagaaaaa

SEQ ID NO: 166068 - DNA, 9 bp, Unknown
  misc_feature (1)..( 9): Result.004 file - promoters50/1380135
gaataaaaa

SEQ ID NO: 166069 - DNA, 9 bp, Unknown
  misc_feature (1)..( 9): Result.004 file - promoters50/1380135
tcagaaaag

SEQ ID NO: 166070 - DNA, 9 bp, Unknown
  misc_feature (1)..( 9): Result.004 file - promoters50/1380163
caataaact

SEQ ID NO: 166071 - DNA, 8 bp, Unknown
  misc_feature (1)..( 8): Result.004 file - promoters50/1380163
aaataatt

SEQ ID NO: 166072 - DNA, 8 bp, Unknown
  misc_feature (1)..( 8): Result.004 file - promoters50/1380163
caataatt

SEQ ID NO: 166073 - DNA, 8 bp, Unknown
  misc_feature (1)..( 8): Result.004 file - promoters50/1380163
caataaca

SEQ ID NO: 166074 - DNA, 8 bp, Unknown
  misc_feature (1)..( 8): Result.004 file - promoters50/1380163
taaaacca

SEQ ID NO: 166075 - DNA, 8 bp, Unknown
  misc_feature (1)..( 8): Result.004 file - promoters50/1380163
taacaccc

SEQ ID NO: 166076 - DNA, 8 bp, Unknown
  misc_feature (1)..( 8): Result.004 file - promoters50/1380224
taaatcaa

SEQ ID NO: 166077 - DNA, 10 bp, Unknown
  misc_feature (1)..( 10): Result.004 file - promoters50/1380224
ctcattatag

SEQ ID NO: 166078 - DNA, 10 bp, Unknown
  misc_feature (1)..( 10): Result.004 file - promoters50/1380224
atcaatatta

SEQ ID NO: 166079 - DNA, 10 bp, Unknown
  misc_feature (1)..( 10): Result.004 file - promoters50/1380224
ctcattaatt

SEQ ID NO: 166080 - DNA, 10 bp, Unknown
  misc_feature (1)..( 10): Result.004 file - promoters50/1380224
tcgaatattt

SEQ ID NO: 166081 - DNA, 10 bp, Unknown
  misc_feature (1)..( 10): Result.004 file - promoters50/1380309
gagaacattt

SEQ ID NO: 166082 - DNA, 12 bp, Unknown
  misc_feature (1)..( 12): Result.004 file - promoters50/1380309
aacttaaacttt

SEQ ID NO: 166083 - DNA, 12 bp, Unknown
  misc_feature (1)..( 12): Result.004 file - promoters50/1380309
acgttagactca

SEQ ID NO: 166084 - DNA, 12 bp, Unknown
  misc_feature (1)..( 12): Result.004 file - promoters50/1380309
taattaaagttt

SEQ ID NO: 166085 - DNA, 12 bp, Unknown
  misc_feature (1)..( 12): Result.004 file - promoters50/1380309
gagtaaaaattt

SEQ ID NO: 166086 - DNA, 12 bp, Unknown
  misc_feature (1)..( 12): Result.004 file - promoters50/1380309
ttactaaaataa

SEQ ID NO: 166087 - DNA, 12 bp, Unknown
  misc_feature (1)..( 12): Result.004 file - promoters50/1380309
agtctaagacaa

SEQ ID NO: 166088 - DNA, 12 bp, Unknown
  misc_feature (1)..( 12): Result.004 file - promoters50/1380309
ttcttagacccg

SEQ ID NO: 166089 - DNA, 11 bp, Unknown
  misc_feature (1)..( 11): Result.004 file - promoters50/1380309
aacacaaatca

SEQ ID NO: 166090 - DNA, 11 bp, Unknown
  misc_feature (1)..( 11): Result.004 file - promoters50/1380309
aacataaaaag

SEQ ID NO: 166091 - DNA, 11 bp, Unknown
  misc_feature (1)..( 11): Result.004 file - promoters50/1380309
gtaacaaatct

SEQ ID NO: 166092 - DNA, 11 bp, Unknown
  misc_feature (1)..( 11): Result.004 file - promoters50/1380309
aatataaacct

SEQ ID NO: 166093 - DNA, 11 bp, Unknown
  misc_feature (1)..( 11): Result.004 file - promoters50/1380309
agaataaaaag

SEQ ID NO: 166094 - DNA, 11 bp, Unknown
  misc_feature (1)..( 11): Result.004 file - promoters50/1380309
tacataattgt

SEQ ID NO: 166095 - DNA, 14 bp, Unknown
  misc_feature (1)..( 14): Result.004 file - promoters50/1380309
acaatcaagaagag

SEQ ID NO: 166096 - DNA, 14 bp, Unknown
  misc_feature (1)..( 14): Result.004 file - promoters50/1380309
aaaaacaaaaagta

SEQ ID NO: 166097 - DNA, 15 bp, Unknown
  misc_feature (1)..( 15): Result.004 file - promoters50/1380309
tttccaaataaagaa

SEQ ID NO: 166098 - DNA, 15 bp, Unknown
  misc_feature (1)..( 15): Result.004 file - promoters50/1380309
aagttaaataaatag

SEQ ID NO: 166099 - DNA, 15 bp, Unknown
  misc_feature (1)..( 15): Result.004 file - promoters50/1380309
acataaaataaatac

SEQ ID NO: 166100 - DNA, 15 bp, Unknown
  misc_feature (1)..( 15): Result.004 file - promoters50/1380389
tgtcccataaaaaat

SEQ ID NO: 166101 - DNA, 12 bp, Unknown
  misc_feature (1)..( 12): Result.004 file - promoters50/1380389
taaatcaaaatg

SEQ ID NO: 166102 - DNA, 12 bp, Unknown
  misc_feature (1)..( 12): Result.004 file - promoters50/1380389
cgaatcaatatg

SEQ ID NO: 166103 - DNA, 12 bp, Unknown
  misc_feature (1)..( 12): Result.004 file - promoters50/1380389
taaaacaattat

SEQ ID NO: 166104 - DNA, 12 bp, Unknown
  misc_feature (1)..( 12): Result.004 file - promoters50/1380389
gtcttcaataga

SEQ ID NO: 166105 - DNA, 12 bp, Unknown
  misc_feature (1)..( 12): Result.004 file - promoters50/1380389
ccaaacgattcc

SEQ ID NO: 166106 - DNA, 11 bp, Unknown
  misc_feature (1)..( 11): Result.004 file - promoters50/1380389
aaattttgaat

SEQ ID NO: 166107 - DNA, 11 bp, Unknown
  misc_feature (1)..( 11): Result.004 file - promoters50/1380389
tggttttgact

SEQ ID NO: 166108 - DNA, 11 bp, Unknown
  misc_feature (1)..( 11): Result.004 file - promoters50/1380389
atcttttcaat

SEQ ID NO: 166109 - DNA, 11 bp, Unknown
  misc_feature (1)..( 11): Result.004 file - promoters50/1380389
ttctgttcgta

SEQ ID NO: 166110 - DNA, 11 bp, Unknown
  misc_feature (1)..( 11): Result.004 file - promoters50/1380389
atctgttctca

SEQ ID NO: 166111 - DNA, 11 bp, Unknown
  misc_feature (1)..( 11): Result.004 file - promoters50/1380389
caaaaatatca

SEQ ID NO: 166112 - DNA, 11 bp, Unknown
  misc_feature (1)..( 11): Result.004 file - promoters50/1380389
caaaattatat

SEQ ID NO: 166113 - DNA, 11 bp, Unknown
  misc_feature (1)..( 11): Result.004 file - promoters50/1380389
gaaagatatgg

SEQ ID NO: 166114 - DNA, 11 bp, Unknown
  misc_feature (1)..( 11): Result.004 file - promoters50/1380389
caatatttgta

SEQ ID NO: 166115 - DNA, 11 bp, Unknown
  misc_feature (1)..( 11): Result.004 file - promoters50/1380389
cttatatatgt

SEQ ID NO: 166116 - DNA, 11 bp, Unknown
  misc_feature (1)..( 11): Result.004 file - promoters50/1380389
ttataaatcaa

SEQ ID NO: 166117 - DNA, 11 bp, Unknown
  misc_feature (1)..( 11): Result.004 file - promoters50/1380389
caatagatctt

SEQ ID NO: 166118 - DNA, 11 bp, Unknown
  misc_feature (1)..( 11): Result.004 file - promoters50/1380389
atttaaaacaa

SEQ ID NO: 166119 - DNA, 11 bp, Unknown
  misc_feature (1)..( 11): Result.004 file - promoters50/1380389
caaaagaaacg

SEQ ID NO: 166120 - DNA, 11 bp, Unknown
  misc_feature (1)..( 11): Result.004 file - promoters50/1380418
caaacgattcc

SEQ ID NO: 166121 - DNA, 12 bp, Unknown
  misc_feature (1)..( 12): Result.004 file - promoters50/1380418
agtttctatttt

SEQ ID NO: 166122 - DNA, 12 bp, Unknown
  misc_feature (1)..( 12): Result.004 file - promoters50/1380418
agtttctcattg

SEQ ID NO: 166123 - DNA, 12 bp, Unknown
  misc_feature (1)..( 12): Result.004 file - promoters50/1380418
cctttttcataa

SEQ ID NO: 166124 - DNA, 12 bp, Unknown
  misc_feature (1)..( 12): Result.004 file - promoters50/1380418
atgttcatacca

SEQ ID NO: 166125 - DNA, 12 bp, Unknown
  misc_feature (1)..( 12): Result.004 file - promoters50/1380418
ccttattcaaga

SEQ ID NO: 166126 - DNA, 12 bp, Unknown
  misc_feature (1)..( 12): Result.004 file - promoters50/1380418
tcttatgcaaga

SEQ ID NO: 166127 - DNA, 12 bp, Unknown
  misc_feature (1)..( 12): Result.004 file - promoters50/1380418
tatttttcttct

SEQ ID NO: 166128 - DNA, 10 bp, Unknown
  misc_feature (1)..( 10): Result.004 file - promoters50/1380418
atttctagat

SEQ ID NO: 166129 - DNA, 10 bp, Unknown
  misc_feature (1)..( 10): Result.004 file - promoters50/1380418
tattcaagat

SEQ ID NO: 166130 - DNA, 10 bp, Unknown
  misc_feature (1)..( 10): Result.004 file - promoters50/1380418
ttttctagca

SEQ ID NO: 166131 - DNA, 10 bp, Unknown
  misc_feature (1)..( 10): Result.004 file - promoters50/1380418
caatctcgat

SEQ ID NO: 166132 - DNA, 10 bp, Unknown
  misc_feature (1)..( 10): Result.004 file - promoters50/1380418
ttttctttct

SEQ ID NO: 166133 - DNA, 10 bp, Unknown
  misc_feature (1)..( 10): Result.004 file - promoters50/1380424
ttttctcaag

SEQ ID NO: 166134 - DNA, 7 bp, Unknown
  misc_feature (1)..( 7): Result.004 file - promoters50/1380424
attccag

SEQ ID NO: 166135 - DNA, 7 bp, Unknown
  misc_feature (1)..( 7): Result.004 file - promoters50/1380424
attccaa

SEQ ID NO: 166136 - DNA, 7 bp, Unknown
  misc_feature (1)..( 7): Result.004 file - promoters50/1380424
attgcaa

SEQ ID NO: 166137 - DNA, 7 bp, Unknown
  misc_feature (1)..( 7): Result.004 file - promoters50/1380424
agaaatt

SEQ ID NO: 166138 - DNA, 7 bp, Unknown
  misc_feature (1)..( 7): Result.004 file - promoters50/1380424
tgaaatt

SEQ ID NO: 166139 - DNA, 7 bp, Unknown
  misc_feature (1)..( 7): Result.004 file - promoters50/1380437
tgaaata

SEQ ID NO: 166140 - DNA, 7 bp, Unknown
  misc_feature (1)..( 7): Result.004 file - promoters50/1380437
aacaaaa

SEQ ID NO: 166141 - DNA, 7 bp, Unknown
  misc_feature (1)..( 7): Result.004 file - promoters50/1380437
aactaaa

SEQ ID NO: 166142 - DNA, 7 bp, Unknown
  misc_feature (1)..( 7): Result.004 file - promoters50/1380437
cacaaaa

SEQ ID NO: 166143 - DNA, 9 bp, Unknown
  misc_feature (1)..( 9): Result.004 file - promoters50/1380437
gaagaaaag

SEQ ID NO: 166144 - DNA, 9 bp, Unknown
  misc_feature (1)..( 9): Result.004 file - promoters50/1380437
aaagaaaag

SEQ ID NO: 166145 - DNA, 9 bp, Unknown
  misc_feature (1)..( 9): Result.004 file - promoters50/1380519
aaagtaaag

SEQ ID NO: 166146 - DNA, 9 bp, Unknown
  misc_feature (1)..( 9): Result.004 file - promoters50/1380519
tctcaaact

SEQ ID NO: 166147 - DNA, 9 bp, Unknown
  misc_feature (1)..( 9): Result.004 file - promoters50/1380519
tctaaaaag

SEQ ID NO: 166148 - DNA, 9 bp, Unknown
  misc_feature (1)..( 9): Result.004 file - promoters50/1380519
tatcatact

SEQ ID NO: 166149 - DNA, 8 bp, Unknown
  misc_feature (1)..( 8): Result.004 file - promoters50/1380519
gagcaaaa

SEQ ID NO: 166150 - DNA, 8 bp, Unknown
  misc_feature (1)..( 8): Result.004 file - promoters50/1380519
gagaaaaa

SEQ ID NO: 166151 - DNA, 8 bp, Unknown
  misc_feature (1)..( 8): Result.004 file - promoters50/1380708
gagcaatg

SEQ ID NO: 166152 - DNA, 7 bp, Unknown
  misc_feature (1)..( 7): Result.004 file - promoters50/1380708
aattttt

SEQ ID NO: 166153 - DNA, 7 bp, Unknown
  misc_feature (1)..( 7): Result.004 file - promoters50/1380708
aattttt

SEQ ID NO: 166154 - DNA, 7 bp, Unknown
  misc_feature (1)..( 7): Result.004 file - promoters50/1380708
gattttt

SEQ ID NO: 166155 - DNA, 11 bp, Unknown
  misc_feature (1)..( 11): Result.004 file - promoters50/1380708
taacatttttt

SEQ ID NO: 166156 - DNA, 11 bp, Unknown
  misc_feature (1)..( 11): Result.004 file - promoters50/1380708
agaattttttt

SEQ ID NO: 166157 - DNA, 11 bp, Unknown
  misc_feature (1)..( 11): Result.004 file - promoters50/1380708
taagatttttg

SEQ ID NO: 166158 - DNA, 9 bp, Unknown
  misc_feature (1)..( 9): Result.004 file - promoters50/1380708
tttaatcag

SEQ ID NO: 166159 - DNA, 9 bp, Unknown
  misc_feature (1)..( 9): Result.004 file - promoters50/1380708
tttattcag

SEQ ID NO: 166160 - DNA, 9 bp, Unknown
  misc_feature (1)..( 9): Result.004 file - promoters50/1380738
gttattcga

SEQ ID NO: 166161 - DNA, 16 bp, Unknown
  misc_feature (1)..( 16): Result.004 file - promoters50/1380738
attacattatttttat

SEQ ID NO: 166162 - DNA, 16 bp, Unknown
  misc_feature (1)..( 16): Result.004 file - promoters50/1380738
cctacaatataagata

SEQ ID NO: 166163 - DNA, 16 bp, Unknown
  misc_feature (1)..( 16): Result.004 file - promoters50/1380738
attaaattaacaaaac

SEQ ID NO: 166164 - DNA, 16 bp, Unknown
  misc_feature (1)..( 16): Result.004 file - promoters50/1380738
ttattaatatgagata

SEQ ID NO: 166165 - DNA, 16 bp, Unknown
  misc_feature (1)..( 16): Result.004 file - promoters50/1380738
ttgacatacaagccat

SEQ ID NO: 166166 - DNA, 16 bp, Unknown
  misc_feature (1)..( 16): Result.004 file - promoters50/1380738
tttaaatacatcaata

SEQ ID NO: 166167 - DNA, 16 bp, Unknown
  misc_feature (1)..( 16): Result.004 file - promoters50/1380738
tttaatttattcctat

SEQ ID NO: 166168 - DNA, 13 bp, Unknown
  misc_feature (1)..( 13): Result.004 file - promoters50/1380738
actaattccaaac

SEQ ID NO: 166169 - DNA, 13 bp, Unknown
  misc_feature (1)..( 13): Result.004 file - promoters50/1380738
taagattacaaag

SEQ ID NO: 166170 - DNA, 13 bp, Unknown
  misc_feature (1)..( 13): Result.004 file - promoters50/1380738
ttttattaaaaac

SEQ ID NO: 166171 - DNA, 13 bp, Unknown
  misc_feature (1)..( 13): Result.004 file - promoters50/1380738
ttttcttaaaagt

SEQ ID NO: 166172 - DNA, 13 bp, Unknown
  misc_feature (1)..( 13): Result.004 file - promoters50/1380738
tgtcatttaaacc

SEQ ID NO: 166173 - DNA, 13 bp, Unknown
  misc_feature (1)..( 13): Result.004 file - promoters50/1380738
aggaaagaaaaac

SEQ ID NO: 166174 - DNA, 15 bp, Unknown
  misc_feature (1)..( 15): Result.004 file - promoters50/1380738
ttatttttaccaacc

SEQ ID NO: 166175 - DNA, 15 bp, Unknown
  misc_feature (1)..( 15): Result.004 file - promoters50/1380738
ttattattaactaaa

SEQ ID NO: 166176 - DNA, 15 bp, Unknown
  misc_feature (1)..( 15): Result.004 file - promoters50/1380738
gaatttttagtagat

SEQ ID NO: 166177 - DNA, 15 bp, Unknown
  misc_feature (1)..( 15): Result.004 file - promoters50/1380738
ctttttttcccaaag

SEQ ID NO: 166178 - DNA, 15 bp, Unknown
  misc_feature (1)..( 15): Result.004 file - promoters50/1380738
aagtttttctgttta

SEQ ID NO: 166179 - DNA, 15 bp, Unknown
  misc_feature (1)..( 15): Result.004 file - promoters50/1380738
atattaataattaaa

SEQ ID NO: 166180 - DNA, 15 bp, Unknown
  misc_feature (1)..( 15): Result.004 file - promoters50/1380738
tgatttatcctaagc

SEQ ID NO: 166181 - DNA, 11 bp, Unknown
  misc_feature (1)..( 11): Result.004 file - promoters50/1380738
cttaaatttaa

SEQ ID NO: 166182 - DNA, 11 bp, Unknown
  misc_feature (1)..( 11): Result.004 file - promoters50/1380738
tttaaatttat

SEQ ID NO: 166183 - DNA, 11 bp, Unknown
  misc_feature (1)..( 11): Result.004 file - promoters50/1380738
aatgtatttaa

SEQ ID NO: 166184 - DNA, 11 bp, Unknown
  misc_feature (1)..( 11): Result.004 file - promoters50/1380738
taacaatttag

SEQ ID NO: 166185 - DNA, 11 bp, Unknown
  misc_feature (1)..( 11): Result.004 file - promoters50/1380738
cttaaatggct

SEQ ID NO: 166186 - DNA, 11 bp, Unknown
  misc_feature (1)..( 11): Result.004 file - promoters50/1380797
ttttaatgatt

SEQ ID NO: 166187 - DNA, 8 bp, Unknown
  misc_feature (1)..( 8): Result.004 file - promoters50/1380797
cttatgga

SEQ ID NO: 166188 - DNA, 8 bp, Unknown
  misc_feature (1)..( 8): Result.004 file - promoters50/1380797
attatgga

SEQ ID NO: 166189 - DNA, 8 bp, Unknown
  misc_feature (1)..( 8): Result.004 file - promoters50/1380797
attttgga

SEQ ID NO: 166190 - DNA, 7 bp, Unknown
  misc_feature (1)..( 7): Result.004 file - promoters50/1380797
aatcaat

SEQ ID NO: 166191 - DNA, 7 bp, Unknown
  misc_feature (1)..( 7): Result.004 file - promoters50/1380797
aatgaat

SEQ ID NO: 166192 - DNA, 7 bp, Unknown
  misc_feature (1)..( 7): Result.004 file - promoters50/1380797
aatgaat

SEQ ID NO: 166193 - DNA, 7 bp, Unknown
  misc_feature (1)..( 7): Result.004 file - promoters50/1380797
aaaaagt

SEQ ID NO: 166194 - DNA, 7 bp, Unknown
  misc_feature (1)..( 7): Result.004 file - promoters50/1380797
aaatagt

SEQ ID NO: 166195 - DNA, 7 bp, Unknown
  misc_feature (1)..( 7): Result.004 file - promoters50/1380849
aaacata

SEQ ID NO: 166196 - DNA, 12 bp, Unknown
  misc_feature (1)..( 12): Result.004 file - promoters50/1380849
cttatttttctt

SEQ ID NO: 166197 - DNA, 12 bp, Unknown
  misc_feature (1)..( 12): Result.004 file - promoters50/1380849
cttgtttccaag

SEQ ID NO: 166198 - DNA, 12 bp, Unknown
  misc_feature (1)..( 12): Result.004 file - promoters50/1380849
tttatttttctt

SEQ ID NO: 166199 - DNA, 12 bp, Unknown
  misc_feature (1)..( 12): Result.004 file - promoters50/1380849
tgtatttttttt

SEQ ID NO: 166200 - DNA, 16 bp, Unknown
  misc_feature (1)..( 16): Result.004 file - promoters50/1380849
ttaggaatctttgaga

SEQ ID NO: 166201 - DNA, 16 bp, Unknown
  misc_feature (1)..( 16): Result.004 file - promoters50/1380849
gagttttgtttttaga

SEQ ID NO: 166202 - DNA, 16 bp, Unknown
  misc_feature (1)..( 16): Result.004 file - promoters50/1380849
tgattaatatttgaag

SEQ ID NO: 166203 - DNA, 16 bp, Unknown
  misc_feature (1)..( 16): Result.004 file - promoters50/1380849
tgataaatcttttttt

SEQ ID NO: 166204 - DNA, 8 bp, Unknown
  misc_feature (1)..( 8): Result.004 file - promoters50/1380849
gaatcttt

SEQ ID NO: 166205 - DNA, 8 bp, Unknown
  misc_feature (1)..( 8): Result.004 file - promoters50/1380849
aaatcttt

SEQ ID NO: 166206 - DNA, 9 bp, Unknown
  misc_feature (1)..( 9): Result.004 file - promoters50/1380849
agatcattt

SEQ ID NO: 166207 - DNA, 9 bp, Unknown
  misc_feature (1)..( 9): Result.004 file - promoters50/1380849
aaatgttta

SEQ ID NO: 166208 - DNA, 9 bp, Unknown
  misc_feature (1)..( 9): Result.004 file - promoters50/1380849
aatttatta

SEQ ID NO: 166209 - DNA, 9 bp, Unknown
  misc_feature (1)..( 9): Result.004 file - promoters50/1380849
tttttttta

SEQ ID NO: 166210 - DNA, 9 bp, Unknown
  misc_feature (1)..( 9): Result.004 file - promoters50/1380849
aattaatta

SEQ ID NO: 166211 - DNA, 9 bp, Unknown
  misc_feature (1)..( 9): Result.004 file - promoters50/1380849
aaaaaatta

SEQ ID NO: 166212 - DNA, 11 bp, Unknown
  misc_feature (1)..( 11): Result.004 file - promoters50/1380849
atgttagtttg

SEQ ID NO: 166213 - DNA, 11 bp, Unknown
  misc_feature (1)..( 11): Result.004 file - promoters50/1380849
tttatagattg

SEQ ID NO: 166214 - DNA, 11 bp, Unknown
  misc_feature (1)..( 11): Result.004 file - promoters50/1380849
tttttagatca

SEQ ID NO: 166215 - DNA, 11 bp, Unknown
  misc_feature (1)..( 11): Result.004 file - promoters50/1380947
cagttagatct

SEQ ID NO: 166216 - DNA, 7 bp, Unknown
  misc_feature (1)..( 7): Result.004 file - promoters50/1380947
gatcgaa

SEQ ID NO: 166217 - DNA, 7 bp, Unknown
  misc_feature (1)..( 7): Result.004 file - promoters50/1380947
gatggaa

SEQ ID NO: 166218 - DNA, 7 bp, Unknown
  misc_feature (1)..( 7): Result.004 file - promoters50/1380947
gatcgat

SEQ ID NO: 166219 - DNA, 7 bp, Unknown
  misc_feature (1)..( 7): Result.004 file - promoters50/1380963
gatggat

SEQ ID NO: 166220 - DNA, 10 bp, Unknown
  misc_feature (1)..( 10): Result.004 file - promoters50/1380963
tattatatat

SEQ ID NO: 166221 - DNA, 10 bp, Unknown
  misc_feature (1)..( 10): Result.004 file - promoters50/1380963
tatcatattt

SEQ ID NO: 166222 - DNA, 10 bp, Unknown
  misc_feature (1)..( 10): Result.004 file - promoters50/1380963
caatatataa

SEQ ID NO: 166223 - DNA, 10 bp, Unknown
  misc_feature (1)..( 10): Result.004 file - promoters50/1380963
acttatgtaa

SEQ ID NO: 166224 - DNA, 7 bp, Unknown
  misc_feature (1)..( 7): Result.004 file - promoters50/1380963
tatatat

SEQ ID NO: 166225 - DNA, 7 bp, Unknown
  misc_feature (1)..( 7): Result.004 file - promoters50/1380963
gatatat

SEQ ID NO: 166226 - DNA, 7 bp, Unknown
  misc_feature (1)..( 7): Result.004 file - promoters50/1380963
tatataa

SEQ ID NO: 166227 - DNA, 7 bp, Unknown
  misc_feature (1)..( 7): Result.004 file - promoters50/1380963
tatgtaa

SEQ ID NO: 166228 - DNA, 12 bp, Unknown
  misc_feature (1)..( 12): Result.004 file - promoters50/1380963
gattattatttc

SEQ ID NO: 166229 - DNA, 12 bp, Unknown
  misc_feature (1)..( 12): Result.004 file - promoters50/1380963
aattcttaatgt

SEQ ID NO: 166230 - DNA, 12 bp, Unknown
  misc_feature (1)..( 12): Result.004 file - promoters50/1380963
tataatttatgc

SEQ ID NO: 166231 - DNA, 12 bp, Unknown
  misc_feature (1)..( 12): Result.004 file - promoters50/1380963
taaaattaatgc

SEQ ID NO: 166232 - DNA, 11 bp, Unknown
  misc_feature (1)..( 11): Result.004 file - promoters50/1380963
tcaaccaatta

SEQ ID NO: 166233 - DNA, 11 bp, Unknown
  misc_feature (1)..( 11): Result.004 file - promoters50/1380963
cttaccaattg

SEQ ID NO: 166234 - DNA, 11 bp, Unknown
  misc_feature (1)..( 11): Result.004 file - promoters50/1380963
tcaatcaaggc

SEQ ID NO: 166235 - DNA, 11 bp, Unknown
  misc_feature (1)..( 11): Result.004 file - promoters50/1381002
caaaccatttg

SEQ ID NO: 166236 - DNA, 16 bp, Unknown
  misc_feature (1)..( 16): Result.004 file - promoters50/1381002
tattaaattttaattg

SEQ ID NO: 166237 - DNA, 16 bp, Unknown
  misc_feature (1)..( 16): Result.004 file - promoters50/1381002
tcaaaaactttcataa

SEQ ID NO: 166238 - DNA, 16 bp, Unknown
  misc_feature (1)..( 16): Result.004 file - promoters50/1381002
tatcaaattgacttgt

SEQ ID NO: 166239 - DNA, 16 bp, Unknown
  misc_feature (1)..( 16): Result.004 file - promoters50/1381002
catgttactttcttaa

SEQ ID NO: 166240 - DNA, 16 bp, Unknown
  misc_feature (1)..( 16): Result.004 file - promoters50/1381002
attcttacttgttcta

SEQ ID NO: 166241 - DNA, 16 bp, Unknown
  misc_feature (1)..( 16): Result.004 file - promoters50/1381002
tttcagattctgattt

SEQ ID NO: 166242 - DNA, 14 bp, Unknown
  misc_feature (1)..( 14): Result.004 file - promoters50/1381002
acattaaataatat

SEQ ID NO: 166243 - DNA, 14 bp, Unknown
  misc_feature (1)..( 14): Result.004 file - promoters50/1381002
gactaaaataaagg

SEQ ID NO: 166244 - DNA, 14 bp, Unknown
  misc_feature (1)..( 14): Result.004 file - promoters50/1381002
gagtcaattatagg

SEQ ID NO: 166245 - DNA, 14 bp, Unknown
  misc_feature (1)..( 14): Result.004 file - promoters50/1381002
actacaattaagcc

SEQ ID NO: 166246 - DNA, 14 bp, Unknown
  misc_feature (1)..( 14): Result.004 file - promoters50/1381002
gagagaaaaaaaag

SEQ ID NO: 166247 - DNA, 14 bp, Unknown
  misc_feature (1)..( 14): Result.004 file - promoters50/1381033
aatggaataaaatc

SEQ ID NO: 166248 - DNA, 11 bp, Unknown
  misc_feature (1)..( 11): Result.004 file - promoters50/1381033
ttatacatatg

SEQ ID NO: 166249 - DNA, 11 bp, Unknown
  misc_feature (1)..( 11): Result.004 file - promoters50/1381033
tgataaatatg

SEQ ID NO: 166250 - DNA, 11 bp, Unknown
  misc_feature (1)..( 11): Result.004 file - promoters50/1381033
ttatacataac

SEQ ID NO: 166251 - DNA, 11 bp, Unknown
  misc_feature (1)..( 11): Result.004 file - promoters50/1381097
ttaaaaatatc

SEQ ID NO: 166252 - DNA, 12 bp, Unknown
  misc_feature (1)..( 12): Result.004 file - promoters50/1381097
ttttgcaatttt

SEQ ID NO: 166253 - DNA, 12 bp, Unknown
  misc_feature (1)..( 12): Result.004 file - promoters50/1381097
taaggcaaattt

SEQ ID NO: 166254 - DNA, 8 bp, Unknown
  misc_feature (1)..( 8): Result.004 file - promoters50/1381097
ataatttt

SEQ ID NO: 166255 - DNA, 12 bp, Unknown
  misc_feature (1)..( 12): Result.004 file - promoters50/1381097
taagccaaacgc

SEQ ID NO: 166256 - DNA, 9 bp, Unknown
  misc_feature (1)..( 9): Result.004 file - promoters50/1381097
tattgaaat

SEQ ID NO: 166257 - DNA, 9 bp, Unknown
  misc_feature (1)..( 9): Result.004 file - promoters50/1381097
tattaaaaa

SEQ ID NO: 166258 - DNA, 9 bp, Unknown
  misc_feature (1)..( 9): Result.004 file - promoters50/1381097
tcatgaaat

SEQ ID NO: 166259 - DNA, 10 bp, Unknown
  misc_feature (1)..( 10): Result.004 file - promoters50/1381097
tttatacaat

SEQ ID NO: 166260 - DNA, 10 bp, Unknown
  misc_feature (1)..( 10): Result.004 file - promoters50/1381097
tttatataat

SEQ ID NO: 166261 - DNA, 10 bp, Unknown
  misc_feature (1)..( 10): Result.004 file - promoters50/1381097
cttatatcat

SEQ ID NO: 166262 - DNA, 9 bp, Unknown
  misc_feature (1)..( 9): Result.004 file - promoters50/1381097
agaaaataa

SEQ ID NO: 166263 - DNA, 9 bp, Unknown
  misc_feature (1)..( 9): Result.004 file - promoters50/1381097
agaaaaaat

SEQ ID NO: 166264 - DNA, 9 bp, Unknown
  misc_feature (1)..( 9): Result.004 file - promoters50/1381097
tgaaaaaat

SEQ ID NO: 166265 - DNA, 9 bp, Unknown
  misc_feature (1)..( 9): Result.004 file - promoters50/1381097
aaaataata

SEQ ID NO: 166266 - DNA, 9 bp, Unknown
  misc_feature (1)..( 9): Result.004 file - promoters50/1381097
gaaaaaata

SEQ ID NO: 166267 - DNA, 9 bp, Unknown
  misc_feature (1)..( 9): Result.004 file - promoters50/1381097
gaaaaaatt

SEQ ID NO: 166268 - DNA, 13 bp, Unknown
  misc_feature (1)..( 13): Result.004 file - promoters50/1381097
ttgattcttaatt

SEQ ID NO: 166269 - DNA, 13 bp, Unknown
  misc_feature (1)..( 13): Result.004 file - promoters50/1381097
ttgatttttaaat

SEQ ID NO: 166270 - DNA, 13 bp, Unknown
  misc_feature (1)..( 13): Result.004 file - promoters50/1381097
aagagtttcaaat

SEQ ID NO: 166271 - DNA, 15 bp, Unknown
  misc_feature (1)..( 15): Result.004 file - promoters50/1381097
tttggaaatgtgttt

SEQ ID NO: 166272 - DNA, 15 bp, Unknown
  misc_feature (1)..( 15): Result.004 file - promoters50/1381097
tttggatatgtattt

SEQ ID NO: 166273 - DNA, 15 bp, Unknown
  misc_feature (1)..( 15): Result.004 file - promoters50/1381097
gtgggatataattta

SEQ ID NO: 166274 - DNA, 9 bp, Unknown
  misc_feature (1)..( 9): Result.004 file - promoters50/1381097
ccaaacttt

SEQ ID NO: 166275 - DNA, 9 bp, Unknown
  misc_feature (1)..( 9): Result.004 file - promoters50/1381097
ccaaatttt

SEQ ID NO: 166276 - DNA, 9 bp, Unknown
  misc_feature (1)..( 9): Result.004 file - promoters50/1381119
ccaaacgca

SEQ ID NO: 166277 - DNA, 13 bp, Unknown
  misc_feature (1)..( 13): Result.004 file - promoters50/1381119
actattttatata

SEQ ID NO: 166278 - DNA, 13 bp, Unknown
  misc_feature (1)..( 13): Result.004 file - promoters50/1381119
ttaattttaaata

SEQ ID NO: 166279 - DNA, 13 bp, Unknown
  misc_feature (1)..( 13): Result.004 file - promoters50/1381119
ttagttttggttc

SEQ ID NO: 166280 - DNA, 10 bp, Unknown
  misc_feature (1)..( 10): Result.004 file - promoters50/1381119
tttactattt

SEQ ID NO: 166281 - DNA, 10 bp, Unknown
  misc_feature (1)..( 10): Result.004 file - promoters50/1381119
tagactgttt

SEQ ID NO: 166282 - DNA, 10 bp, Unknown
  misc_feature (1)..( 10): Result.004 file - promoters50/1381119
tttagtatcc

SEQ ID NO: 166283 - DNA, 7 bp, Unknown
  misc_feature (1)..( 7): Result.004 file - promoters50/1381119
tattttc

SEQ ID NO: 166284 - DNA, 7 bp, Unknown
  misc_feature (1)..( 7): Result.004 file - promoters50/1381119
tattttt

SEQ ID NO: 166285 - DNA, 8 bp, Unknown
  misc_feature (1)..( 8): Result.004 file - promoters50/1381119
aattgtta

SEQ ID NO: 166286 - DNA, 9 bp, Unknown
  misc_feature (1)..( 9): Result.004 file - promoters50/1381119
ttttgaata

SEQ ID NO: 166287 - DNA, 9 bp, Unknown
  misc_feature (1)..( 9): Result.004 file - promoters50/1381119
tttttaatt

SEQ ID NO: 166288 - DNA, 9 bp, Unknown
  misc_feature (1)..( 9): Result.004 file - promoters50/1381119
ggtttaatt

SEQ ID NO: 166289 - DNA, 10 bp, Unknown
  misc_feature (1)..( 10): Result.004 file - promoters50/1381119
tttcaattat

SEQ ID NO: 166290 - DNA, 10 bp, Unknown
  misc_feature (1)..( 10): Result.004 file - promoters50/1381119
tttcatttat

SEQ ID NO: 166291 - DNA, 10 bp, Unknown
  misc_feature (1)..( 10): Result.004 file - promoters50/1381155
tttcatcact

SEQ ID NO: 166292 - DNA, 9 bp, Unknown
  misc_feature (1)..( 9): Result.004 file - promoters50/1381155
tttctactt

SEQ ID NO: 166293 - DNA, 9 bp, Unknown
  misc_feature (1)..( 9): Result.004 file - promoters50/1381155
tttcttctt

SEQ ID NO: 166294 - DNA, 9 bp, Unknown
  misc_feature (1)..( 9): Result.004 file - promoters50/1381187
ttgctactt

SEQ ID NO: 166295 - DNA, 13 bp, Unknown
  misc_feature (1)..( 13): Result.004 file - promoters50/1381187
aatcgtacattat

SEQ ID NO: 166296 - DNA, 13 bp, Unknown
  misc_feature (1)..( 13): Result.004 file - promoters50/1381187
aattatacattat

SEQ ID NO: 166297 - DNA, 13 bp, Unknown
  misc_feature (1)..( 13): Result.004 file - promoters50/1381187
aattatatatttt

SEQ ID NO: 166298 - DNA, 7 bp, Unknown
  misc_feature (1)..( 7): Result.004 file - promoters50/1381187
tttctca

SEQ ID NO: 166299 - DNA, 7 bp, Unknown
  misc_feature (1)..( 7): Result.004 file - promoters50/1381187
gttctca

SEQ ID NO: 166300 - DNA, 7 bp, Unknown
  misc_feature (1)..( 7): Result.004 file - promoters50/1381187
tttctct

SEQ ID NO: 166301 - DNA, 8 bp, Unknown
  misc_feature (1)..( 8): Result.004 file - promoters50/1381187
aaagacat

SEQ ID NO: 166302 - DNA, 8 bp, Unknown
  misc_feature (1)..( 8): Result.004 file - promoters50/1381187
aaagccat

SEQ ID NO: 166303 - DNA, 8 bp, Unknown
  misc_feature (1)..( 8): Result.004 file - promoters50/1381187
caagagat

SEQ ID NO: 166304 - DNA, 8 bp, Unknown
  misc_feature (1)..( 8): Result.004 file - promoters50/1381187
gtaataaa

SEQ ID NO: 166305 - DNA, 8 bp, Unknown
  misc_feature (1)..( 8): Result.004 file - promoters50/1381187
tgaataaa

SEQ ID NO: 166306 - DNA, 9 bp, Unknown
  misc_feature (1)..( 9): Result.004 file - promoters50/1381187
tgaatgaaa

SEQ ID NO: 166307 - DNA, 9 bp, Unknown
  misc_feature (1)..( 9): Result.004 file - promoters50/1381187
ctcattttt

SEQ ID NO: 166308 - DNA, 9 bp, Unknown
  misc_feature (1)..( 9): Result.004 file - promoters50/1381187
ctcactttt

SEQ ID NO: 166309 - DNA, 9 bp, Unknown
  misc_feature (1)..( 9): Result.004 file - promoters50/1381187
cacactttt

SEQ ID NO: 166310 - DNA, 8 bp, Unknown
  misc_feature (1)..( 8): Result.004 file - promoters50/1381187
taacttat

SEQ ID NO: 166311 - DNA, 8 bp, Unknown
  misc_feature (1)..( 8): Result.004 file - promoters50/1381187
taaattaa

SEQ ID NO: 166312 - DNA, 8 bp, Unknown
  misc_feature (1)..( 8): Result.004 file - promoters50/1381187
ttaattaa

SEQ ID NO: 166313 - DNA, 9 bp, Unknown
  misc_feature (1)..( 9): Result.004 file - promoters50/1381187
attgctttc

SEQ ID NO: 166314 - DNA, 9 bp, Unknown
  misc_feature (1)..( 9): Result.004 file - promoters50/1381187
tttggtttc

SEQ ID NO: 166315 - DNA, 9 bp, Unknown
  misc_feature (1)..( 9): Result.004 file - promoters50/1381187
tttagtttg

SEQ ID NO: 166316 - DNA, 8 bp, Unknown
  misc_feature (1)..( 8): Result.004 file - promoters50/1381187
tttagttt

SEQ ID NO: 166317 - DNA, 8 bp, Unknown
  misc_feature (1)..( 8): Result.004 file - promoters50/1381187
tttagtgt

SEQ ID NO: 166318 - DNA, 8 bp, Unknown
  misc_feature (1)..( 8): Result.004 file - promoters50/1381195
tttggttt

SEQ ID NO: 166319 - DNA, 7 bp, Unknown
  misc_feature (1)..( 7): Result.004 file - promoters50/1381195
taattgg

SEQ ID NO: 166320 - DNA, 7 bp, Unknown
  misc_feature (1)..( 7): Result.004 file - promoters50/1381195
taagtgg

SEQ ID NO: 166321 - DNA, 7 bp, Unknown
  misc_feature (1)..( 7): Result.004 file - promoters50/1381321
taaatgg

SEQ ID NO: 166322 - DNA, 14 bp, Unknown
  misc_feature (1)..( 14): Result.004 file - promoters50/1381321
tcaaagagaaattc

SEQ ID NO: 166323 - DNA, 14 bp, Unknown
  misc_feature (1)..( 14): Result.004 file - promoters50/1381321
ggacagagacattc

SEQ ID NO: 166324 - DNA, 14 bp, Unknown
  misc_feature (1)..( 14): Result.004 file - promoters50/1381334
tcaaagtgaattat

SEQ ID NO: 166325 - DNA, 8 bp, Unknown
  misc_feature (1)..( 8): Result.004 file - promoters50/1381334
ttatatta

SEQ ID NO: 166326 - DNA, 8 bp, Unknown
  misc_feature (1)..( 8): Result.004 file - promoters50/1381334
ttaaattg

SEQ ID NO: 166327 - DNA, 8 bp, Unknown
  misc_feature (1)..( 8): Result.004 file - promoters50/1381342
ccaaattg

SEQ ID NO: 166328 - DNA, 8 bp, Unknown
  misc_feature (1)..( 8): Result.004 file - promoters50/1381342
ttattttc

SEQ ID NO: 166329 - DNA, 8 bp, Unknown
  misc_feature (1)..( 8): Result.004 file - promoters50/1381342
ttactttg

SEQ ID NO: 166330 - DNA, 8 bp, Unknown
  misc_feature (1)..( 8): Result.004 file - promoters50/1381342
tttctttt

SEQ ID NO: 166331 - DNA, 9 bp, Unknown
  misc_feature (1)..( 9): Result.004 file - promoters50/1381342
tttttcttc

SEQ ID NO: 166332 - DNA, 9 bp, Unknown
  misc_feature (1)..( 9): Result.004 file - promoters50/1381342
tttttctca

SEQ ID NO: 166333 - DNA, 9 bp, Unknown
  misc_feature (1)..( 9): Result.004 file - promoters50/1381387
cgtttctca

SEQ ID NO: 166334 - DNA, 13 bp, Unknown
  misc_feature (1)..( 13): Result.004 file - promoters50/1381387
attgtgttttacg

SEQ ID NO: 166335 - DNA, 13 bp, Unknown
  misc_feature (1)..( 13): Result.004 file - promoters50/1381387
aatgtgatttacg

SEQ ID NO: 166336 - DNA, 13 bp, Unknown
  misc_feature (1)..( 13): Result.004 file - promoters50/1381387
ttaatgatttcat

SEQ ID NO: 166337 - DNA, 13 bp, Unknown
  misc_feature (1)..( 13): Result.004 file - promoters50/1381387
tatccgaattatt

SEQ ID NO: 166338 - DNA, 13 bp, Unknown
  misc_feature (1)..( 13): Result.004 file - promoters50/1381387
ttattgatttcac

SEQ ID NO: 166339 - DNA, 13 bp, Unknown
  misc_feature (1)..( 13): Result.004 file - promoters50/1381457
aatatgaatttgc

SEQ ID NO: 166340 - DNA, 11 bp, Unknown
  misc_feature (1)..( 11): Result.004 file - promoters50/1381457
ggcttttgacc

SEQ ID NO: 166341 - DNA, 11 bp, Unknown
  misc_feature (1)..( 11): Result.004 file - promoters50/1381457
aggttttgaaa

SEQ ID NO: 166342 - DNA, 11 bp, Unknown
  misc_feature (1)..( 11): Result.004 file - promoters50/1381457
agattttgatt

SEQ ID NO: 166343 - DNA, 11 bp, Unknown
  misc_feature (1)..( 11): Result.004 file - promoters50/1381457
ggcttatgaat

SEQ ID NO: 166344 - DNA, 11 bp, Unknown
  misc_feature (1)..( 11): Result.004 file - promoters50/1381457
gtcttatgtgg

SEQ ID NO: 166345 - DNA, 11 bp, Unknown
  misc_feature (1)..( 11): Result.004 file - promoters50/1381457
tctgtttcatt

SEQ ID NO: 166346 - DNA, 11 bp, Unknown
  misc_feature (1)..( 11): Result.004 file - promoters50/1381481
taagtataaat

SEQ ID NO: 166347 - DNA, 11 bp, Unknown
  misc_feature (1)..( 11): Result.004 file - promoters50/1381481
aaaacataaat

SEQ ID NO: 166348 - DNA, 11 bp, Unknown
  misc_feature (1)..( 11): Result.004 file - promoters50/1381481
aaaaaataaat

SEQ ID NO: 166349 - DNA, 11 bp, Unknown
  misc_feature (1)..( 11): Result.004 file - promoters50/1381481
tgaacatacct

SEQ ID NO: 166350 - DNA, 6 bp, Unknown
  misc_feature (1)..( 6): Result.004 file - promoters50/1381481
tttcga

SEQ ID NO: 166351 - DNA, 6 bp, Unknown
  misc_feature (1)..( 6): Result.004 file - promoters50/1381481
tttcga

SEQ ID NO: 166352 - DNA, 6 bp, Unknown
  misc_feature (1)..( 6): Result.004 file - promoters50/1381491
tttcga

SEQ ID NO: 166353 - DNA, 8 bp, Unknown
  misc_feature (1)..( 8): Result.004 file - promoters50/1381491
caatttaa

SEQ ID NO: 166354 - DNA, 8 bp, Unknown
  misc_feature (1)..( 8): Result.004 file - promoters50/1381491
acatttaa

SEQ ID NO: 166355 - DNA, 8 bp, Unknown
  misc_feature (1)..( 8): Result.004 file - promoters50/1381491
acatataa

SEQ ID NO: 166356 - DNA, 8 bp, Unknown
  misc_feature (1)..( 8): Result.004 file - promoters50/1381491
aaacacaa

SEQ ID NO: 166357 - DNA, 8 bp, Unknown
  misc_feature (1)..( 8): Result.004 file - promoters50/1381491
aaaaacat

SEQ ID NO: 166358 - DNA, 8 bp, Unknown
  misc_feature (1)..( 8): Result.004 file - promoters50/1381491
ggacacaa

SEQ ID NO: 166359 - DNA, 11 bp, Unknown
  misc_feature (1)..( 11): Result.004 file - promoters50/1381491
gaagaaaaaca

SEQ ID NO: 166360 - DNA, 11 bp, Unknown
  misc_feature (1)..( 11): Result.004 file - promoters50/1381491
gaagcaaaacc

SEQ ID NO: 166361 - DNA, 11 bp, Unknown
  misc_feature (1)..( 11): Result.004 file - promoters50/1381491
atctcaaaacc

SEQ ID NO: 166362 - DNA, 10 bp, Unknown
  misc_feature (1)..( 10): Result.004 file - promoters50/1381491
aaaaacagct

SEQ ID NO: 166363 - DNA, 10 bp, Unknown
  misc_feature (1)..( 10): Result.004 file - promoters50/1381491
caaaacaacc

SEQ ID NO: 166364 - DNA, 11 bp, Unknown
  misc_feature (1)..( 11): Result.004 file - promoters50/1381491
aaagaactctt

SEQ ID NO: 166365 - DNA, 8 bp, Unknown
  misc_feature (1)..( 8): Result.004 file - promoters50/1381491
attaaatc

SEQ ID NO: 166366 - DNA, 8 bp, Unknown
  misc_feature (1)..( 8): Result.004 file - promoters50/1381491
attgaatt

SEQ ID NO: 166367 - DNA, 8 bp, Unknown
  misc_feature (1)..( 8): Result.004 file - promoters50/1381491
tctgaatt

SEQ ID NO: 166368 - DNA, 14 bp, Unknown
  misc_feature (1)..( 14): Result.004 file - promoters50/1381491
tctttcttatataa

SEQ ID NO: 166369 - DNA, 14 bp, Unknown
  misc_feature (1)..( 14): Result.004 file - promoters50/1381491
tctctcttacataa

SEQ ID NO: 166370 - DNA, 14 bp, Unknown
  misc_feature (1)..( 14): Result.004 file - promoters50/1381491
aaacccatatataa

SEQ ID NO: 166371 - DNA, 8 bp, Unknown
  misc_feature (1)..( 8): Result.004 file - promoters50/1381491
acatttaa

SEQ ID NO: 166372 - DNA, 8 bp, Unknown
  misc_feature (1)..( 8): Result.004 file - promoters50/1381491
acatataa

SEQ ID NO: 166373 - DNA, 8 bp, Unknown
  misc_feature (1)..( 8): Result.004 file - promoters50/1381491
acatttaa

SEQ ID NO: 166374 - DNA, 7 bp, Unknown
  misc_feature (1)..( 7): Result.004 file - promoters50/1381491
gttttag

SEQ ID NO: 166375 - DNA, 7 bp, Unknown
  misc_feature (1)..( 7): Result.004 file - promoters50/1381491
gttttat

SEQ ID NO: 166376 - DNA, 7 bp, Unknown
  misc_feature (1)..( 7): Result.004 file - promoters50/1381491
tttttat

SEQ ID NO: 166377 - DNA, 9 bp, Unknown
  misc_feature (1)..( 9): Result.004 file - promoters50/1381491
taagacaat

SEQ ID NO: 166378 - DNA, 9 bp, Unknown
  misc_feature (1)..( 9): Result.004 file - promoters50/1381491
aaagaaaat

SEQ ID NO: 166379 - DNA, 9 bp, Unknown
  misc_feature (1)..( 9): Result.004 file - promoters50/1381537
aaagaaaga

SEQ ID NO: 166380 - DNA, 9 bp, Unknown
  misc_feature (1)..( 9): Result.004 file - promoters50/1381537
taaaacaaa

SEQ ID NO: 166381 - DNA, 9 bp, Unknown
  misc_feature (1)..( 9): Result.004 file - promoters50/1381537
taaaccaat

SEQ ID NO: 166382 - DNA, 9 bp, Unknown
  misc_feature (1)..( 9): Result.004 file - promoters50/1381537
caaaataaa

SEQ ID NO: 166383 - DNA, 11 bp, Unknown
  misc_feature (1)..( 11): Result.004 file - promoters50/1381537
aaaatccttta

SEQ ID NO: 166384 - DNA, 11 bp, Unknown
  misc_feature (1)..( 11): Result.004 file - promoters50/1381537
aaaatgctttg

SEQ ID NO: 166385 - DNA, 11 bp, Unknown
  misc_feature (1)..( 11): Result.004 file - promoters50/1381537
attttccttta

SEQ ID NO: 166386 - DNA, 8 bp, Unknown
  misc_feature (1)..( 8): Result.004 file - promoters50/1381537
atttgtta

SEQ ID NO: 166387 - DNA, 8 bp, Unknown
  misc_feature (1)..( 8): Result.004 file - promoters50/1381537
ttttgttt

SEQ ID NO: 166388 - DNA, 8 bp, Unknown
  misc_feature (1)..( 8): Result.004 file - promoters50/1381563
ttttcttt

SEQ ID NO: 166389 - DNA, 14 bp, Unknown
  misc_feature (1)..( 14): Result.004 file - promoters50/1381563
tgaatttgatgaat

SEQ ID NO: 166390 - DNA, 14 bp, Unknown
  misc_feature (1)..( 14): Result.004 file - promoters50/1381563
acctgctgaagaaa

SEQ ID NO: 166391 - DNA, 14 bp, Unknown
  misc_feature (1)..( 14): Result.004 file - promoters50/1381563
ttccacggataaat

SEQ ID NO: 166392 - DNA, 14 bp, Unknown
  misc_feature (1)..( 14): Result.004 file - promoters50/1381563
tgaatatgatgatg

SEQ ID NO: 166393 - DNA, 14 bp, Unknown
  misc_feature (1)..( 14): Result.004 file - promoters50/1381563
caaagtagataaaa

SEQ ID NO: 166394 - DNA, 14 bp, Unknown
  misc_feature (1)..( 14): Result.004 file - promoters50/1381563
taatttacataaaa

SEQ ID NO: 166395 - DNA, 12 bp, Unknown
  misc_feature (1)..( 12): Result.004 file - promoters50/1381563
ttttagaaaaaa

SEQ ID NO: 166396 - DNA, 12 bp, Unknown
  misc_feature (1)..( 12): Result.004 file - promoters50/1381563
cattacaaaaag

SEQ ID NO: 166397 - DNA, 12 bp, Unknown
  misc_feature (1)..( 12): Result.004 file - promoters50/1381563
gtttagaagaag

SEQ ID NO: 166398 - DNA, 12 bp, Unknown
  misc_feature (1)..( 12): Result.004 file - promoters50/1381563
ttttaaaaactt

SEQ ID NO: 166399 - DNA, 12 bp, Unknown
  misc_feature (1)..( 12): Result.004 file - promoters50/1381563
agaaggaaaaaa

SEQ ID NO: 166400 - DNA, 12 bp, Unknown
  misc_feature (1)..( 12): Result.004 file - promoters50/1381563
ccttataaaaca

SEQ ID NO: 166401 - DNA, 12 bp, Unknown
  misc_feature (1)..( 12): Result.004 file - promoters50/1381563
aggtacaaactt

SEQ ID NO: 166402 - DNA, 17 bp, Unknown
  misc_feature (1)..( 17): Result.004 file - promoters50/1381563
ttctttgaatttgatga

SEQ ID NO: 166403 - DNA, 17 bp, Unknown
  misc_feature (1)..( 17): Result.004 file - promoters50/1381563
atatttaaatgggccta

SEQ ID NO: 166404 - DNA, 17 bp, Unknown
  misc_feature (1)..( 17): Result.004 file - promoters50/1381563
tgatttttggtggtgaa

SEQ ID NO: 166405 - DNA, 17 bp, Unknown
  misc_feature (1)..( 17): Result.004 file - promoters50/1381563
aggtctgaatatgatga

SEQ ID NO: 166406 - DNA, 17 bp, Unknown
  misc_feature (1)..( 17): Result.004 file - promoters50/1381563
cactttaaaatcacatc

SEQ ID NO: 166407 - DNA, 18 bp, Unknown
  misc_feature (1)..( 18): Result.004 file - promoters50/1381563
gattttataatataaata

SEQ ID NO: 166408 - DNA, 14 bp, Unknown
  misc_feature (1)..( 14): Result.004 file - promoters50/1381563
attttaaaaaggag

SEQ ID NO: 166409 - DNA, 14 bp, Unknown
  misc_feature (1)..( 14): Result.004 file - promoters50/1381563
ttcgtaaaaattta

SEQ ID NO: 166410 - DNA, 14 bp, Unknown
  misc_feature (1)..( 14): Result.004 file - promoters50/1381563
tttttaaagttcca

SEQ ID NO: 166411 - DNA, 14 bp, Unknown
  misc_feature (1)..( 14): Result.004 file - promoters50/1381563
atacgaaagattgt

SEQ ID NO: 166412 - DNA, 14 bp, Unknown
  misc_feature (1)..( 14): Result.004 file - promoters50/1381563
tcgctaaaagttta

SEQ ID NO: 166413 - DNA, 14 bp, Unknown
  misc_feature (1)..( 14): Result.004 file - promoters50/1381563
gatgtaaaaggtct

SEQ ID NO: 166414 - DNA, 9 bp, Unknown
  misc_feature (1)..( 9): Result.004 file - promoters50/1381563
caaacatta

SEQ ID NO: 166415 - DNA, 9 bp, Unknown
  misc_feature (1)..( 9): Result.004 file - promoters50/1381563
caaacttta

SEQ ID NO: 166416 - DNA, 9 bp, Unknown
  misc_feature (1)..( 9): Result.004 file - promoters50/1381563
taaaaattg

SEQ ID NO: 166417 - DNA, 9 bp, Unknown
  misc_feature (1)..( 9): Result.004 file - promoters50/1381563
taataatcc

SEQ ID NO: 166418 - DNA, 9 bp, Unknown
  misc_feature (1)..( 9): Result.004 file - promoters50/1381563
taaagtttt

SEQ ID NO: 166419 - DNA, 9 bp, Unknown
  misc_feature (1)..( 9): Result.004 file - promoters50/1381579
ctaactttg

SEQ ID NO: 166420 - DNA, 13 bp, Unknown
  misc_feature (1)..( 13): Result.004 file - promoters50/1381579
aagaaactgagaa

SEQ ID NO: 166421 - DNA, 13 bp, Unknown
  misc_feature (1)..( 13): Result.004 file - promoters50/1381579
atgccacttagag

SEQ ID NO: 166422 - DNA, 13 bp, Unknown
  misc_feature (1)..( 13): Result.004 file - promoters50/1381579
atgccaattaact

SEQ ID NO: 166423 - DNA, 13 bp, Unknown
  misc_feature (1)..( 13): Result.004 file - promoters50/1381579
tagcccattataa

SEQ ID NO: 166424 - DNA, 13 bp, Unknown
  misc_feature (1)..( 13): Result.004 file - promoters50/1381579
aataacattgtaa

SEQ ID NO: 166425 - DNA, 8 bp, Unknown
  misc_feature (1)..( 8): Result.004 file - promoters50/1381579
gtttctat

SEQ ID NO: 166426 - DNA, 8 bp, Unknown
  misc_feature (1)..( 8): Result.004 file - promoters50/1381579
tcttctat

SEQ ID NO: 166427 - DNA, 8 bp, Unknown
  misc_feature (1)..( 8): Result.004 file - promoters50/1381579
atttatat

SEQ ID NO: 166428 - DNA, 8 bp, Unknown
  misc_feature (1)..( 8): Result.004 file - promoters50/1381579
ttttctac

SEQ ID NO: 166429 - DNA, 8 bp, Unknown
  misc_feature (1)..( 8): Result.004 file - promoters50/1381647
ttttctcg

SEQ ID NO: 166430 - DNA, 12 bp, Unknown
  misc_feature (1)..( 12): Result.004 file - promoters50/1381647
aaaagtctgaat

SEQ ID NO: 166431 - DNA, 12 bp, Unknown
  misc_feature (1)..( 12): Result.004 file - promoters50/1381647
ataagtttgata

SEQ ID NO: 166432 - DNA, 12 bp, Unknown
  misc_feature (1)..( 12): Result.004 file - promoters50/1381647
ctttctcttaat

SEQ ID NO: 166433 - DNA, 12 bp, Unknown
  misc_feature (1)..( 12): Result.004 file - promoters50/1381704
atatgttgaacc

SEQ ID NO: 166434 - DNA, 13 bp, Unknown
  misc_feature (1)..( 13): Result.004 file - promoters50/1381704
agtaataaaataa

SEQ ID NO: 166435 - DNA, 13 bp, Unknown
  misc_feature (1)..( 13): Result.004 file - promoters50/1381704
aataaaaaaacta

SEQ ID NO: 166436 - DNA, 13 bp, Unknown
  misc_feature (1)..( 13): Result.004 file - promoters50/1381704
agttatatgaaaa

SEQ ID NO: 166437 - DNA, 13 bp, Unknown
  misc_feature (1)..( 13): Result.004 file - promoters50/1381704
cgttataatggtc

SEQ ID NO: 166438 - DNA, 13 bp, Unknown
  misc_feature (1)..( 13): Result.004 file - promoters50/1381704
atcaaaaaccaac

SEQ ID NO: 166439 - DNA, 13 bp, Unknown
  misc_feature (1)..( 13): Result.004 file - promoters50/1381704
tgacaaaactaac

SEQ ID NO: 166440 - DNA, 9 bp, Unknown
  misc_feature (1)..( 9): Result.004 file - promoters50/1381704
ataaaataa

SEQ ID NO: 166441 - DNA, 9 bp, Unknown
  misc_feature (1)..( 9): Result.004 file - promoters50/1381704
caaaactaa

SEQ ID NO: 166442 - DNA, 9 bp, Unknown
  misc_feature (1)..( 9): Result.004 file - promoters50/1381704
gtaaaataa

SEQ ID NO: 166443 - DNA, 9 bp, Unknown
  misc_feature (1)..( 9): Result.004 file - promoters50/1381704
agaaacaaa

SEQ ID NO: 166444 - DNA, 9 bp, Unknown
  misc_feature (1)..( 9): Result.004 file - promoters50/1381704
aaaaactaa

SEQ ID NO: 166445 - DNA, 9 bp, Unknown
  misc_feature (1)..( 9): Result.004 file - promoters50/1381818
aaaaaccaa

SEQ ID NO: 166446 - DNA, 13 bp, Unknown
  misc_feature (1)..( 13): Result.004 file - promoters50/1381818
acaattaacttat

SEQ ID NO: 166447 - DNA, 13 bp, Unknown
  misc_feature (1)..( 13): Result.004 file - promoters50/1381818
gtaatgaaccagt

SEQ ID NO: 166448 - DNA, 13 bp, Unknown
  misc_feature (1)..( 13): Result.004 file - promoters50/1381818
aaagttaactttg

SEQ ID NO: 166449 - DNA, 13 bp, Unknown
  misc_feature (1)..( 13): Result.004 file - promoters50/1381818
tatattaactttg

SEQ ID NO: 166450 - DNA, 13 bp, Unknown
  misc_feature (1)..( 13): Result.004 file - promoters50/1381818
aatattaaccttg

SEQ ID NO: 166451 - DNA, 13 bp, Unknown
  misc_feature (1)..( 13): Result.004 file - promoters50/1381818
caaataaacatat

SEQ ID NO: 166452 - DNA, 13 bp, Unknown
  misc_feature (1)..( 13): Result.004 file - promoters50/1381818
acaaaaaaagcta

SEQ ID NO: 166453 - DNA, 14 bp, Unknown
  misc_feature (1)..( 14): Result.004 file - promoters50/1381818
tataagaaaatata

SEQ ID NO: 166454 - DNA, 14 bp, Unknown
  misc_feature (1)..( 14): Result.004 file - promoters50/1381818
tttaaaaaaagaag

SEQ ID NO: 166455 - DNA, 14 bp, Unknown
  misc_feature (1)..( 14): Result.004 file - promoters50/1381818
tatgagaaatcata

SEQ ID NO: 166456 - DNA, 14 bp, Unknown
  misc_feature (1)..( 14): Result.004 file - promoters50/1381818
ctatccaaaatgaa

SEQ ID NO: 166457 - DNA, 14 bp, Unknown
  misc_feature (1)..( 14): Result.004 file - promoters50/1381818
tataaataaatttt

SEQ ID NO: 166458 - DNA, 14 bp, Unknown
  misc_feature (1)..( 14): Result.004 file - promoters50/1381818
actaattaatggat

SEQ ID NO: 166459 - DNA, 9 bp, Unknown
  misc_feature (1)..( 9): Result.004 file - promoters50/1381818
aaaataaac

SEQ ID NO: 166460 - DNA, 9 bp, Unknown
  misc_feature (1)..( 9): Result.004 file - promoters50/1381818
taaataaat

SEQ ID NO: 166461 - DNA, 9 bp, Unknown
  misc_feature (1)..( 9): Result.004 file - promoters50/1381818
taaaaaaaa

SEQ ID NO: 166462 - DNA, 9 bp, Unknown
  misc_feature (1)..( 9): Result.004 file - promoters50/1381818
aaaacaaac

SEQ ID NO: 166463 - DNA, 9 bp, Unknown
  misc_feature (1)..( 9): Result.004 file - promoters50/1381818
acaacaaag

SEQ ID NO: 166464 - DNA, 9 bp, Unknown
  misc_feature (1)..( 9): Result.004 file - promoters50/1381818
taaaaaaag

SEQ ID NO: 166465 - DNA, 8 bp, Unknown
  misc_feature (1)..( 8): Result.004 file - promoters50/1381818
aaaaacaa

SEQ ID NO: 166466 - DNA, 8 bp, Unknown
  misc_feature (1)..( 8): Result.004 file - promoters50/1381818
caaaacat

SEQ ID NO: 166467 - DNA, 8 bp, Unknown
  misc_feature (1)..( 8): Result.004 file - promoters50/1381818
taaaaaaa

SEQ ID NO: 166468 - DNA, 8 bp, Unknown
  misc_feature (1)..( 8): Result.004 file - promoters50/1381818
taaataaa

SEQ ID NO: 166469 - DNA, 8 bp, Unknown
  misc_feature (1)..( 8): Result.004 file - promoters50/1381818
gaaatcat

SEQ ID NO: 166470 - DNA, 8 bp, Unknown
  misc_feature (1)..( 8): Result.004 file - promoters50/1381818
taattaat

SEQ ID NO: 166471 - DNA, 12 bp, Unknown
  misc_feature (1)..( 12): Result.004 file - promoters50/1381818
catattattagt

SEQ ID NO: 166472 - DNA, 12 bp, Unknown
  misc_feature (1)..( 12): Result.004 file - promoters50/1381818
gatataattatt

SEQ ID NO: 166473 - DNA, 12 bp, Unknown
  misc_feature (1)..( 12): Result.004 file - promoters50/1381818
aatattattagc

SEQ ID NO: 166474 - DNA, 12 bp, Unknown
  misc_feature (1)..( 12): Result.004 file - promoters50/1381818
catcttaatatg

SEQ ID NO: 166475 - DNA, 12 bp, Unknown
  misc_feature (1)..( 12): Result.004 file - promoters50/1381818
ttaatgattttg

SEQ ID NO: 166476 - DNA, 12 bp, Unknown
  misc_feature (1)..( 12): Result.004 file - promoters50/1381896
cgaattctttaa

SEQ ID NO: 166477 - DNA, 12 bp, Unknown
  misc_feature (1)..( 12): Result.004 file - promoters50/1381896
aagaatatatat

SEQ ID NO: 166478 - DNA, 12 bp, Unknown
  misc_feature (1)..( 12): Result.004 file - promoters50/1381896
taagatatttat

SEQ ID NO: 166479 - DNA, 12 bp, Unknown
  misc_feature (1)..( 12): Result.004 file - promoters50/1381896
gaagatacgatc

SEQ ID NO: 166480 - DNA, 12 bp, Unknown
  misc_feature (1)..( 12): Result.004 file - promoters50/1381903
ggagacattcgc

SEQ ID NO: 166481 - DNA, 8 bp, Unknown
  misc_feature (1)..( 8): Result.004 file - promoters50/1381903
catagatt

SEQ ID NO: 166482 - DNA, 8 bp, Unknown
  misc_feature (1)..( 8): Result.004 file - promoters50/1381903
aatagatc

SEQ ID NO: 166483 - DNA, 8 bp, Unknown
  misc_feature (1)..( 8): Result.004 file - promoters50/1381903
catcgatt

SEQ ID NO: 166484 - DNA, 8 bp, Unknown
  misc_feature (1)..( 8): Result.004 file - promoters50/1381903
gatccatt

SEQ ID NO: 166485 - DNA, 12 bp, Unknown
  misc_feature (1)..( 12): Result.004 file - promoters50/1381903
aacttaatagtt

SEQ ID NO: 166486 - DNA, 12 bp, Unknown
  misc_feature (1)..( 12): Result.004 file - promoters50/1381903
aactcaattgtt

SEQ ID NO: 166487 - DNA, 12 bp, Unknown
  misc_feature (1)..( 12): Result.004 file - promoters50/1381903
acccaaatggtt

SEQ ID NO: 166488 - DNA, 7 bp, Unknown
  misc_feature (1)..( 7): Result.004 file - promoters50/1381903
ctaaatt

SEQ ID NO: 166489 - DNA, 7 bp, Unknown
  misc_feature (1)..( 7): Result.004 file - promoters50/1381903
ctaaata

SEQ ID NO: 166490 - DNA, 7 bp, Unknown
  misc_feature (1)..( 7): Result.004 file - promoters50/1381903
ttaaatt

SEQ ID NO: 166491 - DNA, 8 bp, Unknown
  misc_feature (1)..( 8): Result.004 file - promoters50/1381903
ttttattt

SEQ ID NO: 166492 - DNA, 8 bp, Unknown
  misc_feature (1)..( 8): Result.004 file - promoters50/1381903
tttgattt

SEQ ID NO: 166493 - DNA, 8 bp, Unknown
  misc_feature (1)..( 8): Result.004 file - promoters50/1381903
cttgattt

SEQ ID NO: 166494 - DNA, 8 bp, Unknown
  misc_feature (1)..( 8): Result.004 file - promoters50/1381903
atgaaact

SEQ ID NO: 166495 - DNA, 8 bp, Unknown
  misc_feature (1)..( 8): Result.004 file - promoters50/1381903
atgaaata

SEQ ID NO: 166496 - DNA, 8 bp, Unknown
  misc_feature (1)..( 8): Result.004 file - promoters50/1381911
ctgatata

SEQ ID NO: 166497 - DNA, 8 bp, Unknown
  misc_feature (1)..( 8): Result.004 file - promoters50/1381911
taatattg

SEQ ID NO: 166498 - DNA, 8 bp, Unknown
  misc_feature (1)..( 8): Result.004 file - promoters50/1381911
caattttg

SEQ ID NO: 166499 - DNA, 8 bp, Unknown
  misc_feature (1)..( 8): Result.004 file - promoters50/1381911
taacattt

SEQ ID NO: 166500 - DNA, 8 bp, Unknown
  misc_feature (1)..( 8): Result.004 file - promoters50/1381911
aaaagaaa

SEQ ID NO: 166501 - DNA, 8 bp, Unknown
  misc_feature (1)..( 8): Result.004 file - promoters50/1381911
aaatgaaa

SEQ ID NO: 166502 - DNA, 8 bp, Unknown
  misc_feature (1)..( 8): Result.004 file - promoters50/1381911
aaatgaga

SEQ ID NO: 166503 - DNA, 8 bp, Unknown
  misc_feature (1)..( 8): Result.004 file - promoters50/1381911
ttataact

SEQ ID NO: 166504 - DNA, 8 bp, Unknown
  misc_feature (1)..( 8): Result.004 file - promoters50/1381911
ttattact

SEQ ID NO: 166505 - DNA, 8 bp, Unknown
  misc_feature (1)..( 8): Result.004 file - promoters50/1381911
ttattaag

SEQ ID NO: 166506 - DNA, 8 bp, Unknown
  misc_feature (1)..( 8): Result.004 file - promoters50/1381911
catattga

SEQ ID NO: 166507 - DNA, 8 bp, Unknown
  misc_feature (1)..( 8): Result.004 file - promoters50/1381911
catattaa

SEQ ID NO: 166508 - DNA, 8 bp, Unknown
  misc_feature (1)..( 8): Result.004 file - promoters50/1381915
gataataa

SEQ ID NO: 166509 - DNA, 8 bp, Unknown
  misc_feature (1)..( 8): Result.004 file - promoters50/1381915
ccactaag

SEQ ID NO: 166510 - DNA, 8 bp, Unknown
  misc_feature (1)..( 8): Result.004 file - promoters50/1381915
ccacaaag

SEQ ID NO: 166511 - DNA, 8 bp, Unknown
  misc_feature (1)..( 8): Result.004 file - promoters50/1381915
tcactaaa

SEQ ID NO: 166512 - DNA, 8 bp, Unknown
  misc_feature (1)..( 8): Result.004 file - promoters50/1381915
tccaattg

SEQ ID NO: 166513 - DNA, 8 bp, Unknown
  misc_feature (1)..( 8): Result.004 file - promoters50/1381915
tcctattt

SEQ ID NO: 166514 - DNA, 8 bp, Unknown
  misc_feature (1)..( 8): Result.004 file - promoters50/1381926
cgctattt

SEQ ID NO: 166515 - DNA, 13 bp, Unknown
  misc_feature (1)..( 13): Result.004 file - promoters50/1381926
attgtgttttacg

SEQ ID NO: 166516 - DNA, 13 bp, Unknown
  misc_feature (1)..( 13): Result.004 file - promoters50/1381926
aatgtgatttacg

SEQ ID NO: 166517 - DNA, 13 bp, Unknown
  misc_feature (1)..( 13): Result.004 file - promoters50/1381926
aatatgaatttgc

SEQ ID NO: 166518 - DNA, 13 bp, Unknown
  misc_feature (1)..( 13): Result.004 file - promoters50/1381926
ttaatgatttcat

SEQ ID NO: 166519 - DNA, 13 bp, Unknown
  misc_feature (1)..( 13): Result.004 file - promoters50/1381926
cgaattattgacg

SEQ ID NO: 166520 - DNA, 13 bp, Unknown
  misc_feature (1)..( 13): Result.004 file - promoters50/1382033
ttattgatttcac

SEQ ID NO: 166521 - DNA, 9 bp, Unknown
  misc_feature (1)..( 9): Result.004 file - promoters50/1382033
tttgttttt

SEQ ID NO: 166522 - DNA, 9 bp, Unknown
  misc_feature (1)..( 9): Result.004 file - promoters50/1382033
cttgctttt

SEQ ID NO: 166523 - DNA, 9 bp, Unknown
  misc_feature (1)..( 9): Result.004 file - promoters50/1382033
tttgttttc

SEQ ID NO: 166524 - DNA, 9 bp, Unknown
  misc_feature (1)..( 9): Result.004 file - promoters50/1382033
caaattgaa

SEQ ID NO: 166525 - DNA, 9 bp, Unknown
  misc_feature (1)..( 9): Result.004 file - promoters50/1382033
caaattgga

SEQ ID NO: 166526 - DNA, 9 bp, Unknown
  misc_feature (1)..( 9): Result.004 file - promoters50/1382084
ataatcgga

SEQ ID NO: 166527 - DNA, 11 bp, Unknown
  misc_feature (1)..( 11): Result.004 file - promoters50/1382084
tggtcaactat

SEQ ID NO: 166528 - DNA, 11 bp, Unknown
  misc_feature (1)..( 11): Result.004 file - promoters50/1382084
tttgcaattat

SEQ ID NO: 166529 - DNA, 11 bp, Unknown
  misc_feature (1)..( 11): Result.004 file - promoters50/1382084
tttgaaattgc

SEQ ID NO: 166530 - DNA, 8 bp, Unknown
  misc_feature (1)..( 8): Result.004 file - promoters50/1382084
atttgatg

SEQ ID NO: 166531 - DNA, 8 bp, Unknown
  misc_feature (1)..( 8): Result.004 file - promoters50/1382084
atttaatg

SEQ ID NO: 166532 - DNA, 8 bp, Unknown
  misc_feature (1)..( 8): Result.004 file - promoters50/1382119
atttaaac

SEQ ID NO: 166533 - DNA, 12 bp, Unknown
  misc_feature (1)..( 12): Result.004 file - promoters50/1382119
cgacaatgaaac

SEQ ID NO: 166534 - DNA, 12 bp, Unknown
  misc_feature (1)..( 12): Result.004 file - promoters50/1382119
tataaattaaat

SEQ ID NO: 166535 - DNA, 12 bp, Unknown
  misc_feature (1)..( 12): Result.004 file - promoters50/1382119
cacgtattaaat

SEQ ID NO: 166536 - DNA, 12 bp, Unknown
  misc_feature (1)..( 12): Result.004 file - promoters50/1382119
tttccattaaag

SEQ ID NO: 166537 - DNA, 12 bp, Unknown
  misc_feature (1)..( 12): Result.004 file - promoters50/1382119
tatgaattatga

SEQ ID NO: 166538 - DNA, 12 bp, Unknown
  misc_feature (1)..( 12): Result.004 file - promoters50/1382119
ttcaaatttaag

SEQ ID NO: 166539 - DNA, 17 bp, Unknown
  misc_feature (1)..( 17): Result.004 file - promoters50/1382119
accaaaataaataaatt

SEQ ID NO: 166540 - DNA, 17 bp, Unknown
  misc_feature (1)..( 17): Result.004 file - promoters50/1382119
gaaaatataaataaaaa

SEQ ID NO: 166541 - DNA, 17 bp, Unknown
  misc_feature (1)..( 17): Result.004 file - promoters50/1382119
aattttataaagaaccc

SEQ ID NO: 166542 - DNA, 17 bp, Unknown
  misc_feature (1)..( 17): Result.004 file - promoters50/1382119
atttttttaatcaaaag

SEQ ID NO: 166543 - DNA, 17 bp, Unknown
  misc_feature (1)..( 17): Result.004 file - promoters50/1382119
aattttataaaaggagc

SEQ ID NO: 166544 - DNA, 17 bp, Unknown
  misc_feature (1)..( 17): Result.004 file - promoters50/1382119
cacaacaaaaatacaaa

SEQ ID NO: 166545 - DNA, 17 bp, Unknown
  misc_feature (1)..( 17): Result.004 file - promoters50/1382119
aggtagagaaataccga

SEQ ID NO: 166546 - DNA, 13 bp, Unknown
  misc_feature (1)..( 13): Result.004 file - promoters50/1382119
aaattaaatgcta

SEQ ID NO: 166547 - DNA, 13 bp, Unknown
  misc_feature (1)..( 13): Result.004 file - promoters50/1382119
taatcaaaagtgt

SEQ ID NO: 166548 - DNA, 13 bp, Unknown
  misc_feature (1)..( 13): Result.004 file - promoters50/1382119
aaataaaaaaaga

SEQ ID NO: 166549 - DNA, 13 bp, Unknown
  misc_feature (1)..( 13): Result.004 file - promoters50/1382119
caaaaaacccaat

SEQ ID NO: 166550 - DNA, 13 bp, Unknown
  misc_feature (1)..( 13): Result.004 file - promoters50/1382119
caaaaatacaaat

SEQ ID NO: 166551 - DNA, 13 bp, Unknown
  misc_feature (1)..( 13): Result.004 file - promoters50/1382128
gaaataccgaatt

SEQ ID NO: 166552 - DNA, 7 bp, Unknown
  misc_feature (1)..( 7): Result.004 file - promoters50/1382128
aaaaaaa

SEQ ID NO: 166553 - DNA, 7 bp, Unknown
  misc_feature (1)..( 7): Result.004 file - promoters50/1382128
aaaaaat

SEQ ID NO: 166554 - DNA, 7 bp, Unknown
  misc_feature (1)..( 7): Result.004 file - promoters50/1382134
aaataat

SEQ ID NO: 166555 - DNA, 15 bp, Unknown
  misc_feature (1)..( 15): Result.004 file - promoters50/1382134
tacagtgaaattgaa

SEQ ID NO: 166556 - DNA, 15 bp, Unknown
  misc_feature (1)..( 15): Result.004 file - promoters50/1382134
aattatgatatttaa

SEQ ID NO: 166557 - DNA, 15 bp, Unknown
  misc_feature (1)..( 15): Result.004 file - promoters50/1382134
aattttgatttttaa

SEQ ID NO: 166558 - DNA, 12 bp, Unknown
  misc_feature (1)..( 12): Result.004 file - promoters50/1382134
gctaaacattag

SEQ ID NO: 166559 - DNA, 12 bp, Unknown
  misc_feature (1)..( 12): Result.004 file - promoters50/1382134
aataaacatagt

SEQ ID NO: 166560 - DNA, 12 bp, Unknown
  misc_feature (1)..( 12): Result.004 file - promoters50/1382134
aattaactctaa

SEQ ID NO: 166561 - DNA, 12 bp, Unknown
  misc_feature (1)..( 12): Result.004 file - promoters50/1382134
acttaactgtaa

SEQ ID NO: 166562 - DNA, 10 bp, Unknown
  misc_feature (1)..( 10): Result.004 file - promoters50/1382134
aaatatatgg

SEQ ID NO: 166563 - DNA, 10 bp, Unknown
  misc_feature (1)..( 10): Result.004 file - promoters50/1382134
taatatattt

SEQ ID NO: 166564 - DNA, 11 bp, Unknown
  misc_feature (1)..( 11): Result.004 file - promoters50/1382134
taatattataa

SEQ ID NO: 166565 - DNA, 11 bp, Unknown
  misc_feature (1)..( 11): Result.004 file - promoters50/1382134
gcatattttaa

SEQ ID NO: 166566 - DNA, 12 bp, Unknown
  misc_feature (1)..( 12): Result.004 file - promoters50/1382134
taacactttttc

SEQ ID NO: 166567 - DNA, 12 bp, Unknown
  misc_feature (1)..( 12): Result.004 file - promoters50/1382134
cgacaattttta

SEQ ID NO: 166568 - DNA, 12 bp, Unknown
  misc_feature (1)..( 12): Result.004 file - promoters50/1382134
taaaactaccat

SEQ ID NO: 166569 - DNA, 12 bp, Unknown
  misc_feature (1)..( 12): Result.004 file - promoters50/1382134
tgttggttttta

SEQ ID NO: 166570 - DNA, 8 bp, Unknown
  misc_feature (1)..( 8): Result.004 file - promoters50/1382134
taatttaa

SEQ ID NO: 166571 - DNA, 8 bp, Unknown
  misc_feature (1)..( 8): Result.004 file - promoters50/1382134
aaatttaa

SEQ ID NO: 166572 - DNA, 8 bp, Unknown
  misc_feature (1)..( 8): Result.004 file - promoters50/1382134
aaaattat

SEQ ID NO: 166573 - DNA, 12 bp, Unknown
  misc_feature (1)..( 12): Result.004 file - promoters50/1382134
ttttaatatttt

SEQ ID NO: 166574 - DNA, 12 bp, Unknown
  misc_feature (1)..( 12): Result.004 file - promoters50/1382134
gttttatatttt

SEQ ID NO: 166575 - DNA, 12 bp, Unknown
  misc_feature (1)..( 12): Result.004 file - promoters50/1382202
tttttataatta

SEQ ID NO: 166576 - DNA, 12 bp, Unknown
  misc_feature (1)..( 12): Result.004 file - promoters50/1382202
cagatcaaacta

SEQ ID NO: 166577 - DNA, 12 bp, Unknown
  misc_feature (1)..( 12): Result.004 file - promoters50/1382202
cagaacaaactg

SEQ ID NO: 166578 - DNA, 12 bp, Unknown
  misc_feature (1)..( 12): Result.004 file - promoters50/1382202
tagctccaagaa

SEQ ID NO: 166579 - DNA, 12 bp, Unknown
  misc_feature (1)..( 12): Result.004 file - promoters50/1382202
tgaaagaaagaa

SEQ ID NO: 166580 - DNA, 8 bp, Unknown
  misc_feature (1)..( 8): Result.004 file - promoters50/1382202
ggaaagct

SEQ ID NO: 166581 - DNA, 8 bp, Unknown
  misc_feature (1)..( 8): Result.004 file - promoters50/1382202
tgaaagca

SEQ ID NO: 166582 - DNA, 8 bp, Unknown
  misc_feature (1)..( 8): Result.004 file - promoters50/1382202
tgatagca

SEQ ID NO: 166583 - DNA, 9 bp, Unknown
  misc_feature (1)..( 9): Result.004 file - promoters50/1382202
ccatttctt

SEQ ID NO: 166584 - DNA, 9 bp, Unknown
  misc_feature (1)..( 9): Result.004 file - promoters50/1382202
caattactt

SEQ ID NO: 166585 - DNA, 9 bp, Unknown
  misc_feature (1)..( 9): Result.004 file - promoters50/1382202
caatcactt

SEQ ID NO: 166586 - DNA, 9 bp, Unknown
  misc_feature (1)..( 9): Result.004 file - promoters50/1382202
gaagatatg

SEQ ID NO: 166587 - DNA, 9 bp, Unknown
  misc_feature (1)..( 9): Result.004 file - promoters50/1382202
gaagatgag

SEQ ID NO: 166588 - DNA, 9 bp, Unknown
  misc_feature (1)..( 9): Result.004 file - promoters50/1382215
gaaaatatg

SEQ ID NO: 166589 - DNA, 9 bp, Unknown
  misc_feature (1)..( 9): Result.004 file - promoters50/1382215
cttttttaa

SEQ ID NO: 166590 - DNA, 9 bp, Unknown
  misc_feature (1)..( 9): Result.004 file - promoters50/1382215
aatttttat

SEQ ID NO: 166591 - DNA, 10 bp, Unknown
  misc_feature (1)..( 10): Result.004 file - promoters50/1382215
acttgtttcc

SEQ ID NO: 166592 - DNA, 10 bp, Unknown
  misc_feature (1)..( 10): Result.004 file - promoters50/1382215
acatgtatcc

SEQ ID NO: 166593 - DNA, 7 bp, Unknown
  misc_feature (1)..( 7): Result.004 file - promoters50/1382215
aaagaaa

SEQ ID NO: 166594 - DNA, 7 bp, Unknown
  misc_feature (1)..( 7): Result.004 file - promoters50/1382215
aaataaa

SEQ ID NO: 166595 - DNA, 8 bp, Unknown
  misc_feature (1)..( 8): Result.004 file - promoters50/1382281
gaatcaaa

SEQ ID NO: 166596 - DNA, 9 bp, Unknown
  misc_feature (1)..( 9): Result.004 file - promoters50/1382281
caaataaat

SEQ ID NO: 166597 - DNA, 9 bp, Unknown
  misc_feature (1)..( 9): Result.004 file - promoters50/1382281
taaatgaat

SEQ ID NO: 166598 - DNA, 9 bp, Unknown
  misc_feature (1)..( 9): Result.004 file - promoters50/1382281
taaatgtta

SEQ ID NO: 166599 - DNA, 12 bp, Unknown
  misc_feature (1)..( 12): Result.004 file - promoters50/1382281
tatatttaaaat

SEQ ID NO: 166600 - DNA, 12 bp, Unknown
  misc_feature (1)..( 12): Result.004 file - promoters50/1382281
agagtttcaaat

SEQ ID NO: 166601 - DNA, 12 bp, Unknown
  misc_feature (1)..( 12): Result.004 file - promoters50/1382281
tatttttgaaat

SEQ ID NO: 166602 - DNA, 12 bp, Unknown
  misc_feature (1)..( 12): Result.004 file - promoters50/1382281
tgtgtttcaaaa

SEQ ID NO: 166603 - DNA, 9 bp, Unknown
  misc_feature (1)..( 9): Result.004 file - promoters50/1382281
aaaataaat

SEQ ID NO: 166604 - DNA, 9 bp, Unknown
  misc_feature (1)..( 9): Result.004 file - promoters50/1382281
aaaataaat

SEQ ID NO: 166605 - DNA, 9 bp, Unknown
  misc_feature (1)..( 9): Result.004 file - promoters50/1382281
aaaagatat

SEQ ID NO: 166606 - DNA, 6 bp, Unknown
  misc_feature (1)..( 6): Result.004 file - promoters50/1382281
taaatg

SEQ ID NO: 166607 - DNA, 6 bp, Unknown
  misc_feature (1)..( 6): Result.004 file - promoters50/1382281
taaatg

SEQ ID NO: 166608 - DNA, 6 bp, Unknown
  misc_feature (1)..( 6): Result.004 file - promoters50/1382281
taaatg

SEQ ID NO: 166609 - DNA, 11 bp, Unknown
  misc_feature (1)..( 11): Result.004 file - promoters50/1382281
ttttcgaaaaa

SEQ ID NO: 166610 - DNA, 11 bp, Unknown
  misc_feature (1)..( 11): Result.004 file - promoters50/1382281
ctttcgacatt

SEQ ID NO: 166611 - DNA, 11 bp, Unknown
  misc_feature (1)..( 11): Result.004 file - promoters50/1382302
ttttcgaaaaa

SEQ ID NO: 166612 - DNA, 9 bp, Unknown
  misc_feature (1)..( 9): Result.004 file - promoters50/1382302
taataaagt

SEQ ID NO: 166613 - DNA, 9 bp, Unknown
  misc_feature (1)..( 9): Result.004 file - promoters50/1382302
taatacagt

SEQ ID NO: 166614 - DNA, 9 bp, Unknown
  misc_feature (1)..( 9): Result.004 file - promoters50/1382302
caataaata

SEQ ID NO: 166615 - DNA, 9 bp, Unknown
  misc_feature (1)..( 9): Result.004 file - promoters50/1382302
ttatagagt

SEQ ID NO: 166616 - DNA, 9 bp, Unknown
  misc_feature (1)..( 9): Result.004 file - promoters50/1382302
taaaacaaa

SEQ ID NO: 166617 - DNA, 9 bp, Unknown
  misc_feature (1)..( 9): Result.004 file - promoters50/1382302
caaaaaaat

SEQ ID NO: 166618 - DNA, 12 bp, Unknown
  misc_feature (1)..( 12): Result.004 file - promoters50/1382302
caatacaatgaa

SEQ ID NO: 166619 - DNA, 12 bp, Unknown
  misc_feature (1)..( 12): Result.004 file - promoters50/1382302
atatataattta

SEQ ID NO: 166620 - DNA, 12 bp, Unknown
  misc_feature (1)..( 12): Result.004 file - promoters50/1382302
gtttacaataaa

SEQ ID NO: 166621 - DNA, 13 bp, Unknown
  misc_feature (1)..( 13): Result.004 file - promoters50/1382302
ttatagatatttt

SEQ ID NO: 166622 - DNA, 13 bp, Unknown
  misc_feature (1)..( 13): Result.004 file - promoters50/1382347
ttaaagagacaga

SEQ ID NO: 166623 - DNA, 8 bp, Unknown
  misc_feature (1)..( 8): Result.004 file - promoters50/1382347
tttggatt

SEQ ID NO: 166624 - DNA, 8 bp, Unknown
  misc_feature (1)..( 8): Result.004 file - promoters50/1382347
ttttgatt

SEQ ID NO: 166625 - DNA, 8 bp, Unknown
  misc_feature (1)..( 8): Result.004 file - promoters50/1382347
ctttcatt

SEQ ID NO: 166626 - DNA, 8 bp, Unknown
  misc_feature (1)..( 8): Result.004 file - promoters50/1382347
ctatcaaa

SEQ ID NO: 166627 - DNA, 8 bp, Unknown
  misc_feature (1)..( 8): Result.004 file - promoters50/1382347
atattaaa

SEQ ID NO: 166628 - DNA, 8 bp, Unknown
  misc_feature (1)..( 8): Result.004 file - promoters50/1382347
ctatcatt

SEQ ID NO: 166629 - DNA, 8 bp, Unknown
  misc_feature (1)..( 8): Result.004 file - promoters50/1382347
ttatcaaa

SEQ ID NO: 166630 - DNA, 9 bp, Unknown
  misc_feature (1)..( 9): Result.004 file - promoters50/1382347
tttgattgt

SEQ ID NO: 166631 - DNA, 9 bp, Unknown
  misc_feature (1)..( 9): Result.004 file - promoters50/1382347
aatgaatgt

SEQ ID NO: 166632 - DNA, 9 bp, Unknown
  misc_feature (1)..( 9): Result.004 file - promoters50/1382347
cttgattga

SEQ ID NO: 166633 - DNA, 9 bp, Unknown
  misc_feature (1)..( 9): Result.004 file - promoters50/1382347
ctttatttc

SEQ ID NO: 166634 - DNA, 9 bp, Unknown
  misc_feature (1)..( 9): Result.004 file - promoters50/1382347
tctatttat

SEQ ID NO: 166635 - DNA, 9 bp, Unknown
  misc_feature (1)..( 9): Result.004 file - promoters50/1382347
tctatatat

SEQ ID NO: 166636 - DNA, 9 bp, Unknown
  misc_feature (1)..( 9): Result.004 file - promoters50/1382347
gctatttaa

SEQ ID NO: 166637 - DNA, 9 bp, Unknown
  misc_feature (1)..( 9): Result.004 file - promoters50/1382347
tataaatat

SEQ ID NO: 166638 - DNA, 9 bp, Unknown
  misc_feature (1)..( 9): Result.004 file - promoters50/1382347
cttctcttt

SEQ ID NO: 166639 - DNA, 9 bp, Unknown
  misc_feature (1)..( 9): Result.004 file - promoters50/1382347
cttcttttt

SEQ ID NO: 166640 - DNA, 9 bp, Unknown
  misc_feature (1)..( 9): Result.004 file - promoters50/1382347
ttcctcttt

SEQ ID NO: 166641 - DNA, 7 bp, Unknown
  misc_feature (1)..( 7): Result.004 file - promoters50/1382347
taaattt

SEQ ID NO: 166642 - DNA, 7 bp, Unknown
  misc_feature (1)..( 7): Result.004 file - promoters50/1382347
taaatta

SEQ ID NO: 166643 - DNA, 7 bp, Unknown
  misc_feature (1)..( 7): Result.004 file - promoters50/1382347
caaattt

SEQ ID NO: 166644 - DNA, 7 bp, Unknown
  misc_feature (1)..( 7): Result.004 file - promoters50/1382347
aattttt

SEQ ID NO: 166645 - DNA, 7 bp, Unknown
  misc_feature (1)..( 7): Result.004 file - promoters50/1382347
tattttt

SEQ ID NO: 166646 - DNA, 7 bp, Unknown
  misc_feature (1)..( 7): Result.004 file - promoters50/1382347
tatcttt

SEQ ID NO: 166647 - DNA, 8 bp, Unknown
  misc_feature (1)..( 8): Result.004 file - promoters50/1382347
tgttttgt

SEQ ID NO: 166648 - DNA, 8 bp, Unknown
  misc_feature (1)..( 8): Result.004 file - promoters50/1382347
tgttttac

SEQ ID NO: 166649 - DNA, 8 bp, Unknown
  misc_feature (1)..( 8): Result.004 file - promoters50/1382347
tgttatgt

SEQ ID NO: 166650 - DNA, 10 bp, Unknown
  misc_feature (1)..( 10): Result.004 file - promoters50/1382347
aacaaaaacg

SEQ ID NO: 166651 - DNA, 10 bp, Unknown
  misc_feature (1)..( 10): Result.004 file - promoters50/1382347
agaaaaaacg

SEQ ID NO: 166652 - DNA, 10 bp, Unknown
  misc_feature (1)..( 10): Result.004 file - promoters50/1382347
aacaagaacc

SEQ ID NO: 166653 - DNA, 7 bp, Unknown
  misc_feature (1)..( 7): Result.004 file - promoters50/1382347
tatataa

SEQ ID NO: 166654 - DNA, 7 bp, Unknown
  misc_feature (1)..( 7): Result.004 file - promoters50/1382347
aatataa

SEQ ID NO: 166655 - DNA, 7 bp, Unknown
  misc_feature (1)..( 7): Result.004 file - promoters50/1382347
aatctaa

SEQ ID NO: 166656 - DNA, 8 bp, Unknown
  misc_feature (1)..( 8): Result.004 file - promoters50/1382347
taaccatt

SEQ ID NO: 166657 - DNA, 8 bp, Unknown
  misc_feature (1)..( 8): Result.004 file - promoters50/1382347
gaacaatt

SEQ ID NO: 166658 - DNA, 8 bp, Unknown
  misc_feature (1)..( 8): Result.004 file - promoters50/1382347
taaacata

SEQ ID NO: 166659 - DNA, 7 bp, Unknown
  misc_feature (1)..( 7): Result.004 file - promoters50/1382347
ttaacca

SEQ ID NO: 166660 - DNA, 7 bp, Unknown
  misc_feature (1)..( 7): Result.004 file - promoters50/1382347
ttaaccg

SEQ ID NO: 166661 - DNA, 7 bp, Unknown
  misc_feature (1)..( 7): Result.004 file - promoters50/1382505
taaacat

SEQ ID NO: 166662 - DNA, 8 bp, Unknown
  misc_feature (1)..( 8): Result.004 file - promoters50/1382505
atatatca

SEQ ID NO: 166663 - DNA, 8 bp, Unknown
  misc_feature (1)..( 8): Result.004 file - promoters50/1382505
atatatgt

SEQ ID NO: 166664 - DNA, 8 bp, Unknown
  misc_feature (1)..( 8): Result.004 file - promoters50/1382505
ttatatgt

SEQ ID NO: 166665 - DNA, 9 bp, Unknown
  misc_feature (1)..( 9): Result.004 file - promoters50/1382505
attttatct

SEQ ID NO: 166666 - DNA, 9 bp, Unknown
  misc_feature (1)..( 9): Result.004 file - promoters50/1382505
attttaaag

SEQ ID NO: 166667 - DNA, 9 bp, Unknown
  misc_feature (1)..( 9): Result.004 file - promoters50/1382505
ggtttaaaa

SEQ ID NO: 166668 - DNA, 7 bp, Unknown
  misc_feature (1)..( 7): Result.004 file - promoters50/1382505
cttattt

SEQ ID NO: 166669 - DNA, 7 bp, Unknown
  misc_feature (1)..( 7): Result.004 file - promoters50/1382505
attattt

SEQ ID NO: 166670 - DNA, 7 bp, Unknown
  misc_feature (1)..( 7): Result.004 file - promoters50/1382505
attgttt

SEQ ID NO: 166671 - DNA, 8 bp, Unknown
  misc_feature (1)..( 8): Result.004 file - promoters50/1382505
gaggaaat

SEQ ID NO: 166672 - DNA, 8 bp, Unknown
  misc_feature (1)..( 8): Result.004 file - promoters50/1382505
caggaaat

SEQ ID NO: 166673 - DNA, 8 bp, Unknown
  misc_feature (1)..( 8): Result.004 file - promoters50/1382505
cagtaaaa

SEQ ID NO: 166674 - DNA, 9 bp, Unknown
  misc_feature (1)..( 9): Result.004 file - promoters50/1382505
atgtttatt

SEQ ID NO: 166675 - DNA, 9 bp, Unknown
  misc_feature (1)..( 9): Result.004 file - promoters50/1382505
atgtttata

SEQ ID NO: 166676 - DNA, 9 bp, Unknown
  misc_feature (1)..( 9): Result.004 file - promoters50/1382505
taatttata

SEQ ID NO: 166677 - DNA, 8 bp, Unknown
  misc_feature (1)..( 8): Result.004 file - promoters50/1382505
ttagtttg

SEQ ID NO: 166678 - DNA, 8 bp, Unknown
  misc_feature (1)..( 8): Result.004 file - promoters50/1382505
ttaattta

SEQ ID NO: 166679 - DNA, 8 bp, Unknown
  misc_feature (1)..( 8): Result.004 file - promoters50/1382505
ttaagtta

SEQ ID NO: 166680 - DNA, 7 bp, Unknown
  misc_feature (1)..( 7): Result.004 file - promoters50/1382505
tttcatt

SEQ ID NO: 166681 - DNA, 7 bp, Unknown
  misc_feature (1)..( 7): Result.004 file - promoters50/1382505
tttcatg

SEQ ID NO: 166682 - DNA, 7 bp, Unknown
  misc_feature (1)..( 7): Result.004 file - promoters50/1382581
tttgatg

SEQ ID NO: 166683 - DNA, 8 bp, Unknown
  misc_feature (1)..( 8): Result.004 file - promoters50/1382581
aagtaaaa

SEQ ID NO: 166684 - DNA, 8 bp, Unknown
  misc_feature (1)..( 8): Result.004 file - promoters50/1382581
tggtaaaa

SEQ ID NO: 166685 - DNA, 8 bp, Unknown
  misc_feature (1)..( 8): Result.004 file - promoters50/1382581
aagtaaat

SEQ ID NO: 166686 - DNA, 8 bp, Unknown
  misc_feature (1)..( 8): Result.004 file - promoters50/1382581
aagcaaaa

SEQ ID NO: 166687 - DNA, 9 bp, Unknown
  misc_feature (1)..( 9): Result.004 file - promoters50/1382581
taataaaag

SEQ ID NO: 166688 - DNA, 9 bp, Unknown
  misc_feature (1)..( 9): Result.004 file - promoters50/1382581
taacaaaat

SEQ ID NO: 166689 - DNA, 9 bp, Unknown
  misc_feature (1)..( 9): Result.004 file - promoters50/1382581
tattaaaag

SEQ ID NO: 166690 - DNA, 9 bp, Unknown
  misc_feature (1)..( 9): Result.004 file - promoters50/1382581
aaaccaaac

SEQ ID NO: 166691 - DNA, 15 bp, Unknown
  misc_feature (1)..( 15): Result.004 file - promoters50/1382581
ttctgggtttggttt

SEQ ID NO: 166692 - DNA, 15 bp, Unknown
  misc_feature (1)..( 15): Result.004 file - promoters50/1382581
cgcttaatttgtttt

SEQ ID NO: 166693 - DNA, 15 bp, Unknown
  misc_feature (1)..( 15): Result.004 file - promoters50/1382581
taagaaatatgttaa

SEQ ID NO: 166694 - DNA, 15 bp, Unknown
  misc_feature (1)..( 15): Result.004 file - promoters50/1382581
taagaaatatgtttt

SEQ ID NO: 166695 - DNA, 20 bp, Unknown
  misc_feature (1)..( 20): Result.004 file - promoters50/1382581
catatattctatcaatataa

SEQ ID NO: 166696 - DNA, 20 bp, Unknown
  misc_feature (1)..( 20): Result.004 file - promoters50/1382581
catattttctatataaaccc

SEQ ID NO: 166697 - DNA, 20 bp, Unknown
  misc_feature (1)..( 20): Result.004 file - promoters50/1382581
gttctaatctatttaacccc

SEQ ID NO: 166698 - DNA, 20 bp, Unknown
  misc_feature (1)..( 20): Result.004 file - promoters50/1382581
tccactatatatataaaccc

SEQ ID NO: 166699 - DNA, 13 bp, Unknown
  misc_feature (1)..( 13): Result.004 file - promoters50/1382581
tcaatataaatat

SEQ ID NO: 166700 - DNA, 13 bp, Unknown
  misc_feature (1)..( 13): Result.004 file - promoters50/1382581
tctatataaaccc

SEQ ID NO: 166701 - DNA, 13 bp, Unknown
  misc_feature (1)..( 13): Result.004 file - promoters50/1382581
tatatataaaccc

SEQ ID NO: 166702 - DNA, 13 bp, Unknown
  misc_feature (1)..( 13): Result.004 file - promoters50/1382709
tctatttaacccc

SEQ ID NO: 166703 - DNA, 13 bp, Unknown
  misc_feature (1)..( 13): Result.004 file - promoters50/1382709
ataataatccatt

SEQ ID NO: 166704 - DNA, 13 bp, Unknown
  misc_feature (1)..( 13): Result.004 file - promoters50/1382709
aatacaatacatg

SEQ ID NO: 166705 - DNA, 13 bp, Unknown
  misc_feature (1)..( 13): Result.004 file - promoters50/1382709
aattcaataccga

SEQ ID NO: 166706 - DNA, 13 bp, Unknown
  misc_feature (1)..( 13): Result.004 file - promoters50/1382709
aaagtcttacatg

SEQ ID NO: 166707 - DNA, 7 bp, Unknown
  misc_feature (1)..( 7): Result.004 file - promoters50/1382709
cataaaa

SEQ ID NO: 166708 - DNA, 7 bp, Unknown
  misc_feature (1)..( 7): Result.004 file - promoters50/1382709
aataaaa

SEQ ID NO: 166709 - DNA, 7 bp, Unknown
  misc_feature (1)..( 7): Result.004 file - promoters50/1382709
cattaaa

SEQ ID NO: 166710 - DNA, 7 bp, Unknown
  misc_feature (1)..( 7): Result.004 file - promoters50/1382709
aatcaaa

SEQ ID NO: 166711 - DNA, 10 bp, Unknown
  misc_feature (1)..( 10): Result.004 file - promoters50/1382709
aaaacaataa

SEQ ID NO: 166712 - DNA, 10 bp, Unknown
  misc_feature (1)..( 10): Result.004 file - promoters50/1382709
aaaacagcca

SEQ ID NO: 166713 - DNA, 10 bp, Unknown
  misc_feature (1)..( 10): Result.004 file - promoters50/1382709
taaacattaa

SEQ ID NO: 166714 - DNA, 10 bp, Unknown
  misc_feature (1)..( 10): Result.004 file - promoters50/1382713
caaagaattg

SEQ ID NO: 166715 - DNA, 8 bp, Unknown
  misc_feature (1)..( 8): Result.004 file - promoters50/1382713
atgactta

SEQ ID NO: 166716 - DNA, 8 bp, Unknown
  misc_feature (1)..( 8): Result.004 file - promoters50/1382713
atgactac

SEQ ID NO: 166717 - DNA, 8 bp, Unknown
  misc_feature (1)..( 8): Result.004 file - promoters50/1382713
ttgattta

SEQ ID NO: 166718 - DNA, 7 bp, Unknown
  misc_feature (1)..( 7): Result.004 file - promoters50/1382713
attctgt

SEQ ID NO: 166719 - DNA, 7 bp, Unknown
  misc_feature (1)..( 7): Result.004 file - promoters50/1382713
attgtgt

SEQ ID NO: 166720 - DNA, 7 bp, Unknown
  misc_feature (1)..( 7): Result.004 file - promoters50/1382713
tttgtgt

SEQ ID NO: 166721 - DNA, 8 bp, Unknown
  misc_feature (1)..( 8): Result.004 file - promoters50/1382713
ggaataaa

SEQ ID NO: 166722 - DNA, 8 bp, Unknown
  misc_feature (1)..( 8): Result.004 file - promoters50/1382713
tgaagaaa

SEQ ID NO: 166723 - DNA, 8 bp, Unknown
  misc_feature (1)..( 8): Result.004 file - promoters50/1382713
tgaagaat

SEQ ID NO: 166724 - DNA, 8 bp, Unknown
  misc_feature (1)..( 8): Result.004 file - promoters50/1382713
cttattct

SEQ ID NO: 166725 - DNA, 8 bp, Unknown
  misc_feature (1)..( 8): Result.004 file - promoters50/1382713
attattct

SEQ ID NO: 166726 - DNA, 8 bp, Unknown
  misc_feature (1)..( 8): Result.004 file - promoters50/1382959
atttttca

SEQ ID NO: 166727 - DNA, 10 bp, Unknown
  misc_feature (1)..( 10): Result.004 file - promoters50/1382959
gctaataaat

SEQ ID NO: 166728 - DNA, 10 bp, Unknown
  misc_feature (1)..( 10): Result.004 file - promoters50/1382959
acaaataaac

SEQ ID NO: 166729 - DNA, 10 bp, Unknown
  misc_feature (1)..( 10): Result.004 file - promoters50/1382959
gtaaataaat

SEQ ID NO: 166730 - DNA, 10 bp, Unknown
  misc_feature (1)..( 10): Result.004 file - promoters50/1382959
acacataatg

SEQ ID NO: 166731 - DNA, 10 bp, Unknown
  misc_feature (1)..( 10): Result.004 file - promoters50/1382959
agaaagaaag

SEQ ID NO: 166732 - DNA, 10 bp, Unknown
  misc_feature (1)..( 10): Result.004 file - promoters50/1382959
gtaaataatt

SEQ ID NO: 166733 - DNA, 10 bp, Unknown
  misc_feature (1)..( 10): Result.004 file - promoters50/1382959
aaaaagaacg

SEQ ID NO: 166734 - DNA, 11 bp, Unknown
  misc_feature (1)..( 11): Result.004 file - promoters50/1382959
cttgtatgttg

SEQ ID NO: 166735 - DNA, 11 bp, Unknown
  misc_feature (1)..( 11): Result.004 file - promoters50/1382959
cgaatattttg

SEQ ID NO: 166736 - DNA, 11 bp, Unknown
  misc_feature (1)..( 11): Result.004 file - promoters50/1382959
gttatatttac

SEQ ID NO: 166737 - DNA, 11 bp, Unknown
  misc_feature (1)..( 11): Result.004 file - promoters50/1382959
tgcataattaa

SEQ ID NO: 166738 - DNA, 11 bp, Unknown
  misc_feature (1)..( 11): Result.004 file - promoters50/1382959
ttaatgtttac

SEQ ID NO: 166739 - DNA, 11 bp, Unknown
  misc_feature (1)..( 11): Result.004 file - promoters50/1382959
taaataatata

SEQ ID NO: 166740 - DNA, 10 bp, Unknown
  misc_feature (1)..( 10): Result.004 file - promoters50/1382959
aaagtatttt

SEQ ID NO: 166741 - DNA, 10 bp, Unknown
  misc_feature (1)..( 10): Result.004 file - promoters50/1382959
caactatttt

SEQ ID NO: 166742 - DNA, 11 bp, Unknown
  misc_feature (1)..( 11): Result.004 file - promoters50/1382959
aaattatcttt

SEQ ID NO: 166743 - DNA, 11 bp, Unknown
  misc_feature (1)..( 11): Result.004 file - promoters50/1382959
tttttatttta

SEQ ID NO: 166744 - DNA, 11 bp, Unknown
  misc_feature (1)..( 11): Result.004 file - promoters50/1382959
accatttcttt

SEQ ID NO: 166745 - DNA, 11 bp, Unknown
  misc_feature (1)..( 11): Result.004 file - promoters50/1383066
ccgctatttgt

SEQ ID NO: 166746 - DNA, 8 bp, Unknown
  misc_feature (1)..( 8): Result.004 file - promoters50/1383066
attccagg

SEQ ID NO: 166747 - DNA, 8 bp, Unknown
  misc_feature (1)..( 8): Result.004 file - promoters50/1383066
attacaga

SEQ ID NO: 166748 - DNA, 8 bp, Unknown
  misc_feature (1)..( 8): Result.004 file - promoters50/1383066
attaaaga

SEQ ID NO: 166749 - DNA, 7 bp, Unknown
  misc_feature (1)..( 7): Result.004 file - promoters50/1383066
aaacagc

SEQ ID NO: 166750 - DNA, 7 bp, Unknown
  misc_feature (1)..( 7): Result.004 file - promoters50/1383066
aaaaagc

SEQ ID NO: 166751 - DNA, 7 bp, Unknown
  misc_feature (1)..( 7): Result.004 file - promoters50/1383066
aaaaaat

SEQ ID NO: 166752 - DNA, 7 bp, Unknown
  misc_feature (1)..( 7): Result.004 file - promoters50/1383066
gaacaaa

SEQ ID NO: 166753 - DNA, 7 bp, Unknown
  misc_feature (1)..( 7): Result.004 file - promoters50/1383066
gaaaaaa

SEQ ID NO: 166754 - DNA, 7 bp, Unknown
  misc_feature (1)..( 7): Result.004 file - promoters50/1383074
caaaaaa

SEQ ID NO: 166755 - DNA, 10 bp, Unknown
  misc_feature (1)..( 10): Result.004 file - promoters50/1383074
aaatacaaag

SEQ ID NO: 166756 - DNA, 10 bp, Unknown
  misc_feature (1)..( 10): Result.004 file - promoters50/1383074
aaataaaaat

SEQ ID NO: 166757 - DNA, 10 bp, Unknown
  misc_feature (1)..( 10): Result.004 file - promoters50/1383074
atttacaaag

SEQ ID NO: 166758 - DNA, 10 bp, Unknown
  misc_feature (1)..( 10): Result.004 file - promoters50/1383074
aaataaaaaa

SEQ ID NO: 166759 - DNA, 12 bp, Unknown
  misc_feature (1)..( 12): Result.004 file - promoters50/1383074
atatatatatat

SEQ ID NO: 166760 - DNA, 12 bp, Unknown
  misc_feature (1)..( 12): Result.004 file - promoters50/1383074
atacatataaca

SEQ ID NO: 166761 - DNA, 12 bp, Unknown
  misc_feature (1)..( 12): Result.004 file - promoters50/1383074
tttcatttaatt

SEQ ID NO: 166762 - DNA, 12 bp, Unknown
  misc_feature (1)..( 12): Result.004 file - promoters50/1383074
ttgagtttgatt

SEQ ID NO: 166763 - DNA, 14 bp, Unknown
  misc_feature (1)..( 14): Result.004 file - promoters50/1383074
aaaaaatcaaaagt

SEQ ID NO: 166764 - DNA, 14 bp, Unknown
  misc_feature (1)..( 14): Result.004 file - promoters50/1383074
aaaaaaaaaaaaaa

SEQ ID NO: 166765 - DNA, 15 bp, Unknown
  misc_feature (1)..( 15): Result.004 file - promoters50/1383074
aaataaaatatgaaa

SEQ ID NO: 166766 - DNA, 15 bp, Unknown
  misc_feature (1)..( 15): Result.004 file - promoters50/1383074
aaacaaagaaacaaa

SEQ ID NO: 166767 - DNA, 11 bp, Unknown
  misc_feature (1)..( 11): Result.004 file - promoters50/1383074
gtttcgaatat

SEQ ID NO: 166768 - DNA, 11 bp, Unknown
  misc_feature (1)..( 11): Result.004 file - promoters50/1383074
ctttctaatct

SEQ ID NO: 166769 - DNA, 11 bp, Unknown
  misc_feature (1)..( 11): Result.004 file - promoters50/1383074
taatctattct

SEQ ID NO: 166770 - DNA, 11 bp, Unknown
  misc_feature (1)..( 11): Result.004 file - promoters50/1383102
ctttcttttaa

SEQ ID NO: 166771 - DNA, 11 bp, Unknown
  misc_feature (1)..( 11): Result.004 file - promoters50/1383102
ataatcacttc

SEQ ID NO: 166772 - DNA, 11 bp, Unknown
  misc_feature (1)..( 11): Result.004 file - promoters50/1383102
ataatcataaa

SEQ ID NO: 166773 - DNA, 11 bp, Unknown
  misc_feature (1)..( 11): Result.004 file - promoters50/1383102
ataatgataaa

SEQ ID NO: 166774 - DNA, 7 bp, Unknown
  misc_feature (1)..( 7): Result.004 file - promoters50/1383102
aattatt

SEQ ID NO: 166775 - DNA, 7 bp, Unknown
  misc_feature (1)..( 7): Result.004 file - promoters50/1383102
cattatt

SEQ ID NO: 166776 - DNA, 7 bp, Unknown
  misc_feature (1)..( 7): Result.004 file - promoters50/1383144
aattatt

SEQ ID NO: 166777 - DNA, 7 bp, Unknown
  misc_feature (1)..( 7): Result.004 file - promoters50/1383144
aaatttt

SEQ ID NO: 166778 - DNA, 7 bp, Unknown
  misc_feature (1)..( 7): Result.004 file - promoters50/1383144
aaatttc

SEQ ID NO: 166779 - DNA, 8 bp, Unknown
  misc_feature (1)..( 8): Result.004 file - promoters50/1383144
aatattca

SEQ ID NO: 166780 - DNA, 8 bp, Unknown
  misc_feature (1)..( 8): Result.004 file - promoters50/1383144
ataatttt

SEQ ID NO: 166781 - DNA, 13 bp, Unknown
  misc_feature (1)..( 13): Result.004 file - promoters50/1383144
tttcttaatattc

SEQ ID NO: 166782 - DNA, 13 bp, Unknown
  misc_feature (1)..( 13): Result.004 file - promoters50/1383144
tattataatatta

SEQ ID NO: 166783 - DNA, 13 bp, Unknown
  misc_feature (1)..( 13): Result.004 file - promoters50/1383144
ttttttagtatac

SEQ ID NO: 166784 - DNA, 13 bp, Unknown
  misc_feature (1)..( 13): Result.004 file - promoters50/1383144
ctgaagaatattc

SEQ ID NO: 166785 - DNA, 13 bp, Unknown
  misc_feature (1)..( 13): Result.004 file - promoters50/1383214
gaaaacaatattg

SEQ ID NO: 166786 - DNA, 9 bp, Unknown
  misc_feature (1)..( 9): Result.004 file - promoters50/1383214
cataaattt

SEQ ID NO: 166787 - DNA, 9 bp, Unknown
  misc_feature (1)..( 9): Result.004 file - promoters50/1383214
tttaagttt

SEQ ID NO: 166788 - DNA, 9 bp, Unknown
  misc_feature (1)..( 9): Result.004 file - promoters50/1383214
tttgagtta

SEQ ID NO: 166789 - DNA, 8 bp, Unknown
  misc_feature (1)..( 8): Result.004 file - promoters50/1383214
atggtcat

SEQ ID NO: 166790 - DNA, 8 bp, Unknown
  misc_feature (1)..( 8): Result.004 file - promoters50/1383214
atggtcag

SEQ ID NO: 166791 - DNA, 8 bp, Unknown
  misc_feature (1)..( 8): Result.004 file - promoters50/1383214
taggtcat

SEQ ID NO: 166792 - DNA, 9 bp, Unknown
  misc_feature (1)..( 9): Result.004 file - promoters50/1383214
ctatatata

SEQ ID NO: 166793 - DNA, 9 bp, Unknown
  misc_feature (1)..( 9): Result.004 file - promoters50/1383214
atatataaa

SEQ ID NO: 166794 - DNA, 9 bp, Unknown
  misc_feature (1)..( 9): Result.004 file - promoters50/1383214
atatctata

SEQ ID NO: 166795 - DNA, 9 bp, Unknown
  misc_feature (1)..( 9): Result.004 file - promoters50/1383214
ctataatta

SEQ ID NO: 166796 - DNA, 8 bp, Unknown
  misc_feature (1)..( 8): Result.004 file - promoters50/1383214
cataatca

SEQ ID NO: 166797 - DNA, 8 bp, Unknown
  misc_feature (1)..( 8): Result.004 file - promoters50/1383214
cataattt

SEQ ID NO: 166798 - DNA, 8 bp, Unknown
  misc_feature (1)..( 8): Result.004 file - promoters50/1383214
catcatca

SEQ ID NO: 166799 - DNA, 7 bp, Unknown
  misc_feature (1)..( 7): Result.004 file - promoters50/1383214
atggttt

SEQ ID NO: 166800 - DNA, 7 bp, Unknown
  misc_feature (1)..( 7): Result.004 file - promoters50/1383214
ttggttt

SEQ ID NO: 166801 - DNA, 7 bp, Unknown
  misc_feature (1)..( 7): Result.004 file - promoters50/1383214
atgcttt

SEQ ID NO: 166802 - DNA, 7 bp, Unknown
  misc_feature (1)..( 7): Result.004 file - promoters50/1383214
ttaagtt

SEQ ID NO: 166803 - DNA, 7 bp, Unknown
  misc_feature (1)..( 7): Result.004 file - promoters50/1383214
ttaagtt

SEQ ID NO: 166804 - DNA, 7 bp, Unknown
  misc_feature (1)..( 7): Result.004 file - promoters50/1383312
ttaagta

SEQ ID NO: 166805 - DNA, 10 bp, Unknown
  misc_feature (1)..( 10): Result.004 file - promoters50/1383312
tggaaacaat

SEQ ID NO: 166806 - DNA, 10 bp, Unknown
  misc_feature (1)..( 10): Result.004 file - promoters50/1383312
tggagacagc

SEQ ID NO: 166807 - DNA, 10 bp, Unknown
  misc_feature (1)..( 10): Result.004 file - promoters50/1383312
ttgaatcaat

SEQ ID NO: 166808 - DNA, 11 bp, Unknown
  misc_feature (1)..( 11): Result.004 file - promoters50/1383312
taatttctttt

SEQ ID NO: 166809 - DNA, 11 bp, Unknown
  misc_feature (1)..( 11): Result.004 file - promoters50/1383312
tgatttgtttt

SEQ ID NO: 166810 - DNA, 11 bp, Unknown
  misc_feature (1)..( 11): Result.004 file - promoters50/1383312
taatctcttgt

SEQ ID NO: 166811 - DNA, 11 bp, Unknown
  misc_feature (1)..( 11): Result.004 file - promoters50/1383312
gatattgattt

SEQ ID NO: 166812 - DNA, 8 bp, Unknown
  misc_feature (1)..( 8): Result.004 file - promoters50/1383312
acaatttt

SEQ ID NO: 166813 - DNA, 8 bp, Unknown
  misc_feature (1)..( 8): Result.004 file - promoters50/1383312
tcaacttt

SEQ ID NO: 166814 - DNA, 8 bp, Unknown
  misc_feature (1)..( 8): Result.004 file - promoters50/1383322
tcaacttc

SEQ ID NO: 166815 - DNA, 8 bp, Unknown
  misc_feature (1)..( 8): Result.004 file - promoters50/1383322
tttgttga

SEQ ID NO: 166816 - DNA, 8 bp, Unknown
  misc_feature (1)..( 8): Result.004 file - promoters50/1383322
tttgatga

SEQ ID NO: 166817 - DNA, 8 bp, Unknown
  misc_feature (1)..( 8): Result.004 file - promoters50/1383341
tttaatgt

SEQ ID NO: 166818 - DNA, 11 bp, Unknown
  misc_feature (1)..( 11): Result.004 file - promoters50/1383341
caattaatctc

SEQ ID NO: 166819 - DNA, 11 bp, Unknown
  misc_feature (1)..( 11): Result.004 file - promoters50/1383341
tttttattcta

SEQ ID NO: 166820 - DNA, 11 bp, Unknown
  misc_feature (1)..( 11): Result.004 file - promoters50/1383341
attttaatctc

SEQ ID NO: 166821 - DNA, 11 bp, Unknown
  misc_feature (1)..( 11): Result.004 file - promoters50/1383341
attttagaaaa

SEQ ID NO: 166822 - DNA, 12 bp, Unknown
  misc_feature (1)..( 12): Result.004 file - promoters50/1383341
tgttgtattcta

SEQ ID NO: 166823 - DNA, 12 bp, Unknown
  misc_feature (1)..( 12): Result.004 file - promoters50/1383356
tttttgattcag

SEQ ID NO: 166824 - DNA, 10 bp, Unknown
  misc_feature (1)..( 10): Result.004 file - promoters50/1383356
ttttagaaaa

SEQ ID NO: 166825 - DNA, 10 bp, Unknown
  misc_feature (1)..( 10): Result.004 file - promoters50/1383356
aattacaaaa

SEQ ID NO: 166826 - DNA, 10 bp, Unknown
  misc_feature (1)..( 10): Result.004 file - promoters50/1383386
aataacagtt

SEQ ID NO: 166827 - DNA, 8 bp, Unknown
  misc_feature (1)..( 8): Result.004 file - promoters50/1383386
tttcctta

SEQ ID NO: 166828 - DNA, 8 bp, Unknown
  misc_feature (1)..( 8): Result.004 file - promoters50/1383386
ttttcttt

SEQ ID NO: 166829 - DNA, 8 bp, Unknown
  misc_feature (1)..( 8): Result.004 file - promoters50/1383386
tttcgtta

SEQ ID NO: 166830 - DNA, 8 bp, Unknown
  misc_feature (1)..( 8): Result.004 file - promoters50/1383386
ttttctta

SEQ ID NO: 166831 - DNA, 9 bp, Unknown
  misc_feature (1)..( 9): Result.004 file - promoters50/1383386
gaatgtctc

SEQ ID NO: 166832 - DNA, 9 bp, Unknown
  misc_feature (1)..( 9): Result.004 file - promoters50/1383386
aattgtctc

SEQ ID NO: 166833 - DNA, 9 bp, Unknown
  misc_feature (1)..( 9): Result.004 file - promoters50/1383386
aaatctcta

SEQ ID NO: 166834 - DNA, 9 bp, Unknown
  misc_feature (1)..( 9): Result.004 file - promoters50/1383386
aaatctggg

SEQ ID NO: 166835 - DNA, 10 bp, Unknown
  misc_feature (1)..( 10): Result.004 file - promoters50/1383386
ttgttatatg

SEQ ID NO: 166836 - DNA, 10 bp, Unknown
  misc_feature (1)..( 10): Result.004 file - promoters50/1383386
tatttatatt

SEQ ID NO: 166837 - DNA, 10 bp, Unknown
  misc_feature (1)..( 10): Result.004 file - promoters50/1383386
gttttaaatg

SEQ ID NO: 166838 - DNA, 11 bp, Unknown
  misc_feature (1)..( 11): Result.004 file - promoters50/1383386
ttattcatata

SEQ ID NO: 166839 - DNA, 10 bp, Unknown
  misc_feature (1)..( 10): Result.004 file - promoters50/1383386
atataattta

SEQ ID NO: 166840 - DNA, 10 bp, Unknown
  misc_feature (1)..( 10): Result.004 file - promoters50/1383386
ttataatatt

SEQ ID NO: 166841 - DNA, 10 bp, Unknown
  misc_feature (1)..( 10): Result.004 file - promoters50/1383386
atataagatg

SEQ ID NO: 166842 - DNA, 10 bp, Unknown
  misc_feature (1)..( 10): Result.004 file - promoters50/1383430
atatgattta

SEQ ID NO: 166843 - DNA, 8 bp, Unknown
  misc_feature (1)..( 8): Result.004 file - promoters50/1383430
tttttctg

SEQ ID NO: 166844 - DNA, 8 bp, Unknown
  misc_feature (1)..( 8): Result.004 file - promoters50/1383430
cttttctt

SEQ ID NO: 166845 - DNA, 8 bp, Unknown
  misc_feature (1)..( 8): Result.004 file - promoters50/1383430
gttttcta

SEQ ID NO: 166846 - DNA, 8 bp, Unknown
  misc_feature (1)..( 8): Result.004 file - promoters50/1383430
ggtttcta

SEQ ID NO: 166847 - DNA, 8 bp, Unknown
  misc_feature (1)..( 8): Result.004 file - promoters50/1383485
cttttcct

SEQ ID NO: 166848 - DNA, 14 bp, Unknown
  misc_feature (1)..( 14): Result.004 file - promoters50/1383485
ctcaaaaaaaaaaa

SEQ ID NO: 166849 - DNA, 14 bp, Unknown
  misc_feature (1)..( 14): Result.004 file - promoters50/1383485
ctcaataaagtaga

SEQ ID NO: 166850 - DNA, 15 bp, Unknown
  misc_feature (1)..( 15): Result.004 file - promoters50/1383485
actaaaagaaataaa

SEQ ID NO: 166851 - DNA, 15 bp, Unknown
  misc_feature (1)..( 15): Result.004 file - promoters50/1383485
gtcaaaattggaaga

SEQ ID NO: 166852 - DNA, 15 bp, Unknown
  misc_feature (1)..( 15): Result.004 file - promoters50/1383485
accaataattgtcaa

SEQ ID NO: 166853 - DNA, 15 bp, Unknown
  misc_feature (1)..( 15): Result.004 file - promoters50/1383485
acaaaattaactaag

SEQ ID NO: 166854 - DNA, 15 bp, Unknown
  misc_feature (1)..( 15): Result.004 file - promoters50/1383485
gagaataataacatt

SEQ ID NO: 166855 - DNA, 12 bp, Unknown
  misc_feature (1)..( 12): Result.004 file - promoters50/1383485
catattatcaat

SEQ ID NO: 166856 - DNA, 12 bp, Unknown
  misc_feature (1)..( 12): Result.004 file - promoters50/1383485
aagattttcaaa

SEQ ID NO: 166857 - DNA, 12 bp, Unknown
  misc_feature (1)..( 12): Result.004 file - promoters50/1383485
tgcatgttatat

SEQ ID NO: 166858 - DNA, 12 bp, Unknown
  misc_feature (1)..( 12): Result.004 file - promoters50/1383485
atcattggacag

SEQ ID NO: 166859 - DNA, 12 bp, Unknown
  misc_feature (1)..( 12): Result.004 file - promoters50/1383485
attaagttcaaa

SEQ ID NO: 166860 - DNA, 12 bp, Unknown
  misc_feature (1)..( 12): Result.004 file - promoters50/1383506
aagatgttaagg

SEQ ID NO: 166861 - DNA, 7 bp, Unknown
  misc_feature (1)..( 7): Result.004 file - promoters50/1383506
ttgccag

SEQ ID NO: 166862 - DNA, 7 bp, Unknown
  misc_feature (1)..( 7): Result.004 file - promoters50/1383506
atgccag

SEQ ID NO: 166863 - DNA, 7 bp, Unknown
  misc_feature (1)..( 7): Result.004 file - promoters50/1383506
atgccaa

SEQ ID NO: 166864 - DNA, 13 bp, Unknown
  misc_feature (1)..( 13): Result.004 file - promoters50/1383506
tgccttcatccct

SEQ ID NO: 166865 - DNA, 13 bp, Unknown
  misc_feature (1)..( 13): Result.004 file - promoters50/1383506
cttgttcagccct

SEQ ID NO: 166866 - DNA, 13 bp, Unknown
  misc_feature (1)..( 13): Result.004 file - promoters50/1383506
tgccttcatcgtc

SEQ ID NO: 166867 - DNA, 10 bp, Unknown
  misc_feature (1)..( 10): Result.004 file - promoters50/1383506
tgagattgga

SEQ ID NO: 166868 - DNA, 10 bp, Unknown
  misc_feature (1)..( 10): Result.004 file - promoters50/1383506
gaagatggga

SEQ ID NO: 166869 - DNA, 10 bp, Unknown
  misc_feature (1)..( 10): Result.004 file - promoters50/1383514
gaaaatgctg

SEQ ID NO: 166870 - DNA, 10 bp, Unknown
  misc_feature (1)..( 10): Result.004 file - promoters50/1383514
acttttaaat

SEQ ID NO: 166871 - DNA, 10 bp, Unknown
  misc_feature (1)..( 10): Result.004 file - promoters50/1383514
gattttaatc

SEQ ID NO: 166872 - DNA, 10 bp, Unknown
  misc_feature (1)..( 10): Result.004 file - promoters50/1383514
catttgaaat

SEQ ID NO: 166873 - DNA, 10 bp, Unknown
  misc_feature (1)..( 10): Result.004 file - promoters50/1383514
gattttatat

SEQ ID NO: 166874 - DNA, 10 bp, Unknown
  misc_feature (1)..( 10): Result.004 file - promoters50/1383514
tattctaacc

SEQ ID NO: 166875 - DNA, 11 bp, Unknown
  misc_feature (1)..( 11): Result.004 file - promoters50/1383514
tatttgtaatc

SEQ ID NO: 166876 - DNA, 10 bp, Unknown
  misc_feature (1)..( 10): Result.004 file - promoters50/1383514
taattaaact

SEQ ID NO: 166877 - DNA, 10 bp, Unknown
  misc_feature (1)..( 10): Result.004 file - promoters50/1383514
gaataaaagc

SEQ ID NO: 166878 - DNA, 10 bp, Unknown
  misc_feature (1)..( 10): Result.004 file - promoters50/1383514
aaatcaaatg

SEQ ID NO: 166879 - DNA, 10 bp, Unknown
  misc_feature (1)..( 10): Result.004 file - promoters50/1383514
tgataaaatg

SEQ ID NO: 166880 - DNA, 10 bp, Unknown
  misc_feature (1)..( 10): Result.004 file - promoters50/1383514
taatatgaga

SEQ ID NO: 166881 - DNA, 10 bp, Unknown
  misc_feature (1)..( 10): Result.004 file - promoters50/1383514
gtgtaacatg

SEQ ID NO: 166882 - DNA, 11 bp, Unknown
  misc_feature (1)..( 11): Result.004 file - promoters50/1383514
gaataaaatgt

SEQ ID NO: 166883 - DNA, 11 bp, Unknown
  misc_feature (1)..( 11): Result.004 file - promoters50/1383514
cagtaaaatat

SEQ ID NO: 166884 - DNA, 11 bp, Unknown
  misc_feature (1)..( 11): Result.004 file - promoters50/1383514
atataaaataa

SEQ ID NO: 166885 - DNA, 11 bp, Unknown
  misc_feature (1)..( 11): Result.004 file - promoters50/1383514
gtataaaatac

SEQ ID NO: 166886 - DNA, 11 bp, Unknown
  misc_feature (1)..( 11): Result.004 file - promoters50/1383514
cagtaaaaaaa

SEQ ID NO: 166887 - DNA, 11 bp, Unknown
  misc_feature (1)..( 11): Result.004 file - promoters50/1383514
ttacaaagtat

SEQ ID NO: 166888 - DNA, 9 bp, Unknown
  misc_feature (1)..( 9): Result.004 file - promoters50/1383514
atttgttac

SEQ ID NO: 166889 - DNA, 9 bp, Unknown
  misc_feature (1)..( 9): Result.004 file - promoters50/1383514
ttttgttat

SEQ ID NO: 166890 - DNA, 9 bp, Unknown
  misc_feature (1)..( 9): Result.004 file - promoters50/1383514
atttgtaat

SEQ ID NO: 166891 - DNA, 9 bp, Unknown
  misc_feature (1)..( 9): Result.004 file - promoters50/1383514
atttgttta

SEQ ID NO: 166892 - DNA, 9 bp, Unknown
  misc_feature (1)..( 9): Result.004 file - promoters50/1383514
gtttcttac

SEQ ID NO: 166893 - DNA, 9 bp, Unknown
  misc_feature (1)..( 9): Result.004 file - promoters50/1383514
atttgaaat

SEQ ID NO: 166894 - DNA, 11 bp, Unknown
  misc_feature (1)..( 11): Result.004 file - promoters50/1383514
atataaatagt

SEQ ID NO: 166895 - DNA, 11 bp, Unknown
  misc_feature (1)..( 11): Result.004 file - promoters50/1383514
atataaatacc

SEQ ID NO: 166896 - DNA, 11 bp, Unknown
  misc_feature (1)..( 11): Result.004 file - promoters50/1383514
taataaataca

SEQ ID NO: 166897 - DNA, 11 bp, Unknown
  misc_feature (1)..( 11): Result.004 file - promoters50/1383514
ctataaataga

SEQ ID NO: 166898 - DNA, 11 bp, Unknown
  misc_feature (1)..( 11): Result.004 file - promoters50/1383514
ctataaataga

SEQ ID NO: 166899 - DNA, 11 bp, Unknown
  misc_feature (1)..( 11): Result.004 file - promoters50/1383518
ctctcaatata

SEQ ID NO: 166900 - DNA, 8 bp, Unknown
  misc_feature (1)..( 8): Result.004 file - promoters50/1383518
aaactaaa

SEQ ID NO: 166901 - DNA, 8 bp, Unknown
  misc_feature (1)..( 8): Result.004 file - promoters50/1383518
atactaaa

SEQ ID NO: 166902 - DNA, 8 bp, Unknown
  misc_feature (1)..( 8): Result.004 file - promoters50/1383518
ataataat

SEQ ID NO: 166903 - DNA, 12 bp, Unknown
  misc_feature (1)..( 12): Result.004 file - promoters50/1383518
accaaaaacaaa

SEQ ID NO: 166904 - DNA, 12 bp, Unknown
  misc_feature (1)..( 12): Result.004 file - promoters50/1383518
ataacaaataaa

SEQ ID NO: 166905 - DNA, 12 bp, Unknown
  misc_feature (1)..( 12): Result.004 file - promoters50/1383518
accaaaaacaat

SEQ ID NO: 166906 - DNA, 9 bp, Unknown
  misc_feature (1)..( 9): Result.004 file - promoters50/1383518
atataaata

SEQ ID NO: 166907 - DNA, 9 bp, Unknown
  misc_feature (1)..( 9): Result.004 file - promoters50/1383518
ctatatata

SEQ ID NO: 166908 - DNA, 9 bp, Unknown
  misc_feature (1)..( 9): Result.004 file - promoters50/1383518
atataaaca

SEQ ID NO: 166909 - DNA, 9 bp, Unknown
  misc_feature (1)..( 9): Result.004 file - promoters50/1383518
aaaaaatga

SEQ ID NO: 166910 - DNA, 9 bp, Unknown
  misc_feature (1)..( 9): Result.004 file - promoters50/1383518
aaataataa

SEQ ID NO: 166911 - DNA, 9 bp, Unknown
  misc_feature (1)..( 9): Result.004 file - promoters50/1383518
tcatactaa

SEQ ID NO: 166912 - DNA, 8 bp, Unknown
  misc_feature (1)..( 8): Result.004 file - promoters50/1383518
aatgatac

SEQ ID NO: 166913 - DNA, 8 bp, Unknown
  misc_feature (1)..( 8): Result.004 file - promoters50/1383518
aataataa

SEQ ID NO: 166914 - DNA, 8 bp, Unknown
  misc_feature (1)..( 8): Result.004 file - promoters50/1383518
catactaa

SEQ ID NO: 166915 - DNA, 11 bp, Unknown
  misc_feature (1)..( 11): Result.004 file - promoters50/1383518
ttaatgtttgt

SEQ ID NO: 166916 - DNA, 11 bp, Unknown
  misc_feature (1)..( 11): Result.004 file - promoters50/1383518
ttaatgttaag

SEQ ID NO: 166917 - DNA, 11 bp, Unknown
  misc_feature (1)..( 11): Result.004 file - promoters50/1383552
aatatgtaaag

SEQ ID NO: 166918 - DNA, 11 bp, Unknown
  misc_feature (1)..( 11): Result.004 file - promoters50/1383552
aggcccacttt

SEQ ID NO: 166919 - DNA, 11 bp, Unknown
  misc_feature (1)..( 11): Result.004 file - promoters50/1383552
cggcccatcaa

SEQ ID NO: 166920 - DNA, 11 bp, Unknown
  misc_feature (1)..( 11): Result.004 file - promoters50/1383552
tggcccataag

SEQ ID NO: 166921 - DNA, 11 bp, Unknown
  misc_feature (1)..( 11): Result.004 file - promoters50/1383552
aggcccatata

SEQ ID NO: 166922 - DNA, 11 bp, Unknown
  misc_feature (1)..( 11): Result.004 file - promoters50/1383552
aggcccattat

SEQ ID NO: 166923 - DNA, 11 bp, Unknown
  misc_feature (1)..( 11): Result.004 file - promoters50/1383552
gggcctataag

SEQ ID NO: 166924 - DNA, 12 bp, Unknown
  misc_feature (1)..( 12): Result.004 file - promoters50/1383552
aaaagtaaatct

SEQ ID NO: 166925 - DNA, 12 bp, Unknown
  misc_feature (1)..( 12): Result.004 file - promoters50/1383552
aaaaataaacta

SEQ ID NO: 166926 - DNA, 12 bp, Unknown
  misc_feature (1)..( 12): Result.004 file - promoters50/1383552
tagagtaaacca

SEQ ID NO: 166927 - DNA, 12 bp, Unknown
  misc_feature (1)..( 12): Result.004 file - promoters50/1383552
taaattaatata

SEQ ID NO: 166928 - DNA, 12 bp, Unknown
  misc_feature (1)..( 12): Result.004 file - promoters50/1383552
aactttaaaaac

SEQ ID NO: 166929 - DNA, 12 bp, Unknown
  misc_feature (1)..( 12): Result.004 file - promoters50/1383552
cgatgtaaaaat

SEQ ID NO: 166930 - DNA, 10 bp, Unknown
  misc_feature (1)..( 10): Result.004 file - promoters50/1383552
catatgattg

SEQ ID NO: 166931 - DNA, 10 bp, Unknown
  misc_feature (1)..( 10): Result.004 file - promoters50/1383552
ttaatgtttg

SEQ ID NO: 166932 - DNA, 10 bp, Unknown
  misc_feature (1)..( 10): Result.004 file - promoters50/1383552
ttaatttttt

SEQ ID NO: 166933 - DNA, 10 bp, Unknown
  misc_feature (1)..( 10): Result.004 file - promoters50/1383552
ataatttact

SEQ ID NO: 166934 - DNA, 10 bp, Unknown
  misc_feature (1)..( 10): Result.004 file - promoters50/1383552
ataatttagt

SEQ ID NO: 166935 - DNA, 11 bp, Unknown
  misc_feature (1)..( 11): Result.004 file - promoters50/1383552
ctcattcttta

SEQ ID NO: 166936 - DNA, 11 bp, Unknown
  misc_feature (1)..( 11): Result.004 file - promoters50/1383552
tatatataaat

SEQ ID NO: 166937 - DNA, 11 bp, Unknown
  misc_feature (1)..( 11): Result.004 file - promoters50/1383552
tatttatgaat

SEQ ID NO: 166938 - DNA, 11 bp, Unknown
  misc_feature (1)..( 11): Result.004 file - promoters50/1383552
ccactataaaa

SEQ ID NO: 166939 - DNA, 11 bp, Unknown
  misc_feature (1)..( 11): Result.004 file - promoters50/1383552
catatatactt

SEQ ID NO: 166940 - DNA, 11 bp, Unknown
  misc_feature (1)..( 11): Result.004 file - promoters50/1383552
ccactataaat

SEQ ID NO: 166941 - DNA, 11 bp, Unknown
  misc_feature (1)..( 11): Result.004 file - promoters50/1383569
actatataacc

SEQ ID NO: 166942 - DNA, 8 bp, Unknown
  misc_feature (1)..( 8): Result.004 file - promoters50/1383569
atttgaat

SEQ ID NO: 166943 - DNA, 8 bp, Unknown
  misc_feature (1)..( 8): Result.004 file - promoters50/1383569
attttaat

SEQ ID NO: 166944 - DNA, 8 bp, Unknown
  misc_feature (1)..( 8): Result.004 file - promoters50/1383569
attttaaa

SEQ ID NO: 166945 - DNA, 8 bp, Unknown
  misc_feature (1)..( 8): Result.004 file - promoters50/1383569
attttaca

SEQ ID NO: 166946 - DNA, 14 bp, Unknown
  misc_feature (1)..( 14): Result.004 file - promoters50/1383569
ataatagtttaaaa

SEQ ID NO: 166947 - DNA, 14 bp, Unknown
  misc_feature (1)..( 14): Result.004 file - promoters50/1383569
atattagctggtgc

SEQ ID NO: 166948 - DNA, 14 bp, Unknown
  misc_feature (1)..( 14): Result.004 file - promoters50/1383569
ccattggctggtgc

SEQ ID NO: 166949 - DNA, 7 bp, Unknown
  misc_feature (1)..( 7): Result.004 file - promoters50/1383569
gaagatg

SEQ ID NO: 166950 - DNA, 7 bp, Unknown
  misc_feature (1)..( 7): Result.004 file - promoters50/1383569
taagatg

SEQ ID NO: 166951 - DNA, 7 bp, Unknown
  misc_feature (1)..( 7): Result.004 file - promoters50/1383569
taagatt

SEQ ID NO: 166952 - DNA, 11 bp, Unknown
  misc_feature (1)..( 11): Result.004 file - promoters50/1383569
aatgaaatagt

SEQ ID NO: 166953 - DNA, 11 bp, Unknown
  misc_feature (1)..( 11): Result.004 file - promoters50/1383569
taagaaatagt

SEQ ID NO: 166954 - DNA, 11 bp, Unknown
  misc_feature (1)..( 11): Result.004 file - promoters50/1383569
aataaaataaa

SEQ ID NO: 166955 - DNA, 7 bp, Unknown
  misc_feature (1)..( 7): Result.004 file - promoters50/1383569
atttaaa

SEQ ID NO: 166956 - DNA, 7 bp, Unknown
  misc_feature (1)..( 7): Result.004 file - promoters50/1383569
gtttaaa

SEQ ID NO: 166957 - DNA, 7 bp, Unknown
  misc_feature (1)..( 7): Result.004 file - promoters50/1383569
atttaaa

SEQ ID NO: 166958 - DNA, 10 bp, Unknown
  misc_feature (1)..( 10): Result.004 file - promoters50/1383569
aatataaact

SEQ ID NO: 166959 - DNA, 10 bp, Unknown
  misc_feature (1)..( 10): Result.004 file - promoters50/1383569
agtttaaact

SEQ ID NO: 166960 - DNA, 10 bp, Unknown
  misc_feature (1)..( 10): Result.004 file - promoters50/1383569
aatttaaaca

SEQ ID NO: 166961 - DNA, 13 bp, Unknown
  misc_feature (1)..( 13): Result.004 file - promoters50/1383569
aatattaaaataa

SEQ ID NO: 166962 - DNA, 13 bp, Unknown
  misc_feature (1)..( 13): Result.004 file - promoters50/1383569
aatattaatataa

SEQ ID NO: 166963 - DNA, 13 bp, Unknown
  misc_feature (1)..( 13): Result.004 file - promoters50/1383569
aatttaaacagaa

SEQ ID NO: 166964 - DNA, 7 bp, Unknown
  misc_feature (1)..( 7): Result.004 file - promoters50/1383569
aattgat

SEQ ID NO: 166965 - DNA, 7 bp, Unknown
  misc_feature (1)..( 7): Result.004 file - promoters50/1383569
gattgat

SEQ ID NO: 166966 - DNA, 7 bp, Unknown
  misc_feature (1)..( 7): Result.004 file - promoters50/1383572
gattgaa

SEQ ID NO: 166967 - DNA, 13 bp, Unknown
  misc_feature (1)..( 13): Result.004 file - promoters50/1383572
ccaaagaaaaaat

SEQ ID NO: 166968 - DNA, 13 bp, Unknown
  misc_feature (1)..( 13): Result.004 file - promoters50/1383572
tgaaagaatatct

SEQ ID NO: 166969 - DNA, 13 bp, Unknown
  misc_feature (1)..( 13): Result.004 file - promoters50/1383572
cgaaagaaacaat

SEQ ID NO: 166970 - DNA, 13 bp, Unknown
  misc_feature (1)..( 13): Result.004 file - promoters50/1383572
tgaaaaaattcac

SEQ ID NO: 166971 - DNA, 8 bp, Unknown
  misc_feature (1)..( 8): Result.004 file - promoters50/1383572
gatatata

SEQ ID NO: 166972 - DNA, 8 bp, Unknown
  misc_feature (1)..( 8): Result.004 file - promoters50/1383572
gatgtatt

SEQ ID NO: 166973 - DNA, 8 bp, Unknown
  misc_feature (1)..( 8): Result.004 file - promoters50/1383572
tatggatt

SEQ ID NO: 166974 - DNA, 7 bp, Unknown
  misc_feature (1)..( 7): Result.004 file - promoters50/1383572
tttatta

SEQ ID NO: 166975 - DNA, 7 bp, Unknown
  misc_feature (1)..( 7): Result.004 file - promoters50/1383572
tttattt

SEQ ID NO: 166976 - DNA, 7 bp, Unknown
  misc_feature (1)..( 7): Result.004 file - promoters50/1383572
ttaataa

SEQ ID NO: 166977 - DNA, 9 bp, Unknown
  misc_feature (1)..( 9): Result.004 file - promoters50/1383572
tttcaaatg

SEQ ID NO: 166978 - DNA, 9 bp, Unknown
  misc_feature (1)..( 9): Result.004 file - promoters50/1383572
ttttaaata

SEQ ID NO: 166979 - DNA, 9 bp, Unknown
  misc_feature (1)..( 9): Result.004 file - promoters50/1383572
tcataaata

SEQ ID NO: 166980 - DNA, 7 bp, Unknown
  misc_feature (1)..( 7): Result.004 file - promoters50/1383572
aaaataa

SEQ ID NO: 166981 - DNA, 7 bp, Unknown
  misc_feature (1)..( 7): Result.004 file - promoters50/1383572
taaataa

SEQ ID NO: 166982 - DNA, 7 bp, Unknown
  misc_feature (1)..( 7): Result.004 file - promoters50/1383572
taaatat

SEQ ID NO: 166983 - DNA, 7 bp, Unknown
  misc_feature (1)..( 7): Result.004 file - promoters50/1383572
attaaat

SEQ ID NO: 166984 - DNA, 7 bp, Unknown
  misc_feature (1)..( 7): Result.004 file - promoters50/1383572
attaaat

SEQ ID NO: 166985 - DNA, 7 bp, Unknown
  misc_feature (1)..( 7): Result.004 file - promoters50/1383572
aataaaa

SEQ ID NO: 166986 - DNA, 11 bp, Unknown
  misc_feature (1)..( 11): Result.004 file - promoters50/1383572
aaagaaaaaat

SEQ ID NO: 166987 - DNA, 11 bp, Unknown
  misc_feature (1)..( 11): Result.004 file - promoters50/1383572
tttgaaaaaat

SEQ ID NO: 166988 - DNA, 11 bp, Unknown
  misc_feature (1)..( 11): Result.004 file - promoters50/1383572
aaagaaacaat

SEQ ID NO: 166989 - DNA, 11 bp, Unknown
  misc_feature (1)..( 11): Result.004 file - promoters50/1383572
cctgaaagaat

SEQ ID NO: 166990 - DNA, 8 bp, Unknown
  misc_feature (1)..( 8): Result.004 file - promoters50/1383572
ataaattt

SEQ ID NO: 166991 - DNA, 8 bp, Unknown
  misc_feature (1)..( 8): Result.004 file - promoters50/1383572
acaaattt

SEQ ID NO: 166992 - DNA, 8 bp, Unknown
  misc_feature (1)..( 8): Result.004 file - promoters50/1383572
acaaatta

SEQ ID NO: 166993 - DNA, 11 bp, Unknown
  misc_feature (1)..( 11): Result.004 file - promoters50/1383572
ctttattaaaa

SEQ ID NO: 166994 - DNA, 11 bp, Unknown
  misc_feature (1)..( 11): Result.004 file - promoters50/1383572
gtatattaata

SEQ ID NO: 166995 - DNA, 11 bp, Unknown
  misc_feature (1)..( 11): Result.004 file - promoters50/1383572
gtatattcata

SEQ ID NO: 166996 - DNA, 10 bp, Unknown
  misc_feature (1)..( 10): Result.004 file - promoters50/1383572
aaattaaaat

SEQ ID NO: 166997 - DNA, 10 bp, Unknown
  misc_feature (1)..( 10): Result.004 file - promoters50/1383572
aaattcaaaa

SEQ ID NO: 166998 - DNA, 10 bp, Unknown
  misc_feature (1)..( 10): Result.004 file - promoters50/1383572
aaattcttca

SEQ ID NO: 166999 - DNA, 10 bp, Unknown
  misc_feature (1)..( 10): Result.004 file - promoters50/1383572
actttcaaaa

SEQ ID NO: 167000 - DNA, 8 bp, Unknown
  misc_feature (1)..( 8): Result.004 file - promoters50/1383572
tgaaatgt

SEQ ID NO: 167001 - DNA, 8 bp, Unknown
  misc_feature (1)..( 8): Result.004 file - promoters50/1383572
tgaaatca

SEQ ID NO: 167002 - DNA, 8 bp, Unknown
  misc_feature (1)..( 8): Result.004 file - promoters50/1383602
tgagatca

SEQ ID NO: 167003 - DNA, 7 bp, Unknown
  misc_feature (1)..( 7): Result.004 file - promoters50/1383602
caaaaaa

SEQ ID NO: 167004 - DNA, 7 bp, Unknown
  misc_feature (1)..( 7): Result.004 file - promoters50/1383602
caataaa

SEQ ID NO: 167005 - DNA, 7 bp, Unknown
  misc_feature (1)..( 7): Result.004 file - promoters50/1383602
gaaaaaa

SEQ ID NO: 167006 - DNA, 10 bp, Unknown
  misc_feature (1)..( 10): Result.004 file - promoters50/1383602
gaattaaccc

SEQ ID NO: 167007 - DNA, 10 bp, Unknown
  misc_feature (1)..( 10): Result.004 file - promoters50/1383602
atattgaccc

SEQ ID NO: 167008 - DNA, 10 bp, Unknown
  misc_feature (1)..( 10): Result.004 file - promoters50/1383602
atactgaagg

SEQ ID NO: 167009 - DNA, 8 bp, Unknown
  misc_feature (1)..( 8): Result.004 file - promoters50/1383602
aattttag

SEQ ID NO: 167010 - DNA, 8 bp, Unknown
  misc_feature (1)..( 8): Result.004 file - promoters50/1383602
aatcttat

SEQ ID NO: 167011 - DNA, 8 bp, Unknown
  misc_feature (1)..( 8): Result.004 file - promoters50/1383602
aatcctat

SEQ ID NO: 167012 - DNA, 10 bp, Unknown
  misc_feature (1)..( 10): Result.004 file - promoters50/1383602
agtaaacgac

SEQ ID NO: 167013 - DNA, 10 bp, Unknown
  misc_feature (1)..( 10): Result.004 file - promoters50/1383602
attaaaagac

SEQ ID NO: 167014 - DNA, 10 bp, Unknown
  misc_feature (1)..( 10): Result.004 file - promoters50/1383602
attgaaacag

SEQ ID NO: 167015 - DNA, 8 bp, Unknown
  misc_feature (1)..( 8): Result.004 file - promoters50/1383602
atttacaa

SEQ ID NO: 167016 - DNA, 8 bp, Unknown
  misc_feature (1)..( 8): Result.004 file - promoters50/1383602
attaacac

SEQ ID NO: 167017 - DNA, 8 bp, Unknown
  misc_feature (1)..( 8): Result.004 file - promoters50/1383602
atttttaa

SEQ ID NO: 167018 - DNA, 7 bp, Unknown
  misc_feature (1)..( 7): Result.004 file - promoters50/1383602
acaaaag

SEQ ID NO: 167019 - DNA, 7 bp, Unknown
  misc_feature (1)..( 7): Result.004 file - promoters50/1383602
gcaaaag

SEQ ID NO: 167020 - DNA, 7 bp, Unknown
  misc_feature (1)..( 7): Result.004 file - promoters50/1383624
gcaaaag

SEQ ID NO: 167021 - DNA, 13 bp, Unknown
  misc_feature (1)..( 13): Result.004 file - promoters50/1383624
aatttagttttaa

SEQ ID NO: 167022 - DNA, 13 bp, Unknown
  misc_feature (1)..( 13): Result.004 file - promoters50/1383624
aatttatttttag

SEQ ID NO: 167023 - DNA, 13 bp, Unknown
  misc_feature (1)..( 13): Result.004 file - promoters50/1383624
atgacttttgtag

SEQ ID NO: 167024 - DNA, 9 bp, Unknown
  misc_feature (1)..( 9): Result.004 file - promoters50/1383624
tgcaaaatt

SEQ ID NO: 167025 - DNA, 9 bp, Unknown
  misc_feature (1)..( 9): Result.004 file - promoters50/1383624
gaaaaaatt

SEQ ID NO: 167026 - DNA, 10 bp, Unknown
  misc_feature (1)..( 10): Result.004 file - promoters50/1383677
tgaaagaata

SEQ ID NO: 167027 - DNA, 8 bp, Unknown
  misc_feature (1)..( 8): Result.004 file - promoters50/1383677
tagctata

SEQ ID NO: 167028 - DNA, 8 bp, Unknown
  misc_feature (1)..( 8): Result.004 file - promoters50/1383677
tagatata

SEQ ID NO: 167029 - DNA, 8 bp, Unknown
  misc_feature (1)..( 8): Result.004 file - promoters50/1383677
tagataag

SEQ ID NO: 167030 - DNA, 7 bp, Unknown
  misc_feature (1)..( 7): Result.004 file - promoters50/1383677
aatattt

SEQ ID NO: 167031 - DNA, 7 bp, Unknown
  misc_feature (1)..( 7): Result.004 file - promoters50/1383677
tatattt

SEQ ID NO: 167032 - DNA, 7 bp, Unknown
  misc_feature (1)..( 7): Result.004 file - promoters50/1383677
aatattg

SEQ ID NO: 167033 - DNA, 8 bp, Unknown
  misc_feature (1)..( 8): Result.004 file - promoters50/1383677
ataaaaac

SEQ ID NO: 167034 - DNA, 8 bp, Unknown
  misc_feature (1)..( 8): Result.004 file - promoters50/1383677
ttaataac

SEQ ID NO: 167035 - DNA, 8 bp, Unknown
  misc_feature (1)..( 8): Result.004 file - promoters50/1383919
ttactaag

SEQ ID NO: 167036 - DNA, 7 bp, Unknown
  misc_feature (1)..( 7): Result.004 file - promoters50/1383919
catagaa

SEQ ID NO: 167037 - DNA, 7 bp, Unknown
  misc_feature (1)..( 7): Result.004 file - promoters50/1383919
catagag

SEQ ID NO: 167038 - DNA, 7 bp, Unknown
  misc_feature (1)..( 7): Result.004 file - promoters50/1383919
aatagaa

SEQ ID NO: 167039 - DNA, 11 bp, Unknown
  misc_feature (1)..( 11): Result.004 file - promoters50/1383919
aatatacaaaa

SEQ ID NO: 167040 - DNA, 11 bp, Unknown
  misc_feature (1)..( 11): Result.004 file - promoters50/1383919
aatagacaaaa

SEQ ID NO: 167041 - DNA, 11 bp, Unknown
  misc_feature (1)..( 11): Result.004 file - promoters50/1383919
tacatacaaaa

SEQ ID NO: 167042 - DNA, 10 bp, Unknown
  misc_feature (1)..( 10): Result.004 file - promoters50/1383919
aaatcaaagg

SEQ ID NO: 167043 - DNA, 10 bp, Unknown
  misc_feature (1)..( 10): Result.004 file - promoters50/1383919
aaaacaaaat

SEQ ID NO: 167044 - DNA, 10 bp, Unknown
  misc_feature (1)..( 10): Result.004 file - promoters50/1384016
catacaaaat

SEQ ID NO: 167045 - DNA, 13 bp, Unknown
  misc_feature (1)..( 13): Result.004 file - promoters50/1384016
ttttttcttattc

SEQ ID NO: 167046 - DNA, 13 bp, Unknown
  misc_feature (1)..( 13): Result.004 file - promoters50/1384016
ggttttattattc

SEQ ID NO: 167047 - DNA, 13 bp, Unknown
  misc_feature (1)..( 13): Result.004 file - promoters50/1384016
aatttacttagga

SEQ ID NO: 167048 - DNA, 13 bp, Unknown
  misc_feature (1)..( 13): Result.004 file - promoters50/1384016
tagattattacat

SEQ ID NO: 167049 - DNA, 13 bp, Unknown
  misc_feature (1)..( 13): Result.004 file - promoters50/1384016
ggttttagtatat

SEQ ID NO: 167050 - DNA, 13 bp, Unknown
  misc_feature (1)..( 13): Result.004 file - promoters50/1384016
agttttatcaaaa

SEQ ID NO: 167051 - DNA, 13 bp, Unknown
  misc_feature (1)..( 13): Result.004 file - promoters50/1384016
gttaataataaat

SEQ ID NO: 167052 - DNA, 13 bp, Unknown
  misc_feature (1)..( 13): Result.004 file - promoters50/1384016
tttagtaacaaaa

SEQ ID NO: 167053 - DNA, 13 bp, Unknown
  misc_feature (1)..( 13): Result.004 file - promoters50/1384016
tgtaaaaattata

SEQ ID NO: 167054 - DNA, 13 bp, Unknown
  misc_feature (1)..( 13): Result.004 file - promoters50/1384016
gcttcaaacaaaa

SEQ ID NO: 167055 - DNA, 13 bp, Unknown
  misc_feature (1)..( 13): Result.004 file - promoters50/1384016
ttttgtaaatttt

SEQ ID NO: 167056 - DNA, 13 bp, Unknown
  misc_feature (1)..( 13): Result.004 file - promoters50/1384016
tatgaaaaaaaaa

SEQ ID NO: 167057 - DNA, 13 bp, Unknown
  misc_feature (1)..( 13): Result.004 file - promoters50/1384016
ttttaaaatttag

SEQ ID NO: 167058 - DNA, 11 bp, Unknown
  misc_feature (1)..( 11): Result.004 file - promoters50/1384016
aattaaataaa

SEQ ID NO: 167059 - DNA, 11 bp, Unknown
  misc_feature (1)..( 11): Result.004 file - promoters50/1384016
ttttaaataga

SEQ ID NO: 167060 - DNA, 11 bp, Unknown
  misc_feature (1)..( 11): Result.004 file - promoters50/1384016
tattatatagc

SEQ ID NO: 167061 - DNA, 11 bp, Unknown
  misc_feature (1)..( 11): Result.004 file - promoters50/1384016
ctctaaaaaaa

SEQ ID NO: 167062 - DNA, 11 bp, Unknown
  misc_feature (1)..( 11): Result.004 file - promoters50/1384016
cttttaatatt

SEQ ID NO: 167063 - DNA, 11 bp, Unknown
  misc_feature (1)..( 11): Result.004 file - promoters50/1384016
tattatcaaag

SEQ ID NO: 167064 - DNA, 11 bp, Unknown
  misc_feature (1)..( 11): Result.004 file - promoters50/1384016
tattatcaatg

SEQ ID NO: 167065 - DNA, 11 bp, Unknown
  misc_feature (1)..( 11): Result.004 file - promoters50/1384016
tattatttcaa

SEQ ID NO: 167066 - DNA, 12 bp, Unknown
  misc_feature (1)..( 12): Result.004 file - promoters50/1384016
tttttaatttct

SEQ ID NO: 167067 - DNA, 12 bp, Unknown
  misc_feature (1)..( 12): Result.004 file - promoters50/1384016
acaataatttac

SEQ ID NO: 167068 - DNA, 12 bp, Unknown
  misc_feature (1)..( 12): Result.004 file - promoters50/1384016
tcaattatttta

SEQ ID NO: 167069 - DNA, 12 bp, Unknown
  misc_feature (1)..( 12): Result.004 file - promoters50/1384016
tttttactttta

SEQ ID NO: 167070 - DNA, 12 bp, Unknown
  misc_feature (1)..( 12): Result.004 file - promoters50/1384016
aaaatagtttac

SEQ ID NO: 167071 - DNA, 12 bp, Unknown
  misc_feature (1)..( 12): Result.004 file - promoters50/1384016
aaaaaagttttt

SEQ ID NO: 167072 - DNA, 8 bp, Unknown
  misc_feature (1)..( 8): Result.004 file - promoters50/1384016
ggaaaaaa

SEQ ID NO: 167073 - DNA, 8 bp, Unknown
  misc_feature (1)..( 8): Result.004 file - promoters50/1384016
ttaaaaaa

SEQ ID NO: 167074 - DNA, 9 bp, Unknown
  misc_feature (1)..( 9): Result.004 file - promoters50/1384016
ttaaacaaa

SEQ ID NO: 167075 - DNA, 9 bp, Unknown
  misc_feature (1)..( 9): Result.004 file - promoters50/1384016
agaaagaaa

SEQ ID NO: 167076 - DNA, 9 bp, Unknown
  misc_feature (1)..( 9): Result.004 file - promoters50/1384016
aaaaaaaaa

SEQ ID NO: 167077 - DNA, 9 bp, Unknown
  misc_feature (1)..( 9): Result.004 file - promoters50/1384016
agaaacaaa

SEQ ID NO: 167078 - DNA, 9 bp, Unknown
  misc_feature (1)..( 9): Result.004 file - promoters50/1384016
atgatgaaa

SEQ ID NO: 167079 - DNA, 14 bp, Unknown
  misc_feature (1)..( 14): Result.004 file - promoters50/1384016
atttgaaggcccaa

SEQ ID NO: 167080 - DNA, 14 bp, Unknown
  misc_feature (1)..( 14): Result.004 file - promoters50/1384016
tgtcataggcccat

SEQ ID NO: 167081 - DNA, 14 bp, Unknown
  misc_feature (1)..( 14): Result.004 file - promoters50/1384016
atttgatggcccat

SEQ ID NO: 167082 - DNA, 14 bp, Unknown
  misc_feature (1)..( 14): Result.004 file - promoters50/1384016
acctaaaggcccaa

SEQ ID NO: 167083 - DNA, 14 bp, Unknown
  misc_feature (1)..( 14): Result.004 file - promoters50/1384016
aaagtttgggccaa

SEQ ID NO: 167084 - DNA, 14 bp, Unknown
  misc_feature (1)..( 14): Result.004 file - promoters50/1384016
tatccttgggcttt

SEQ ID NO: 167085 - DNA, 14 bp, Unknown
  misc_feature (1)..( 14): Result.004 file - promoters50/1384016
ttttcttttaccct

SEQ ID NO: 167086 - DNA, 14 bp, Unknown
  misc_feature (1)..( 14): Result.004 file - promoters50/1384016
atttattttagatt

SEQ ID NO: 167087 - DNA, 14 bp, Unknown
  misc_feature (1)..( 14): Result.004 file - promoters50/1384016
taatcttttttaga

SEQ ID NO: 167088 - DNA, 14 bp, Unknown
  misc_feature (1)..( 14): Result.004 file - promoters50/1384016
catccttatacttc

SEQ ID NO: 167089 - DNA, 14 bp, Unknown
  misc_feature (1)..( 14): Result.004 file - promoters50/1384016
tttgcttctttgga

SEQ ID NO: 167090 - DNA, 14 bp, Unknown
  misc_feature (1)..( 14): Result.004 file - promoters50/1384016
ccctatattaaatt

SEQ ID NO: 167091 - DNA, 11 bp, Unknown
  misc_feature (1)..( 11): Result.004 file - promoters50/1384016
acatatatata

SEQ ID NO: 167092 - DNA, 11 bp, Unknown
  misc_feature (1)..( 11): Result.004 file - promoters50/1384016
ttataaatatt

SEQ ID NO: 167093 - DNA, 11 bp, Unknown
  misc_feature (1)..( 11): Result.004 file - promoters50/1384016
ttatacataat

SEQ ID NO: 167094 - DNA, 11 bp, Unknown
  misc_feature (1)..( 11): Result.004 file - promoters50/1384016
agacaaataga

SEQ ID NO: 167095 - DNA, 11 bp, Unknown
  misc_feature (1)..( 11): Result.004 file - promoters50/1384016
ttattaataaa

SEQ ID NO: 167096 - DNA, 11 bp, Unknown
  misc_feature (1)..( 11): Result.004 file - promoters50/1384016
gtttaaacatt

SEQ ID NO: 167097 - DNA, 10 bp, Unknown
  misc_feature (1)..( 10): Result.004 file - promoters50/1384016
taacaaaaaa

SEQ ID NO: 167098 - DNA, 10 bp, Unknown
  misc_feature (1)..( 10): Result.004 file - promoters50/1384016
tttcaaaaat

SEQ ID NO: 167099 - DNA, 10 bp, Unknown
  misc_feature (1)..( 10): Result.004 file - promoters50/1384016
tatgaaaaaa

SEQ ID NO: 167100 - DNA, 10 bp, Unknown
  misc_feature (1)..( 10): Result.004 file - promoters50/1384016
aaacaaaact

SEQ ID NO: 167101 - DNA, 10 bp, Unknown
  misc_feature (1)..( 10): Result.004 file - promoters50/1384016
ttttaaaatt

SEQ ID NO: 167102 - DNA, 10 bp, Unknown
  misc_feature (1)..( 10): Result.004 file - promoters50/1384016
atgtaaaaat

SEQ ID NO: 167103 - DNA, 15 bp, Unknown
  misc_feature (1)..( 15): Result.004 file - promoters50/1384016
tataaaaaatttttt

SEQ ID NO: 167104 - DNA, 15 bp, Unknown
  misc_feature (1)..( 15): Result.004 file - promoters50/1384016
aagaaaaaaaaaaaa

SEQ ID NO: 167105 - DNA, 15 bp, Unknown
  misc_feature (1)..( 15): Result.004 file - promoters50/1384016
gggaaagattaaaca

SEQ ID NO: 167106 - DNA, 15 bp, Unknown
  misc_feature (1)..( 15): Result.004 file - promoters50/1384016
atgaaatattttttt

SEQ ID NO: 167107 - DNA, 15 bp, Unknown
  misc_feature (1)..( 15): Result.004 file - promoters50/1384016
aagaaacaaagtaaa

SEQ ID NO: 167108 - DNA, 15 bp, Unknown
  misc_feature (1)..( 15): Result.004 file - promoters50/1384016
tagaaagaaataata

SEQ ID NO: 167109 - DNA, 12 bp, Unknown
  misc_feature (1)..( 12): Result.004 file - promoters50/1384016
ctttttttgttt

SEQ ID NO: 167110 - DNA, 12 bp, Unknown
  misc_feature (1)..( 12): Result.004 file - promoters50/1384016
cttttttttttt

SEQ ID NO: 167111 - DNA, 12 bp, Unknown
  misc_feature (1)..( 12): Result.004 file - promoters50/1384016
tgattttggttt

SEQ ID NO: 167112 - DNA, 12 bp, Unknown
  misc_feature (1)..( 12): Result.004 file - promoters50/1384016
acgtttttgtct

SEQ ID NO: 167113 - DNA, 12 bp, Unknown
  misc_feature (1)..( 12): Result.004 file - promoters50/1384016
atgtttttgctg

SEQ ID NO: 167114 - DNA, 12 bp, Unknown
  misc_feature (1)..( 12): Result.004 file - promoters50/1384161
gtttttcggtta

SEQ ID NO: 167115 - DNA, 9 bp, Unknown
  misc_feature (1)..( 9): Result.004 file - promoters50/1384161
ttttaacta

SEQ ID NO: 167116 - DNA, 9 bp, Unknown
  misc_feature (1)..( 9): Result.004 file - promoters50/1384161
tttgaactt

SEQ ID NO: 167117 - DNA, 9 bp, Unknown
  misc_feature (1)..( 9): Result.004 file - promoters50/1384161
ttttcactt

SEQ ID NO: 167118 - DNA, 9 bp, Unknown
  misc_feature (1)..( 9): Result.004 file - promoters50/1384161
aattaacta

SEQ ID NO: 167119 - DNA, 9 bp, Unknown
  misc_feature (1)..( 9): Result.004 file - promoters50/1384261
cctgaacta

SEQ ID NO: 167120 - DNA, 9 bp, Unknown
  misc_feature (1)..( 9): Result.004 file - promoters50/1384261
aaaagaaga

SEQ ID NO: 167121 - DNA, 9 bp, Unknown
  misc_feature (1)..( 9): Result.004 file - promoters50/1384261
caaaaaagc

SEQ ID NO: 167122 - DNA, 9 bp, Unknown
  misc_feature (1)..( 9): Result.004 file - promoters50/1384261
caaaaaaca

SEQ ID NO: 167123 - DNA, 9 bp, Unknown
  misc_feature (1)..( 9): Result.004 file - promoters50/1384261
gcaaaaagt

SEQ ID NO: 167124 - DNA, 9 bp, Unknown
  misc_feature (1)..( 9): Result.004 file - promoters50/1384261
aaaacaaca

SEQ ID NO: 167125 - DNA, 9 bp, Unknown
  misc_feature (1)..( 9): Result.004 file - promoters50/1384261
ttaaatagt

SEQ ID NO: 167126 - DNA, 10 bp, Unknown
  misc_feature (1)..( 10): Result.004 file - promoters50/1384261
actaatattt

SEQ ID NO: 167127 - DNA, 10 bp, Unknown
  misc_feature (1)..( 10): Result.004 file - promoters50/1384261
acttatagat

SEQ ID NO: 167128 - DNA, 10 bp, Unknown
  misc_feature (1)..( 10): Result.004 file - promoters50/1384261
cataacatta

SEQ ID NO: 167129 - DNA, 10 bp, Unknown
  misc_feature (1)..( 10): Result.004 file - promoters50/1384261
tctaacatgt

SEQ ID NO: 167130 - DNA, 10 bp, Unknown
  misc_feature (1)..( 10): Result.004 file - promoters50/1384261
cattatcgat

SEQ ID NO: 167131 - DNA, 10 bp, Unknown
  misc_feature (1)..( 10): Result.004 file - promoters50/1384261
ttttaccgac

SEQ ID NO: 167132 - DNA, 11 bp, Unknown
  misc_feature (1)..( 11): Result.004 file - promoters50/1384261
aaaaaagaaaa

SEQ ID NO: 167133 - DNA, 11 bp, Unknown
  misc_feature (1)..( 11): Result.004 file - promoters50/1384261
gctaaacaaaa

SEQ ID NO: 167134 - DNA, 11 bp, Unknown
  misc_feature (1)..( 11): Result.004 file - promoters50/1384261
tccaaaaaagc

SEQ ID NO: 167135 - DNA, 11 bp, Unknown
  misc_feature (1)..( 11): Result.004 file - promoters50/1384261
tgcaaaaagta

SEQ ID NO: 167136 - DNA, 11 bp, Unknown
  misc_feature (1)..( 11): Result.004 file - promoters50/1384261
tccaaaacaac

SEQ ID NO: 167137 - DNA, 11 bp, Unknown
  misc_feature (1)..( 11): Result.004 file - promoters50/1384261
attaaatagtt

SEQ ID NO: 167138 - DNA, 8 bp, Unknown
  misc_feature (1)..( 8): Result.004 file - promoters50/1384261
aaaaaagg

SEQ ID NO: 167139 - DNA, 8 bp, Unknown
  misc_feature (1)..( 8): Result.004 file - promoters50/1384261
aaaaaaat

SEQ ID NO: 167140 - DNA, 8 bp, Unknown
  misc_feature (1)..( 8): Result.004 file - promoters50/1384261
aaacaagt

SEQ ID NO: 167141 - DNA, 8 bp, Unknown
  misc_feature (1)..( 8): Result.004 file - promoters50/1384261
aaaaaata

SEQ ID NO: 167142 - DNA, 8 bp, Unknown
  misc_feature (1)..( 8): Result.004 file - promoters50/1384261
aaactagt

SEQ ID NO: 167143 - DNA, 8 bp, Unknown
  misc_feature (1)..( 8): Result.004 file - promoters50/1384261
aaaatatc

SEQ ID NO: 167144 - DNA, 10 bp, Unknown
  misc_feature (1)..( 10): Result.004 file - promoters50/1384261
caatttagct

SEQ ID NO: 167145 - DNA, 10 bp, Unknown
  misc_feature (1)..( 10): Result.004 file - promoters50/1384261
taatttaaaa

SEQ ID NO: 167146 - DNA, 10 bp, Unknown
  misc_feature (1)..( 10): Result.004 file - promoters50/1384261
aaatttaaaa

SEQ ID NO: 167147 - DNA, 10 bp, Unknown
  misc_feature (1)..( 10): Result.004 file - promoters50/1384261
taattttgac

SEQ ID NO: 167148 - DNA, 10 bp, Unknown
  misc_feature (1)..( 10): Result.004 file - promoters50/1384261
gtttttgatt

SEQ ID NO: 167149 - DNA, 10 bp, Unknown
  misc_feature (1)..( 10): Result.004 file - promoters50/1384261
aaaattaacc

SEQ ID NO: 167150 - DNA, 12 bp, Unknown
  misc_feature (1)..( 12): Result.004 file - promoters50/1384261
aacacaataaca

SEQ ID NO: 167151 - DNA, 12 bp, Unknown
  misc_feature (1)..( 12): Result.004 file - promoters50/1384261
aacaaaattaac

SEQ ID NO: 167152 - DNA, 12 bp, Unknown
  misc_feature (1)..( 12): Result.004 file - promoters50/1384261
atcacaatacat

SEQ ID NO: 167153 - DNA, 12 bp, Unknown
  misc_feature (1)..( 12): Result.004 file - promoters50/1384261
tttaaaattttc

SEQ ID NO: 167154 - DNA, 12 bp, Unknown
  misc_feature (1)..( 12): Result.004 file - promoters50/1384261
atcaaaatgaat

SEQ ID NO: 167155 - DNA, 12 bp, Unknown
  misc_feature (1)..( 12): Result.004 file - promoters50/1384329
tcttaaatttaa

SEQ ID NO: 167156 - DNA, 23 bp, Unknown
  misc_feature (1)..( 23): Result.004 file - promoters50/1384329
tttggttacatagtagtatgtat

SEQ ID NO: 167157 - DNA, 23 bp, Unknown
  misc_feature (1)..( 23): Result.004 file - promoters50/1384329
ttaagtaacatagactcacaaac

SEQ ID NO: 167158 - DNA, 23 bp, Unknown
  misc_feature (1)..( 23): Result.004 file - promoters50/1384329
attgtttaaataaaagtaactta

SEQ ID NO: 167159 - DNA, 23 bp, Unknown
  misc_feature (1)..( 23): Result.004 file - promoters50/1384329
attattttaatacgtacaaaagc

SEQ ID NO: 167160 - DNA, 23 bp, Unknown
  misc_feature (1)..( 23): Result.004 file - promoters50/1384329
aatcataaaataaaaaataaaaa

SEQ ID NO: 167161 - DNA, 23 bp, Unknown
  misc_feature (1)..( 23): Result.004 file - promoters50/1384329
tttgtttagtgtctaagttatat

SEQ ID NO: 167162 - DNA, 23 bp, Unknown
  misc_feature (1)..( 23): Result.004 file - promoters50/1384329
catcatcaaacaaaaataaatta

SEQ ID NO: 167163 - DNA, 12 bp, Unknown
  misc_feature (1)..( 12): Result.004 file - promoters50/1384329
tgaatattaaac

SEQ ID NO: 167164 - DNA, 12 bp, Unknown
  misc_feature (1)..( 12): Result.004 file - promoters50/1384329
tgactattatag

SEQ ID NO: 167165 - DNA, 12 bp, Unknown
  misc_feature (1)..( 12): Result.004 file - promoters50/1384329
aatataataaaa

SEQ ID NO: 167166 - DNA, 12 bp, Unknown
  misc_feature (1)..( 12): Result.004 file - promoters50/1384329
attatataatag

SEQ ID NO: 167167 - DNA, 12 bp, Unknown
  misc_feature (1)..( 12): Result.004 file - promoters50/1384329
cccctaaaaaaa

SEQ ID NO: 167168 - DNA, 12 bp, Unknown
  misc_feature (1)..( 12): Result.004 file - promoters50/1384329
tttgtatttaag

SEQ ID NO: 167169 - DNA, 8 bp, Unknown
  misc_feature (1)..( 8): Result.004 file - promoters50/1384329
atatttaa

SEQ ID NO: 167170 - DNA, 8 bp, Unknown
  misc_feature (1)..( 8): Result.004 file - promoters50/1384329
atattttg

SEQ ID NO: 167171 - DNA, 8 bp, Unknown
  misc_feature (1)..( 8): Result.004 file - promoters50/1384329
atatataa

SEQ ID NO: 167172 - DNA, 8 bp, Unknown
  misc_feature (1)..( 8): Result.004 file - promoters50/1384329
atacaata

SEQ ID NO: 167173 - DNA, 8 bp, Unknown
  misc_feature (1)..( 8): Result.004 file - promoters50/1384329
atatttat

SEQ ID NO: 167174 - DNA, 8 bp, Unknown
  misc_feature (1)..( 8): Result.004 file - promoters50/1384329
ttattttt

SEQ ID NO: 167175 - DNA, 12 bp, Unknown
  misc_feature (1)..( 12): Result.004 file - promoters50/1384329
attttaatatct

SEQ ID NO: 167176 - DNA, 12 bp, Unknown
  misc_feature (1)..( 12): Result.004 file - promoters50/1384329
tctataatatac

SEQ ID NO: 167177 - DNA, 12 bp, Unknown
  misc_feature (1)..( 12): Result.004 file - promoters50/1384329
tatataatagct

SEQ ID NO: 167178 - DNA, 12 bp, Unknown
  misc_feature (1)..( 12): Result.004 file - promoters50/1384329
ataataaaatgg

SEQ ID NO: 167179 - DNA, 12 bp, Unknown
  misc_feature (1)..( 12): Result.004 file - promoters50/1384329
cccctaaaaaaa

SEQ ID NO: 167180 - DNA, 12 bp, Unknown
  misc_feature (1)..( 12): Result.004 file - promoters50/1384329
tatttaagttga

SEQ ID NO: 167181 - DNA, 13 bp, Unknown
  misc_feature (1)..( 13): Result.004 file - promoters50/1384329
ctatttatacccc

SEQ ID NO: 167182 - DNA, 13 bp, Unknown
  misc_feature (1)..( 13): Result.004 file - promoters50/1384329
gtatttaaacccc

SEQ ID NO: 167183 - DNA, 13 bp, Unknown
  misc_feature (1)..( 13): Result.004 file - promoters50/1384329
ctatttataaatg

SEQ ID NO: 167184 - DNA, 13 bp, Unknown
  misc_feature (1)..( 13): Result.004 file - promoters50/1384329
cactttatataaa

SEQ ID NO: 167185 - DNA, 13 bp, Unknown
  misc_feature (1)..( 13): Result.004 file - promoters50/1384329
ctatatatacaca

SEQ ID NO: 167186 - DNA, 13 bp, Unknown
  misc_feature (1)..( 13): Result.004 file - promoters50/1384329
atataaatagact

SEQ ID NO: 167187 - DNA, 20 bp, Unknown
  misc_feature (1)..( 20): Result.004 file - promoters50/1384329
acattttcattattttaata

SEQ ID NO: 167188 - DNA, 11 bp, Unknown
  misc_feature (1)..( 11): Result.004 file - promoters50/1384329
ttatttgtgtt

SEQ ID NO: 167189 - DNA, 20 bp, Unknown
  misc_feature (1)..( 20): Result.004 file - promoters50/1384329
aaaacaaaattgtttaaata

SEQ ID NO: 167190 - DNA, 13 bp, Unknown
  misc_feature (1)..( 13): Result.004 file - promoters50/1384329
atcaaattaaatt

SEQ ID NO: 167191 - DNA, 20 bp, Unknown
  misc_feature (1)..( 20): Result.004 file - promoters50/1384329
aacatgtttttgtttagtgt

SEQ ID NO: 167192 - DNA, 20 bp, Unknown
  misc_feature (1)..( 20): Result.004 file - promoters50/1384329
aaacaaaaataaattatacg

SEQ ID NO: 167193 - DNA, 20 bp, Unknown
  misc_feature (1)..( 20): Result.004 file - promoters50/1384329
ataaaataaaaaataaaaat

SEQ ID NO: 167194 - DNA, 10 bp, Unknown
  misc_feature (1)..( 10): Result.004 file - promoters50/1384329
ttttaatctg

SEQ ID NO: 167195 - DNA, 10 bp, Unknown
  misc_feature (1)..( 10): Result.004 file - promoters50/1384329
ttttaatcat

SEQ ID NO: 167196 - DNA, 10 bp, Unknown
  misc_feature (1)..( 10): Result.004 file - promoters50/1384329
atttaattta

SEQ ID NO: 167197 - DNA, 10 bp, Unknown
  misc_feature (1)..( 10): Result.004 file - promoters50/1384329
ttttaatata

SEQ ID NO: 167198 - DNA, 10 bp, Unknown
  misc_feature (1)..( 10): Result.004 file - promoters50/1384329
ctttagtcaa

SEQ ID NO: 167199 - DNA, 10 bp, Unknown
  misc_feature (1)..( 10): Result.004 file - promoters50/1384329
gtttactata

SEQ ID NO: 167200 - DNA, 10 bp, Unknown
  misc_feature (1)..( 10): Result.004 file - promoters50/1384329
attattttag

SEQ ID NO: 167201 - DNA, 10 bp, Unknown
  misc_feature (1)..( 10): Result.004 file - promoters50/1384329
tgtatattat

SEQ ID NO: 167202 - DNA, 10 bp, Unknown
  misc_feature (1)..( 10): Result.004 file - promoters50/1384329
attatattat

SEQ ID NO: 167203 - DNA, 10 bp, Unknown
  misc_feature (1)..( 10): Result.004 file - promoters50/1384329
taaatattac

SEQ ID NO: 167204 - DNA, 10 bp, Unknown
  misc_feature (1)..( 10): Result.004 file - promoters50/1384329
cccatattat

SEQ ID NO: 167205 - DNA, 10 bp, Unknown
  misc_feature (1)..( 10): Result.004 file - promoters50/1384732
tttggtttat

SEQ ID NO: 167206 - DNA, 10 bp, Unknown
  misc_feature (1)..( 10): Result.004 file - promoters50/1384732
cacaacatag

SEQ ID NO: 167207 - DNA, 10 bp, Unknown
  misc_feature (1)..( 10): Result.004 file - promoters50/1384732
ctcaaaatat

SEQ ID NO: 167208 - DNA, 10 bp, Unknown
  misc_feature (1)..( 10): Result.004 file - promoters50/1384732
tccaagatag

SEQ ID NO: 167209 - DNA, 10 bp, Unknown
  misc_feature (1)..( 10): Result.004 file - promoters50/1384921
ctctaaataa

SEQ ID NO: 167210 - DNA, 10 bp, Unknown
  misc_feature (1)..( 10): Result.004 file - promoters50/1384921
catatataac

SEQ ID NO: 167211 - DNA, 10 bp, Unknown
  misc_feature (1)..( 10): Result.004 file - promoters50/1384921
aatatatatg

SEQ ID NO: 167212 - DNA, 10 bp, Unknown
  misc_feature (1)..( 10): Result.004 file - promoters50/1384921
actatgtaaa

SEQ ID NO: 167213 - DNA, 10 bp, Unknown
  misc_feature (1)..( 10): Result.004 file - promoters50/1384921
caaaaataaa

SEQ ID NO: 167214 - DNA, 10 bp, Unknown
  misc_feature (1)..( 10): Result.004 file - promoters50/1384921
gaaacatatc

SEQ ID NO: 167215 - DNA, 10 bp, Unknown
  misc_feature (1)..( 10): Result.004 file - promoters50/1384921
gacatgtcaa

SEQ ID NO: 167216 - DNA, 10 bp, Unknown
  misc_feature (1)..( 10): Result.004 file - promoters50/1385263
ttaaagtaaa

SEQ ID NO: 167217 - DNA, 6 bp, Unknown
  misc_feature (1)..( 6): Result.004 file - promoters50/1385263
gttaaa

SEQ ID NO: 167218 - DNA, 6 bp, Unknown
  misc_feature (1)..( 6): Result.004 file - promoters50/1385263
gttaaa

SEQ ID NO: 167219 - DNA, 7 bp, Unknown
  misc_feature (1)..( 7): Result.004 file - promoters50/1385263
gttcaaa

SEQ ID NO: 167220 - DNA, 8 bp, Unknown
  misc_feature (1)..( 8): Result.004 file - promoters50/1385263
ttgtgatg

SEQ ID NO: 167221 - DNA, 8 bp, Unknown
  misc_feature (1)..( 8): Result.004 file - promoters50/1385263
ttgttatg

SEQ ID NO: 167222 - DNA, 8 bp, Unknown
  misc_feature (1)..( 8): Result.004 file - promoters50/1385263
ttgggatt

SEQ ID NO: 167223 - DNA, 16 bp, Unknown
  misc_feature (1)..( 16): Result.004 file - promoters50/1385263
caactctaactaaaaa

SEQ ID NO: 167224 - DNA, 16 bp, Unknown
  misc_feature (1)..( 16): Result.004 file - promoters50/1385263
cattcatatgtaaaaa

SEQ ID NO: 167225 - DNA, 16 bp, Unknown
  misc_feature (1)..( 16): Result.004 file - promoters50/1385263
tttgttcacttaaatc

SEQ ID NO: 167226 - DNA, 16 bp, Unknown
  misc_feature (1)..( 16): Result.004 file - promoters50/1385263
ttttttcagttaatca

SEQ ID NO: 167227 - DNA, 8 bp, Unknown
  misc_feature (1)..( 8): Result.004 file - promoters50/1385263
aaaactaa

SEQ ID NO: 167228 - DNA, 8 bp, Unknown
  misc_feature (1)..( 8): Result.004 file - promoters50/1385263
aaaactgt

SEQ ID NO: 167229 - DNA, 8 bp, Unknown
  misc_feature (1)..( 8): Result.004 file - promoters50/1385263
aaaataaa

SEQ ID NO: 167230 - DNA, 12 bp, Unknown
  misc_feature (1)..( 12): Result.004 file - promoters50/1385263
ctccttccaaac

SEQ ID NO: 167231 - DNA, 12 bp, Unknown
  misc_feature (1)..( 12): Result.004 file - promoters50/1385263
gtccatcccaac

SEQ ID NO: 167232 - DNA, 12 bp, Unknown
  misc_feature (1)..( 12): Result.004 file - promoters50/1385263
gtcaatccttct

SEQ ID NO: 167233 - DNA, 7 bp, Unknown
  misc_feature (1)..( 7): Result.004 file - promoters50/1385263
agatttt

SEQ ID NO: 167234 - DNA, 7 bp, Unknown
  misc_feature (1)..( 7): Result.004 file - promoters50/1385263
agattta

SEQ ID NO: 167235 - DNA, 7 bp, Unknown
  misc_feature (1)..( 7): Result.004 file - promoters50/1385263
agactta

SEQ ID NO: 167236 - DNA, 10 bp, Unknown
  misc_feature (1)..( 10): Result.004 file - promoters50/1385263
tgttttattt

SEQ ID NO: 167237 - DNA, 10 bp, Unknown
  misc_feature (1)..( 10): Result.004 file - promoters50/1385263
tgttttctta

SEQ ID NO: 167238 - DNA, 10 bp, Unknown
  misc_feature (1)..( 10): Result.004 file - promoters50/1385263
cgtttttttt

SEQ ID NO: 167239 - DNA, 9 bp, Unknown
  misc_feature (1)..( 9): Result.004 file - promoters50/1385263
ttcacttgt

SEQ ID NO: 167240 - DNA, 9 bp, Unknown
  misc_feature (1)..( 9): Result.004 file - promoters50/1385263
ttctcttga

SEQ ID NO: 167241 - DNA, 9 bp, Unknown
  misc_feature (1)..( 9): Result.004 file - promoters50/1385347
tccacgtgt

SEQ ID NO: 167242 - DNA, 10 bp, Unknown
  misc_feature (1)..( 10): Result.004 file - promoters50/1385347
ataattttta

SEQ ID NO: 167243 - DNA, 10 bp, Unknown
  misc_feature (1)..( 10): Result.004 file - promoters50/1385347
gtaattttct

SEQ ID NO: 167244 - DNA, 10 bp, Unknown
  misc_feature (1)..( 10): Result.004 file - promoters50/1385347
atagtttaga

SEQ ID NO: 167245 - DNA, 10 bp, Unknown
  misc_feature (1)..( 10): Result.004 file - promoters50/1385347
gaaatgttca

SEQ ID NO: 167246 - DNA, 10 bp, Unknown
  misc_feature (1)..( 10): Result.004 file - promoters50/1385347
tgaatcttct

SEQ ID NO: 167247 - DNA, 10 bp, Unknown
  misc_feature (1)..( 10): Result.004 file - promoters50/1385347
aaaatgtgaa

SEQ ID NO: 167248 - DNA, 15 bp, Unknown
  misc_feature (1)..( 15): Result.004 file - promoters50/1385347
atagctaaagtctat

SEQ ID NO: 167249 - DNA, 15 bp, Unknown
  misc_feature (1)..( 15): Result.004 file - promoters50/1385347
aaatctaaattctta

SEQ ID NO: 167250 - DNA, 15 bp, Unknown
  misc_feature (1)..( 15): Result.004 file - promoters50/1385347
gaagctaaaacaacg

SEQ ID NO: 167251 - DNA, 15 bp, Unknown
  misc_feature (1)..( 15): Result.004 file - promoters50/1385347
cccatttcattttta

SEQ ID NO: 167252 - DNA, 15 bp, Unknown
  misc_feature (1)..( 15): Result.004 file - promoters50/1385347
tatcttcaatttaac

SEQ ID NO: 167253 - DNA, 15 bp, Unknown
  misc_feature (1)..( 15): Result.004 file - promoters50/1385347
gaaactaaaattatt

SEQ ID NO: 167254 - DNA, 15 bp, Unknown
  misc_feature (1)..( 15): Result.004 file - promoters50/1385347
taagtaactttttta

SEQ ID NO: 167255 - DNA, 13 bp, Unknown
  misc_feature (1)..( 13): Result.004 file - promoters50/1385347
aaaaataattttt

SEQ ID NO: 167256 - DNA, 13 bp, Unknown
  misc_feature (1)..( 13): Result.004 file - promoters50/1385347
acaaaaaatgtga

SEQ ID NO: 167257 - DNA, 13 bp, Unknown
  misc_feature (1)..( 13): Result.004 file - promoters50/1385347
gaaaataaatata

SEQ ID NO: 167258 - DNA, 13 bp, Unknown
  misc_feature (1)..( 13): Result.004 file - promoters50/1385347
cttgatagtttag

SEQ ID NO: 167259 - DNA, 13 bp, Unknown
  misc_feature (1)..( 13): Result.004 file - promoters50/1385347
acaaactgtgaaa

SEQ ID NO: 167260 - DNA, 13 bp, Unknown
  misc_feature (1)..( 13): Result.004 file - promoters50/1385347
taacacagaaatg

SEQ ID NO: 167261 - DNA, 13 bp, Unknown
  misc_feature (1)..( 13): Result.004 file - promoters50/1385376
agaaatgaaggaa

SEQ ID NO: 167262 - DNA, 9 bp, Unknown
  misc_feature (1)..( 9): Result.004 file - promoters50/1385376
taaaaaatt

SEQ ID NO: 167263 - DNA, 9 bp, Unknown
  misc_feature (1)..( 9): Result.004 file - promoters50/1385376
taaaagatt

SEQ ID NO: 167264 - DNA, 9 bp, Unknown
  misc_feature (1)..( 9): Result.004 file - promoters50/1385376
gataagatt

SEQ ID NO: 167265 - DNA, 7 bp, Unknown
  misc_feature (1)..( 7): Result.004 file - promoters50/1385376
ttggttt

SEQ ID NO: 167266 - DNA, 7 bp, Unknown
  misc_feature (1)..( 7): Result.004 file - promoters50/1385376
ttgattt

SEQ ID NO: 167267 - DNA, 7 bp, Unknown
  misc_feature (1)..( 7): Result.004 file - promoters50/1385376
ttggttg

SEQ ID NO: 167268 - DNA, 9 bp, Unknown
  misc_feature (1)..( 9): Result.004 file - promoters50/1385376
tttgatttt

SEQ ID NO: 167269 - DNA, 9 bp, Unknown
  misc_feature (1)..( 9): Result.004 file - promoters50/1385376
tttggtttt

SEQ ID NO: 167270 - DNA, 9 bp, Unknown
  misc_feature (1)..( 9): Result.004 file - promoters50/1385655
cttggttgg

SEQ ID NO: 167271 - DNA, 19 bp, Unknown
  misc_feature (1)..( 19): Result.004 file - promoters50/1385655
atttttttgtctaggtttt

SEQ ID NO: 167272 - DNA, 19 bp, Unknown
  misc_feature (1)..( 19): Result.004 file - promoters50/1385655
atttttttttctatgtttt

SEQ ID NO: 167273 - DNA, 19 bp, Unknown
  misc_feature (1)..( 19): Result.004 file - promoters50/1386125
gctcgattctagtggtttt

SEQ ID NO: 167274 - DNA, 10 bp, Unknown
  misc_feature (1)..( 10): Result.004 file - promoters50/1386125
atttccagct

SEQ ID NO: 167275 - DNA, 10 bp, Unknown
  misc_feature (1)..( 10): Result.004 file - promoters50/1386125
attttcagta

SEQ ID NO: 167276 - DNA, 10 bp, Unknown
  misc_feature (1)..( 10): Result.004 file - promoters50/1386215
cttttaagta

SEQ ID NO: 167277 - DNA, 10 bp, Unknown
  misc_feature (1)..( 10): Result.004 file - promoters50/1386215
aaaatgtgaa

SEQ ID NO: 167278 - DNA, 10 bp, Unknown
  misc_feature (1)..( 10): Result.004 file - promoters50/1386215
aaaatttgaa

SEQ ID NO: 167279 - DNA, 10 bp, Unknown
  misc_feature (1)..( 10): Result.004 file - promoters50/1386215
agaatttgac

SEQ ID NO: 167280 - DNA, 10 bp, Unknown
  misc_feature (1)..( 10): Result.004 file - promoters50/1386215
caaatgttgc

SEQ ID NO: 167281 - DNA, 10 bp, Unknown
  misc_feature (1)..( 10): Result.004 file - promoters50/1386215
aaaatgtatc

SEQ ID NO: 167282 - DNA, 10 bp, Unknown
  misc_feature (1)..( 10): Result.004 file - promoters50/1386215
aaaatgttat

SEQ ID NO: 167283 - DNA, 12 bp, Unknown
  misc_feature (1)..( 12): Result.004 file - promoters50/1386215
attcataatttg

SEQ ID NO: 167284 - DNA, 12 bp, Unknown
  misc_feature (1)..( 12): Result.004 file - promoters50/1386215
gttcaaaatttt

SEQ ID NO: 167285 - DNA, 12 bp, Unknown
  misc_feature (1)..( 12): Result.004 file - promoters50/1386215
aaatgtaatttg

SEQ ID NO: 167286 - DNA, 12 bp, Unknown
  misc_feature (1)..( 12): Result.004 file - promoters50/1386215
attcatgaccaa

SEQ ID NO: 167287 - DNA, 12 bp, Unknown
  misc_feature (1)..( 12): Result.004 file - promoters50/1386215
aggaaaaattac

SEQ ID NO: 167288 - DNA, 12 bp, Unknown
  misc_feature (1)..( 12): Result.004 file - promoters50/1386387
aaccaaaattgt

SEQ ID NO: 167289 - DNA, 9 bp, Unknown
  misc_feature (1)..( 9): Result.004 file - promoters50/1386387
cttttctgc

SEQ ID NO: 167290 - DNA, 9 bp, Unknown
  misc_feature (1)..( 9): Result.004 file - promoters50/1386387
gctttttgc

SEQ ID NO: 167291 - DNA, 9 bp, Unknown
  misc_feature (1)..( 9): Result.004 file - promoters50/1386444
tcttcctct

SEQ ID NO: 167292 - DNA, 10 bp, Unknown
  misc_feature (1)..( 10): Result.004 file - promoters50/1386444
aagttttttt

SEQ ID NO: 167293 - DNA, 10 bp, Unknown
  misc_feature (1)..( 10): Result.004 file - promoters50/1386444
atgtttcttt

SEQ ID NO: 167294 - DNA, 10 bp, Unknown
  misc_feature (1)..( 10): Result.004 file - promoters50/1386444
aagcttttaa

SEQ ID NO: 167295 - DNA, 7 bp, Unknown
  misc_feature (1)..( 7): Result.004 file - promoters50/1386444
aacagat

SEQ ID NO: 167296 - DNA, 7 bp, Unknown
  misc_feature (1)..( 7): Result.004 file - promoters50/1386444
aacagaa

SEQ ID NO: 167297 - DNA, 7 bp, Unknown
  misc_feature (1)..( 7): Result.004 file - promoters50/1386444
aaccgat

SEQ ID NO: 167298 - DNA, 8 bp, Unknown
  misc_feature (1)..( 8): Result.004 file - promoters50/1386444
taaagttt

SEQ ID NO: 167299 - DNA, 8 bp, Unknown
  misc_feature (1)..( 8): Result.004 file - promoters50/1386444
taaatttt

SEQ ID NO: 167300 - DNA, 8 bp, Unknown
  misc_feature (1)..( 8): Result.004 file - promoters50/1386444
taaattcg

SEQ ID NO: 167301 - DNA, 6 bp, Unknown
  misc_feature (1)..( 6): Result.004 file - promoters50/1386444
acattt

SEQ ID NO: 167302 - DNA, 6 bp, Unknown
  misc_feature (1)..( 6): Result.004 file - promoters50/1386444
acattt

SEQ ID NO: 167303 - DNA, 6 bp, Unknown
  misc_feature (1)..( 6): Result.004 file - promoters50/1386444
acattt

SEQ ID NO: 167304 - DNA, 8 bp, Unknown
  misc_feature (1)..( 8): Result.004 file - promoters50/1386444
gagaagca

SEQ ID NO: 167305 - DNA, 8 bp, Unknown
  misc_feature (1)..( 8): Result.004 file - promoters50/1386444
aagaggca

SEQ ID NO: 167306 - DNA, 8 bp, Unknown
  misc_feature (1)..( 8): Result.004 file - promoters50/1386609
aagaggtc

SEQ ID NO: 167307 - DNA, 8 bp, Unknown
  misc_feature (1)..( 8): Result.004 file - promoters50/1386609
acaagata

SEQ ID NO: 167308 - DNA, 8 bp, Unknown
  misc_feature (1)..( 8): Result.004 file - promoters50/1386609
acatgatt

SEQ ID NO: 167309 - DNA, 8 bp, Unknown
  misc_feature (1)..( 8): Result.004 file - promoters50/1386609
ggaagata

SEQ ID NO: 167310 - DNA, 10 bp, Unknown
  misc_feature (1)..( 10): Result.004 file - promoters50/1386609
tttgatgatt

SEQ ID NO: 167311 - DNA, 10 bp, Unknown
  misc_feature (1)..( 10): Result.004 file - promoters50/1386609
tttgatgatg

SEQ ID NO: 167312 - DNA, 10 bp, Unknown
  misc_feature (1)..( 10): Result.004 file - promoters50/1386609
agtgaggatg

SEQ ID NO: 167313 - DNA, 8 bp, Unknown
  misc_feature (1)..( 8): Result.004 file - promoters50/1386609
tgttattg

SEQ ID NO: 167314 - DNA, 8 bp, Unknown
  misc_feature (1)..( 8): Result.004 file - promoters50/1386609
tgtttttg

SEQ ID NO: 167315 - DNA, 8 bp, Unknown
  misc_feature (1)..( 8): Result.004 file - promoters50/1386628
tggtattt

SEQ ID NO: 167316 - DNA, 10 bp, Unknown
  misc_feature (1)..( 10): Result.004 file - promoters50/1386628
gttttttatg

SEQ ID NO: 167317 - DNA, 10 bp, Unknown
  misc_feature (1)..( 10): Result.004 file - promoters50/1386628
atttcttact

SEQ ID NO: 167318 - DNA, 10 bp, Unknown
  misc_feature (1)..( 10): Result.004 file - promoters50/1386628
atttgttaat

SEQ ID NO: 167319 - DNA, 10 bp, Unknown
  misc_feature (1)..( 10): Result.004 file - promoters50/1386628
atttcttaca

SEQ ID NO: 167320 - DNA, 10 bp, Unknown
  misc_feature (1)..( 10): Result.004 file - promoters50/1386628
agttgataat

SEQ ID NO: 167321 - DNA, 10 bp, Unknown
  misc_feature (1)..( 10): Result.004 file - promoters50/1386749
gtttgttgac

SEQ ID NO: 167322 - DNA, 10 bp, Unknown
  misc_feature (1)..( 10): Result.004 file - promoters50/1386749
atctaaattt

SEQ ID NO: 167323 - DNA, 10 bp, Unknown
  misc_feature (1)..( 10): Result.004 file - promoters50/1386749
ttctcaattt

SEQ ID NO: 167324 - DNA, 10 bp, Unknown
  misc_feature (1)..( 10): Result.004 file - promoters50/1386749
atcaaaatat

SEQ ID NO: 167325 - DNA, 10 bp, Unknown
  misc_feature (1)..( 10): Result.004 file - promoters50/1386749
gtttaaattg

SEQ ID NO: 167326 - DNA, 10 bp, Unknown
  misc_feature (1)..( 10): Result.004 file - promoters50/1386749
taaaaaaaaa

SEQ ID NO: 167327 - DNA, 10 bp, Unknown
  misc_feature (1)..( 10): Result.004 file - promoters50/1386749
caaaacaaaa

SEQ ID NO: 167328 - DNA, 10 bp, Unknown
  misc_feature (1)..( 10): Result.004 file - promoters50/1386749
caaaacccga

SEQ ID NO: 167329 - DNA, 9 bp, Unknown
  misc_feature (1)..( 9): Result.004 file - promoters50/1386749
tatcagcta

SEQ ID NO: 167330 - DNA, 9 bp, Unknown
  misc_feature (1)..( 9): Result.004 file - promoters50/1386749
tattagcta

SEQ ID NO: 167331 - DNA, 9 bp, Unknown
  misc_feature (1)..( 9): Result.004 file - promoters50/1386749
tattagatc

SEQ ID NO: 167332 - DNA, 7 bp, Unknown
  misc_feature (1)..( 7): Result.004 file - promoters50/1386749
taaatta

SEQ ID NO: 167333 - DNA, 7 bp, Unknown
  misc_feature (1)..( 7): Result.004 file - promoters50/1386749
taaattg

SEQ ID NO: 167334 - DNA, 7 bp, Unknown
  misc_feature (1)..( 7): Result.004 file - promoters50/1386778
caaattg

SEQ ID NO: 167335 - DNA, 9 bp, Unknown
  misc_feature (1)..( 9): Result.004 file - promoters50/1386778
aaacaaaaa

SEQ ID NO: 167336 - DNA, 9 bp, Unknown
  misc_feature (1)..( 9): Result.004 file - promoters50/1386778
aaacaaaaa

SEQ ID NO: 167337 - DNA, 9 bp, Unknown
  misc_feature (1)..( 9): Result.004 file - promoters50/1386778
aaagaaagc

SEQ ID NO: 167338 - DNA, 9 bp, Unknown
  misc_feature (1)..( 9): Result.004 file - promoters50/1386778
acaaagaac

SEQ ID NO: 167339 - DNA, 9 bp, Unknown
  misc_feature (1)..( 9): Result.004 file - promoters50/1386778
gaaaagaaa

SEQ ID NO: 167340 - DNA, 10 bp, Unknown
  misc_feature (1)..( 10): Result.004 file - promoters50/1386778
ggaaatgaaa

SEQ ID NO: 167341 - DNA, 14 bp, Unknown
  misc_feature (1)..( 14): Result.004 file - promoters50/1386778
taataaaaaaaagg

SEQ ID NO: 167342 - DNA, 14 bp, Unknown
  misc_feature (1)..( 14): Result.004 file - promoters50/1386778
gtatataaacaagg

SEQ ID NO: 167343 - DNA, 14 bp, Unknown
  misc_feature (1)..( 14): Result.004 file - promoters50/1386786
gtatatatttattt

SEQ ID NO: 167344 - DNA, 9 bp, Unknown
  misc_feature (1)..( 9): Result.004 file - promoters50/1386786
tttttaatt

SEQ ID NO: 167345 - DNA, 9 bp, Unknown
  misc_feature (1)..( 9): Result.004 file - promoters50/1386786
attttcatt

SEQ ID NO: 167346 - DNA, 9 bp, Unknown
  misc_feature (1)..( 9): Result.004 file - promoters50/1386786
tttttaatt

SEQ ID NO: 167347 - DNA, 9 bp, Unknown
  misc_feature (1)..( 9): Result.004 file - promoters50/1386786
gtttccata

SEQ ID NO: 167348 - DNA, 9 bp, Unknown
  misc_feature (1)..( 9): Result.004 file - promoters50/1386861
gatttatta

SEQ ID NO: 167349 - DNA, 10 bp, Unknown
  misc_feature (1)..( 10): Result.004 file - promoters50/1386861
ttaatttata

SEQ ID NO: 167350 - DNA, 10 bp, Unknown
  misc_feature (1)..( 10): Result.004 file - promoters50/1386861
ctaaattatc

SEQ ID NO: 167351 - DNA, 10 bp, Unknown
  misc_feature (1)..( 10): Result.004 file - promoters50/1386861
atcattcata

SEQ ID NO: 167352 - DNA, 10 bp, Unknown
  misc_feature (1)..( 10): Result.004 file - promoters50/1386861
gagattgata

SEQ ID NO: 167353 - DNA, 10 bp, Unknown
  misc_feature (1)..( 10): Result.004 file - promoters50/1387088
ttaatttgat

SEQ ID NO: 167354 - DNA, 11 bp, Unknown
  misc_feature (1)..( 11): Result.004 file - promoters50/1387088
agataaagtaa

SEQ ID NO: 167355 - DNA, 11 bp, Unknown
  misc_feature (1)..( 11): Result.004 file - promoters50/1387088
agattaagggt

SEQ ID NO: 167356 - DNA, 11 bp, Unknown
  misc_feature (1)..( 11): Result.004 file - promoters50/1387117
ccattaaaggt

SEQ ID NO: 167357 - DNA, 10 bp, Unknown
  misc_feature (1)..( 10): Result.004 file - promoters50/1387117
agataattta

SEQ ID NO: 167358 - DNA, 10 bp, Unknown
  misc_feature (1)..( 10): Result.004 file - promoters50/1387117
agaaaatttc

SEQ ID NO: 167359 - DNA, 10 bp, Unknown
  misc_feature (1)..( 10): Result.004 file - promoters50/1387117
gacaaattta

SEQ ID NO: 167360 - DNA, 14 bp, Unknown
  misc_feature (1)..( 14): Result.004 file - promoters50/1387117
caaccaaaaaacct

SEQ ID NO: 167361 - DNA, 14 bp, Unknown
  misc_feature (1)..( 14): Result.004 file - promoters50/1387117
aatccaaaatggac

SEQ ID NO: 167362 - DNA, 14 bp, Unknown
  misc_feature (1)..( 14): Result.004 file - promoters50/1387117
aatccacaattgac

SEQ ID NO: 167363 - DNA, 10 bp, Unknown
  misc_feature (1)..( 10): Result.004 file - promoters50/1387117
aaaaaaaaaa

SEQ ID NO: 167364 - DNA, 10 bp, Unknown
  misc_feature (1)..( 10): Result.004 file - promoters50/1387117
aaaaagaaaa

SEQ ID NO: 167365 - DNA, 10 bp, Unknown
  misc_feature (1)..( 10): Result.004 file - promoters50/1387117
gaaaagatca

SEQ ID NO: 167366 - DNA, 10 bp, Unknown
  misc_feature (1)..( 10): Result.004 file - promoters50/1387117
gatatgatat

SEQ ID NO: 167367 - DNA, 10 bp, Unknown
  misc_feature (1)..( 10): Result.004 file - promoters50/1387117
tatataatat

SEQ ID NO: 167368 - DNA, 10 bp, Unknown
  misc_feature (1)..( 10): Result.004 file - promoters50/1387123
tatataatcc

SEQ ID NO: 167369 - DNA, 12 bp, Unknown
  misc_feature (1)..( 12): Result.004 file - promoters50/1387123
gcctcaacgaaa

SEQ ID NO: 167370 - DNA, 12 bp, Unknown
  misc_feature (1)..( 12): Result.004 file - promoters50/1387123
cttgtaacgaac

SEQ ID NO: 167371 - DNA, 12 bp, Unknown
  misc_feature (1)..( 12): Result.004 file - promoters50/1387123
gaaccaactaaa

SEQ ID NO: 167372 - DNA, 12 bp, Unknown
  misc_feature (1)..( 12): Result.004 file - promoters50/1387123
aacataacaaaa

SEQ ID NO: 167373 - DNA, 12 bp, Unknown
  misc_feature (1)..( 12): Result.004 file - promoters50/1387123
atatcaataata

SEQ ID NO: 167374 - DNA, 15 bp, Unknown
  misc_feature (1)..( 15): Result.004 file - promoters50/1387123
aaataattttcaaag

SEQ ID NO: 167375 - DNA, 15 bp, Unknown
  misc_feature (1)..( 15): Result.004 file - promoters50/1387123
aaatcattttttccg

SEQ ID NO: 167376 - DNA, 15 bp, Unknown
  misc_feature (1)..( 15): Result.004 file - promoters50/1387123
ttctaatttaattat

SEQ ID NO: 167377 - DNA, 15 bp, Unknown
  misc_feature (1)..( 15): Result.004 file - promoters50/1387123
cgttaatttcattta

SEQ ID NO: 167378 - DNA, 15 bp, Unknown
  misc_feature (1)..( 15): Result.004 file - promoters50/1387123
atcaaatttcatctg

SEQ ID NO: 167379 - DNA, 15 bp, Unknown
  misc_feature (1)..( 15): Result.004 file - promoters50/1387123
atgcaatttgattat

SEQ ID NO: 167380 - DNA, 9 bp, Unknown
  misc_feature (1)..( 9): Result.004 file - promoters50/1387123
attattata

SEQ ID NO: 167381 - DNA, 9 bp, Unknown
  misc_feature (1)..( 9): Result.004 file - promoters50/1387123
actatcata

SEQ ID NO: 167382 - DNA, 9 bp, Unknown
  misc_feature (1)..( 9): Result.004 file - promoters50/1387123
tcaatcata

SEQ ID NO: 167383 - DNA, 9 bp, Unknown
  misc_feature (1)..( 9): Result.004 file - promoters50/1387123
acaaacata

SEQ ID NO: 167384 - DNA, 9 bp, Unknown
  misc_feature (1)..( 9): Result.004 file - promoters50/1387123
tcaataata

SEQ ID NO: 167385 - DNA, 10 bp, Unknown
  misc_feature (1)..( 10): Result.004 file - promoters50/1387123
aaatgaaaaa

SEQ ID NO: 167386 - DNA, 10 bp, Unknown
  misc_feature (1)..( 10): Result.004 file - promoters50/1387123
aaattaaaac

SEQ ID NO: 167387 - DNA, 10 bp, Unknown
  misc_feature (1)..( 10): Result.004 file - promoters50/1387123
aaattaaaac

SEQ ID NO: 167388 - DNA, 11 bp, Unknown
  misc_feature (1)..( 11): Result.004 file - promoters50/1387123
aaagttacaaa

SEQ ID NO: 167389 - DNA, 11 bp, Unknown
  misc_feature (1)..( 11): Result.004 file - promoters50/1387123
agtatttaatt

SEQ ID NO: 167390 - DNA, 10 bp, Unknown
  misc_feature (1)..( 10): Result.004 file - promoters50/1387123
tcaaccatag

SEQ ID NO: 167391 - DNA, 10 bp, Unknown
  misc_feature (1)..( 10): Result.004 file - promoters50/1387123
acaaacataa

SEQ ID NO: 167392 - DNA, 10 bp, Unknown
  misc_feature (1)..( 10): Result.004 file - promoters50/1387123
tcaatcatat

SEQ ID NO: 167393 - DNA, 10 bp, Unknown
  misc_feature (1)..( 10): Result.004 file - promoters50/1387123
actatcataa

SEQ ID NO: 167394 - DNA, 10 bp, Unknown
  misc_feature (1)..( 10): Result.004 file - promoters50/1387123
aaaaaaataa

SEQ ID NO: 167395 - DNA, 11 bp, Unknown
  misc_feature (1)..( 11): Result.004 file - promoters50/1387123
tataatttatt

SEQ ID NO: 167396 - DNA, 11 bp, Unknown
  misc_feature (1)..( 11): Result.004 file - promoters50/1387123
tatatttttta

SEQ ID NO: 167397 - DNA, 11 bp, Unknown
  misc_feature (1)..( 11): Result.004 file - promoters50/1387123
tctaatttaat

SEQ ID NO: 167398 - DNA, 11 bp, Unknown
  misc_feature (1)..( 11): Result.004 file - promoters50/1387123
gttaatttcat

SEQ ID NO: 167399 - DNA, 11 bp, Unknown
  misc_feature (1)..( 11): Result.004 file - promoters50/1387140
tcaaatttcat

SEQ ID NO: 167400 - DNA, 8 bp, Unknown
  misc_feature (1)..( 8): Result.004 file - promoters50/1387140
gagtattt

SEQ ID NO: 167401 - DNA, 8 bp, Unknown
  misc_feature (1)..( 8): Result.004 file - promoters50/1387140
gagtataa

SEQ ID NO: 167402 - DNA, 8 bp, Unknown
  misc_feature (1)..( 8): Result.004 file - promoters50/1387140
cagttttt

SEQ ID NO: 167403 - DNA, 7 bp, Unknown
  misc_feature (1)..( 7): Result.004 file - promoters50/1387140
atgaaaa

SEQ ID NO: 167404 - DNA, 7 bp, Unknown
  misc_feature (1)..( 7): Result.004 file - promoters50/1387140
ttgaaaa

SEQ ID NO: 167405 - DNA, 7 bp, Unknown
  misc_feature (1)..( 7): Result.004 file - promoters50/1387194
ttgaaat

SEQ ID NO: 167406 - DNA, 9 bp, Unknown
  misc_feature (1)..( 9): Result.004 file - promoters50/1387194
ctttttatt

SEQ ID NO: 167407 - DNA, 9 bp, Unknown
  misc_feature (1)..( 9): Result.004 file - promoters50/1387194
attttaatt

SEQ ID NO: 167408 - DNA, 9 bp, Unknown
  misc_feature (1)..( 9): Result.004 file - promoters50/1387194
attgtaaaa

SEQ ID NO: 167409 - DNA, 9 bp, Unknown
  misc_feature (1)..( 9): Result.004 file - promoters50/1387211
aatgtaaac

SEQ ID NO: 167410 - DNA, 13 bp, Unknown
  misc_feature (1)..( 13): Result.004 file - promoters50/1387211
gattttaataaaa

SEQ ID NO: 167411 - DNA, 13 bp, Unknown
  misc_feature (1)..( 13): Result.004 file - promoters50/1387211
tttttcaattcca

SEQ ID NO: 167412 - DNA, 13 bp, Unknown
  misc_feature (1)..( 13): Result.004 file - promoters50/1387211
gatcttaattcgt

SEQ ID NO: 167413 - DNA, 13 bp, Unknown
  misc_feature (1)..( 13): Result.004 file - promoters50/1387211
tatgttaacaaaa

SEQ ID NO: 167414 - DNA, 13 bp, Unknown
  misc_feature (1)..( 13): Result.004 file - promoters50/1387211
tattctaaaaagt

SEQ ID NO: 167415 - DNA, 13 bp, Unknown
  misc_feature (1)..( 13): Result.004 file - promoters50/1387211
tttattaacaaac

SEQ ID NO: 167416 - DNA, 8 bp, Unknown
  misc_feature (1)..( 8): Result.004 file - promoters50/1387211
tattttat

SEQ ID NO: 167417 - DNA, 8 bp, Unknown
  misc_feature (1)..( 8): Result.004 file - promoters50/1387211
aattatat

SEQ ID NO: 167418 - DNA, 8 bp, Unknown
  misc_feature (1)..( 8): Result.004 file - promoters50/1387211
tatttttg

SEQ ID NO: 167419 - DNA, 8 bp, Unknown
  misc_feature (1)..( 8): Result.004 file - promoters50/1387211
gatttttt

SEQ ID NO: 167420 - DNA, 8 bp, Unknown
  misc_feature (1)..( 8): Result.004 file - promoters50/1387211
tatttttg

SEQ ID NO: 167421 - DNA, 8 bp, Unknown
  misc_feature (1)..( 8): Result.004 file - promoters50/1387265
gatttttg

SEQ ID NO: 167422 - DNA, 7 bp, Unknown
  misc_feature (1)..( 7): Result.004 file - promoters50/1387265
ctgatga

SEQ ID NO: 167423 - DNA, 7 bp, Unknown
  misc_feature (1)..( 7): Result.004 file - promoters50/1387265
ctgatgt

SEQ ID NO: 167424 - DNA, 7 bp, Unknown
  misc_feature (1)..( 7): Result.004 file - promoters50/1387336
atgatga

SEQ ID NO: 167425 - DNA, 8 bp, Unknown
  misc_feature (1)..( 8): Result.004 file - promoters50/1387336
cttcaaat

SEQ ID NO: 167426 - DNA, 8 bp, Unknown
  misc_feature (1)..( 8): Result.004 file - promoters50/1387336
attcaaat

SEQ ID NO: 167427 - DNA, 8 bp, Unknown
  misc_feature (1)..( 8): Result.004 file - promoters50/1387349
attcaagc

SEQ ID NO: 167428 - DNA, 12 bp, Unknown
  misc_feature (1)..( 12): Result.004 file - promoters50/1387349
tacagagtcgtg

SEQ ID NO: 167429 - DNA, 12 bp, Unknown
  misc_feature (1)..( 12): Result.004 file - promoters50/1387349
gacaaagtatct

SEQ ID NO: 167430 - DNA, 12 bp, Unknown
  misc_feature (1)..( 12): Result.004 file - promoters50/1387349
gacaaaaacaaa

SEQ ID NO: 167431 - DNA, 12 bp, Unknown
  misc_feature (1)..( 12): Result.004 file - promoters50/1387349
tttaaaatatat

SEQ ID NO: 167432 - DNA, 12 bp, Unknown
  misc_feature (1)..( 12): Result.004 file - promoters50/1387349
aggaaaacataa

SEQ ID NO: 167433 - DNA, 12 bp, Unknown
  misc_feature (1)..( 12): Result.004 file - promoters50/1387349
gaacaaatatat

SEQ ID NO: 167434 - DNA, 15 bp, Unknown
  misc_feature (1)..( 15): Result.004 file - promoters50/1387349
gctaaacaaaaactc

SEQ ID NO: 167435 - DNA, 15 bp, Unknown
  misc_feature (1)..( 15): Result.004 file - promoters50/1387349
atctcacaaagacta

SEQ ID NO: 167436 - DNA, 15 bp, Unknown
  misc_feature (1)..( 15): Result.004 file - promoters50/1387349
aaagactaaaaactc

SEQ ID NO: 167437 - DNA, 15 bp, Unknown
  misc_feature (1)..( 15): Result.004 file - promoters50/1387349
tcttgacacaaacac

SEQ ID NO: 167438 - DNA, 15 bp, Unknown
  misc_feature (1)..( 15): Result.004 file - promoters50/1387349
ttgatacacatctcg

SEQ ID NO: 167439 - DNA, 15 bp, Unknown
  misc_feature (1)..( 15): Result.004 file - promoters50/1387352
gaagaccacaaacgg

SEQ ID NO: 167440 - DNA, 9 bp, Unknown
  misc_feature (1)..( 9): Result.004 file - promoters50/1387352
ttaaaaagt

SEQ ID NO: 167441 - DNA, 9 bp, Unknown
  misc_feature (1)..( 9): Result.004 file - promoters50/1387352
ttataaata

SEQ ID NO: 167442 - DNA, 9 bp, Unknown
  misc_feature (1)..( 9): Result.004 file - promoters50/1387352
ttatacata

SEQ ID NO: 167443 - DNA, 8 bp, Unknown
  misc_feature (1)..( 8): Result.004 file - promoters50/1387352
gaaaatgg

SEQ ID NO: 167444 - DNA, 8 bp, Unknown
  misc_feature (1)..( 8): Result.004 file - promoters50/1387352
aaaattgg

SEQ ID NO: 167445 - DNA, 8 bp, Unknown
  misc_feature (1)..( 8): Result.004 file - promoters50/1387352
taaaatta

SEQ ID NO: 167446 - DNA, 13 bp, Unknown
  misc_feature (1)..( 13): Result.004 file - promoters50/1387352
atacgaataaagt

SEQ ID NO: 167447 - DNA, 13 bp, Unknown
  misc_feature (1)..( 13): Result.004 file - promoters50/1387352
tttgtaatatagt

SEQ ID NO: 167448 - DNA, 13 bp, Unknown
  misc_feature (1)..( 13): Result.004 file - promoters50/1387352
ataagaataaaat

SEQ ID NO: 167449 - DNA, 10 bp, Unknown
  misc_feature (1)..( 10): Result.004 file - promoters50/1387352
aaaagttagg

SEQ ID NO: 167450 - DNA, 10 bp, Unknown
  misc_feature (1)..( 10): Result.004 file - promoters50/1387352
taaaattagg

SEQ ID NO: 167451 - DNA, 10 bp, Unknown
  misc_feature (1)..( 10): Result.004 file - promoters50/1387352
taaaattgga

SEQ ID NO: 167452 - DNA, 7 bp, Unknown
  misc_feature (1)..( 7): Result.004 file - promoters50/1387352
gataaaa

SEQ ID NO: 167453 - DNA, 7 bp, Unknown
  misc_feature (1)..( 7): Result.004 file - promoters50/1387352
cataaaa

SEQ ID NO: 167454 - DNA, 7 bp, Unknown
  misc_feature (1)..( 7): Result.004 file - promoters50/1387352
cataaac

SEQ ID NO: 167455 - DNA, 8 bp, Unknown
  misc_feature (1)..( 8): Result.004 file - promoters50/1387352
tttactaa

SEQ ID NO: 167456 - DNA, 8 bp, Unknown
  misc_feature (1)..( 8): Result.004 file - promoters50/1387352
tttattaa

SEQ ID NO: 167457 - DNA, 8 bp, Unknown
  misc_feature (1)..( 8): Result.004 file - promoters50/1387356
gttattac

SEQ ID NO: 167458 - DNA, 9 bp, Unknown
  misc_feature (1)..( 9): Result.004 file - promoters50/1387356
gcagagtaa

SEQ ID NO: 167459 - DNA, 9 bp, Unknown
  misc_feature (1)..( 9): Result.004 file - promoters50/1387356
taagaataa

SEQ ID NO: 167460 - DNA, 9 bp, Unknown
  misc_feature (1)..( 9): Result.004 file - promoters50/1387356
taaaaatgt

SEQ ID NO: 167461 - DNA, 6 bp, Unknown
  misc_feature (1)..( 6): Result.004 file - promoters50/1387356
ttaaaa

SEQ ID NO: 167462 - DNA, 6 bp, Unknown
  misc_feature (1)..( 6): Result.004 file - promoters50/1387356
ttaaaa

SEQ ID NO: 167463 - DNA, 6 bp, Unknown
  misc_feature (1)..( 6): Result.004 file - promoters50/1387356
ttaaaa

SEQ ID NO: 167464 - DNA, 13 bp, Unknown
  misc_feature (1)..( 13): Result.004 file - promoters50/1387356
aaagatagacaga

SEQ ID NO: 167465 - DNA, 13 bp, Unknown
  misc_feature (1)..( 13): Result.004 file - promoters50/1387356
aaagaaagaaaga

SEQ ID NO: 167466 - DNA, 13 bp, Unknown
  misc_feature (1)..( 13): Result.004 file - promoters50/1387356
aaagaaaaacaaa

SEQ ID NO: 167467 - DNA, 9 bp, Unknown
  misc_feature (1)..( 9): Result.004 file - promoters50/1387356
aaaaaagtt

SEQ ID NO: 167468 - DNA, 9 bp, Unknown
  misc_feature (1)..( 9): Result.004 file - promoters50/1387356
ttaaaagtt

SEQ ID NO: 167469 - DNA, 10 bp, Unknown
  misc_feature (1)..( 10): Result.004 file - promoters50/1387356
aaaataagtt

SEQ ID NO: 167470 - DNA, 10 bp, Unknown
  misc_feature (1)..( 10): Result.004 file - promoters50/1387356
aaactaagaa

SEQ ID NO: 167471 - DNA, 8 bp, Unknown
  misc_feature (1)..( 8): Result.004 file - promoters50/1387356
caaaagga

SEQ ID NO: 167472 - DNA, 8 bp, Unknown
  misc_feature (1)..( 8): Result.004 file - promoters50/1387356
caaaagaa

SEQ ID NO: 167473 - DNA, 8 bp, Unknown
  misc_feature (1)..( 8): Result.004 file - promoters50/1387356
aaaatgaa

SEQ ID NO: 167474 - DNA, 7 bp, Unknown
  misc_feature (1)..( 7): Result.004 file - promoters50/1387356
cacacgt

SEQ ID NO: 167475 - DNA, 7 bp, Unknown
  misc_feature (1)..( 7): Result.004 file - promoters50/1387356
tacacgt

SEQ ID NO: 167476 - DNA, 7 bp, Unknown
  misc_feature (1)..( 7): Result.004 file - promoters50/1387356
tacacgt

SEQ ID NO: 167477 - DNA, 12 bp, Unknown
  misc_feature (1)..( 12): Result.004 file - promoters50/1387356
caatacaagata

SEQ ID NO: 167478 - DNA, 12 bp, Unknown
  misc_feature (1)..( 12): Result.004 file - promoters50/1387356
atatacaaatta

SEQ ID NO: 167479 - DNA, 12 bp, Unknown
  misc_feature (1)..( 12): Result.004 file - promoters50/1387368
aaaaacaaaaca

SEQ ID NO: 167480 - DNA, 9 bp, Unknown
  misc_feature (1)..( 9): Result.004 file - promoters50/1387368
tacaaaagt

SEQ ID NO: 167481 - DNA, 9 bp, Unknown
  misc_feature (1)..( 9): Result.004 file - promoters50/1387368
aacacaaga

SEQ ID NO: 167482 - DNA, 9 bp, Unknown
  misc_feature (1)..( 9): Result.004 file - promoters50/1387368
aacaataca

SEQ ID NO: 167483 - DNA, 10 bp, Unknown
  misc_feature (1)..( 10): Result.004 file - promoters50/1387368
tgagaagaaa

SEQ ID NO: 167484 - DNA, 10 bp, Unknown
  misc_feature (1)..( 10): Result.004 file - promoters50/1387368
ggagaagaaa

SEQ ID NO: 167485 - DNA, 10 bp, Unknown
  misc_feature (1)..( 10): Result.004 file - promoters50/1387417
agagaaagct

SEQ ID NO: 167486 - DNA, 7 bp, Unknown
  misc_feature (1)..( 7): Result.004 file - promoters50/1387417
ttcttat

SEQ ID NO: 167487 - DNA, 7 bp, Unknown
  misc_feature (1)..( 7): Result.004 file - promoters50/1387417
ttcttac

SEQ ID NO: 167488 - DNA, 7 bp, Unknown
  misc_feature (1)..( 7): Result.004 file - promoters50/1387417
ttcatat

SEQ ID NO: 167489 - DNA, 9 bp, Unknown
  misc_feature (1)..( 9): Result.004 file - promoters50/1387417
catgatttc

SEQ ID NO: 167490 - DNA, 9 bp, Unknown
  misc_feature (1)..( 9): Result.004 file - promoters50/1387417
aatgttttc

SEQ ID NO: 167491 - DNA, 9 bp, Unknown
  misc_feature (1)..( 9): Result.004 file - promoters50/1387417
aatgctttg

SEQ ID NO: 167492 - DNA, 8 bp, Unknown
  misc_feature (1)..( 8): Result.004 file - promoters50/1387417
aatgatcg

SEQ ID NO: 167493 - DNA, 8 bp, Unknown
  misc_feature (1)..( 8): Result.004 file - promoters50/1387417
tgtgatcg

SEQ ID NO: 167494 - DNA, 8 bp, Unknown
  misc_feature (1)..( 8): Result.004 file - promoters50/1387417
tgtaatcg

SEQ ID NO: 167495 - DNA, 8 bp, Unknown
  misc_feature (1)..( 8): Result.004 file - promoters50/1387417
ctttactg

SEQ ID NO: 167496 - DNA, 8 bp, Unknown
  misc_feature (1)..( 8): Result.004 file - promoters50/1387417
attttctg

SEQ ID NO: 167497 - DNA, 8 bp, Unknown
  misc_feature (1)..( 8): Result.004 file - promoters50/1387417
attttcaa

SEQ ID NO: 167498 - DNA, 9 bp, Unknown
  misc_feature (1)..( 9): Result.004 file - promoters50/1387417
atttggtaa

SEQ ID NO: 167499 - DNA, 9 bp, Unknown
  misc_feature (1)..( 9): Result.004 file - promoters50/1387417
ttttgctaa

SEQ ID NO: 167500 - DNA, 9 bp, Unknown
  misc_feature (1)..( 9): Result.004 file - promoters50/1387421
ttttgcttc

SEQ ID NO: 167501 - DNA, 12 bp, Unknown
  misc_feature (1)..( 12): Result.004 file - promoters50/1387421
cacaaaatgata

SEQ ID NO: 167502 - DNA, 12 bp, Unknown
  misc_feature (1)..( 12): Result.004 file - promoters50/1387421
aacaaaaatcgt

SEQ ID NO: 167503 - DNA, 12 bp, Unknown
  misc_feature (1)..( 12): Result.004 file - promoters50/1387421
cacaaaatgact

SEQ ID NO: 167504 - DNA, 12 bp, Unknown
  misc_feature (1)..( 12): Result.004 file - promoters50/1387421
aagaaaatgact

SEQ ID NO: 167505 - DNA, 10 bp, Unknown
  misc_feature (1)..( 10): Result.004 file - promoters50/1387421
gaaaggtaat

SEQ ID NO: 167506 - DNA, 10 bp, Unknown
  misc_feature (1)..( 10): Result.004 file - promoters50/1387421
ggaagataaa

SEQ ID NO: 167507 - DNA, 10 bp, Unknown
  misc_feature (1)..( 10): Result.004 file - promoters50/1387421
gaaacgtaaa

SEQ ID NO: 167508 - DNA, 10 bp, Unknown
  misc_feature (1)..( 10): Result.004 file - promoters50/1387421
gtaagaaaaa

SEQ ID NO: 167509 - DNA, 10 bp, Unknown
  misc_feature (1)..( 10): Result.004 file - promoters50/1387421
taaaatatgc

SEQ ID NO: 167510 - DNA, 10 bp, Unknown
  misc_feature (1)..( 10): Result.004 file - promoters50/1387421
taaattattt

SEQ ID NO: 167511 - DNA, 10 bp, Unknown
  misc_feature (1)..( 10): Result.004 file - promoters50/1387421
tatattattt

SEQ ID NO: 167512 - DNA, 10 bp, Unknown
  misc_feature (1)..( 10): Result.004 file - promoters50/1387421
ttaattccca

SEQ ID NO: 167513 - DNA, 11 bp, Unknown
  misc_feature (1)..( 11): Result.004 file - promoters50/1387421
cgcagttaact

SEQ ID NO: 167514 - DNA, 11 bp, Unknown
  misc_feature (1)..( 11): Result.004 file - promoters50/1387421
tgtagttaaag

SEQ ID NO: 167515 - DNA, 11 bp, Unknown
  misc_feature (1)..( 11): Result.004 file - promoters50/1387421
tgttgttatta

SEQ ID NO: 167516 - DNA, 11 bp, Unknown
  misc_feature (1)..( 11): Result.004 file - promoters50/1387429
agtagtttttg

SEQ ID NO: 167517 - DNA, 9 bp, Unknown
  misc_feature (1)..( 9): Result.004 file - promoters50/1387429
aatgatttg

SEQ ID NO: 167518 - DNA, 9 bp, Unknown
  misc_feature (1)..( 9): Result.004 file - promoters50/1387429
cttgaattg

SEQ ID NO: 167519 - DNA, 9 bp, Unknown
  misc_feature (1)..( 9): Result.004 file - promoters50/1387429
aataatttc

SEQ ID NO: 167520 - DNA, 9 bp, Unknown
  misc_feature (1)..( 9): Result.004 file - promoters50/1387429
gatgattgg

SEQ ID NO: 167521 - DNA, 9 bp, Unknown
  misc_feature (1)..( 9): Result.004 file - promoters50/1387429
aaaaaataa

SEQ ID NO: 167522 - DNA, 11 bp, Unknown
  misc_feature (1)..( 11): Result.004 file - promoters50/1387429
tgttactttca

SEQ ID NO: 167523 - DNA, 11 bp, Unknown
  misc_feature (1)..( 11): Result.004 file - promoters50/1387429
agttaatttct

SEQ ID NO: 167524 - DNA, 11 bp, Unknown
  misc_feature (1)..( 11): Result.004 file - promoters50/1387429
tgtaacttcag

SEQ ID NO: 167525 - DNA, 11 bp, Unknown
  misc_feature (1)..( 11): Result.004 file - promoters50/1387429
cataaattcat

SEQ ID NO: 167526 - DNA, 11 bp, Unknown
  misc_feature (1)..( 11): Result.004 file - promoters50/1387429
ccaaaatatct

SEQ ID NO: 167527 - DNA, 8 bp, Unknown
  misc_feature (1)..( 8): Result.004 file - promoters50/1387429
caatttat

SEQ ID NO: 167528 - DNA, 8 bp, Unknown
  misc_feature (1)..( 8): Result.004 file - promoters50/1387429
caaattat

SEQ ID NO: 167529 - DNA, 8 bp, Unknown
  misc_feature (1)..( 8): Result.004 file - promoters50/1387429
gaaattag

SEQ ID NO: 167530 - DNA, 8 bp, Unknown
  misc_feature (1)..( 8): Result.004 file - promoters50/1387429
caaattct

SEQ ID NO: 167531 - DNA, 8 bp, Unknown
  misc_feature (1)..( 8): Result.004 file - promoters50/1387429
aaaatcta

SEQ ID NO: 167532 - DNA, 7 bp, Unknown
  misc_feature (1)..( 7): Result.004 file - promoters50/1387429
gaaatta

SEQ ID NO: 167533 - DNA, 7 bp, Unknown
  misc_feature (1)..( 7): Result.004 file - promoters50/1387429
gaaattg

SEQ ID NO: 167534 - DNA, 7 bp, Unknown
  misc_feature (1)..( 7): Result.004 file - promoters50/1387429
caaatta

SEQ ID NO: 167535 - DNA, 7 bp, Unknown
  misc_feature (1)..( 7): Result.004 file - promoters50/1387429
caaattc

SEQ ID NO: 167536 - DNA, 7 bp, Unknown
  misc_feature (1)..( 7): Result.004 file - promoters50/1387505
aaaatct

SEQ ID NO: 167537 - DNA, 8 bp, Unknown
  misc_feature (1)..( 8): Result.004 file - promoters50/1387505
aatgcaaa

SEQ ID NO: 167538 - DNA, 8 bp, Unknown
  misc_feature (1)..( 8): Result.004 file - promoters50/1387505
aatgtaaa

SEQ ID NO: 167539 - DNA, 8 bp, Unknown
  misc_feature (1)..( 8): Result.004 file - promoters50/1387505
gatgcaag

SEQ ID NO: 167540 - DNA, 9 bp, Unknown
  misc_feature (1)..( 9): Result.004 file - promoters50/1387505
aatgaaatc

SEQ ID NO: 167541 - DNA, 9 bp, Unknown
  misc_feature (1)..( 9): Result.004 file - promoters50/1387505
aattaaatg

SEQ ID NO: 167542 - DNA, 9 bp, Unknown
  misc_feature (1)..( 9): Result.004 file - promoters50/1387524
cctgagatc

SEQ ID NO: 167543 - DNA, 13 bp, Unknown
  misc_feature (1)..( 13): Result.004 file - promoters50/1387524
cattatgtatagg

SEQ ID NO: 167544 - DNA, 13 bp, Unknown
  misc_feature (1)..( 13): Result.004 file - promoters50/1387524
tgttatctattgt

SEQ ID NO: 167545 - DNA, 13 bp, Unknown
  misc_feature (1)..( 13): Result.004 file - promoters50/1387524
tgttatcaattgt

SEQ ID NO: 167546 - DNA, 8 bp, Unknown
  misc_feature (1)..( 8): Result.004 file - promoters50/1387524
agagaaaa

SEQ ID NO: 167547 - DNA, 8 bp, Unknown
  misc_feature (1)..( 8): Result.004 file - promoters50/1387524
agaaaaaa

SEQ ID NO: 167548 - DNA, 8 bp, Unknown
  misc_feature (1)..( 8): Result.004 file - promoters50/1387524
ggaaaacc

SEQ ID NO: 167549 - DNA, 8 bp, Unknown
  misc_feature (1)..( 8): Result.004 file - promoters50/1387524
agataaaa

SEQ ID NO: 167550 - DNA, 9 bp, Unknown
  misc_feature (1)..( 9): Result.004 file - promoters50/1387524
gaaaacact

SEQ ID NO: 167551 - DNA, 9 bp, Unknown
  misc_feature (1)..( 9): Result.004 file - promoters50/1387524
aaaaaaact

SEQ ID NO: 167552 - DNA, 9 bp, Unknown
  misc_feature (1)..( 9): Result.004 file - promoters50/1387524
gaaaacctt

SEQ ID NO: 167553 - DNA, 10 bp, Unknown
  misc_feature (1)..( 10): Result.004 file - promoters50/1387524
agggataaaa

SEQ ID NO: 167554 - DNA, 10 bp, Unknown
  misc_feature (1)..( 10): Result.004 file - promoters50/1387524
attaataaaa

SEQ ID NO: 167555 - DNA, 10 bp, Unknown
  misc_feature (1)..( 10): Result.004 file - promoters50/1387524
aggggtaaaa

SEQ ID NO: 167556 - DNA, 10 bp, Unknown
  misc_feature (1)..( 10): Result.004 file - promoters50/1387524
aaaaataaat

SEQ ID NO: 167557 - DNA, 7 bp, Unknown
  misc_feature (1)..( 7): Result.004 file - promoters50/1387524
aaataga

SEQ ID NO: 167558 - DNA, 7 bp, Unknown
  misc_feature (1)..( 7): Result.004 file - promoters50/1387524
aaaaaga

SEQ ID NO: 167559 - DNA, 7 bp, Unknown
  misc_feature (1)..( 7): Result.004 file - promoters50/1387524
aaaaaaa

SEQ ID NO: 167560 - DNA, 9 bp, Unknown
  misc_feature (1)..( 9): Result.004 file - promoters50/1387524
taatcatct

SEQ ID NO: 167561 - DNA, 9 bp, Unknown
  misc_feature (1)..( 9): Result.004 file - promoters50/1387524
taattatca

SEQ ID NO: 167562 - DNA, 9 bp, Unknown
  misc_feature (1)..( 9): Result.004 file - promoters50/1387524
ttcttatca

SEQ ID NO: 167563 - DNA, 9 bp, Unknown
  misc_feature (1)..( 9): Result.004 file - promoters50/1387524
agtaaaaat

SEQ ID NO: 167564 - DNA, 9 bp, Unknown
  misc_feature (1)..( 9): Result.004 file - promoters50/1387524
agtaaagac

SEQ ID NO: 167565 - DNA, 9 bp, Unknown
  misc_feature (1)..( 9): Result.004 file - promoters50/1387524
tttaaataa

SEQ ID NO: 167566 - DNA, 8 bp, Unknown
  misc_feature (1)..( 8): Result.004 file - promoters50/1387524
gaaacaaa

SEQ ID NO: 167567 - DNA, 8 bp, Unknown
  misc_feature (1)..( 8): Result.004 file - promoters50/1387524
gaaagaaa

SEQ ID NO: 167568 - DNA, 8 bp, Unknown
  misc_feature (1)..( 8): Result.004 file - promoters50/1387524
agaagaaa

SEQ ID NO: 167569 - DNA, 10 bp, Unknown
  misc_feature (1)..( 10): Result.004 file - promoters50/1387524
ggaaatgaaa

SEQ ID NO: 167570 - DNA, 10 bp, Unknown
  misc_feature (1)..( 10): Result.004 file - promoters50/1387524
ggaaaagaaa

SEQ ID NO: 167571 - DNA, 10 bp, Unknown
  misc_feature (1)..( 10): Result.004 file - promoters50/1387524
tataaagaag

SEQ ID NO: 167572 - DNA, 6 bp, Unknown
  misc_feature (1)..( 6): Result.004 file - promoters50/1387524
ttttaa

SEQ ID NO: 167573 - DNA, 6 bp, Unknown
  misc_feature (1)..( 6): Result.004 file - promoters50/1387524
ttttaa

SEQ ID NO: 167574 - DNA, 7 bp, Unknown
  misc_feature (1)..( 7): Result.004 file - promoters50/1387547
tttgtaa

SEQ ID NO: 167575 - DNA, 9 bp, Unknown
  misc_feature (1)..( 9): Result.004 file - promoters50/1387547
ttattgtct

SEQ ID NO: 167576 - DNA, 9 bp, Unknown
  misc_feature (1)..( 9): Result.004 file - promoters50/1387547
ttattgcaa

SEQ ID NO: 167577 - DNA, 9 bp, Unknown
  misc_feature (1)..( 9): Result.004 file - promoters50/1387580
ttaatgtct

SEQ ID NO: 167578 - DNA, 10 bp, Unknown
  misc_feature (1)..( 10): Result.004 file - promoters50/1387580
gtaagaaaat

SEQ ID NO: 167579 - DNA, 10 bp, Unknown
  misc_feature (1)..( 10): Result.004 file - promoters50/1387580
gtaaaaaaaa

SEQ ID NO: 167580 - DNA, 10 bp, Unknown
  misc_feature (1)..( 10): Result.004 file - promoters50/1387587
acaaaaaaaa

SEQ ID NO: 167581 - DNA, 11 bp, Unknown
  misc_feature (1)..( 11): Result.004 file - promoters50/1387587
ttttgaagaac

SEQ ID NO: 167582 - DNA, 11 bp, Unknown
  misc_feature (1)..( 11): Result.004 file - promoters50/1387587
ttttggagaac

SEQ ID NO: 167583 - DNA, 11 bp, Unknown
  misc_feature (1)..( 11): Result.004 file - promoters50/1387587
tttcgaaataa

SEQ ID NO: 167584 - DNA, 7 bp, Unknown
  misc_feature (1)..( 7): Result.004 file - promoters50/1387587
agtaaac

SEQ ID NO: 167585 - DNA, 7 bp, Unknown
  misc_feature (1)..( 7): Result.004 file - promoters50/1387587
agtaaaa

SEQ ID NO: 167586 - DNA, 7 bp, Unknown
  misc_feature (1)..( 7): Result.004 file - promoters50/1387587
ggtaaaa

SEQ ID NO: 167587 - DNA, 10 bp, Unknown
  misc_feature (1)..( 10): Result.004 file - promoters50/1387587
atggttaaaa

SEQ ID NO: 167588 - DNA, 10 bp, Unknown
  misc_feature (1)..( 10): Result.004 file - promoters50/1387587
atggtaaaaa

SEQ ID NO: 167589 - DNA, 10 bp, Unknown
  misc_feature (1)..( 10): Result.004 file - promoters50/1387590
ctagtaaaac

SEQ ID NO: 167590 - DNA, 9 bp, Unknown
  misc_feature (1)..( 9): Result.004 file - promoters50/1387590
ctatttcaa

SEQ ID NO: 167591 - DNA, 9 bp, Unknown
  misc_feature (1)..( 9): Result.004 file - promoters50/1387590
agattacaa

SEQ ID NO: 167592 - DNA, 9 bp, Unknown
  misc_feature (1)..( 9): Result.004 file - promoters50/1387590
ctatttcgt

SEQ ID NO: 167593 - DNA, 11 bp, Unknown
  misc_feature (1)..( 11): Result.004 file - promoters50/1387590
tataacaacac

SEQ ID NO: 167594 - DNA, 11 bp, Unknown
  misc_feature (1)..( 11): Result.004 file - promoters50/1387590
tatgacatcac

SEQ ID NO: 167595 - DNA, 11 bp, Unknown
  misc_feature (1)..( 11): Result.004 file - promoters50/1387590
gaagacaacaa

SEQ ID NO: 167596 - DNA, 8 bp, Unknown
  misc_feature (1)..( 8): Result.004 file - promoters50/1387590
ttcaataa

SEQ ID NO: 167597 - DNA, 8 bp, Unknown
  misc_feature (1)..( 8): Result.004 file - promoters50/1387590
ttcaatca

SEQ ID NO: 167598 - DNA, 8 bp, Unknown
  misc_feature (1)..( 8): Result.004 file - promoters50/1387590
atcaataa

SEQ ID NO: 167599 - DNA, 10 bp, Unknown
  misc_feature (1)..( 10): Result.004 file - promoters50/1387590
gattttgagt

SEQ ID NO: 167600 - DNA, 10 bp, Unknown
  misc_feature (1)..( 10): Result.004 file - promoters50/1387590
tgttttcagt

SEQ ID NO: 167601 - DNA, 10 bp, Unknown
  misc_feature (1)..( 10): Result.004 file - promoters50/1387605
gattttgatt

SEQ ID NO: 167602 - DNA, 8 bp, Unknown
  misc_feature (1)..( 8): Result.004 file - promoters50/1387605
tttttaaa

SEQ ID NO: 167603 - DNA, 8 bp, Unknown
  misc_feature (1)..( 8): Result.004 file - promoters50/1387605
actttaaa

SEQ ID NO: 167604 - DNA, 8 bp, Unknown
  misc_feature (1)..( 8): Result.004 file - promoters50/1387616
actctaaa

SEQ ID NO: 167605 - DNA, 10 bp, Unknown
  misc_feature (1)..( 10): Result.004 file - promoters50/1387616
ctagatatat

SEQ ID NO: 167606 - DNA, 10 bp, Unknown
  misc_feature (1)..( 10): Result.004 file - promoters50/1387616
atagatatgc

SEQ ID NO: 167607 - DNA, 10 bp, Unknown
  misc_feature (1)..( 10): Result.004 file - promoters50/1387616
ctaaatactc

SEQ ID NO: 167608 - DNA, 10 bp, Unknown
  misc_feature (1)..( 10): Result.004 file - promoters50/1387616
gtagataagt

SEQ ID NO: 167609 - DNA, 10 bp, Unknown
  misc_feature (1)..( 10): Result.004 file - promoters50/1387616
gcaaatcctc

SEQ ID NO: 167610 - DNA, 10 bp, Unknown
  misc_feature (1)..( 10): Result.004 file - promoters50/1387616
atagagaagc

SEQ ID NO: 167611 - DNA, 11 bp, Unknown
  misc_feature (1)..( 11): Result.004 file - promoters50/1387616
ttaaaaaaaga

SEQ ID NO: 167612 - DNA, 11 bp, Unknown
  misc_feature (1)..( 11): Result.004 file - promoters50/1387616
tcaaacaaatg

SEQ ID NO: 167613 - DNA, 11 bp, Unknown
  misc_feature (1)..( 11): Result.004 file - promoters50/1387616
ttaagaaaagc

SEQ ID NO: 167614 - DNA, 11 bp, Unknown
  misc_feature (1)..( 11): Result.004 file - promoters50/1387616
tctagacaaga

SEQ ID NO: 167615 - DNA, 11 bp, Unknown
  misc_feature (1)..( 11): Result.004 file - promoters50/1387616
agtagagaaga

SEQ ID NO: 167616 - DNA, 11 bp, Unknown
  misc_feature (1)..( 11): Result.004 file - promoters50/1387628
ccgaaagaaga

SEQ ID NO: 167617 - DNA, 7 bp, Unknown
  misc_feature (1)..( 7): Result.004 file - promoters50/1387628
gataaag

SEQ ID NO: 167618 - DNA, 7 bp, Unknown
  misc_feature (1)..( 7): Result.004 file - promoters50/1387628
tataaag

SEQ ID NO: 167619 - DNA, 7 bp, Unknown
  misc_feature (1)..( 7): Result.004 file - promoters50/1387628
tattaag

SEQ ID NO: 167620 - DNA, 9 bp, Unknown
  misc_feature (1)..( 9): Result.004 file - promoters50/1387628
taatttgtt

SEQ ID NO: 167621 - DNA, 9 bp, Unknown
  misc_feature (1)..( 9): Result.004 file - promoters50/1387628
caatttgtt

SEQ ID NO: 167622 - DNA, 9 bp, Unknown
  misc_feature (1)..( 9): Result.004 file - promoters50/1387628
taattttat

SEQ ID NO: 167623 - DNA, 9 bp, Unknown
  misc_feature (1)..( 9): Result.004 file - promoters50/1387628
agataaaat

SEQ ID NO: 167624 - DNA, 9 bp, Unknown
  misc_feature (1)..( 9): Result.004 file - promoters50/1387628
agaaaaaaa

SEQ ID NO: 167625 - DNA, 9 bp, Unknown
  misc_feature (1)..( 9): Result.004 file - promoters50/1387665
agataaaaa

SEQ ID NO: 167626 - DNA, 9 bp, Unknown
  misc_feature (1)..( 9): Result.004 file - promoters50/1387665
tttttttgt

SEQ ID NO: 167627 - DNA, 9 bp, Unknown
  misc_feature (1)..( 9): Result.004 file - promoters50/1387665
tttttttgt

SEQ ID NO: 167628 - DNA, 9 bp, Unknown
  misc_feature (1)..( 9): Result.004 file - promoters50/1387665
atattttgt

SEQ ID NO: 167629 - DNA, 7 bp, Unknown
  misc_feature (1)..( 7): Result.004 file - promoters50/1387665
aaactaa

SEQ ID NO: 167630 - DNA, 7 bp, Unknown
  misc_feature (1)..( 7): Result.004 file - promoters50/1387665
aaattaa

SEQ ID NO: 167631 - DNA, 7 bp, Unknown
  misc_feature (1)..( 7): Result.004 file - promoters50/1387665
aaattta

SEQ ID NO: 167632 - DNA, 7 bp, Unknown
  misc_feature (1)..( 7): Result.004 file - promoters50/1387665
atagtaa

SEQ ID NO: 167633 - DNA, 7 bp, Unknown
  misc_feature (1)..( 7): Result.004 file - promoters50/1387665
gtagtaa

SEQ ID NO: 167634 - DNA, 7 bp, Unknown
  misc_feature (1)..( 7): Result.004 file - promoters50/1387671
atagtaa

SEQ ID NO: 167635 - DNA, 16 bp, Unknown
  misc_feature (1)..( 16): Result.004 file - promoters50/1387671
cactatttaaagctcg

SEQ ID NO: 167636 - DNA, 16 bp, Unknown
  misc_feature (1)..( 16): Result.004 file - promoters50/1387671
ttactattaaagccgc

SEQ ID NO: 167637 - DNA, 15 bp, Unknown
  misc_feature (1)..( 15): Result.004 file - promoters50/1387671
tttaattaaaaccct

SEQ ID NO: 167638 - DNA, 16 bp, Unknown
  misc_feature (1)..( 16): Result.004 file - promoters50/1387671
cactatataaagacaa

SEQ ID NO: 167639 - DNA, 16 bp, Unknown
  misc_feature (1)..( 16): Result.004 file - promoters50/1387671
tcgtatataaagacgc

SEQ ID NO: 167640 - DNA, 16 bp, Unknown
  misc_feature (1)..( 16): Result.004 file - promoters50/1387793
atatttatatagataa

SEQ ID NO: 167641 - DNA, 10 bp, Unknown
  misc_feature (1)..( 10): Result.004 file - promoters50/1387793
ttaaaagcta

SEQ ID NO: 167642 - DNA, 10 bp, Unknown
  misc_feature (1)..( 10): Result.004 file - promoters50/1387793
ttaaaatgaa

SEQ ID NO: 167643 - DNA, 10 bp, Unknown
  misc_feature (1)..( 10): Result.004 file - promoters50/1387793
ctaaaagata

SEQ ID NO: 167644 - DNA, 10 bp, Unknown
  misc_feature (1)..( 10): Result.004 file - promoters50/1387793
agaaaatata

SEQ ID NO: 167645 - DNA, 9 bp, Unknown
  misc_feature (1)..( 9): Result.004 file - promoters50/1387793
aaaacctta

SEQ ID NO: 167646 - DNA, 9 bp, Unknown
  misc_feature (1)..( 9): Result.004 file - promoters50/1387793
aaaaccatc

SEQ ID NO: 167647 - DNA, 9 bp, Unknown
  misc_feature (1)..( 9): Result.004 file - promoters50/1387793
taaaccatt

SEQ ID NO: 167648 - DNA, 9 bp, Unknown
  misc_feature (1)..( 9): Result.004 file - promoters50/1387793
aaatccatc

SEQ ID NO: 167649 - DNA, 8 bp, Unknown
  misc_feature (1)..( 8): Result.004 file - promoters50/1387793
caagaaag

SEQ ID NO: 167650 - DNA, 8 bp, Unknown
  misc_feature (1)..( 8): Result.004 file - promoters50/1387793
caaaaaaa

SEQ ID NO: 167651 - DNA, 8 bp, Unknown
  misc_feature (1)..( 8): Result.004 file - promoters50/1387793
taagaaaa

SEQ ID NO: 167652 - DNA, 8 bp, Unknown
  misc_feature (1)..( 8): Result.004 file - promoters50/1387818
taaaaaaa

SEQ ID NO: 167653 - DNA, 11 bp, Unknown
  misc_feature (1)..( 11): Result.004 file - promoters50/1387818
gaagacataaa

SEQ ID NO: 167654 - DNA, 11 bp, Unknown
  misc_feature (1)..( 11): Result.004 file - promoters50/1387818
acagaaataga

SEQ ID NO: 167655 - DNA, 11 bp, Unknown
  misc_feature (1)..( 11): Result.004 file - promoters50/1387818
ttcgaaaacac

SEQ ID NO: 167656 - DNA, 11 bp, Unknown
  misc_feature (1)..( 11): Result.004 file - promoters50/1387818
aaacaaaaact

SEQ ID NO: 167657 - DNA, 11 bp, Unknown
  misc_feature (1)..( 11): Result.004 file - promoters50/1387818
aacgaaatctg

SEQ ID NO: 167658 - DNA, 11 bp, Unknown
  misc_feature (1)..( 11): Result.004 file - promoters50/1387818
tgaaaaatact

SEQ ID NO: 167659 - DNA, 11 bp, Unknown
  misc_feature (1)..( 11): Result.004 file - promoters50/1387818
aatttttctct

SEQ ID NO: 167660 - DNA, 11 bp, Unknown
  misc_feature (1)..( 11): Result.004 file - promoters50/1387818
cattcttcttg

SEQ ID NO: 167661 - DNA, 11 bp, Unknown
  misc_feature (1)..( 11): Result.004 file - promoters50/1387818
catttttgtgc

SEQ ID NO: 167662 - DNA, 11 bp, Unknown
  misc_feature (1)..( 11): Result.004 file - promoters50/1387818
aattttcttta

SEQ ID NO: 167663 - DNA, 11 bp, Unknown
  misc_feature (1)..( 11): Result.004 file - promoters50/1387818
ggtttttgtgt

SEQ ID NO: 167664 - DNA, 11 bp, Unknown
  misc_feature (1)..( 11): Result.004 file - promoters50/1387818
ctttcgtcttg

SEQ ID NO: 167665 - DNA, 11 bp, Unknown
  misc_feature (1)..( 11): Result.004 file - promoters50/1387906
tcgtcttcttc

SEQ ID NO: 167666 - DNA, 11 bp, Unknown
  misc_feature (1)..( 11): Result.004 file - promoters50/1387906
atataacaaca

SEQ ID NO: 167667 - DNA, 11 bp, Unknown
  misc_feature (1)..( 11): Result.004 file - promoters50/1387906
ttttaataaca

SEQ ID NO: 167668 - DNA, 11 bp, Unknown
  misc_feature (1)..( 11): Result.004 file - promoters50/1387906
ttttactaact

SEQ ID NO: 167669 - DNA, 11 bp, Unknown
  misc_feature (1)..( 11): Result.004 file - promoters50/1387906
ttttaccttgt

SEQ ID NO: 167670 - DNA, 12 bp, Unknown
  misc_feature (1)..( 12): Result.004 file - promoters50/1387906
attaaatttgtt

SEQ ID NO: 167671 - DNA, 12 bp, Unknown
  misc_feature (1)..( 12): Result.004 file - promoters50/1387906
tcaaaatctgtt

SEQ ID NO: 167672 - DNA, 11 bp, Unknown
  misc_feature (1)..( 11): Result.004 file - promoters50/1387906
ataaatttgag

SEQ ID NO: 167673 - DNA, 11 bp, Unknown
  misc_feature (1)..( 11): Result.004 file - promoters50/1387906
taaaatcgaac

SEQ ID NO: 167674 - DNA, 12 bp, Unknown
  misc_feature (1)..( 12): Result.004 file - promoters50/1387935
ttataatgattc

SEQ ID NO: 167675 - DNA, 10 bp, Unknown
  misc_feature (1)..( 10): Result.004 file - promoters50/1387935
tttgaattta

SEQ ID NO: 167676 - DNA, 10 bp, Unknown
  misc_feature (1)..( 10): Result.004 file - promoters50/1387935
attgtattta

SEQ ID NO: 167677 - DNA, 10 bp, Unknown
  misc_feature (1)..( 10): Result.004 file - promoters50/1387935
tttgaaacta

SEQ ID NO: 167678 - DNA, 10 bp, Unknown
  misc_feature (1)..( 10): Result.004 file - promoters50/1387935
attgtttttt

SEQ ID NO: 167679 - DNA, 10 bp, Unknown
  misc_feature (1)..( 10): Result.004 file - promoters50/1387935
catgtatttg

SEQ ID NO: 167680 - DNA, 12 bp, Unknown
  misc_feature (1)..( 12): Result.004 file - promoters50/1387935
caatcaatggtt

SEQ ID NO: 167681 - DNA, 12 bp, Unknown
  misc_feature (1)..( 12): Result.004 file - promoters50/1387935
caaacaaaaggc

SEQ ID NO: 167682 - DNA, 12 bp, Unknown
  misc_feature (1)..( 12): Result.004 file - promoters50/1387935
aaatcaattgtt

SEQ ID NO: 167683 - DNA, 12 bp, Unknown
  misc_feature (1)..( 12): Result.004 file - promoters50/1387935
gaaataaaagat

SEQ ID NO: 167684 - DNA, 12 bp, Unknown
  misc_feature (1)..( 12): Result.004 file - promoters50/1387935
tatacaagtaga

SEQ ID NO: 167685 - DNA, 9 bp, Unknown
  misc_feature (1)..( 9): Result.004 file - promoters50/1387935
caaagaagg

SEQ ID NO: 167686 - DNA, 9 bp, Unknown
  misc_feature (1)..( 9): Result.004 file - promoters50/1387935
aaaagaaga

SEQ ID NO: 167687 - DNA, 9 bp, Unknown
  misc_feature (1)..( 9): Result.004 file - promoters50/1387935
taaacaaga

SEQ ID NO: 167688 - DNA, 9 bp, Unknown
  misc_feature (1)..( 9): Result.004 file - promoters50/1387935
aaaagatgt

SEQ ID NO: 167689 - DNA, 9 bp, Unknown
  misc_feature (1)..( 9): Result.004 file - promoters50/1387947
tatacaagt

SEQ ID NO: 167690 - DNA, 12 bp, Unknown
  misc_feature (1)..( 12): Result.004 file - promoters50/1387947
gaaggaaaagaa

SEQ ID NO: 167691 - DNA, 12 bp, Unknown
  misc_feature (1)..( 12): Result.004 file - promoters50/1387947
gaaagaacgtga

SEQ ID NO: 167692 - DNA, 12 bp, Unknown
  misc_feature (1)..( 12): Result.004 file - promoters50/1387947
caaggaaaggag

SEQ ID NO: 167693 - DNA, 12 bp, Unknown
  misc_feature (1)..( 12): Result.004 file - promoters50/1387947
aaaaaaacttga

SEQ ID NO: 167694 - DNA, 12 bp, Unknown
  misc_feature (1)..( 12): Result.004 file - promoters50/1387947
taaagcttctga

SEQ ID NO: 167695 - DNA, 12 bp, Unknown
  misc_feature (1)..( 12): Result.004 file - promoters50/1387947
caaaaaaagtta

SEQ ID NO: 167696 - DNA, 13 bp, Unknown
  misc_feature (1)..( 13): Result.004 file - promoters50/1387947
caattaaaaaaat

SEQ ID NO: 167697 - DNA, 13 bp, Unknown
  misc_feature (1)..( 13): Result.004 file - promoters50/1387947
gatcaaaataaac

SEQ ID NO: 167698 - DNA, 13 bp, Unknown
  misc_feature (1)..( 13): Result.004 file - promoters50/1387947
attagaaatatat

SEQ ID NO: 167699 - DNA, 13 bp, Unknown
  misc_feature (1)..( 13): Result.004 file - promoters50/1387947
ttagtaaaagaat

SEQ ID NO: 167700 - DNA, 13 bp, Unknown
  misc_feature (1)..( 13): Result.004 file - promoters50/1387947
ctaaacaatatat

SEQ ID NO: 167701 - DNA, 13 bp, Unknown
  misc_feature (1)..( 13): Result.004 file - promoters50/1388009
caatcatatatat

SEQ ID NO: 167702 - DNA, 11 bp, Unknown
  misc_feature (1)..( 11): Result.004 file - promoters50/1388009
tatgaaaatat

SEQ ID NO: 167703 - DNA, 11 bp, Unknown
  misc_feature (1)..( 11): Result.004 file - promoters50/1388009
tattaaagtat

SEQ ID NO: 167704 - DNA, 11 bp, Unknown
  misc_feature (1)..( 11): Result.004 file - promoters50/1388009
tattaaattat

SEQ ID NO: 167705 - DNA, 7 bp, Unknown
  misc_feature (1)..( 7): Result.004 file - promoters50/1388009
tttttac

SEQ ID NO: 167706 - DNA, 7 bp, Unknown
  misc_feature (1)..( 7): Result.004 file - promoters50/1388009
attttac

SEQ ID NO: 167707 - DNA, 7 bp, Unknown
  misc_feature (1)..( 7): Result.004 file - promoters50/1388009
attttag

SEQ ID NO: 167708 - DNA, 10 bp, Unknown
  misc_feature (1)..( 10): Result.004 file - promoters50/1388009
cgaaatcata

SEQ ID NO: 167709 - DNA, 10 bp, Unknown
  misc_feature (1)..( 10): Result.004 file - promoters50/1388009
acaaataata

SEQ ID NO: 167710 - DNA, 10 bp, Unknown
  misc_feature (1)..( 10): Result.004 file - promoters50/1388009
cgaattcaaa

SEQ ID NO: 167711 - DNA, 9 bp, Unknown
  misc_feature (1)..( 9): Result.004 file - promoters50/1388009
acattataa

SEQ ID NO: 167712 - DNA, 9 bp, Unknown
  misc_feature (1)..( 9): Result.004 file - promoters50/1388009
aaattataa

SEQ ID NO: 167713 - DNA, 9 bp, Unknown
  misc_feature (1)..( 9): Result.004 file - promoters50/1388009
aaattatta

SEQ ID NO: 167714 - DNA, 8 bp, Unknown
  misc_feature (1)..( 8): Result.004 file - promoters50/1388009
atattttc

SEQ ID NO: 167715 - DNA, 8 bp, Unknown
  misc_feature (1)..( 8): Result.004 file - promoters50/1388009
atatttta

SEQ ID NO: 167716 - DNA, 8 bp, Unknown
  misc_feature (1)..( 8): Result.004 file - promoters50/1388009
tcatttta

SEQ ID NO: 167717 - DNA, 9 bp, Unknown
  misc_feature (1)..( 9): Result.004 file - promoters50/1388009
tatatgacg

SEQ ID NO: 167718 - DNA, 9 bp, Unknown
  misc_feature (1)..( 9): Result.004 file - promoters50/1388009
tatatgtta

SEQ ID NO: 167719 - DNA, 9 bp, Unknown
  misc_feature (1)..( 9): Result.004 file - promoters50/1388069
tatatatat

SEQ ID NO: 167720 - DNA, 11 bp, Unknown
  misc_feature (1)..( 11): Result.004 file - promoters50/1388069
caattaaaaaa

SEQ ID NO: 167721 - DNA, 11 bp, Unknown
  misc_feature (1)..( 11): Result.004 file - promoters50/1388069
caattgaaaat

SEQ ID NO: 167722 - DNA, 11 bp, Unknown
  misc_feature (1)..( 11): Result.004 file - promoters50/1388069
taaataaacct

SEQ ID NO: 167723 - DNA, 11 bp, Unknown
  misc_feature (1)..( 11): Result.004 file - promoters50/1388069
aaaccaaaaaa

SEQ ID NO: 167724 - DNA, 11 bp, Unknown
  misc_feature (1)..( 11): Result.004 file - promoters50/1388069
ccactaaaaac

SEQ ID NO: 167725 - DNA, 11 bp, Unknown
  misc_feature (1)..( 11): Result.004 file - promoters50/1388423
aaaataaaccc

SEQ ID NO: 167726 - DNA, 8 bp, Unknown
  misc_feature (1)..( 8): Result.004 file - promoters50/1388423
aaaaacat

SEQ ID NO: 167727 - DNA, 8 bp, Unknown
  misc_feature (1)..( 8): Result.004 file - promoters50/1388423
aaacacaa

SEQ ID NO: 167728 - DNA, 8 bp, Unknown
  misc_feature (1)..( 8): Result.004 file - promoters50/1388423
ggacacaa

SEQ ID NO: 167729 - DNA, 11 bp, Unknown
  misc_feature (1)..( 11): Result.004 file - promoters50/1388423
gaagcaaaacc

SEQ ID NO: 167730 - DNA, 11 bp, Unknown
  misc_feature (1)..( 11): Result.004 file - promoters50/1388423
gaagaaaaaca

SEQ ID NO: 167731 - DNA, 11 bp, Unknown
  misc_feature (1)..( 11): Result.004 file - promoters50/1388423
atctcaaaacc

SEQ ID NO: 167732 - DNA, 8 bp, Unknown
  misc_feature (1)..( 8): Result.004 file - promoters50/1388423
tctgaatt

SEQ ID NO: 167733 - DNA, 8 bp, Unknown
  misc_feature (1)..( 8): Result.004 file - promoters50/1388423
attgaatt

SEQ ID NO: 167734 - DNA, 8 bp, Unknown
  misc_feature (1)..( 8): Result.004 file - promoters50/1388423
attaaatc

SEQ ID NO: 167735 - DNA, 8 bp, Unknown
  misc_feature (1)..( 8): Result.004 file - promoters50/1388423
taacttgg

SEQ ID NO: 167736 - DNA, 8 bp, Unknown
  misc_feature (1)..( 8): Result.004 file - promoters50/1388423
aaacttgg

SEQ ID NO: 167737 - DNA, 9 bp, Unknown
  misc_feature (1)..( 9): Result.004 file - promoters50/1388423
aaaccttga

SEQ ID NO: 167738 - DNA, 7 bp, Unknown
  misc_feature (1)..( 7): Result.004 file - promoters50/1388423
acataac

SEQ ID NO: 167739 - DNA, 7 bp, Unknown
  misc_feature (1)..( 7): Result.004 file - promoters50/1388423
acacaac

SEQ ID NO: 167740 - DNA, 7 bp, Unknown
  misc_feature (1)..( 7): Result.004 file - promoters50/1388438
acacaag

SEQ ID NO: 167741 - DNA, 7 bp, Unknown
  misc_feature (1)..( 7): Result.004 file - promoters50/1388438
ccattaa

SEQ ID NO: 167742 - DNA, 7 bp, Unknown
  misc_feature (1)..( 7): Result.004 file - promoters50/1388438
ccattag

SEQ ID NO: 167743 - DNA, 7 bp, Unknown
  misc_feature (1)..( 7): Result.004 file - promoters50/1388444
ccactaa

SEQ ID NO: 167744 - DNA, 8 bp, Unknown
  misc_feature (1)..( 8): Result.004 file - promoters50/1388444
ttacattt

SEQ ID NO: 167745 - DNA, 8 bp, Unknown
  misc_feature (1)..( 8): Result.004 file - promoters50/1388444
ttacatta

SEQ ID NO: 167746 - DNA, 8 bp, Unknown
  misc_feature (1)..( 8): Result.004 file - promoters50/1388444
ttagatta

SEQ ID NO: 167747 - DNA, 10 bp, Unknown
  misc_feature (1)..( 10): Result.004 file - promoters50/1388444
tgtataaata

SEQ ID NO: 167748 - DNA, 10 bp, Unknown
  misc_feature (1)..( 10): Result.004 file - promoters50/1388444
tttattaata

SEQ ID NO: 167749 - DNA, 10 bp, Unknown
  misc_feature (1)..( 10): Result.004 file - promoters50/1388444
ttttttataa

SEQ ID NO: 167750 - DNA, 7 bp, Unknown
  misc_feature (1)..( 7): Result.004 file - promoters50/1388444
catatag

SEQ ID NO: 167751 - DNA, 7 bp, Unknown
  misc_feature (1)..( 7): Result.004 file - promoters50/1388444
catatat

SEQ ID NO: 167752 - DNA, 7 bp, Unknown
  misc_feature (1)..( 7): Result.004 file - promoters50/1388468
catttat

SEQ ID NO: 167753 - DNA, 11 bp, Unknown
  misc_feature (1)..( 11): Result.004 file - promoters50/1388468
atgtttattag

SEQ ID NO: 167754 - DNA, 11 bp, Unknown
  misc_feature (1)..( 11): Result.004 file - promoters50/1388468
atgttaattgg

SEQ ID NO: 167755 - DNA, 11 bp, Unknown
  misc_feature (1)..( 11): Result.004 file - promoters50/1388468
tagtttctgtt

SEQ ID NO: 167756 - DNA, 11 bp, Unknown
  misc_feature (1)..( 11): Result.004 file - promoters50/1388468
aaaaacaaaaa

SEQ ID NO: 167757 - DNA, 11 bp, Unknown
  misc_feature (1)..( 11): Result.004 file - promoters50/1388468
caaaagaaaaa

SEQ ID NO: 167758 - DNA, 11 bp, Unknown
  misc_feature (1)..( 11): Result.004 file - promoters50/1388468
caaaggaaggt

SEQ ID NO: 167759 - DNA, 8 bp, Unknown
  misc_feature (1)..( 8): Result.004 file - promoters50/1388468
aattaact

SEQ ID NO: 167760 - DNA, 8 bp, Unknown
  misc_feature (1)..( 8): Result.004 file - promoters50/1388468
aatttact

SEQ ID NO: 167761 - DNA, 8 bp, Unknown
  misc_feature (1)..( 8): Result.004 file - promoters50/1388484
aatttata

SEQ ID NO: 167762 - DNA, 8 bp, Unknown
  misc_feature (1)..( 8): Result.004 file - promoters50/1388484
gaatcaca

SEQ ID NO: 167763 - DNA, 8 bp, Unknown
  misc_feature (1)..( 8): Result.004 file - promoters50/1388484
gaatcaat

SEQ ID NO: 167764 - DNA, 8 bp, Unknown
  misc_feature (1)..( 8): Result.004 file - promoters50/1388484
taataaat

SEQ ID NO: 167765 - DNA, 7 bp, Unknown
  misc_feature (1)..( 7): Result.004 file - promoters50/1388484
cttcaat

SEQ ID NO: 167766 - DNA, 7 bp, Unknown
  misc_feature (1)..( 7): Result.004 file - promoters50/1388484
tttcaat

SEQ ID NO: 167767 - DNA, 7 bp, Unknown
  misc_feature (1)..( 7): Result.004 file - promoters50/1388484
tttcaaa

SEQ ID NO: 167768 - DNA, 9 bp, Unknown
  misc_feature (1)..( 9): Result.004 file - promoters50/1388484
gaattcaga

SEQ ID NO: 167769 - DNA, 9 bp, Unknown
  misc_feature (1)..( 9): Result.004 file - promoters50/1388484
gaatttaga

SEQ ID NO: 167770 - DNA, 9 bp, Unknown
  misc_feature (1)..( 9): Result.004 file - promoters50/1388484
taattcact

SEQ ID NO: 167771 - DNA, 8 bp, Unknown
  misc_feature (1)..( 8): Result.004 file - promoters50/1388484
agttattt

SEQ ID NO: 167772 - DNA, 8 bp, Unknown
  misc_feature (1)..( 8): Result.004 file - promoters50/1388484
agttcttt

SEQ ID NO: 167773 - DNA, 8 bp, Unknown
  misc_feature (1)..( 8): Result.004 file - promoters50/1388484
tgttattc

SEQ ID NO: 167774 - DNA, 10 bp, Unknown
  misc_feature (1)..( 10): Result.004 file - promoters50/1388484
tgcttatgat

SEQ ID NO: 167775 - DNA, 10 bp, Unknown
  misc_feature (1)..( 10): Result.004 file - promoters50/1388484
aacttttgat

SEQ ID NO: 167776 - DNA, 10 bp, Unknown
  misc_feature (1)..( 10): Result.004 file - promoters50/1388545
tgcatatgtt

SEQ ID NO: 167777 - DNA, 10 bp, Unknown
  misc_feature (1)..( 10): Result.004 file - promoters50/1388545
ctattaagca

SEQ ID NO: 167778 - DNA, 10 bp, Unknown
  misc_feature (1)..( 10): Result.004 file - promoters50/1388545
ttatgaagat

SEQ ID NO: 167779 - DNA, 10 bp, Unknown
  misc_feature (1)..( 10): Result.004 file - promoters50/1388545
aaatgatgat

SEQ ID NO: 167780 - DNA, 10 bp, Unknown
  misc_feature (1)..( 10): Result.004 file - promoters50/1388545
atatgaatca

SEQ ID NO: 167781 - DNA, 10 bp, Unknown
  misc_feature (1)..( 10): Result.004 file - promoters50/1388545
ttacgaatac

SEQ ID NO: 167782 - DNA, 10 bp, Unknown
  misc_feature (1)..( 10): Result.004 file - promoters50/1388593
gtatgattac

SEQ ID NO: 167783 - DNA, 8 bp, Unknown
  misc_feature (1)..( 8): Result.004 file - promoters50/1388593
attattta

SEQ ID NO: 167784 - DNA, 8 bp, Unknown
  misc_feature (1)..( 8): Result.004 file - promoters50/1388593
attatttt

SEQ ID NO: 167785 - DNA, 8 bp, Unknown
  misc_feature (1)..( 8): Result.004 file - promoters50/1388593
actatttt

SEQ ID NO: 167786 - DNA, 8 bp, Unknown
  misc_feature (1)..( 8): Result.004 file - promoters50/1388593
gaattata

SEQ ID NO: 167787 - DNA, 8 bp, Unknown
  misc_feature (1)..( 8): Result.004 file - promoters50/1388593
gaagtata

SEQ ID NO: 167788 - DNA, 8 bp, Unknown
  misc_feature (1)..( 8): Result.004 file - promoters50/1388593
aaagtagt

SEQ ID NO: 167789 - DNA, 11 bp, Unknown
  misc_feature (1)..( 11): Result.004 file - promoters50/1388593
aagaaagaagt

SEQ ID NO: 167790 - DNA, 11 bp, Unknown
  misc_feature (1)..( 11): Result.004 file - promoters50/1388593
aagaaaaaagt

SEQ ID NO: 167791 - DNA, 11 bp, Unknown
  misc_feature (1)..( 11): Result.004 file - promoters50/1388661
aagtaaaattc

SEQ ID NO: 167792 - DNA, 9 bp, Unknown
  misc_feature (1)..( 9): Result.004 file - promoters50/1388661
ttgttaatt

SEQ ID NO: 167793 - DNA, 9 bp, Unknown
  misc_feature (1)..( 9): Result.004 file - promoters50/1388661
ttgttactc

SEQ ID NO: 167794 - DNA, 9 bp, Unknown
  misc_feature (1)..( 9): Result.004 file - promoters50/1388661
atgtaaatt

SEQ ID NO: 167795 - DNA, 7 bp, Unknown
  misc_feature (1)..( 7): Result.004 file - promoters50/1388661
caaaaaa

SEQ ID NO: 167796 - DNA, 7 bp, Unknown
  misc_feature (1)..( 7): Result.004 file - promoters50/1388661
taaaaaa

SEQ ID NO: 167797 - DNA, 7 bp, Unknown
  misc_feature (1)..( 7): Result.004 file - promoters50/1388661
taaaaat

SEQ ID NO: 167798 - DNA, 9 bp, Unknown
  misc_feature (1)..( 9): Result.004 file - promoters50/1388661
tgaagaact

SEQ ID NO: 167799 - DNA, 9 bp, Unknown
  misc_feature (1)..( 9): Result.004 file - promoters50/1388661
aaaagtact

SEQ ID NO: 167800 - DNA, 9 bp, Unknown
  misc_feature (1)..( 9): Result.004 file - promoters50/1388661
aaaagtaaa

SEQ ID NO: 167801 - DNA, 10 bp, Unknown
  misc_feature (1)..( 10): Result.004 file - promoters50/1388661
ttttgttaat

SEQ ID NO: 167802 - DNA, 10 bp, Unknown
  misc_feature (1)..( 10): Result.004 file - promoters50/1388661
atttattaat

SEQ ID NO: 167803 - DNA, 10 bp, Unknown
  misc_feature (1)..( 10): Result.004 file - promoters50/1388688
atttattttt

SEQ ID NO: 167804 - DNA, 11 bp, Unknown
  misc_feature (1)..( 11): Result.004 file - promoters50/1388688
agatgtctttt

SEQ ID NO: 167805 - DNA, 11 bp, Unknown
  misc_feature (1)..( 11): Result.004 file - promoters50/1388688
agatatctaaa

SEQ ID NO: 167806 - DNA, 11 bp, Unknown
  misc_feature (1)..( 11): Result.004 file - promoters50/1388688
ctctatttaaa

SEQ ID NO: 167807 - DNA, 9 bp, Unknown
  misc_feature (1)..( 9): Result.004 file - promoters50/1388688
ctttactag

SEQ ID NO: 167808 - DNA, 9 bp, Unknown
  misc_feature (1)..( 9): Result.004 file - promoters50/1388688
gtttaatag

SEQ ID NO: 167809 - DNA, 9 bp, Unknown
  misc_feature (1)..( 9): Result.004 file - promoters50/1388688
gtttaaggt

SEQ ID NO: 167810 - DNA, 9 bp, Unknown
  misc_feature (1)..( 9): Result.004 file - promoters50/1388688
tgtcttttt

SEQ ID NO: 167811 - DNA, 9 bp, Unknown
  misc_feature (1)..( 9): Result.004 file - promoters50/1388688
actctattt

SEQ ID NO: 167812 - DNA, 9 bp, Unknown
  misc_feature (1)..( 9): Result.004 file - promoters50/1388688
tatctaaaa

SEQ ID NO: 167813 - DNA, 8 bp, Unknown
  misc_feature (1)..( 8): Result.004 file - promoters50/1388688
aacaaagt

SEQ ID NO: 167814 - DNA, 8 bp, Unknown
  misc_feature (1)..( 8): Result.004 file - promoters50/1388688
tacaaagt

SEQ ID NO: 167815 - DNA, 8 bp, Unknown
  misc_feature (1)..( 8): Result.004 file - promoters50/1388688
aacaaaac

SEQ ID NO: 167816 - DNA, 7 bp, Unknown
  misc_feature (1)..( 7): Result.004 file - promoters50/1388688
taaaaaa

SEQ ID NO: 167817 - DNA, 7 bp, Unknown
  misc_feature (1)..( 7): Result.004 file - promoters50/1388688
caaaaaa

SEQ ID NO: 167818 - DNA, 7 bp, Unknown
  misc_feature (1)..( 7): Result.004 file - promoters50/1388688
taaaaac

SEQ ID NO: 167819 - DNA, 13 bp, Unknown
  misc_feature (1)..( 13): Result.004 file - promoters50/1388688
ataatattttaat

SEQ ID NO: 167820 - DNA, 13 bp, Unknown
  misc_feature (1)..( 13): Result.004 file - promoters50/1388688
ctaatatttaaat

SEQ ID NO: 167821 - DNA, 13 bp, Unknown
  misc_feature (1)..( 13): Result.004 file - promoters50/1388688
ttaatttatcaat

SEQ ID NO: 167822 - DNA, 8 bp, Unknown
  misc_feature (1)..( 8): Result.004 file - promoters50/1388688
aaaattat

SEQ ID NO: 167823 - DNA, 8 bp, Unknown
  misc_feature (1)..( 8): Result.004 file - promoters50/1388688
aaaaatat

SEQ ID NO: 167824 - DNA, 8 bp, Unknown
  misc_feature (1)..( 8): Result.004 file - promoters50/1388688
aaaaaaca

SEQ ID NO: 167825 - DNA, 8 bp, Unknown
  misc_feature (1)..( 8): Result.004 file - promoters50/1388688
aaaaacgg

SEQ ID NO: 167826 - DNA, 8 bp, Unknown
  misc_feature (1)..( 8): Result.004 file - promoters50/1388688
aaaaacaa

SEQ ID NO: 167827 - DNA, 8 bp, Unknown
  misc_feature (1)..( 8): Result.004 file - promoters50/1388688
taaaacaa

SEQ ID NO: 167828 - DNA, 7 bp, Unknown
  misc_feature (1)..( 7): Result.004 file - promoters50/1388688
ttaattg

SEQ ID NO: 167829 - DNA, 7 bp, Unknown
  misc_feature (1)..( 7): Result.004 file - promoters50/1388688
ttaattt

SEQ ID NO: 167830 - DNA, 8 bp, Unknown
  misc_feature (1)..( 8): Result.004 file - promoters50/1388692
ttaaatta

SEQ ID NO: 167831 - DNA, 11 bp, Unknown
  misc_feature (1)..( 11): Result.004 file - promoters50/1388692
ttgtttttttg

SEQ ID NO: 167832 - DNA, 11 bp, Unknown
  misc_feature (1)..( 11): Result.004 file - promoters50/1388692
atgttatttaa

SEQ ID NO: 167833 - DNA, 11 bp, Unknown
  misc_feature (1)..( 11): Result.004 file - promoters50/1388692
ttgtctttcgc

SEQ ID NO: 167834 - DNA, 11 bp, Unknown
  misc_feature (1)..( 11): Result.004 file - promoters50/1388692
cttttatgtaa

SEQ ID NO: 167835 - DNA, 12 bp, Unknown
  misc_feature (1)..( 12): Result.004 file - promoters50/1388692
tttgtaaattgt

SEQ ID NO: 167836 - DNA, 12 bp, Unknown
  misc_feature (1)..( 12): Result.004 file - promoters50/1388692
attgtaaaagat

SEQ ID NO: 167837 - DNA, 13 bp, Unknown
  misc_feature (1)..( 13): Result.004 file - promoters50/1388692
attgttaaacata

SEQ ID NO: 167838 - DNA, 13 bp, Unknown
  misc_feature (1)..( 13): Result.004 file - promoters50/1388741
gcaggtaaaacct

SEQ ID NO: 167839 - DNA, 9 bp, Unknown
  misc_feature (1)..( 9): Result.004 file - promoters50/1388741
gaaaagatc

SEQ ID NO: 167840 - DNA, 9 bp, Unknown
  misc_feature (1)..( 9): Result.004 file - promoters50/1388741
aaaatgata

SEQ ID NO: 167841 - DNA, 9 bp, Unknown
  misc_feature (1)..( 9): Result.004 file - promoters50/1388741
aaaataata

SEQ ID NO: 167842 - DNA, 8 bp, Unknown
  misc_feature (1)..( 8): Result.004 file - promoters50/1388741
ggagaaaa

SEQ ID NO: 167843 - DNA, 8 bp, Unknown
  misc_feature (1)..( 8): Result.004 file - promoters50/1388741
aaagaaaa

SEQ ID NO: 167844 - DNA, 8 bp, Unknown
  misc_feature (1)..( 8): Result.004 file - promoters50/1388775
aaacaaaa

SEQ ID NO: 167845 - DNA, 8 bp, Unknown
  misc_feature (1)..( 8): Result.004 file - promoters50/1388775
aataaata

SEQ ID NO: 167846 - DNA, 8 bp, Unknown
  misc_feature (1)..( 8): Result.004 file - promoters50/1388775
aatatata

SEQ ID NO: 167847 - DNA, 8 bp, Unknown
  misc_feature (1)..( 8): Result.004 file - promoters50/1388775
aatttatt

SEQ ID NO: 167848 - DNA, 8 bp, Unknown
  misc_feature (1)..( 8): Result.004 file - promoters50/1388775
ataaatga

SEQ ID NO: 167849 - DNA, 8 bp, Unknown
  misc_feature (1)..( 8): Result.004 file - promoters50/1388775
ataaatgc

SEQ ID NO: 167850 - DNA, 8 bp, Unknown
  misc_feature (1)..( 8): Result.004 file - promoters50/1388793
acaaatgc

SEQ ID NO: 167851 - DNA, 19 bp, Unknown
  misc_feature (1)..( 19): Result.004 file - promoters50/1388793
aacaaactacaaaagttta

SEQ ID NO: 167852 - DNA, 19 bp, Unknown
  misc_feature (1)..( 19): Result.004 file - promoters50/1388793
ttagagcagaaaatgtttt

SEQ ID NO: 167853 - DNA, 19 bp, Unknown
  misc_feature (1)..( 19): Result.004 file - promoters50/1388793
agtttagggaaaatggatc

SEQ ID NO: 167854 - DNA, 19 bp, Unknown
  misc_feature (1)..( 19): Result.004 file - promoters50/1388793
ccaacacattcaatatttt

SEQ ID NO: 167855 - DNA, 8 bp, Unknown
  misc_feature (1)..( 8): Result.004 file - promoters50/1388793
aatgtttt

SEQ ID NO: 167856 - DNA, 8 bp, Unknown
  misc_feature (1)..( 8): Result.004 file - promoters50/1388793
aatatttt

SEQ ID NO: 167857 - DNA, 8 bp, Unknown
  misc_feature (1)..( 8): Result.004 file - promoters50/1388793
aatgtttt

SEQ ID NO: 167858 - DNA, 6 bp, Unknown
  misc_feature (1)..( 6): Result.004 file - promoters50/1388793
ttttac

SEQ ID NO: 167859 - DNA, 6 bp, Unknown
  misc_feature (1)..( 6): Result.004 file - promoters50/1388793
ttttac

SEQ ID NO: 167860 - DNA, 6 bp, Unknown
  misc_feature (1)..( 6): Result.004 file - promoters50/1388793
ttttac

SEQ ID NO: 167861 - DNA, 9 bp, Unknown
  misc_feature (1)..( 9): Result.004 file - promoters50/1388793
acattcaat

SEQ ID NO: 167862 - DNA, 9 bp, Unknown
  misc_feature (1)..( 9): Result.004 file - promoters50/1388793
acatttaat

SEQ ID NO: 167863 - DNA, 9 bp, Unknown
  misc_feature (1)..( 9): Result.004 file - promoters50/1388793
acattcaat

SEQ ID NO: 167864 - DNA, 6 bp, Unknown
  misc_feature (1)..( 6): Result.004 file - promoters50/1388793
cattat

SEQ ID NO: 167865 - DNA, 6 bp, Unknown
  misc_feature (1)..( 6): Result.004 file - promoters50/1388793
cattat

SEQ ID NO: 167866 - DNA, 6 bp, Unknown
  misc_feature (1)..( 6): Result.004 file - promoters50/1388793
cattat

SEQ ID NO: 167867 - DNA, 7 bp, Unknown
  misc_feature (1)..( 7): Result.004 file - promoters50/1388793
acgcaaa

SEQ ID NO: 167868 - DNA, 7 bp, Unknown
  misc_feature (1)..( 7): Result.004 file - promoters50/1388793
acggaaa

SEQ ID NO: 167869 - DNA, 7 bp, Unknown
  misc_feature (1)..( 7): Result.004 file - promoters50/1388793
acgcaaa

SEQ ID NO: 167870 - DNA, 7 bp, Unknown
  misc_feature (1)..( 7): Result.004 file - promoters50/1388793
aattatc

SEQ ID NO: 167871 - DNA, 7 bp, Unknown
  misc_feature (1)..( 7): Result.004 file - promoters50/1388793
cattatc

SEQ ID NO: 167872 - DNA, 7 bp, Unknown
  misc_feature (1)..( 7): Result.004 file - promoters50/1388793
cattata

SEQ ID NO: 167873 - DNA, 7 bp, Unknown
  misc_feature (1)..( 7): Result.004 file - promoters50/1388852
aattatc

SEQ ID NO: 167874 - DNA, 9 bp, Unknown
  misc_feature (1)..( 9): Result.004 file - promoters50/1388852
aaatatgaa

SEQ ID NO: 167875 - DNA, 9 bp, Unknown
  misc_feature (1)..( 9): Result.004 file - promoters50/1388852
aaacatgtg

SEQ ID NO: 167876 - DNA, 9 bp, Unknown
  misc_feature (1)..( 9): Result.004 file - promoters50/1388852
caataagaa

SEQ ID NO: 167877 - DNA, 6 bp, Unknown
  misc_feature (1)..( 6): Result.004 file - promoters50/1388852
tttttt

SEQ ID NO: 167878 - DNA, 6 bp, Unknown
  misc_feature (1)..( 6): Result.004 file - promoters50/1388852
tttttt

SEQ ID NO: 167879 - DNA, 6 bp, Unknown
  misc_feature (1)..( 6): Result.004 file - promoters50/1388852
tttttt

SEQ ID NO: 167880 - DNA, 12 bp, Unknown
  misc_feature (1)..( 12): Result.004 file - promoters50/1388852
ctttaccaattc

SEQ ID NO: 167881 - DNA, 12 bp, Unknown
  misc_feature (1)..( 12): Result.004 file - promoters50/1388852
ctttacaaacac

SEQ ID NO: 167882 - DNA, 12 bp, Unknown
  misc_feature (1)..( 12): Result.004 file - promoters50/1388864
tttttcaaacac

SEQ ID NO: 167883 - DNA, 7 bp, Unknown
  misc_feature (1)..( 7): Result.004 file - promoters50/1388864
ctcagag

SEQ ID NO: 167884 - DNA, 7 bp, Unknown
  misc_feature (1)..( 7): Result.004 file - promoters50/1388864
ctcagaa

SEQ ID NO: 167885 - DNA, 7 bp, Unknown
  misc_feature (1)..( 7): Result.004 file - promoters50/1388872
ctcggaa

SEQ ID NO: 167886 - DNA, 8 bp, Unknown
  misc_feature (1)..( 8): Result.004 file - promoters50/1388872
aattttta

SEQ ID NO: 167887 - DNA, 8 bp, Unknown
  misc_feature (1)..( 8): Result.004 file - promoters50/1388872
aatttttt

SEQ ID NO: 167888 - DNA, 8 bp, Unknown
  misc_feature (1)..( 8): Result.004 file - promoters50/1388872
aattttgg

SEQ ID NO: 167889 - DNA, 8 bp, Unknown
  misc_feature (1)..( 8): Result.004 file - promoters50/1388872
gatttttg

SEQ ID NO: 167890 - DNA, 7 bp, Unknown
  misc_feature (1)..( 7): Result.004 file - promoters50/1388872
tttcttt

SEQ ID NO: 167891 - DNA, 11 bp, Unknown
  misc_feature (1)..( 11): Result.004 file - promoters50/1388872
aatttttttct

SEQ ID NO: 167892 - DNA, 11 bp, Unknown
  misc_feature (1)..( 11): Result.004 file - promoters50/1388872
aattttgctga

SEQ ID NO: 167893 - DNA, 11 bp, Unknown
  misc_feature (1)..( 11): Result.004 file - promoters50/1388872
aatttggctcc

SEQ ID NO: 167894 - DNA, 11 bp, Unknown
  misc_feature (1)..( 11): Result.004 file - promoters50/1388872
aatgtggtgat

SEQ ID NO: 167895 - DNA, 11 bp, Unknown
  misc_feature (1)..( 11): Result.004 file - promoters50/1388872
aatttggatcc

SEQ ID NO: 167896 - DNA, 11 bp, Unknown
  misc_feature (1)..( 11): Result.004 file - promoters50/1388872
ataacattttt

SEQ ID NO: 167897 - DNA, 11 bp, Unknown
  misc_feature (1)..( 11): Result.004 file - promoters50/1388872
atatcatccaa

SEQ ID NO: 167898 - DNA, 11 bp, Unknown
  misc_feature (1)..( 11): Result.004 file - promoters50/1388872
ttaagattttt

SEQ ID NO: 167899 - DNA, 11 bp, Unknown
  misc_feature (1)..( 11): Result.004 file - promoters50/1388872
ttagaattttt

SEQ ID NO: 167900 - DNA, 10 bp, Unknown
  misc_feature (1)..( 10): Result.004 file - promoters50/1388910
tttctttgac

SEQ ID NO: 167901 - DNA, 12 bp, Unknown
  misc_feature (1)..( 12): Result.004 file - promoters50/1388910
ccattttgacta

SEQ ID NO: 167902 - DNA, 12 bp, Unknown
  misc_feature (1)..( 12): Result.004 file - promoters50/1388910
tatgtttaactg

SEQ ID NO: 167903 - DNA, 12 bp, Unknown
  misc_feature (1)..( 12): Result.004 file - promoters50/1388910
gttctttaacta

SEQ ID NO: 167904 - DNA, 12 bp, Unknown
  misc_feature (1)..( 12): Result.004 file - promoters50/1388910
tgtttttgattc

SEQ ID NO: 167905 - DNA, 12 bp, Unknown
  misc_feature (1)..( 12): Result.004 file - promoters50/1388910
acagtttaacaa

SEQ ID NO: 167906 - DNA, 12 bp, Unknown
  misc_feature (1)..( 12): Result.004 file - promoters50/1388910
tatgtttaatgg

SEQ ID NO: 167907 - DNA, 14 bp, Unknown
  misc_feature (1)..( 14): Result.004 file - promoters50/1388910
aataaaatggacgg

SEQ ID NO: 167908 - DNA, 14 bp, Unknown
  misc_feature (1)..( 14): Result.004 file - promoters50/1388910
actgaaatagactt

SEQ ID NO: 167909 - DNA, 14 bp, Unknown
  misc_feature (1)..( 14): Result.004 file - promoters50/1388910
ttaaaaatgcatgc

SEQ ID NO: 167910 - DNA, 14 bp, Unknown
  misc_feature (1)..( 14): Result.004 file - promoters50/1388910
tgtttaatggatta

SEQ ID NO: 167911 - DNA, 14 bp, Unknown
  misc_feature (1)..( 14): Result.004 file - promoters50/1388910
ttagaaacagactt

SEQ ID NO: 167912 - DNA, 14 bp, Unknown
  misc_feature (1)..( 14): Result.004 file - promoters50/1388910
ttaacaatttaaaa

SEQ ID NO: 167913 - DNA, 14 bp, Unknown
  misc_feature (1)..( 14): Result.004 file - promoters50/1388910
tgcgaaacaccctg

SEQ ID NO: 167914 - DNA, 11 bp, Unknown
  misc_feature (1)..( 11): Result.004 file - promoters50/1388910
gcaaatatcta

SEQ ID NO: 167915 - DNA, 11 bp, Unknown
  misc_feature (1)..( 11): Result.004 file - promoters50/1388910
tgaaatatttt

SEQ ID NO: 167916 - DNA, 11 bp, Unknown
  misc_feature (1)..( 11): Result.004 file - promoters50/1388910
taaaaaatcgt

SEQ ID NO: 167917 - DNA, 11 bp, Unknown
  misc_feature (1)..( 11): Result.004 file - promoters50/1388910
ggaaaaaacat

SEQ ID NO: 167918 - DNA, 12 bp, Unknown
  misc_feature (1)..( 12): Result.004 file - promoters50/1388910
ggaacaaaggag

SEQ ID NO: 167919 - DNA, 12 bp, Unknown
  misc_feature (1)..( 12): Result.004 file - promoters50/1388910
taaaacaataga

SEQ ID NO: 167920 - DNA, 12 bp, Unknown
  misc_feature (1)..( 12): Result.004 file - promoters50/1388973
actggaaattcg

SEQ ID NO: 167921 - DNA, 15 bp, Unknown
  misc_feature (1)..( 15): Result.004 file - promoters50/1388973
tgtcttattaaacaa

SEQ ID NO: 167922 - DNA, 15 bp, Unknown
  misc_feature (1)..( 15): Result.004 file - promoters50/1388973
attctaattgcagct

SEQ ID NO: 167923 - DNA, 15 bp, Unknown
  misc_feature (1)..( 15): Result.004 file - promoters50/1388973
tctcttatccaatct

SEQ ID NO: 167924 - DNA, 15 bp, Unknown
  misc_feature (1)..( 15): Result.004 file - promoters50/1388973
tgtctaattatacaa

SEQ ID NO: 167925 - DNA, 15 bp, Unknown
  misc_feature (1)..( 15): Result.004 file - promoters50/1388973
agtctaaagagttgt

SEQ ID NO: 167926 - DNA, 15 bp, Unknown
  misc_feature (1)..( 15): Result.004 file - promoters50/1389231
catctaaaaataaca

SEQ ID NO: 167927 - DNA, 9 bp, Unknown
  misc_feature (1)..( 9): Result.004 file - promoters50/1389231
ttttccttt

SEQ ID NO: 167928 - DNA, 9 bp, Unknown
  misc_feature (1)..( 9): Result.004 file - promoters50/1389231
tttttcttt

SEQ ID NO: 167929 - DNA, 9 bp, Unknown
  misc_feature (1)..( 9): Result.004 file - promoters50/1389231
attttattt

SEQ ID NO: 167930 - DNA, 8 bp, Unknown
  misc_feature (1)..( 8): Result.004 file - promoters50/1389231
ctttcatt

SEQ ID NO: 167931 - DNA, 8 bp, Unknown
  misc_feature (1)..( 8): Result.004 file - promoters50/1389231
ctttcaag

SEQ ID NO: 167932 - DNA, 8 bp, Unknown
  misc_feature (1)..( 8): Result.004 file - promoters50/1389231
attttatt

SEQ ID NO: 167933 - DNA, 8 bp, Unknown
  misc_feature (1)..( 8): Result.004 file - promoters50/1389231
attaacaa

SEQ ID NO: 167934 - DNA, 8 bp, Unknown
  misc_feature (1)..( 8): Result.004 file - promoters50/1389231
attaacac

SEQ ID NO: 167935 - DNA, 8 bp, Unknown
  misc_feature (1)..( 8): Result.004 file - promoters50/1389231
gttaacaa

SEQ ID NO: 167936 - DNA, 8 bp, Unknown
  misc_feature (1)..( 8): Result.004 file - promoters50/1389231
ttttcttt

SEQ ID NO: 167937 - DNA, 8 bp, Unknown
  misc_feature (1)..( 8): Result.004 file - promoters50/1389231
ttttattt

SEQ ID NO: 167938 - DNA, 8 bp, Unknown
  misc_feature (1)..( 8): Result.004 file - promoters50/1389231
ttttcttt

SEQ ID NO: 167939 - DNA, 9 bp, Unknown
  misc_feature (1)..( 9): Result.004 file - promoters50/1389231
aaataaaat

SEQ ID NO: 167940 - DNA, 9 bp, Unknown
  misc_feature (1)..( 9): Result.004 file - promoters50/1389231
aaatcaaat

SEQ ID NO: 167941 - DNA, 9 bp, Unknown
  misc_feature (1)..( 9): Result.004 file - promoters50/1389243
aaataaaat

SEQ ID NO: 167942 - DNA, 13 bp, Unknown
  misc_feature (1)..( 13): Result.004 file - promoters50/1389243
agtaatataaatt

SEQ ID NO: 167943 - DNA, 13 bp, Unknown
  misc_feature (1)..( 13): Result.004 file - promoters50/1389243
atgaatttaaatt

SEQ ID NO: 167944 - DNA, 13 bp, Unknown
  misc_feature (1)..( 13): Result.004 file - promoters50/1389243
atcaatttaaaaa

SEQ ID NO: 167945 - DNA, 13 bp, Unknown
  misc_feature (1)..( 13): Result.004 file - promoters50/1389243
agtaatatttgag

SEQ ID NO: 167946 - DNA, 13 bp, Unknown
  misc_feature (1)..( 13): Result.004 file - promoters50/1389243
tacaatttcactc

SEQ ID NO: 167947 - DNA, 13 bp, Unknown
  misc_feature (1)..( 13): Result.004 file - promoters50/1389243
attaagatttttt

SEQ ID NO: 167948 - DNA, 13 bp, Unknown
  misc_feature (1)..( 13): Result.004 file - promoters50/1389243
gagaatttttgta

SEQ ID NO: 167949 - DNA, 10 bp, Unknown
  misc_feature (1)..( 10): Result.004 file - promoters50/1389243
tcttaagaat

SEQ ID NO: 167950 - DNA, 10 bp, Unknown
  misc_feature (1)..( 10): Result.004 file - promoters50/1389243
gtataagaat

SEQ ID NO: 167951 - DNA, 10 bp, Unknown
  misc_feature (1)..( 10): Result.004 file - promoters50/1389243
atttaaaaat

SEQ ID NO: 167952 - DNA, 10 bp, Unknown
  misc_feature (1)..( 10): Result.004 file - promoters50/1389243
ttttaaagtt

SEQ ID NO: 167953 - DNA, 10 bp, Unknown
  misc_feature (1)..( 10): Result.004 file - promoters50/1389243
aattaagaaa

SEQ ID NO: 167954 - DNA, 10 bp, Unknown
  misc_feature (1)..( 10): Result.004 file - promoters50/1389250
cattcagatg

SEQ ID NO: 167955 - DNA, 7 bp, Unknown
  misc_feature (1)..( 7): Result.004 file - promoters50/1389250
catctat

SEQ ID NO: 167956 - DNA, 7 bp, Unknown
  misc_feature (1)..( 7): Result.004 file - promoters50/1389250
catttat

SEQ ID NO: 167957 - DNA, 7 bp, Unknown
  misc_feature (1)..( 7): Result.004 file - promoters50/1389250
catctat

SEQ ID NO: 167958 - DNA, 10 bp, Unknown
  misc_feature (1)..( 10): Result.004 file - promoters50/1389250
tatcttttca

SEQ ID NO: 167959 - DNA, 10 bp, Unknown
  misc_feature (1)..( 10): Result.004 file - promoters50/1389250
caacttgtca

SEQ ID NO: 167960 - DNA, 10 bp, Unknown
  misc_feature (1)..( 10): Result.004 file - promoters50/1389279
caatttgtac

SEQ ID NO: 167961 - DNA, 7 bp, Unknown
  misc_feature (1)..( 7): Result.004 file - promoters50/1389279
caatgtt

SEQ ID NO: 167962 - DNA, 7 bp, Unknown
  misc_feature (1)..( 7): Result.004 file - promoters50/1389279
caatgta

SEQ ID NO: 167963 - DNA, 7 bp, Unknown
  misc_feature (1)..( 7): Result.004 file - promoters50/1389279
gaatgtt

SEQ ID NO: 167964 - DNA, 7 bp, Unknown
  misc_feature (1)..( 7): Result.004 file - promoters50/1389279
agaaaaa

SEQ ID NO: 167965 - DNA, 7 bp, Unknown
  misc_feature (1)..( 7): Result.004 file - promoters50/1389279
ggaaaaa

SEQ ID NO: 167966 - DNA, 8 bp, Unknown
  misc_feature (1)..( 8): Result.004 file - promoters50/1389279
agacaaaa

SEQ ID NO: 167967 - DNA, 8 bp, Unknown
  misc_feature (1)..( 8): Result.004 file - promoters50/1389279
acaaaaat

SEQ ID NO: 167968 - DNA, 8 bp, Unknown
  misc_feature (1)..( 8): Result.004 file - promoters50/1389279
acaaaaaa

SEQ ID NO: 167969 - DNA, 8 bp, Unknown
  misc_feature (1)..( 8): Result.004 file - promoters50/1389279
gcaaaaat

SEQ ID NO: 167970 - DNA, 8 bp, Unknown
  misc_feature (1)..( 8): Result.004 file - promoters50/1389279
tatatata

SEQ ID NO: 167971 - DNA, 8 bp, Unknown
  misc_feature (1)..( 8): Result.004 file - promoters50/1389279
tatatata

SEQ ID NO: 167972 - DNA, 8 bp, Unknown
  misc_feature (1)..( 8): Result.004 file - promoters50/1389279
tatatata

SEQ ID NO: 167973 - DNA, 9 bp, Unknown
  misc_feature (1)..( 9): Result.004 file - promoters50/1389279
aaaataagc

SEQ ID NO: 167974 - DNA, 9 bp, Unknown
  misc_feature (1)..( 9): Result.004 file - promoters50/1389279
aaaacaagt

SEQ ID NO: 167975 - DNA, 9 bp, Unknown
  misc_feature (1)..( 9): Result.004 file - promoters50/1389301
aatacaagt

SEQ ID NO: 167976 - DNA, 11 bp, Unknown
  misc_feature (1)..( 11): Result.004 file - promoters50/1389301
taataaactga

SEQ ID NO: 167977 - DNA, 11 bp, Unknown
  misc_feature (1)..( 11): Result.004 file - promoters50/1389301
cgatatactga

SEQ ID NO: 167978 - DNA, 11 bp, Unknown
  misc_feature (1)..( 11): Result.004 file - promoters50/1389301
taatgaactac

SEQ ID NO: 167979 - DNA, 7 bp, Unknown
  misc_feature (1)..( 7): Result.004 file - promoters50/1389301
ttcttga

SEQ ID NO: 167980 - DNA, 7 bp, Unknown
  misc_feature (1)..( 7): Result.004 file - promoters50/1389301
ctcttga

SEQ ID NO: 167981 - DNA, 7 bp, Unknown
  misc_feature (1)..( 7): Result.004 file - promoters50/1389330
ctcctga

SEQ ID NO: 167982 - DNA, 6 bp, Unknown
  misc_feature (1)..( 6): Result.004 file - promoters50/1389330
tttaaa

SEQ ID NO: 167983 - DNA, 6 bp, Unknown
  misc_feature (1)..( 6): Result.004 file - promoters50/1389330
tttaaa

SEQ ID NO: 167984 - DNA, 6 bp, Unknown
  misc_feature (1)..( 6): Result.004 file - promoters50/1389330
tttaaa

SEQ ID NO: 167985 - DNA, 10 bp, Unknown
  misc_feature (1)..( 10): Result.004 file - promoters50/1389330
ttaacaataa

SEQ ID NO: 167986 - DNA, 10 bp, Unknown
  misc_feature (1)..( 10): Result.004 file - promoters50/1389330
ttaaaaatca

SEQ ID NO: 167987 - DNA, 10 bp, Unknown
  misc_feature (1)..( 10): Result.004 file - promoters50/1389401
gtaacaataa

SEQ ID NO: 167988 - DNA, 12 bp, Unknown
  misc_feature (1)..( 12): Result.004 file - promoters50/1389401
catgaaaaatta

SEQ ID NO: 167989 - DNA, 12 bp, Unknown
  misc_feature (1)..( 12): Result.004 file - promoters50/1389401
catgaataattt

SEQ ID NO: 167990 - DNA, 12 bp, Unknown
  misc_feature (1)..( 12): Result.004 file - promoters50/1389401
tagaaaatatta

SEQ ID NO: 167991 - DNA, 9 bp, Unknown
  misc_feature (1)..( 9): Result.004 file - promoters50/1389401
attatgtga

SEQ ID NO: 167992 - DNA, 9 bp, Unknown
  misc_feature (1)..( 9): Result.004 file - promoters50/1389401
attctgttt

SEQ ID NO: 167993 - DNA, 9 bp, Unknown
  misc_feature (1)..( 9): Result.004 file - promoters50/1389401
tctctcttt

SEQ ID NO: 167994 - DNA, 8 bp, Unknown
  misc_feature (1)..( 8): Result.004 file - promoters50/1389401
gcagattc

SEQ ID NO: 167995 - DNA, 8 bp, Unknown
  misc_feature (1)..( 8): Result.004 file - promoters50/1389401
acagattc

SEQ ID NO: 167996 - DNA, 8 bp, Unknown
  misc_feature (1)..( 8): Result.004 file - promoters50/1389401
acagatac

SEQ ID NO: 167997 - DNA, 7 bp, Unknown
  misc_feature (1)..( 7): Result.004 file - promoters50/1389401
aacaaag

SEQ ID NO: 167998 - DNA, 7 bp, Unknown
  misc_feature (1)..( 7): Result.004 file - promoters50/1389401
aacaaaa

SEQ ID NO: 167999 - DNA, 7 bp, Unknown
  misc_feature (1)..( 7): Result.004 file - promoters50/1389401
tacaaaa

SEQ ID NO: 168000 - DNA, 11 bp, Unknown
  misc_feature (1)..( 11): Result.004 file - promoters50/1389401
cataatcgact

SEQ ID NO: 168001 - DNA, 11 bp, Unknown
  misc_feature (1)..( 11): Result.004 file - promoters50/1389401
cataattacat

SEQ ID NO: 168002 - DNA, 11 bp, Unknown
  misc_feature (1)..( 11): Result.004 file - promoters50/1390146
tataattgcat

SEQ ID NO: 168003 - DNA, 12 bp, Unknown
  misc_feature (1)..( 12): Result.004 file - promoters50/1390146
tatatcaaaatt

SEQ ID NO: 168004 - DNA, 12 bp, Unknown
  misc_feature (1)..( 12): Result.004 file - promoters50/1390146
ggtataaaaaga

SEQ ID NO: 168005 - DNA, 12 bp, Unknown
  misc_feature (1)..( 12): Result.004 file - promoters50/1390146
ctttccaaaatg

SEQ ID NO: 168006 - DNA, 12 bp, Unknown
  misc_feature (1)..( 12): Result.004 file - promoters50/1390146
ggtgtaatgagt

SEQ ID NO: 168007 - DNA, 12 bp, Unknown
  misc_feature (1)..( 12): Result.004 file - promoters50/1390146
agtgtaacagat

SEQ ID NO: 168008 - DNA, 12 bp, Unknown
  misc_feature (1)..( 12): Result.004 file - promoters50/1390146
tgaggcaatatg

SEQ ID NO: 168009 - DNA, 10 bp, Unknown
  misc_feature (1)..( 10): Result.004 file - promoters50/1390146
aaatttgaac

SEQ ID NO: 168010 - DNA, 10 bp, Unknown
  misc_feature (1)..( 10): Result.004 file - promoters50/1390146
caatgtgaaa

SEQ ID NO: 168011 - DNA, 10 bp, Unknown
  misc_feature (1)..( 10): Result.004 file - promoters50/1390146
caatatgatt

SEQ ID NO: 168012 - DNA, 10 bp, Unknown
  misc_feature (1)..( 10): Result.004 file - promoters50/1390146
taatttcaac

SEQ ID NO: 168013 - DNA, 10 bp, Unknown
  misc_feature (1)..( 10): Result.004 file - promoters50/1390146
caaaatgtta

SEQ ID NO: 168014 - DNA, 10 bp, Unknown
  misc_feature (1)..( 10): Result.004 file - promoters50/1390240
caatttcaca

SEQ ID NO: 168015 - DNA, 10 bp, Unknown
  misc_feature (1)..( 10): Result.004 file - promoters50/1390240
aaaaagaaaa

SEQ ID NO: 168016 - DNA, 10 bp, Unknown
  misc_feature (1)..( 10): Result.004 file - promoters50/1390240
taaaagtaaa

SEQ ID NO: 168017 - DNA, 10 bp, Unknown
  misc_feature (1)..( 10): Result.004 file - promoters50/1390240
caaaataaac

SEQ ID NO: 168018 - DNA, 10 bp, Unknown
  misc_feature (1)..( 10): Result.004 file - promoters50/1390240
acaaatagaa

SEQ ID NO: 168019 - DNA, 10 bp, Unknown
  misc_feature (1)..( 10): Result.004 file - promoters50/1390240
aaaaatacag

SEQ ID NO: 168020 - DNA, 10 bp, Unknown
  misc_feature (1)..( 10): Result.004 file - promoters50/1390240
aaaaattttt

SEQ ID NO: 168021 - DNA, 8 bp, Unknown
  misc_feature (1)..( 8): Result.004 file - promoters50/1390240
gaaattta

SEQ ID NO: 168022 - DNA, 8 bp, Unknown
  misc_feature (1)..( 8): Result.004 file - promoters50/1390240
gaattttg

SEQ ID NO: 168023 - DNA, 8 bp, Unknown
  misc_feature (1)..( 8): Result.004 file - promoters50/1390240
taatttac

SEQ ID NO: 168024 - DNA, 8 bp, Unknown
  misc_feature (1)..( 8): Result.004 file - promoters50/1390240
gaaaaaat

SEQ ID NO: 168025 - DNA, 8 bp, Unknown
  misc_feature (1)..( 8): Result.004 file - promoters50/1390240
aaaatttt

SEQ ID NO: 168026 - DNA, 8 bp, Unknown
  misc_feature (1)..( 8): Result.004 file - promoters50/1390240
caaaataa

SEQ ID NO: 168027 - DNA, 8 bp, Unknown
  misc_feature (1)..( 8): Result.004 file - promoters50/1390240
gaaacaaa

SEQ ID NO: 168028 - DNA, 13 bp, Unknown
  misc_feature (1)..( 13): Result.004 file - promoters50/1390240
acttgttgacaaa

SEQ ID NO: 168029 - DNA, 13 bp, Unknown
  misc_feature (1)..( 13): Result.004 file - promoters50/1390240
acttgctgagcca

SEQ ID NO: 168030 - DNA, 13 bp, Unknown
  misc_feature (1)..( 13): Result.004 file - promoters50/1390240
ctctgtggactcc

SEQ ID NO: 168031 - DNA, 13 bp, Unknown
  misc_feature (1)..( 13): Result.004 file - promoters50/1390240
tccagttgacagt

SEQ ID NO: 168032 - DNA, 13 bp, Unknown
  misc_feature (1)..( 13): Result.004 file - promoters50/1390240
gcttgcttaacac

SEQ ID NO: 168033 - DNA, 14 bp, Unknown
  misc_feature (1)..( 14): Result.004 file - promoters50/1390240
tgatgtttgattaa

SEQ ID NO: 168034 - DNA, 14 bp, Unknown
  misc_feature (1)..( 14): Result.004 file - promoters50/1390240
gtttgccagattaa

SEQ ID NO: 168035 - DNA, 14 bp, Unknown
  misc_feature (1)..( 14): Result.004 file - promoters50/1390240
tgtctttgtatcaa

SEQ ID NO: 168036 - DNA, 14 bp, Unknown
  misc_feature (1)..( 14): Result.004 file - promoters50/1390240
catgtttatatttt

SEQ ID NO: 168037 - DNA, 14 bp, Unknown
  misc_feature (1)..( 14): Result.004 file - promoters50/1390240
catctctgtggact

SEQ ID NO: 168038 - DNA, 14 bp, Unknown
  misc_feature (1)..( 14): Result.004 file - promoters50/1390240
cactcttaaattat

SEQ ID NO: 168039 - DNA, 14 bp, Unknown
  misc_feature (1)..( 14): Result.004 file - promoters50/1390240
gatgtaaaaattat

SEQ ID NO: 168040 - DNA, 14 bp, Unknown
  misc_feature (1)..( 14): Result.004 file - promoters50/1390240
catctcttgtccag

SEQ ID NO: 168041 - DNA, 13 bp, Unknown
  misc_feature (1)..( 13): Result.004 file - promoters50/1390240
gatgattgtgaac

SEQ ID NO: 168042 - DNA, 13 bp, Unknown
  misc_feature (1)..( 13): Result.004 file - promoters50/1390240
aatgtttgcttct

SEQ ID NO: 168043 - DNA, 13 bp, Unknown
  misc_feature (1)..( 13): Result.004 file - promoters50/1390240
tgtttttgctgat

SEQ ID NO: 168044 - DNA, 13 bp, Unknown
  misc_feature (1)..( 13): Result.004 file - promoters50/1390240
tttgtttgttact

SEQ ID NO: 168045 - DNA, 13 bp, Unknown
  misc_feature (1)..( 13): Result.004 file - promoters50/1390240
aattttttgagta

SEQ ID NO: 168046 - DNA, 13 bp, Unknown
  misc_feature (1)..( 13): Result.004 file - promoters50/1391338
aatgttgggtttt

SEQ ID NO: 168047 - DNA, 8 bp, Unknown
  misc_feature (1)..( 8): Result.004 file - promoters50/1391338
aaaagatt

SEQ ID NO: 168048 - DNA, 8 bp, Unknown
  misc_feature (1)..( 8): Result.004 file - promoters50/1391338
aaaggatt

SEQ ID NO: 168049 - DNA, 8 bp, Unknown
  misc_feature (1)..( 8): Result.004 file - promoters50/1391361
aaaggagc

SEQ ID NO: 168050 - DNA, 8 bp, Unknown
  misc_feature (1)..( 8): Result.004 file - promoters50/1391361
tttctttt

SEQ ID NO: 168051 - DNA, 8 bp, Unknown
  misc_feature (1)..( 8): Result.004 file - promoters50/1391361
cttcgttt

SEQ ID NO: 168052 - DNA, 8 bp, Unknown
  misc_feature (1)..( 8): Result.004 file - promoters50/1391361
tctctttc

SEQ ID NO: 168053 - DNA, 11 bp, Unknown
  misc_feature (1)..( 11): Result.004 file - promoters50/1391361
aatataaaaat

SEQ ID NO: 168054 - DNA, 11 bp, Unknown
  misc_feature (1)..( 11): Result.004 file - promoters50/1391361
gatattaaaat

SEQ ID NO: 168055 - DNA, 11 bp, Unknown
  misc_feature (1)..( 11): Result.004 file - promoters50/1391420
gatatttgttt

SEQ ID NO: 168056 - DNA, 12 bp, Unknown
  misc_feature (1)..( 12): Result.004 file - promoters50/1391420
agaagattctcg

SEQ ID NO: 168057 - DNA, 12 bp, Unknown
  misc_feature (1)..( 12): Result.004 file - promoters50/1391420
cagagattcctc

SEQ ID NO: 168058 - DNA, 12 bp, Unknown
  misc_feature (1)..( 12): Result.004 file - promoters50/1391420
agaacattggat

SEQ ID NO: 168059 - DNA, 12 bp, Unknown
  misc_feature (1)..( 12): Result.004 file - promoters50/1391420
agacgattcggt

SEQ ID NO: 168060 - DNA, 12 bp, Unknown
  misc_feature (1)..( 12): Result.004 file - promoters50/1391420
ccaagaacttcc

SEQ ID NO: 168061 - DNA, 12 bp, Unknown
  misc_feature (1)..( 12): Result.004 file - promoters50/1391420
ttaagactcctc

SEQ ID NO: 168062 - DNA, 12 bp, Unknown
  misc_feature (1)..( 12): Result.004 file - promoters50/1391420
tttaatgggctt

SEQ ID NO: 168063 - DNA, 12 bp, Unknown
  misc_feature (1)..( 12): Result.004 file - promoters50/1391420
tttaatcaagtc

SEQ ID NO: 168064 - DNA, 12 bp, Unknown
  misc_feature (1)..( 12): Result.004 file - promoters50/1391420
cttattgggctt

SEQ ID NO: 168065 - DNA, 12 bp, Unknown
  misc_feature (1)..( 12): Result.004 file - promoters50/1391420
aagtttgggcca

SEQ ID NO: 168066 - DNA, 12 bp, Unknown
  misc_feature (1)..( 12): Result.004 file - promoters50/1391420
caaattgggccc

SEQ ID NO: 168067 - DNA, 12 bp, Unknown
  misc_feature (1)..( 12): Result.004 file - promoters50/1391420
acaaatgggcct

SEQ ID NO: 168068 - DNA, 13 bp, Unknown
  misc_feature (1)..( 13): Result.004 file - promoters50/1391420
ttaatgggcttta

SEQ ID NO: 168069 - DNA, 13 bp, Unknown
  misc_feature (1)..( 13): Result.004 file - promoters50/1391420
acattaggcttta

SEQ ID NO: 168070 - DNA, 13 bp, Unknown
  misc_feature (1)..( 13): Result.004 file - promoters50/1391420
ttattgggcttgg

SEQ ID NO: 168071 - DNA, 13 bp, Unknown
  misc_feature (1)..( 13): Result.004 file - promoters50/1391420
agtttgggccaac

SEQ ID NO: 168072 - DNA, 13 bp, Unknown
  misc_feature (1)..( 13): Result.004 file - promoters50/1391420
aaattgggcccaa

SEQ ID NO: 168073 - DNA, 13 bp, Unknown
  misc_feature (1)..( 13): Result.004 file - promoters50/1391535
caaatgggcctaa

SEQ ID NO: 168074 - DNA, 8 bp, Unknown
  misc_feature (1)..( 8): Result.004 file - promoters50/1391535
agtaaaac

SEQ ID NO: 168075 - DNA, 8 bp, Unknown
  misc_feature (1)..( 8): Result.004 file - promoters50/1391535
gataaaac

SEQ ID NO: 168076 - DNA, 8 bp, Unknown
  misc_feature (1)..( 8): Result.004 file - promoters50/1391535
agtgaaag

SEQ ID NO: 168077 - DNA, 8 bp, Unknown
  misc_feature (1)..( 8): Result.004 file - promoters50/1391535
aaacaaac

SEQ ID NO: 168078 - DNA, 8 bp, Unknown
  misc_feature (1)..( 8): Result.004 file - promoters50/1391535
aaagaaaa

SEQ ID NO: 168079 - DNA, 9 bp, Unknown
  misc_feature (1)..( 9): Result.004 file - promoters50/1391535
aaagtaaag

SEQ ID NO: 168080 - DNA, 9 bp, Unknown
  misc_feature (1)..( 9): Result.004 file - promoters50/1391535
attcaaatc

SEQ ID NO: 168081 - DNA, 9 bp, Unknown
  misc_feature (1)..( 9): Result.004 file - promoters50/1391535
attcaaaaa

SEQ ID NO: 168082 - DNA, 9 bp, Unknown
  misc_feature (1)..( 9): Result.004 file - promoters50/1391535
cgtcaaaaa

SEQ ID NO: 168083 - DNA, 8 bp, Unknown
  misc_feature (1)..( 8): Result.004 file - promoters50/1391535
aaattggt

SEQ ID NO: 168084 - DNA, 8 bp, Unknown
  misc_feature (1)..( 8): Result.004 file - promoters50/1391535
aaattggg

SEQ ID NO: 168085 - DNA, 8 bp, Unknown
  misc_feature (1)..( 8): Result.004 file - promoters50/1391535
taatcggg

SEQ ID NO: 168086 - DNA, 10 bp, Unknown
  misc_feature (1)..( 10): Result.004 file - promoters50/1391535
aaaaatcttg

SEQ ID NO: 168087 - DNA, 10 bp, Unknown
  misc_feature (1)..( 10): Result.004 file - promoters50/1391535
aaatatctta

SEQ ID NO: 168088 - DNA, 10 bp, Unknown
  misc_feature (1)..( 10): Result.004 file - promoters50/1391651
aaataaaata

SEQ ID NO: 168089 - DNA, 8 bp, Unknown
  misc_feature (1)..( 8): Result.004 file - promoters50/1391651
agaacaaa

SEQ ID NO: 168090 - DNA, 8 bp, Unknown
  misc_feature (1)..( 8): Result.004 file - promoters50/1391651
taaacaaa

SEQ ID NO: 168091 - DNA, 8 bp, Unknown
  misc_feature (1)..( 8): Result.004 file - promoters50/1391651
agagcaag

SEQ ID NO: 168092 - DNA, 7 bp, Unknown
  misc_feature (1)..( 7): Result.004 file - promoters50/1391651
taaagaa

SEQ ID NO: 168093 - DNA, 7 bp, Unknown
  misc_feature (1)..( 7): Result.004 file - promoters50/1391651
caaagaa

SEQ ID NO: 168094 - DNA, 7 bp, Unknown
  misc_feature (1)..( 7): Result.004 file - promoters50/1391765
caatgaa

SEQ ID NO: 168095 - DNA, 8 bp, Unknown
  misc_feature (1)..( 8): Result.004 file - promoters50/1391765
tatcttat

SEQ ID NO: 168096 - DNA, 8 bp, Unknown
  misc_feature (1)..( 8): Result.004 file - promoters50/1391765
tattttac

SEQ ID NO: 168097 - DNA, 8 bp, Unknown
  misc_feature (1)..( 8): Result.004 file - promoters50/1391765
cgttttac

SEQ ID NO: 168098 - DNA, 8 bp, Unknown
  misc_feature (1)..( 8): Result.004 file - promoters50/1391765
tgatcatc

SEQ ID NO: 168099 - DNA, 8 bp, Unknown
  misc_feature (1)..( 8): Result.004 file - promoters50/1391765
tgatcatt

SEQ ID NO: 168100 - DNA, 8 bp, Unknown
  misc_feature (1)..( 8): Result.004 file - promoters50/1392370
gtatcatt

SEQ ID NO: 168101 - DNA, 8 bp, Unknown
  misc_feature (1)..( 8): Result.004 file - promoters50/1392370
aattgatc

SEQ ID NO: 168102 - DNA, 8 bp, Unknown
  misc_feature (1)..( 8): Result.004 file - promoters50/1392370
aattgatt

SEQ ID NO: 168103 - DNA, 8 bp, Unknown
  misc_feature (1)..( 8): Result.004 file - promoters50/1392370
gattcatt

SEQ ID NO: 168104 - DNA, 9 bp, Unknown
  misc_feature (1)..( 9): Result.004 file - promoters50/1392370
atatctttt

SEQ ID NO: 168105 - DNA, 9 bp, Unknown
  misc_feature (1)..( 9): Result.004 file - promoters50/1392370
atatttttt

SEQ ID NO: 168106 - DNA, 9 bp, Unknown
  misc_feature (1)..( 9): Result.004 file - promoters50/1392370
aagtttttg

SEQ ID NO: 168107 - DNA, 10 bp, Unknown
  misc_feature (1)..( 10): Result.004 file - promoters50/1392370
ccttataaat

SEQ ID NO: 168108 - DNA, 10 bp, Unknown
  misc_feature (1)..( 10): Result.004 file - promoters50/1392370
ttctataaat

SEQ ID NO: 168109 - DNA, 10 bp, Unknown
  misc_feature (1)..( 10): Result.004 file - promoters50/1392427
ttctataagt

SEQ ID NO: 168110 - DNA, 8 bp, Unknown
  misc_feature (1)..( 8): Result.004 file - promoters50/1392427
aattcaaa

SEQ ID NO: 168111 - DNA, 8 bp, Unknown
  misc_feature (1)..( 8): Result.004 file - promoters50/1392427
aatacaaa

SEQ ID NO: 168112 - DNA, 8 bp, Unknown
  misc_feature (1)..( 8): Result.004 file - promoters50/1392427
gatataaa

SEQ ID NO: 168113 - DNA, 9 bp, Unknown
  misc_feature (1)..( 9): Result.004 file - promoters50/1392427
tgcacacct

SEQ ID NO: 168114 - DNA, 9 bp, Unknown
  misc_feature (1)..( 9): Result.004 file - promoters50/1392427
atcacgcct

SEQ ID NO: 168115 - DNA, 9 bp, Unknown
  misc_feature (1)..( 9): Result.004 file - promoters50/1393104
atcgcgcca

SEQ ID NO: 168116 - DNA, 7 bp, Unknown
  misc_feature (1)..( 7): Result.004 file - promoters50/1393104
atgtggt

SEQ ID NO: 168117 - DNA, 7 bp, Unknown
  misc_feature (1)..( 7): Result.004 file - promoters50/1393104
atgtgga

SEQ ID NO: 168118 - DNA, 7 bp, Unknown
  misc_feature (1)..( 7): Result.004 file - promoters50/1393139
atgagga

SEQ ID NO: 168119 - DNA, 13 bp, Unknown
  misc_feature (1)..( 13): Result.004 file - promoters50/1393139
tctacttttggta

SEQ ID NO: 168120 - DNA, 13 bp, Unknown
  misc_feature (1)..( 13): Result.004 file - promoters50/1393139
ttaactttttagt

SEQ ID NO: 168121 - DNA, 13 bp, Unknown
  misc_feature (1)..( 13): Result.004 file - promoters50/1393139
tcttcttttgtca

SEQ ID NO: 168122 - DNA, 13 bp, Unknown
  misc_feature (1)..( 13): Result.004 file - promoters50/1393139
ataacttttgagt

SEQ ID NO: 168123 - DNA, 13 bp, Unknown
  misc_feature (1)..( 13): Result.004 file - promoters50/1393139
agatcttttagtt

SEQ ID NO: 168124 - DNA, 13 bp, Unknown
  misc_feature (1)..( 13): Result.004 file - promoters50/1393139
tgatattttaatg

SEQ ID NO: 168125 - DNA, 11 bp, Unknown
  misc_feature (1)..( 11): Result.004 file - promoters50/1393139
cgatacaatac

SEQ ID NO: 168126 - DNA, 11 bp, Unknown
  misc_feature (1)..( 11): Result.004 file - promoters50/1393139
gaataaaatac

SEQ ID NO: 168127 - DNA, 11 bp, Unknown
  misc_feature (1)..( 11): Result.004 file - promoters50/1393139
caataaaagcc

SEQ ID NO: 168128 - DNA, 11 bp, Unknown
  misc_feature (1)..( 11): Result.004 file - promoters50/1393139
taataaaggtt

SEQ ID NO: 168129 - DNA, 11 bp, Unknown
  misc_feature (1)..( 11): Result.004 file - promoters50/1393139
taataatagag

SEQ ID NO: 168130 - DNA, 11 bp, Unknown
  misc_feature (1)..( 11): Result.004 file - promoters50/1393139
tttcaaagacg

SEQ ID NO: 168131 - DNA, 11 bp, Unknown
  misc_feature (1)..( 11): Result.004 file - promoters50/1393139
taagaaaatag

SEQ ID NO: 168132 - DNA, 11 bp, Unknown
  misc_feature (1)..( 11): Result.004 file - promoters50/1393173
attttaaatag

SEQ ID NO: 168133 - DNA, 11 bp, Unknown
  misc_feature (1)..( 11): Result.004 file - promoters50/1393173
aaaatgagata

SEQ ID NO: 168134 - DNA, 11 bp, Unknown
  misc_feature (1)..( 11): Result.004 file - promoters50/1393173
aaaatgagtta

SEQ ID NO: 168135 - DNA, 11 bp, Unknown
  misc_feature (1)..( 11): Result.004 file - promoters50/1393173
tgaatgtgata

SEQ ID NO: 168136 - DNA, 8 bp, Unknown
  misc_feature (1)..( 8): Result.004 file - promoters50/1393173
taaaaaaa

SEQ ID NO: 168137 - DNA, 8 bp, Unknown
  misc_feature (1)..( 8): Result.004 file - promoters50/1393173
taataaaa

SEQ ID NO: 168138 - DNA, 8 bp, Unknown
  misc_feature (1)..( 8): Result.004 file - promoters50/1393173
tataaaac

SEQ ID NO: 168139 - DNA, 10 bp, Unknown
  misc_feature (1)..( 10): Result.004 file - promoters50/1393173
ttgtgaagta

SEQ ID NO: 168140 - DNA, 10 bp, Unknown
  misc_feature (1)..( 10): Result.004 file - promoters50/1393173
atgtgtagta

SEQ ID NO: 168141 - DNA, 10 bp, Unknown
  misc_feature (1)..( 10): Result.004 file - promoters50/1393181
ttgtgaaaat

SEQ ID NO: 168142 - DNA, 9 bp, Unknown
  misc_feature (1)..( 9): Result.004 file - promoters50/1393181
tcactaata

SEQ ID NO: 168143 - DNA, 9 bp, Unknown
  misc_feature (1)..( 9): Result.004 file - promoters50/1393181
taactaatc

SEQ ID NO: 168144 - DNA, 9 bp, Unknown
  misc_feature (1)..( 9): Result.004 file - promoters50/1393181
ctactataa

SEQ ID NO: 168145 - DNA, 9 bp, Unknown
  misc_feature (1)..( 9): Result.004 file - promoters50/1393181
ttactaata

SEQ ID NO: 168146 - DNA, 9 bp, Unknown
  misc_feature (1)..( 9): Result.004 file - promoters50/1393181
ttactaata

SEQ ID NO: 168147 - DNA, 19 bp, Unknown
  misc_feature (1)..( 19): Result.004 file - promoters50/1393181
caaattaaaaaaaaaatct

SEQ ID NO: 168148 - DNA, 19 bp, Unknown
  misc_feature (1)..( 19): Result.004 file - promoters50/1393181
aagattataaaaaaagtct

SEQ ID NO: 168149 - DNA, 19 bp, Unknown
  misc_feature (1)..( 19): Result.004 file - promoters50/1393181
caaattcaaagaacataga

SEQ ID NO: 168150 - DNA, 19 bp, Unknown
  misc_feature (1)..( 19): Result.004 file - promoters50/1393181
ttaaaaaaaaaaaaaaatt

SEQ ID NO: 168151 - DNA, 19 bp, Unknown
  misc_feature (1)..( 19): Result.004 file - promoters50/1393181
ctaattttaattttgttat

SEQ ID NO: 168152 - DNA, 8 bp, Unknown
  misc_feature (1)..( 8): Result.004 file - promoters50/1393181
aaattttt

SEQ ID NO: 168153 - DNA, 8 bp, Unknown
  misc_feature (1)..( 8): Result.004 file - promoters50/1393181
aaatcttt

SEQ ID NO: 168154 - DNA, 8 bp, Unknown
  misc_feature (1)..( 8): Result.004 file - promoters50/1393181
taatttta

SEQ ID NO: 168155 - DNA, 8 bp, Unknown
  misc_feature (1)..( 8): Result.004 file - promoters50/1393181
taatttta

SEQ ID NO: 168156 - DNA, 8 bp, Unknown
  misc_feature (1)..( 8): Result.004 file - promoters50/1393181
taatttta

SEQ ID NO: 168157 - DNA, 9 bp, Unknown
  misc_feature (1)..( 9): Result.004 file - promoters50/1393181
tttttaaat

SEQ ID NO: 168158 - DNA, 9 bp, Unknown
  misc_feature (1)..( 9): Result.004 file - promoters50/1393181
atttaaaat

SEQ ID NO: 168159 - DNA, 10 bp, Unknown
  misc_feature (1)..( 10): Result.004 file - promoters50/1393181
atttgtaatg

SEQ ID NO: 168160 - DNA, 10 bp, Unknown
  misc_feature (1)..( 10): Result.004 file - promoters50/1393181
gcttttaatt

SEQ ID NO: 168161 - DNA, 10 bp, Unknown
  misc_feature (1)..( 10): Result.004 file - promoters50/1393181
tttgttattg

SEQ ID NO: 168162 - DNA, 10 bp, Unknown
  misc_feature (1)..( 10): Result.004 file - promoters50/1393181
tttggtttac

SEQ ID NO: 168163 - DNA, 11 bp, Unknown
  misc_feature (1)..( 11): Result.004 file - promoters50/1393181
tgttttgtccc

SEQ ID NO: 168164 - DNA, 11 bp, Unknown
  misc_feature (1)..( 11): Result.004 file - promoters50/1393181
atttttgtcgg

SEQ ID NO: 168165 - DNA, 11 bp, Unknown
  misc_feature (1)..( 11): Result.004 file - promoters50/1393181
acttttgttat

SEQ ID NO: 168166 - DNA, 11 bp, Unknown
  misc_feature (1)..( 11): Result.004 file - promoters50/1393181
ttttttggggg

SEQ ID NO: 168167 - DNA, 11 bp, Unknown
  misc_feature (1)..( 11): Result.004 file - promoters50/1393181
attttagtcgg

SEQ ID NO: 168168 - DNA, 12 bp, Unknown
  misc_feature (1)..( 12): Result.004 file - promoters50/1393181
agatttttaaat

SEQ ID NO: 168169 - DNA, 12 bp, Unknown
  misc_feature (1)..( 12): Result.004 file - promoters50/1393181
agattattaaat

SEQ ID NO: 168170 - DNA, 12 bp, Unknown
  misc_feature (1)..( 12): Result.004 file - promoters50/1393181
aaattattaaag

SEQ ID NO: 168171 - DNA, 10 bp, Unknown
  misc_feature (1)..( 10): Result.004 file - promoters50/1393181
attatcaaaa

SEQ ID NO: 168172 - DNA, 12 bp, Unknown
  misc_feature (1)..( 12): Result.004 file - promoters50/1393181
caattatttatc

SEQ ID NO: 168173 - DNA, 13 bp, Unknown
  misc_feature (1)..( 13): Result.004 file - promoters50/1393181
tccacttagtctt

SEQ ID NO: 168174 - DNA, 13 bp, Unknown
  misc_feature (1)..( 13): Result.004 file - promoters50/1393181
atattttagtcgg

SEQ ID NO: 168175 - DNA, 13 bp, Unknown
  misc_feature (1)..( 13): Result.004 file - promoters50/1393181
acatttttgtcgg

SEQ ID NO: 168176 - DNA, 13 bp, Unknown
  misc_feature (1)..( 13): Result.004 file - promoters50/1393181
tcattttactttt

SEQ ID NO: 168177 - DNA, 13 bp, Unknown
  misc_feature (1)..( 13): Result.004 file - promoters50/1393187
tcatcttatttct

SEQ ID NO: 168178 - DNA, 8 bp, Unknown
  misc_feature (1)..( 8): Result.004 file - promoters50/1393187
aataaatc

SEQ ID NO: 168179 - DNA, 8 bp, Unknown
  misc_feature (1)..( 8): Result.004 file - promoters50/1393187
actaaatc

SEQ ID NO: 168180 - DNA, 8 bp, Unknown
  misc_feature (1)..( 8): Result.004 file - promoters50/1393187
aataaata

SEQ ID NO: 168181 - DNA, 7 bp, Unknown
  misc_feature (1)..( 7): Result.004 file - promoters50/1393187
aactaaa

SEQ ID NO: 168182 - DNA, 7 bp, Unknown
  misc_feature (1)..( 7): Result.004 file - promoters50/1393187
aactaag

SEQ ID NO: 168183 - DNA, 7 bp, Unknown
  misc_feature (1)..( 7): Result.004 file - promoters50/1393187
gactaaa

SEQ ID NO: 168184 - DNA, 7 bp, Unknown
  misc_feature (1)..( 7): Result.004 file - promoters50/1393187
ataaaag

SEQ ID NO: 168185 - DNA, 7 bp, Unknown
  misc_feature (1)..( 7): Result.004 file - promoters50/1393187
gtaaaag

SEQ ID NO: 168186 - DNA, 7 bp, Unknown
  misc_feature (1)..( 7): Result.004 file - promoters50/1393187
atataag

SEQ ID NO: 168187 - DNA, 9 bp, Unknown
  misc_feature (1)..( 9): Result.004 file - promoters50/1393187
aaaaaaaga

SEQ ID NO: 168188 - DNA, 9 bp, Unknown
  misc_feature (1)..( 9): Result.004 file - promoters50/1393187
aaaaaagaa

SEQ ID NO: 168189 - DNA, 10 bp, Unknown
  misc_feature (1)..( 10): Result.004 file - promoters50/1393187
aaagaaagaa

SEQ ID NO: 168190 - DNA, 8 bp, Unknown
  misc_feature (1)..( 8): Result.004 file - promoters50/1393187
atttgaat

SEQ ID NO: 168191 - DNA, 8 bp, Unknown
  misc_feature (1)..( 8): Result.004 file - promoters50/1393187
atttaaat

SEQ ID NO: 168192 - DNA, 8 bp, Unknown
  misc_feature (1)..( 8): Result.004 file - promoters50/1393187
atttgaat

SEQ ID NO: 168193 - DNA, 6 bp, Unknown
  misc_feature (1)..( 6): Result.004 file - promoters50/1393187
aaattt

SEQ ID NO: 168194 - DNA, 6 bp, Unknown
  misc_feature (1)..( 6): Result.004 file - promoters50/1393187
aaattt

SEQ ID NO: 168195 - DNA, 6 bp, Unknown
  misc_feature (1)..( 6): Result.004 file - promoters50/1393187
aaattt

SEQ ID NO: 168196 - DNA, 7 bp, Unknown
  misc_feature (1)..( 7): Result.004 file - promoters50/1393187
gactaat

SEQ ID NO: 168197 - DNA, 7 bp, Unknown
  misc_feature (1)..( 7): Result.004 file - promoters50/1393187
gacaaat

SEQ ID NO: 168198 - DNA, 7 bp, Unknown
  misc_feature (1)..( 7): Result.004 file - promoters50/1393226
gactaat

SEQ ID NO: 168199 - DNA, 12 bp, Unknown
  misc_feature (1)..( 12): Result.004 file - promoters50/1393226
tttttcttatat

SEQ ID NO: 168200 - DNA, 12 bp, Unknown
  misc_feature (1)..( 12): Result.004 file - promoters50/1393226
tttctctttata

SEQ ID NO: 168201 - DNA, 12 bp, Unknown
  misc_feature (1)..( 12): Result.004 file - promoters50/1393226
ttcctatttaaa

SEQ ID NO: 168202 - DNA, 12 bp, Unknown
  misc_feature (1)..( 12): Result.004 file - promoters50/1393226
atttactttttt

SEQ ID NO: 168203 - DNA, 12 bp, Unknown
  misc_feature (1)..( 12): Result.004 file - promoters50/1393226
atcctatttaaa

SEQ ID NO: 168204 - DNA, 12 bp, Unknown
  misc_feature (1)..( 12): Result.004 file - promoters50/1393226
ttttaaagcttt

SEQ ID NO: 168205 - DNA, 12 bp, Unknown
  misc_feature (1)..( 12): Result.004 file - promoters50/1393226
cccctatataaa

SEQ ID NO: 168206 - DNA, 16 bp, Unknown
  misc_feature (1)..( 16): Result.004 file - promoters50/1393226
tttttcttatattaga

SEQ ID NO: 168207 - DNA, 16 bp, Unknown
  misc_feature (1)..( 16): Result.004 file - promoters50/1393226
ttctctttatattaag

SEQ ID NO: 168208 - DNA, 16 bp, Unknown
  misc_feature (1)..( 16): Result.004 file - promoters50/1393226
tcctatttaaatttta

SEQ ID NO: 168209 - DNA, 16 bp, Unknown
  misc_feature (1)..( 16): Result.004 file - promoters50/1393226
cttcccctatataaag

SEQ ID NO: 168210 - DNA, 16 bp, Unknown
  misc_feature (1)..( 16): Result.004 file - promoters50/1393226
ttgcctttatcatctc

SEQ ID NO: 168211 - DNA, 16 bp, Unknown
  misc_feature (1)..( 16): Result.004 file - promoters50/1393226
tcctatttaaaccaat

SEQ ID NO: 168212 - DNA, 16 bp, Unknown
  misc_feature (1)..( 16): Result.004 file - promoters50/1393226
tttattttaaagcttt

SEQ ID NO: 168213 - DNA, 16 bp, Unknown
  misc_feature (1)..( 16): Result.004 file - promoters50/1393226
tcaccaatgatgattt

SEQ ID NO: 168214 - DNA, 16 bp, Unknown
  misc_feature (1)..( 16): Result.004 file - promoters50/1393226
taacaaataatgtttt

SEQ ID NO: 168215 - DNA, 16 bp, Unknown
  misc_feature (1)..( 16): Result.004 file - promoters50/1393226
ttgacaattatgtgat

SEQ ID NO: 168216 - DNA, 16 bp, Unknown
  misc_feature (1)..( 16): Result.004 file - promoters50/1393226
gtgaggataatggttt

SEQ ID NO: 168217 - DNA, 16 bp, Unknown
  misc_feature (1)..( 16): Result.004 file - promoters50/1393226
ctcagtacaatattta

SEQ ID NO: 168218 - DNA, 16 bp, Unknown
  misc_feature (1)..( 16): Result.004 file - promoters50/1393226
ttgtcaatttttcgtc

SEQ ID NO: 168219 - DNA, 11 bp, Unknown
  misc_feature (1)..( 11): Result.004 file - promoters50/1393226
tttgttaatgt

SEQ ID NO: 168220 - DNA, 11 bp, Unknown
  misc_feature (1)..( 11): Result.004 file - promoters50/1393226
tttgtttatga

SEQ ID NO: 168221 - DNA, 11 bp, Unknown
  misc_feature (1)..( 11): Result.004 file - promoters50/1393226
cttgttaattg

SEQ ID NO: 168222 - DNA, 11 bp, Unknown
  misc_feature (1)..( 11): Result.004 file - promoters50/1393226
gttgtatatta

SEQ ID NO: 168223 - DNA, 11 bp, Unknown
  misc_feature (1)..( 11): Result.004 file - promoters50/1393226
aggttttatat

SEQ ID NO: 168224 - DNA, 11 bp, Unknown
  misc_feature (1)..( 11): Result.004 file - promoters50/1393284
caattttataa

SEQ ID NO: 168225 - DNA, 13 bp, Unknown
  misc_feature (1)..( 13): Result.004 file - promoters50/1393284
accctactttttt

SEQ ID NO: 168226 - DNA, 13 bp, Unknown
  misc_feature (1)..( 13): Result.004 file - promoters50/1393284
aatttactttttt

SEQ ID NO: 168227 - DNA, 13 bp, Unknown
  misc_feature (1)..( 13): Result.004 file - promoters50/1393284
gatttaattttgt

SEQ ID NO: 168228 - DNA, 13 bp, Unknown
  misc_feature (1)..( 13): Result.004 file - promoters50/1393284
gatataagaaact

SEQ ID NO: 168229 - DNA, 13 bp, Unknown
  misc_feature (1)..( 13): Result.004 file - promoters50/1393284
ctggacattgtgt

SEQ ID NO: 168230 - DNA, 13 bp, Unknown
  misc_feature (1)..( 13): Result.004 file - promoters50/1393288
tcttttatttatt

SEQ ID NO: 168231 - DNA, 8 bp, Unknown
  misc_feature (1)..( 8): Result.004 file - promoters50/1393288
caaaattg

SEQ ID NO: 168232 - DNA, 8 bp, Unknown
  misc_feature (1)..( 8): Result.004 file - promoters50/1393288
aaaaatta

SEQ ID NO: 168233 - DNA, 8 bp, Unknown
  misc_feature (1)..( 8): Result.004 file - promoters50/1393288
ctaaattg

SEQ ID NO: 168234 - DNA, 8 bp, Unknown
  misc_feature (1)..( 8): Result.004 file - promoters50/1393288
caaaatta

SEQ ID NO: 168235 - DNA, 10 bp, Unknown
  misc_feature (1)..( 10): Result.004 file - promoters50/1393288
ttttgaaatc

SEQ ID NO: 168236 - DNA, 10 bp, Unknown
  misc_feature (1)..( 10): Result.004 file - promoters50/1393288
tcgcgaaatc

SEQ ID NO: 168237 - DNA, 10 bp, Unknown
  misc_feature (1)..( 10): Result.004 file - promoters50/1393288
ttttcaaatt

SEQ ID NO: 168238 - DNA, 10 bp, Unknown
  misc_feature (1)..( 10): Result.004 file - promoters50/1393288
acctcaaatg

SEQ ID NO: 168239 - DNA, 8 bp, Unknown
  misc_feature (1)..( 8): Result.004 file - promoters50/1393288
ttgtttga

SEQ ID NO: 168240 - DNA, 8 bp, Unknown
  misc_feature (1)..( 8): Result.004 file - promoters50/1393288
ttgtttta

SEQ ID NO: 168241 - DNA, 8 bp, Unknown
  misc_feature (1)..( 8): Result.004 file - promoters50/1393288
gtgtttga

SEQ ID NO: 168242 - DNA, 8 bp, Unknown
  misc_feature (1)..( 8): Result.004 file - promoters50/1393288
ctgtgtga

SEQ ID NO: 168243 - DNA, 16 bp, Unknown
  misc_feature (1)..( 16): Result.004 file - promoters50/1393288
aaaattttggtaattt

SEQ ID NO: 168244 - DNA, 16 bp, Unknown
  misc_feature (1)..( 16): Result.004 file - promoters50/1393288
tcaattttgctaaaaa

SEQ ID NO: 168245 - DNA, 16 bp, Unknown
  misc_feature (1)..( 16): Result.004 file - promoters50/1393288
ctcaatttggtaattt

SEQ ID NO: 168246 - DNA, 16 bp, Unknown
  misc_feature (1)..( 16): Result.004 file - promoters50/1393326
atcatttttttctaga

SEQ ID NO: 168247 - DNA, 13 bp, Unknown
  misc_feature (1)..( 13): Result.004 file - promoters50/1393326
taattttcatcaa

SEQ ID NO: 168248 - DNA, 13 bp, Unknown
  misc_feature (1)..( 13): Result.004 file - promoters50/1393326
caattttagttat

SEQ ID NO: 168249 - DNA, 13 bp, Unknown
  misc_feature (1)..( 13): Result.004 file - promoters50/1393326
ttattttcttttt

SEQ ID NO: 168250 - DNA, 13 bp, Unknown
  misc_feature (1)..( 13): Result.004 file - promoters50/1393326
taatattcgaatt

SEQ ID NO: 168251 - DNA, 13 bp, Unknown
  misc_feature (1)..( 13): Result.004 file - promoters50/1393326
taattttaagaag

SEQ ID NO: 168252 - DNA, 13 bp, Unknown
  misc_feature (1)..( 13): Result.004 file - promoters50/1393326
taatttttggcgg

SEQ ID NO: 168253 - DNA, 13 bp, Unknown
  misc_feature (1)..( 13): Result.004 file - promoters50/1393326
tcgtttttttttt

SEQ ID NO: 168254 - DNA, 9 bp, Unknown
  misc_feature (1)..( 9): Result.004 file - promoters50/1393326
cttttaata

SEQ ID NO: 168255 - DNA, 9 bp, Unknown
  misc_feature (1)..( 9): Result.004 file - promoters50/1393326
gttttaatc

SEQ ID NO: 168256 - DNA, 9 bp, Unknown
  misc_feature (1)..( 9): Result.004 file - promoters50/1393326
tttttaatt

SEQ ID NO: 168257 - DNA, 9 bp, Unknown
  misc_feature (1)..( 9): Result.004 file - promoters50/1393326
ctttttata

SEQ ID NO: 168258 - DNA, 9 bp, Unknown
  misc_feature (1)..( 9): Result.004 file - promoters50/1393326
attttaaga

SEQ ID NO: 168259 - DNA, 10 bp, Unknown
  misc_feature (1)..( 10): Result.004 file - promoters50/1393326
atttctaata

SEQ ID NO: 168260 - DNA, 9 bp, Unknown
  misc_feature (1)..( 9): Result.004 file - promoters50/1393326
agaacaaat

SEQ ID NO: 168261 - DNA, 9 bp, Unknown
  misc_feature (1)..( 9): Result.004 file - promoters50/1393326
ttcacaaat

SEQ ID NO: 168262 - DNA, 9 bp, Unknown
  misc_feature (1)..( 9): Result.004 file - promoters50/1393326
aggaaaaaa

SEQ ID NO: 168263 - DNA, 9 bp, Unknown
  misc_feature (1)..( 9): Result.004 file - promoters50/1393326
tcgacaaat

SEQ ID NO: 168264 - DNA, 9 bp, Unknown
  misc_feature (1)..( 9): Result.004 file - promoters50/1393326
gagaaaaag

SEQ ID NO: 168265 - DNA, 9 bp, Unknown
  misc_feature (1)..( 9): Result.004 file - promoters50/1393326
gagagaaag

SEQ ID NO: 168266 - DNA, 9 bp, Unknown
  misc_feature (1)..( 9): Result.004 file - promoters50/1393342
ttaagaaag

SEQ ID NO: 168267 - DNA, 12 bp, Unknown
  misc_feature (1)..( 12): Result.004 file - promoters50/1393342
ctgataaatatg

SEQ ID NO: 168268 - DNA, 12 bp, Unknown
  misc_feature (1)..( 12): Result.004 file - promoters50/1393342
attatacatatg

SEQ ID NO: 168269 - DNA, 12 bp, Unknown
  misc_feature (1)..( 12): Result.004 file - promoters50/1393342
attaaacataac

SEQ ID NO: 168270 - DNA, 13 bp, Unknown
  misc_feature (1)..( 13): Result.004 file - promoters50/1393342
ttatattaaacag

SEQ ID NO: 168271 - DNA, 13 bp, Unknown
  misc_feature (1)..( 13): Result.004 file - promoters50/1393342
tgatatgaaaata

SEQ ID NO: 168272 - DNA, 13 bp, Unknown
  misc_feature (1)..( 13): Result.004 file - promoters50/1393342
ttatgttattgtt

SEQ ID NO: 168273 - DNA, 13 bp, Unknown
  misc_feature (1)..( 13): Result.004 file - promoters50/1393342
attttttaatcag

SEQ ID NO: 168274 - DNA, 10 bp, Unknown
  misc_feature (1)..( 10): Result.004 file - promoters50/1393342
atatctttca

SEQ ID NO: 168275 - DNA, 10 bp, Unknown
  misc_feature (1)..( 10): Result.004 file - promoters50/1393342
atatcattcg

SEQ ID NO: 168276 - DNA, 10 bp, Unknown
  misc_feature (1)..( 10): Result.004 file - promoters50/1393342
ggttctgtca

SEQ ID NO: 168277 - DNA, 7 bp, Unknown
  misc_feature (1)..( 7): Result.004 file - promoters50/1393342
tttattc

SEQ ID NO: 168278 - DNA, 7 bp, Unknown
  misc_feature (1)..( 7): Result.004 file - promoters50/1393342
ttttttc

SEQ ID NO: 168279 - DNA, 7 bp, Unknown
  misc_feature (1)..( 7): Result.004 file - promoters50/1393342
atttttc

SEQ ID NO: 168280 - DNA, 16 bp, Unknown
  misc_feature (1)..( 16): Result.004 file - promoters50/1393342
ccactagataataatt

SEQ ID NO: 168281 - DNA, 16 bp, Unknown
  misc_feature (1)..( 16): Result.004 file - promoters50/1393342
aaacgagataatgatt

SEQ ID NO: 168282 - DNA, 16 bp, Unknown
  misc_feature (1)..( 16): Result.004 file - promoters50/1393342
aaacgtgatattcgcg

SEQ ID NO: 168283 - DNA, 7 bp, Unknown
  misc_feature (1)..( 7): Result.004 file - promoters50/1393342
aaaaaaa

SEQ ID NO: 168284 - DNA, 7 bp, Unknown
  misc_feature (1)..( 7): Result.004 file - promoters50/1393342
aaacaaa

SEQ ID NO: 168285 - DNA, 7 bp, Unknown
  misc_feature (1)..( 7): Result.004 file - promoters50/1393342
acacaaa

SEQ ID NO: 168286 - DNA, 7 bp, Unknown
  misc_feature (1)..( 7): Result.004 file - promoters50/1393342
tttctct

SEQ ID NO: 168287 - DNA, 7 bp, Unknown
  misc_feature (1)..( 7): Result.004 file - promoters50/1393342
tttttct

SEQ ID NO: 168288 - DNA, 7 bp, Unknown
  misc_feature (1)..( 7): Result.004 file - promoters50/1393367
tttttta

SEQ ID NO: 168289 - DNA, 8 bp, Unknown
  misc_feature (1)..( 8): Result.004 file - promoters50/1393367
gatagaca

SEQ ID NO: 168290 - DNA, 8 bp, Unknown
  misc_feature (1)..( 8): Result.004 file - promoters50/1393367
aatataca

SEQ ID NO: 168291 - DNA, 8 bp, Unknown
  misc_feature (1)..( 8): Result.004 file - promoters50/1393367
aatataat

SEQ ID NO: 168292 - DNA, 7 bp, Unknown
  misc_feature (1)..( 7): Result.004 file - promoters50/1393367
ttctaaa

SEQ ID NO: 168293 - DNA, 7 bp, Unknown
  misc_feature (1)..( 7): Result.004 file - promoters50/1393367
ttcaaaa

SEQ ID NO: 168294 - DNA, 7 bp, Unknown
  misc_feature (1)..( 7): Result.004 file - promoters50/1393367
ttcaaac

SEQ ID NO: 168295 - DNA, 12 bp, Unknown
  misc_feature (1)..( 12): Result.004 file - promoters50/1393367
attgtttgcttt

SEQ ID NO: 168296 - DNA, 12 bp, Unknown
  misc_feature (1)..( 12): Result.004 file - promoters50/1393367
attatttgtttt

SEQ ID NO: 168297 - DNA, 12 bp, Unknown
  misc_feature (1)..( 12): Result.004 file - promoters50/1393367
caccgttgtttt

SEQ ID NO: 168298 - DNA, 7 bp, Unknown
  misc_feature (1)..( 7): Result.004 file - promoters50/1393367
tttcaat

SEQ ID NO: 168299 - DNA, 7 bp, Unknown
  misc_feature (1)..( 7): Result.004 file - promoters50/1393367
tttcaaa

SEQ ID NO: 168300 - DNA, 7 bp, Unknown
  misc_feature (1)..( 7): Result.004 file - promoters50/1393367
cttcaaa

SEQ ID NO: 168301 - DNA, 7 bp, Unknown
  misc_feature (1)..( 7): Result.004 file - promoters50/1393367
aaagaaa

SEQ ID NO: 168302 - DNA, 7 bp, Unknown
  misc_feature (1)..( 7): Result.004 file - promoters50/1393367
aaagaag

SEQ ID NO: 168303 - DNA, 7 bp, Unknown
  misc_feature (1)..( 7): Result.004 file - promoters50/1393371
caagaag

SEQ ID NO: 168304 - DNA, 12 bp, Unknown
  misc_feature (1)..( 12): Result.004 file - promoters50/1393371
tcactcacatca

SEQ ID NO: 168305 - DNA, 12 bp, Unknown
  misc_feature (1)..( 12): Result.004 file - promoters50/1393371
ctgatcaaatca

SEQ ID NO: 168306 - DNA, 12 bp, Unknown
  misc_feature (1)..( 12): Result.004 file - promoters50/1393383
tcaatcacatgc

SEQ ID NO: 168307 - DNA, 12 bp, Unknown
  misc_feature (1)..( 12): Result.004 file - promoters50/1393383
agaaaataaaaa

SEQ ID NO: 168308 - DNA, 12 bp, Unknown
  misc_feature (1)..( 12): Result.004 file - promoters50/1393383
agaaaataaaaa

SEQ ID NO: 168309 - DNA, 12 bp, Unknown
  misc_feature (1)..( 12): Result.004 file - promoters50/1393383
tgtatataaaaa

SEQ ID NO: 168310 - DNA, 12 bp, Unknown
  misc_feature (1)..( 12): Result.004 file - promoters50/1393383
cgcaaacaagac

SEQ ID NO: 168311 - DNA, 12 bp, Unknown
  misc_feature (1)..( 12): Result.004 file - promoters50/1393383
atgatacaaaac

SEQ ID NO: 168312 - DNA, 12 bp, Unknown
  misc_feature (1)..( 12): Result.004 file - promoters50/1393478
gtaaaacgagaa

SEQ ID NO: 168313 - DNA, 15 bp, Unknown
  misc_feature (1)..( 15): Result.004 file - promoters50/1393478
caattggttaatata

SEQ ID NO: 168314 - DNA, 15 bp, Unknown
  misc_feature (1)..( 15): Result.004 file - promoters50/1393478
gatttagttgataat

SEQ ID NO: 168315 - DNA, 15 bp, Unknown
  misc_feature (1)..( 15): Result.004 file - promoters50/1393478
tccttttataagata

SEQ ID NO: 168316 - DNA, 15 bp, Unknown
  misc_feature (1)..( 15): Result.004 file - promoters50/1393478
catagtattaataat

SEQ ID NO: 168317 - DNA, 15 bp, Unknown
  misc_feature (1)..( 15): Result.004 file - promoters50/1393478
gtgattgttaacagg

SEQ ID NO: 168318 - DNA, 15 bp, Unknown
  misc_feature (1)..( 15): Result.004 file - promoters50/1393478
gtgtttgttgacaga

SEQ ID NO: 168319 - DNA, 12 bp, Unknown
  misc_feature (1)..( 12): Result.004 file - promoters50/1393478
cctcataacaac

SEQ ID NO: 168320 - DNA, 12 bp, Unknown
  misc_feature (1)..( 12): Result.004 file - promoters50/1393478
agaagtaataac

SEQ ID NO: 168321 - DNA, 12 bp, Unknown
  misc_feature (1)..( 12): Result.004 file - promoters50/1393478
gatgttaataat

SEQ ID NO: 168322 - DNA, 12 bp, Unknown
  misc_feature (1)..( 12): Result.004 file - promoters50/1393478
tcttgtaaaaat

SEQ ID NO: 168323 - DNA, 12 bp, Unknown
  misc_feature (1)..( 12): Result.004 file - promoters50/1393478
tcttataaaaaa

SEQ ID NO: 168324 - DNA, 12 bp, Unknown
  misc_feature (1)..( 12): Result.004 file - promoters50/1393492
tcttttaacttc

SEQ ID NO: 168325 - DNA, 13 bp, Unknown
  misc_feature (1)..( 13): Result.004 file - promoters50/1393492
ggtgtataaattg

SEQ ID NO: 168326 - DNA, 13 bp, Unknown
  misc_feature (1)..( 13): Result.004 file - promoters50/1393492
ctcctataaattg

SEQ ID NO: 168327 - DNA, 13 bp, Unknown
  misc_feature (1)..( 13): Result.004 file - promoters50/1393492
ttagtataaataa

SEQ ID NO: 168328 - DNA, 13 bp, Unknown
  misc_feature (1)..( 13): Result.004 file - promoters50/1393492
ctcttatatattc

SEQ ID NO: 168329 - DNA, 13 bp, Unknown
  misc_feature (1)..( 13): Result.004 file - promoters50/1393492
cttctatatatat

SEQ ID NO: 168330 - DNA, 13 bp, Unknown
  misc_feature (1)..( 13): Result.004 file - promoters50/1393492
tgtctatatataa

SEQ ID NO: 168331 - DNA, 8 bp, Unknown
  misc_feature (1)..( 8): Result.004 file - promoters50/1393492
cattgttt

SEQ ID NO: 168332 - DNA, 8 bp, Unknown
  misc_feature (1)..( 8): Result.004 file - promoters50/1393492
ttttgttt

SEQ ID NO: 168333 - DNA, 8 bp, Unknown
  misc_feature (1)..( 8): Result.004 file - promoters50/1393492
catttttt

SEQ ID NO: 168334 - DNA, 8 bp, Unknown
  misc_feature (1)..( 8): Result.004 file - promoters50/1393492
tatttttt

SEQ ID NO: 168335 - DNA, 9 bp, Unknown
  misc_feature (1)..( 9): Result.004 file - promoters50/1393492
catttattt

SEQ ID NO: 168336 - DNA, 9 bp, Unknown
  misc_feature (1)..( 9): Result.004 file - promoters50/1393498
tttttcttg

SEQ ID NO: 168337 - DNA, 13 bp, Unknown
  misc_feature (1)..( 13): Result.004 file - promoters50/1393498
ggaatattaaatg

SEQ ID NO: 168338 - DNA, 13 bp, Unknown
  misc_feature (1)..( 13): Result.004 file - promoters50/1393498
tgcatattattat

SEQ ID NO: 168339 - DNA, 13 bp, Unknown
  misc_feature (1)..( 13): Result.004 file - promoters50/1393498
gatttattaaatg

SEQ ID NO: 168340 - DNA, 13 bp, Unknown
  misc_feature (1)..( 13): Result.004 file - promoters50/1393498
ccaattttaagaa

SEQ ID NO: 168341 - DNA, 13 bp, Unknown
  misc_feature (1)..( 13): Result.004 file - promoters50/1393498
tcaaatttaagtc

SEQ ID NO: 168342 - DNA, 13 bp, Unknown
  misc_feature (1)..( 13): Result.004 file - promoters50/1393498
ccaaatttggtga

SEQ ID NO: 168343 - DNA, 10 bp, Unknown
  misc_feature (1)..( 10): Result.004 file - promoters50/1393498
aaaattgtgt

SEQ ID NO: 168344 - DNA, 10 bp, Unknown
  misc_feature (1)..( 10): Result.004 file - promoters50/1393498
gaaactgtag

SEQ ID NO: 168345 - DNA, 10 bp, Unknown
  misc_feature (1)..( 10): Result.004 file - promoters50/1393498
taaatatttg

SEQ ID NO: 168346 - DNA, 10 bp, Unknown
  misc_feature (1)..( 10): Result.004 file - promoters50/1393498
gagattgtga

SEQ ID NO: 168347 - DNA, 10 bp, Unknown
  misc_feature (1)..( 10): Result.004 file - promoters50/1393498
aaaaatgtct

SEQ ID NO: 168348 - DNA, 10 bp, Unknown
  misc_feature (1)..( 10): Result.004 file - promoters50/1393498
taaatataaa

SEQ ID NO: 168349 - DNA, 10 bp, Unknown
  misc_feature (1)..( 10): Result.004 file - promoters50/1393498
ataatagaaa

SEQ ID NO: 168350 - DNA, 12 bp, Unknown
  misc_feature (1)..( 12): Result.004 file - promoters50/1393498
atgttgttcata

SEQ ID NO: 168351 - DNA, 12 bp, Unknown
  misc_feature (1)..( 12): Result.005 file - promoters50/1393498
atgtggttaatt

SEQ ID NO: 168352 - DNA, 12 bp, Unknown
  misc_feature (1)..( 12): Result.005 file - promoters50/1393498
atgttgtaagta

SEQ ID NO: 168353 - DNA, 12 bp, Unknown
  misc_feature (1)..( 12): Result.005 file - promoters50/1393498
atgttttaatat

SEQ ID NO: 168354 - DNA, 12 bp, Unknown
  misc_feature (1)..( 12): Result.005 file - promoters50/1393498
tttttttaatac

SEQ ID NO: 168355 - DNA, 12 bp, Unknown
  misc_feature (1)..( 12): Result.005 file - promoters50/1393498
ccattttattaa

SEQ ID NO: 168356 - DNA, 10 bp, Unknown
  misc_feature (1)..( 10): Result.005 file - promoters50/1393576
tatgaagtta

SEQ ID NO: 168357 - DNA, 10 bp, Unknown
  misc_feature (1)..( 10): Result.005 file - promoters50/1393576
aatgatgttg

SEQ ID NO: 168358 - DNA, 10 bp, Unknown
  misc_feature (1)..( 10): Result.005 file - promoters50/1393576
aatgattttg

SEQ ID NO: 168359 - DNA, 11 bp, Unknown
  misc_feature (1)..( 11): Result.005 file - promoters50/1393576
ccaaataaatg

SEQ ID NO: 168360 - DNA, 11 bp, Unknown
  misc_feature (1)..( 11): Result.005 file - promoters50/1393576
ccaaataaaaa

SEQ ID NO: 168361 - DNA, 11 bp, Unknown
  misc_feature (1)..( 11): Result.005 file - promoters50/1393576
ttaaaaaaatg

SEQ ID NO: 168362 - DNA, 10 bp, Unknown
  misc_feature (1)..( 10): Result.005 file - promoters50/1393576
atacttaaat

SEQ ID NO: 168363 - DNA, 10 bp, Unknown
  misc_feature (1)..( 10): Result.005 file - promoters50/1393576
aaacttaaat

SEQ ID NO: 168364 - DNA, 10 bp, Unknown
  misc_feature (1)..( 10): Result.005 file - promoters50/1393576
aaaattagat

SEQ ID NO: 168365 - DNA, 13 bp, Unknown
  misc_feature (1)..( 13): Result.005 file - promoters50/1393576
tacatcaataaaa

SEQ ID NO: 168366 - DNA, 13 bp, Unknown
  misc_feature (1)..( 13): Result.005 file - promoters50/1393576
tacatcaattaaa

SEQ ID NO: 168367 - DNA, 13 bp, Unknown
  misc_feature (1)..( 13): Result.005 file - promoters50/1393576
gacagcaatagct

SEQ ID NO: 168368 - DNA, 8 bp, Unknown
  misc_feature (1)..( 8): Result.005 file - promoters50/1393576
acaaaacg

SEQ ID NO: 168369 - DNA, 8 bp, Unknown
  misc_feature (1)..( 8): Result.005 file - promoters50/1393576
acaaaaac

SEQ ID NO: 168370 - DNA, 8 bp, Unknown
  misc_feature (1)..( 8): Result.005 file - promoters50/1393576
gcaaaaaa

SEQ ID NO: 168371 - DNA, 8 bp, Unknown
  misc_feature (1)..( 8): Result.005 file - promoters50/1393576
gatatgaa

SEQ ID NO: 168372 - DNA, 8 bp, Unknown
  misc_feature (1)..( 8): Result.005 file - promoters50/1393576
gatatgtc

SEQ ID NO: 168373 - DNA, 8 bp, Unknown
  misc_feature (1)..( 8): Result.005 file - promoters50/1393576
gatgtgtc

SEQ ID NO: 168374 - DNA, 8 bp, Unknown
  misc_feature (1)..( 8): Result.005 file - promoters50/1393576
ttctaaaa

SEQ ID NO: 168375 - DNA, 8 bp, Unknown
  misc_feature (1)..( 8): Result.005 file - promoters50/1393576
ttcaaaat

SEQ ID NO: 168376 - DNA, 8 bp, Unknown
  misc_feature (1)..( 8): Result.005 file - promoters50/1393576
ctcacaat

SEQ ID NO: 168377 - DNA, 8 bp, Unknown
  misc_feature (1)..( 8): Result.005 file - promoters50/1393576
ctaaaatg

SEQ ID NO: 168378 - DNA, 8 bp, Unknown
  misc_feature (1)..( 8): Result.005 file - promoters50/1393576
aaaaaatg

SEQ ID NO: 168379 - DNA, 8 bp, Unknown
  misc_feature (1)..( 8): Result.005 file - promoters50/1393576
aaaaaata

SEQ ID NO: 168380 - DNA, 9 bp, Unknown
  misc_feature (1)..( 9): Result.005 file - promoters50/1393576
tttcattac

SEQ ID NO: 168381 - DNA, 9 bp, Unknown
  misc_feature (1)..( 9): Result.005 file - promoters50/1393576
tttcattac

SEQ ID NO: 168382 - DNA, 9 bp, Unknown
  misc_feature (1)..( 9): Result.005 file - promoters50/1393576
tttaatttc

SEQ ID NO: 168383 - DNA, 10 bp, Unknown
  misc_feature (1)..( 10): Result.005 file - promoters50/1393576
aaataaatcc

SEQ ID NO: 168384 - DNA, 10 bp, Unknown
  misc_feature (1)..( 10): Result.005 file - promoters50/1393576
acttaaatcc

SEQ ID NO: 168385 - DNA, 10 bp, Unknown
  misc_feature (1)..( 10): Result.005 file - promoters50/1393576
aaataaataa

SEQ ID NO: 168386 - DNA, 12 bp, Unknown
  misc_feature (1)..( 12): Result.005 file - promoters50/1393596
ttttaaaatttt

SEQ ID NO: 168387 - DNA, 12 bp, Unknown
  misc_feature (1)..( 12): Result.005 file - promoters50/1393596
ttataaaataca

SEQ ID NO: 168388 - DNA, 12 bp, Unknown
  misc_feature (1)..( 12): Result.005 file - promoters50/1393596
tttcaaaatcac

SEQ ID NO: 168389 - DNA, 12 bp, Unknown
  misc_feature (1)..( 12): Result.005 file - promoters50/1393596
aaacaaaacttt

SEQ ID NO: 168390 - DNA, 12 bp, Unknown
  misc_feature (1)..( 12): Result.005 file - promoters50/1393596
atatataatatt

SEQ ID NO: 168391 - DNA, 12 bp, Unknown
  misc_feature (1)..( 12): Result.005 file - promoters50/1393596
tagcaaaataac

SEQ ID NO: 168392 - DNA, 14 bp, Unknown
  misc_feature (1)..( 14): Result.005 file - promoters50/1393596
actttaaattacga

SEQ ID NO: 168393 - DNA, 14 bp, Unknown
  misc_feature (1)..( 14): Result.005 file - promoters50/1393596
actgtaaattacgt

SEQ ID NO: 168394 - DNA, 14 bp, Unknown
  misc_feature (1)..( 14): Result.005 file - promoters50/1393596
attttaaaaaaaga

SEQ ID NO: 168395 - DNA, 14 bp, Unknown
  misc_feature (1)..( 14): Result.005 file - promoters50/1393596
agtttagattcttc

SEQ ID NO: 168396 - DNA, 14 bp, Unknown
  misc_feature (1)..( 14): Result.005 file - promoters50/1393596
cgattagaaacaga

SEQ ID NO: 168397 - DNA, 14 bp, Unknown
  misc_feature (1)..( 14): Result.005 file - promoters50/1393596
tgataagagtcttg

SEQ ID NO: 168398 - DNA, 9 bp, Unknown
  misc_feature (1)..( 9): Result.005 file - promoters50/1393599
tactaatta

SEQ ID NO: 168399 - DNA, 9 bp, Unknown
  misc_feature (1)..( 9): Result.005 file - promoters50/1393599
taccaatat

SEQ ID NO: 168400 - DNA, 9 bp, Unknown
  misc_feature (1)..( 9): Result.005 file - promoters50/1393599
aaccaatat

SEQ ID NO: 168401 - DNA, 8 bp, Unknown
  misc_feature (1)..( 8): Result.005 file - promoters50/1393599
actgcaca

SEQ ID NO: 168402 - DNA, 8 bp, Unknown
  misc_feature (1)..( 8): Result.005 file - promoters50/1393599
tctgtaca

SEQ ID NO: 168403 - DNA, 8 bp, Unknown
  misc_feature (1)..( 8): Result.005 file - promoters50/1393599
actggaca

SEQ ID NO: 168404 - DNA, 6 bp, Unknown
  misc_feature (1)..( 6): Result.005 file - promoters50/1393599
aaaaaa

SEQ ID NO: 168405 - DNA, 6 bp, Unknown
  misc_feature (1)..( 6): Result.005 file - promoters50/1393599
aaaaaa

SEQ ID NO: 168406 - DNA, 7 bp, Unknown
  misc_feature (1)..( 7): Result.005 file - promoters50/1393599
aaacaaa

SEQ ID NO: 168407 - DNA, 10 bp, Unknown
  misc_feature (1)..( 10): Result.005 file - promoters50/1393599
gcctatagat

SEQ ID NO: 168408 - DNA, 10 bp, Unknown
  misc_feature (1)..( 10): Result.005 file - promoters50/1393599
tggaatagat

SEQ ID NO: 168409 - DNA, 10 bp, Unknown
  misc_feature (1)..( 10): Result.005 file - promoters50/1393599
tggaaaagaa

SEQ ID NO: 168410 - DNA, 11 bp, Unknown
  misc_feature (1)..( 11): Result.005 file - promoters50/1393599
agataaacaaa

SEQ ID NO: 168411 - DNA, 11 bp, Unknown
  misc_feature (1)..( 11): Result.005 file - promoters50/1393599
cttaaaagaaa

SEQ ID NO: 168412 - DNA, 11 bp, Unknown
  misc_feature (1)..( 11): Result.005 file - promoters50/1393599
agaaaaataaa

SEQ ID NO: 168413 - DNA, 13 bp, Unknown
  misc_feature (1)..( 13): Result.005 file - promoters50/1393599
caaccaaacccac

SEQ ID NO: 168414 - DNA, 13 bp, Unknown
  misc_feature (1)..( 13): Result.005 file - promoters50/1393599
caacaaaaaccac

SEQ ID NO: 168415 - DNA, 13 bp, Unknown
  misc_feature (1)..( 13): Result.005 file - promoters50/1393599
gatccaaccccaa

SEQ ID NO: 168416 - DNA, 7 bp, Unknown
  misc_feature (1)..( 7): Result.005 file - promoters50/1393620
caaatta

SEQ ID NO: 168417 - DNA, 7 bp, Unknown
  misc_feature (1)..( 7): Result.005 file - promoters50/1393620
caaattt

SEQ ID NO: 168418 - DNA, 7 bp, Unknown
  misc_feature (1)..( 7): Result.005 file - promoters50/1393620
aaaatta

SEQ ID NO: 168419 - DNA, 11 bp, Unknown
  misc_feature (1)..( 11): Result.005 file - promoters50/1393620
gagttgcggtc

SEQ ID NO: 168420 - DNA, 11 bp, Unknown
  misc_feature (1)..( 11): Result.005 file - promoters50/1393620
gaggtgctgcg

SEQ ID NO: 168421 - DNA, 10 bp, Unknown
  misc_feature (1)..( 10): Result.005 file - promoters50/1393620
agtggcggtc

SEQ ID NO: 168422 - DNA, 13 bp, Unknown
  misc_feature (1)..( 13): Result.005 file - promoters50/1393642
atcttttgtagac

SEQ ID NO: 168423 - DNA, 13 bp, Unknown
  misc_feature (1)..( 13): Result.005 file - promoters50/1393642
atcttttgtaact

SEQ ID NO: 168424 - DNA, 13 bp, Unknown
  misc_feature (1)..( 13): Result.005 file - promoters50/1393642
cttggttggaact

SEQ ID NO: 168425 - DNA, 8 bp, Unknown
  misc_feature (1)..( 8): Result.005 file - promoters50/1393651
aaatcaaa

SEQ ID NO: 168426 - DNA, 8 bp, Unknown
  misc_feature (1)..( 8): Result.005 file - promoters50/1393651
caataaaa

SEQ ID NO: 168427 - DNA, 8 bp, Unknown
  misc_feature (1)..( 8): Result.005 file - promoters50/1393651
aaaccaaa

SEQ ID NO: 168428 - DNA, 9 bp, Unknown
  misc_feature (1)..( 9): Result.005 file - promoters50/1393665
ttataaaca

SEQ ID NO: 168429 - DNA, 9 bp, Unknown
  misc_feature (1)..( 9): Result.005 file - promoters50/1393665
ttagaaatg

SEQ ID NO: 168430 - DNA, 9 bp, Unknown
  misc_feature (1)..( 9): Result.005 file - promoters50/1393665
tgagagatg

SEQ ID NO: 168431 - DNA, 10 bp, Unknown
  misc_feature (1)..( 10): Result.005 file - promoters50/1393665
accaaatgaa

SEQ ID NO: 168432 - DNA, 10 bp, Unknown
  misc_feature (1)..( 10): Result.005 file - promoters50/1393665
aagaaatgaa

SEQ ID NO: 168433 - DNA, 10 bp, Unknown
  misc_feature (1)..( 10): Result.005 file - promoters50/1393665
accaattgat

SEQ ID NO: 168434 - DNA, 9 bp, Unknown
  misc_feature (1)..( 9): Result.005 file - promoters50/1393665
aattcgaaa

SEQ ID NO: 168435 - DNA, 9 bp, Unknown
  misc_feature (1)..( 9): Result.005 file - promoters50/1393665
aattcgacg

SEQ ID NO: 168436 - DNA, 9 bp, Unknown
  misc_feature (1)..( 9): Result.005 file - promoters50/1393665
acttcgacg

SEQ ID NO: 168437 - DNA, 9 bp, Unknown
  misc_feature (1)..( 9): Result.005 file - promoters50/1393677
tttttattg

SEQ ID NO: 168438 - DNA, 9 bp, Unknown
  misc_feature (1)..( 9): Result.005 file - promoters50/1393677
gatttgttg

SEQ ID NO: 168439 - DNA, 10 bp, Unknown
  misc_feature (1)..( 10): Result.005 file - promoters50/1393677
ttttctattc

SEQ ID NO: 168440 - DNA, 12 bp, Unknown
  misc_feature (1)..( 12): Result.005 file - promoters50/1393677
gaaacacaaata

SEQ ID NO: 168441 - DNA, 12 bp, Unknown
  misc_feature (1)..( 12): Result.005 file - promoters50/1393677
gaaacagaaata

SEQ ID NO: 168442 - DNA, 12 bp, Unknown
  misc_feature (1)..( 12): Result.005 file - promoters50/1393677
taaaaagtttaa

SEQ ID NO: 168443 - DNA, 7 bp, Unknown
  misc_feature (1)..( 7): Result.005 file - promoters50/1393677
aagaaaa

SEQ ID NO: 168444 - DNA, 7 bp, Unknown
  misc_feature (1)..( 7): Result.005 file - promoters50/1393677
cagaaaa

SEQ ID NO: 168445 - DNA, 7 bp, Unknown
  misc_feature (1)..( 7): Result.005 file - promoters50/1393677
aagaaaa

SEQ ID NO: 168446 - DNA, 9 bp, Unknown
  misc_feature (1)..( 9): Result.005 file - promoters50/1393677
caattaaaa

SEQ ID NO: 168447 - DNA, 9 bp, Unknown
  misc_feature (1)..( 9): Result.005 file - promoters50/1393677
taataaaaa

SEQ ID NO: 168448 - DNA, 9 bp, Unknown
  misc_feature (1)..( 9): Result.005 file - promoters50/1393677
aaatagttt

SEQ ID NO: 168449 - DNA, 13 bp, Unknown
  misc_feature (1)..( 13): Result.005 file - promoters50/1393684
atatttttagtaa

SEQ ID NO: 168450 - DNA, 13 bp, Unknown
  misc_feature (1)..( 13): Result.005 file - promoters50/1393684
ataatttgagtta

SEQ ID NO: 168451 - DNA, 13 bp, Unknown
  misc_feature (1)..( 13): Result.005 file - promoters50/1393684
gcaattttagcct

SEQ ID NO: 168452 - DNA, 13 bp, Unknown
  misc_feature (1)..( 13): Result.005 file - promoters50/1393684
aatttcttactaa

SEQ ID NO: 168453 - DNA, 13 bp, Unknown
  misc_feature (1)..( 13): Result.005 file - promoters50/1393684
caaatgtgattgc

SEQ ID NO: 168454 - DNA, 13 bp, Unknown
  misc_feature (1)..( 13): Result.005 file - promoters50/1393684
tcaatgttaagcc

SEQ ID NO: 168455 - DNA, 13 bp, Unknown
  misc_feature (1)..( 13): Result.005 file - promoters50/1393684
tgaatggtaaatc

SEQ ID NO: 168456 - DNA, 11 bp, Unknown
  misc_feature (1)..( 11): Result.005 file - promoters50/1393684
ccttttaaaaa

SEQ ID NO: 168457 - DNA, 11 bp, Unknown
  misc_feature (1)..( 11): Result.005 file - promoters50/1393684
ccttataaata

SEQ ID NO: 168458 - DNA, 11 bp, Unknown
  misc_feature (1)..( 11): Result.005 file - promoters50/1393684
atctataaagc

SEQ ID NO: 168459 - DNA, 11 bp, Unknown
  misc_feature (1)..( 11): Result.005 file - promoters50/1393684
tcctataatta

SEQ ID NO: 168460 - DNA, 11 bp, Unknown
  misc_feature (1)..( 11): Result.005 file - promoters50/1393684
atatataaaga

SEQ ID NO: 168461 - DNA, 11 bp, Unknown
  misc_feature (1)..( 11): Result.005 file - promoters50/1393684
atatataaaac

SEQ ID NO: 168462 - DNA, 11 bp, Unknown
  misc_feature (1)..( 11): Result.005 file - promoters50/1393684
cactatatata

SEQ ID NO: 168463 - DNA, 12 bp, Unknown
  misc_feature (1)..( 12): Result.005 file - promoters50/1393684
atatctataaag

SEQ ID NO: 168464 - DNA, 12 bp, Unknown
  misc_feature (1)..( 12): Result.005 file - promoters50/1393684
atatatataaag

SEQ ID NO: 168465 - DNA, 12 bp, Unknown
  misc_feature (1)..( 12): Result.005 file - promoters50/1393684
tcatatataaaa

SEQ ID NO: 168466 - DNA, 12 bp, Unknown
  misc_feature (1)..( 12): Result.005 file - promoters50/1393684
ctccttataaat

SEQ ID NO: 168467 - DNA, 12 bp, Unknown
  misc_feature (1)..( 12): Result.005 file - promoters50/1393684
ctatatatattc

SEQ ID NO: 168468 - DNA, 12 bp, Unknown
  misc_feature (1)..( 12): Result.005 file - promoters50/1393684
cctcctataatt

SEQ ID NO: 168469 - DNA, 7 bp, Unknown
  misc_feature (1)..( 7): Result.005 file - promoters50/1393725
attgtat

SEQ ID NO: 168470 - DNA, 7 bp, Unknown
  misc_feature (1)..( 7): Result.005 file - promoters50/1393725
attgtaa

SEQ ID NO: 168471 - DNA, 7 bp, Unknown
  misc_feature (1)..( 7): Result.005 file - promoters50/1393725
attttat

SEQ ID NO: 168472 - DNA, 8 bp, Unknown
  misc_feature (1)..( 8): Result.005 file - promoters50/1393725
tctctcac

SEQ ID NO: 168473 - DNA, 8 bp, Unknown
  misc_feature (1)..( 8): Result.005 file - promoters50/1393725
tctatcat

SEQ ID NO: 168474 - DNA, 8 bp, Unknown
  misc_feature (1)..( 8): Result.005 file - promoters50/1393725
attctcac

SEQ ID NO: 168475 - DNA, 10 bp, Unknown
  misc_feature (1)..( 10): Result.005 file - promoters50/1393725
atacaacatt

SEQ ID NO: 168476 - DNA, 10 bp, Unknown
  misc_feature (1)..( 10): Result.005 file - promoters50/1393725
atgcaagatt

SEQ ID NO: 168477 - DNA, 10 bp, Unknown
  misc_feature (1)..( 10): Result.005 file - promoters50/1393725
atataacaaa

SEQ ID NO: 168478 - DNA, 9 bp, Unknown
  misc_feature (1)..( 9): Result.005 file - promoters50/1393725
taaaattct

SEQ ID NO: 168479 - DNA, 9 bp, Unknown
  misc_feature (1)..( 9): Result.005 file - promoters50/1393725
aaaacttct

SEQ ID NO: 168480 - DNA, 9 bp, Unknown
  misc_feature (1)..( 9): Result.005 file - promoters50/1393725
aaaacctct

SEQ ID NO: 168481 - DNA, 8 bp, Unknown
  misc_feature (1)..( 8): Result.005 file - promoters50/1393725
ttagtttt

SEQ ID NO: 168482 - DNA, 8 bp, Unknown
  misc_feature (1)..( 8): Result.005 file - promoters50/1393725
ttaatttt

SEQ ID NO: 168483 - DNA, 9 bp, Unknown
  misc_feature (1)..( 9): Result.005 file - promoters50/1393725
aaaatgttt

SEQ ID NO: 168484 - DNA, 13 bp, Unknown
  misc_feature (1)..( 13): Result.005 file - promoters50/1393725
aaaacattggtaa

SEQ ID NO: 168485 - DNA, 13 bp, Unknown
  misc_feature (1)..( 13): Result.005 file - promoters50/1393725
aaaccatttggag

SEQ ID NO: 168486 - DNA, 13 bp, Unknown
  misc_feature (1)..( 13): Result.005 file - promoters50/1393725
gaaatatttgtaa

SEQ ID NO: 168487 - DNA, 9 bp, Unknown
  misc_feature (1)..( 9): Result.005 file - promoters50/1393725
aaaacctct

SEQ ID NO: 168488 - DNA, 9 bp, Unknown
  misc_feature (1)..( 9): Result.005 file - promoters50/1393725
aaaaccaag

SEQ ID NO: 168489 - DNA, 9 bp, Unknown
  misc_feature (1)..( 9): Result.005 file - promoters50/1393725
aaaacttct

SEQ ID NO: 168490 - DNA, 12 bp, Unknown
  misc_feature (1)..( 12): Result.005 file - promoters50/1393725
ctcttattctca

SEQ ID NO: 168491 - DNA, 12 bp, Unknown
  misc_feature (1)..( 12): Result.005 file - promoters50/1393725
ctcttattacat

SEQ ID NO: 168492 - DNA, 12 bp, Unknown
  misc_feature (1)..( 12): Result.005 file - promoters50/1393725
cttttattttca

SEQ ID NO: 168493 - DNA, 9 bp, Unknown
  misc_feature (1)..( 9): Result.005 file - promoters50/1393725
ttattctca

SEQ ID NO: 168494 - DNA, 9 bp, Unknown
  misc_feature (1)..( 9): Result.005 file - promoters50/1393725
agattctct

SEQ ID NO: 168495 - DNA, 9 bp, Unknown
  misc_feature (1)..( 9): Result.005 file - promoters50/1393725
ttattttca

SEQ ID NO: 168496 - DNA, 9 bp, Unknown
  misc_feature (1)..( 9): Result.005 file - promoters50/1393725
tactaattg

SEQ ID NO: 168497 - DNA, 9 bp, Unknown
  misc_feature (1)..( 9): Result.005 file - promoters50/1393725
taccaattg

SEQ ID NO: 168498 - DNA, 9 bp, Unknown
  misc_feature (1)..( 9): Result.005 file - promoters50/1393725
aaccatttg

SEQ ID NO: 168499 - DNA, 12 bp, Unknown
  misc_feature (1)..( 12): Result.005 file - promoters50/1393751
tactcacatatg

SEQ ID NO: 168500 - DNA, 12 bp, Unknown
  misc_feature (1)..( 12): Result.005 file - promoters50/1393751
aactcaccggag

SEQ ID NO: 168501 - DNA, 12 bp, Unknown
  misc_feature (1)..( 12): Result.005 file - promoters50/1393751
tactaacatatg

SEQ ID NO: 168502 - DNA, 12 bp, Unknown
  misc_feature (1)..( 12): Result.005 file - promoters50/1393751
tcaaaacataat

SEQ ID NO: 168503 - DNA, 12 bp, Unknown
  misc_feature (1)..( 12): Result.005 file - promoters50/1393751
atgtgacataaa

SEQ ID NO: 168504 - DNA, 6 bp, Unknown
  misc_feature (1)..( 6): Result.005 file - promoters50/1393761
tttttt

SEQ ID NO: 168505 - DNA, 6 bp, Unknown
  misc_feature (1)..( 6): Result.005 file - promoters50/1393761
tttttt

SEQ ID NO: 168506 - DNA, 6 bp, Unknown
  misc_feature (1)..( 6): Result.005 file - promoters50/1393761
tttttt

SEQ ID NO: 168507 - DNA, 9 bp, Unknown
  misc_feature (1)..( 9): Result.005 file - promoters50/1393761
aaatgaaat

SEQ ID NO: 168508 - DNA, 9 bp, Unknown
  misc_feature (1)..( 9): Result.005 file - promoters50/1393761
aaataaaat

SEQ ID NO: 168509 - DNA, 9 bp, Unknown
  misc_feature (1)..( 9): Result.005 file - promoters50/1393761
aaacgaaaa

SEQ ID NO: 168510 - DNA, 7 bp, Unknown
  misc_feature (1)..( 7): Result.005 file - promoters50/1393761
ctgggtc

SEQ ID NO: 168511 - DNA, 7 bp, Unknown
  misc_feature (1)..( 7): Result.005 file - promoters50/1393761
ctgtgtc

SEQ ID NO: 168512 - DNA, 7 bp, Unknown
  misc_feature (1)..( 7): Result.005 file - promoters50/1393761
ttgtgtc

SEQ ID NO: 168513 - DNA, 10 bp, Unknown
  misc_feature (1)..( 10): Result.005 file - promoters50/1393761
cgatttcaac

SEQ ID NO: 168514 - DNA, 10 bp, Unknown
  misc_feature (1)..( 10): Result.005 file - promoters50/1393761
ctatttaaac

SEQ ID NO: 168515 - DNA, 10 bp, Unknown
  misc_feature (1)..( 10): Result.005 file - promoters50/1393761
ctagttactt

SEQ ID NO: 168516 - DNA, 9 bp, Unknown
  misc_feature (1)..( 9): Result.005 file - promoters50/1393761
aagctaaat

SEQ ID NO: 168517 - DNA, 9 bp, Unknown
  misc_feature (1)..( 9): Result.005 file - promoters50/1393761
aagttaata

SEQ ID NO: 168518 - DNA, 9 bp, Unknown
  misc_feature (1)..( 9): Result.005 file - promoters50/1393761
cagttaata

SEQ ID NO: 168519 - DNA, 8 bp, Unknown
  misc_feature (1)..( 8): Result.005 file - promoters50/1393761
cttgattc

SEQ ID NO: 168520 - DNA, 8 bp, Unknown
  misc_feature (1)..( 8): Result.005 file - promoters50/1393761
tttgattg

SEQ ID NO: 168521 - DNA, 8 bp, Unknown
  misc_feature (1)..( 8): Result.005 file - promoters50/1393761
tttgtttg

SEQ ID NO: 168522 - DNA, 12 bp, Unknown
  misc_feature (1)..( 12): Result.005 file - promoters50/1393777
taaaaaatgttt

SEQ ID NO: 168523 - DNA, 12 bp, Unknown
  misc_feature (1)..( 12): Result.005 file - promoters50/1393777
tcaaaattgtta

SEQ ID NO: 168524 - DNA, 12 bp, Unknown
  misc_feature (1)..( 12): Result.005 file - promoters50/1393777
ctgcaatggttt

SEQ ID NO: 168525 - DNA, 12 bp, Unknown
  misc_feature (1)..( 12): Result.005 file - promoters50/1393777
taagaaacaaat

SEQ ID NO: 168526 - DNA, 12 bp, Unknown
  misc_feature (1)..( 12): Result.005 file - promoters50/1393777
tggccattgttg

SEQ ID NO: 168527 - DNA, 12 bp, Unknown
  misc_feature (1)..( 12): Result.005 file - promoters50/1393777
cccatattttta

SEQ ID NO: 168528 - DNA, 12 bp, Unknown
  misc_feature (1)..( 12): Result.005 file - promoters50/1393777
acattattttat

SEQ ID NO: 168529 - DNA, 11 bp, Unknown
  misc_feature (1)..( 11): Result.005 file - promoters50/1393777
caattttattt

SEQ ID NO: 168530 - DNA, 11 bp, Unknown
  misc_feature (1)..( 11): Result.005 file - promoters50/1393777
atattttatct

SEQ ID NO: 168531 - DNA, 11 bp, Unknown
  misc_feature (1)..( 11): Result.005 file - promoters50/1393777
ttcgtttcttt

SEQ ID NO: 168532 - DNA, 11 bp, Unknown
  misc_feature (1)..( 11): Result.005 file - promoters50/1393777
tctctttattt

SEQ ID NO: 168533 - DNA, 11 bp, Unknown
  misc_feature (1)..( 11): Result.005 file - promoters50/1393777
caactttcatt

SEQ ID NO: 168534 - DNA, 11 bp, Unknown
  misc_feature (1)..( 11): Result.005 file - promoters50/1393777
tctttttgttt

SEQ ID NO: 168535 - DNA, 11 bp, Unknown
  misc_feature (1)..( 11): Result.005 file - promoters50/1393777
ttattttaatc

SEQ ID NO: 168536 - DNA, 11 bp, Unknown
  misc_feature (1)..( 11): Result.005 file - promoters50/1393777
ttttattttat

SEQ ID NO: 168537 - DNA, 11 bp, Unknown
  misc_feature (1)..( 11): Result.005 file - promoters50/1393777
tataattttag

SEQ ID NO: 168538 - DNA, 11 bp, Unknown
  misc_feature (1)..( 11): Result.005 file - promoters50/1393777
atttatttttc

SEQ ID NO: 168539 - DNA, 11 bp, Unknown
  misc_feature (1)..( 11): Result.005 file - promoters50/1393777
tttcatttgag

SEQ ID NO: 168540 - DNA, 11 bp, Unknown
  misc_feature (1)..( 11): Result.005 file - promoters50/1393777
tccgattgtag

SEQ ID NO: 168541 - DNA, 11 bp, Unknown
  misc_feature (1)..( 11): Result.005 file - promoters50/1393777
gtttctttaac

SEQ ID NO: 168542 - DNA, 15 bp, Unknown
  misc_feature (1)..( 15): Result.005 file - promoters50/1393777
tattttttgatataa

SEQ ID NO: 168543 - DNA, 15 bp, Unknown
  misc_feature (1)..( 15): Result.005 file - promoters50/1393777
ttagtgttgttattt

SEQ ID NO: 168544 - DNA, 16 bp, Unknown
  misc_feature (1)..( 16): Result.005 file - promoters50/1393777
cgcggtttggataacc

SEQ ID NO: 168545 - DNA, 16 bp, Unknown
  misc_feature (1)..( 16): Result.005 file - promoters50/1393777
tttatttatgattttt

SEQ ID NO: 168546 - DNA, 16 bp, Unknown
  misc_feature (1)..( 16): Result.005 file - promoters50/1393777
attgtttatggaaaat

SEQ ID NO: 168547 - DNA, 16 bp, Unknown
  misc_feature (1)..( 16): Result.005 file - promoters50/1393777
tttctttatacacttt

SEQ ID NO: 168548 - DNA, 16 bp, Unknown
  misc_feature (1)..( 16): Result.005 file - promoters50/1393777
tatttttcttgtacca

SEQ ID NO: 168549 - DNA, 16 bp, Unknown
  misc_feature (1)..( 16): Result.005 file - promoters50/1393777
aatgttttttttgtac

SEQ ID NO: 168550 - DNA, 17 bp, Unknown
  misc_feature (1)..( 17): Result.005 file - promoters50/1393777
ctaaaatttaaacgtaa

SEQ ID NO: 168551 - DNA, 17 bp, Unknown
  misc_feature (1)..( 17): Result.005 file - promoters50/1393777
catataattaaacaaag

SEQ ID NO: 168552 - DNA, 17 bp, Unknown
  misc_feature (1)..( 17): Result.005 file - promoters50/1393777
tcttttattaaaaactt

SEQ ID NO: 168553 - DNA, 17 bp, Unknown
  misc_feature (1)..( 17): Result.005 file - promoters50/1393777
aaaacaaataaaatatg

SEQ ID NO: 168554 - DNA, 17 bp, Unknown
  misc_feature (1)..( 17): Result.005 file - promoters50/1393777
catattattaaatttac

SEQ ID NO: 168555 - DNA, 17 bp, Unknown
  misc_feature (1)..( 17): Result.005 file - promoters50/1393777
tcggatcatatgactca

SEQ ID NO: 168556 - DNA, 17 bp, Unknown
  misc_feature (1)..( 17): Result.005 file - promoters50/1393777
ttcatacacaaaaaaaa

SEQ ID NO: 168557 - DNA, 10 bp, Unknown
  misc_feature (1)..( 10): Result.005 file - promoters50/1393777
aaaattatat

SEQ ID NO: 168558 - DNA, 10 bp, Unknown
  misc_feature (1)..( 10): Result.005 file - promoters50/1393777
taaattctat

SEQ ID NO: 168559 - DNA, 10 bp, Unknown
  misc_feature (1)..( 10): Result.005 file - promoters50/1393777
ctttttatat

SEQ ID NO: 168560 - DNA, 10 bp, Unknown
  misc_feature (1)..( 10): Result.005 file - promoters50/1393777
taaattagag

SEQ ID NO: 168561 - DNA, 10 bp, Unknown
  misc_feature (1)..( 10): Result.005 file - promoters50/1393777
aaaattgaca

SEQ ID NO: 168562 - DNA, 10 bp, Unknown
  misc_feature (1)..( 10): Result.005 file - promoters50/1393777
taagttacag

SEQ ID NO: 168563 - DNA, 10 bp, Unknown
  misc_feature (1)..( 10): Result.005 file - promoters50/1393777
tagattctag

SEQ ID NO: 168564 - DNA, 12 bp, Unknown
  misc_feature (1)..( 12): Result.005 file - promoters50/1393777
tttattttttga

SEQ ID NO: 168565 - DNA, 12 bp, Unknown
  misc_feature (1)..( 12): Result.005 file - promoters50/1393777
agcattgtttat

SEQ ID NO: 168566 - DNA, 12 bp, Unknown
  misc_feature (1)..( 12): Result.005 file - promoters50/1393777
tttatttatgat

SEQ ID NO: 168567 - DNA, 12 bp, Unknown
  misc_feature (1)..( 12): Result.005 file - promoters50/1393777
tttatttttctt

SEQ ID NO: 168568 - DNA, 12 bp, Unknown
  misc_feature (1)..( 12): Result.005 file - promoters50/1393777
aatgtttttttt

SEQ ID NO: 168569 - DNA, 12 bp, Unknown
  misc_feature (1)..( 12): Result.005 file - promoters50/1393777
gttatttttttc

SEQ ID NO: 168570 - DNA, 13 bp, Unknown
  misc_feature (1)..( 13): Result.005 file - promoters50/1393777
agtctttctttat

SEQ ID NO: 168571 - DNA, 7 bp, Unknown
  misc_feature (1)..( 7): Result.005 file - promoters50/1393777
tttattt

SEQ ID NO: 168572 - DNA, 7 bp, Unknown
  misc_feature (1)..( 7): Result.005 file - promoters50/1393777
tttattt

SEQ ID NO: 168573 - DNA, 7 bp, Unknown
  misc_feature (1)..( 7): Result.005 file - promoters50/1393777
tttattt

SEQ ID NO: 168574 - DNA, 8 bp, Unknown
  misc_feature (1)..( 8): Result.005 file - promoters50/1393777
tttcattt

SEQ ID NO: 168575 - DNA, 8 bp, Unknown
  misc_feature (1)..( 8): Result.005 file - promoters50/1393777
tgttattt

SEQ ID NO: 168576 - DNA, 8 bp, Unknown
  misc_feature (1)..( 8): Result.005 file - promoters50/1393777
tttttttt

SEQ ID NO: 168577 - DNA, 9 bp, Unknown
  misc_feature (1)..( 9): Result.005 file - promoters50/1393777
aatttataa

SEQ ID NO: 168578 - DNA, 9 bp, Unknown
  misc_feature (1)..( 9): Result.005 file - promoters50/1393777
aattaataa

SEQ ID NO: 168579 - DNA, 9 bp, Unknown
  misc_feature (1)..( 9): Result.005 file - promoters50/1393777
tatttattt

SEQ ID NO: 168580 - DNA, 9 bp, Unknown
  misc_feature (1)..( 9): Result.005 file - promoters50/1393777
cgtttcttt

SEQ ID NO: 168581 - DNA, 9 bp, Unknown
  misc_feature (1)..( 9): Result.005 file - promoters50/1393777
tctttgttt

SEQ ID NO: 168582 - DNA, 9 bp, Unknown
  misc_feature (1)..( 9): Result.005 file - promoters50/1393777
tttttgttt

SEQ ID NO: 168583 - DNA, 13 bp, Unknown
  misc_feature (1)..( 13): Result.005 file - promoters50/1393777
acatataattaaa

SEQ ID NO: 168584 - DNA, 13 bp, Unknown
  misc_feature (1)..( 13): Result.005 file - promoters50/1393777
acaaataaaatat

SEQ ID NO: 168585 - DNA, 13 bp, Unknown
  misc_feature (1)..( 13): Result.005 file - promoters50/1393777
tcatattattaaa

SEQ ID NO: 168586 - DNA, 14 bp, Unknown
  misc_feature (1)..( 14): Result.005 file - promoters50/1393777
taatattcatacac

SEQ ID NO: 168587 - DNA, 14 bp, Unknown
  misc_feature (1)..( 14): Result.005 file - promoters50/1393777
tcatatgactcagc

SEQ ID NO: 168588 - DNA, 14 bp, Unknown
  misc_feature (1)..( 14): Result.005 file - promoters50/1393777
atttattaatctta

SEQ ID NO: 168589 - DNA, 15 bp, Unknown
  misc_feature (1)..( 15): Result.005 file - promoters50/1393787
tgattaatttctcta

SEQ ID NO: 168590 - DNA, 15 bp, Unknown
  misc_feature (1)..( 15): Result.005 file - promoters50/1393787
ggatgaatttatttt

SEQ ID NO: 168591 - DNA, 15 bp, Unknown
  misc_feature (1)..( 15): Result.005 file - promoters50/1393787
ggattaatgtctctt

SEQ ID NO: 168592 - DNA, 15 bp, Unknown
  misc_feature (1)..( 15): Result.005 file - promoters50/1393787
ttatgaatctgctaa

SEQ ID NO: 168593 - DNA, 15 bp, Unknown
  misc_feature (1)..( 15): Result.005 file - promoters50/1393787
ttatgaatccgaaac

SEQ ID NO: 168594 - DNA, 15 bp, Unknown
  misc_feature (1)..( 15): Result.005 file - promoters50/1393787
agttagttctcttgc

SEQ ID NO: 168595 - DNA, 14 bp, Unknown
  misc_feature (1)..( 14): Result.005 file - promoters50/1393787
ttaaaaaatcaaaa

SEQ ID NO: 168596 - DNA, 14 bp, Unknown
  misc_feature (1)..( 14): Result.005 file - promoters50/1393787
tcaaaaaaaaaagt

SEQ ID NO: 168597 - DNA, 14 bp, Unknown
  misc_feature (1)..( 14): Result.005 file - promoters50/1393787
ataaaaatttttct

SEQ ID NO: 168598 - DNA, 14 bp, Unknown
  misc_feature (1)..( 14): Result.005 file - promoters50/1393787
tcaaataatgtaat

SEQ ID NO: 168599 - DNA, 14 bp, Unknown
  misc_feature (1)..( 14): Result.005 file - promoters50/1393787
acgtataatttaat

SEQ ID NO: 168600 - DNA, 14 bp, Unknown
  misc_feature (1)..( 14): Result.005 file - promoters50/1393787
ataaaaattcaaaa

SEQ ID NO: 168601 - DNA, 11 bp, Unknown
  misc_feature (1)..( 11): Result.005 file - promoters50/1393802
taaccaaaaaa

SEQ ID NO: 168602 - DNA, 11 bp, Unknown
  misc_feature (1)..( 11): Result.005 file - promoters50/1393802
taacctaaaaa

SEQ ID NO: 168603 - DNA, 11 bp, Unknown
  misc_feature (1)..( 11): Result.005 file - promoters50/1393802
tcagctaaaat

SEQ ID NO: 168604 - DNA, 9 bp, Unknown
  misc_feature (1)..( 9): Result.005 file - promoters50/1393802
agaaatctt

SEQ ID NO: 168605 - DNA, 9 bp, Unknown
  misc_feature (1)..( 9): Result.005 file - promoters50/1393802
tgaaacctt

SEQ ID NO: 168606 - DNA, 9 bp, Unknown
  misc_feature (1)..( 9): Result.005 file - promoters50/1393802
agaaataca

SEQ ID NO: 168607 - DNA, 12 bp, Unknown
  misc_feature (1)..( 12): Result.005 file - promoters50/1393802
aaacataaagtt

SEQ ID NO: 168608 - DNA, 12 bp, Unknown
  misc_feature (1)..( 12): Result.005 file - promoters50/1393802
aaacacaaaagt

SEQ ID NO: 168609 - DNA, 12 bp, Unknown
  misc_feature (1)..( 12): Result.005 file - promoters50/1393802
ttacaaaaagtt

SEQ ID NO: 168610 - DNA, 12 bp, Unknown
  misc_feature (1)..( 12): Result.005 file - promoters50/1393802
taaagttagaga

SEQ ID NO: 168611 - DNA, 12 bp, Unknown
  misc_feature (1)..( 12): Result.005 file - promoters50/1393802
aaaagttcatct

SEQ ID NO: 168612 - DNA, 12 bp, Unknown
  misc_feature (1)..( 12): Result.005 file - promoters50/1393802
taaagtgttaca

SEQ ID NO: 168613 - DNA, 12 bp, Unknown
  misc_feature (1)..( 12): Result.005 file - promoters50/1393802
caaacttcatct

SEQ ID NO: 168614 - DNA, 8 bp, Unknown
  misc_feature (1)..( 8): Result.005 file - promoters50/1393802
attgtttt

SEQ ID NO: 168615 - DNA, 8 bp, Unknown
  misc_feature (1)..( 8): Result.005 file - promoters50/1393802
attttttt

SEQ ID NO: 168616 - DNA, 8 bp, Unknown
  misc_feature (1)..( 8): Result.005 file - promoters50/1393802
ctttctta

SEQ ID NO: 168617 - DNA, 13 bp, Unknown
  misc_feature (1)..( 13): Result.005 file - promoters50/1393802
ataatttaatcac

SEQ ID NO: 168618 - DNA, 13 bp, Unknown
  misc_feature (1)..( 13): Result.005 file - promoters50/1393802
agttattaatcac

SEQ ID NO: 168619 - DNA, 13 bp, Unknown
  misc_feature (1)..( 13): Result.005 file - promoters50/1393802
agtgattcatctt

SEQ ID NO: 168620 - DNA, 9 bp, Unknown
  misc_feature (1)..( 9): Result.005 file - promoters50/1393802
actatgaaa

SEQ ID NO: 168621 - DNA, 9 bp, Unknown
  misc_feature (1)..( 9): Result.005 file - promoters50/1393802
tttattaaa

SEQ ID NO: 168622 - DNA, 9 bp, Unknown
  misc_feature (1)..( 9): Result.005 file - promoters50/1393802
ttttttaaa

SEQ ID NO: 168623 - DNA, 16 bp, Unknown
  misc_feature (1)..( 16): Result.005 file - promoters50/1393805
tatcaattaatctcac

SEQ ID NO: 168624 - DNA, 16 bp, Unknown
  misc_feature (1)..( 16): Result.005 file - promoters50/1393805
tcatttttattctatt

SEQ ID NO: 168625 - DNA, 17 bp, Unknown
  misc_feature (1)..( 17): Result.005 file - promoters50/1393805
atttgttgtattctaaa

SEQ ID NO: 168626 - DNA, 16 bp, Unknown
  misc_feature (1)..( 16): Result.005 file - promoters50/1393805
taaattttaatctctg

SEQ ID NO: 168627 - DNA, 17 bp, Unknown
  misc_feature (1)..( 17): Result.005 file - promoters50/1393805
atgtttttgattcagga

SEQ ID NO: 168628 - DNA, 17 bp, Unknown
  misc_feature (1)..( 17): Result.005 file - promoters50/1393805
ttcttttttattacact

SEQ ID NO: 168629 - DNA, 17 bp, Unknown
  misc_feature (1)..( 17): Result.005 file - promoters50/1393805
caacacgttcttctttt

SEQ ID NO: 168630 - DNA, 6 bp, Unknown
  misc_feature (1)..( 6): Result.005 file - promoters50/1393808
atccat

SEQ ID NO: 168631 - DNA, 6 bp, Unknown
  misc_feature (1)..( 6): Result.005 file - promoters50/1393808
atccat

SEQ ID NO: 168632 - DNA, 6 bp, Unknown
  misc_feature (1)..( 6): Result.005 file - promoters50/1393808
atccat

SEQ ID NO: 168633 - DNA, 11 bp, Unknown
  misc_feature (1)..( 11): Result.005 file - promoters50/1393812
tcgttctcaaa

SEQ ID NO: 168634 - DNA, 11 bp, Unknown
  misc_feature (1)..( 11): Result.005 file - promoters50/1393812
tctctctgaaa

SEQ ID NO: 168635 - DNA, 11 bp, Unknown
  misc_feature (1)..( 11): Result.005 file - promoters50/1393812
tcgtgctcaca

SEQ ID NO: 168636 - DNA, 11 bp, Unknown
  misc_feature (1)..( 11): Result.005 file - promoters50/1393812
ttgattataaa

SEQ ID NO: 168637 - DNA, 11 bp, Unknown
  misc_feature (1)..( 11): Result.005 file - promoters50/1393812
ttggttataaa

SEQ ID NO: 168638 - DNA, 11 bp, Unknown
  misc_feature (1)..( 11): Result.005 file - promoters50/1393812
gtgagtatgaa

SEQ ID NO: 168639 - DNA, 9 bp, Unknown
  misc_feature (1)..( 9): Result.005 file - promoters50/1393812
aaactgaat

SEQ ID NO: 168640 - DNA, 9 bp, Unknown
  misc_feature (1)..( 9): Result.005 file - promoters50/1393812
aaacagaat

SEQ ID NO: 168641 - DNA, 9 bp, Unknown
  misc_feature (1)..( 9): Result.005 file - promoters50/1393812
aaaatgaaa

SEQ ID NO: 168642 - DNA, 8 bp, Unknown
  misc_feature (1)..( 8): Result.005 file - promoters50/1393812
gaataacc

SEQ ID NO: 168643 - DNA, 8 bp, Unknown
  misc_feature (1)..( 8): Result.005 file - promoters50/1393812
gaataaat

SEQ ID NO: 168644 - DNA, 8 bp, Unknown
  misc_feature (1)..( 8): Result.005 file - promoters50/1393812
aaataacc

SEQ ID NO: 168645 - DNA, 8 bp, Unknown
  misc_feature (1)..( 8): Result.005 file - promoters50/1393812
atataacc

SEQ ID NO: 168646 - DNA, 7 bp, Unknown
  misc_feature (1)..( 7): Result.005 file - promoters50/1393812
aacttat

SEQ ID NO: 168647 - DNA, 7 bp, Unknown
  misc_feature (1)..( 7): Result.005 file - promoters50/1393812
tacttat

SEQ ID NO: 168648 - DNA, 7 bp, Unknown
  misc_feature (1)..( 7): Result.005 file - promoters50/1393812
aacttat

SEQ ID NO: 168649 - DNA, 10 bp, Unknown
  misc_feature (1)..( 10): Result.005 file - promoters50/1393812
ttctttttga

SEQ ID NO: 168650 - DNA, 10 bp, Unknown
  misc_feature (1)..( 10): Result.005 file - promoters50/1393812
ttctttttat

SEQ ID NO: 168651 - DNA, 10 bp, Unknown
  misc_feature (1)..( 10): Result.005 file - promoters50/1393812
gcttttgtat

SEQ ID NO: 168652 - DNA, 8 bp, Unknown
  misc_feature (1)..( 8): Result.005 file - promoters50/1393812
ataaccaa

SEQ ID NO: 168653 - DNA, 8 bp, Unknown
  misc_feature (1)..( 8): Result.005 file - promoters50/1393812
ataaccaa

SEQ ID NO: 168654 - DNA, 8 bp, Unknown
  misc_feature (1)..( 8): Result.005 file - promoters50/1393812
ataacctt

SEQ ID NO: 168655 - DNA, 12 bp, Unknown
  misc_feature (1)..( 12): Result.005 file - promoters50/1393812
tgggccctaaag

SEQ ID NO: 168656 - DNA, 12 bp, Unknown
  misc_feature (1)..( 12): Result.005 file - promoters50/1393812
tgggcccattaa

SEQ ID NO: 168657 - DNA, 12 bp, Unknown
  misc_feature (1)..( 12): Result.005 file - promoters50/1393812
taggcccattaa

SEQ ID NO: 168658 - DNA, 8 bp, Unknown
  misc_feature (1)..( 8): Result.005 file - promoters50/1393812
gctaacta

SEQ ID NO: 168659 - DNA, 8 bp, Unknown
  misc_feature (1)..( 8): Result.005 file - promoters50/1393812
tataacta

SEQ ID NO: 168660 - DNA, 8 bp, Unknown
  misc_feature (1)..( 8): Result.005 file - promoters50/1393812
tatcactt

SEQ ID NO: 168661 - DNA, 8 bp, Unknown
  misc_feature (1)..( 8): Result.005 file - promoters50/1393827
agttatct

SEQ ID NO: 168662 - DNA, 8 bp, Unknown
  misc_feature (1)..( 8): Result.005 file - promoters50/1393827
cgttttct

SEQ ID NO: 168663 - DNA, 8 bp, Unknown
  misc_feature (1)..( 8): Result.005 file - promoters50/1393827
agttataa

SEQ ID NO: 168664 - DNA, 7 bp, Unknown
  misc_feature (1)..( 7): Result.005 file - promoters50/1393827
ttttctg

SEQ ID NO: 168665 - DNA, 7 bp, Unknown
  misc_feature (1)..( 7): Result.005 file - promoters50/1393827
ttttctg

SEQ ID NO: 168666 - DNA, 8 bp, Unknown
  misc_feature (1)..( 8): Result.005 file - promoters50/1393827
tttgtcta

SEQ ID NO: 168667 - DNA, 11 bp, Unknown
  misc_feature (1)..( 11): Result.005 file - promoters50/1393827
tcttattagat

SEQ ID NO: 168668 - DNA, 11 bp, Unknown
  misc_feature (1)..( 11): Result.005 file - promoters50/1393827
tctaatttcat

SEQ ID NO: 168669 - DNA, 11 bp, Unknown
  misc_feature (1)..( 11): Result.005 file - promoters50/1393827
cattattggat

SEQ ID NO: 168670 - DNA, 8 bp, Unknown
  misc_feature (1)..( 8): Result.005 file - promoters50/1393827
tatcaaat

SEQ ID NO: 168671 - DNA, 8 bp, Unknown
  misc_feature (1)..( 8): Result.005 file - promoters50/1393827
aatcaaat

SEQ ID NO: 168672 - DNA, 8 bp, Unknown
  misc_feature (1)..( 8): Result.005 file - promoters50/1393827
aattaaaa

SEQ ID NO: 168673 - DNA, 10 bp, Unknown
  misc_feature (1)..( 10): Result.005 file - promoters50/1393827
attctccaca

SEQ ID NO: 168674 - DNA, 10 bp, Unknown
  misc_feature (1)..( 10): Result.005 file - promoters50/1393827
aacttccaca

SEQ ID NO: 168675 - DNA, 10 bp, Unknown
  misc_feature (1)..( 10): Result.005 file - promoters50/1393827
aacctccacg

SEQ ID NO: 168676 - DNA, 12 bp, Unknown
  misc_feature (1)..( 12): Result.005 file - promoters50/1393827
taagatacgaaa

SEQ ID NO: 168677 - DNA, 12 bp, Unknown
  misc_feature (1)..( 12): Result.005 file - promoters50/1393827
taaaataagaaa

SEQ ID NO: 168678 - DNA, 13 bp, Unknown
  misc_feature (1)..( 13): Result.005 file - promoters50/1393827
gtcataaagcaaa

SEQ ID NO: 168679 - DNA, 24 bp, Unknown
  misc_feature (1)..( 24): Result.005 file - promoters50/1393845
tattttatttatttattataattc

SEQ ID NO: 168680 - DNA, 19 bp, Unknown
  misc_feature (1)..( 19): Result.005 file - promoters50/1393845
atgaaacttaatatacgtt

SEQ ID NO: 168681 - DNA, 21 bp, Unknown
  misc_feature (1)..( 21): Result.005 file - promoters50/1393845
aacttagcattaaaatattcg

SEQ ID NO: 168682 - DNA, 24 bp, Unknown
  misc_feature (1)..( 24): Result.005 file - promoters50/1393845
tttttttttttttttttttaaatt

SEQ ID NO: 168683 - DNA, 14 bp, Unknown
  misc_feature (1)..( 14): Result.005 file - promoters50/1393845
agttataattgtac

SEQ ID NO: 168684 - DNA, 24 bp, Unknown
  misc_feature (1)..( 24): Result.005 file - promoters50/1393845
ctgactttttctaaaaaaaattcg

SEQ ID NO: 168685 - DNA, 10 bp, Unknown
  misc_feature (1)..( 10): Result.005 file - promoters50/1393845
attcaaaatg

SEQ ID NO: 168686 - DNA, 10 bp, Unknown
  misc_feature (1)..( 10): Result.005 file - promoters50/1393845
cttcaaagaa

SEQ ID NO: 168687 - DNA, 11 bp, Unknown
  misc_feature (1)..( 11): Result.005 file - promoters50/1393845
attcgaaatgg

SEQ ID NO: 168688 - DNA, 11 bp, Unknown
  misc_feature (1)..( 11): Result.005 file - promoters50/1393845
cttcaaattcg

SEQ ID NO: 168689 - DNA, 11 bp, Unknown
  misc_feature (1)..( 11): Result.005 file - promoters50/1393845
tctgcaaatca

SEQ ID NO: 168690 - DNA, 11 bp, Unknown
  misc_feature (1)..( 11): Result.005 file - promoters50/1393845
tacagaaatgg

SEQ ID NO: 168691 - DNA, 11 bp, Unknown
  misc_feature (1)..( 11): Result.005 file - promoters50/1393845
attagaaaaga

SEQ ID NO: 168692 - DNA, 12 bp, Unknown
  misc_feature (1)..( 12): Result.005 file - promoters50/1393845
atataattttaa

SEQ ID NO: 168693 - DNA, 12 bp, Unknown
  misc_feature (1)..( 12): Result.005 file - promoters50/1393845
tcataatttagg

SEQ ID NO: 168694 - DNA, 12 bp, Unknown
  misc_feature (1)..( 12): Result.005 file - promoters50/1393845
aattaatttact

SEQ ID NO: 168695 - DNA, 12 bp, Unknown
  misc_feature (1)..( 12): Result.005 file - promoters50/1393845
tggaaatttacc

SEQ ID NO: 168696 - DNA, 12 bp, Unknown
  misc_feature (1)..( 12): Result.005 file - promoters50/1393845
tcaaaattcata

SEQ ID NO: 168697 - DNA, 12 bp, Unknown
  misc_feature (1)..( 12): Result.005 file - promoters50/1393845
aacggatttatt

SEQ ID NO: 168698 - DNA, 12 bp, Unknown
  misc_feature (1)..( 12): Result.005 file - promoters50/1393845
aaaaattaaaat

SEQ ID NO: 168699 - DNA, 12 bp, Unknown
  misc_feature (1)..( 12): Result.005 file - promoters50/1393845
gaattctaaaat

SEQ ID NO: 168700 - DNA, 12 bp, Unknown
  misc_feature (1)..( 12): Result.005 file - promoters50/1393845
tatgattaaaaa

SEQ ID NO: 168701 - DNA, 12 bp, Unknown
  misc_feature (1)..( 12): Result.005 file - promoters50/1393845
aattcttaaatt

SEQ ID NO: 168702 - DNA, 12 bp, Unknown
  misc_feature (1)..( 12): Result.005 file - promoters50/1393845
ctttattaaatt

SEQ ID NO: 168703 - DNA, 12 bp, Unknown
  misc_feature (1)..( 12): Result.005 file - promoters50/1393845
tcgttctaaaaa

SEQ ID NO: 168704 - DNA, 9 bp, Unknown
  misc_feature (1)..( 9): Result.005 file - promoters50/1393935
aaaagcaaa

SEQ ID NO: 168705 - DNA, 9 bp, Unknown
  misc_feature (1)..( 9): Result.005 file - promoters50/1393935
ataagcaaa

SEQ ID NO: 168706 - DNA, 9 bp, Unknown
  misc_feature (1)..( 9): Result.005 file - promoters50/1393935
aaaagaaaa

SEQ ID NO: 168707 - DNA, 8 bp, Unknown
  misc_feature (1)..( 8): Result.005 file - promoters50/1393954
tcaaggaa

SEQ ID NO: 168708 - DNA, 8 bp, Unknown
  misc_feature (1)..( 8): Result.005 file - promoters50/1393954
tcaaggtt

SEQ ID NO: 168709 - DNA, 8 bp, Unknown
  misc_feature (1)..( 8): Result.005 file - promoters50/1393954
tcacggtt

SEQ ID NO: 168710 - DNA, 9 bp, Unknown
  misc_feature (1)..( 9): Result.005 file - promoters50/1393954
tatctttat

SEQ ID NO: 168711 - DNA, 9 bp, Unknown
  misc_feature (1)..( 9): Result.005 file - promoters50/1393954
tatatttat

SEQ ID NO: 168712 - DNA, 9 bp, Unknown
  misc_feature (1)..( 9): Result.005 file - promoters50/1393954
tatctttag

SEQ ID NO: 168713 - DNA, 11 bp, Unknown
  misc_feature (1)..( 11): Result.005 file - promoters50/1393954
tctgaattcaa

SEQ ID NO: 168714 - DNA, 11 bp, Unknown
  misc_feature (1)..( 11): Result.005 file - promoters50/1393954
gttgaattttt

SEQ ID NO: 168715 - DNA, 11 bp, Unknown
  misc_feature (1)..( 11): Result.005 file - promoters50/1393954
gttgacttttt

SEQ ID NO: 168716 - DNA, 8 bp, Unknown
  misc_feature (1)..( 8): Result.005 file - promoters50/1393954
cgaacaaa

SEQ ID NO: 168717 - DNA, 8 bp, Unknown
  misc_feature (1)..( 8): Result.005 file - promoters50/1393954
tgaaaaaa

SEQ ID NO: 168718 - DNA, 8 bp, Unknown
  misc_feature (1)..( 8): Result.005 file - promoters50/1393954
tgtgcaaa

SEQ ID NO: 168719 - DNA, 8 bp, Unknown
  misc_feature (1)..( 8): Result.005 file - promoters50/1394008
aaagattt

SEQ ID NO: 168720 - DNA, 8 bp, Unknown
  misc_feature (1)..( 8): Result.005 file - promoters50/1394008
aaagatga

SEQ ID NO: 168721 - DNA, 8 bp, Unknown
  misc_feature (1)..( 8): Result.005 file - promoters50/1394008
aaagattt

SEQ ID NO: 168722 - DNA, 7 bp, Unknown
  misc_feature (1)..( 7): Result.005 file - promoters50/1394034
taagttt

SEQ ID NO: 168723 - DNA, 7 bp, Unknown
  misc_feature (1)..( 7): Result.005 file - promoters50/1394034
taacttt

SEQ ID NO: 168724 - DNA, 7 bp, Unknown
  misc_feature (1)..( 7): Result.005 file - promoters50/1394034
taatttt

SEQ ID NO: 168725 - DNA, 10 bp, Unknown
  misc_feature (1)..( 10): Result.005 file - promoters50/1394110
taataaacaa

SEQ ID NO: 168726 - DNA, 10 bp, Unknown
  misc_feature (1)..( 10): Result.005 file - promoters50/1394110
caataaaagt

SEQ ID NO: 168727 - DNA, 10 bp, Unknown
  misc_feature (1)..( 10): Result.005 file - promoters50/1394110
caaaaaaagg

SEQ ID NO: 168728 - DNA, 10 bp, Unknown
  misc_feature (1)..( 10): Result.005 file - promoters50/1394110
gtataaaaga

SEQ ID NO: 168729 - DNA, 10 bp, Unknown
  misc_feature (1)..( 10): Result.005 file - promoters50/1394110
atatacaagt

SEQ ID NO: 168730 - DNA, 10 bp, Unknown
  misc_feature (1)..( 10): Result.005 file - promoters50/1394110
aaacaaaata

SEQ ID NO: 168731 - DNA, 10 bp, Unknown
  misc_feature (1)..( 10): Result.005 file - promoters50/1394110
aaagaaagct

SEQ ID NO: 168732 - DNA, 10 bp, Unknown
  misc_feature (1)..( 10): Result.005 file - promoters50/1394110
tgacaaaata

SEQ ID NO: 168733 - DNA, 10 bp, Unknown
  misc_feature (1)..( 10): Result.005 file - promoters50/1394110
atacacaatc

SEQ ID NO: 168734 - DNA, 10 bp, Unknown
  misc_feature (1)..( 10): Result.005 file - promoters50/1394110
agacacaatg

SEQ ID NO: 168735 - DNA, 10 bp, Unknown
  misc_feature (1)..( 10): Result.005 file - promoters50/1394110
ttttccaaat

SEQ ID NO: 168736 - DNA, 10 bp, Unknown
  misc_feature (1)..( 10): Result.005 file - promoters50/1394110
ttttcaaaaa

SEQ ID NO: 168737 - DNA, 10 bp, Unknown
  misc_feature (1)..( 10): Result.005 file - promoters50/1394110
ccatccaaat

SEQ ID NO: 168738 - DNA, 10 bp, Unknown
  misc_feature (1)..( 10): Result.005 file - promoters50/1394110
acgtcaaaaa

SEQ ID NO: 168739 - DNA, 8 bp, Unknown
  misc_feature (1)..( 8): Result.005 file - promoters50/1394110
attcaaat

SEQ ID NO: 168740 - DNA, 8 bp, Unknown
  misc_feature (1)..( 8): Result.005 file - promoters50/1394110
attgaaac

SEQ ID NO: 168741 - DNA, 9 bp, Unknown
  misc_feature (1)..( 9): Result.005 file - promoters50/1394110
atatcaaat

SEQ ID NO: 168742 - DNA, 9 bp, Unknown
  misc_feature (1)..( 9): Result.005 file - promoters50/1394110
atataaaaa

SEQ ID NO: 168743 - DNA, 13 bp, Unknown
  misc_feature (1)..( 13): Result.005 file - promoters50/1394110
aaatttcatacat

SEQ ID NO: 168744 - DNA, 13 bp, Unknown
  misc_feature (1)..( 13): Result.005 file - promoters50/1394110
aaatttcaaacat

SEQ ID NO: 168745 - DNA, 13 bp, Unknown
  misc_feature (1)..( 13): Result.005 file - promoters50/1394110
aaatttattcata

SEQ ID NO: 168746 - DNA, 13 bp, Unknown
  misc_feature (1)..( 13): Result.005 file - promoters50/1394110
tcttttcaaaaaa

SEQ ID NO: 168747 - DNA, 9 bp, Unknown
  misc_feature (1)..( 9): Result.005 file - promoters50/1394110
cgaaattta

SEQ ID NO: 168748 - DNA, 9 bp, Unknown
  misc_feature (1)..( 9): Result.005 file - promoters50/1394110
aaaaatttg

SEQ ID NO: 168749 - DNA, 9 bp, Unknown
  misc_feature (1)..( 9): Result.005 file - promoters50/1394110
aaaaattta

SEQ ID NO: 168750 - DNA, 9 bp, Unknown
  misc_feature (1)..( 9): Result.005 file - promoters50/1394110
gaaaatttt

SEQ ID NO: 168751 - DNA, 9 bp, Unknown
  misc_feature (1)..( 9): Result.005 file - promoters50/1394178
tttttttct

SEQ ID NO: 168752 - DNA, 9 bp, Unknown
  misc_feature (1)..( 9): Result.005 file - promoters50/1394178
ttttattct

SEQ ID NO: 168753 - DNA, 9 bp, Unknown
  misc_feature (1)..( 9): Result.005 file - promoters50/1394178
tttctttct

SEQ ID NO: 168754 - DNA, 9 bp, Unknown
  misc_feature (1)..( 9): Result.005 file - promoters50/1394178
tttttctta

SEQ ID NO: 168755 - DNA, 9 bp, Unknown
  misc_feature (1)..( 9): Result.005 file - promoters50/1394178
tttttttta

SEQ ID NO: 168756 - DNA, 9 bp, Unknown
  misc_feature (1)..( 9): Result.005 file - promoters50/1394178
tgtttcttt

SEQ ID NO: 168757 - DNA, 6 bp, Unknown
  misc_feature (1)..( 6): Result.005 file - promoters50/1394178
gttttt

SEQ ID NO: 168758 - DNA, 6 bp, Unknown
  misc_feature (1)..( 6): Result.005 file - promoters50/1394178
gttttt

SEQ ID NO: 168759 - DNA, 6 bp, Unknown
  misc_feature (1)..( 6): Result.005 file - promoters50/1394178
gttttt

SEQ ID NO: 168760 - DNA, 9 bp, Unknown
  misc_feature (1)..( 9): Result.005 file - promoters50/1394178
attttcaaa

SEQ ID NO: 168761 - DNA, 9 bp, Unknown
  misc_feature (1)..( 9): Result.005 file - promoters50/1394178
ttttttaaa

SEQ ID NO: 168762 - DNA, 9 bp, Unknown
  misc_feature (1)..( 9): Result.005 file - promoters50/1394178
ttttttaca

SEQ ID NO: 168763 - DNA, 8 bp, Unknown
  misc_feature (1)..( 8): Result.005 file - promoters50/1394178
catataaa

SEQ ID NO: 168764 - DNA, 8 bp, Unknown
  misc_feature (1)..( 8): Result.005 file - promoters50/1394178
cataaaaa

SEQ ID NO: 168765 - DNA, 8 bp, Unknown
  misc_feature (1)..( 8): Result.005 file - promoters50/1394178
tttaaaaa

SEQ ID NO: 168766 - DNA, 17 bp, Unknown
  misc_feature (1)..( 17): Result.005 file - promoters50/1394302
tatgttaaaaaataaaa

SEQ ID NO: 168767 - DNA, 17 bp, Unknown
  misc_feature (1)..( 17): Result.005 file - promoters50/1394302
actgtttaaaaagaaaa

SEQ ID NO: 168768 - DNA, 17 bp, Unknown
  misc_feature (1)..( 17): Result.005 file - promoters50/1394302
actttttctatcaaggt

SEQ ID NO: 168769 - DNA, 8 bp, Unknown
  misc_feature (1)..( 8): Result.005 file - promoters50/1394302
acgttaat

SEQ ID NO: 168770 - DNA, 8 bp, Unknown
  misc_feature (1)..( 8): Result.005 file - promoters50/1394302
ttgttaat

SEQ ID NO: 168771 - DNA, 8 bp, Unknown
  misc_feature (1)..( 8): Result.005 file - promoters50/1394302
ttgttaaa

SEQ ID NO: 168772 - DNA, 8 bp, Unknown
  misc_feature (1)..( 8): Result.005 file - promoters50/1394302
aaaacaaa

SEQ ID NO: 168773 - DNA, 8 bp, Unknown
  misc_feature (1)..( 8): Result.005 file - promoters50/1394302
aaaacaag

SEQ ID NO: 168774 - DNA, 8 bp, Unknown
  misc_feature (1)..( 8): Result.005 file - promoters50/1394302
gaaagaaa

SEQ ID NO: 168775 - DNA, 12 bp, Unknown
  misc_feature (1)..( 12): Result.005 file - promoters50/1394310
ataacatacaaa

SEQ ID NO: 168776 - DNA, 12 bp, Unknown
  misc_feature (1)..( 12): Result.005 file - promoters50/1394310
aatatgtacaaa

SEQ ID NO: 168777 - DNA, 12 bp, Unknown
  misc_feature (1)..( 12): Result.005 file - promoters50/1394310
atatcataaaaa

SEQ ID NO: 168778 - DNA, 10 bp, Unknown
  misc_feature (1)..( 10): Result.005 file - promoters50/1394310
cttgatatca

SEQ ID NO: 168779 - DNA, 10 bp, Unknown
  misc_feature (1)..( 10): Result.005 file - promoters50/1394310
ctttataagt

SEQ ID NO: 168780 - DNA, 10 bp, Unknown
  misc_feature (1)..( 10): Result.005 file - promoters50/1394310
aatgaaatca

SEQ ID NO: 168781 - DNA, 16 bp, Unknown
  misc_feature (1)..( 16): Result.005 file - promoters50/1394310
agtggcatttcaccgt

SEQ ID NO: 168782 - DNA, 16 bp, Unknown
  misc_feature (1)..( 16): Result.005 file - promoters50/1394310
atctttattttaccgt

SEQ ID NO: 168783 - DNA, 16 bp, Unknown
  misc_feature (1)..( 16): Result.005 file - promoters50/1394310
atccttatattagaaa

SEQ ID NO: 168784 - DNA, 8 bp, Unknown
  misc_feature (1)..( 8): Result.005 file - promoters50/1394310
tctatata

SEQ ID NO: 168785 - DNA, 8 bp, Unknown
  misc_feature (1)..( 8): Result.005 file - promoters50/1394310
actatata

SEQ ID NO: 168786 - DNA, 8 bp, Unknown
  misc_feature (1)..( 8): Result.005 file - promoters50/1394310
tctttatg

SEQ ID NO: 168787 - DNA, 7 bp, Unknown
  misc_feature (1)..( 7): Result.005 file - promoters50/1394327
gcaaaaa

SEQ ID NO: 168788 - DNA, 7 bp, Unknown
  misc_feature (1)..( 7): Result.005 file - promoters50/1394327
gcaaaac

SEQ ID NO: 168789 - DNA, 7 bp, Unknown
  misc_feature (1)..( 7): Result.005 file - promoters50/1394327
tcaaaaa

SEQ ID NO: 168790 - DNA, 10 bp, Unknown
  misc_feature (1)..( 10): Result.005 file - promoters50/1394327
atagggacat

SEQ ID NO: 168791 - DNA, 10 bp, Unknown
  misc_feature (1)..( 10): Result.005 file - promoters50/1394327
atatggaaaa

SEQ ID NO: 168792 - DNA, 10 bp, Unknown
  misc_feature (1)..( 10): Result.005 file - promoters50/1394327
aaatgtaaaa

SEQ ID NO: 168793 - DNA, 9 bp, Unknown
  misc_feature (1)..( 9): Result.005 file - promoters50/1394327
caagactta

SEQ ID NO: 168794 - DNA, 9 bp, Unknown
  misc_feature (1)..( 9): Result.005 file - promoters50/1394327
caaaacttt

SEQ ID NO: 168795 - DNA, 9 bp, Unknown
  misc_feature (1)..( 9): Result.005 file - promoters50/1394327
gaaaatttt

SEQ ID NO: 168796 - DNA, 8 bp, Unknown
  misc_feature (1)..( 8): Result.005 file - promoters50/1394327
attgtttc

SEQ ID NO: 168797 - DNA, 8 bp, Unknown
  misc_feature (1)..( 8): Result.005 file - promoters50/1394327
attgttta

SEQ ID NO: 168798 - DNA, 8 bp, Unknown
  misc_feature (1)..( 8): Result.005 file - promoters50/1394327
tttgttta

SEQ ID NO: 168799 - DNA, 8 bp, Unknown
  misc_feature (1)..( 8): Result.005 file - promoters50/1394447
aggagaaa

SEQ ID NO: 168800 - DNA, 8 bp, Unknown
  misc_feature (1)..( 8): Result.005 file - promoters50/1394447
aggataaa

SEQ ID NO: 168801 - DNA, 8 bp, Unknown
  misc_feature (1)..( 8): Result.005 file - promoters50/1394447
ctgataaa

SEQ ID NO: 168802 - DNA, 10 bp, Unknown
  misc_feature (1)..( 10): Result.005 file - promoters50/1394447
tattttcaca

SEQ ID NO: 168803 - DNA, 10 bp, Unknown
  misc_feature (1)..( 10): Result.005 file - promoters50/1394447
tatttttctc

SEQ ID NO: 168804 - DNA, 10 bp, Unknown
  misc_feature (1)..( 10): Result.005 file - promoters50/1394447
cattttcctc

SEQ ID NO: 168805 - DNA, 7 bp, Unknown
  misc_feature (1)..( 7): Result.005 file - promoters50/1394447
ctgaaaa

SEQ ID NO: 168806 - DNA, 7 bp, Unknown
  misc_feature (1)..( 7): Result.005 file - promoters50/1394447
atgaaaa

SEQ ID NO: 168807 - DNA, 7 bp, Unknown
  misc_feature (1)..( 7): Result.005 file - promoters50/1394447
atgaaac

SEQ ID NO: 168808 - DNA, 10 bp, Unknown
  misc_feature (1)..( 10): Result.005 file - promoters50/1394447
gctgaataaa

SEQ ID NO: 168809 - DNA, 10 bp, Unknown
  misc_feature (1)..( 10): Result.005 file - promoters50/1394447
atttaataaa

SEQ ID NO: 168810 - DNA, 10 bp, Unknown
  misc_feature (1)..( 10): Result.005 file - promoters50/1394447
atttaataat

SEQ ID NO: 168811 - DNA, 8 bp, Unknown
  misc_feature (1)..( 8): Result.005 file - promoters50/1394451
caattata

SEQ ID NO: 168812 - DNA, 8 bp, Unknown
  misc_feature (1)..( 8): Result.005 file - promoters50/1394451
taattatg

SEQ ID NO: 168813 - DNA, 8 bp, Unknown
  misc_feature (1)..( 8): Result.005 file - promoters50/1394451
tgattatg

SEQ ID NO: 168814 - DNA, 8 bp, Unknown
  misc_feature (1)..( 8): Result.005 file - promoters50/1394451
taattaaa

SEQ ID NO: 168815 - DNA, 10 bp, Unknown
  misc_feature (1)..( 10): Result.005 file - promoters50/1394451
atcacgaaca

SEQ ID NO: 168816 - DNA, 10 bp, Unknown
  misc_feature (1)..( 10): Result.005 file - promoters50/1394451
atcacggaga

SEQ ID NO: 168817 - DNA, 10 bp, Unknown
  misc_feature (1)..( 10): Result.005 file - promoters50/1394451
ctcaaggaaa

SEQ ID NO: 168818 - DNA, 10 bp, Unknown
  misc_feature (1)..( 10): Result.005 file - promoters50/1394451
aggaaggaaa

SEQ ID NO: 168819 - DNA, 13 bp, Unknown
  misc_feature (1)..( 13): Result.005 file - promoters50/1394473
aacgacaaatagc

SEQ ID NO: 168820 - DNA, 13 bp, Unknown
  misc_feature (1)..( 13): Result.005 file - promoters50/1394473
aacgtcaaaaagc

SEQ ID NO: 168821 - DNA, 13 bp, Unknown
  misc_feature (1)..( 13): Result.005 file - promoters50/1394473
taattcaaaaaaa

SEQ ID NO: 168822 - DNA, 9 bp, Unknown
  misc_feature (1)..( 9): Result.005 file - promoters50/1394473
ttaatatat

SEQ ID NO: 168823 - DNA, 9 bp, Unknown
  misc_feature (1)..( 9): Result.005 file - promoters50/1394473
agaatttat

SEQ ID NO: 168824 - DNA, 9 bp, Unknown
  misc_feature (1)..( 9): Result.005 file - promoters50/1394473
ttagtataa

SEQ ID NO: 168825 - DNA, 9 bp, Unknown
  misc_feature (1)..( 9): Result.005 file - promoters50/1394473
ccaaaccaa

SEQ ID NO: 168826 - DNA, 9 bp, Unknown
  misc_feature (1)..( 9): Result.005 file - promoters50/1394473
tcaaatcaa

SEQ ID NO: 168827 - DNA, 9 bp, Unknown
  misc_feature (1)..( 9): Result.005 file - promoters50/1394473
tcatatcac

SEQ ID NO: 168828 - DNA, 9 bp, Unknown
  misc_feature (1)..( 9): Result.005 file - promoters50/1394473
aataaagat

SEQ ID NO: 168829 - DNA, 9 bp, Unknown
  misc_feature (1)..( 9): Result.005 file - promoters50/1394473
aataaatgc

SEQ ID NO: 168830 - DNA, 9 bp, Unknown
  misc_feature (1)..( 9): Result.005 file - promoters50/1394473
aaaaaaaga

SEQ ID NO: 168831 - DNA, 12 bp, Unknown
  misc_feature (1)..( 12): Result.005 file - promoters50/1394473
aaataaagataa

SEQ ID NO: 168832 - DNA, 12 bp, Unknown
  misc_feature (1)..( 12): Result.005 file - promoters50/1394473
atgcaaacataa

SEQ ID NO: 168833 - DNA, 12 bp, Unknown
  misc_feature (1)..( 12): Result.005 file - promoters50/1394473
aaaaaaagacag

SEQ ID NO: 168834 - DNA, 9 bp, Unknown
  misc_feature (1)..( 9): Result.005 file - promoters50/1394473
agtatataa

SEQ ID NO: 168835 - DNA, 9 bp, Unknown
  misc_feature (1)..( 9): Result.005 file - promoters50/1394473
catatatac

SEQ ID NO: 168836 - DNA, 9 bp, Unknown
  misc_feature (1)..( 9): Result.005 file - promoters50/1394473
catatttac

SEQ ID NO: 168837 - DNA, 9 bp, Unknown
  misc_feature (1)..( 9): Result.005 file - promoters50/1394480
aaactttaa

SEQ ID NO: 168838 - DNA, 9 bp, Unknown
  misc_feature (1)..( 9): Result.005 file - promoters50/1394480
aaaatttct

SEQ ID NO: 168839 - DNA, 9 bp, Unknown
  misc_feature (1)..( 9): Result.005 file - promoters50/1394480
aaaatctct

SEQ ID NO: 168840 - DNA, 8 bp, Unknown
  misc_feature (1)..( 8): Result.005 file - promoters50/1394480
tttgaaac

SEQ ID NO: 168841 - DNA, 8 bp, Unknown
  misc_feature (1)..( 8): Result.005 file - promoters50/1394480
tgtgaaac

SEQ ID NO: 168842 - DNA, 8 bp, Unknown
  misc_feature (1)..( 8): Result.005 file - promoters50/1394480
tgtgaaaa

SEQ ID NO: 168843 - DNA, 9 bp, Unknown
  misc_feature (1)..( 9): Result.005 file - promoters50/1394480
gatatttct

SEQ ID NO: 168844 - DNA, 9 bp, Unknown
  misc_feature (1)..( 9): Result.005 file - promoters50/1394480
aaaatttct

SEQ ID NO: 168845 - DNA, 9 bp, Unknown
  misc_feature (1)..( 9): Result.005 file - promoters50/1394480
aaaatctct

SEQ ID NO: 168846 - DNA, 14 bp, Unknown
  misc_feature (1)..( 14): Result.005 file - promoters50/1394510
taagatttttgttg

SEQ ID NO: 168847 - DNA, 14 bp, Unknown
  misc_feature (1)..( 14): Result.005 file - promoters50/1394510
tagaatttttttct

SEQ ID NO: 168848 - DNA, 14 bp, Unknown
  misc_feature (1)..( 14): Result.005 file - promoters50/1394510
taacattttttaat

SEQ ID NO: 168849 - DNA, 14 bp, Unknown
  misc_feature (1)..( 14): Result.005 file - promoters50/1394510
ggagactttgggtg

SEQ ID NO: 168850 - DNA, 14 bp, Unknown
  misc_feature (1)..( 14): Result.005 file - promoters50/1394510
aacaattttagtta

SEQ ID NO: 168851 - DNA, 14 bp, Unknown
  misc_feature (1)..( 14): Result.005 file - promoters50/1394510
tattctttttcttg

SEQ ID NO: 168852 - DNA, 14 bp, Unknown
  misc_feature (1)..( 14): Result.005 file - promoters50/1394510
tccaattttgggca

SEQ ID NO: 168853 - DNA, 14 bp, Unknown
  misc_feature (1)..( 14): Result.005 file - promoters50/1394510
taaactaatttaaa

SEQ ID NO: 168854 - DNA, 14 bp, Unknown
  misc_feature (1)..( 14): Result.005 file - promoters50/1394510
acatgtaatttttc

SEQ ID NO: 168855 - DNA, 15 bp, Unknown
  misc_feature (1)..( 15): Result.005 file - promoters50/1394510
acatttaactttatt

SEQ ID NO: 168856 - DNA, 16 bp, Unknown
  misc_feature (1)..( 16): Result.005 file - promoters50/1394510
ctttttaatatttcat

SEQ ID NO: 168857 - DNA, 16 bp, Unknown
  misc_feature (1)..( 16): Result.005 file - promoters50/1394510
cacaaaactatataaa

SEQ ID NO: 168858 - DNA, 16 bp, Unknown
  misc_feature (1)..( 16): Result.005 file - promoters50/1394510
aatgataatatcttga

SEQ ID NO: 168859 - DNA, 10 bp, Unknown
  misc_feature (1)..( 10): Result.005 file - promoters50/1394510
acattctcaa

SEQ ID NO: 168860 - DNA, 10 bp, Unknown
  misc_feature (1)..( 10): Result.005 file - promoters50/1394510
taattttcag

SEQ ID NO: 168861 - DNA, 10 bp, Unknown
  misc_feature (1)..( 10): Result.005 file - promoters50/1394510
catttcacaa

SEQ ID NO: 168862 - DNA, 10 bp, Unknown
  misc_feature (1)..( 10): Result.005 file - promoters50/1394510
catttctcat

SEQ ID NO: 168863 - DNA, 10 bp, Unknown
  misc_feature (1)..( 10): Result.005 file - promoters50/1394510
taactttatt

SEQ ID NO: 168864 - DNA, 10 bp, Unknown
  misc_feature (1)..( 10): Result.005 file - promoters50/1394510
aaactatata

SEQ ID NO: 168865 - DNA, 13 bp, Unknown
  misc_feature (1)..( 13): Result.005 file - promoters50/1394510
tttaacattctca

SEQ ID NO: 168866 - DNA, 13 bp, Unknown
  misc_feature (1)..( 13): Result.005 file - promoters50/1394510
gataagattacta

SEQ ID NO: 168867 - DNA, 13 bp, Unknown
  misc_feature (1)..( 13): Result.005 file - promoters50/1394510
tttcacaaatcct

SEQ ID NO: 168868 - DNA, 13 bp, Unknown
  misc_feature (1)..( 13): Result.005 file - promoters50/1394510
cataatattattg

SEQ ID NO: 168869 - DNA, 13 bp, Unknown
  misc_feature (1)..( 13): Result.005 file - promoters50/1394510
tttaatatttcat

SEQ ID NO: 168870 - DNA, 13 bp, Unknown
  misc_feature (1)..( 13): Result.005 file - promoters50/1394510
tgtaatttttcat

SEQ ID NO: 168871 - DNA, 9 bp, Unknown
  misc_feature (1)..( 9): Result.005 file - promoters50/1394514
tattttaca

SEQ ID NO: 168872 - DNA, 9 bp, Unknown
  misc_feature (1)..( 9): Result.005 file - promoters50/1394514
aattttagt

SEQ ID NO: 168873 - DNA, 9 bp, Unknown
  misc_feature (1)..( 9): Result.005 file - promoters50/1394514
aatttgagt

SEQ ID NO: 168874 - DNA, 11 bp, Unknown
  misc_feature (1)..( 11): Result.005 file - promoters50/1394514
ttaattgaacc

SEQ ID NO: 168875 - DNA, 11 bp, Unknown
  misc_feature (1)..( 11): Result.005 file - promoters50/1394514
ttagttgtttc

SEQ ID NO: 168876 - DNA, 11 bp, Unknown
  misc_feature (1)..( 11): Result.005 file - promoters50/1394514
acaatttgagt

SEQ ID NO: 168877 - DNA, 10 bp, Unknown
  misc_feature (1)..( 10): Result.005 file - promoters50/1394514
aaactgttta

SEQ ID NO: 168878 - DNA, 10 bp, Unknown
  misc_feature (1)..( 10): Result.005 file - promoters50/1394514
aaaatgttag

SEQ ID NO: 168879 - DNA, 10 bp, Unknown
  misc_feature (1)..( 10): Result.005 file - promoters50/1394514
caaatgatag

SEQ ID NO: 168880 - DNA, 9 bp, Unknown
  misc_feature (1)..( 9): Result.005 file - promoters50/1394514
catgattga

SEQ ID NO: 168881 - DNA, 9 bp, Unknown
  misc_feature (1)..( 9): Result.005 file - promoters50/1394514
cattattgt

SEQ ID NO: 168882 - DNA, 9 bp, Unknown
  misc_feature (1)..( 9): Result.005 file - promoters50/1394514
aagtattgt

SEQ ID NO: 168883 - DNA, 8 bp, Unknown
  misc_feature (1)..( 8): Result.005 file - promoters50/1394545
catctaac

SEQ ID NO: 168884 - DNA, 8 bp, Unknown
  misc_feature (1)..( 8): Result.005 file - promoters50/1394545
aatctaat

SEQ ID NO: 168885 - DNA, 8 bp, Unknown
  misc_feature (1)..( 8): Result.005 file - promoters50/1394545
catctaac

SEQ ID NO: 168886 - DNA, 12 bp, Unknown
  misc_feature (1)..( 12): Result.005 file - promoters50/1394592
tttaaaataata

SEQ ID NO: 168887 - DNA, 12 bp, Unknown
  misc_feature (1)..( 12): Result.005 file - promoters50/1394592
tttagaatccta

SEQ ID NO: 168888 - DNA, 12 bp, Unknown
  misc_feature (1)..( 12): Result.005 file - promoters50/1394592
tttagaatttga

SEQ ID NO: 168889 - DNA, 12 bp, Unknown
  misc_feature (1)..( 12): Result.005 file - promoters50/1394592
tccaaaataaaa

SEQ ID NO: 168890 - DNA, 12 bp, Unknown
  misc_feature (1)..( 12): Result.005 file - promoters50/1394592
tgaagaatctga

SEQ ID NO: 168891 - DNA, 12 bp, Unknown
  misc_feature (1)..( 12): Result.005 file - promoters50/1394592
cagaaacaaacc

SEQ ID NO: 168892 - DNA, 8 bp, Unknown
  misc_feature (1)..( 8): Result.005 file - promoters50/1394610
aaaactcc

SEQ ID NO: 168893 - DNA, 8 bp, Unknown
  misc_feature (1)..( 8): Result.005 file - promoters50/1394610
taaactct

SEQ ID NO: 168894 - DNA, 8 bp, Unknown
  misc_feature (1)..( 8): Result.005 file - promoters50/1394610
taaattct

SEQ ID NO: 168895 - DNA, 6 bp, Unknown
  misc_feature (1)..( 6): Result.005 file - promoters50/1394610
ctcttt

SEQ ID NO: 168896 - DNA, 6 bp, Unknown
  misc_feature (1)..( 6): Result.005 file - promoters50/1394610
ctcttt

SEQ ID NO: 168897 - DNA, 6 bp, Unknown
  misc_feature (1)..( 6): Result.005 file - promoters50/1394610
ctcttt

SEQ ID NO: 168898 - DNA, 11 bp, Unknown
  misc_feature (1)..( 11): Result.005 file - promoters50/1394610
aataataactt

SEQ ID NO: 168899 - DNA, 11 bp, Unknown
  misc_feature (1)..( 11): Result.005 file - promoters50/1394610
cataatagctt

SEQ ID NO: 168900 - DNA, 11 bp, Unknown
  misc_feature (1)..( 11): Result.005 file - promoters50/1394610
tctaattttgg

SEQ ID NO: 168901 - DNA, 11 bp, Unknown
  misc_feature (1)..( 11): Result.005 file - promoters50/1394610
tctgattagaa

SEQ ID NO: 168902 - DNA, 11 bp, Unknown
  misc_feature (1)..( 11): Result.005 file - promoters50/1394610
taactttggcc

SEQ ID NO: 168903 - DNA, 11 bp, Unknown
  misc_feature (1)..( 11): Result.005 file - promoters50/1394610
ttactttgctt

SEQ ID NO: 168904 - DNA, 11 bp, Unknown
  misc_feature (1)..( 11): Result.005 file - promoters50/1394610
taattttggta

SEQ ID NO: 168905 - DNA, 11 bp, Unknown
  misc_feature (1)..( 11): Result.005 file - promoters50/1394610
caaatctgatt

SEQ ID NO: 168906 - DNA, 8 bp, Unknown
  misc_feature (1)..( 8): Result.005 file - promoters50/1394610
ataatttt

SEQ ID NO: 168907 - DNA, 8 bp, Unknown
  misc_feature (1)..( 8): Result.005 file - promoters50/1394610
ataattac

SEQ ID NO: 168908 - DNA, 8 bp, Unknown
  misc_feature (1)..( 8): Result.005 file - promoters50/1394610
ctaatttt

SEQ ID NO: 168909 - DNA, 19 bp, Unknown
  misc_feature (1)..( 19): Result.005 file - promoters50/1394625
caaattaaaaaaaaaatct

SEQ ID NO: 168910 - DNA, 19 bp, Unknown
  misc_feature (1)..( 19): Result.005 file - promoters50/1394625
aagattataaaaaaagtct

SEQ ID NO: 168911 - DNA, 19 bp, Unknown
  misc_feature (1)..( 19): Result.005 file - promoters50/1394625
caaattcaaagaacataga

SEQ ID NO: 168912 - DNA, 19 bp, Unknown
  misc_feature (1)..( 19): Result.005 file - promoters50/1394625
ataattaattttctcggtc

SEQ ID NO: 168913 - DNA, 19 bp, Unknown
  misc_feature (1)..( 19): Result.005 file - promoters50/1394625
ttaaaaaaaaaaaaaaatt

SEQ ID NO: 168914 - DNA, 19 bp, Unknown
  misc_feature (1)..( 19): Result.005 file - promoters50/1394625
ctaattttaattttgttat

SEQ ID NO: 168915 - DNA, 8 bp, Unknown
  misc_feature (1)..( 8): Result.005 file - promoters50/1394625
aaattttt

SEQ ID NO: 168916 - DNA, 8 bp, Unknown
  misc_feature (1)..( 8): Result.005 file - promoters50/1394625
aaatcttt

SEQ ID NO: 168917 - DNA, 8 bp, Unknown
  misc_feature (1)..( 8): Result.005 file - promoters50/1394625
taatttta

SEQ ID NO: 168918 - DNA, 8 bp, Unknown
  misc_feature (1)..( 8): Result.005 file - promoters50/1394625
taatttta

SEQ ID NO: 168919 - DNA, 8 bp, Unknown
  misc_feature (1)..( 8): Result.005 file - promoters50/1394625
taatttta

SEQ ID NO: 168920 - DNA, 8 bp, Unknown
  misc_feature (1)..( 8): Result.005 file - promoters50/1394625
taattttc

SEQ ID NO: 168921 - DNA, 10 bp, Unknown
  misc_feature (1)..( 10): Result.005 file - promoters50/1394625
ttttttaaat

SEQ ID NO: 168922 - DNA, 10 bp, Unknown
  misc_feature (1)..( 10): Result.005 file - promoters50/1394625
aatttaaaat

SEQ ID NO: 168923 - DNA, 10 bp, Unknown
  misc_feature (1)..( 10): Result.005 file - promoters50/1394625
gcttttaatt

SEQ ID NO: 168924 - DNA, 11 bp, Unknown
  misc_feature (1)..( 11): Result.005 file - promoters50/1394625
ttttgttattg

SEQ ID NO: 168925 - DNA, 11 bp, Unknown
  misc_feature (1)..( 11): Result.005 file - promoters50/1394625
atttgtaatga

SEQ ID NO: 168926 - DNA, 11 bp, Unknown
  misc_feature (1)..( 11): Result.005 file - promoters50/1394625
tttggtttacg

SEQ ID NO: 168927 - DNA, 9 bp, Unknown
  misc_feature (1)..( 9): Result.005 file - promoters50/1394625
caaagatgt

SEQ ID NO: 168928 - DNA, 9 bp, Unknown
  misc_feature (1)..( 9): Result.005 file - promoters50/1394625
aaaatatgt

SEQ ID NO: 168929 - DNA, 9 bp, Unknown
  misc_feature (1)..( 9): Result.005 file - promoters50/1394625
aaaataaaa

SEQ ID NO: 168930 - DNA, 9 bp, Unknown
  misc_feature (1)..( 9): Result.005 file - promoters50/1394625
cgaatatgc

SEQ ID NO: 168931 - DNA, 9 bp, Unknown
  misc_feature (1)..( 9): Result.005 file - promoters50/1394625
taaacataa

SEQ ID NO: 168932 - DNA, 9 bp, Unknown
  misc_feature (1)..( 9): Result.005 file - promoters50/1394625
agaacatgg

SEQ ID NO: 168933 - DNA, 11 bp, Unknown
  misc_feature (1)..( 11): Result.005 file - promoters50/1394625
atttaatcaaa

SEQ ID NO: 168934 - DNA, 11 bp, Unknown
  misc_feature (1)..( 11): Result.005 file - promoters50/1394625
atttaataaaa

SEQ ID NO: 168935 - DNA, 11 bp, Unknown
  misc_feature (1)..( 11): Result.005 file - promoters50/1394625
atttaaaaaaa

SEQ ID NO: 168936 - DNA, 11 bp, Unknown
  misc_feature (1)..( 11): Result.005 file - promoters50/1394625
gaagcataaaa

SEQ ID NO: 168937 - DNA, 11 bp, Unknown
  misc_feature (1)..( 11): Result.005 file - promoters50/1394625
gtataataagt

SEQ ID NO: 168938 - DNA, 11 bp, Unknown
  misc_feature (1)..( 11): Result.005 file - promoters50/1394625
ttatagtaacg

SEQ ID NO: 168939 - DNA, 12 bp, Unknown
  misc_feature (1)..( 12): Result.005 file - promoters50/1394625
agatttttaaat

SEQ ID NO: 168940 - DNA, 12 bp, Unknown
  misc_feature (1)..( 12): Result.005 file - promoters50/1394625
agattattaaat

SEQ ID NO: 168941 - DNA, 12 bp, Unknown
  misc_feature (1)..( 12): Result.005 file - promoters50/1394625
aaattattaaag

SEQ ID NO: 168942 - DNA, 10 bp, Unknown
  misc_feature (1)..( 10): Result.005 file - promoters50/1394625
attatcaaaa

SEQ ID NO: 168943 - DNA, 12 bp, Unknown
  misc_feature (1)..( 12): Result.005 file - promoters50/1394625
caattatttatc

SEQ ID NO: 168944 - DNA, 12 bp, Unknown
  misc_feature (1)..( 12): Result.005 file - promoters50/1394625
acacaattaaac

SEQ ID NO: 168945 - DNA, 12 bp, Unknown
  misc_feature (1)..( 12): Result.005 file - promoters50/1394643
gttttatatatt

SEQ ID NO: 168946 - DNA, 12 bp, Unknown
  misc_feature (1)..( 12): Result.005 file - promoters50/1394643
gttatatgtatt

SEQ ID NO: 168947 - DNA, 12 bp, Unknown
  misc_feature (1)..( 12): Result.005 file - promoters50/1394643
gttttagaatat

SEQ ID NO: 168948 - DNA, 12 bp, Unknown
  misc_feature (1)..( 12): Result.005 file - promoters50/1394643
tctttataacaa

SEQ ID NO: 168949 - DNA, 13 bp, Unknown
  misc_feature (1)..( 13): Result.005 file - promoters50/1394643
atttaatacgttt

SEQ ID NO: 168950 - DNA, 13 bp, Unknown
  misc_feature (1)..( 13): Result.005 file - promoters50/1394643
tattaataatttt

SEQ ID NO: 168951 - DNA, 13 bp, Unknown
  misc_feature (1)..( 13): Result.005 file - promoters50/1394643
tattaagaatttg

SEQ ID NO: 168952 - DNA, 13 bp, Unknown
  misc_feature (1)..( 13): Result.005 file - promoters50/1394643
aattattaaactt

SEQ ID NO: 168953 - DNA, 13 bp, Unknown
  misc_feature (1)..( 13): Result.005 file - promoters50/1394643
aaaagcgaatttg

SEQ ID NO: 168954 - DNA, 12 bp, Unknown
  misc_feature (1)..( 12): Result.005 file - promoters50/1394643
atatttggtttt

SEQ ID NO: 168955 - DNA, 12 bp, Unknown
  misc_feature (1)..( 12): Result.005 file - promoters50/1394643
aattttagttat

SEQ ID NO: 168956 - DNA, 12 bp, Unknown
  misc_feature (1)..( 12): Result.005 file - promoters50/1394643
gaatttgatttt

SEQ ID NO: 168957 - DNA, 12 bp, Unknown
  misc_feature (1)..( 12): Result.005 file - promoters50/1394643
gaatttgtttga

SEQ ID NO: 168958 - DNA, 13 bp, Unknown
  misc_feature (1)..( 13): Result.005 file - promoters50/1394643
tatagtacattta

SEQ ID NO: 168959 - DNA, 13 bp, Unknown
  misc_feature (1)..( 13): Result.005 file - promoters50/1394643
aatattacgttta

SEQ ID NO: 168960 - DNA, 13 bp, Unknown
  misc_feature (1)..( 13): Result.005 file - promoters50/1394643
gatagtaaaaaga

SEQ ID NO: 168961 - DNA, 13 bp, Unknown
  misc_feature (1)..( 13): Result.005 file - promoters50/1394643
atatacacatttc

SEQ ID NO: 168962 - DNA, 13 bp, Unknown
  misc_feature (1)..( 13): Result.005 file - promoters50/1394643
aattttaataatt

SEQ ID NO: 168963 - DNA, 7 bp, Unknown
  misc_feature (1)..( 7): Result.005 file - promoters50/1394643
tttgata

SEQ ID NO: 168964 - DNA, 7 bp, Unknown
  misc_feature (1)..( 7): Result.005 file - promoters50/1394643
tttgatt

SEQ ID NO: 168965 - DNA, 7 bp, Unknown
  misc_feature (1)..( 7): Result.005 file - promoters50/1394643
tttgatt

SEQ ID NO: 168966 - DNA, 7 bp, Unknown
  misc_feature (1)..( 7): Result.005 file - promoters50/1394643
tttaatt

SEQ ID NO: 168967 - DNA, 11 bp, Unknown
  misc_feature (1)..( 11): Result.005 file - promoters50/1394643
tgtcttataga

SEQ ID NO: 168968 - DNA, 11 bp, Unknown
  misc_feature (1)..( 11): Result.005 file - promoters50/1394643
cttcttatatc

SEQ ID NO: 168969 - DNA, 11 bp, Unknown
  misc_feature (1)..( 11): Result.005 file - promoters50/1394643
aaaattagatc

SEQ ID NO: 168970 - DNA, 11 bp, Unknown
  misc_feature (1)..( 11): Result.005 file - promoters50/1394643
ctttttaaaaa

SEQ ID NO: 168971 - DNA, 9 bp, Unknown
  misc_feature (1)..( 9): Result.005 file - promoters50/1394676
tttggttga

SEQ ID NO: 168972 - DNA, 9 bp, Unknown
  misc_feature (1)..( 9): Result.005 file - promoters50/1394676
tttgtttga

SEQ ID NO: 168973 - DNA, 9 bp, Unknown
  misc_feature (1)..( 9): Result.005 file - promoters50/1394676
tttgatttt

SEQ ID NO: 168974 - DNA, 9 bp, Unknown
  misc_feature (1)..( 9): Result.005 file - promoters50/1394697
aatcataaa

SEQ ID NO: 168975 - DNA, 9 bp, Unknown
  misc_feature (1)..( 9): Result.005 file - promoters50/1394697
aattatata

SEQ ID NO: 168976 - DNA, 9 bp, Unknown
  misc_feature (1)..( 9): Result.005 file - promoters50/1394697
aatcagaaa

SEQ ID NO: 168977 - DNA, 9 bp, Unknown
  misc_feature (1)..( 9): Result.005 file - promoters50/1394697
tattttata

SEQ ID NO: 168978 - DNA, 9 bp, Unknown
  misc_feature (1)..( 9): Result.005 file - promoters50/1394697
aatgatatg

SEQ ID NO: 168979 - DNA, 9 bp, Unknown
  misc_feature (1)..( 9): Result.005 file - promoters50/1394697
tgttttatt

SEQ ID NO: 168980 - DNA, 9 bp, Unknown
  misc_feature (1)..( 9): Result.005 file - promoters50/1394697
tatccgaat

SEQ ID NO: 168981 - DNA, 19 bp, Unknown
  misc_feature (1)..( 19): Result.005 file - promoters50/1394697
ttattaaaatatttttcaa

SEQ ID NO: 168982 - DNA, 19 bp, Unknown
  misc_feature (1)..( 19): Result.005 file - promoters50/1394697
tctttataatgaaactgaa

SEQ ID NO: 168983 - DNA, 19 bp, Unknown
  misc_feature (1)..( 19): Result.005 file - promoters50/1394697
tttatataaaaaaaaacta

SEQ ID NO: 168984 - DNA, 19 bp, Unknown
  misc_feature (1)..( 19): Result.005 file - promoters50/1394697
actttttaaatggcgtggc

SEQ ID NO: 168985 - DNA, 19 bp, Unknown
  misc_feature (1)..( 19): Result.005 file - promoters50/1394697
acttttctacggtacatta

SEQ ID NO: 168986 - DNA, 19 bp, Unknown
  misc_feature (1)..( 19): Result.005 file - promoters50/1394697
caacaaaaacaaaacaaat

SEQ ID NO: 168987 - DNA, 11 bp, Unknown
  misc_feature (1)..( 11): Result.005 file - promoters50/1394697
gaaaacaattt

SEQ ID NO: 168988 - DNA, 11 bp, Unknown
  misc_feature (1)..( 11): Result.005 file - promoters50/1394697
gcaaataattc

SEQ ID NO: 168989 - DNA, 11 bp, Unknown
  misc_feature (1)..( 11): Result.005 file - promoters50/1394697
ttcaacaatag

SEQ ID NO: 168990 - DNA, 11 bp, Unknown
  misc_feature (1)..( 11): Result.005 file - promoters50/1394697
ttcgacaaatg

SEQ ID NO: 168991 - DNA, 12 bp, Unknown
  misc_feature (1)..( 12): Result.005 file - promoters50/1394697
tgcaactaattt

SEQ ID NO: 168992 - DNA, 12 bp, Unknown
  misc_feature (1)..( 12): Result.005 file - promoters50/1394697
ataaactaattt

SEQ ID NO: 168993 - DNA, 7 bp, Unknown
  misc_feature (1)..( 7): Result.005 file - promoters50/1394767
caattaa

SEQ ID NO: 168994 - DNA, 7 bp, Unknown
  misc_feature (1)..( 7): Result.005 file - promoters50/1394767
aaattaa

SEQ ID NO: 168995 - DNA, 7 bp, Unknown
  misc_feature (1)..( 7): Result.005 file - promoters50/1394767
caattac

SEQ ID NO: 168996 - DNA, 13 bp, Unknown
  misc_feature (1)..( 13): Result.005 file - promoters50/1394795
actatataaactc

SEQ ID NO: 168997 - DNA, 13 bp, Unknown
  misc_feature (1)..( 13): Result.005 file - promoters50/1394795
ttcatataaataa

SEQ ID NO: 168998 - DNA, 13 bp, Unknown
  misc_feature (1)..( 13): Result.005 file - promoters50/1394795
catatatataagt

SEQ ID NO: 168999 - DNA, 13 bp, Unknown
  misc_feature (1)..( 13): Result.005 file - promoters50/1394795
tctacatatccat

SEQ ID NO: 169000 - DNA, 13 bp, Unknown
  misc_feature (1)..( 13): Result.005 file - promoters50/1394795
tatatataaagtt

SEQ ID NO: 169001 - DNA, 13 bp, Unknown
  misc_feature (1)..( 13): Result.005 file - promoters50/1394795
agtatatatactc

SEQ ID NO: 169002 - DNA, 13 bp, Unknown
  misc_feature (1)..( 13): Result.005 file - promoters50/1394795
tctacacttaacc

SEQ ID NO: 169003 - DNA, 20 bp, Unknown
  misc_feature (1)..( 20): Result.005 file - promoters50/1394819
acaaaatgtcttatcaactt

SEQ ID NO: 169004 - DNA, 20 bp, Unknown
  misc_feature (1)..( 20): Result.005 file - promoters50/1394819
ggaaaaggtcctatcatctt

SEQ ID NO: 169005 - DNA, 20 bp, Unknown
  misc_feature (1)..( 20): Result.005 file - promoters50/1394819
acataattcattcataaacg

SEQ ID NO: 169006 - DNA, 12 bp, Unknown
  misc_feature (1)..( 12): Result.005 file - promoters50/1394842
taaggattggtt

SEQ ID NO: 169007 - DNA, 12 bp, Unknown
  misc_feature (1)..( 12): Result.005 file - promoters50/1394842
taagaatttgtt

SEQ ID NO: 169008 - DNA, 12 bp, Unknown
  misc_feature (1)..( 12): Result.005 file - promoters50/1394842
atcggattaggg

SEQ ID NO: 169009 - DNA, 8 bp, Unknown
  misc_feature (1)..( 8): Result.005 file - promoters50/1394842
attgtgtt

SEQ ID NO: 169010 - DNA, 8 bp, Unknown
  misc_feature (1)..( 8): Result.005 file - promoters50/1394842
tttgtgtt

SEQ ID NO: 169011 - DNA, 8 bp, Unknown
  misc_feature (1)..( 8): Result.005 file - promoters50/1394842
attttgtt

SEQ ID NO: 169012 - DNA, 8 bp, Unknown
  misc_feature (1)..( 8): Result.005 file - promoters50/1394842
taaaccgg

SEQ ID NO: 169013 - DNA, 8 bp, Unknown
  misc_feature (1)..( 8): Result.005 file - promoters50/1394842
gaaatcgg

SEQ ID NO: 169014 - DNA, 8 bp, Unknown
  misc_feature (1)..( 8): Result.005 file - promoters50/1394842
taacccga

SEQ ID NO: 169015 - DNA, 8 bp, Unknown
  misc_feature (1)..( 8): Result.005 file - promoters50/1394842
ttttttgt

SEQ ID NO: 169016 - DNA, 8 bp, Unknown
  misc_feature (1)..( 8): Result.005 file - promoters50/1394842
ggttttgt

SEQ ID NO: 169017 - DNA, 8 bp, Unknown
  misc_feature (1)..( 8): Result.005 file - promoters50/1394842
ggtgttgg

SEQ ID NO: 169018 - DNA, 8 bp, Unknown
  misc_feature (1)..( 8): Result.005 file - promoters50/1394842
gattttgg

SEQ ID NO: 169019 - DNA, 8 bp, Unknown
  misc_feature (1)..( 8): Result.005 file - promoters50/1394842
gattttgt

SEQ ID NO: 169020 - DNA, 8 bp, Unknown
  misc_feature (1)..( 8): Result.005 file - promoters50/1394842
gattgtgt

SEQ ID NO: 169021 - DNA, 7 bp, Unknown
  misc_feature (1)..( 7): Result.005 file - promoters50/1394861
attgaag

SEQ ID NO: 169022 - DNA, 7 bp, Unknown
  misc_feature (1)..( 7): Result.005 file - promoters50/1394861
attgaaa

SEQ ID NO: 169023 - DNA, 7 bp, Unknown
  misc_feature (1)..( 7): Result.005 file - promoters50/1394861
gttgaaa

SEQ ID NO: 169024 - DNA, 10 bp, Unknown
  misc_feature (1)..( 10): Result.005 file - promoters50/1394861
ggcaatttat

SEQ ID NO: 169025 - DNA, 10 bp, Unknown
  misc_feature (1)..( 10): Result.005 file - promoters50/1394861
ggccatttta

SEQ ID NO: 169026 - DNA, 10 bp, Unknown
  misc_feature (1)..( 10): Result.005 file - promoters50/1394861
tgccttttta

SEQ ID NO: 169027 - DNA, 8 bp, Unknown
  misc_feature (1)..( 8): Result.005 file - promoters50/1394861
aaacaaaa

SEQ ID NO: 169028 - DNA, 8 bp, Unknown
  misc_feature (1)..( 8): Result.005 file - promoters50/1394861
caactaaa

SEQ ID NO: 169029 - DNA, 8 bp, Unknown
  misc_feature (1)..( 8): Result.005 file - promoters50/1394861
aaagaaag

SEQ ID NO: 169030 - DNA, 10 bp, Unknown
  misc_feature (1)..( 10): Result.005 file - promoters50/1394861
gttctttaag

SEQ ID NO: 169031 - DNA, 10 bp, Unknown
  misc_feature (1)..( 10): Result.005 file - promoters50/1394861
gttcttaaag

SEQ ID NO: 169032 - DNA, 10 bp, Unknown
  misc_feature (1)..( 10): Result.005 file - promoters50/1394861
attcttattt

SEQ ID NO: 169033 - DNA, 8 bp, Unknown
  misc_feature (1)..( 8): Result.005 file - promoters50/1394861
attgtatt

SEQ ID NO: 169034 - DNA, 8 bp, Unknown
  misc_feature (1)..( 8): Result.005 file - promoters50/1394861
attttatt

SEQ ID NO: 169035 - DNA, 8 bp, Unknown
  misc_feature (1)..( 8): Result.005 file - promoters50/1394861
tttttatg

SEQ ID NO: 169036 - DNA, 9 bp, Unknown
  misc_feature (1)..( 9): Result.005 file - promoters50/1394884
aattttttt

SEQ ID NO: 169037 - DNA, 9 bp, Unknown
  misc_feature (1)..( 9): Result.005 file - promoters50/1394884
cattttttt

SEQ ID NO: 169038 - DNA, 9 bp, Unknown
  misc_feature (1)..( 9): Result.005 file - promoters50/1394884
aattttaat

SEQ ID NO: 169039 - DNA, 8 bp, Unknown
  misc_feature (1)..( 8): Result.005 file - promoters50/1394884
gtttattt

SEQ ID NO: 169040 - DNA, 8 bp, Unknown
  misc_feature (1)..( 8): Result.005 file - promoters50/1394884
atttgttt

SEQ ID NO: 169041 - DNA, 8 bp, Unknown
  misc_feature (1)..( 8): Result.005 file - promoters50/1394884
atttgtat

SEQ ID NO: 169042 - DNA, 9 bp, Unknown
  misc_feature (1)..( 9): Result.005 file - promoters50/1394884
atttctata

SEQ ID NO: 169043 - DNA, 9 bp, Unknown
  misc_feature (1)..( 9): Result.005 file - promoters50/1394884
atttgtata

SEQ ID NO: 169044 - DNA, 9 bp, Unknown
  misc_feature (1)..( 9): Result.005 file - promoters50/1394884
atttgtttg

SEQ ID NO: 169045 - DNA, 7 bp, Unknown
  misc_feature (1)..( 7): Result.005 file - promoters50/1394884
aatttat

SEQ ID NO: 169046 - DNA, 7 bp, Unknown
  misc_feature (1)..( 7): Result.005 file - promoters50/1394884
aatttaa

SEQ ID NO: 169047 - DNA, 7 bp, Unknown
  misc_feature (1)..( 7): Result.005 file - promoters50/1394884
tatttaa

SEQ ID NO: 169048 - DNA, 10 bp, Unknown
  misc_feature (1)..( 10): Result.005 file - promoters50/1394884
gaattatatt

SEQ ID NO: 169049 - DNA, 10 bp, Unknown
  misc_feature (1)..( 10): Result.005 file - promoters50/1394884
ttcttatatc

SEQ ID NO: 169050 - DNA, 10 bp, Unknown
  misc_feature (1)..( 10): Result.005 file - promoters50/1394884
gaaatatata

SEQ ID NO: 169051 - DNA, 10 bp, Unknown
  misc_feature (1)..( 10): Result.005 file - promoters50/1394884
aaattagatc

SEQ ID NO: 169052 - DNA, 11 bp, Unknown
  misc_feature (1)..( 11): Result.005 file - promoters50/1394884
ctgaattatat

SEQ ID NO: 169053 - DNA, 11 bp, Unknown
  misc_feature (1)..( 11): Result.005 file - promoters50/1394884
ctgtattgcag

SEQ ID NO: 169054 - DNA, 11 bp, Unknown
  misc_feature (1)..( 11): Result.005 file - promoters50/1394884
tagaaatatat

SEQ ID NO: 169055 - DNA, 9 bp, Unknown
  misc_feature (1)..( 9): Result.005 file - promoters50/1394884
ttctcttag

SEQ ID NO: 169056 - DNA, 9 bp, Unknown
  misc_feature (1)..( 9): Result.005 file - promoters50/1394884
taatcttag

SEQ ID NO: 169057 - DNA, 9 bp, Unknown
  misc_feature (1)..( 9): Result.005 file - promoters50/1394884
taatattaa

SEQ ID NO: 169058 - DNA, 6 bp, Unknown
  misc_feature (1)..( 6): Result.005 file - promoters50/1394884
tataat

SEQ ID NO: 169059 - DNA, 6 bp, Unknown
  misc_feature (1)..( 6): Result.005 file - promoters50/1394884
tataat

SEQ ID NO: 169060 - DNA, 6 bp, Unknown
  misc_feature (1)..( 6): Result.005 file - promoters50/1394884
tataat

SEQ ID NO: 169061 - DNA, 6 bp, Unknown
  misc_feature (1)..( 6): Result.005 file - promoters50/1394884
atttaa

SEQ ID NO: 169062 - DNA, 6 bp, Unknown
  misc_feature (1)..( 6): Result.005 file - promoters50/1394884
atttaa

SEQ ID NO: 169063 - DNA, 6 bp, Unknown
  misc_feature (1)..( 6): Result.005 file - promoters50/1394884
atttaa

SEQ ID NO: 169064 - DNA, 8 bp, Unknown
  misc_feature (1)..( 8): Result.005 file - promoters50/1394978
atcaacat

SEQ ID NO: 169065 - DNA, 8 bp, Unknown
  misc_feature (1)..( 8): Result.005 file - promoters50/1394978
atcaacca

SEQ ID NO: 169066 - DNA, 8 bp, Unknown
  misc_feature (1)..( 8): Result.005 file - promoters50/1394978
atcaacat

SEQ ID NO: 169067 - DNA, 10 bp, Unknown
  misc_feature (1)..( 10): Result.005 file - promoters50/1394978
atcaacatta

SEQ ID NO: 169068 - DNA, 10 bp, Unknown
  misc_feature (1)..( 10): Result.005 file - promoters50/1394978
ataaacttta

SEQ ID NO: 169069 - DNA, 10 bp, Unknown
  misc_feature (1)..( 10): Result.005 file - promoters50/1394978
atcaacatag

SEQ ID NO: 169070 - DNA, 10 bp, Unknown
  misc_feature (1)..( 10): Result.005 file - promoters50/1394978
acaaacattg

SEQ ID NO: 169071 - DNA, 12 bp, Unknown
  misc_feature (1)..( 12): Result.005 file - promoters50/1394978
caatatcattta

SEQ ID NO: 169072 - DNA, 12 bp, Unknown
  misc_feature (1)..( 12): Result.005 file - promoters50/1394978
caatttcattta

SEQ ID NO: 169073 - DNA, 12 bp, Unknown
  misc_feature (1)..( 12): Result.005 file - promoters50/1394978
tttttttattgt

SEQ ID NO: 169074 - DNA, 8 bp, Unknown
  misc_feature (1)..( 8): Result.005 file - promoters50/1394978
cttatatc

SEQ ID NO: 169075 - DNA, 8 bp, Unknown
  misc_feature (1)..( 8): Result.005 file - promoters50/1394978
tttatatc

SEQ ID NO: 169076 - DNA, 8 bp, Unknown
  misc_feature (1)..( 8): Result.005 file - promoters50/1394978
cttttatg

SEQ ID NO: 169077 - DNA, 8 bp, Unknown
  misc_feature (1)..( 8): Result.005 file - promoters50/1394978
tagaaaaa

SEQ ID NO: 169078 - DNA, 8 bp, Unknown
  misc_feature (1)..( 8): Result.005 file - promoters50/1394978
cagaaaaa

SEQ ID NO: 169079 - DNA, 8 bp, Unknown
  misc_feature (1)..( 8): Result.005 file - promoters50/1394978
taggaaat

SEQ ID NO: 169080 - DNA, 14 bp, Unknown
  misc_feature (1)..( 14): Result.005 file - promoters50/1394978
aaacaccattttaa

SEQ ID NO: 169081 - DNA, 14 bp, Unknown
  misc_feature (1)..( 14): Result.005 file - promoters50/1394978
aaaaaccttttttt

SEQ ID NO: 169082 - DNA, 14 bp, Unknown
  misc_feature (1)..( 14): Result.005 file - promoters50/1394978
ttggttgattttaa

SEQ ID NO: 169083 - DNA, 9 bp, Unknown
  misc_feature (1)..( 9): Result.005 file - promoters50/1394978
aaaagagaa

SEQ ID NO: 169084 - DNA, 9 bp, Unknown
  misc_feature (1)..( 9): Result.005 file - promoters50/1394978
cgaagagaa

SEQ ID NO: 169085 - DNA, 9 bp, Unknown
  misc_feature (1)..( 9): Result.005 file - promoters50/1394978
aaaagagaa

SEQ ID NO: 169086 - DNA, 9 bp, Unknown
  misc_feature (1)..( 9): Result.005 file - promoters50/1394978
ttaaattcc

SEQ ID NO: 169087 - DNA, 9 bp, Unknown
  misc_feature (1)..( 9): Result.005 file - promoters50/1394978
gtaaaatcc

SEQ ID NO: 169088 - DNA, 9 bp, Unknown
  misc_feature (1)..( 9): Result.005 file - promoters50/1394978
gtataattt

SEQ ID NO: 169089 - DNA, 10 bp, Unknown
  misc_feature (1)..( 10): Result.005 file - promoters50/1394978
aaaaataaag

SEQ ID NO: 169090 - DNA, 10 bp, Unknown
  misc_feature (1)..( 10): Result.005 file - promoters50/1394978
aaaattaaaa

SEQ ID NO: 169091 - DNA, 10 bp, Unknown
  misc_feature (1)..( 10): Result.005 file - promoters50/1394978
tcaattaagt

SEQ ID NO: 169092 - DNA, 8 bp, Unknown
  misc_feature (1)..( 8): Result.005 file - promoters50/1394978
tgtatatc

SEQ ID NO: 169093 - DNA, 8 bp, Unknown
  misc_feature (1)..( 8): Result.005 file - promoters50/1394978
tgtataat

SEQ ID NO: 169094 - DNA, 8 bp, Unknown
  misc_feature (1)..( 8): Result.005 file - promoters50/1394978
agtaaaat

SEQ ID NO: 169095 - DNA, 9 bp, Unknown
  misc_feature (1)..( 9): Result.005 file - promoters50/1395027
taaactaat

SEQ ID NO: 169096 - DNA, 9 bp, Unknown
  misc_feature (1)..( 9): Result.005 file - promoters50/1395027
aaaactaat

SEQ ID NO: 169097 - DNA, 9 bp, Unknown
  misc_feature (1)..( 9): Result.005 file - promoters50/1395027
taatctatg

SEQ ID NO: 169098 - DNA, 10 bp, Unknown
  misc_feature (1)..( 10): Result.005 file - promoters50/1395027
ataaataata

SEQ ID NO: 169099 - DNA, 10 bp, Unknown
  misc_feature (1)..( 10): Result.005 file - promoters50/1395027
ataaattata

SEQ ID NO: 169100 - DNA, 10 bp, Unknown
  misc_feature (1)..( 10): Result.005 file - promoters50/1395027
ggaaataatc

SEQ ID NO: 169101 - DNA, 8 bp, Unknown
  misc_feature (1)..( 8): Result.005 file - promoters50/1395027
aaagcaaa

SEQ ID NO: 169102 - DNA, 8 bp, Unknown
  misc_feature (1)..( 8): Result.005 file - promoters50/1395027
aaaacaaa

SEQ ID NO: 169103 - DNA, 8 bp, Unknown
  misc_feature (1)..( 8): Result.005 file - promoters50/1395027
aaaaaaaa

SEQ ID NO: 169104 - DNA, 8 bp, Unknown
  misc_feature (1)..( 8): Result.005 file - promoters50/1395027
aaaatatg

SEQ ID NO: 169105 - DNA, 8 bp, Unknown
  misc_feature (1)..( 8): Result.005 file - promoters50/1395027
aaaataca

SEQ ID NO: 169106 - DNA, 8 bp, Unknown
  misc_feature (1)..( 8): Result.005 file - promoters50/1395027
gaaatata

SEQ ID NO: 169107 - DNA, 8 bp, Unknown
  misc_feature (1)..( 8): Result.005 file - promoters50/1395046
actataaa

SEQ ID NO: 169108 - DNA, 8 bp, Unknown
  misc_feature (1)..( 8): Result.005 file - promoters50/1395046
tctataaa

SEQ ID NO: 169109 - DNA, 8 bp, Unknown
  misc_feature (1)..( 8): Result.005 file - promoters50/1395046
tctctaaa

SEQ ID NO: 169110 - DNA, 14 bp, Unknown
  misc_feature (1)..( 14): Result.005 file - promoters50/1395066
tttggaactgagta

SEQ ID NO: 169111 - DNA, 14 bp, Unknown
  misc_feature (1)..( 14): Result.005 file - promoters50/1395066
tttggaaatgagta

SEQ ID NO: 169112 - DNA, 14 bp, Unknown
  misc_feature (1)..( 14): Result.005 file - promoters50/1395066
ttagaaaatgcgta

SEQ ID NO: 169113 - DNA, 14 bp, Unknown
  misc_feature (1)..( 14): Result.005 file - promoters50/1395066
tttgaaaaaaaact

SEQ ID NO: 169114 - DNA, 14 bp, Unknown
  misc_feature (1)..( 14): Result.005 file - promoters50/1395066
aatgaaaactccca

SEQ ID NO: 169115 - DNA, 9 bp, Unknown
  misc_feature (1)..( 9): Result.005 file - promoters50/1395066
aataacaaa

SEQ ID NO: 169116 - DNA, 9 bp, Unknown
  misc_feature (1)..( 9): Result.005 file - promoters50/1395066
acgaacaaa

SEQ ID NO: 169117 - DNA, 10 bp, Unknown
  misc_feature (1)..( 10): Result.005 file - promoters50/1395066
agtaactaaa

SEQ ID NO: 169118 - DNA, 10 bp, Unknown
  misc_feature (1)..( 10): Result.005 file - promoters50/1395066
agtaactaac

SEQ ID NO: 169119 - DNA, 10 bp, Unknown
  misc_feature (1)..( 10): Result.005 file - promoters50/1395066
agaaaccaaa

SEQ ID NO: 169120 - DNA, 9 bp, Unknown
  misc_feature (1)..( 9): Result.005 file - promoters50/1395095
ttttctttc

SEQ ID NO: 169121 - DNA, 9 bp, Unknown
  misc_feature (1)..( 9): Result.005 file - promoters50/1395095
atttatttc

SEQ ID NO: 169122 - DNA, 9 bp, Unknown
  misc_feature (1)..( 9): Result.005 file - promoters50/1395095
atttttttt

SEQ ID NO: 169123 - DNA, 9 bp, Unknown
  misc_feature (1)..( 9): Result.005 file - promoters50/1395095
ttttatttc

SEQ ID NO: 169124 - DNA, 9 bp, Unknown
  misc_feature (1)..( 9): Result.005 file - promoters50/1395095
tcttctttt

SEQ ID NO: 169125 - DNA, 9 bp, Unknown
  misc_feature (1)..( 9): Result.005 file - promoters50/1395095
ctttgtttt

SEQ ID NO: 169126 - DNA, 9 bp, Unknown
  misc_feature (1)..( 9): Result.005 file - promoters50/1395095
atttgttgt

SEQ ID NO: 169127 - DNA, 9 bp, Unknown
  misc_feature (1)..( 9): Result.005 file - promoters50/1395095
gatttttgt

SEQ ID NO: 169128 - DNA, 7 bp, Unknown
  misc_feature (1)..( 7): Result.005 file - promoters50/1395128
atatgtg

SEQ ID NO: 169129 - DNA, 7 bp, Unknown
  misc_feature (1)..( 7): Result.005 file - promoters50/1395128
atatgta

SEQ ID NO: 169130 - DNA, 7 bp, Unknown
  misc_feature (1)..( 7): Result.005 file - promoters50/1395128
ttatgta

SEQ ID NO: 169131 - DNA, 10 bp, Unknown
  misc_feature (1)..( 10): Result.005 file - promoters50/1395128
ataattaaat

SEQ ID NO: 169132 - DNA, 10 bp, Unknown
  misc_feature (1)..( 10): Result.005 file - promoters50/1395128
ataactaaat

SEQ ID NO: 169133 - DNA, 10 bp, Unknown
  misc_feature (1)..( 10): Result.005 file - promoters50/1395128
ctaattaaca

SEQ ID NO: 169134 - DNA, 12 bp, Unknown
  misc_feature (1)..( 12): Result.005 file - promoters50/1395128
tttatataaacc

SEQ ID NO: 169135 - DNA, 12 bp, Unknown
  misc_feature (1)..( 12): Result.005 file - promoters50/1395128
ttaatagaaaca

SEQ ID NO: 169136 - DNA, 12 bp, Unknown
  misc_feature (1)..( 12): Result.005 file - promoters50/1395128
aaaataaaaaaa

SEQ ID NO: 169137 - DNA, 12 bp, Unknown
  misc_feature (1)..( 12): Result.005 file - promoters50/1395128
aaaacaaaaaaa

SEQ ID NO: 169138 - DNA, 9 bp, Unknown
  misc_feature (1)..( 9): Result.005 file - promoters50/1395128
acagatgac

SEQ ID NO: 169139 - DNA, 9 bp, Unknown
  misc_feature (1)..( 9): Result.005 file - promoters50/1395128
acagatgaa

SEQ ID NO: 169140 - DNA, 9 bp, Unknown
  misc_feature (1)..( 9): Result.005 file - promoters50/1395128
gaagaagaa

SEQ ID NO: 169141 - DNA, 9 bp, Unknown
  misc_feature (1)..( 9): Result.005 file - promoters50/1395128
tcaaacaaa

SEQ ID NO: 169142 - DNA, 9 bp, Unknown
  misc_feature (1)..( 9): Result.005 file - promoters50/1395128
agaaaaaaa

SEQ ID NO: 169143 - DNA, 9 bp, Unknown
  misc_feature (1)..( 9): Result.005 file - promoters50/1395128
tcaaacatg

SEQ ID NO: 169144 - DNA, 7 bp, Unknown
  misc_feature (1)..( 7): Result.005 file - promoters50/1395128
ccaattg

SEQ ID NO: 169145 - DNA, 7 bp, Unknown
  misc_feature (1)..( 7): Result.005 file - promoters50/1395128
ccaattt

SEQ ID NO: 169146 - DNA, 7 bp, Unknown
  misc_feature (1)..( 7): Result.005 file - promoters50/1395128
acaattt

SEQ ID NO: 169147 - DNA, 9 bp, Unknown
  misc_feature (1)..( 9): Result.005 file - promoters50/1395128
tttatcaaa

SEQ ID NO: 169148 - DNA, 9 bp, Unknown
  misc_feature (1)..( 9): Result.005 file - promoters50/1395128
tttaccaaa

SEQ ID NO: 169149 - DNA, 9 bp, Unknown
  misc_feature (1)..( 9): Result.005 file - promoters50/1395128
tttatcaac

SEQ ID NO: 169150 - DNA, 12 bp, Unknown
  misc_feature (1)..( 12): Result.005 file - promoters50/1395128
taataaagagag

SEQ ID NO: 169151 - DNA, 12 bp, Unknown
  misc_feature (1)..( 12): Result.005 file - promoters50/1395128
taacaaaaagaa

SEQ ID NO: 169152 - DNA, 12 bp, Unknown
  misc_feature (1)..( 12): Result.005 file - promoters50/1395128
atagaaaacgaa

SEQ ID NO: 169153 - DNA, 9 bp, Unknown
  misc_feature (1)..( 9): Result.005 file - promoters50/1395128
ctttatcaa

SEQ ID NO: 169154 - DNA, 9 bp, Unknown
  misc_feature (1)..( 9): Result.005 file - promoters50/1395128
cttgatcca

SEQ ID NO: 169155 - DNA, 9 bp, Unknown
  misc_feature (1)..( 9): Result.005 file - promoters50/1395128
atttaccaa

SEQ ID NO: 169156 - DNA, 7 bp, Unknown
  misc_feature (1)..( 7): Result.005 file - promoters50/1395128
attttgt

SEQ ID NO: 169157 - DNA, 7 bp, Unknown
  misc_feature (1)..( 7): Result.005 file - promoters50/1395128
tttttgt

SEQ ID NO: 169158 - DNA, 7 bp, Unknown
  misc_feature (1)..( 7): Result.005 file - promoters50/1395128
attttgc

SEQ ID NO: 169159 - DNA, 10 bp, Unknown
  misc_feature (1)..( 10): Result.005 file - promoters50/1395128
gaaacaagac

SEQ ID NO: 169160 - DNA, 10 bp, Unknown
  misc_feature (1)..( 10): Result.005 file - promoters50/1395128
aaaacaaaaa

SEQ ID NO: 169161 - DNA, 10 bp, Unknown
  misc_feature (1)..( 10): Result.005 file - promoters50/1395128
aaaataaaaa

SEQ ID NO: 169162 - DNA, 7 bp, Unknown
  misc_feature (1)..( 7): Result.005 file - promoters50/1395142
aggttat

SEQ ID NO: 169163 - DNA, 7 bp, Unknown
  misc_feature (1)..( 7): Result.005 file - promoters50/1395142
gggttat

SEQ ID NO: 169164 - DNA, 7 bp, Unknown
  misc_feature (1)..( 7): Result.005 file - promoters50/1395142
gggatat

SEQ ID NO: 169165 - DNA, 9 bp, Unknown
  misc_feature (1)..( 9): Result.005 file - promoters50/1395142
atttaccaa

SEQ ID NO: 169166 - DNA, 9 bp, Unknown
  misc_feature (1)..( 9): Result.005 file - promoters50/1395142
atttacaat

SEQ ID NO: 169167 - DNA, 8 bp, Unknown
  misc_feature (1)..( 8): Result.005 file - promoters50/1395142
tttagaat

SEQ ID NO: 169168 - DNA, 11 bp, Unknown
  misc_feature (1)..( 11): Result.005 file - promoters50/1395185
attatgtttta

SEQ ID NO: 169169 - DNA, 11 bp, Unknown
  misc_feature (1)..( 11): Result.005 file - promoters50/1395185
acaatgattta

SEQ ID NO: 169170 - DNA, 11 bp, Unknown
  misc_feature (1)..( 11): Result.005 file - promoters50/1395185
attaggtttct

SEQ ID NO: 169171 - DNA, 9 bp, Unknown
  misc_feature (1)..( 9): Result.005 file - promoters50/1395185
taagctaaa

SEQ ID NO: 169172 - DNA, 9 bp, Unknown
  misc_feature (1)..( 9): Result.005 file - promoters50/1395185
aaagcaaaa

SEQ ID NO: 169173 - DNA, 10 bp, Unknown
  misc_feature (1)..( 10): Result.005 file - promoters50/1395185
gaaggcaagt

SEQ ID NO: 169174 - DNA, 10 bp, Unknown
  misc_feature (1)..( 10): Result.005 file - promoters50/1395185
tgaagcaaac

SEQ ID NO: 169175 - DNA, 8 bp, Unknown
  misc_feature (1)..( 8): Result.005 file - promoters50/1395215
ttgttagt

SEQ ID NO: 169176 - DNA, 8 bp, Unknown
  misc_feature (1)..( 8): Result.005 file - promoters50/1395215
ttgctagt

SEQ ID NO: 169177 - DNA, 8 bp, Unknown
  misc_feature (1)..( 8): Result.005 file - promoters50/1395215
ttgttatc

SEQ ID NO: 169178 - DNA, 8 bp, Unknown
  misc_feature (1)..( 8): Result.005 file - promoters50/1395215
aaaacaac

SEQ ID NO: 169179 - DNA, 8 bp, Unknown
  misc_feature (1)..( 8): Result.005 file - promoters50/1395215
gaaacaaa

SEQ ID NO: 169180 - DNA, 8 bp, Unknown
  misc_feature (1)..( 8): Result.005 file - promoters50/1395215
gaaagaaa

SEQ ID NO: 169181 - DNA, 9 bp, Unknown
  misc_feature (1)..( 9): Result.005 file - promoters50/1395254
ttttctatt

SEQ ID NO: 169182 - DNA, 9 bp, Unknown
  misc_feature (1)..( 9): Result.005 file - promoters50/1395254
ttttttatt

SEQ ID NO: 169183 - DNA, 9 bp, Unknown
  misc_feature (1)..( 9): Result.005 file - promoters50/1395254
cgtttaatt

SEQ ID NO: 169184 - DNA, 8 bp, Unknown
  misc_feature (1)..( 8): Result.005 file - promoters50/1395254
cttgtttg

SEQ ID NO: 169185 - DNA, 8 bp, Unknown
  misc_feature (1)..( 8): Result.005 file - promoters50/1395254
attgtttg

SEQ ID NO: 169186 - DNA, 8 bp, Unknown
  misc_feature (1)..( 8): Result.005 file - promoters50/1395254
attttttt

SEQ ID NO: 169187 - DNA, 9 bp, Unknown
  misc_feature (1)..( 9): Result.005 file - promoters50/1395254
taaaaacag

SEQ ID NO: 169188 - DNA, 9 bp, Unknown
  misc_feature (1)..( 9): Result.005 file - promoters50/1395254
cataaacag

SEQ ID NO: 169189 - DNA, 9 bp, Unknown
  misc_feature (1)..( 9): Result.005 file - promoters50/1395254
taacaacaa

SEQ ID NO: 169190 - DNA, 8 bp, Unknown
  misc_feature (1)..( 8): Result.005 file - promoters50/1395254
attaatga

SEQ ID NO: 169191 - DNA, 8 bp, Unknown
  misc_feature (1)..( 8): Result.005 file - promoters50/1395254
attgatga

SEQ ID NO: 169192 - DNA, 8 bp, Unknown
  misc_feature (1)..( 8): Result.005 file - promoters50/1395254
attactga

SEQ ID NO: 169193 - DNA, 8 bp, Unknown
  misc_feature (1)..( 8): Result.005 file - promoters50/1395254
aaatctct

SEQ ID NO: 169194 - DNA, 8 bp, Unknown
  misc_feature (1)..( 8): Result.005 file - promoters50/1395254
aaatctaa

SEQ ID NO: 169195 - DNA, 8 bp, Unknown
  misc_feature (1)..( 8): Result.005 file - promoters50/1395254
taatttaa

SEQ ID NO: 169196 - DNA, 6 bp, Unknown
  misc_feature (1)..( 6): Result.005 file - promoters50/1395254
attttt

SEQ ID NO: 169197 - DNA, 6 bp, Unknown
  misc_feature (1)..( 6): Result.005 file - promoters50/1395254
attttt

SEQ ID NO: 169198 - DNA, 7 bp, Unknown
  misc_feature (1)..( 7): Result.005 file - promoters50/1395254
attgttt

SEQ ID NO: 169199 - DNA, 8 bp, Unknown
  misc_feature (1)..( 8): Result.005 file - promoters50/1395270
aattattt

SEQ ID NO: 169200 - DNA, 8 bp, Unknown
  misc_feature (1)..( 8): Result.005 file - promoters50/1395270
aattatcg

SEQ ID NO: 169201 - DNA, 8 bp, Unknown
  misc_feature (1)..( 8): Result.005 file - promoters50/1395270
aattattt

SEQ ID NO: 169202 - DNA, 13 bp, Unknown
  misc_feature (1)..( 13): Result.005 file - promoters50/1395390
acaaatatatata

SEQ ID NO: 169203 - DNA, 13 bp, Unknown
  misc_feature (1)..( 13): Result.005 file - promoters50/1395390
acaaatattttta

SEQ ID NO: 169204 - DNA, 13 bp, Unknown
  misc_feature (1)..( 13): Result.005 file - promoters50/1395390
acaaatctattaa

SEQ ID NO: 169205 - DNA, 13 bp, Unknown
  misc_feature (1)..( 13): Result.005 file - promoters50/1395390
aacaattttttta

SEQ ID NO: 169206 - DNA, 8 bp, Unknown
  misc_feature (1)..( 8): Result.005 file - promoters50/1395390
agaatttt

SEQ ID NO: 169207 - DNA, 8 bp, Unknown
  misc_feature (1)..( 8): Result.005 file - promoters50/1395390
agaatttc

SEQ ID NO: 169208 - DNA, 8 bp, Unknown
  misc_feature (1)..( 8): Result.005 file - promoters50/1395390
ataatttt

SEQ ID NO: 169209 - DNA, 8 bp, Unknown
  misc_feature (1)..( 8): Result.005 file - promoters50/1395390
ataattta

SEQ ID NO: 169210 - DNA, 10 bp, Unknown
  misc_feature (1)..( 10): Result.005 file - promoters50/1395390
actttttaaa

SEQ ID NO: 169211 - DNA, 10 bp, Unknown
  misc_feature (1)..( 10): Result.005 file - promoters50/1395390
tgtttttaaa

SEQ ID NO: 169212 - DNA, 10 bp, Unknown
  misc_feature (1)..( 10): Result.005 file - promoters50/1395390
agttttttgt

SEQ ID NO: 169213 - DNA, 10 bp, Unknown
  misc_feature (1)..( 10): Result.005 file - promoters50/1395390
tgtatttgca

SEQ ID NO: 169214 - DNA, 9 bp, Unknown
  misc_feature (1)..( 9): Result.005 file - promoters50/1395390
attaaaaaa

SEQ ID NO: 169215 - DNA, 9 bp, Unknown
  misc_feature (1)..( 9): Result.005 file - promoters50/1395390
attacaaat

SEQ ID NO: 169216 - DNA, 9 bp, Unknown
  misc_feature (1)..( 9): Result.005 file - promoters50/1395390
acaaaaaaa

SEQ ID NO: 169217 - DNA, 8 bp, Unknown
  misc_feature (1)..( 8): Result.005 file - promoters50/1395390
tttttttc

SEQ ID NO: 169218 - DNA, 8 bp, Unknown
  misc_feature (1)..( 8): Result.005 file - promoters50/1395390
atttattc

SEQ ID NO: 169219 - DNA, 8 bp, Unknown
  misc_feature (1)..( 8): Result.005 file - promoters50/1395390
attaattt

SEQ ID NO: 169220 - DNA, 12 bp, Unknown
  misc_feature (1)..( 12): Result.005 file - promoters50/1395390
agcataacattc

SEQ ID NO: 169221 - DNA, 12 bp, Unknown
  misc_feature (1)..( 12): Result.005 file - promoters50/1395390
aaaataaaattt

SEQ ID NO: 169222 - DNA, 12 bp, Unknown
  misc_feature (1)..( 12): Result.005 file - promoters50/1395390
aaaagaaaataa

SEQ ID NO: 169223 - DNA, 12 bp, Unknown
  misc_feature (1)..( 12): Result.005 file - promoters50/1395390
agtgtaaagttt

SEQ ID NO: 169224 - DNA, 10 bp, Unknown
  misc_feature (1)..( 10): Result.005 file - promoters50/1395390
aactttctta

SEQ ID NO: 169225 - DNA, 10 bp, Unknown
  misc_feature (1)..( 10): Result.005 file - promoters50/1395390
aattttttta

SEQ ID NO: 169226 - DNA, 10 bp, Unknown
  misc_feature (1)..( 10): Result.005 file - promoters50/1395390
aatattttta

SEQ ID NO: 169227 - DNA, 10 bp, Unknown
  misc_feature (1)..( 10): Result.005 file - promoters50/1395390
aatattttta

SEQ ID NO: 169228 - DNA, 12 bp, Unknown
  misc_feature (1)..( 12): Result.005 file - promoters50/1395390
ttctatctttaa

SEQ ID NO: 169229 - DNA, 12 bp, Unknown
  misc_feature (1)..( 12): Result.005 file - promoters50/1395390
acttatcattaa

SEQ ID NO: 169230 - DNA, 12 bp, Unknown
  misc_feature (1)..( 12): Result.005 file - promoters50/1395390
atttattcaaga

SEQ ID NO: 169231 - DNA, 7 bp, Unknown
  misc_feature (1)..( 7): Result.005 file - promoters50/1395390
attttcc

SEQ ID NO: 169232 - DNA, 7 bp, Unknown
  misc_feature (1)..( 7): Result.005 file - promoters50/1395390
attttct

SEQ ID NO: 169233 - DNA, 7 bp, Unknown
  misc_feature (1)..( 7): Result.005 file - promoters50/1395390
cttttct

SEQ ID NO: 169234 - DNA, 13 bp, Unknown
  misc_feature (1)..( 13): Result.005 file - promoters50/1395390
ttttaaataacat

SEQ ID NO: 169235 - DNA, 13 bp, Unknown
  misc_feature (1)..( 13): Result.005 file - promoters50/1395390
acttaaatctgaa

SEQ ID NO: 169236 - DNA, 14 bp, Unknown
  misc_feature (1)..( 14): Result.005 file - promoters50/1395390
aattataattaaca

SEQ ID NO: 169237 - DNA, 7 bp, Unknown
  misc_feature (1)..( 7): Result.005 file - promoters50/1395390
aaaataa

SEQ ID NO: 169238 - DNA, 7 bp, Unknown
  misc_feature (1)..( 7): Result.005 file - promoters50/1395390
aaattaa

SEQ ID NO: 169239 - DNA, 7 bp, Unknown
  misc_feature (1)..( 7): Result.005 file - promoters50/1395390
caattaa

SEQ ID NO: 169240 - DNA, 8 bp, Unknown
  misc_feature (1)..( 8): Result.005 file - promoters50/1395390
taaacttt

SEQ ID NO: 169241 - DNA, 8 bp, Unknown
  misc_feature (1)..( 8): Result.005 file - promoters50/1395390
taaagttt

SEQ ID NO: 169242 - DNA, 8 bp, Unknown
  misc_feature (1)..( 8): Result.005 file - promoters50/1395390
taaaattt

SEQ ID NO: 169243 - DNA, 8 bp, Unknown
  misc_feature (1)..( 8): Result.005 file - promoters50/1395421
gaagaaga

SEQ ID NO: 169244 - DNA, 8 bp, Unknown
  misc_feature (1)..( 8): Result.005 file - promoters50/1395421
gaagaaga

SEQ ID NO: 169245 - DNA, 8 bp, Unknown
  misc_feature (1)..( 8): Result.005 file - promoters50/1395421
gaagaaag

SEQ ID NO: 169246 - DNA, 14 bp, Unknown
  misc_feature (1)..( 14): Result.005 file - promoters50/1395421
caatgtttctcgaa

SEQ ID NO: 169247 - DNA, 14 bp, Unknown
  misc_feature (1)..( 14): Result.005 file - promoters50/1395421
tcaattttcttgaa

SEQ ID NO: 169248 - DNA, 14 bp, Unknown
  misc_feature (1)..( 14): Result.005 file - promoters50/1395421
ttggatttttggca

SEQ ID NO: 169249 - DNA, 11 bp, Unknown
  misc_feature (1)..( 11): Result.005 file - promoters50/1395421
cccaatgtttc

SEQ ID NO: 169250 - DNA, 11 bp, Unknown
  misc_feature (1)..( 11): Result.005 file - promoters50/1395421
ttgaatttttg

SEQ ID NO: 169251 - DNA, 11 bp, Unknown
  misc_feature (1)..( 11): Result.005 file - promoters50/1395421
ttggatttttg

SEQ ID NO: 169252 - DNA, 11 bp, Unknown
  misc_feature (1)..( 11): Result.005 file - promoters50/1395481
aatactagtag

SEQ ID NO: 169253 - DNA, 11 bp, Unknown
  misc_feature (1)..( 11): Result.005 file - promoters50/1395481
tatactactag

SEQ ID NO: 169254 - DNA, 11 bp, Unknown
  misc_feature (1)..( 11): Result.005 file - promoters50/1395481
aatactgaagg

SEQ ID NO: 169255 - DNA, 8 bp, Unknown
  misc_feature (1)..( 8): Result.005 file - promoters50/1395485
tctttttg

SEQ ID NO: 169256 - DNA, 8 bp, Unknown
  misc_feature (1)..( 8): Result.005 file - promoters50/1395485
tctgtttc

SEQ ID NO: 169257 - DNA, 8 bp, Unknown
  misc_feature (1)..( 8): Result.005 file - promoters50/1395485
acttcttg

SEQ ID NO: 169258 - DNA, 13 bp, Unknown
  misc_feature (1)..( 13): Result.005 file - promoters50/1395534
actttataaaaaa

SEQ ID NO: 169259 - DNA, 13 bp, Unknown
  misc_feature (1)..( 13): Result.005 file - promoters50/1395534
ggtttgtaataaa

SEQ ID NO: 169260 - DNA, 13 bp, Unknown
  misc_feature (1)..( 13): Result.005 file - promoters50/1395534
actttataatgat

SEQ ID NO: 169261 - DNA, 9 bp, Unknown
  misc_feature (1)..( 9): Result.005 file - promoters50/1395534
ttaaaaaaa

SEQ ID NO: 169262 - DNA, 9 bp, Unknown
  misc_feature (1)..( 9): Result.005 file - promoters50/1395534
gcaaagaaa

SEQ ID NO: 169263 - DNA, 9 bp, Unknown
  misc_feature (1)..( 9): Result.005 file - promoters50/1395534
gcaaagaac

SEQ ID NO: 169264 - DNA, 6 bp, Unknown
  misc_feature (1)..( 6): Result.005 file - promoters50/1395534
ttttca

SEQ ID NO: 169265 - DNA, 6 bp, Unknown
  misc_feature (1)..( 6): Result.005 file - promoters50/1395534
ttttca

SEQ ID NO: 169266 - DNA, 6 bp, Unknown
  misc_feature (1)..( 6): Result.005 file - promoters50/1395534
ttttca

SEQ ID NO: 169267 - DNA, 8 bp, Unknown
  misc_feature (1)..( 8): Result.005 file - promoters50/1395534
actccagc

SEQ ID NO: 169268 - DNA, 8 bp, Unknown
  misc_feature (1)..( 8): Result.005 file - promoters50/1395534
actccatt

SEQ ID NO: 169269 - DNA, 8 bp, Unknown
  misc_feature (1)..( 8): Result.005 file - promoters50/1395534
tctcaatt

SEQ ID NO: 169270 - DNA, 10 bp, Unknown
  misc_feature (1)..( 10): Result.005 file - promoters50/1395568
aaatgtggca

SEQ ID NO: 169271 - DNA, 10 bp, Unknown
  misc_feature (1)..( 10): Result.005 file - promoters50/1395568
aaatgtatcg

SEQ ID NO: 169272 - DNA, 10 bp, Unknown
  misc_feature (1)..( 10): Result.005 file - promoters50/1395568
taatttattt

SEQ ID NO: 169273 - DNA, 10 bp, Unknown
  misc_feature (1)..( 10): Result.005 file - promoters50/1395568
tcattttttt

SEQ ID NO: 169274 - DNA, 10 bp, Unknown
  misc_feature (1)..( 10): Result.005 file - promoters50/1395568
ccattttcgt

SEQ ID NO: 169275 - DNA, 10 bp, Unknown
  misc_feature (1)..( 10): Result.005 file - promoters50/1395568
acatgtttta

SEQ ID NO: 169276 - DNA, 7 bp, Unknown
  misc_feature (1)..( 7): Result.005 file - promoters50/1395605
gatataa

SEQ ID NO: 169277 - DNA, 7 bp, Unknown
  misc_feature (1)..( 7): Result.005 file - promoters50/1395605
gatatat

SEQ ID NO: 169278 - DNA, 7 bp, Unknown
  misc_feature (1)..( 7): Result.005 file - promoters50/1395605
tatataa

SEQ ID NO: 169279 - DNA, 8 bp, Unknown
  misc_feature (1)..( 8): Result.005 file - promoters50/1395605
tgaaccac

SEQ ID NO: 169280 - DNA, 8 bp, Unknown
  misc_feature (1)..( 8): Result.005 file - promoters50/1395605
ggaatcac

SEQ ID NO: 169281 - DNA, 8 bp, Unknown
  misc_feature (1)..( 8): Result.005 file - promoters50/1395605
tgacccaa

SEQ ID NO: 169282 - DNA, 9 bp, Unknown
  misc_feature (1)..( 9): Result.005 file - promoters50/1395605
cataaaaca

SEQ ID NO: 169283 - DNA, 9 bp, Unknown
  misc_feature (1)..( 9): Result.005 file - promoters50/1395605
cataaaatt

SEQ ID NO: 169284 - DNA, 9 bp, Unknown
  misc_feature (1)..( 9): Result.005 file - promoters50/1395605
tctaatatt

SEQ ID NO: 169285 - DNA, 11 bp, Unknown
  misc_feature (1)..( 11): Result.005 file - promoters50/1395605
tttctctacgc

SEQ ID NO: 169286 - DNA, 11 bp, Unknown
  misc_feature (1)..( 11): Result.005 file - promoters50/1395605
attctcttatt

SEQ ID NO: 169287 - DNA, 11 bp, Unknown
  misc_feature (1)..( 11): Result.005 file - promoters50/1395605
attcttttatt

SEQ ID NO: 169288 - DNA, 7 bp, Unknown
  misc_feature (1)..( 7): Result.005 file - promoters50/1395605
aatatat

SEQ ID NO: 169289 - DNA, 7 bp, Unknown
  misc_feature (1)..( 7): Result.005 file - promoters50/1395605
aatatat

SEQ ID NO: 169290 - DNA, 7 bp, Unknown
  misc_feature (1)..( 7): Result.005 file - promoters50/1395605
gatatat

SEQ ID NO: 169291 - DNA, 10 bp, Unknown
  misc_feature (1)..( 10): Result.005 file - promoters50/1395728
cctttgagaa

SEQ ID NO: 169292 - DNA, 10 bp, Unknown
  misc_feature (1)..( 10): Result.005 file - promoters50/1395728
aaagtgagaa

SEQ ID NO: 169293 - DNA, 10 bp, Unknown
  misc_feature (1)..( 10): Result.005 file - promoters50/1395728
cctttgagat

SEQ ID NO: 169294 - DNA, 13 bp, Unknown
  misc_feature (1)..( 13): Result.005 file - promoters50/1395781
taattataagcaa

SEQ ID NO: 169295 - DNA, 13 bp, Unknown
  misc_feature (1)..( 13): Result.005 file - promoters50/1395781
aaatgatatgaga

SEQ ID NO: 169296 - DNA, 13 bp, Unknown
  misc_feature (1)..( 13): Result.005 file - promoters50/1395781
taattactctaat

SEQ ID NO: 169297 - DNA, 13 bp, Unknown
  misc_feature (1)..( 13): Result.005 file - promoters50/1395781
taataactctaat

SEQ ID NO: 169298 - DNA, 13 bp, Unknown
  misc_feature (1)..( 13): Result.005 file - promoters50/1395781
taaatacaaatat

SEQ ID NO: 169299 - DNA, 13 bp, Unknown
  misc_feature (1)..( 13): Result.005 file - promoters50/1395781
aagtgaatggtca

SEQ ID NO: 169300 - DNA, 10 bp, Unknown
  misc_feature (1)..( 10): Result.005 file - promoters50/1395781
catttttgtc

SEQ ID NO: 169301 - DNA, 10 bp, Unknown
  misc_feature (1)..( 10): Result.005 file - promoters50/1395781
catttttgtg

SEQ ID NO: 169302 - DNA, 10 bp, Unknown
  misc_feature (1)..( 10): Result.005 file - promoters50/1395781
ttaatttgtc

SEQ ID NO: 169303 - DNA, 10 bp, Unknown
  misc_feature (1)..( 10): Result.005 file - promoters50/1395781
tattattgtc

SEQ ID NO: 169304 - DNA, 10 bp, Unknown
  misc_feature (1)..( 10): Result.005 file - promoters50/1395781
cattttaagt

SEQ ID NO: 169305 - DNA, 10 bp, Unknown
  misc_feature (1)..( 10): Result.005 file - promoters50/1395781
aatctgttga

SEQ ID NO: 169306 - DNA, 8 bp, Unknown
  misc_feature (1)..( 8): Result.005 file - promoters50/1395790
aactatgg

SEQ ID NO: 169307 - DNA, 8 bp, Unknown
  misc_feature (1)..( 8): Result.005 file - promoters50/1395790
aacaatga

SEQ ID NO: 169308 - DNA, 8 bp, Unknown
  misc_feature (1)..( 8): Result.005 file - promoters50/1395790
aaaaatat

SEQ ID NO: 169309 - DNA, 8 bp, Unknown
  misc_feature (1)..( 8): Result.005 file - promoters50/1395790
atcaatga

SEQ ID NO: 169310 - DNA, 9 bp, Unknown
  misc_feature (1)..( 9): Result.005 file - promoters50/1395790
gtattgttg

SEQ ID NO: 169311 - DNA, 9 bp, Unknown
  misc_feature (1)..( 9): Result.005 file - promoters50/1395790
gtattgtta

SEQ ID NO: 169312 - DNA, 9 bp, Unknown
  misc_feature (1)..( 9): Result.005 file - promoters50/1395790
atatttttg

SEQ ID NO: 169313 - DNA, 8 bp, Unknown
  misc_feature (1)..( 8): Result.005 file - promoters50/1395806
acaaaagc

SEQ ID NO: 169314 - DNA, 8 bp, Unknown
  misc_feature (1)..( 8): Result.005 file - promoters50/1395806
acaaaata

SEQ ID NO: 169315 - DNA, 8 bp, Unknown
  misc_feature (1)..( 8): Result.005 file - promoters50/1395806
acaaaagg

SEQ ID NO: 169316 - DNA, 8 bp, Unknown
  misc_feature (1)..( 8): Result.005 file - promoters50/1395806
tcaatata

SEQ ID NO: 169317 - DNA, 12 bp, Unknown
  misc_feature (1)..( 12): Result.005 file - promoters50/1395806
atagaaacaaat

SEQ ID NO: 169318 - DNA, 12 bp, Unknown
  misc_feature (1)..( 12): Result.005 file - promoters50/1395806
atagagacaaaa

SEQ ID NO: 169319 - DNA, 12 bp, Unknown
  misc_feature (1)..( 12): Result.005 file - promoters50/1395806
ggagaaaaaaaa

SEQ ID NO: 169320 - DNA, 12 bp, Unknown
  misc_feature (1)..( 12): Result.005 file - promoters50/1395806
atttgtacaaaa

SEQ ID NO: 169321 - DNA, 9 bp, Unknown
  misc_feature (1)..( 9): Result.005 file - promoters50/1395806
ataatgaat

SEQ ID NO: 169322 - DNA, 9 bp, Unknown
  misc_feature (1)..( 9): Result.005 file - promoters50/1395806
aaaatgaat

SEQ ID NO: 169323 - DNA, 9 bp, Unknown
  misc_feature (1)..( 9): Result.005 file - promoters50/1395806
aaaacgaac

SEQ ID NO: 169324 - DNA, 9 bp, Unknown
  misc_feature (1)..( 9): Result.005 file - promoters50/1395806
aaaatgaaa

SEQ ID NO: 169325 - DNA, 11 bp, Unknown
  misc_feature (1)..( 11): Result.005 file - promoters50/1395806
attatcaaagc

SEQ ID NO: 169326 - DNA, 11 bp, Unknown
  misc_feature (1)..( 11): Result.005 file - promoters50/1395806
attttcaaagc

SEQ ID NO: 169327 - DNA, 11 bp, Unknown
  misc_feature (1)..( 11): Result.005 file - promoters50/1395806
gttttaaaaac

SEQ ID NO: 169328 - DNA, 11 bp, Unknown
  misc_feature (1)..( 11): Result.005 file - promoters50/1395806
aatttaaaatg

SEQ ID NO: 169329 - DNA, 10 bp, Unknown
  misc_feature (1)..( 10): Result.005 file - promoters50/1395824
ttcaaatata

SEQ ID NO: 169330 - DNA, 10 bp, Unknown
  misc_feature (1)..( 10): Result.005 file - promoters50/1395824
cacaaacata

SEQ ID NO: 169331 - DNA, 10 bp, Unknown
  misc_feature (1)..( 10): Result.005 file - promoters50/1395824
ttcagataaa

SEQ ID NO: 169332 - DNA, 10 bp, Unknown
  misc_feature (1)..( 10): Result.005 file - promoters50/1395824
gagaaagata

SEQ ID NO: 169333 - DNA, 10 bp, Unknown
  misc_feature (1)..( 10): Result.005 file - promoters50/1395824
aacaatcatc

SEQ ID NO: 169334 - DNA, 15 bp, Unknown
  misc_feature (1)..( 15): Result.005 file - promoters50/1395824
gtaatttgcaataat

SEQ ID NO: 169335 - DNA, 15 bp, Unknown
  misc_feature (1)..( 15): Result.005 file - promoters50/1395824
caaataagcaaaaat

SEQ ID NO: 169336 - DNA, 15 bp, Unknown
  misc_feature (1)..( 15): Result.005 file - promoters50/1395824
aatattttcaaaatc

SEQ ID NO: 169337 - DNA, 15 bp, Unknown
  misc_feature (1)..( 15): Result.005 file - promoters50/1395824
aggttaatcacaatg

SEQ ID NO: 169338 - DNA, 15 bp, Unknown
  misc_feature (1)..( 15): Result.005 file - promoters50/1395824
acatgattaaacatt

SEQ ID NO: 169339 - DNA, 14 bp, Unknown
  misc_feature (1)..( 14): Result.005 file - promoters50/1395824
aattttaaaaaagc

SEQ ID NO: 169340 - DNA, 14 bp, Unknown
  misc_feature (1)..( 14): Result.005 file - promoters50/1395824
caagtcaaataagc

SEQ ID NO: 169341 - DNA, 14 bp, Unknown
  misc_feature (1)..( 14): Result.005 file - promoters50/1395824
attttcaaaatcaa

SEQ ID NO: 169342 - DNA, 14 bp, Unknown
  misc_feature (1)..( 14): Result.005 file - promoters50/1395824
ttaatcacaatgct

SEQ ID NO: 169343 - DNA, 12 bp, Unknown
  misc_feature (1)..( 12): Result.005 file - promoters50/1395824
agtggataaatc

SEQ ID NO: 169344 - DNA, 12 bp, Unknown
  misc_feature (1)..( 12): Result.005 file - promoters50/1395824
atgcgataaacg

SEQ ID NO: 169345 - DNA, 12 bp, Unknown
  misc_feature (1)..( 12): Result.005 file - promoters50/1395824
atgcaataaacg

SEQ ID NO: 169346 - DNA, 12 bp, Unknown
  misc_feature (1)..( 12): Result.005 file - promoters50/1395824
tagcagtaatca

SEQ ID NO: 169347 - DNA, 12 bp, Unknown
  misc_feature (1)..( 12): Result.005 file - promoters50/1395824
aagcaataaaag

SEQ ID NO: 169348 - DNA, 9 bp, Unknown
  misc_feature (1)..( 9): Result.005 file - promoters50/1395828
acacctaac

SEQ ID NO: 169349 - DNA, 9 bp, Unknown
  misc_feature (1)..( 9): Result.005 file - promoters50/1395828
gaaccaaac

SEQ ID NO: 169350 - DNA, 9 bp, Unknown
  misc_feature (1)..( 9): Result.005 file - promoters50/1395828
gaatcaatc

SEQ ID NO: 169351 - DNA, 10 bp, Unknown
  misc_feature (1)..( 10): Result.005 file - promoters50/1395828
aactaactca

SEQ ID NO: 169352 - DNA, 10 bp, Unknown
  misc_feature (1)..( 10): Result.005 file - promoters50/1395828
aaccaacaat

SEQ ID NO: 169353 - DNA, 10 bp, Unknown
  misc_feature (1)..( 10): Result.005 file - promoters50/1395828
tcccaataat

SEQ ID NO: 169354 - DNA, 7 bp, Unknown
  misc_feature (1)..( 7): Result.005 file - promoters50/1395836
attacat

SEQ ID NO: 169355 - DNA, 7 bp, Unknown
  misc_feature (1)..( 7): Result.005 file - promoters50/1395836
attacag

SEQ ID NO: 169356 - DNA, 7 bp, Unknown
  misc_feature (1)..( 7): Result.005 file - promoters50/1395836
atttcat

SEQ ID NO: 169357 - DNA, 8 bp, Unknown
  misc_feature (1)..( 8): Result.005 file - promoters50/1395836
attcgaag

SEQ ID NO: 169358 - DNA, 8 bp, Unknown
  misc_feature (1)..( 8): Result.005 file - promoters50/1395836
atttgaat

SEQ ID NO: 169359 - DNA, 8 bp, Unknown
  misc_feature (1)..( 8): Result.005 file - promoters50/1395836
gattgaat

SEQ ID NO: 169360 - DNA, 10 bp, Unknown
  misc_feature (1)..( 10): Result.005 file - promoters50/1395836
ttgaagatta

SEQ ID NO: 169361 - DNA, 10 bp, Unknown
  misc_feature (1)..( 10): Result.005 file - promoters50/1395836
ttggagactg

SEQ ID NO: 169362 - DNA, 10 bp, Unknown
  misc_feature (1)..( 10): Result.005 file - promoters50/1395836
aggaagttta

SEQ ID NO: 169363 - DNA, 7 bp, Unknown
  misc_feature (1)..( 7): Result.005 file - promoters50/1395836
aaaccgg

SEQ ID NO: 169364 - DNA, 7 bp, Unknown
  misc_feature (1)..( 7): Result.005 file - promoters50/1395836
aaagcgg

SEQ ID NO: 169365 - DNA, 7 bp, Unknown
  misc_feature (1)..( 7): Result.005 file - promoters50/1395836
gaagcgg

SEQ ID NO: 169366 - DNA, 10 bp, Unknown
  misc_feature (1)..( 10): Result.005 file - promoters50/1395836
gcgaatatgc

SEQ ID NO: 169367 - DNA, 10 bp, Unknown
  misc_feature (1)..( 10): Result.005 file - promoters50/1395836
gagaaaatgg

SEQ ID NO: 169368 - DNA, 10 bp, Unknown
  misc_feature (1)..( 10): Result.005 file - promoters50/1395836
gagaaactgg

SEQ ID NO: 169369 - DNA, 13 bp, Unknown
  misc_feature (1)..( 13): Result.005 file - promoters50/1395839
agtttatttttct

SEQ ID NO: 169370 - DNA, 13 bp, Unknown
  misc_feature (1)..( 13): Result.005 file - promoters50/1395839
tgtttagttttgg

SEQ ID NO: 169371 - DNA, 13 bp, Unknown
  misc_feature (1)..( 13): Result.005 file - promoters50/1395839
agttgatttattt

SEQ ID NO: 169372 - DNA, 13 bp, Unknown
  misc_feature (1)..( 13): Result.005 file - promoters50/1395839
agtatatatatat

SEQ ID NO: 169373 - DNA, 13 bp, Unknown
  misc_feature (1)..( 13): Result.005 file - promoters50/1395839
tactgatttgttt

SEQ ID NO: 169374 - DNA, 13 bp, Unknown
  misc_feature (1)..( 13): Result.005 file - promoters50/1395839
ccatgaattggca

SEQ ID NO: 169375 - DNA, 11 bp, Unknown
  misc_feature (1)..( 11): Result.005 file - promoters50/1395972
ctcaaaatagc

SEQ ID NO: 169376 - DNA, 11 bp, Unknown
  misc_feature (1)..( 11): Result.005 file - promoters50/1395972
actaaaatagt

SEQ ID NO: 169377 - DNA, 11 bp, Unknown
  misc_feature (1)..( 11): Result.005 file - promoters50/1395972
gtcaaaaagca

SEQ ID NO: 169378 - DNA, 11 bp, Unknown
  misc_feature (1)..( 11): Result.005 file - promoters50/1395972
cctacaatttt

SEQ ID NO: 169379 - DNA, 11 bp, Unknown
  misc_feature (1)..( 11): Result.005 file - promoters50/1395972
tcaaaaaaaaa

SEQ ID NO: 169380 - DNA, 9 bp, Unknown
  misc_feature (1)..( 9): Result.005 file - promoters50/1395972
aacagaaag

SEQ ID NO: 169381 - DNA, 9 bp, Unknown
  misc_feature (1)..( 9): Result.005 file - promoters50/1395972
ttcagaaac

SEQ ID NO: 169382 - DNA, 9 bp, Unknown
  misc_feature (1)..( 9): Result.005 file - promoters50/1395972
aacaaaaac

SEQ ID NO: 169383 - DNA, 9 bp, Unknown
  misc_feature (1)..( 9): Result.005 file - promoters50/1395972
aggagaaag

SEQ ID NO: 169384 - DNA, 9 bp, Unknown
  misc_feature (1)..( 9): Result.005 file - promoters50/1396022
ttgttgttg

SEQ ID NO: 169385 - DNA, 9 bp, Unknown
  misc_feature (1)..( 9): Result.005 file - promoters50/1396022
atgtttttg

SEQ ID NO: 169386 - DNA, 9 bp, Unknown
  misc_feature (1)..( 9): Result.005 file - promoters50/1396022
ttgatgtaa

SEQ ID NO: 169387 - DNA, 9 bp, Unknown
  misc_feature (1)..( 9): Result.005 file - promoters50/1396022
ttaaagttt

SEQ ID NO: 169388 - DNA, 9 bp, Unknown
  misc_feature (1)..( 9): Result.005 file - promoters50/1396022
ttaaagtcg

SEQ ID NO: 169389 - DNA, 9 bp, Unknown
  misc_feature (1)..( 9): Result.005 file - promoters50/1396022
tgaaactcg

SEQ ID NO: 169390 - DNA, 9 bp, Unknown
  misc_feature (1)..( 9): Result.005 file - promoters50/1396022
cttctttgg

SEQ ID NO: 169391 - DNA, 9 bp, Unknown
  misc_feature (1)..( 9): Result.005 file - promoters50/1396022
cttgtttaa

SEQ ID NO: 169392 - DNA, 9 bp, Unknown
  misc_feature (1)..( 9): Result.005 file - promoters50/1396022
gttgtttaa

SEQ ID NO: 169393 - DNA, 9 bp, Unknown
  misc_feature (1)..( 9): Result.005 file - promoters50/1396022
aaaaacaaa

SEQ ID NO: 169394 - DNA, 9 bp, Unknown
  misc_feature (1)..( 9): Result.005 file - promoters50/1396022
gaaatcaaa

SEQ ID NO: 169395 - DNA, 9 bp, Unknown
  misc_feature (1)..( 9): Result.005 file - promoters50/1396022
gaaattaaa

SEQ ID NO: 169396 - DNA, 13 bp, Unknown
  misc_feature (1)..( 13): Result.005 file - promoters50/1396057
acaaataaaaatt

SEQ ID NO: 169397 - DNA, 13 bp, Unknown
  misc_feature (1)..( 13): Result.005 file - promoters50/1396057
cctcttaaatatt

SEQ ID NO: 169398 - DNA, 13 bp, Unknown
  misc_feature (1)..( 13): Result.005 file - promoters50/1396057
tagcttgaatcaa

SEQ ID NO: 169399 - DNA, 13 bp, Unknown
  misc_feature (1)..( 13): Result.005 file - promoters50/1396057
ttgattcaaaatt

SEQ ID NO: 169400 - DNA, 10 bp, Unknown
  misc_feature (1)..( 10): Result.005 file - promoters50/1396057
ggtatttgtt

SEQ ID NO: 169401 - DNA, 10 bp, Unknown
  misc_feature (1)..( 10): Result.005 file - promoters50/1396057
tatatatgtt

SEQ ID NO: 169402 - DNA, 10 bp, Unknown
  misc_feature (1)..( 10): Result.005 file - promoters50/1396057
ggtgtttgca

SEQ ID NO: 169403 - DNA, 10 bp, Unknown
  misc_feature (1)..( 10): Result.005 file - promoters50/1396057
aatatttata

SEQ ID NO: 169404 - DNA, 13 bp, Unknown
  misc_feature (1)..( 13): Result.005 file - promoters50/1396057
ataaaattataaa

SEQ ID NO: 169405 - DNA, 13 bp, Unknown
  misc_feature (1)..( 13): Result.005 file - promoters50/1396057
atacaatgatatt

SEQ ID NO: 169406 - DNA, 13 bp, Unknown
  misc_feature (1)..( 13): Result.005 file - promoters50/1396057
ccggaattttaac

SEQ ID NO: 169407 - DNA, 13 bp, Unknown
  misc_feature (1)..( 13): Result.005 file - promoters50/1396057
ttaacctttgacc

SEQ ID NO: 169408 - DNA, 12 bp, Unknown
  misc_feature (1)..( 12): Result.005 file - promoters50/1396057
tctatttatcta

SEQ ID NO: 169409 - DNA, 12 bp, Unknown
  misc_feature (1)..( 12): Result.005 file - promoters50/1396057
aatttttttcta

SEQ ID NO: 169410 - DNA, 12 bp, Unknown
  misc_feature (1)..( 12): Result.005 file - promoters50/1396057
cacctttctctt

SEQ ID NO: 169411 - DNA, 12 bp, Unknown
  misc_feature (1)..( 12): Result.005 file - promoters50/1396057
attgttttggtt

SEQ ID NO: 169412 - DNA, 11 bp, Unknown
  misc_feature (1)..( 11): Result.005 file - promoters50/1396085
ttctttgttca

SEQ ID NO: 169413 - DNA, 11 bp, Unknown
  misc_feature (1)..( 11): Result.005 file - promoters50/1396085
atttttattct

SEQ ID NO: 169414 - DNA, 11 bp, Unknown
  misc_feature (1)..( 11): Result.005 file - promoters50/1396085
aaatttgttgt

SEQ ID NO: 169415 - DNA, 11 bp, Unknown
  misc_feature (1)..( 11): Result.005 file - promoters50/1396085
aaatatgttaa

SEQ ID NO: 169416 - DNA, 11 bp, Unknown
  misc_feature (1)..( 11): Result.005 file - promoters50/1396085
aattttaatct

SEQ ID NO: 169417 - DNA, 11 bp, Unknown
  misc_feature (1)..( 11): Result.005 file - promoters50/1396085
gaccttaatct

SEQ ID NO: 169418 - DNA, 10 bp, Unknown
  misc_feature (1)..( 10): Result.005 file - promoters50/1396085
aaaatagcct

SEQ ID NO: 169419 - DNA, 10 bp, Unknown
  misc_feature (1)..( 10): Result.005 file - promoters50/1396085
aaaataaact

SEQ ID NO: 169420 - DNA, 10 bp, Unknown
  misc_feature (1)..( 10): Result.005 file - promoters50/1396085
caaataaatc

SEQ ID NO: 169421 - DNA, 10 bp, Unknown
  misc_feature (1)..( 10): Result.005 file - promoters50/1396085
aaaaaaaact

SEQ ID NO: 169422 - DNA, 10 bp, Unknown
  misc_feature (1)..( 10): Result.005 file - promoters50/1396085
aaagtaattt

SEQ ID NO: 169423 - DNA, 10 bp, Unknown
  misc_feature (1)..( 10): Result.005 file - promoters50/1396085
acagtagttt

SEQ ID NO: 169424 - DNA, 10 bp, Unknown
  misc_feature (1)..( 10): Result.005 file - promoters50/1396085
acattagcgg

SEQ ID NO: 169425 - DNA, 10 bp, Unknown
  misc_feature (1)..( 10): Result.005 file - promoters50/1396085
aattctcaat

SEQ ID NO: 169426 - DNA, 10 bp, Unknown
  misc_feature (1)..( 10): Result.005 file - promoters50/1396085
ttttctcagt

SEQ ID NO: 169427 - DNA, 10 bp, Unknown
  misc_feature (1)..( 10): Result.005 file - promoters50/1396085
atttcttaat

SEQ ID NO: 169428 - DNA, 10 bp, Unknown
  misc_feature (1)..( 10): Result.005 file - promoters50/1396085
atttcttctc

SEQ ID NO: 169429 - DNA, 10 bp, Unknown
  misc_feature (1)..( 10): Result.005 file - promoters50/1396085
tttttttagt

SEQ ID NO: 169430 - DNA, 10 bp, Unknown
  misc_feature (1)..( 10): Result.005 file - promoters50/1396085
gcttcttatt

SEQ ID NO: 169431 - DNA, 6 bp, Unknown
  misc_feature (1)..( 6): Result.005 file - promoters50/1396104
atcaaa

SEQ ID NO: 169432 - DNA, 6 bp, Unknown
  misc_feature (1)..( 6): Result.005 file - promoters50/1396104
atcaaa

SEQ ID NO: 169433 - DNA, 6 bp, Unknown
  misc_feature (1)..( 6): Result.005 file - promoters50/1396104
atcaaa

SEQ ID NO: 169434 - DNA, 7 bp, Unknown
  misc_feature (1)..( 7): Result.005 file - promoters50/1396123
ttattat

SEQ ID NO: 169435 - DNA, 7 bp, Unknown
  misc_feature (1)..( 7): Result.005 file - promoters50/1396123
ttaatat

SEQ ID NO: 169436 - DNA, 7 bp, Unknown
  misc_feature (1)..( 7): Result.005 file - promoters50/1396123
ttattaa

SEQ ID NO: 169437 - DNA, 7 bp, Unknown
  misc_feature (1)..( 7): Result.005 file - promoters50/1396123
tattaaa

SEQ ID NO: 169438 - DNA, 7 bp, Unknown
  misc_feature (1)..( 7): Result.005 file - promoters50/1396123
tattaat

SEQ ID NO: 169439 - DNA, 7 bp, Unknown
  misc_feature (1)..( 7): Result.005 file - promoters50/1396123
tattaaa

SEQ ID NO: 169440 - DNA, 16 bp, Unknown
  misc_feature (1)..( 16): Result.005 file - promoters50/1396123
ttatcaaagttatatt

SEQ ID NO: 169441 - DNA, 16 bp, Unknown
  misc_feature (1)..( 16): Result.005 file - promoters50/1396123
aaactattaatatatt

SEQ ID NO: 169442 - DNA, 16 bp, Unknown
  misc_feature (1)..( 16): Result.005 file - promoters50/1396123
ttattaaagttatata

SEQ ID NO: 169443 - DNA, 8 bp, Unknown
  misc_feature (1)..( 8): Result.005 file - promoters50/1396123
aattatca

SEQ ID NO: 169444 - DNA, 8 bp, Unknown
  misc_feature (1)..( 8): Result.005 file - promoters50/1396123
tattatca

SEQ ID NO: 169445 - DNA, 8 bp, Unknown
  misc_feature (1)..( 8): Result.005 file - promoters50/1396123
aataatcg

SEQ ID NO: 169446 - DNA, 12 bp, Unknown
  misc_feature (1)..( 12): Result.005 file - promoters50/1396123
aaaaatactttg

SEQ ID NO: 169447 - DNA, 12 bp, Unknown
  misc_feature (1)..( 12): Result.005 file - promoters50/1396123
tataattctttg

SEQ ID NO: 169448 - DNA, 12 bp, Unknown
  misc_feature (1)..( 12): Result.005 file - promoters50/1396123
aaaaatactcaa

SEQ ID NO: 169449 - DNA, 9 bp, Unknown
  misc_feature (1)..( 9): Result.005 file - promoters50/1396123
attaaaatt

SEQ ID NO: 169450 - DNA, 9 bp, Unknown
  misc_feature (1)..( 9): Result.005 file - promoters50/1396123
attaaaatc

SEQ ID NO: 169451 - DNA, 9 bp, Unknown
  misc_feature (1)..( 9): Result.005 file - promoters50/1396123
gtcaaaatc

SEQ ID NO: 169452 - DNA, 11 bp, Unknown
  misc_feature (1)..( 11): Result.005 file - promoters50/1396127
ataaaattgag

SEQ ID NO: 169453 - DNA, 11 bp, Unknown
  misc_feature (1)..( 11): Result.005 file - promoters50/1396127
ttaatattgga

SEQ ID NO: 169454 - DNA, 11 bp, Unknown
  misc_feature (1)..( 11): Result.005 file - promoters50/1396127
tcaaaattgcg

SEQ ID NO: 169455 - DNA, 11 bp, Unknown
  misc_feature (1)..( 11): Result.005 file - promoters50/1396127
gtaatatagga

SEQ ID NO: 169456 - DNA, 11 bp, Unknown
  misc_feature (1)..( 11): Result.005 file - promoters50/1396127
ttaacatatca

SEQ ID NO: 169457 - DNA, 11 bp, Unknown
  misc_feature (1)..( 11): Result.005 file - promoters50/1396127
gtagtatgtac

SEQ ID NO: 169458 - DNA, 11 bp, Unknown
  misc_feature (1)..( 11): Result.005 file - promoters50/1396127
ataaattaatt

SEQ ID NO: 169459 - DNA, 11 bp, Unknown
  misc_feature (1)..( 11): Result.005 file - promoters50/1396127
ataaagtaatt

SEQ ID NO: 169460 - DNA, 11 bp, Unknown
  misc_feature (1)..( 11): Result.005 file - promoters50/1396127
agaaaataaac

SEQ ID NO: 169461 - DNA, 11 bp, Unknown
  misc_feature (1)..( 11): Result.005 file - promoters50/1396127
caaaaataata

SEQ ID NO: 169462 - DNA, 11 bp, Unknown
  misc_feature (1)..( 11): Result.005 file - promoters50/1396127
ataaataaggt

SEQ ID NO: 169463 - DNA, 11 bp, Unknown
  misc_feature (1)..( 11): Result.005 file - promoters50/1396127
agaagagaatt

SEQ ID NO: 169464 - DNA, 12 bp, Unknown
  misc_feature (1)..( 12): Result.005 file - promoters50/1396147
atcttaatttca

SEQ ID NO: 169465 - DNA, 12 bp, Unknown
  misc_feature (1)..( 12): Result.005 file - promoters50/1396147
atattactttta

SEQ ID NO: 169466 - DNA, 12 bp, Unknown
  misc_feature (1)..( 12): Result.005 file - promoters50/1396147
atcctaatcaac

SEQ ID NO: 169467 - DNA, 12 bp, Unknown
  misc_feature (1)..( 12): Result.005 file - promoters50/1396147
aattaactatta

SEQ ID NO: 169468 - DNA, 12 bp, Unknown
  misc_feature (1)..( 12): Result.005 file - promoters50/1396147
ttccaaatatac

SEQ ID NO: 169469 - DNA, 12 bp, Unknown
  misc_feature (1)..( 12): Result.005 file - promoters50/1396147
ttcataattatc

SEQ ID NO: 169470 - DNA, 9 bp, Unknown
  misc_feature (1)..( 9): Result.005 file - promoters50/1396147
gatattcct

SEQ ID NO: 169471 - DNA, 9 bp, Unknown
  misc_feature (1)..( 9): Result.005 file - promoters50/1396147
tataatcca

SEQ ID NO: 169472 - DNA, 9 bp, Unknown
  misc_feature (1)..( 9): Result.005 file - promoters50/1396147
tccattcct

SEQ ID NO: 169473 - DNA, 9 bp, Unknown
  misc_feature (1)..( 9): Result.005 file - promoters50/1396147
aatattctc

SEQ ID NO: 169474 - DNA, 9 bp, Unknown
  misc_feature (1)..( 9): Result.005 file - promoters50/1396147
agtaaacca

SEQ ID NO: 169475 - DNA, 9 bp, Unknown
  misc_feature (1)..( 9): Result.005 file - promoters50/1396147
tccattccg

SEQ ID NO: 169476 - DNA, 13 bp, Unknown
  misc_feature (1)..( 13): Result.005 file - promoters50/1396147
tcaaataaaccat

SEQ ID NO: 169477 - DNA, 13 bp, Unknown
  misc_feature (1)..( 13): Result.005 file - promoters50/1396147
aaaaataactttc

SEQ ID NO: 169478 - DNA, 13 bp, Unknown
  misc_feature (1)..( 13): Result.005 file - promoters50/1396147
tcaaaaaaagaat

SEQ ID NO: 169479 - DNA, 13 bp, Unknown
  misc_feature (1)..( 13): Result.005 file - promoters50/1396147
ggaaaaaaaaaat

SEQ ID NO: 169480 - DNA, 13 bp, Unknown
  misc_feature (1)..( 13): Result.005 file - promoters50/1396147
acaaaaaaattca

SEQ ID NO: 169481 - DNA, 13 bp, Unknown
  misc_feature (1)..( 13): Result.005 file - promoters50/1396147
ctaaaaaaaaggg

SEQ ID NO: 169482 - DNA, 12 bp, Unknown
  misc_feature (1)..( 12): Result.005 file - promoters50/1396147
attcaaataaac

SEQ ID NO: 169483 - DNA, 12 bp, Unknown
  misc_feature (1)..( 12): Result.005 file - promoters50/1396147
ggtcaaattcga

SEQ ID NO: 169484 - DNA, 12 bp, Unknown
  misc_feature (1)..( 12): Result.005 file - promoters50/1396147
attccaatctct

SEQ ID NO: 169485 - DNA, 12 bp, Unknown
  misc_feature (1)..( 12): Result.005 file - promoters50/1396147
taacaaatttct

SEQ ID NO: 169486 - DNA, 12 bp, Unknown
  misc_feature (1)..( 12): Result.005 file - promoters50/1396147
agtcaaatatca

SEQ ID NO: 169487 - DNA, 12 bp, Unknown
  misc_feature (1)..( 12): Result.005 file - promoters50/1396147
gctcttgactcc

SEQ ID NO: 169488 - DNA, 14 bp, Unknown
  misc_feature (1)..( 14): Result.005 file - promoters50/1396147
aaacttttttttta

SEQ ID NO: 169489 - DNA, 14 bp, Unknown
  misc_feature (1)..( 14): Result.005 file - promoters50/1396147
aaactttttctaat

SEQ ID NO: 169490 - DNA, 14 bp, Unknown
  misc_feature (1)..( 14): Result.005 file - promoters50/1396147
aaaattttctggtt

SEQ ID NO: 169491 - DNA, 15 bp, Unknown
  misc_feature (1)..( 15): Result.005 file - promoters50/1396147
gtcgtttgttttatc

SEQ ID NO: 169492 - DNA, 15 bp, Unknown
  misc_feature (1)..( 15): Result.005 file - promoters50/1396147
catatttttataaat

SEQ ID NO: 169493 - DNA, 15 bp, Unknown
  misc_feature (1)..( 15): Result.005 file - promoters50/1396147
ctcgtcagtttcatc

SEQ ID NO: 169494 - DNA, 11 bp, Unknown
  misc_feature (1)..( 11): Result.005 file - promoters50/1396147
aaatttctagt

SEQ ID NO: 169495 - DNA, 11 bp, Unknown
  misc_feature (1)..( 11): Result.005 file - promoters50/1396147
ctttttctaat

SEQ ID NO: 169496 - DNA, 12 bp, Unknown
  misc_feature (1)..( 12): Result.005 file - promoters50/1396147
tcaaattcgagt

SEQ ID NO: 169497 - DNA, 11 bp, Unknown
  misc_feature (1)..( 11): Result.005 file - promoters50/1396147
aattttctggt

SEQ ID NO: 169498 - DNA, 12 bp, Unknown
  misc_feature (1)..( 12): Result.005 file - promoters50/1396147
gttttatctgtt

SEQ ID NO: 169499 - DNA, 12 bp, Unknown
  misc_feature (1)..( 12): Result.005 file - promoters50/1396147
gtttcatcaagc

SEQ ID NO: 169500 - DNA, 10 bp, Unknown
  misc_feature (1)..( 10): Result.005 file - promoters50/1396147
tatttagaaa

SEQ ID NO: 169501 - DNA, 10 bp, Unknown
  misc_feature (1)..( 10): Result.005 file - promoters50/1396147
tttttataaa

SEQ ID NO: 169502 - DNA, 10 bp, Unknown
  misc_feature (1)..( 10): Result.005 file - promoters50/1396147
tttttctaat

SEQ ID NO: 169503 - DNA, 10 bp, Unknown
  misc_feature (1)..( 10): Result.005 file - promoters50/1396147
attttctggt

SEQ ID NO: 169504 - DNA, 10 bp, Unknown
  misc_feature (1)..( 10): Result.005 file - promoters50/1396147
gttttatctg

SEQ ID NO: 169505 - DNA, 10 bp, Unknown
  misc_feature (1)..( 10): Result.005 file - promoters50/1396147
gtttcatcaa

SEQ ID NO: 169506 - DNA, 11 bp, Unknown
  misc_feature (1)..( 11): Result.005 file - promoters50/1396147
ttttttttaac

SEQ ID NO: 169507 - DNA, 11 bp, Unknown
  misc_feature (1)..( 11): Result.005 file - promoters50/1396147
atatttttata

SEQ ID NO: 169508 - DNA, 11 bp, Unknown
  misc_feature (1)..( 11): Result.005 file - promoters50/1396147
tttgttttatc

SEQ ID NO: 169509 - DNA, 11 bp, Unknown
  misc_feature (1)..( 11): Result.005 file - promoters50/1396147
ctttttctaat

SEQ ID NO: 169510 - DNA, 11 bp, Unknown
  misc_feature (1)..( 11): Result.005 file - promoters50/1396147
aattttctggt

SEQ ID NO: 169511 - DNA, 11 bp, Unknown
  misc_feature (1)..( 11): Result.005 file - promoters50/1396147
tcagtttcatc

SEQ ID NO: 169512 - DNA, 13 bp, Unknown
  misc_feature (1)..( 13): Result.005 file - promoters50/1396151
ttcaaaccctccc

SEQ ID NO: 169513 - DNA, 13 bp, Unknown
  misc_feature (1)..( 13): Result.005 file - promoters50/1396151
ttcaaaattctct

SEQ ID NO: 169514 - DNA, 13 bp, Unknown
  misc_feature (1)..( 13): Result.005 file - promoters50/1396151
ttgaatcaatatt

SEQ ID NO: 169515 - DNA, 7 bp, Unknown
  misc_feature (1)..( 7): Result.005 file - promoters50/1396151
tatttca

SEQ ID NO: 169516 - DNA, 7 bp, Unknown
  misc_feature (1)..( 7): Result.005 file - promoters50/1396151
tatttct

SEQ ID NO: 169517 - DNA, 7 bp, Unknown
  misc_feature (1)..( 7): Result.005 file - promoters50/1396151
aatttct

SEQ ID NO: 169518 - DNA, 13 bp, Unknown
  misc_feature (1)..( 13): Result.005 file - promoters50/1396151
aagaaacaagctt

SEQ ID NO: 169519 - DNA, 13 bp, Unknown
  misc_feature (1)..( 13): Result.005 file - promoters50/1396151
ttgaatcaatatt

SEQ ID NO: 169520 - DNA, 13 bp, Unknown
  misc_feature (1)..( 13): Result.005 file - promoters50/1396151
ttgattcaaaatt

SEQ ID NO: 169521 - DNA, 7 bp, Unknown
  misc_feature (1)..( 7): Result.005 file - promoters50/1396163
aattaaa

SEQ ID NO: 169522 - DNA, 7 bp, Unknown
  misc_feature (1)..( 7): Result.005 file - promoters50/1396163
gattaaa

SEQ ID NO: 169523 - DNA, 7 bp, Unknown
  misc_feature (1)..( 7): Result.005 file - promoters50/1396163
aattaaa

SEQ ID NO: 169524 - DNA, 13 bp, Unknown
  misc_feature (1)..( 13): Result.005 file - promoters50/1396182
cgttgtaatcggg

SEQ ID NO: 169525 - DNA, 13 bp, Unknown
  misc_feature (1)..( 13): Result.005 file - promoters50/1396182
agtctaaattggg

SEQ ID NO: 169526 - DNA, 13 bp, Unknown
  misc_feature (1)..( 13): Result.005 file - promoters50/1396182
ctgtgtgatcgaa

SEQ ID NO: 169527 - DNA, 13 bp, Unknown
  misc_feature (1)..( 13): Result.005 file - promoters50/1396182
gaaaatgatcgtg

SEQ ID NO: 169528 - DNA, 13 bp, Unknown
  misc_feature (1)..( 13): Result.005 file - promoters50/1396182
ctgtttgatactc

SEQ ID NO: 169529 - DNA, 12 bp, Unknown
  misc_feature (1)..( 12): Result.005 file - promoters50/1396238
aagtcaaataag

SEQ ID NO: 169530 - DNA, 12 bp, Unknown
  misc_feature (1)..( 12): Result.005 file - promoters50/1396238
cagtcaaatatg

SEQ ID NO: 169531 - DNA, 12 bp, Unknown
  misc_feature (1)..( 12): Result.005 file - promoters50/1396238
aagttaaaatta

SEQ ID NO: 169532 - DNA, 12 bp, Unknown
  misc_feature (1)..( 12): Result.005 file - promoters50/1396238
ctgtcaaagaag

SEQ ID NO: 169533 - DNA, 12 bp, Unknown
  misc_feature (1)..( 12): Result.005 file - promoters50/1396238
atgatgaagaag

SEQ ID NO: 169534 - DNA, 10 bp, Unknown
  misc_feature (1)..( 10): Result.005 file - promoters50/1396256
aaaaatgaat

SEQ ID NO: 169535 - DNA, 10 bp, Unknown
  misc_feature (1)..( 10): Result.005 file - promoters50/1396256
aaatatgtta

SEQ ID NO: 169536 - DNA, 10 bp, Unknown
  misc_feature (1)..( 10): Result.005 file - promoters50/1396256
taaaatgcta

SEQ ID NO: 169537 - DNA, 10 bp, Unknown
  misc_feature (1)..( 10): Result.005 file - promoters50/1396256
atataagttt

SEQ ID NO: 169538 - DNA, 10 bp, Unknown
  misc_feature (1)..( 10): Result.005 file - promoters50/1396256
atttaacttt

SEQ ID NO: 169539 - DNA, 10 bp, Unknown
  misc_feature (1)..( 10): Result.005 file - promoters50/1396256
ataaatgcta

SEQ ID NO: 169540 - DNA, 9 bp, Unknown
  misc_feature (1)..( 9): Result.005 file - promoters50/1396285
ttttccttt

SEQ ID NO: 169541 - DNA, 9 bp, Unknown
  misc_feature (1)..( 9): Result.005 file - promoters50/1396285
tttttctta

SEQ ID NO: 169542 - DNA, 10 bp, Unknown
  misc_feature (1)..( 10): Result.005 file - promoters50/1396285
ttctccatta

SEQ ID NO: 169543 - DNA, 10 bp, Unknown
  misc_feature (1)..( 10): Result.005 file - promoters50/1396285
tttttcctgc

SEQ ID NO: 169544 - DNA, 9 bp, Unknown
  misc_feature (1)..( 9): Result.005 file - promoters50/1396285
tatttttgt

SEQ ID NO: 169545 - DNA, 9 bp, Unknown
  misc_feature (1)..( 9): Result.005 file - promoters50/1396285
tattttaca

SEQ ID NO: 169546 - DNA, 10 bp, Unknown
  misc_feature (1)..( 10): Result.005 file - promoters50/1396285
tactttttta

SEQ ID NO: 169547 - DNA, 10 bp, Unknown
  misc_feature (1)..( 10): Result.005 file - promoters50/1396285
ttgtttatta

SEQ ID NO: 169548 - DNA, 8 bp, Unknown
  misc_feature (1)..( 8): Result.005 file - promoters50/1396285
attaaatc

SEQ ID NO: 169549 - DNA, 8 bp, Unknown
  misc_feature (1)..( 8): Result.005 file - promoters50/1396285
cataaatc

SEQ ID NO: 169550 - DNA, 8 bp, Unknown
  misc_feature (1)..( 8): Result.005 file - promoters50/1396285
attaaatt

SEQ ID NO: 169551 - DNA, 8 bp, Unknown
  misc_feature (1)..( 8): Result.005 file - promoters50/1396285
tttaaata

SEQ ID NO: 169552 - DNA, 10 bp, Unknown
  misc_feature (1)..( 10): Result.005 file - promoters50/1396285
tctaaaatat

SEQ ID NO: 169553 - DNA, 10 bp, Unknown
  misc_feature (1)..( 10): Result.005 file - promoters50/1396285
cacaaattat

SEQ ID NO: 169554 - DNA, 10 bp, Unknown
  misc_feature (1)..( 10): Result.005 file - promoters50/1396285
taaaaaatag

SEQ ID NO: 169555 - DNA, 10 bp, Unknown
  misc_feature (1)..( 10): Result.005 file - promoters50/1396285
tcttaaataa

SEQ ID NO: 169556 - DNA, 7 bp, Unknown
  misc_feature (1)..( 7): Result.005 file - promoters50/1396296
gatgatt

SEQ ID NO: 169557 - DNA, 7 bp, Unknown
  misc_feature (1)..( 7): Result.005 file - promoters50/1396296
catgatt

SEQ ID NO: 169558 - DNA, 7 bp, Unknown
  misc_feature (1)..( 7): Result.005 file - promoters50/1396296
gatgatc

SEQ ID NO: 169559 - DNA, 7 bp, Unknown
  misc_feature (1)..( 7): Result.005 file - promoters50/1396296
ttttttt

SEQ ID NO: 169560 - DNA, 7 bp, Unknown
  misc_feature (1)..( 7): Result.005 file - promoters50/1396296
tttgttt

SEQ ID NO: 169561 - DNA, 7 bp, Unknown
  misc_feature (1)..( 7): Result.005 file - promoters50/1396296
ttttttc

SEQ ID NO: 169562 - DNA, 7 bp, Unknown
  misc_feature (1)..( 7): Result.005 file - promoters50/1396296
tttgaat

SEQ ID NO: 169563 - DNA, 7 bp, Unknown
  misc_feature (1)..( 7): Result.005 file - promoters50/1396296
tttgaag

SEQ ID NO: 169564 - DNA, 7 bp, Unknown
  misc_feature (1)..( 7): Result.005 file - promoters50/1396296
tttcaag

SEQ ID NO: 169565 - DNA, 12 bp, Unknown
  misc_feature (1)..( 12): Result.005 file - promoters50/1396308
gacgaaaaaggg

SEQ ID NO: 169566 - DNA, 9 bp, Unknown
  misc_feature (1)..( 9): Result.005 file - promoters50/1396308
taaaaagtc

SEQ ID NO: 169567 - DNA, 12 bp, Unknown
  misc_feature (1)..( 12): Result.005 file - promoters50/1396308
gaccaaaaaaag

SEQ ID NO: 169568 - DNA, 9 bp, Unknown
  misc_feature (1)..( 9): Result.005 file - promoters50/1396308
taaaaatga

SEQ ID NO: 169569 - DNA, 12 bp, Unknown
  misc_feature (1)..( 12): Result.005 file - promoters50/1396308
gtccaaaaatct

SEQ ID NO: 169570 - DNA, 12 bp, Unknown
  misc_feature (1)..( 12): Result.005 file - promoters50/1396308
gaccaagaatct

SEQ ID NO: 169571 - DNA, 11 bp, Unknown
  misc_feature (1)..( 11): Result.005 file - promoters50/1396308
taattttgtat

SEQ ID NO: 169572 - DNA, 11 bp, Unknown
  misc_feature (1)..( 11): Result.005 file - promoters50/1396308
tgtttttgttt

SEQ ID NO: 169573 - DNA, 11 bp, Unknown
  misc_feature (1)..( 11): Result.005 file - promoters50/1396308
taaatttgttt

SEQ ID NO: 169574 - DNA, 11 bp, Unknown
  misc_feature (1)..( 11): Result.005 file - promoters50/1396308
tgactttgttg

SEQ ID NO: 169575 - DNA, 11 bp, Unknown
  misc_feature (1)..( 11): Result.005 file - promoters50/1396308
ctgatttattt

SEQ ID NO: 169576 - DNA, 11 bp, Unknown
  misc_feature (1)..( 11): Result.005 file - promoters50/1396308
aaaatttgcta

SEQ ID NO: 169577 - DNA, 10 bp, Unknown
  misc_feature (1)..( 10): Result.005 file - promoters50/1396308
taatttatgt

SEQ ID NO: 169578 - DNA, 10 bp, Unknown
  misc_feature (1)..( 10): Result.005 file - promoters50/1396308
atatttattt

SEQ ID NO: 169579 - DNA, 10 bp, Unknown
  misc_feature (1)..( 10): Result.005 file - promoters50/1396308
tgatttattt

SEQ ID NO: 169580 - DNA, 10 bp, Unknown
  misc_feature (1)..( 10): Result.005 file - promoters50/1396308
aaatatatat

SEQ ID NO: 169581 - DNA, 10 bp, Unknown
  misc_feature (1)..( 10): Result.005 file - promoters50/1396308
aaatttgttt

SEQ ID NO: 169582 - DNA, 10 bp, Unknown
  misc_feature (1)..( 10): Result.005 file - promoters50/1396308
aaatttgcta

SEQ ID NO: 169583 - DNA, 9 bp, Unknown
  misc_feature (1)..( 9): Result.005 file - promoters50/1396308
ttattatac

SEQ ID NO: 169584 - DNA, 9 bp, Unknown
  misc_feature (1)..( 9): Result.005 file - promoters50/1396308
atataataa

SEQ ID NO: 169585 - DNA, 9 bp, Unknown
  misc_feature (1)..( 9): Result.005 file - promoters50/1396308
atataataa

SEQ ID NO: 169586 - DNA, 9 bp, Unknown
  misc_feature (1)..( 9): Result.005 file - promoters50/1396308
ttataatgt

SEQ ID NO: 169587 - DNA, 9 bp, Unknown
  misc_feature (1)..( 9): Result.005 file - promoters50/1396308
atataaaat

SEQ ID NO: 169588 - DNA, 9 bp, Unknown
  misc_feature (1)..( 9): Result.005 file - promoters50/1396308
gtttaataa

SEQ ID NO: 169589 - DNA, 9 bp, Unknown
  misc_feature (1)..( 9): Result.005 file - promoters50/1396308
atataacaa

SEQ ID NO: 169590 - DNA, 11 bp, Unknown
  misc_feature (1)..( 11): Result.005 file - promoters50/1396308
ttgatccaaac

SEQ ID NO: 169591 - DNA, 11 bp, Unknown
  misc_feature (1)..( 11): Result.005 file - promoters50/1396308
tcaatcaaaag

SEQ ID NO: 169592 - DNA, 11 bp, Unknown
  misc_feature (1)..( 11): Result.005 file - promoters50/1396308
attatcctaac

SEQ ID NO: 169593 - DNA, 11 bp, Unknown
  misc_feature (1)..( 11): Result.005 file - promoters50/1396308
caaatcaaatt

SEQ ID NO: 169594 - DNA, 11 bp, Unknown
  misc_feature (1)..( 11): Result.005 file - promoters50/1396308
cctttcaaata

SEQ ID NO: 169595 - DNA, 11 bp, Unknown
  misc_feature (1)..( 11): Result.005 file - promoters50/1396308
tcaattaaaag

SEQ ID NO: 169596 - DNA, 11 bp, Unknown
  misc_feature (1)..( 11): Result.005 file - promoters50/1396308
ggtgtaaacga

SEQ ID NO: 169597 - DNA, 11 bp, Unknown
  misc_feature (1)..( 11): Result.005 file - promoters50/1396308
tttgtcaacga

SEQ ID NO: 169598 - DNA, 11 bp, Unknown
  misc_feature (1)..( 11): Result.005 file - promoters50/1396308
ggtgtaatgct

SEQ ID NO: 169599 - DNA, 11 bp, Unknown
  misc_feature (1)..( 11): Result.005 file - promoters50/1396308
tcttttatcac

SEQ ID NO: 169600 - DNA, 11 bp, Unknown
  misc_feature (1)..( 11): Result.005 file - promoters50/1396308
tgtttgccaaa

SEQ ID NO: 169601 - DNA, 11 bp, Unknown
  misc_feature (1)..( 11): Result.005 file - promoters50/1396308
cgtataacaat

SEQ ID NO: 169602 - DNA, 11 bp, Unknown
  misc_feature (1)..( 11): Result.005 file - promoters50/1396308
ataaaaaataa

SEQ ID NO: 169603 - DNA, 11 bp, Unknown
  misc_feature (1)..( 11): Result.005 file - promoters50/1396308
gcctaaaatat

SEQ ID NO: 169604 - DNA, 11 bp, Unknown
  misc_feature (1)..( 11): Result.005 file - promoters50/1396308
ataataaatag

SEQ ID NO: 169605 - DNA, 11 bp, Unknown
  misc_feature (1)..( 11): Result.005 file - promoters50/1396308
atctcaaataa

SEQ ID NO: 169606 - DNA, 11 bp, Unknown
  misc_feature (1)..( 11): Result.005 file - promoters50/1396308
ataacaaatca

SEQ ID NO: 169607 - DNA, 11 bp, Unknown
  misc_feature (1)..( 11): Result.005 file - promoters50/1396308
ataacaatttg

SEQ ID NO: 169608 - DNA, 11 bp, Unknown
  misc_feature (1)..( 11): Result.005 file - promoters50/1396308
tataatagtaa

SEQ ID NO: 169609 - DNA, 11 bp, Unknown
  misc_feature (1)..( 11): Result.005 file - promoters50/1396308
cataataaata

SEQ ID NO: 169610 - DNA, 11 bp, Unknown
  misc_feature (1)..( 11): Result.005 file - promoters50/1396308
tataatataat

SEQ ID NO: 169611 - DNA, 11 bp, Unknown
  misc_feature (1)..( 11): Result.005 file - promoters50/1396308
tataatgaatt

SEQ ID NO: 169612 - DNA, 11 bp, Unknown
  misc_feature (1)..( 11): Result.005 file - promoters50/1396308
aataaggaatt

SEQ ID NO: 169613 - DNA, 11 bp, Unknown
  misc_feature (1)..( 11): Result.005 file - promoters50/1396308
gatagtgaacc

SEQ ID NO: 169614 - DNA, 12 bp, Unknown
  misc_feature (1)..( 12): Result.005 file - promoters50/1396312
aaaaataaataa

SEQ ID NO: 169615 - DNA, 12 bp, Unknown
  misc_feature (1)..( 12): Result.005 file - promoters50/1396312
attaataaagct

SEQ ID NO: 169616 - DNA, 12 bp, Unknown
  misc_feature (1)..( 12): Result.005 file - promoters50/1396312
ttaaataaagca

SEQ ID NO: 169617 - DNA, 12 bp, Unknown
  misc_feature (1)..( 12): Result.005 file - promoters50/1396312
gaaaattaactc

SEQ ID NO: 169618 - DNA, 12 bp, Unknown
  misc_feature (1)..( 12): Result.005 file - promoters50/1396312
gaaaattccttt

SEQ ID NO: 169619 - DNA, 12 bp, Unknown
  misc_feature (1)..( 12): Result.005 file - promoters50/1396312
ttatattatata

SEQ ID NO: 169620 - DNA, 12 bp, Unknown
  misc_feature (1)..( 12): Result.005 file - promoters50/1396312
aatattaacctt

SEQ ID NO: 169621 - DNA, 12 bp, Unknown
  misc_feature (1)..( 12): Result.005 file - promoters50/1396312
attattaacatt

SEQ ID NO: 169622 - DNA, 12 bp, Unknown
  misc_feature (1)..( 12): Result.005 file - promoters50/1396312
gtttttaacctt

SEQ ID NO: 169623 - DNA, 12 bp, Unknown
  misc_feature (1)..( 12): Result.005 file - promoters50/1396312
atttttaattca

SEQ ID NO: 169624 - DNA, 12 bp, Unknown
  misc_feature (1)..( 12): Result.005 file - promoters50/1396312
cacatttacatc

SEQ ID NO: 169625 - DNA, 12 bp, Unknown
  misc_feature (1)..( 12): Result.005 file - promoters50/1396312
ttttttaacaaa

SEQ ID NO: 169626 - DNA, 10 bp, Unknown
  misc_feature (1)..( 10): Result.005 file - promoters50/1396312
taacgaaaaa

SEQ ID NO: 169627 - DNA, 10 bp, Unknown
  misc_feature (1)..( 10): Result.005 file - promoters50/1396312
aaacaaaaaa

SEQ ID NO: 169628 - DNA, 10 bp, Unknown
  misc_feature (1)..( 10): Result.005 file - promoters50/1396312
aaacatataa

SEQ ID NO: 169629 - DNA, 10 bp, Unknown
  misc_feature (1)..( 10): Result.005 file - promoters50/1396312
tcccaaaaac

SEQ ID NO: 169630 - DNA, 10 bp, Unknown
  misc_feature (1)..( 10): Result.005 file - promoters50/1396312
cgtcaaaaaa

SEQ ID NO: 169631 - DNA, 10 bp, Unknown
  misc_feature (1)..( 10): Result.005 file - promoters50/1396312
atacaaatag

SEQ ID NO: 169632 - DNA, 12 bp, Unknown
  misc_feature (1)..( 12): Result.005 file - promoters50/1396312
ttcttaaacaaa

SEQ ID NO: 169633 - DNA, 12 bp, Unknown
  misc_feature (1)..( 12): Result.005 file - promoters50/1396312
ttctgaaacttc

SEQ ID NO: 169634 - DNA, 12 bp, Unknown
  misc_feature (1)..( 12): Result.005 file - promoters50/1396312
ttaagaaactaa

SEQ ID NO: 169635 - DNA, 12 bp, Unknown
  misc_feature (1)..( 12): Result.005 file - promoters50/1396312
tcaggaaaataa

SEQ ID NO: 169636 - DNA, 12 bp, Unknown
  misc_feature (1)..( 12): Result.005 file - promoters50/1396312
attggaaaaagg

SEQ ID NO: 169637 - DNA, 12 bp, Unknown
  misc_feature (1)..( 12): Result.005 file - promoters50/1396312
tactgaaaaaga

SEQ ID NO: 169638 - DNA, 7 bp, Unknown
  misc_feature (1)..( 7): Result.005 file - promoters50/1396320
tttcagt

SEQ ID NO: 169639 - DNA, 7 bp, Unknown
  misc_feature (1)..( 7): Result.005 file - promoters50/1396320
cttcagt

SEQ ID NO: 169640 - DNA, 7 bp, Unknown
  misc_feature (1)..( 7): Result.005 file - promoters50/1396320
cttcaga

SEQ ID NO: 169641 - DNA, 9 bp, Unknown
  misc_feature (1)..( 9): Result.005 file - promoters50/1396354
aatatatac

SEQ ID NO: 169642 - DNA, 9 bp, Unknown
  misc_feature (1)..( 9): Result.005 file - promoters50/1396354
tctatataa

SEQ ID NO: 169643 - DNA, 9 bp, Unknown
  misc_feature (1)..( 9): Result.005 file - promoters50/1396354
aatatatat

SEQ ID NO: 169644 - DNA, 9 bp, Unknown
  misc_feature (1)..( 9): Result.005 file - promoters50/1396354
cataaatac

SEQ ID NO: 169645 - DNA, 9 bp, Unknown
  misc_feature (1)..( 9): Result.005 file - promoters50/1396354
actatttaa

SEQ ID NO: 169646 - DNA, 9 bp, Unknown
  misc_feature (1)..( 9): Result.005 file - promoters50/1396354
cctagttac

SEQ ID NO: 169647 - DNA, 13 bp, Unknown
  misc_feature (1)..( 13): Result.005 file - promoters50/1396364
tagttgattcgtt

SEQ ID NO: 169648 - DNA, 13 bp, Unknown
  misc_feature (1)..( 13): Result.005 file - promoters50/1396364
atttttatttgtt

SEQ ID NO: 169649 - DNA, 13 bp, Unknown
  misc_feature (1)..( 13): Result.005 file - promoters50/1396364
tagtttattcgag

SEQ ID NO: 169650 - DNA, 14 bp, Unknown
  misc_feature (1)..( 14): Result.005 file - promoters50/1396364
tgaaatgtttagtt

SEQ ID NO: 169651 - DNA, 8 bp, Unknown
  misc_feature (1)..( 8): Result.005 file - promoters50/1396364
tattaatg

SEQ ID NO: 169652 - DNA, 8 bp, Unknown
  misc_feature (1)..( 8): Result.005 file - promoters50/1396364
tattaata

SEQ ID NO: 169653 - DNA, 8 bp, Unknown
  misc_feature (1)..( 8): Result.005 file - promoters50/1396364
agttaatg

SEQ ID NO: 169654 - DNA, 8 bp, Unknown
  misc_feature (1)..( 8): Result.005 file - promoters50/1396364
ggttaatt

SEQ ID NO: 169655 - DNA, 7 bp, Unknown
  misc_feature (1)..( 7): Result.005 file - promoters50/1396364
aatatta

SEQ ID NO: 169656 - DNA, 7 bp, Unknown
  misc_feature (1)..( 7): Result.005 file - promoters50/1396364
aatattt

SEQ ID NO: 169657 - DNA, 7 bp, Unknown
  misc_feature (1)..( 7): Result.005 file - promoters50/1396364
aatgttt

SEQ ID NO: 169658 - DNA, 7 bp, Unknown
  misc_feature (1)..( 7): Result.005 file - promoters50/1396364
aatgttt

SEQ ID NO: 169659 - DNA, 8 bp, Unknown
  misc_feature (1)..( 8): Result.005 file - promoters50/1396364
tttagtgg

SEQ ID NO: 169660 - DNA, 8 bp, Unknown
  misc_feature (1)..( 8): Result.005 file - promoters50/1396364
tttagttt

SEQ ID NO: 169661 - DNA, 8 bp, Unknown
  misc_feature (1)..( 8): Result.005 file - promoters50/1396364
tttagtta

SEQ ID NO: 169662 - DNA, 8 bp, Unknown
  misc_feature (1)..( 8): Result.005 file - promoters50/1396364
cttatttt

SEQ ID NO: 169663 - DNA, 11 bp, Unknown
  misc_feature (1)..( 11): Result.005 file - promoters50/1396364
tacgtaacatg

SEQ ID NO: 169664 - DNA, 11 bp, Unknown
  misc_feature (1)..( 11): Result.005 file - promoters50/1396364
tacgttacaat

SEQ ID NO: 169665 - DNA, 11 bp, Unknown
  misc_feature (1)..( 11): Result.005 file - promoters50/1396364
gtattaatatg

SEQ ID NO: 169666 - DNA, 11 bp, Unknown
  misc_feature (1)..( 11): Result.005 file - promoters50/1396364
tacgttttttt

SEQ ID NO: 169667 - DNA, 9 bp, Unknown
  misc_feature (1)..( 9): Result.005 file - promoters50/1396383
gttaattta

SEQ ID NO: 169668 - DNA, 9 bp, Unknown
  misc_feature (1)..( 9): Result.005 file - promoters50/1396383
gttgattat

SEQ ID NO: 169669 - DNA, 9 bp, Unknown
  misc_feature (1)..( 9): Result.005 file - promoters50/1396383
tataattta

SEQ ID NO: 169670 - DNA, 8 bp, Unknown
  misc_feature (1)..( 8): Result.005 file - promoters50/1396399
taatgatg

SEQ ID NO: 169671 - DNA, 8 bp, Unknown
  misc_feature (1)..( 8): Result.005 file - promoters50/1396399
taatgaat

SEQ ID NO: 169672 - DNA, 8 bp, Unknown
  misc_feature (1)..( 8): Result.005 file - promoters50/1396399
taattaat

SEQ ID NO: 169673 - DNA, 11 bp, Unknown
  misc_feature (1)..( 11): Result.005 file - promoters50/1396407
aaaagaaaaac

SEQ ID NO: 169674 - DNA, 11 bp, Unknown
  misc_feature (1)..( 11): Result.005 file - promoters50/1396407
gaaagaatcaa

SEQ ID NO: 169675 - DNA, 11 bp, Unknown
  misc_feature (1)..( 11): Result.005 file - promoters50/1396407
gaaggaaacaa

SEQ ID NO: 169676 - DNA, 10 bp, Unknown
  misc_feature (1)..( 10): Result.005 file - promoters50/1396425
aataatttga

SEQ ID NO: 169677 - DNA, 10 bp, Unknown
  misc_feature (1)..( 10): Result.005 file - promoters50/1396425
ttgcatttga

SEQ ID NO: 169678 - DNA, 10 bp, Unknown
  misc_feature (1)..( 10): Result.005 file - promoters50/1396425
ttgaatttga

SEQ ID NO: 169679 - DNA, 7 bp, Unknown
  misc_feature (1)..( 7): Result.005 file - promoters50/1396425
agtgact

SEQ ID NO: 169680 - DNA, 7 bp, Unknown
  misc_feature (1)..( 7): Result.005 file - promoters50/1396425
agtgact

SEQ ID NO: 169681 - DNA, 7 bp, Unknown
  misc_feature (1)..( 7): Result.005 file - promoters50/1396425
agttact

SEQ ID NO: 169682 - DNA, 7 bp, Unknown
  misc_feature (1)..( 7): Result.005 file - promoters50/1396425
atagaat

SEQ ID NO: 169683 - DNA, 7 bp, Unknown
  misc_feature (1)..( 7): Result.005 file - promoters50/1396425
ataaaat

SEQ ID NO: 169684 - DNA, 7 bp, Unknown
  misc_feature (1)..( 7): Result.005 file - promoters50/1396425
ataaaat

SEQ ID NO: 169685 - DNA, 10 bp, Unknown
  misc_feature (1)..( 10): Result.005 file - promoters50/1396425
gttaatttgg

SEQ ID NO: 169686 - DNA, 10 bp, Unknown
  misc_feature (1)..( 10): Result.005 file - promoters50/1396425
ttgaatttga

SEQ ID NO: 169687 - DNA, 10 bp, Unknown
  misc_feature (1)..( 10): Result.005 file - promoters50/1396425
ttgcatttga

SEQ ID NO: 169688 - DNA, 7 bp, Unknown
  misc_feature (1)..( 7): Result.005 file - promoters50/1396425
cactatt

SEQ ID NO: 169689 - DNA, 7 bp, Unknown
  misc_feature (1)..( 7): Result.005 file - promoters50/1396425
caccatt

SEQ ID NO: 169690 - DNA, 7 bp, Unknown
  misc_feature (1)..( 7): Result.005 file - promoters50/1396425
aaccatt

SEQ ID NO: 169691 - DNA, 8 bp, Unknown
  misc_feature (1)..( 8): Result.005 file - promoters50/1396425
taattcaa

SEQ ID NO: 169692 - DNA, 8 bp, Unknown
  misc_feature (1)..( 8): Result.005 file - promoters50/1396425
taattctt

SEQ ID NO: 169693 - DNA, 8 bp, Unknown
  misc_feature (1)..( 8): Result.005 file - promoters50/1396425
caattctt

SEQ ID NO: 169694 - DNA, 10 bp, Unknown
  misc_feature (1)..( 10): Result.005 file - promoters50/1396462
taaaaagtaa

SEQ ID NO: 169695 - DNA, 10 bp, Unknown
  misc_feature (1)..( 10): Result.005 file - promoters50/1396462
taataagtaa

SEQ ID NO: 169696 - DNA, 10 bp, Unknown
  misc_feature (1)..( 10): Result.005 file - promoters50/1396462
taaaaatatc

SEQ ID NO: 169697 - DNA, 10 bp, Unknown
  misc_feature (1)..( 10): Result.005 file - promoters50/1396462
aaacaaattt

SEQ ID NO: 169698 - DNA, 10 bp, Unknown
  misc_feature (1)..( 10): Result.005 file - promoters50/1396462
aaagaaagct

SEQ ID NO: 169699 - DNA, 10 bp, Unknown
  misc_feature (1)..( 10): Result.005 file - promoters50/1396462
ctacaatttt

SEQ ID NO: 169700 - DNA, 9 bp, Unknown
  misc_feature (1)..( 9): Result.005 file - promoters50/1396462
ttttgaaaa

SEQ ID NO: 169701 - DNA, 9 bp, Unknown
  misc_feature (1)..( 9): Result.005 file - promoters50/1396462
tttggaaaa

SEQ ID NO: 169702 - DNA, 9 bp, Unknown
  misc_feature (1)..( 9): Result.005 file - promoters50/1396462
ccttgaaac

SEQ ID NO: 169703 - DNA, 9 bp, Unknown
  misc_feature (1)..( 9): Result.005 file - promoters50/1396462
tgaaaaaaa

SEQ ID NO: 169704 - DNA, 9 bp, Unknown
  misc_feature (1)..( 9): Result.005 file - promoters50/1396462
gaaaagaaa

SEQ ID NO: 169705 - DNA, 10 bp, Unknown
  misc_feature (1)..( 10): Result.005 file - promoters50/1396462
ggaaatgaaa

SEQ ID NO: 169706 - DNA, 11 bp, Unknown
  misc_feature (1)..( 11): Result.005 file - promoters50/1396462
aaaaaaaaagt

SEQ ID NO: 169707 - DNA, 11 bp, Unknown
  misc_feature (1)..( 11): Result.005 file - promoters50/1396462
aaaataaaata

SEQ ID NO: 169708 - DNA, 11 bp, Unknown
  misc_feature (1)..( 11): Result.005 file - promoters50/1396462
gaaatgaaata

SEQ ID NO: 169709 - DNA, 9 bp, Unknown
  misc_feature (1)..( 9): Result.005 file - promoters50/1396462
aaaaggaaa

SEQ ID NO: 169710 - DNA, 9 bp, Unknown
  misc_feature (1)..( 9): Result.005 file - promoters50/1396462
aaaaggaga

SEQ ID NO: 169711 - DNA, 9 bp, Unknown
  misc_feature (1)..( 9): Result.005 file - promoters50/1396462
taaagtaaa

SEQ ID NO: 169712 - DNA, 14 bp, Unknown
  misc_feature (1)..( 14): Result.005 file - promoters50/1396469
ttttttatagatta

SEQ ID NO: 169713 - DNA, 14 bp, Unknown
  misc_feature (1)..( 14): Result.005 file - promoters50/1396469
ttttctataaatta

SEQ ID NO: 169714 - DNA, 14 bp, Unknown
  misc_feature (1)..( 14): Result.005 file - promoters50/1396469
ctttatatagagac

SEQ ID NO: 169715 - DNA, 14 bp, Unknown
  misc_feature (1)..( 14): Result.005 file - promoters50/1396469
agagctaaaaacgg

SEQ ID NO: 169716 - DNA, 14 bp, Unknown
  misc_feature (1)..( 14): Result.005 file - promoters50/1396469
tcagatatacattg

SEQ ID NO: 169717 - DNA, 12 bp, Unknown
  misc_feature (1)..( 12): Result.005 file - promoters50/1396469
aatcacatatta

SEQ ID NO: 169718 - DNA, 12 bp, Unknown
  misc_feature (1)..( 12): Result.005 file - promoters50/1396469
actcatatatat

SEQ ID NO: 169719 - DNA, 12 bp, Unknown
  misc_feature (1)..( 12): Result.005 file - promoters50/1396469
acgtatatataa

SEQ ID NO: 169720 - DNA, 12 bp, Unknown
  misc_feature (1)..( 12): Result.005 file - promoters50/1396469
actcatatatat

SEQ ID NO: 169721 - DNA, 12 bp, Unknown
  misc_feature (1)..( 12): Result.005 file - promoters50/1396469
tacaatataaac

SEQ ID NO: 169722 - DNA, 13 bp, Unknown
  misc_feature (1)..( 13): Result.005 file - promoters50/1396469
tcacatattaaca

SEQ ID NO: 169723 - DNA, 13 bp, Unknown
  misc_feature (1)..( 13): Result.005 file - promoters50/1396469
tacaatataaaca

SEQ ID NO: 169724 - DNA, 13 bp, Unknown
  misc_feature (1)..( 13): Result.005 file - promoters50/1396469
tcatatatataca

SEQ ID NO: 169725 - DNA, 13 bp, Unknown
  misc_feature (1)..( 13): Result.005 file - promoters50/1396469
acgtatatataaa

SEQ ID NO: 169726 - DNA, 13 bp, Unknown
  misc_feature (1)..( 13): Result.005 file - promoters50/1396469
actcatatatatc

SEQ ID NO: 169727 - DNA, 15 bp, Unknown
  misc_feature (1)..( 15): Result.005 file - promoters50/1396469
acaaacattaagatg

SEQ ID NO: 169728 - DNA, 15 bp, Unknown
  misc_feature (1)..( 15): Result.005 file - promoters50/1396469
acaaactttttttac

SEQ ID NO: 169729 - DNA, 15 bp, Unknown
  misc_feature (1)..( 15): Result.005 file - promoters50/1396469
tcaaattttttttct

SEQ ID NO: 169730 - DNA, 15 bp, Unknown
  misc_feature (1)..( 15): Result.005 file - promoters50/1396469
ttgacttttctttct

SEQ ID NO: 169731 - DNA, 15 bp, Unknown
  misc_feature (1)..( 15): Result.005 file - promoters50/1396469
accaatttttagtca

SEQ ID NO: 169732 - DNA, 9 bp, Unknown
  misc_feature (1)..( 9): Result.005 file - promoters50/1396469
cgaactaat

SEQ ID NO: 169733 - DNA, 9 bp, Unknown
  misc_feature (1)..( 9): Result.005 file - promoters50/1396469
cgaactaaa

SEQ ID NO: 169734 - DNA, 9 bp, Unknown
  misc_feature (1)..( 9): Result.005 file - promoters50/1396469
acaactaaa

SEQ ID NO: 169735 - DNA, 9 bp, Unknown
  misc_feature (1)..( 9): Result.005 file - promoters50/1396469
cctactaaa

SEQ ID NO: 169736 - DNA, 9 bp, Unknown
  misc_feature (1)..( 9): Result.005 file - promoters50/1396469
tatacgaaa

SEQ ID NO: 169737 - DNA, 10 bp, Unknown
  misc_feature (1)..( 10): Result.005 file - promoters50/1396482
aaaccaatat

SEQ ID NO: 169738 - DNA, 10 bp, Unknown
  misc_feature (1)..( 10): Result.005 file - promoters50/1396482
aaaacaaaac

SEQ ID NO: 169739 - DNA, 10 bp, Unknown
  misc_feature (1)..( 10): Result.005 file - promoters50/1396482
ataacaaata

SEQ ID NO: 169740 - DNA, 10 bp, Unknown
  misc_feature (1)..( 10): Result.005 file - promoters50/1396482
gaaccaatct

SEQ ID NO: 169741 - DNA, 10 bp, Unknown
  misc_feature (1)..( 10): Result.005 file - promoters50/1396482
aaaacacaaa

SEQ ID NO: 169742 - DNA, 10 bp, Unknown
  misc_feature (1)..( 10): Result.005 file - promoters50/1396482
ccgccattct

SEQ ID NO: 169743 - DNA, 7 bp, Unknown
  misc_feature (1)..( 7): Result.005 file - promoters50/1396519
atataaa

SEQ ID NO: 169744 - DNA, 7 bp, Unknown
  misc_feature (1)..( 7): Result.005 file - promoters50/1396519
atataaa

SEQ ID NO: 169745 - DNA, 7 bp, Unknown
  misc_feature (1)..( 7): Result.005 file - promoters50/1396519
atataat

SEQ ID NO: 169746 - DNA, 8 bp, Unknown
  misc_feature (1)..( 8): Result.005 file - promoters50/1396519
aaaatttt

SEQ ID NO: 169747 - DNA, 8 bp, Unknown
  misc_feature (1)..( 8): Result.005 file - promoters50/1396519
aaacttta

SEQ ID NO: 169748 - DNA, 8 bp, Unknown
  misc_feature (1)..( 8): Result.005 file - promoters50/1396519
gtaatttt

SEQ ID NO: 169749 - DNA, 10 bp, Unknown
  misc_feature (1)..( 10): Result.005 file - promoters50/1396519
ccaaaacatc

SEQ ID NO: 169750 - DNA, 10 bp, Unknown
  misc_feature (1)..( 10): Result.005 file - promoters50/1396519
ctaaaatatc

SEQ ID NO: 169751 - DNA, 10 bp, Unknown
  misc_feature (1)..( 10): Result.005 file - promoters50/1396519
ctagaattct

SEQ ID NO: 169752 - DNA, 13 bp, Unknown
  misc_feature (1)..( 13): Result.005 file - promoters50/1396519
acattttcagata

SEQ ID NO: 169753 - DNA, 13 bp, Unknown
  misc_feature (1)..( 13): Result.005 file - promoters50/1396519
acatttttagata

SEQ ID NO: 169754 - DNA, 13 bp, Unknown
  misc_feature (1)..( 13): Result.005 file - promoters50/1396519
gttaatttacata

SEQ ID NO: 169755 - DNA, 9 bp, Unknown
  misc_feature (1)..( 9): Result.005 file - promoters50/1396539
ttcttcctt

SEQ ID NO: 169756 - DNA, 9 bp, Unknown
  misc_feature (1)..( 9): Result.005 file - promoters50/1396539
ttcttcagt

SEQ ID NO: 169757 - DNA, 9 bp, Unknown
  misc_feature (1)..( 9): Result.005 file - promoters50/1396539
ctcttaagt

SEQ ID NO: 169758 - DNA, 9 bp, Unknown
  misc_feature (1)..( 9): Result.005 file - promoters50/1396665
atttatttt

SEQ ID NO: 169759 - DNA, 9 bp, Unknown
  misc_feature (1)..( 9): Result.005 file - promoters50/1396665
aattatttt

SEQ ID NO: 169760 - DNA, 9 bp, Unknown
  misc_feature (1)..( 9): Result.005 file - promoters50/1396665
aatcattct

SEQ ID NO: 169761 - DNA, 8 bp, Unknown
  misc_feature (1)..( 8): Result.005 file - promoters50/1396665
taaaactt

SEQ ID NO: 169762 - DNA, 8 bp, Unknown
  misc_feature (1)..( 8): Result.005 file - promoters50/1396665
aaaaactt

SEQ ID NO: 169763 - DNA, 9 bp, Unknown
  misc_feature (1)..( 9): Result.005 file - promoters50/1396665
aaacaactg

SEQ ID NO: 169764 - DNA, 10 bp, Unknown
  misc_feature (1)..( 10): Result.005 file - promoters50/1396721
tgagattgaa

SEQ ID NO: 169765 - DNA, 10 bp, Unknown
  misc_feature (1)..( 10): Result.005 file - promoters50/1396721
aagaattgaa

SEQ ID NO: 169766 - DNA, 10 bp, Unknown
  misc_feature (1)..( 10): Result.005 file - promoters50/1396721
tgagagtgat

SEQ ID NO: 169767 - DNA, 11 bp, Unknown
  misc_feature (1)..( 11): Result.005 file - promoters50/1396721
catgacttcat

SEQ ID NO: 169768 - DNA, 11 bp, Unknown
  misc_feature (1)..( 11): Result.005 file - promoters50/1396721
tgtgactccat

SEQ ID NO: 169769 - DNA, 11 bp, Unknown
  misc_feature (1)..( 11): Result.005 file - promoters50/1396721
cattactataa

SEQ ID NO: 169770 - DNA, 9 bp, Unknown
  misc_feature (1)..( 9): Result.005 file - promoters50/1396767
taaacaaaa

SEQ ID NO: 169771 - DNA, 9 bp, Unknown
  misc_feature (1)..( 9): Result.005 file - promoters50/1396767
caaactaaa

SEQ ID NO: 169772 - DNA, 9 bp, Unknown
  misc_feature (1)..( 9): Result.005 file - promoters50/1396767
caagctaga

SEQ ID NO: 169773 - DNA, 8 bp, Unknown
  misc_feature (1)..( 8): Result.005 file - promoters50/1396767
gttagaaa

SEQ ID NO: 169774 - DNA, 8 bp, Unknown
  misc_feature (1)..( 8): Result.005 file - promoters50/1396767
cttacaaa

SEQ ID NO: 169775 - DNA, 8 bp, Unknown
  misc_feature (1)..( 8): Result.005 file - promoters50/1396767
cttacatt

SEQ ID NO: 169776 - DNA, 11 bp, Unknown
  misc_feature (1)..( 11): Result.005 file - promoters50/1396816
tatctcacaat

SEQ ID NO: 169777 - DNA, 11 bp, Unknown
  misc_feature (1)..( 11): Result.005 file - promoters50/1396816
cctatcacaat

SEQ ID NO: 169778 - DNA, 11 bp, Unknown
  misc_feature (1)..( 11): Result.005 file - promoters50/1396816
tatttcacaga

SEQ ID NO: 169779 - DNA, 11 bp, Unknown
  misc_feature (1)..( 11): Result.005 file - promoters50/1396816
tagctcacacg

SEQ ID NO: 169780 - DNA, 11 bp, Unknown
  misc_feature (1)..( 11): Result.005 file - promoters50/1396816
aggttcacaga

SEQ ID NO: 169781 - DNA, 11 bp, Unknown
  misc_feature (1)..( 11): Result.005 file - promoters50/1396816
tctctcacctt

SEQ ID NO: 169782 - DNA, 11 bp, Unknown
  misc_feature (1)..( 11): Result.005 file - promoters50/1396816
gctaatttgaa

SEQ ID NO: 169783 - DNA, 11 bp, Unknown
  misc_feature (1)..( 11): Result.005 file - promoters50/1396816
tttaattttaa

SEQ ID NO: 169784 - DNA, 11 bp, Unknown
  misc_feature (1)..( 11): Result.005 file - promoters50/1396816
gataatttgtc

SEQ ID NO: 169785 - DNA, 11 bp, Unknown
  misc_feature (1)..( 11): Result.005 file - promoters50/1396816
gatgatttgag

SEQ ID NO: 169786 - DNA, 11 bp, Unknown
  misc_feature (1)..( 11): Result.005 file - promoters50/1396816
attgatgacgt

SEQ ID NO: 169787 - DNA, 11 bp, Unknown
  misc_feature (1)..( 11): Result.005 file - promoters50/1396816
tgagatttatg

SEQ ID NO: 169788 - DNA, 11 bp, Unknown
  misc_feature (1)..( 11): Result.005 file - promoters50/1396816
aaagaaaaact

SEQ ID NO: 169789 - DNA, 11 bp, Unknown
  misc_feature (1)..( 11): Result.005 file - promoters50/1396816
gacgaagaact

SEQ ID NO: 169790 - DNA, 11 bp, Unknown
  misc_feature (1)..( 11): Result.005 file - promoters50/1396816
atggaattttg

SEQ ID NO: 169791 - DNA, 11 bp, Unknown
  misc_feature (1)..( 11): Result.005 file - promoters50/1396816
tctgaatttta

SEQ ID NO: 169792 - DNA, 11 bp, Unknown
  misc_feature (1)..( 11): Result.005 file - promoters50/1396816
atgtaatttat

SEQ ID NO: 169793 - DNA, 11 bp, Unknown
  misc_feature (1)..( 11): Result.005 file - promoters50/1396816
tgtgaacttag

SEQ ID NO: 169794 - DNA, 15 bp, Unknown
  misc_feature (1)..( 15): Result.005 file - promoters50/1396877
tctgtctagttcggt

SEQ ID NO: 169795 - DNA, 15 bp, Unknown
  misc_feature (1)..( 15): Result.005 file - promoters50/1396877
tctctcttgtttggt

SEQ ID NO: 169796 - DNA, 15 bp, Unknown
  misc_feature (1)..( 15): Result.005 file - promoters50/1396877
aaattctagtaaatg

SEQ ID NO: 169797 - DNA, 7 bp, Unknown
  misc_feature (1)..( 7): Result.005 file - promoters50/1396877
caaatca

SEQ ID NO: 169798 - DNA, 7 bp, Unknown
  misc_feature (1)..( 7): Result.005 file - promoters50/1396877
caattca

SEQ ID NO: 169799 - DNA, 7 bp, Unknown
  misc_feature (1)..( 7): Result.005 file - promoters50/1396877
aaaatca

SEQ ID NO: 169800 - DNA, 11 bp, Unknown
  misc_feature (1)..( 11): Result.005 file - promoters50/1396877
tctgaagattt

SEQ ID NO: 169801 - DNA, 11 bp, Unknown
  misc_feature (1)..( 11): Result.005 file - promoters50/1396877
tctgcagattc

SEQ ID NO: 169802 - DNA, 11 bp, Unknown
  misc_feature (1)..( 11): Result.005 file - promoters50/1396877
aattcagattt

SEQ ID NO: 169803 - DNA, 8 bp, Unknown
  misc_feature (1)..( 8): Result.005 file - promoters50/1396877
aatacatt

SEQ ID NO: 169804 - DNA, 8 bp, Unknown
  misc_feature (1)..( 8): Result.005 file - promoters50/1396877
aatacaat

SEQ ID NO: 169805 - DNA, 8 bp, Unknown
  misc_feature (1)..( 8): Result.005 file - promoters50/1396877
tatataat

SEQ ID NO: 169806 - DNA, 9 bp, Unknown
  misc_feature (1)..( 9): Result.005 file - promoters50/1396885
gttattcct

SEQ ID NO: 169807 - DNA, 9 bp, Unknown
  misc_feature (1)..( 9): Result.005 file - promoters50/1396885
atgattcct

SEQ ID NO: 169808 - DNA, 9 bp, Unknown
  misc_feature (1)..( 9): Result.005 file - promoters50/1396885
atgattccc

SEQ ID NO: 169809 - DNA, 11 bp, Unknown
  misc_feature (1)..( 11): Result.005 file - promoters50/1396989
tgctaaaccaa

SEQ ID NO: 169810 - DNA, 11 bp, Unknown
  misc_feature (1)..( 11): Result.005 file - promoters50/1396989
tgcaaaaccaa

SEQ ID NO: 169811 - DNA, 11 bp, Unknown
  misc_feature (1)..( 11): Result.005 file - promoters50/1396989
ctcaaaaccta

SEQ ID NO: 169812 - DNA, 10 bp, Unknown
  misc_feature (1)..( 10): Result.005 file - promoters50/1397029
tttcgatgta

SEQ ID NO: 169813 - DNA, 10 bp, Unknown
  misc_feature (1)..( 10): Result.005 file - promoters50/1397029
ttttgatttg

SEQ ID NO: 169814 - DNA, 10 bp, Unknown
  misc_feature (1)..( 10): Result.005 file - promoters50/1397029
ctttgctttg

SEQ ID NO: 169815 - DNA, 12 bp, Unknown
  misc_feature (1)..( 12): Result.005 file - promoters50/1397029
ttattttcagta

SEQ ID NO: 169816 - DNA, 12 bp, Unknown
  misc_feature (1)..( 12): Result.005 file - promoters50/1397029
aacttttaagta

SEQ ID NO: 169817 - DNA, 12 bp, Unknown
  misc_feature (1)..( 12): Result.005 file - promoters50/1397029
aacctttatgta

SEQ ID NO: 169818 - DNA, 9 bp, Unknown
  misc_feature (1)..( 9): Result.005 file - promoters50/1397029
taatcgttt

SEQ ID NO: 169819 - DNA, 9 bp, Unknown
  misc_feature (1)..( 9): Result.005 file - promoters50/1397029
caatccttt

SEQ ID NO: 169820 - DNA, 9 bp, Unknown
  misc_feature (1)..( 9): Result.005 file - promoters50/1397029
taagcgtag

SEQ ID NO: 169821 - DNA, 7 bp, Unknown
  misc_feature (1)..( 7): Result.005 file - promoters50/1397029
ttttagt

SEQ ID NO: 169822 - DNA, 7 bp, Unknown
  misc_feature (1)..( 7): Result.005 file - promoters50/1397029
ttttaga

SEQ ID NO: 169823 - DNA, 7 bp, Unknown
  misc_feature (1)..( 7): Result.005 file - promoters50/1397029
gtttagt

SEQ ID NO: 169824 - DNA, 12 bp, Unknown
  misc_feature (1)..( 12): Result.005 file - promoters50/1397029
cgggtttatgtt

SEQ ID NO: 169825 - DNA, 12 bp, Unknown
  misc_feature (1)..( 12): Result.005 file - promoters50/1397029
aacctttatgta

SEQ ID NO: 169826 - DNA, 12 bp, Unknown
  misc_feature (1)..( 12): Result.005 file - promoters50/1397029
aacttttaagta

SEQ ID NO: 169827 - DNA, 9 bp, Unknown
  misc_feature (1)..( 9): Result.005 file - promoters50/1397033
gaatagatt

SEQ ID NO: 169828 - DNA, 9 bp, Unknown
  misc_feature (1)..( 9): Result.005 file - promoters50/1397033
caatagaaa

SEQ ID NO: 169829 - DNA, 9 bp, Unknown
  misc_feature (1)..( 9): Result.005 file - promoters50/1397033
caacagatg

SEQ ID NO: 169830 - DNA, 9 bp, Unknown
  misc_feature (1)..( 9): Result.005 file - promoters50/1397033
aaataaaaa

SEQ ID NO: 169831 - DNA, 9 bp, Unknown
  misc_feature (1)..( 9): Result.005 file - promoters50/1397033
tacagtttc

SEQ ID NO: 169832 - DNA, 9 bp, Unknown
  misc_feature (1)..( 9): Result.005 file - promoters50/1397033
tacattttt

SEQ ID NO: 169833 - DNA, 9 bp, Unknown
  misc_feature (1)..( 9): Result.005 file - promoters50/1397033
gttattttt

SEQ ID NO: 169834 - DNA, 9 bp, Unknown
  misc_feature (1)..( 9): Result.005 file - promoters50/1397033
agtattttc

SEQ ID NO: 169835 - DNA, 8 bp, Unknown
  misc_feature (1)..( 8): Result.005 file - promoters50/1397033
attcttta

SEQ ID NO: 169836 - DNA, 8 bp, Unknown
  misc_feature (1)..( 8): Result.005 file - promoters50/1397033
attattta

SEQ ID NO: 169837 - DNA, 8 bp, Unknown
  misc_feature (1)..( 8): Result.005 file - promoters50/1397033
catcttta

SEQ ID NO: 169838 - DNA, 8 bp, Unknown
  misc_feature (1)..( 8): Result.005 file - promoters50/1397033
attttttg

SEQ ID NO: 169839 - DNA, 8 bp, Unknown
  misc_feature (1)..( 8): Result.005 file - promoters50/1397033
atttttct

SEQ ID NO: 169840 - DNA, 11 bp, Unknown
  misc_feature (1)..( 11): Result.005 file - promoters50/1397080
gaaaaacaaaa

SEQ ID NO: 169841 - DNA, 11 bp, Unknown
  misc_feature (1)..( 11): Result.005 file - promoters50/1397080
acaaatcaaat

SEQ ID NO: 169842 - DNA, 11 bp, Unknown
  misc_feature (1)..( 11): Result.005 file - promoters50/1397080
taaaaacgggt

SEQ ID NO: 169843 - DNA, 11 bp, Unknown
  misc_feature (1)..( 11): Result.005 file - promoters50/1397080
gaataacgata

SEQ ID NO: 169844 - DNA, 11 bp, Unknown
  misc_feature (1)..( 11): Result.005 file - promoters50/1397080
ttccatcgaat

SEQ ID NO: 169845 - DNA, 11 bp, Unknown
  misc_feature (1)..( 11): Result.005 file - promoters50/1397080
ctccaacgaac

SEQ ID NO: 169846 - DNA, 12 bp, Unknown
  misc_feature (1)..( 12): Result.005 file - promoters50/1397125
cagtcaacttgt

SEQ ID NO: 169847 - DNA, 12 bp, Unknown
  misc_feature (1)..( 12): Result.005 file - promoters50/1397125
caggcaaaacca

SEQ ID NO: 169848 - DNA, 12 bp, Unknown
  misc_feature (1)..( 12): Result.005 file - promoters50/1397125
aagttaactttg

SEQ ID NO: 169849 - DNA, 12 bp, Unknown
  misc_feature (1)..( 12): Result.005 file - promoters50/1397125
ctggaaacttta

SEQ ID NO: 169850 - DNA, 12 bp, Unknown
  misc_feature (1)..( 12): Result.005 file - promoters50/1397125
caattaacttat

SEQ ID NO: 169851 - DNA, 12 bp, Unknown
  misc_feature (1)..( 12): Result.005 file - promoters50/1397125
atattaaccttg

SEQ ID NO: 169852 - DNA, 9 bp, Unknown
  misc_feature (1)..( 9): Result.005 file - promoters50/1397125
ccaaaattg

SEQ ID NO: 169853 - DNA, 9 bp, Unknown
  misc_feature (1)..( 9): Result.005 file - promoters50/1397125
gtaaaattt

SEQ ID NO: 169854 - DNA, 9 bp, Unknown
  misc_feature (1)..( 9): Result.005 file - promoters50/1397125
ggaaacttt

SEQ ID NO: 169855 - DNA, 9 bp, Unknown
  misc_feature (1)..( 9): Result.005 file - promoters50/1397125
ataagatta

SEQ ID NO: 169856 - DNA, 9 bp, Unknown
  misc_feature (1)..( 9): Result.005 file - promoters50/1397125
gttaacttt

SEQ ID NO: 169857 - DNA, 9 bp, Unknown
  misc_feature (1)..( 9): Result.005 file - promoters50/1397125
attaactta

SEQ ID NO: 169858 - DNA, 9 bp, Unknown
  misc_feature (1)..( 9): Result.005 file - promoters50/1397125
ttaaccttg

SEQ ID NO: 169859 - DNA, 9 bp, Unknown
  misc_feature (1)..( 9): Result.005 file - promoters50/1397125
atttatttc

SEQ ID NO: 169860 - DNA, 9 bp, Unknown
  misc_feature (1)..( 9): Result.005 file - promoters50/1397125
taatatttc

SEQ ID NO: 169861 - DNA, 9 bp, Unknown
  misc_feature (1)..( 9): Result.005 file - promoters50/1397125
tgttatttt

SEQ ID NO: 169862 - DNA, 9 bp, Unknown
  misc_feature (1)..( 9): Result.005 file - promoters50/1397125
taatcttta

SEQ ID NO: 169863 - DNA, 9 bp, Unknown
  misc_feature (1)..( 9): Result.005 file - promoters50/1397125
gaattttta

SEQ ID NO: 169864 - DNA, 9 bp, Unknown
  misc_feature (1)..( 9): Result.005 file - promoters50/1397125
taattttgc

SEQ ID NO: 169865 - DNA, 11 bp, Unknown
  misc_feature (1)..( 11): Result.005 file - promoters50/1397125
taaaaaaaact

SEQ ID NO: 169866 - DNA, 11 bp, Unknown
  misc_feature (1)..( 11): Result.005 file - promoters50/1397125
aaaaataaact

SEQ ID NO: 169867 - DNA, 11 bp, Unknown
  misc_feature (1)..( 11): Result.005 file - promoters50/1397125
taaaaaaaaaa

SEQ ID NO: 169868 - DNA, 11 bp, Unknown
  misc_feature (1)..( 11): Result.005 file - promoters50/1397125
attacaaaact

SEQ ID NO: 169869 - DNA, 11 bp, Unknown
  misc_feature (1)..( 11): Result.005 file - promoters50/1397125
caaaaataaga

SEQ ID NO: 169870 - DNA, 11 bp, Unknown
  misc_feature (1)..( 11): Result.005 file - promoters50/1397125
tctgataaatt

SEQ ID NO: 169871 - DNA, 12 bp, Unknown
  misc_feature (1)..( 12): Result.005 file - promoters50/1397178
tctatttatcta

SEQ ID NO: 169872 - DNA, 12 bp, Unknown
  misc_feature (1)..( 12): Result.005 file - promoters50/1397178
aatttttttcta

SEQ ID NO: 169873 - DNA, 12 bp, Unknown
  misc_feature (1)..( 12): Result.005 file - promoters50/1397178
attgttttggtt

SEQ ID NO: 169874 - DNA, 7 bp, Unknown
  misc_feature (1)..( 7): Result.005 file - promoters50/1397178
atttttc

SEQ ID NO: 169875 - DNA, 7 bp, Unknown
  misc_feature (1)..( 7): Result.005 file - promoters50/1397178
atttttt

SEQ ID NO: 169876 - DNA, 8 bp, Unknown
  misc_feature (1)..( 8): Result.005 file - promoters50/1397178
attgtttt

SEQ ID NO: 169877 - DNA, 10 bp, Unknown
  misc_feature (1)..( 10): Result.005 file - promoters50/1397178
aaaaatttaa

SEQ ID NO: 169878 - DNA, 10 bp, Unknown
  misc_feature (1)..( 10): Result.005 file - promoters50/1397178
aaagatttga

SEQ ID NO: 169879 - DNA, 10 bp, Unknown
  misc_feature (1)..( 10): Result.005 file - promoters50/1397178
aaaactttaa

SEQ ID NO: 169880 - DNA, 10 bp, Unknown
  misc_feature (1)..( 10): Result.005 file - promoters50/1397178
taagattgcc

SEQ ID NO: 169881 - DNA, 8 bp, Unknown
  misc_feature (1)..( 8): Result.005 file - promoters50/1397178
agatttaa

SEQ ID NO: 169882 - DNA, 8 bp, Unknown
  misc_feature (1)..( 8): Result.005 file - promoters50/1397178
caatttaa

SEQ ID NO: 169883 - DNA, 8 bp, Unknown
  misc_feature (1)..( 8): Result.005 file - promoters50/1397178
caatttat

SEQ ID NO: 169884 - DNA, 9 bp, Unknown
  misc_feature (1)..( 9): Result.005 file - promoters50/1397178
ggtatttgt

SEQ ID NO: 169885 - DNA, 9 bp, Unknown
  misc_feature (1)..( 9): Result.005 file - promoters50/1397178
ggtgtttgc

SEQ ID NO: 169886 - DNA, 9 bp, Unknown
  misc_feature (1)..( 9): Result.005 file - promoters50/1397178
tttatttga

SEQ ID NO: 169887 - DNA, 9 bp, Unknown
  misc_feature (1)..( 9): Result.005 file - promoters50/1397178
atgatttga

SEQ ID NO: 169888 - DNA, 10 bp, Unknown
  misc_feature (1)..( 10): Result.005 file - promoters50/1397178
ttacaataat

SEQ ID NO: 169889 - DNA, 10 bp, Unknown
  misc_feature (1)..( 10): Result.005 file - promoters50/1397178
ttataattat

SEQ ID NO: 169890 - DNA, 10 bp, Unknown
  misc_feature (1)..( 10): Result.005 file - promoters50/1397178
aaataattat

SEQ ID NO: 169891 - DNA, 12 bp, Unknown
  misc_feature (1)..( 12): Result.005 file - promoters50/1397178
taataaaattat

SEQ ID NO: 169892 - DNA, 12 bp, Unknown
  misc_feature (1)..( 12): Result.005 file - promoters50/1397178
taaaaaaccgga

SEQ ID NO: 169893 - DNA, 13 bp, Unknown
  misc_feature (1)..( 13): Result.005 file - promoters50/1397178
gtatacaatgata

SEQ ID NO: 169894 - DNA, 13 bp, Unknown
  misc_feature (1)..( 13): Result.005 file - promoters50/1397178
ataaaattataaa

SEQ ID NO: 169895 - DNA, 13 bp, Unknown
  misc_feature (1)..( 13): Result.005 file - promoters50/1397178
ccggaattttaac

SEQ ID NO: 169896 - DNA, 13 bp, Unknown
  misc_feature (1)..( 13): Result.005 file - promoters50/1397178
atacaatgatatt

SEQ ID NO: 169897 - DNA, 13 bp, Unknown
  misc_feature (1)..( 13): Result.005 file - promoters50/1397178
ttaacctttgacc

SEQ ID NO: 169898 - DNA, 9 bp, Unknown
  misc_feature (1)..( 9): Result.005 file - promoters50/1397178
ttgtataaa

SEQ ID NO: 169899 - DNA, 9 bp, Unknown
  misc_feature (1)..( 9): Result.005 file - promoters50/1397178
tcatataaa

SEQ ID NO: 169900 - DNA, 9 bp, Unknown
  misc_feature (1)..( 9): Result.005 file - promoters50/1397178
tcaaataaa

SEQ ID NO: 169901 - DNA, 8 bp, Unknown
  misc_feature (1)..( 8): Result.005 file - promoters50/1397178
attttttt

SEQ ID NO: 169902 - DNA, 8 bp, Unknown
  misc_feature (1)..( 8): Result.005 file - promoters50/1397178
attgtttt

SEQ ID NO: 169903 - DNA, 8 bp, Unknown
  misc_feature (1)..( 8): Result.005 file - promoters50/1397178
attttttt

SEQ ID NO: 169904 - DNA, 10 bp, Unknown
  misc_feature (1)..( 10): Result.005 file - promoters50/1397178
aataaaaatt

SEQ ID NO: 169905 - DNA, 10 bp, Unknown
  misc_feature (1)..( 10): Result.005 file - promoters50/1397178
cttaaatatt

SEQ ID NO: 169906 - DNA, 10 bp, Unknown
  misc_feature (1)..( 10): Result.005 file - promoters50/1397178
cttgaatcaa

SEQ ID NO: 169907 - DNA, 9 bp, Unknown
  misc_feature (1)..( 9): Result.005 file - promoters50/1397178
aataattaa

SEQ ID NO: 169908 - DNA, 9 bp, Unknown
  misc_feature (1)..( 9): Result.005 file - promoters50/1397178
aataattat

SEQ ID NO: 169909 - DNA, 9 bp, Unknown
  misc_feature (1)..( 9): Result.005 file - promoters50/1397178
tataattat

SEQ ID NO: 169910 - DNA, 14 bp, Unknown
  misc_feature (1)..( 14): Result.005 file - promoters50/1397178
cttgaatcaatatt

SEQ ID NO: 169911 - DNA, 14 bp, Unknown
  misc_feature (1)..( 14): Result.005 file - promoters50/1397178
attgattcaaaatt

SEQ ID NO: 169912 - DNA, 14 bp, Unknown
  misc_feature (1)..( 14): Result.005 file - promoters50/1397178
cttaaatatttttc

SEQ ID NO: 169913 - DNA, 10 bp, Unknown
  misc_feature (1)..( 10): Result.005 file - promoters50/1397195
aattcgaagc

SEQ ID NO: 169914 - DNA, 10 bp, Unknown
  misc_feature (1)..( 10): Result.005 file - promoters50/1397195
agttcgaatt

SEQ ID NO: 169915 - DNA, 10 bp, Unknown
  misc_feature (1)..( 10): Result.005 file - promoters50/1397195
aattccaagc

SEQ ID NO: 169916 - DNA, 7 bp, Unknown
  misc_feature (1)..( 7): Result.005 file - promoters50/1397195
tttagtt

SEQ ID NO: 169917 - DNA, 7 bp, Unknown
  misc_feature (1)..( 7): Result.005 file - promoters50/1397195
ttttgtt

SEQ ID NO: 169918 - DNA, 8 bp, Unknown
  misc_feature (1)..( 8): Result.005 file - promoters50/1397195
tttcagta

SEQ ID NO: 169919 - DNA, 11 bp, Unknown
  misc_feature (1)..( 11): Result.005 file - promoters50/1397203
ataaaaaactc

SEQ ID NO: 169920 - DNA, 11 bp, Unknown
  misc_feature (1)..( 11): Result.005 file - promoters50/1397203
tggaaacactt

SEQ ID NO: 169921 - DNA, 11 bp, Unknown
  misc_feature (1)..( 11): Result.005 file - promoters50/1397203
tccaaaaaaga

SEQ ID NO: 169922 - DNA, 12 bp, Unknown
  misc_feature (1)..( 12): Result.005 file - promoters50/1397203
aacaaacaactc

SEQ ID NO: 169923 - DNA, 12 bp, Unknown
  misc_feature (1)..( 12): Result.005 file - promoters50/1397203
aaaaagaaaata

SEQ ID NO: 169924 - DNA, 12 bp, Unknown
  misc_feature (1)..( 12): Result.005 file - promoters50/1397203
cagcaacaacaa

SEQ ID NO: 169925 - DNA, 12 bp, Unknown
  misc_feature (1)..( 12): Result.005 file - promoters50/1397231
gaacaaaattgt

SEQ ID NO: 169926 - DNA, 12 bp, Unknown
  misc_feature (1)..( 12): Result.005 file - promoters50/1397231
taacaaaacaat

SEQ ID NO: 169927 - DNA, 12 bp, Unknown
  misc_feature (1)..( 12): Result.005 file - promoters50/1397231
atacataataat

SEQ ID NO: 169928 - DNA, 12 bp, Unknown
  misc_feature (1)..( 12): Result.005 file - promoters50/1397231
acccaagacatt

SEQ ID NO: 169929 - DNA, 12 bp, Unknown
  misc_feature (1)..( 12): Result.005 file - promoters50/1397231
taataaactctt

SEQ ID NO: 169930 - DNA, 12 bp, Unknown
  misc_feature (1)..( 12): Result.005 file - promoters50/1397231
cttgaagacatt

SEQ ID NO: 169931 - DNA, 12 bp, Unknown
  misc_feature (1)..( 12): Result.005 file - promoters50/1397231
gtatatatattt

SEQ ID NO: 169932 - DNA, 10 bp, Unknown
  misc_feature (1)..( 10): Result.005 file - promoters50/1397251
acataagatt

SEQ ID NO: 169933 - DNA, 10 bp, Unknown
  misc_feature (1)..( 10): Result.005 file - promoters50/1397251
acaaaagttc

SEQ ID NO: 169934 - DNA, 10 bp, Unknown
  misc_feature (1)..( 10): Result.005 file - promoters50/1397251
atctaagata

SEQ ID NO: 169935 - DNA, 9 bp, Unknown
  misc_feature (1)..( 9): Result.005 file - promoters50/1397251
gccaataga

SEQ ID NO: 169936 - DNA, 9 bp, Unknown
  misc_feature (1)..( 9): Result.005 file - promoters50/1397251
gcctatagt

SEQ ID NO: 169937 - DNA, 9 bp, Unknown
  misc_feature (1)..( 9): Result.005 file - promoters50/1397251
aagaataga

SEQ ID NO: 169938 - DNA, 11 bp, Unknown
  misc_feature (1)..( 11): Result.005 file - promoters50/1397263
caccaccgatt

SEQ ID NO: 169939 - DNA, 11 bp, Unknown
  misc_feature (1)..( 11): Result.005 file - promoters50/1397263
ctgatccgatt

SEQ ID NO: 169940 - DNA, 11 bp, Unknown
  misc_feature (1)..( 11): Result.005 file - promoters50/1397263
ggcaacccatt

SEQ ID NO: 169941 - DNA, 11 bp, Unknown
  misc_feature (1)..( 11): Result.005 file - promoters50/1397263
gcaaaccaaac

SEQ ID NO: 169942 - DNA, 11 bp, Unknown
  misc_feature (1)..( 11): Result.005 file - promoters50/1397263
taaaactaaaa

SEQ ID NO: 169943 - DNA, 11 bp, Unknown
  misc_feature (1)..( 11): Result.005 file - promoters50/1397263
agtaactaaaa

SEQ ID NO: 169944 - DNA, 8 bp, Unknown
  misc_feature (1)..( 8): Result.005 file - promoters50/1397263
ataaaaat

SEQ ID NO: 169945 - DNA, 8 bp, Unknown
  misc_feature (1)..( 8): Result.005 file - promoters50/1397263
ataataat

SEQ ID NO: 169946 - DNA, 8 bp, Unknown
  misc_feature (1)..( 8): Result.005 file - promoters50/1397263
gtaataat

SEQ ID NO: 169947 - DNA, 8 bp, Unknown
  misc_feature (1)..( 8): Result.005 file - promoters50/1397263
ttaataaa

SEQ ID NO: 169948 - DNA, 8 bp, Unknown
  misc_feature (1)..( 8): Result.005 file - promoters50/1397263
ataataaa

SEQ ID NO: 169949 - DNA, 8 bp, Unknown
  misc_feature (1)..( 8): Result.005 file - promoters50/1397263
ttaaaaaa

SEQ ID NO: 169950 - DNA, 11 bp, Unknown
  misc_feature (1)..( 11): Result.005 file - promoters50/1397332
ccctctaaacc

SEQ ID NO: 169951 - DNA, 11 bp, Unknown
  misc_feature (1)..( 11): Result.005 file - promoters50/1397332
atgtttaaacc

SEQ ID NO: 169952 - DNA, 11 bp, Unknown
  misc_feature (1)..( 11): Result.005 file - promoters50/1397332
cccactaaacc

SEQ ID NO: 169953 - DNA, 13 bp, Unknown
  misc_feature (1)..( 13): Result.005 file - promoters50/1397350
gtctcatggattc

SEQ ID NO: 169954 - DNA, 13 bp, Unknown
  misc_feature (1)..( 13): Result.005 file - promoters50/1397350
gtttcaaggattc

SEQ ID NO: 169955 - DNA, 13 bp, Unknown
  misc_feature (1)..( 13): Result.005 file - promoters50/1397350
gtctgatggataa

SEQ ID NO: 169956 - DNA, 13 bp, Unknown
  misc_feature (1)..( 13): Result.005 file - promoters50/1397350
atcaaatgtattg

SEQ ID NO: 169957 - DNA, 11 bp, Unknown
  misc_feature (1)..( 11): Result.005 file - promoters50/1397350
aaaattaaaat

SEQ ID NO: 169958 - DNA, 11 bp, Unknown
  misc_feature (1)..( 11): Result.005 file - promoters50/1397350
atttttacaat

SEQ ID NO: 169959 - DNA, 11 bp, Unknown
  misc_feature (1)..( 11): Result.005 file - promoters50/1397350
aaaattaaata

SEQ ID NO: 169960 - DNA, 11 bp, Unknown
  misc_feature (1)..( 11): Result.005 file - promoters50/1397350
atgattaaaca

SEQ ID NO: 169961 - DNA, 9 bp, Unknown
  misc_feature (1)..( 9): Result.005 file - promoters50/1397350
attaaaatt

SEQ ID NO: 169962 - DNA, 9 bp, Unknown
  misc_feature (1)..( 9): Result.005 file - promoters50/1397350
aataaaatt

SEQ ID NO: 169963 - DNA, 9 bp, Unknown
  misc_feature (1)..( 9): Result.005 file - promoters50/1397350
aataaaata

SEQ ID NO: 169964 - DNA, 9 bp, Unknown
  misc_feature (1)..( 9): Result.005 file - promoters50/1397350
aatgaaata

SEQ ID NO: 169965 - DNA, 8 bp, Unknown
  misc_feature (1)..( 8): Result.005 file - promoters50/1397425
tcatgatt

SEQ ID NO: 169966 - DNA, 8 bp, Unknown
  misc_feature (1)..( 8): Result.005 file - promoters50/1397425
tcataatt

SEQ ID NO: 169967 - DNA, 8 bp, Unknown
  misc_feature (1)..( 8): Result.005 file - promoters50/1397425
tcataata

SEQ ID NO: 169968 - DNA, 8 bp, Unknown
  misc_feature (1)..( 8): Result.005 file - promoters50/1397425
atatgtaa

SEQ ID NO: 169969 - DNA, 8 bp, Unknown
  misc_feature (1)..( 8): Result.005 file - promoters50/1397425
ataagtat

SEQ ID NO: 169970 - DNA, 8 bp, Unknown
  misc_feature (1)..( 8): Result.005 file - promoters50/1397425
gtatataa

SEQ ID NO: 169971 - DNA, 7 bp, Unknown
  misc_feature (1)..( 7): Result.005 file - promoters50/1397445
acaaaat

SEQ ID NO: 169972 - DNA, 7 bp, Unknown
  misc_feature (1)..( 7): Result.005 file - promoters50/1397445
tcaaaat

SEQ ID NO: 169973 - DNA, 7 bp, Unknown
  misc_feature (1)..( 7): Result.005 file - promoters50/1397445
tcagaat

SEQ ID NO: 169974 - DNA, 7 bp, Unknown
  misc_feature (1)..( 7): Result.005 file - promoters50/1397445
acaaaac

SEQ ID NO: 169975 - DNA, 7 bp, Unknown
  misc_feature (1)..( 7): Result.005 file - promoters50/1397445
acaaaaa

SEQ ID NO: 169976 - DNA, 7 bp, Unknown
  misc_feature (1)..( 7): Result.005 file - promoters50/1397445
gcaaaac

SEQ ID NO: 169977 - DNA, 11 bp, Unknown
  misc_feature (1)..( 11): Result.005 file - promoters50/1397461
tcttaataatg

SEQ ID NO: 169978 - DNA, 11 bp, Unknown
  misc_feature (1)..( 11): Result.005 file - promoters50/1397461
aaagaataatc

SEQ ID NO: 169979 - DNA, 11 bp, Unknown
  misc_feature (1)..( 11): Result.005 file - promoters50/1397461
cgttactaaaa

SEQ ID NO: 169980 - DNA, 11 bp, Unknown
  misc_feature (1)..( 11): Result.005 file - promoters50/1397461
attaaataatg

SEQ ID NO: 169981 - DNA, 11 bp, Unknown
  misc_feature (1)..( 11): Result.005 file - promoters50/1397461
agcaaagaatt

SEQ ID NO: 169982 - DNA, 11 bp, Unknown
  misc_feature (1)..( 11): Result.005 file - promoters50/1397461
gtcaaagaatc

SEQ ID NO: 169983 - DNA, 11 bp, Unknown
  misc_feature (1)..( 11): Result.005 file - promoters50/1397461
gtcgaagttgt

SEQ ID NO: 169984 - DNA, 12 bp, Unknown
  misc_feature (1)..( 12): Result.005 file - promoters50/1397461
acgaaaatcatc

SEQ ID NO: 169985 - DNA, 12 bp, Unknown
  misc_feature (1)..( 12): Result.005 file - promoters50/1397461
tctcaaaacatt

SEQ ID NO: 169986 - DNA, 12 bp, Unknown
  misc_feature (1)..( 12): Result.005 file - promoters50/1397461
caaaaaatcggg

SEQ ID NO: 169987 - DNA, 12 bp, Unknown
  misc_feature (1)..( 12): Result.005 file - promoters50/1397461
caacaaatgcat

SEQ ID NO: 169988 - DNA, 12 bp, Unknown
  misc_feature (1)..( 12): Result.005 file - promoters50/1397461
gccaaactcggt

SEQ ID NO: 169989 - DNA, 12 bp, Unknown
  misc_feature (1)..( 12): Result.005 file - promoters50/1397461
acaaaaaacaat

SEQ ID NO: 169990 - DNA, 12 bp, Unknown
  misc_feature (1)..( 12): Result.005 file - promoters50/1397461
aaacgaaaatca

SEQ ID NO: 169991 - DNA, 12 bp, Unknown
  misc_feature (1)..( 12): Result.005 file - promoters50/1397461
aaacaaaaaaca

SEQ ID NO: 169992 - DNA, 12 bp, Unknown
  misc_feature (1)..( 12): Result.005 file - promoters50/1397461
caacaaatgcat

SEQ ID NO: 169993 - DNA, 12 bp, Unknown
  misc_feature (1)..( 12): Result.005 file - promoters50/1397461
tgtcaaaaaatc

SEQ ID NO: 169994 - DNA, 12 bp, Unknown
  misc_feature (1)..( 12): Result.005 file - promoters50/1397461
tctcaaaacatt

SEQ ID NO: 169995 - DNA, 12 bp, Unknown
  misc_feature (1)..( 12): Result.005 file - promoters50/1397461
ggccaaactcgg

SEQ ID NO: 169996 - DNA, 10 bp, Unknown
  misc_feature (1)..( 10): Result.005 file - promoters50/1397461
caattaatct

SEQ ID NO: 169997 - DNA, 10 bp, Unknown
  misc_feature (1)..( 10): Result.005 file - promoters50/1397461
atattaattt

SEQ ID NO: 169998 - DNA, 10 bp, Unknown
  misc_feature (1)..( 10): Result.005 file - promoters50/1397461
gtaataataa

SEQ ID NO: 169999 - DNA, 10 bp, Unknown
  misc_feature (1)..( 10): Result.005 file - promoters50/1397461
atattatttt

SEQ ID NO: 170000 - DNA, 11 bp, Unknown
  misc_feature (1)..( 11): Result.005 file - promoters50/1397461
cgattatattt

SEQ ID NO: 170001 - DNA, 11 bp, Unknown
  misc_feature (1)..( 11): Result.005 file - promoters50/1397461
tttttacattg

SEQ ID NO: 170002 - DNA, 22 bp, Unknown
  misc_feature (1)..( 22): Result.005 file - promoters50/1397461
aaagaacttaatttttttttgt

SEQ ID NO: 170003 - DNA, 22 bp, Unknown
  misc_feature (1)..( 22): Result.005 file - promoters50/1397461
taacaacttaattctttttaca

SEQ ID NO: 170004 - DNA, 22 bp, Unknown
  misc_feature (1)..( 22): Result.005 file - promoters50/1397461
aaagagcttattaagatagcaa

SEQ ID NO: 170005 - DNA, 22 bp, Unknown
  misc_feature (1)..( 22): Result.005 file - promoters50/1397461
ttttcaccagatttttagtaaa

SEQ ID NO: 170006 - DNA, 22 bp, Unknown
  misc_feature (1)..( 22): Result.005 file - promoters50/1397461
ccgacttttgagtctatttcaa

SEQ ID NO: 170007 - DNA, 22 bp, Unknown
  misc_feature (1)..( 22): Result.005 file - promoters50/1397461
tgcttttcaaaatctatctcaa

SEQ ID NO: 170008 - DNA, 13 bp, Unknown
  misc_feature (1)..( 13): Result.005 file - promoters50/1397500
agtgccaatcgca

SEQ ID NO: 170009 - DNA, 13 bp, Unknown
  misc_feature (1)..( 13): Result.005 file - promoters50/1397500
agttccaaccaat

SEQ ID NO: 170010 - DNA, 13 bp, Unknown
  misc_feature (1)..( 13): Result.005 file - promoters50/1397500
gctgctaattttt

SEQ ID NO: 170011 - DNA, 13 bp, Unknown
  misc_feature (1)..( 13): Result.005 file - promoters50/1397500
aatgctaaatgat

SEQ ID NO: 170012 - DNA, 13 bp, Unknown
  misc_feature (1)..( 13): Result.005 file - promoters50/1397500
tcacctactttgg

SEQ ID NO: 170013 - DNA, 13 bp, Unknown
  misc_feature (1)..( 13): Result.005 file - promoters50/1397500
tccctcactttgg

SEQ ID NO: 170014 - DNA, 11 bp, Unknown
  misc_feature (1)..( 11): Result.005 file - promoters50/1397500
tgccaatcgca

SEQ ID NO: 170015 - DNA, 11 bp, Unknown
  misc_feature (1)..( 11): Result.005 file - promoters50/1397500
aaccaatcata

SEQ ID NO: 170016 - DNA, 11 bp, Unknown
  misc_feature (1)..( 11): Result.005 file - promoters50/1397500
tgctaattttt

SEQ ID NO: 170017 - DNA, 11 bp, Unknown
  misc_feature (1)..( 11): Result.005 file - promoters50/1397500
aaacaaacatg

SEQ ID NO: 170018 - DNA, 11 bp, Unknown
  misc_feature (1)..( 11): Result.005 file - promoters50/1397500
acctactttgg

SEQ ID NO: 170019 - DNA, 11 bp, Unknown
  misc_feature (1)..( 11): Result.005 file - promoters50/1397500
cctcactttgg

SEQ ID NO: 170020 - DNA, 14 bp, Unknown
  misc_feature (1)..( 14): Result.005 file - promoters50/1397500
aagagcaaataatt

SEQ ID NO: 170021 - DNA, 14 bp, Unknown
  misc_feature (1)..( 14): Result.005 file - promoters50/1397500
atttgaaaacaatt

SEQ ID NO: 170022 - DNA, 14 bp, Unknown
  misc_feature (1)..( 14): Result.005 file - promoters50/1397500
tatatcaaatacta

SEQ ID NO: 170023 - DNA, 14 bp, Unknown
  misc_feature (1)..( 14): Result.005 file - promoters50/1397500
aaaattcaacaata

SEQ ID NO: 170024 - DNA, 14 bp, Unknown
  misc_feature (1)..( 14): Result.005 file - promoters50/1397500
ttcgacaaatggag

SEQ ID NO: 170025 - DNA, 14 bp, Unknown
  misc_feature (1)..( 14): Result.005 file - promoters50/1397500
accgaaaaaaacga

SEQ ID NO: 170026 - DNA, 14 bp, Unknown
  misc_feature (1)..( 14): Result.005 file - promoters50/1397500
gttatcaaaaatgt

SEQ ID NO: 170027 - DNA, 14 bp, Unknown
  misc_feature (1)..( 14): Result.005 file - promoters50/1397500
ttgttaaaaaaaaa

SEQ ID NO: 170028 - DNA, 11 bp, Unknown
  misc_feature (1)..( 11): Result.005 file - promoters50/1397500
ataattattca

SEQ ID NO: 170029 - DNA, 11 bp, Unknown
  misc_feature (1)..( 11): Result.005 file - promoters50/1397500
attattattat

SEQ ID NO: 170030 - DNA, 11 bp, Unknown
  misc_feature (1)..( 11): Result.005 file - promoters50/1397500
ataaatatatc

SEQ ID NO: 170031 - DNA, 11 bp, Unknown
  misc_feature (1)..( 11): Result.005 file - promoters50/1397500
tattttattca

SEQ ID NO: 170032 - DNA, 11 bp, Unknown
  misc_feature (1)..( 11): Result.005 file - promoters50/1397500
tatattatgaa

SEQ ID NO: 170033 - DNA, 11 bp, Unknown
  misc_feature (1)..( 11): Result.005 file - promoters50/1397500
tacaatattag

SEQ ID NO: 170034 - DNA, 10 bp, Unknown
  misc_feature (1)..( 10): Result.005 file - promoters50/1397500
ataatttaca

SEQ ID NO: 170035 - DNA, 10 bp, Unknown
  misc_feature (1)..( 10): Result.005 file - promoters50/1397500
tggatttacg

SEQ ID NO: 170036 - DNA, 10 bp, Unknown
  misc_feature (1)..( 10): Result.005 file - promoters50/1397500
tctatttact

SEQ ID NO: 170037 - DNA, 10 bp, Unknown
  misc_feature (1)..( 10): Result.005 file - promoters50/1397500
aagatttatc

SEQ ID NO: 170038 - DNA, 10 bp, Unknown
  misc_feature (1)..( 10): Result.005 file - promoters50/1397500
aagagttaaa

SEQ ID NO: 170039 - DNA, 10 bp, Unknown
  misc_feature (1)..( 10): Result.005 file - promoters50/1397500
tagatatatc

SEQ ID NO: 170040 - DNA, 8 bp, Unknown
  misc_feature (1)..( 8): Result.005 file - promoters50/1397546
ggagttac

SEQ ID NO: 170041 - DNA, 8 bp, Unknown
  misc_feature (1)..( 8): Result.005 file - promoters50/1397546
agagttaa

SEQ ID NO: 170042 - DNA, 8 bp, Unknown
  misc_feature (1)..( 8): Result.005 file - promoters50/1397546
agacttaa

SEQ ID NO: 170043 - DNA, 10 bp, Unknown
  misc_feature (1)..( 10): Result.005 file - promoters50/1397568
caatctaaga

SEQ ID NO: 170044 - DNA, 10 bp, Unknown
  misc_feature (1)..( 10): Result.005 file - promoters50/1397568
caatttaacg

SEQ ID NO: 170045 - DNA, 10 bp, Unknown
  misc_feature (1)..( 10): Result.005 file - promoters50/1397568
ttttttgacg

SEQ ID NO: 170046 - DNA, 10 bp, Unknown
  misc_feature (1)..( 10): Result.005 file - promoters50/1397568
gtttttgaat

SEQ ID NO: 170047 - DNA, 9 bp, Unknown
  misc_feature (1)..( 9): Result.005 file - promoters50/1397568
attttgaga

SEQ ID NO: 170048 - DNA, 9 bp, Unknown
  misc_feature (1)..( 9): Result.005 file - promoters50/1397568
attgtgagt

SEQ ID NO: 170049 - DNA, 9 bp, Unknown
  misc_feature (1)..( 9): Result.005 file - promoters50/1397568
tttttgacg

SEQ ID NO: 170050 - DNA, 9 bp, Unknown
  misc_feature (1)..( 9): Result.005 file - promoters50/1397568
aatttaacg

SEQ ID NO: 170051 - DNA, 9 bp, Unknown
  misc_feature (1)..( 9): Result.005 file - promoters50/1397568
atttaaaat

SEQ ID NO: 170052 - DNA, 9 bp, Unknown
  misc_feature (1)..( 9): Result.005 file - promoters50/1397568
ctttcaaac

SEQ ID NO: 170053 - DNA, 9 bp, Unknown
  misc_feature (1)..( 9): Result.005 file - promoters50/1397568
tattataat

SEQ ID NO: 170054 - DNA, 9 bp, Unknown
  misc_feature (1)..( 9): Result.005 file - promoters50/1397568
ttttaaaaa

SEQ ID NO: 170055 - DNA, 9 bp, Unknown
  misc_feature (1)..( 9): Result.005 file - promoters50/1397582
ctaattttc

SEQ ID NO: 170056 - DNA, 9 bp, Unknown
  misc_feature (1)..( 9): Result.005 file - promoters50/1397582
ataaattta

SEQ ID NO: 170057 - DNA, 9 bp, Unknown
  misc_feature (1)..( 9): Result.005 file - promoters50/1397582
ctaactttc

SEQ ID NO: 170058 - DNA, 10 bp, Unknown
  misc_feature (1)..( 10): Result.005 file - promoters50/1397594
gaataattgt

SEQ ID NO: 170059 - DNA, 10 bp, Unknown
  misc_feature (1)..( 10): Result.005 file - promoters50/1397594
gaacaattac

SEQ ID NO: 170060 - DNA, 10 bp, Unknown
  misc_feature (1)..( 10): Result.005 file - promoters50/1397594
taataattta

SEQ ID NO: 170061 - DNA, 10 bp, Unknown
  misc_feature (1)..( 10): Result.005 file - promoters50/1397594
tggtaattta

SEQ ID NO: 170062 - DNA, 11 bp, Unknown
  misc_feature (1)..( 11): Result.005 file - promoters50/1397594
ccttgttttat

SEQ ID NO: 170063 - DNA, 11 bp, Unknown
  misc_feature (1)..( 11): Result.005 file - promoters50/1397594
cctcgttgtaa

SEQ ID NO: 170064 - DNA, 11 bp, Unknown
  misc_feature (1)..( 11): Result.005 file - promoters50/1397594
cttcggtgttg

SEQ ID NO: 170065 - DNA, 11 bp, Unknown
  misc_feature (1)..( 11): Result.005 file - promoters50/1397594
attgggttttg

SEQ ID NO: 170066 - DNA, 8 bp, Unknown
  misc_feature (1)..( 8): Result.005 file - promoters50/1397594
atttgttt

SEQ ID NO: 170067 - DNA, 8 bp, Unknown
  misc_feature (1)..( 8): Result.005 file - promoters50/1397594
ttttcttt

SEQ ID NO: 170068 - DNA, 8 bp, Unknown
  misc_feature (1)..( 8): Result.005 file - promoters50/1397594
atttgtta

SEQ ID NO: 170069 - DNA, 8 bp, Unknown
  misc_feature (1)..( 8): Result.005 file - promoters50/1397594
atttcctt

SEQ ID NO: 170070 - DNA, 9 bp, Unknown
  misc_feature (1)..( 9): Result.005 file - promoters50/1397594
gtttttggg

SEQ ID NO: 170071 - DNA, 9 bp, Unknown
  misc_feature (1)..( 9): Result.005 file - promoters50/1397594
atttttgtt

SEQ ID NO: 170072 - DNA, 9 bp, Unknown
  misc_feature (1)..( 9): Result.005 file - promoters50/1397594
atttttgca

SEQ ID NO: 170073 - DNA, 9 bp, Unknown
  misc_feature (1)..( 9): Result.005 file - promoters50/1397594
aattttgtt

SEQ ID NO: 170074 - DNA, 12 bp, Unknown
  misc_feature (1)..( 12): Result.005 file - promoters50/1397700
aatttctagaaa

SEQ ID NO: 170075 - DNA, 12 bp, Unknown
  misc_feature (1)..( 12): Result.005 file - promoters50/1397700
caattcaagaga

SEQ ID NO: 170076 - DNA, 12 bp, Unknown
  misc_feature (1)..( 12): Result.005 file - promoters50/1397700
ttattaaagctt

SEQ ID NO: 170077 - DNA, 12 bp, Unknown
  misc_feature (1)..( 12): Result.005 file - promoters50/1397700
ttatcaaaaaaa

SEQ ID NO: 170078 - DNA, 12 bp, Unknown
  misc_feature (1)..( 12): Result.005 file - promoters50/1397700
atgtcaaaaaga

SEQ ID NO: 170079 - DNA, 12 bp, Unknown
  misc_feature (1)..( 12): Result.005 file - promoters50/1397700
ttgataaagaga

SEQ ID NO: 170080 - DNA, 13 bp, Unknown
  misc_feature (1)..( 13): Result.005 file - promoters50/1397700
gtaaacaaaagat

SEQ ID NO: 170081 - DNA, 13 bp, Unknown
  misc_feature (1)..( 13): Result.005 file - promoters50/1397700
agaaacaaagtaa

SEQ ID NO: 170082 - DNA, 13 bp, Unknown
  misc_feature (1)..( 13): Result.005 file - promoters50/1397700
cgaaccaatgtga

SEQ ID NO: 170083 - DNA, 13 bp, Unknown
  misc_feature (1)..( 13): Result.005 file - promoters50/1397700
aaaaagaaaagag

SEQ ID NO: 170084 - DNA, 13 bp, Unknown
  misc_feature (1)..( 13): Result.005 file - promoters50/1397700
aaaaagatggtta

SEQ ID NO: 170085 - DNA, 13 bp, Unknown
  misc_feature (1)..( 13): Result.005 file - promoters50/1397700
ataaagagataag

SEQ ID NO: 170086 - DNA, 18 bp, Unknown
  misc_feature (1)..( 18): Result.005 file - promoters50/1397700
ttacttttaacaaaacaa

SEQ ID NO: 170087 - DNA, 18 bp, Unknown
  misc_feature (1)..( 18): Result.005 file - promoters50/1397700
tgtattttatcaaaaaaa

SEQ ID NO: 170088 - DNA, 18 bp, Unknown
  misc_feature (1)..( 18): Result.005 file - promoters50/1397700
tgtgttttagtttctttt

SEQ ID NO: 170089 - DNA, 18 bp, Unknown
  misc_feature (1)..( 18): Result.005 file - promoters50/1397700
gatagcttattaaagctt

SEQ ID NO: 170090 - DNA, 18 bp, Unknown
  misc_feature (1)..( 18): Result.005 file - promoters50/1397700
ttagacatgtcaaaaaga

SEQ ID NO: 170091 - DNA, 18 bp, Unknown
  misc_feature (1)..( 18): Result.005 file - promoters50/1397700
acccgattgataaagaga

SEQ ID NO: 170092 - DNA, 10 bp, Unknown
  misc_feature (1)..( 10): Result.005 file - promoters50/1397717
taaaaaaaag

SEQ ID NO: 170093 - DNA, 10 bp, Unknown
  misc_feature (1)..( 10): Result.005 file - promoters50/1397717
taaaaataag

SEQ ID NO: 170094 - DNA, 10 bp, Unknown
  misc_feature (1)..( 10): Result.005 file - promoters50/1397717
cacaaatgag

SEQ ID NO: 170095 - DNA, 10 bp, Unknown
  misc_feature (1)..( 10): Result.005 file - promoters50/1397717
caaaaataat

SEQ ID NO: 170096 - DNA, 8 bp, Unknown
  misc_feature (1)..( 8): Result.005 file - promoters50/1397717
aagaaatt

SEQ ID NO: 170097 - DNA, 8 bp, Unknown
  misc_feature (1)..( 8): Result.005 file - promoters50/1397717
aagaaaaa

SEQ ID NO: 170098 - DNA, 8 bp, Unknown
  misc_feature (1)..( 8): Result.005 file - promoters50/1397717
tagaaaaa

SEQ ID NO: 170099 - DNA, 8 bp, Unknown
  misc_feature (1)..( 8): Result.005 file - promoters50/1397717
caaagtaa

SEQ ID NO: 170100 - DNA, 8 bp, Unknown
  misc_feature (1)..( 8): Result.005 file - promoters50/1397717
aaaaataa

SEQ ID NO: 170101 - DNA, 8 bp, Unknown
  misc_feature (1)..( 8): Result.005 file - promoters50/1397717
aaaaataa

SEQ ID NO: 170102 - DNA, 12 bp, Unknown
  misc_feature (1)..( 12): Result.005 file - promoters50/1397753
ttctcaaattgt

SEQ ID NO: 170103 - DNA, 12 bp, Unknown
  misc_feature (1)..( 12): Result.005 file - promoters50/1397753
ttctaaaataat

SEQ ID NO: 170104 - DNA, 12 bp, Unknown
  misc_feature (1)..( 12): Result.005 file - promoters50/1397753
gaagaaaaaaat

SEQ ID NO: 170105 - DNA, 12 bp, Unknown
  misc_feature (1)..( 12): Result.005 file - promoters50/1397753
ctaataaatatt

SEQ ID NO: 170106 - DNA, 12 bp, Unknown
  misc_feature (1)..( 12): Result.005 file - promoters50/1397753
taccaaactaaa

SEQ ID NO: 170107 - DNA, 12 bp, Unknown
  misc_feature (1)..( 12): Result.005 file - promoters50/1397753
cactaaaacaga

SEQ ID NO: 170108 - DNA, 12 bp, Unknown
  misc_feature (1)..( 12): Result.005 file - promoters50/1397753
aaataaaatatg

SEQ ID NO: 170109 - DNA, 15 bp, Unknown
  misc_feature (1)..( 15): Result.005 file - promoters50/1397753
aatgttttagtggtc

SEQ ID NO: 170110 - DNA, 15 bp, Unknown
  misc_feature (1)..( 15): Result.005 file - promoters50/1397753
tatgatttccttata

SEQ ID NO: 170111 - DNA, 15 bp, Unknown
  misc_feature (1)..( 15): Result.005 file - promoters50/1397753
tctgttttatttttc

SEQ ID NO: 170112 - DNA, 15 bp, Unknown
  misc_feature (1)..( 15): Result.005 file - promoters50/1397753
tataattatgtggtc

SEQ ID NO: 170113 - DNA, 15 bp, Unknown
  misc_feature (1)..( 15): Result.005 file - promoters50/1397753
tgggattttcttaat

SEQ ID NO: 170114 - DNA, 15 bp, Unknown
  misc_feature (1)..( 15): Result.005 file - promoters50/1397753
agctttttggggttt

SEQ ID NO: 170115 - DNA, 12 bp, Unknown
  misc_feature (1)..( 12): Result.005 file - promoters50/1397753
ttttattaaatc

SEQ ID NO: 170116 - DNA, 12 bp, Unknown
  misc_feature (1)..( 12): Result.005 file - promoters50/1397753
aactatcaaatt

SEQ ID NO: 170117 - DNA, 12 bp, Unknown
  misc_feature (1)..( 12): Result.005 file - promoters50/1397753
agttaataaata

SEQ ID NO: 170118 - DNA, 12 bp, Unknown
  misc_feature (1)..( 12): Result.005 file - promoters50/1397753
tgttaatcactt

SEQ ID NO: 170119 - DNA, 12 bp, Unknown
  misc_feature (1)..( 12): Result.005 file - promoters50/1397753
ctcatataaata

SEQ ID NO: 170120 - DNA, 12 bp, Unknown
  misc_feature (1)..( 12): Result.005 file - promoters50/1397753
agttaatatttc

SEQ ID NO: 170121 - DNA, 12 bp, Unknown
  misc_feature (1)..( 12): Result.005 file - promoters50/1397821
gaattgattatg

SEQ ID NO: 170122 - DNA, 12 bp, Unknown
  misc_feature (1)..( 12): Result.005 file - promoters50/1397821
tctttggttaat

SEQ ID NO: 170123 - DNA, 12 bp, Unknown
  misc_feature (1)..( 12): Result.005 file - promoters50/1397821
taattcattgta

SEQ ID NO: 170124 - DNA, 12 bp, Unknown
  misc_feature (1)..( 12): Result.005 file - promoters50/1397821
gaattgatgtac

SEQ ID NO: 170125 - DNA, 12 bp, Unknown
  misc_feature (1)..( 12): Result.005 file - promoters50/1397821
gaaatgaaatat

SEQ ID NO: 170126 - DNA, 12 bp, Unknown
  misc_feature (1)..( 12): Result.005 file - promoters50/1397821
agcttgttgttt

SEQ ID NO: 170127 - DNA, 12 bp, Unknown
  misc_feature (1)..( 12): Result.005 file - promoters50/1397821
ggatcgtttttt

SEQ ID NO: 170128 - DNA, 11 bp, Unknown
  misc_feature (1)..( 11): Result.005 file - promoters50/1397821
tcaagtttgag

SEQ ID NO: 170129 - DNA, 11 bp, Unknown
  misc_feature (1)..( 11): Result.005 file - promoters50/1397821
aagagtctgat

SEQ ID NO: 170130 - DNA, 11 bp, Unknown
  misc_feature (1)..( 11): Result.005 file - promoters50/1397821
tcaattttgct

SEQ ID NO: 170131 - DNA, 11 bp, Unknown
  misc_feature (1)..( 11): Result.005 file - promoters50/1397821
ctaattttaat

SEQ ID NO: 170132 - DNA, 11 bp, Unknown
  misc_feature (1)..( 11): Result.005 file - promoters50/1397821
acgagcctgat

SEQ ID NO: 170133 - DNA, 11 bp, Unknown
  misc_feature (1)..( 11): Result.005 file - promoters50/1397821
ttcagtttctc

SEQ ID NO: 170134 - DNA, 9 bp, Unknown
  misc_feature (1)..( 9): Result.005 file - promoters50/1397821
aaaacattg

SEQ ID NO: 170135 - DNA, 9 bp, Unknown
  misc_feature (1)..( 9): Result.005 file - promoters50/1397821
aaaacattg

SEQ ID NO: 170136 - DNA, 9 bp, Unknown
  misc_feature (1)..( 9): Result.005 file - promoters50/1397821
aaaacagtg

SEQ ID NO: 170137 - DNA, 9 bp, Unknown
  misc_feature (1)..( 9): Result.005 file - promoters50/1397821
aaaaaattc

SEQ ID NO: 170138 - DNA, 10 bp, Unknown
  misc_feature (1)..( 10): Result.005 file - promoters50/1397821
aaaataatat

SEQ ID NO: 170139 - DNA, 10 bp, Unknown
  misc_feature (1)..( 10): Result.005 file - promoters50/1397821
tttaacattt

SEQ ID NO: 170140 - DNA, 14 bp, Unknown
  misc_feature (1)..( 14): Result.005 file - promoters50/1397852
cccaaaataatttg

SEQ ID NO: 170141 - DNA, 14 bp, Unknown
  misc_feature (1)..( 14): Result.005 file - promoters50/1397852
agaaaattaattga

SEQ ID NO: 170142 - DNA, 14 bp, Unknown
  misc_feature (1)..( 14): Result.005 file - promoters50/1397852
cccaaactaaccgg

SEQ ID NO: 170143 - DNA, 14 bp, Unknown
  misc_feature (1)..( 14): Result.005 file - promoters50/1397852
aaattcataatttg

SEQ ID NO: 170144 - DNA, 14 bp, Unknown
  misc_feature (1)..( 14): Result.005 file - promoters50/1397852
aaccacttaccatc

SEQ ID NO: 170145 - DNA, 14 bp, Unknown
  misc_feature (1)..( 14): Result.005 file - promoters50/1397852
attaaactatggca

SEQ ID NO: 170146 - DNA, 13 bp, Unknown
  misc_feature (1)..( 13): Result.005 file - promoters50/1397852
tgcaaacaagttt

SEQ ID NO: 170147 - DNA, 13 bp, Unknown
  misc_feature (1)..( 13): Result.005 file - promoters50/1397852
ataaaaaaagagg

SEQ ID NO: 170148 - DNA, 13 bp, Unknown
  misc_feature (1)..( 13): Result.005 file - promoters50/1397852
aacaaaaaaaacc

SEQ ID NO: 170149 - DNA, 13 bp, Unknown
  misc_feature (1)..( 13): Result.005 file - promoters50/1397852
ataaaataaatta

SEQ ID NO: 170150 - DNA, 13 bp, Unknown
  misc_feature (1)..( 13): Result.005 file - promoters50/1397852
cagaaagaaaacc

SEQ ID NO: 170151 - DNA, 13 bp, Unknown
  misc_feature (1)..( 13): Result.005 file - promoters50/1397852
ataacataatctc

SEQ ID NO: 170152 - DNA, 13 bp, Unknown
  misc_feature (1)..( 13): Result.005 file - promoters50/1397867
aatgatttcattt

SEQ ID NO: 170153 - DNA, 13 bp, Unknown
  misc_feature (1)..( 13): Result.005 file - promoters50/1397867
acgttcttctttt

SEQ ID NO: 170154 - DNA, 13 bp, Unknown
  misc_feature (1)..( 13): Result.005 file - promoters50/1397867
ttcacattctttt

SEQ ID NO: 170155 - DNA, 13 bp, Unknown
  misc_feature (1)..( 13): Result.005 file - promoters50/1397867
atctaattcttaa

SEQ ID NO: 170156 - DNA, 13 bp, Unknown
  misc_feature (1)..( 13): Result.005 file - promoters50/1397867
tttggattctttc

SEQ ID NO: 170157 - DNA, 13 bp, Unknown
  misc_feature (1)..( 13): Result.005 file - promoters50/1397867
tttggtttctagg

SEQ ID NO: 170158 - DNA, 13 bp, Unknown
  misc_feature (1)..( 13): Result.005 file - promoters50/1397867
aatggttttagaa

SEQ ID NO: 170159 - DNA, 8 bp, Unknown
  misc_feature (1)..( 8): Result.005 file - promoters50/1397898
gaattatt

SEQ ID NO: 170160 - DNA, 8 bp, Unknown
  misc_feature (1)..( 8): Result.005 file - promoters50/1397898
gaatgatt

SEQ ID NO: 170161 - DNA, 8 bp, Unknown
  misc_feature (1)..( 8): Result.005 file - promoters50/1397898
taatgata

SEQ ID NO: 170162 - DNA, 8 bp, Unknown
  misc_feature (1)..( 8): Result.005 file - promoters50/1397898
taatgaga

SEQ ID NO: 170163 - DNA, 13 bp, Unknown
  misc_feature (1)..( 13): Result.005 file - promoters50/1397898
cttgattacatga

SEQ ID NO: 170164 - DNA, 13 bp, Unknown
  misc_feature (1)..( 13): Result.005 file - promoters50/1397898
tatgattatatga

SEQ ID NO: 170165 - DNA, 13 bp, Unknown
  misc_feature (1)..( 13): Result.005 file - promoters50/1397898
tattatttgacaa

SEQ ID NO: 170166 - DNA, 13 bp, Unknown
  misc_feature (1)..( 13): Result.005 file - promoters50/1397898
aacgatgatacag

SEQ ID NO: 170167 - DNA, 11 bp, Unknown
  misc_feature (1)..( 11): Result.005 file - promoters50/1397923
accttttacga

SEQ ID NO: 170168 - DNA, 11 bp, Unknown
  misc_feature (1)..( 11): Result.005 file - promoters50/1397923
ttattttacta

SEQ ID NO: 170169 - DNA, 11 bp, Unknown
  misc_feature (1)..( 11): Result.005 file - promoters50/1397923
agattttataa

SEQ ID NO: 170170 - DNA, 11 bp, Unknown
  misc_feature (1)..( 11): Result.005 file - promoters50/1397923
ttattttatag

SEQ ID NO: 170171 - DNA, 11 bp, Unknown
  misc_feature (1)..( 11): Result.005 file - promoters50/1397923
tccttttccta

SEQ ID NO: 170172 - DNA, 11 bp, Unknown
  misc_feature (1)..( 11): Result.005 file - promoters50/1397923
caatttgatat

SEQ ID NO: 170173 - DNA, 11 bp, Unknown
  misc_feature (1)..( 11): Result.005 file - promoters50/1397923
ttttttttttg

SEQ ID NO: 170174 - DNA, 10 bp, Unknown
  misc_feature (1)..( 10): Result.005 file - promoters50/1397923
ttagatatgt

SEQ ID NO: 170175 - DNA, 10 bp, Unknown
  misc_feature (1)..( 10): Result.005 file - promoters50/1397923
ttacataaaa

SEQ ID NO: 170176 - DNA, 10 bp, Unknown
  misc_feature (1)..( 10): Result.005 file - promoters50/1397923
ttaaatatag

SEQ ID NO: 170177 - DNA, 10 bp, Unknown
  misc_feature (1)..( 10): Result.005 file - promoters50/1397923
ctagatttgt

SEQ ID NO: 170178 - DNA, 10 bp, Unknown
  misc_feature (1)..( 10): Result.005 file - promoters50/1397923
gtaggtatac

SEQ ID NO: 170179 - DNA, 10 bp, Unknown
  misc_feature (1)..( 10): Result.005 file - promoters50/1397923
ctacttaaca

SEQ ID NO: 170180 - DNA, 10 bp, Unknown
  misc_feature (1)..( 10): Result.005 file - promoters50/1397923
tatgatttgt

SEQ ID NO: 170181 - DNA, 11 bp, Unknown
  misc_feature (1)..( 11): Result.005 file - promoters50/1397923
gtttttgattt

SEQ ID NO: 170182 - DNA, 11 bp, Unknown
  misc_feature (1)..( 11): Result.005 file - promoters50/1397923
ttttatgaaac

SEQ ID NO: 170183 - DNA, 11 bp, Unknown
  misc_feature (1)..( 11): Result.005 file - promoters50/1397923
tattttaattt

SEQ ID NO: 170184 - DNA, 11 bp, Unknown
  misc_feature (1)..( 11): Result.005 file - promoters50/1397923
ttttttggaca

SEQ ID NO: 170185 - DNA, 11 bp, Unknown
  misc_feature (1)..( 11): Result.005 file - promoters50/1397923
gttattgcaga

SEQ ID NO: 170186 - DNA, 11 bp, Unknown
  misc_feature (1)..( 11): Result.005 file - promoters50/1397923
gttaatgcggt

SEQ ID NO: 170187 - DNA, 17 bp, Unknown
  misc_feature (1)..( 17): Result.005 file - promoters50/1397923
gtagtaaaagtttatgg

SEQ ID NO: 170188 - DNA, 17 bp, Unknown
  misc_feature (1)..( 17): Result.005 file - promoters50/1397923
gaaataaaagatgtata

SEQ ID NO: 170189 - DNA, 17 bp, Unknown
  misc_feature (1)..( 17): Result.005 file - promoters50/1397923
acaagaaaaaaaaaatg

SEQ ID NO: 170190 - DNA, 17 bp, Unknown
  misc_feature (1)..( 17): Result.005 file - promoters50/1397923
actctaaaaattgtcaa

SEQ ID NO: 170191 - DNA, 17 bp, Unknown
  misc_feature (1)..( 17): Result.005 file - promoters50/1397923
gaaataaaaattgggtt

SEQ ID NO: 170192 - DNA, 17 bp, Unknown
  misc_feature (1)..( 17): Result.005 file - promoters50/1397923
agaagaaaaaaaacatt

SEQ ID NO: 170193 - DNA, 14 bp, Unknown
  misc_feature (1)..( 14): Result.005 file - promoters50/1397923
ataataattttttt

SEQ ID NO: 170194 - DNA, 9 bp, Unknown
  misc_feature (1)..( 9): Result.005 file - promoters50/1397923
aatatttac

SEQ ID NO: 170195 - DNA, 14 bp, Unknown
  misc_feature (1)..( 14): Result.005 file - promoters50/1397923
aatactcttttttt

SEQ ID NO: 170196 - DNA, 14 bp, Unknown
  misc_feature (1)..( 14): Result.005 file - promoters50/1397923
gtgataatttcacg

SEQ ID NO: 170197 - DNA, 14 bp, Unknown
  misc_feature (1)..( 14): Result.005 file - promoters50/1397923
ataaaaatttgatt

SEQ ID NO: 170198 - DNA, 14 bp, Unknown
  misc_feature (1)..( 14): Result.005 file - promoters50/1397923
gttataattgtaca

SEQ ID NO: 170199 - DNA, 11 bp, Unknown
  misc_feature (1)..( 11): Result.005 file - promoters50/1397923
aaatttgtaaa

SEQ ID NO: 170200 - DNA, 11 bp, Unknown
  misc_feature (1)..( 11): Result.005 file - promoters50/1397923
aaatttgaaaa

SEQ ID NO: 170201 - DNA, 11 bp, Unknown
  misc_feature (1)..( 11): Result.005 file - promoters50/1397923
ttttttataaa

SEQ ID NO: 170202 - DNA, 11 bp, Unknown
  misc_feature (1)..( 11): Result.005 file - promoters50/1397923
ctttttgtagg

SEQ ID NO: 170203 - DNA, 11 bp, Unknown
  misc_feature (1)..( 11): Result.005 file - promoters50/1397923
acatttttaag

SEQ ID NO: 170204 - DNA, 11 bp, Unknown
  misc_feature (1)..( 11): Result.005 file - promoters50/1397923
ttttttttatt

SEQ ID NO: 170205 - DNA, 8 bp, Unknown
  misc_feature (1)..( 8): Result.005 file - promoters50/1398069
caattttt

SEQ ID NO: 170206 - DNA, 8 bp, Unknown
  misc_feature (1)..( 8): Result.005 file - promoters50/1398069
caactttt

SEQ ID NO: 170207 - DNA, 8 bp, Unknown
  misc_feature (1)..( 8): Result.005 file - promoters50/1398069
caaccttt

SEQ ID NO: 170208 - DNA, 8 bp, Unknown
  misc_feature (1)..( 8): Result.005 file - promoters50/1398069
atatcaga

SEQ ID NO: 170209 - DNA, 8 bp, Unknown
  misc_feature (1)..( 8): Result.005 file - promoters50/1398069
gtataaga

SEQ ID NO: 170210 - DNA, 8 bp, Unknown
  misc_feature (1)..( 8): Result.005 file - promoters50/1398069
atatcaaa

SEQ ID NO: 170211 - DNA, 8 bp, Unknown
  misc_feature (1)..( 8): Result.005 file - promoters50/1398069
aataattg

SEQ ID NO: 170212 - DNA, 8 bp, Unknown
  misc_feature (1)..( 8): Result.005 file - promoters50/1398069
aataattg

SEQ ID NO: 170213 - DNA, 8 bp, Unknown
  misc_feature (1)..( 8): Result.005 file - promoters50/1398069
aatcatta

SEQ ID NO: 170214 - DNA, 9 bp, Unknown
  misc_feature (1)..( 9): Result.005 file - promoters50/1398069
caaactccc

SEQ ID NO: 170215 - DNA, 9 bp, Unknown
  misc_feature (1)..( 9): Result.005 file - promoters50/1398069
caaaatcca

SEQ ID NO: 170216 - DNA, 9 bp, Unknown
  misc_feature (1)..( 9): Result.005 file - promoters50/1398069
ataaatcca

SEQ ID NO: 170217 - DNA, 8 bp, Unknown
  misc_feature (1)..( 8): Result.005 file - promoters50/1398069
aacaaaaa

SEQ ID NO: 170218 - DNA, 8 bp, Unknown
  misc_feature (1)..( 8): Result.005 file - promoters50/1398069
aacaaaat

SEQ ID NO: 170219 - DNA, 8 bp, Unknown
  misc_feature (1)..( 8): Result.005 file - promoters50/1398069
tccaaaat

SEQ ID NO: 170220 - DNA, 8 bp, Unknown
  misc_feature (1)..( 8): Result.005 file - promoters50/1398081
ttatatca

SEQ ID NO: 170221 - DNA, 8 bp, Unknown
  misc_feature (1)..( 8): Result.005 file - promoters50/1398081
tcatatca

SEQ ID NO: 170222 - DNA, 8 bp, Unknown
  misc_feature (1)..( 8): Result.005 file - promoters50/1398081
ttagatcg

SEQ ID NO: 170223 - DNA, 8 bp, Unknown
  misc_feature (1)..( 8): Result.005 file - promoters50/1398081
agataagt

SEQ ID NO: 170224 - DNA, 8 bp, Unknown
  misc_feature (1)..( 8): Result.005 file - promoters50/1398081
taataagt

SEQ ID NO: 170225 - DNA, 8 bp, Unknown
  misc_feature (1)..( 8): Result.005 file - promoters50/1398081
agagaaga

SEQ ID NO: 170226 - DNA, 6 bp, Unknown
  misc_feature (1)..( 6): Result.005 file - promoters50/1398081
agtaaa

SEQ ID NO: 170227 - DNA, 6 bp, Unknown
  misc_feature (1)..( 6): Result.005 file - promoters50/1398081
agtaaa

SEQ ID NO: 170228 - DNA, 6 bp, Unknown
  misc_feature (1)..( 6): Result.005 file - promoters50/1398081
agtaaa

SEQ ID NO: 170229 - DNA, 14 bp, Unknown
  misc_feature (1)..( 14): Result.005 file - promoters50/1398081
caacaaaatttggt

SEQ ID NO: 170230 - DNA, 14 bp, Unknown
  misc_feature (1)..( 14): Result.005 file - promoters50/1398081
caataaaagttgca

SEQ ID NO: 170231 - DNA, 14 bp, Unknown
  misc_feature (1)..( 14): Result.005 file - promoters50/1398081
cctacaattttgtt

SEQ ID NO: 170232 - DNA, 14 bp, Unknown
  misc_feature (1)..( 14): Result.005 file - promoters50/1398081
atacataattcata

SEQ ID NO: 170233 - DNA, 15 bp, Unknown
  misc_feature (1)..( 15): Result.005 file - promoters50/1398081
attggttatcttttg

SEQ ID NO: 170234 - DNA, 15 bp, Unknown
  misc_feature (1)..( 15): Result.005 file - promoters50/1398081
atttgttatctattg

SEQ ID NO: 170235 - DNA, 15 bp, Unknown
  misc_feature (1)..( 15): Result.005 file - promoters50/1398081
ctaggatatttttta

SEQ ID NO: 170236 - DNA, 15 bp, Unknown
  misc_feature (1)..( 15): Result.005 file - promoters50/1398081
atgaagaatattttc

SEQ ID NO: 170237 - DNA, 9 bp, Unknown
  misc_feature (1)..( 9): Result.005 file - promoters50/1398081
ttagatatg

SEQ ID NO: 170238 - DNA, 9 bp, Unknown
  misc_feature (1)..( 9): Result.005 file - promoters50/1398081
ttaaataaa

SEQ ID NO: 170239 - DNA, 9 bp, Unknown
  misc_feature (1)..( 9): Result.005 file - promoters50/1398081
caaaataaa

SEQ ID NO: 170240 - DNA, 11 bp, Unknown
  misc_feature (1)..( 11): Result.005 file - promoters50/1398114
aaagaaatgaa

SEQ ID NO: 170241 - DNA, 11 bp, Unknown
  misc_feature (1)..( 11): Result.005 file - promoters50/1398114
ggagagatgag

SEQ ID NO: 170242 - DNA, 11 bp, Unknown
  misc_feature (1)..( 11): Result.005 file - promoters50/1398114
aaacaaaccac

SEQ ID NO: 170243 - DNA, 11 bp, Unknown
  misc_feature (1)..( 11): Result.005 file - promoters50/1398114
ctagagattgt

SEQ ID NO: 170244 - DNA, 11 bp, Unknown
  misc_feature (1)..( 11): Result.005 file - promoters50/1398114
acagagttgat

SEQ ID NO: 170245 - DNA, 11 bp, Unknown
  misc_feature (1)..( 11): Result.005 file - promoters50/1398114
ctcaggttgat

SEQ ID NO: 170246 - DNA, 14 bp, Unknown
  misc_feature (1)..( 14): Result.005 file - promoters50/1398114
ttacacaagtttcc

SEQ ID NO: 170247 - DNA, 14 bp, Unknown
  misc_feature (1)..( 14): Result.005 file - promoters50/1398114
tgacacaaacaccc

SEQ ID NO: 170248 - DNA, 14 bp, Unknown
  misc_feature (1)..( 14): Result.005 file - promoters50/1398114
ccacacgagtagac

SEQ ID NO: 170249 - DNA, 14 bp, Unknown
  misc_feature (1)..( 14): Result.005 file - promoters50/1398114
gaacacaattttaa

SEQ ID NO: 170250 - DNA, 14 bp, Unknown
  misc_feature (1)..( 14): Result.005 file - promoters50/1398114
tataccaaatttaa

SEQ ID NO: 170251 - DNA, 14 bp, Unknown
  misc_feature (1)..( 14): Result.005 file - promoters50/1398114
atacaaaagttatc

SEQ ID NO: 170252 - DNA, 12 bp, Unknown
  misc_feature (1)..( 12): Result.005 file - promoters50/1398124
aaattattttaa

SEQ ID NO: 170253 - DNA, 12 bp, Unknown
  misc_feature (1)..( 12): Result.005 file - promoters50/1398124
atgttatattaa

SEQ ID NO: 170254 - DNA, 12 bp, Unknown
  misc_feature (1)..( 12): Result.005 file - promoters50/1398124
tttcaatattgg

SEQ ID NO: 170255 - DNA, 12 bp, Unknown
  misc_feature (1)..( 12): Result.005 file - promoters50/1398124
aacttattttat

SEQ ID NO: 170256 - DNA, 12 bp, Unknown
  misc_feature (1)..( 12): Result.005 file - promoters50/1398124
gttttgaattca

SEQ ID NO: 170257 - DNA, 12 bp, Unknown
  misc_feature (1)..( 12): Result.005 file - promoters50/1398124
ctatcatattat

SEQ ID NO: 170258 - DNA, 12 bp, Unknown
  misc_feature (1)..( 12): Result.005 file - promoters50/1398124
tatctattttgt

SEQ ID NO: 170259 - DNA, 10 bp, Unknown
  misc_feature (1)..( 10): Result.005 file - promoters50/1398226
aaattcttgg

SEQ ID NO: 170260 - DNA, 10 bp, Unknown
  misc_feature (1)..( 10): Result.005 file - promoters50/1398226
aaattcttca

SEQ ID NO: 170261 - DNA, 10 bp, Unknown
  misc_feature (1)..( 10): Result.005 file - promoters50/1398226
aaagtcttgg

SEQ ID NO: 170262 - DNA, 11 bp, Unknown
  misc_feature (1)..( 11): Result.005 file - promoters50/1398337
taaacacaaac

SEQ ID NO: 170263 - DNA, 11 bp, Unknown
  misc_feature (1)..( 11): Result.005 file - promoters50/1398337
gaaacaaaaac

SEQ ID NO: 170264 - DNA, 11 bp, Unknown
  misc_feature (1)..( 11): Result.005 file - promoters50/1398337
gaaagaaagct

SEQ ID NO: 170265 - DNA, 10 bp, Unknown
  misc_feature (1)..( 10): Result.005 file - promoters50/1398337
ctaaattggg

SEQ ID NO: 170266 - DNA, 10 bp, Unknown
  misc_feature (1)..( 10): Result.005 file - promoters50/1398337
tgtaatcggg

SEQ ID NO: 170267 - DNA, 10 bp, Unknown
  misc_feature (1)..( 10): Result.005 file - promoters50/1398337
tgtgatcgaa

SEQ ID NO: 170268 - DNA, 8 bp, Unknown
  misc_feature (1)..( 8): Result.005 file - promoters50/1398337
ggttttgt

SEQ ID NO: 170269 - DNA, 8 bp, Unknown
  misc_feature (1)..( 8): Result.005 file - promoters50/1398337
ggtgttgg

SEQ ID NO: 170270 - DNA, 8 bp, Unknown
  misc_feature (1)..( 8): Result.005 file - promoters50/1398337
ctcgttgt

SEQ ID NO: 170271 - DNA, 8 bp, Unknown
  misc_feature (1)..( 8): Result.005 file - promoters50/1398345
aaaaatat

SEQ ID NO: 170272 - DNA, 8 bp, Unknown
  misc_feature (1)..( 8): Result.005 file - promoters50/1398345
aaaaatat

SEQ ID NO: 170273 - DNA, 8 bp, Unknown
  misc_feature (1)..( 8): Result.005 file - promoters50/1398345
aaatatat

SEQ ID NO: 170274 - DNA, 8 bp, Unknown
  misc_feature (1)..( 8): Result.005 file - promoters50/1398345
aaaaataa

SEQ ID NO: 170275 - DNA, 8 bp, Unknown
  misc_feature (1)..( 8): Result.005 file - promoters50/1398345
aaacatat

SEQ ID NO: 170276 - DNA, 9 bp, Unknown
  misc_feature (1)..( 9): Result.005 file - promoters50/1398345
caaaaagta

SEQ ID NO: 170277 - DNA, 9 bp, Unknown
  misc_feature (1)..( 9): Result.005 file - promoters50/1398345
ataaaagta

SEQ ID NO: 170278 - DNA, 9 bp, Unknown
  misc_feature (1)..( 9): Result.005 file - promoters50/1398345
taaaaagtt

SEQ ID NO: 170279 - DNA, 9 bp, Unknown
  misc_feature (1)..( 9): Result.005 file - promoters50/1398345
atataaggc

SEQ ID NO: 170280 - DNA, 9 bp, Unknown
  misc_feature (1)..( 9): Result.005 file - promoters50/1398345
ataaaaaca

SEQ ID NO: 170281 - DNA, 9 bp, Unknown
  misc_feature (1)..( 9): Result.005 file - promoters50/1398345
tgattccat

SEQ ID NO: 170282 - DNA, 9 bp, Unknown
  misc_feature (1)..( 9): Result.005 file - promoters50/1398345
aaattccaa

SEQ ID NO: 170283 - DNA, 9 bp, Unknown
  misc_feature (1)..( 9): Result.005 file - promoters50/1398345
agattacat

SEQ ID NO: 170284 - DNA, 9 bp, Unknown
  misc_feature (1)..( 9): Result.005 file - promoters50/1398345
ggattacag

SEQ ID NO: 170285 - DNA, 9 bp, Unknown
  misc_feature (1)..( 9): Result.005 file - promoters50/1398345
agattagta

SEQ ID NO: 170286 - DNA, 15 bp, Unknown
  misc_feature (1)..( 15): Result.005 file - promoters50/1398345
cattagaccattacg

SEQ ID NO: 170287 - DNA, 15 bp, Unknown
  misc_feature (1)..( 15): Result.005 file - promoters50/1398345
aattagagtttgctt

SEQ ID NO: 170288 - DNA, 15 bp, Unknown
  misc_feature (1)..( 15): Result.005 file - promoters50/1398345
aataagaatcaattt

SEQ ID NO: 170289 - DNA, 15 bp, Unknown
  misc_feature (1)..( 15): Result.005 file - promoters50/1398345
gataagaaaaacaaa

SEQ ID NO: 170290 - DNA, 15 bp, Unknown
  misc_feature (1)..( 15): Result.005 file - promoters50/1398345
aataacaaaaataaa

SEQ ID NO: 170291 - DNA, 18 bp, Unknown
  misc_feature (1)..( 18): Result.005 file - promoters50/1398345
tcaaacatataacaaaga

SEQ ID NO: 170292 - DNA, 18 bp, Unknown
  misc_feature (1)..( 18): Result.005 file - promoters50/1398345
acattaatataatatctc

SEQ ID NO: 170293 - DNA, 18 bp, Unknown
  misc_feature (1)..( 18): Result.005 file - promoters50/1398345
aaaaacttatactattgt

SEQ ID NO: 170294 - DNA, 18 bp, Unknown
  misc_feature (1)..( 18): Result.005 file - promoters50/1398345
aaaatcttactaatcaaa

SEQ ID NO: 170295 - DNA, 19 bp, Unknown
  misc_feature (1)..( 19): Result.005 file - promoters50/1398345
caaatattaataattaaat

SEQ ID NO: 170296 - DNA, 14 bp, Unknown
  misc_feature (1)..( 14): Result.005 file - promoters50/1398345
aaagaaaattaact

SEQ ID NO: 170297 - DNA, 14 bp, Unknown
  misc_feature (1)..( 14): Result.005 file - promoters50/1398345
aaataaaaataaat

SEQ ID NO: 170298 - DNA, 14 bp, Unknown
  misc_feature (1)..( 14): Result.005 file - promoters50/1398345
attaataattaaat

SEQ ID NO: 170299 - DNA, 14 bp, Unknown
  misc_feature (1)..( 14): Result.005 file - promoters50/1398345
cttactaatcaaat

SEQ ID NO: 170300 - DNA, 14 bp, Unknown
  misc_feature (1)..( 14): Result.005 file - promoters50/1398345
tttcaaaaagaaat

SEQ ID NO: 170301 - DNA, 9 bp, Unknown
  misc_feature (1)..( 9): Result.005 file - promoters50/1398401
gaaatagtt

SEQ ID NO: 170302 - DNA, 9 bp, Unknown
  misc_feature (1)..( 9): Result.005 file - promoters50/1398401
gaaattgtt

SEQ ID NO: 170303 - DNA, 9 bp, Unknown
  misc_feature (1)..( 9): Result.005 file - promoters50/1398401
gaaatatct

SEQ ID NO: 170304 - DNA, 9 bp, Unknown
  misc_feature (1)..( 9): Result.005 file - promoters50/1398401
aaaattggc

SEQ ID NO: 170305 - DNA, 9 bp, Unknown
  misc_feature (1)..( 9): Result.005 file - promoters50/1398401
aaaatttct

SEQ ID NO: 170306 - DNA, 16 bp, Unknown
  misc_feature (1)..( 16): Result.005 file - promoters50/1398401
aaattaccaaaaattc

SEQ ID NO: 170307 - DNA, 16 bp, Unknown
  misc_feature (1)..( 16): Result.005 file - promoters50/1398401
atatcatcaagaatca

SEQ ID NO: 170308 - DNA, 16 bp, Unknown
  misc_feature (1)..( 16): Result.005 file - promoters50/1398401
aaattatcaaaaggat

SEQ ID NO: 170309 - DNA, 16 bp, Unknown
  misc_feature (1)..( 16): Result.005 file - promoters50/1398401
tactttcccaaagtat

SEQ ID NO: 170310 - DNA, 16 bp, Unknown
  misc_feature (1)..( 16): Result.005 file - promoters50/1398401
ccattatcttcttcgg

SEQ ID NO: 170311 - DNA, 8 bp, Unknown
  misc_feature (1)..( 8): Result.005 file - promoters50/1398409
aaagtaat

SEQ ID NO: 170312 - DNA, 8 bp, Unknown
  misc_feature (1)..( 8): Result.005 file - promoters50/1398409
aaaataat

SEQ ID NO: 170313 - DNA, 8 bp, Unknown
  misc_feature (1)..( 8): Result.005 file - promoters50/1398409
aaactaaa

SEQ ID NO: 170314 - DNA, 8 bp, Unknown
  misc_feature (1)..( 8): Result.005 file - promoters50/1398409
aaattaac

SEQ ID NO: 170315 - DNA, 9 bp, Unknown
  misc_feature (1)..( 9): Result.005 file - promoters50/1398409
aaccttaca

SEQ ID NO: 170316 - DNA, 9 bp, Unknown
  misc_feature (1)..( 9): Result.005 file - promoters50/1398409
aagcttaca

SEQ ID NO: 170317 - DNA, 9 bp, Unknown
  misc_feature (1)..( 9): Result.005 file - promoters50/1398409
aagcatacc

SEQ ID NO: 170318 - DNA, 8 bp, Unknown
  misc_feature (1)..( 8): Result.005 file - promoters50/1398409
tgaagaaa

SEQ ID NO: 170319 - DNA, 8 bp, Unknown
  misc_feature (1)..( 8): Result.005 file - promoters50/1398409
ctaagaaa

SEQ ID NO: 170320 - DNA, 8 bp, Unknown
  misc_feature (1)..( 8): Result.005 file - promoters50/1398409
ctatgaat

SEQ ID NO: 170321 - DNA, 10 bp, Unknown
  misc_feature (1)..( 10): Result.005 file - promoters50/1398409
taaacaaaat

SEQ ID NO: 170322 - DNA, 10 bp, Unknown
  misc_feature (1)..( 10): Result.005 file - promoters50/1398409
taaactaaat

SEQ ID NO: 170323 - DNA, 10 bp, Unknown
  misc_feature (1)..( 10): Result.005 file - promoters50/1398409
caaattaacg

SEQ ID NO: 170324 - DNA, 10 bp, Unknown
  misc_feature (1)..( 10): Result.005 file - promoters50/1398409
gaaaataatg

SEQ ID NO: 170325 - DNA, 10 bp, Unknown
  misc_feature (1)..( 10): Result.005 file - promoters50/1398409
cccacacttt

SEQ ID NO: 170326 - DNA, 10 bp, Unknown
  misc_feature (1)..( 10): Result.005 file - promoters50/1398409
atcacatttt

SEQ ID NO: 170327 - DNA, 10 bp, Unknown
  misc_feature (1)..( 10): Result.005 file - promoters50/1398409
atcaaattaa

SEQ ID NO: 170328 - DNA, 9 bp, Unknown
  misc_feature (1)..( 9): Result.005 file - promoters50/1398409
agtaaattt

SEQ ID NO: 170329 - DNA, 9 bp, Unknown
  misc_feature (1)..( 9): Result.005 file - promoters50/1398409
agtatatta

SEQ ID NO: 170330 - DNA, 9 bp, Unknown
  misc_feature (1)..( 9): Result.005 file - promoters50/1398409
atcatatta

SEQ ID NO: 170331 - DNA, 12 bp, Unknown
  misc_feature (1)..( 12): Result.005 file - promoters50/1398409
cggttagagaaa

SEQ ID NO: 170332 - DNA, 12 bp, Unknown
  misc_feature (1)..( 12): Result.005 file - promoters50/1398409
tataaagaaaaa

SEQ ID NO: 170333 - DNA, 12 bp, Unknown
  misc_feature (1)..( 12): Result.005 file - promoters50/1398409
atataaggaaat

SEQ ID NO: 170334 - DNA, 9 bp, Unknown
  misc_feature (1)..( 9): Result.005 file - promoters50/1398413
taaaatcat

SEQ ID NO: 170335 - DNA, 9 bp, Unknown
  misc_feature (1)..( 9): Result.005 file - promoters50/1398413
taaactcat

SEQ ID NO: 170336 - DNA, 9 bp, Unknown
  misc_feature (1)..( 9): Result.005 file - promoters50/1398413
ataaatcat

SEQ ID NO: 170337 - DNA, 8 bp, Unknown
  misc_feature (1)..( 8): Result.005 file - promoters50/1398413
acaatatt

SEQ ID NO: 170338 - DNA, 8 bp, Unknown
  misc_feature (1)..( 8): Result.005 file - promoters50/1398413
tcaatatt

SEQ ID NO: 170339 - DNA, 8 bp, Unknown
  misc_feature (1)..( 8): Result.005 file - promoters50/1398413
tcaataaa

SEQ ID NO: 170340 - DNA, 8 bp, Unknown
  misc_feature (1)..( 8): Result.005 file - promoters50/1398431
caattaaa

SEQ ID NO: 170341 - DNA, 8 bp, Unknown
  misc_feature (1)..( 8): Result.005 file - promoters50/1398431
aaattaaa

SEQ ID NO: 170342 - DNA, 8 bp, Unknown
  misc_feature (1)..( 8): Result.005 file - promoters50/1398431
aaattagg

SEQ ID NO: 170343 - DNA, 7 bp, Unknown
  misc_feature (1)..( 7): Result.005 file - promoters50/1398431
aaaatta

SEQ ID NO: 170344 - DNA, 7 bp, Unknown
  misc_feature (1)..( 7): Result.005 file - promoters50/1398431
aaaatta

SEQ ID NO: 170345 - DNA, 7 bp, Unknown
  misc_feature (1)..( 7): Result.005 file - promoters50/1398431
gaaatta

SEQ ID NO: 170346 - DNA, 13 bp, Unknown
  misc_feature (1)..( 13): Result.005 file - promoters50/1398444
ggctaaactaact

SEQ ID NO: 170347 - DNA, 13 bp, Unknown
  misc_feature (1)..( 13): Result.005 file - promoters50/1398444
aaaaaaaataact

SEQ ID NO: 170348 - DNA, 13 bp, Unknown
  misc_feature (1)..( 13): Result.005 file - promoters50/1398444
aaagaaaataaac

SEQ ID NO: 170349 - DNA, 9 bp, Unknown
  misc_feature (1)..( 9): Result.005 file - promoters50/1398444
attcaaggt

SEQ ID NO: 170350 - DNA, 9 bp, Unknown
  misc_feature (1)..( 9): Result.005 file - promoters50/1398444
attgaagct

SEQ ID NO: 170351 - DNA, 9 bp, Unknown
  misc_feature (1)..( 9): Result.005 file - promoters50/1398444
tatgatgct

SEQ ID NO: 170352 - DNA, 10 bp, Unknown
  misc_feature (1)..( 10): Result.005 file - promoters50/1398444
gattaaaatg

SEQ ID NO: 170353 - DNA, 10 bp, Unknown
  misc_feature (1)..( 10): Result.005 file - promoters50/1398444
ggttaatatg

SEQ ID NO: 170354 - DNA, 10 bp, Unknown
  misc_feature (1)..( 10): Result.005 file - promoters50/1398444
gatgaaaaat

SEQ ID NO: 170355 - DNA, 8 bp, Unknown
  misc_feature (1)..( 8): Result.005 file - promoters50/1398444
tctaattt

SEQ ID NO: 170356 - DNA, 8 bp, Unknown
  misc_feature (1)..( 8): Result.005 file - promoters50/1398444
tataattt

SEQ ID NO: 170357 - DNA, 8 bp, Unknown
  misc_feature (1)..( 8): Result.005 file - promoters50/1398444
tctagttt

SEQ ID NO: 170358 - DNA, 7 bp, Unknown
  misc_feature (1)..( 7): Result.005 file - promoters50/1398444
tataatt

SEQ ID NO: 170359 - DNA, 7 bp, Unknown
  misc_feature (1)..( 7): Result.005 file - promoters50/1398444
tatgatt

SEQ ID NO: 170360 - DNA, 7 bp, Unknown
  misc_feature (1)..( 7): Result.005 file - promoters50/1398444
aatgatt

SEQ ID NO: 170361 - DNA, 9 bp, Unknown
  misc_feature (1)..( 9): Result.005 file - promoters50/1398444
gaaacaaag

SEQ ID NO: 170362 - DNA, 9 bp, Unknown
  misc_feature (1)..( 9): Result.005 file - promoters50/1398444
gaaataaac

SEQ ID NO: 170363 - DNA, 9 bp, Unknown
  misc_feature (1)..( 9): Result.005 file - promoters50/1398444
ctgacaaag

SEQ ID NO: 170364 - DNA, 11 bp, Unknown
  misc_feature (1)..( 11): Result.005 file - promoters50/1398444
aaactattata

SEQ ID NO: 170365 - DNA, 11 bp, Unknown
  misc_feature (1)..( 11): Result.005 file - promoters50/1398444
aaattataaat

SEQ ID NO: 170366 - DNA, 11 bp, Unknown
  misc_feature (1)..( 11): Result.005 file - promoters50/1398444
aaagtataaat

SEQ ID NO: 170367 - DNA, 7 bp, Unknown
  misc_feature (1)..( 7): Result.005 file - promoters50/1398444
ggaatga

SEQ ID NO: 170368 - DNA, 7 bp, Unknown
  misc_feature (1)..( 7): Result.005 file - promoters50/1398444
ggattga

SEQ ID NO: 170369 - DNA, 7 bp, Unknown
  misc_feature (1)..( 7): Result.005 file - promoters50/1398444
tgattga

SEQ ID NO: 170370 - DNA, 7 bp, Unknown
  misc_feature (1)..( 7): Result.005 file - promoters50/1398451
aactaat

SEQ ID NO: 170371 - DNA, 7 bp, Unknown
  misc_feature (1)..( 7): Result.005 file - promoters50/1398451
aactaat

SEQ ID NO: 170372 - DNA, 7 bp, Unknown
  misc_feature (1)..( 7): Result.005 file - promoters50/1398451
aacaaat

SEQ ID NO: 170373 - DNA, 8 bp, Unknown
  misc_feature (1)..( 8): Result.005 file - promoters50/1398451
tcatattt

SEQ ID NO: 170374 - DNA, 8 bp, Unknown
  misc_feature (1)..( 8): Result.005 file - promoters50/1398451
tcatatta

SEQ ID NO: 170375 - DNA, 9 bp, Unknown
  misc_feature (1)..( 9): Result.005 file - promoters50/1398451
ggataattt

SEQ ID NO: 170376 - DNA, 8 bp, Unknown
  misc_feature (1)..( 8): Result.005 file - promoters50/1398451
taaatatc

SEQ ID NO: 170377 - DNA, 8 bp, Unknown
  misc_feature (1)..( 8): Result.005 file - promoters50/1398451
taactata

SEQ ID NO: 170378 - DNA, 8 bp, Unknown
  misc_feature (1)..( 8): Result.005 file - promoters50/1398451
aaattaat

SEQ ID NO: 170379 - DNA, 9 bp, Unknown
  misc_feature (1)..( 9): Result.005 file - promoters50/1398451
agatatttc

SEQ ID NO: 170380 - DNA, 9 bp, Unknown
  misc_feature (1)..( 9): Result.005 file - promoters50/1398451
tattatttc

SEQ ID NO: 170381 - DNA, 9 bp, Unknown
  misc_feature (1)..( 9): Result.005 file - promoters50/1398451
tattattta

SEQ ID NO: 170382 - DNA, 8 bp, Unknown
  misc_feature (1)..( 8): Result.005 file - promoters50/1398504
gaaagaag

SEQ ID NO: 170383 - DNA, 8 bp, Unknown
  misc_feature (1)..( 8): Result.005 file - promoters50/1398504
ggaagaag

SEQ ID NO: 170384 - DNA, 9 bp, Unknown
  misc_feature (1)..( 9): Result.005 file - promoters50/1398504
ggaacgaat

SEQ ID NO: 170385 - DNA, 8 bp, Unknown
  misc_feature (1)..( 8): Result.005 file - promoters50/1398504
tcggagaa

SEQ ID NO: 170386 - DNA, 8 bp, Unknown
  misc_feature (1)..( 8): Result.005 file - promoters50/1398504
tcgaagaa

SEQ ID NO: 170387 - DNA, 8 bp, Unknown
  misc_feature (1)..( 8): Result.005 file - promoters50/1398504
tggaagaa

SEQ ID NO: 170388 - DNA, 15 bp, Unknown
  misc_feature (1)..( 15): Result.005 file - promoters50/1398545
tcggatagttcaatt

SEQ ID NO: 170389 - DNA, 15 bp, Unknown
  misc_feature (1)..( 15): Result.005 file - promoters50/1398545
gaaaatagtttacta

SEQ ID NO: 170390 - DNA, 15 bp, Unknown
  misc_feature (1)..( 15): Result.005 file - promoters50/1398545
tttgttagttcaaaa

SEQ ID NO: 170391 - DNA, 15 bp, Unknown
  misc_feature (1)..( 15): Result.005 file - promoters50/1398545
taaaaaagtgttgag

SEQ ID NO: 170392 - DNA, 15 bp, Unknown
  misc_feature (1)..( 15): Result.005 file - promoters50/1398545
gattcatcttcaaaa

SEQ ID NO: 170393 - DNA, 15 bp, Unknown
  misc_feature (1)..( 15): Result.005 file - promoters50/1398545
taaaaaaaagtaatg

SEQ ID NO: 170394 - DNA, 15 bp, Unknown
  misc_feature (1)..( 15): Result.005 file - promoters50/1398545
taataaaatttcaca

SEQ ID NO: 170395 - DNA, 10 bp, Unknown
  misc_feature (1)..( 10): Result.005 file - promoters50/1398545
tttataaata

SEQ ID NO: 170396 - DNA, 10 bp, Unknown
  misc_feature (1)..( 10): Result.005 file - promoters50/1398545
tttatacata

SEQ ID NO: 170397 - DNA, 10 bp, Unknown
  misc_feature (1)..( 10): Result.005 file - promoters50/1398545
cctattaata

SEQ ID NO: 170398 - DNA, 10 bp, Unknown
  misc_feature (1)..( 10): Result.005 file - promoters50/1398545
cttataaaaa

SEQ ID NO: 170399 - DNA, 11 bp, Unknown
  misc_feature (1)..( 11): Result.005 file - promoters50/1398545
attagtaaaag

SEQ ID NO: 170400 - DNA, 11 bp, Unknown
  misc_feature (1)..( 11): Result.005 file - promoters50/1398545
tgtaataataa

SEQ ID NO: 170401 - DNA, 12 bp, Unknown
  misc_feature (1)..( 12): Result.005 file - promoters50/1398545
gaaataatattt

SEQ ID NO: 170402 - DNA, 12 bp, Unknown
  misc_feature (1)..( 12): Result.005 file - promoters50/1398545
gaaatatttttt

SEQ ID NO: 170403 - DNA, 12 bp, Unknown
  misc_feature (1)..( 12): Result.005 file - promoters50/1398545
aaaataaataca

SEQ ID NO: 170404 - DNA, 12 bp, Unknown
  misc_feature (1)..( 12): Result.005 file - promoters50/1398545
agaataaaaaca

SEQ ID NO: 170405 - DNA, 12 bp, Unknown
  misc_feature (1)..( 12): Result.005 file - promoters50/1398545
gaaaaaaaaaaa

SEQ ID NO: 170406 - DNA, 12 bp, Unknown
  misc_feature (1)..( 12): Result.005 file - promoters50/1398545
aacataaattgt

SEQ ID NO: 170407 - DNA, 9 bp, Unknown
  misc_feature (1)..( 9): Result.005 file - promoters50/1398545
gtttcggtt

SEQ ID NO: 170408 - DNA, 9 bp, Unknown
  misc_feature (1)..( 9): Result.005 file - promoters50/1398545
attttggtt

SEQ ID NO: 170409 - DNA, 9 bp, Unknown
  misc_feature (1)..( 9): Result.005 file - promoters50/1398545
tctttggtt

SEQ ID NO: 170410 - DNA, 9 bp, Unknown
  misc_feature (1)..( 9): Result.005 file - promoters50/1398545
aagttggtt

SEQ ID NO: 170411 - DNA, 9 bp, Unknown
  misc_feature (1)..( 9): Result.005 file - promoters50/1398545
attttgcta

SEQ ID NO: 170412 - DNA, 9 bp, Unknown
  misc_feature (1)..( 9): Result.005 file - promoters50/1398545
attttgcac

SEQ ID NO: 170413 - DNA, 15 bp, Unknown
  misc_feature (1)..( 15): Result.005 file - promoters50/1398545
ctaaaggcccaattt

SEQ ID NO: 170414 - DNA, 15 bp, Unknown
  misc_feature (1)..( 15): Result.005 file - promoters50/1398545
ttttcggcccaccgg

SEQ ID NO: 170415 - DNA, 15 bp, Unknown
  misc_feature (1)..( 15): Result.005 file - promoters50/1398545
ctaaaggcccaataa

SEQ ID NO: 170416 - DNA, 15 bp, Unknown
  misc_feature (1)..( 15): Result.005 file - promoters50/1398545
gtgaaagcccaaaac

SEQ ID NO: 170417 - DNA, 15 bp, Unknown
  misc_feature (1)..( 15): Result.005 file - promoters50/1398545
ggaatggcccagtaa

SEQ ID NO: 170418 - DNA, 15 bp, Unknown
  misc_feature (1)..( 15): Result.005 file - promoters50/1398545
tagaaagcccattaa

SEQ ID NO: 170419 - DNA, 12 bp, Unknown
  misc_feature (1)..( 12): Result.005 file - promoters50/1398558
tgaaaaagtaat

SEQ ID NO: 170420 - DNA, 12 bp, Unknown
  misc_feature (1)..( 12): Result.005 file - promoters50/1398558
tcaaaaggtatc

SEQ ID NO: 170421 - DNA, 12 bp, Unknown
  misc_feature (1)..( 12): Result.005 file - promoters50/1398558
tgataaactaat

SEQ ID NO: 170422 - DNA, 12 bp, Unknown
  misc_feature (1)..( 12): Result.005 file - promoters50/1398558
caataaagtagt

SEQ ID NO: 170423 - DNA, 9 bp, Unknown
  misc_feature (1)..( 9): Result.005 file - promoters50/1398558
cacaaacaa

SEQ ID NO: 170424 - DNA, 9 bp, Unknown
  misc_feature (1)..( 9): Result.005 file - promoters50/1398558
aacaatcaa

SEQ ID NO: 170425 - DNA, 9 bp, Unknown
  misc_feature (1)..( 9): Result.005 file - promoters50/1398558
aacaatcac

SEQ ID NO: 170426 - DNA, 9 bp, Unknown
  misc_feature (1)..( 9): Result.005 file - promoters50/1398558
cacaatcct

SEQ ID NO: 170427 - DNA, 13 bp, Unknown
  misc_feature (1)..( 13): Result.005 file - promoters50/1398565
aatataaaaatat

SEQ ID NO: 170428 - DNA, 13 bp, Unknown
  misc_feature (1)..( 13): Result.005 file - promoters50/1398565
tatatgaaaatat

SEQ ID NO: 170429 - DNA, 13 bp, Unknown
  misc_feature (1)..( 13): Result.005 file - promoters50/1398565
aatctaaaaacta

SEQ ID NO: 170430 - DNA, 13 bp, Unknown
  misc_feature (1)..( 13): Result.005 file - promoters50/1398565
tatcaaaaaataa

SEQ ID NO: 170431 - DNA, 13 bp, Unknown
  misc_feature (1)..( 13): Result.005 file - promoters50/1398565
ttaataaaacgag

SEQ ID NO: 170432 - DNA, 13 bp, Unknown
  misc_feature (1)..( 13): Result.005 file - promoters50/1398565
ttagtaaaacctt

SEQ ID NO: 170433 - DNA, 13 bp, Unknown
  misc_feature (1)..( 13): Result.005 file - promoters50/1398565
gttatatatatga

SEQ ID NO: 170434 - DNA, 13 bp, Unknown
  misc_feature (1)..( 13): Result.005 file - promoters50/1398565
agtatataaaatg

SEQ ID NO: 170435 - DNA, 13 bp, Unknown
  misc_feature (1)..( 13): Result.005 file - promoters50/1398565
catatatatccgc

SEQ ID NO: 170436 - DNA, 13 bp, Unknown
  misc_feature (1)..( 13): Result.005 file - promoters50/1398565
tctatataaatcc

SEQ ID NO: 170437 - DNA, 13 bp, Unknown
  misc_feature (1)..( 13): Result.005 file - promoters50/1398565
tctatataatagt

SEQ ID NO: 170438 - DNA, 13 bp, Unknown
  misc_feature (1)..( 13): Result.005 file - promoters50/1398565
tatatataccctt

SEQ ID NO: 170439 - DNA, 13 bp, Unknown
  misc_feature (1)..( 13): Result.005 file - promoters50/1398565
ccaatataaaatg

SEQ ID NO: 170440 - DNA, 19 bp, Unknown
  misc_feature (1)..( 19): Result.005 file - promoters50/1398573
agatagacattcttaaatt

SEQ ID NO: 170441 - DNA, 19 bp, Unknown
  misc_feature (1)..( 19): Result.005 file - promoters50/1398573
tgactaacattcgtgaacg

SEQ ID NO: 170442 - DNA, 19 bp, Unknown
  misc_feature (1)..( 19): Result.005 file - promoters50/1398573
tgcttaacactcttaaatt

SEQ ID NO: 170443 - DNA, 19 bp, Unknown
  misc_feature (1)..( 19): Result.005 file - promoters50/1398573
gaaataaaattaatgtatt

SEQ ID NO: 170444 - DNA, 19 bp, Unknown
  misc_feature (1)..( 19): Result.005 file - promoters50/1398573
aaagaaaaataataactta

SEQ ID NO: 170445 - DNA, 19 bp, Unknown
  misc_feature (1)..( 19): Result.005 file - promoters50/1398573
aataaaaaatctttttatt

SEQ ID NO: 170446 - DNA, 21 bp, Unknown
  misc_feature (1)..( 21): Result.005 file - promoters50/1398573
acattcttaaattcccactat

SEQ ID NO: 170447 - DNA, 21 bp, Unknown
  misc_feature (1)..( 21): Result.005 file - promoters50/1398573
atcttcataatcagttacgtc

SEQ ID NO: 170448 - DNA, 21 bp, Unknown
  misc_feature (1)..( 21): Result.005 file - promoters50/1398573
acactcttaaattattctcaa

SEQ ID NO: 170449 - DNA, 21 bp, Unknown
  misc_feature (1)..( 21): Result.005 file - promoters50/1398573
ttgaaataaaattaatgtatt

SEQ ID NO: 170450 - DNA, 21 bp, Unknown
  misc_feature (1)..( 21): Result.005 file - promoters50/1398573
aaaagaaaaaagaaaaataat

SEQ ID NO: 170451 - DNA, 21 bp, Unknown
  misc_feature (1)..( 21): Result.005 file - promoters50/1398573
ggaataaaaaatctttttatt

SEQ ID NO: 170452 - DNA, 7 bp, Unknown
  misc_feature (1)..( 7): Result.005 file - promoters50/1398638
atgtttt

SEQ ID NO: 170453 - DNA, 7 bp, Unknown
  misc_feature (1)..( 7): Result.005 file - promoters50/1398638
atgattt

SEQ ID NO: 170454 - DNA, 7 bp, Unknown
  misc_feature (1)..( 7): Result.005 file - promoters50/1398638
ttgattt

SEQ ID NO: 170455 - DNA, 9 bp, Unknown
  misc_feature (1)..( 9): Result.005 file - promoters50/1398638
taaattttt

SEQ ID NO: 170456 - DNA, 9 bp, Unknown
  misc_feature (1)..( 9): Result.005 file - promoters50/1398638
taaattttc

SEQ ID NO: 170457 - DNA, 9 bp, Unknown
  misc_feature (1)..( 9): Result.005 file - promoters50/1398638
cagattttc

SEQ ID NO: 170458 - DNA, 7 bp, Unknown
  misc_feature (1)..( 7): Result.005 file - promoters50/1398638
catttaa

SEQ ID NO: 170459 - DNA, 7 bp, Unknown
  misc_feature (1)..( 7): Result.005 file - promoters50/1398638
catttat

SEQ ID NO: 170460 - DNA, 7 bp, Unknown
  misc_feature (1)..( 7): Result.005 file - promoters50/1398638
catatat

SEQ ID NO: 170461 - DNA, 9 bp, Unknown
  misc_feature (1)..( 9): Result.005 file - promoters50/1398704
tccgatcat

SEQ ID NO: 170462 - DNA, 9 bp, Unknown
  misc_feature (1)..( 9): Result.005 file - promoters50/1398704
accgttcat

SEQ ID NO: 170463 - DNA, 9 bp, Unknown
  misc_feature (1)..( 9): Result.005 file - promoters50/1398704
accgttaaa

SEQ ID NO: 170464 - DNA, 10 bp, Unknown
  misc_feature (1)..( 10): Result.005 file - promoters50/1398704
caattatatc

SEQ ID NO: 170465 - DNA, 10 bp, Unknown
  misc_feature (1)..( 10): Result.005 file - promoters50/1398704
ttgatatatc

SEQ ID NO: 170466 - DNA, 10 bp, Unknown
  misc_feature (1)..( 10): Result.005 file - promoters50/1398704
caaatatata

SEQ ID NO: 170467 - DNA, 10 bp, Unknown
  misc_feature (1)..( 10): Result.005 file - promoters50/1398704
cctttttgaa

SEQ ID NO: 170468 - DNA, 10 bp, Unknown
  misc_feature (1)..( 10): Result.005 file - promoters50/1398704
tttttttgtt

SEQ ID NO: 170469 - DNA, 11 bp, Unknown
  misc_feature (1)..( 11): Result.005 file - promoters50/1398704
ttttatttgtt

SEQ ID NO: 170470 - DNA, 14 bp, Unknown
  misc_feature (1)..( 14): Result.005 file - promoters50/1398704
attgttgttttgct

SEQ ID NO: 170471 - DNA, 14 bp, Unknown
  misc_feature (1)..( 14): Result.005 file - promoters50/1398704
attgttttttttgt

SEQ ID NO: 170472 - DNA, 15 bp, Unknown
  misc_feature (1)..( 15): Result.005 file - promoters50/1398704
ttatttttatttgtt

SEQ ID NO: 170473 - DNA, 14 bp, Unknown
  misc_feature (1)..( 14): Result.005 file - promoters50/1398704
tccacacaataaac

SEQ ID NO: 170474 - DNA, 14 bp, Unknown
  misc_feature (1)..( 14): Result.005 file - promoters50/1398704
aaaacaaaatgtca

SEQ ID NO: 170475 - DNA, 14 bp, Unknown
  misc_feature (1)..( 14): Result.005 file - promoters50/1398704
aaaacaaatcataa

SEQ ID NO: 170476 - DNA, 14 bp, Unknown
  misc_feature (1)..( 14): Result.005 file - promoters50/1398704
tgcataaaatctca

SEQ ID NO: 170477 - DNA, 9 bp, Unknown
  misc_feature (1)..( 9): Result.005 file - promoters50/1398704
gtggaactt

SEQ ID NO: 170478 - DNA, 9 bp, Unknown
  misc_feature (1)..( 9): Result.005 file - promoters50/1398704
aatgaactt

SEQ ID NO: 170479 - DNA, 9 bp, Unknown
  misc_feature (1)..( 9): Result.005 file - promoters50/1398704
aatcaacta

SEQ ID NO: 170480 - DNA, 9 bp, Unknown
  misc_feature (1)..( 9): Result.005 file - promoters50/1398704
aaaatatat

SEQ ID NO: 170481 - DNA, 9 bp, Unknown
  misc_feature (1)..( 9): Result.005 file - promoters50/1398704
aaattattt

SEQ ID NO: 170482 - DNA, 9 bp, Unknown
  misc_feature (1)..( 9): Result.005 file - promoters50/1398704
atattgttt

SEQ ID NO: 170483 - DNA, 10 bp, Unknown
  misc_feature (1)..( 10): Result.005 file - promoters50/1398737
gattagtttc

SEQ ID NO: 170484 - DNA, 10 bp, Unknown
  misc_feature (1)..( 10): Result.005 file - promoters50/1398737
atttatttta

SEQ ID NO: 170485 - DNA, 10 bp, Unknown
  misc_feature (1)..( 10): Result.005 file - promoters50/1398737
cattggttag

SEQ ID NO: 170486 - DNA, 10 bp, Unknown
  misc_feature (1)..( 10): Result.005 file - promoters50/1398737
gatcagtacc

SEQ ID NO: 170487 - DNA, 10 bp, Unknown
  misc_feature (1)..( 10): Result.005 file - promoters50/1398737
aatttgtttg

SEQ ID NO: 170488 - DNA, 10 bp, Unknown
  misc_feature (1)..( 10): Result.005 file - promoters50/1398737
gtatggctag

SEQ ID NO: 170489 - DNA, 10 bp, Unknown
  misc_feature (1)..( 10): Result.005 file - promoters50/1398737
ttatatatta

SEQ ID NO: 170490 - DNA, 10 bp, Unknown
  misc_feature (1)..( 10): Result.005 file - promoters50/1398737
agatatttta

SEQ ID NO: 170491 - DNA, 11 bp, Unknown
  misc_feature (1)..( 11): Result.005 file - promoters50/1398737
aacccatatta

SEQ ID NO: 170492 - DNA, 10 bp, Unknown
  misc_feature (1)..( 10): Result.005 file - promoters50/1398737
taagaaattg

SEQ ID NO: 170493 - DNA, 10 bp, Unknown
  misc_feature (1)..( 10): Result.005 file - promoters50/1398737
caagaaaact

SEQ ID NO: 170494 - DNA, 11 bp, Unknown
  misc_feature (1)..( 11): Result.005 file - promoters50/1398737
aaagcaaacaa

SEQ ID NO: 170495 - DNA, 15 bp, Unknown
  misc_feature (1)..( 15): Result.005 file - promoters50/1398737
aagttaataactatt

SEQ ID NO: 170496 - DNA, 15 bp, Unknown
  misc_feature (1)..( 15): Result.005 file - promoters50/1398737
agaataataatttaa

SEQ ID NO: 170497 - DNA, 15 bp, Unknown
  misc_feature (1)..( 15): Result.005 file - promoters50/1398737
gtgttgatatacgag

SEQ ID NO: 170498 - DNA, 15 bp, Unknown
  misc_feature (1)..( 15): Result.005 file - promoters50/1398737
aaaaaaagaacaata

SEQ ID NO: 170499 - DNA, 15 bp, Unknown
  misc_feature (1)..( 15): Result.005 file - promoters50/1398737
atgattggaacaaat

SEQ ID NO: 170500 - DNA, 15 bp, Unknown
  misc_feature (1)..( 15): Result.005 file - promoters50/1398737
gtgttgatcgataat

SEQ ID NO: 170501 - DNA, 7 bp, Unknown
  misc_feature (1)..( 7): Result.005 file - promoters50/1398784
ataaaat

SEQ ID NO: 170502 - DNA, 7 bp, Unknown
  misc_feature (1)..( 7): Result.005 file - promoters50/1398784
ataaaat

SEQ ID NO: 170503 - DNA, 7 bp, Unknown
  misc_feature (1)..( 7): Result.005 file - promoters50/1398784
ctaaaat

SEQ ID NO: 170504 - DNA, 11 bp, Unknown
  misc_feature (1)..( 11): Result.005 file - promoters50/1398784
gaaaattaaag

SEQ ID NO: 170505 - DNA, 11 bp, Unknown
  misc_feature (1)..( 11): Result.005 file - promoters50/1398784
aaaacttaaat

SEQ ID NO: 170506 - DNA, 11 bp, Unknown
  misc_feature (1)..( 11): Result.005 file - promoters50/1398784
gaaaactaaag

SEQ ID NO: 170507 - DNA, 10 bp, Unknown
  misc_feature (1)..( 10): Result.005 file - promoters50/1398784
gaagaaagaa

SEQ ID NO: 170508 - DNA, 10 bp, Unknown
  misc_feature (1)..( 10): Result.005 file - promoters50/1398784
aaagaaaaat

SEQ ID NO: 170509 - DNA, 11 bp, Unknown
  misc_feature (1)..( 11): Result.005 file - promoters50/1398784
aaagtaaaatc

SEQ ID NO: 170510 - DNA, 7 bp, Unknown
  misc_feature (1)..( 7): Result.005 file - promoters50/1398846
tttgtta

SEQ ID NO: 170511 - DNA, 7 bp, Unknown
  misc_feature (1)..( 7): Result.005 file - promoters50/1398846
tttgtta

SEQ ID NO: 170512 - DNA, 7 bp, Unknown
  misc_feature (1)..( 7): Result.005 file - promoters50/1398846
attgtta

SEQ ID NO: 170513 - DNA, 9 bp, Unknown
  misc_feature (1)..( 9): Result.005 file - promoters50/1398846
ttaattaga

SEQ ID NO: 170514 - DNA, 9 bp, Unknown
  misc_feature (1)..( 9): Result.005 file - promoters50/1398846
ttaattaaa

SEQ ID NO: 170515 - DNA, 9 bp, Unknown
  misc_feature (1)..( 9): Result.005 file - promoters50/1398846
taaattaaa

SEQ ID NO: 170516 - DNA, 16 bp, Unknown
  misc_feature (1)..( 16): Result.005 file - promoters50/1398853
tgtaaaaaacgttacg

SEQ ID NO: 170517 - DNA, 16 bp, Unknown
  misc_feature (1)..( 16): Result.005 file - promoters50/1398853
tccaaaaaatagaaga

SEQ ID NO: 170518 - DNA, 16 bp, Unknown
  misc_feature (1)..( 16): Result.005 file - promoters50/1398853
ttcaaaaaaaatggta

SEQ ID NO: 170519 - DNA, 16 bp, Unknown
  misc_feature (1)..( 16): Result.005 file - promoters50/1398853
cagaaaaagatgataa

SEQ ID NO: 170520 - DNA, 9 bp, Unknown
  misc_feature (1)..( 9): Result.005 file - promoters50/1398853
cttttcttg

SEQ ID NO: 170521 - DNA, 9 bp, Unknown
  misc_feature (1)..( 9): Result.005 file - promoters50/1398853
attttattg

SEQ ID NO: 170522 - DNA, 9 bp, Unknown
  misc_feature (1)..( 9): Result.005 file - promoters50/1398853
ttttaattc

SEQ ID NO: 170523 - DNA, 9 bp, Unknown
  misc_feature (1)..( 9): Result.005 file - promoters50/1398853
attctataa

SEQ ID NO: 170524 - DNA, 8 bp, Unknown
  misc_feature (1)..( 8): Result.005 file - promoters50/1398892
atttaaat

SEQ ID NO: 170525 - DNA, 8 bp, Unknown
  misc_feature (1)..( 8): Result.005 file - promoters50/1398892
gtttaaat

SEQ ID NO: 170526 - DNA, 8 bp, Unknown
  misc_feature (1)..( 8): Result.005 file - promoters50/1398892
attgaaat

SEQ ID NO: 170527 - DNA, 9 bp, Unknown
  misc_feature (1)..( 9): Result.005 file - promoters50/1398936
ttttcttct

SEQ ID NO: 170528 - DNA, 9 bp, Unknown
  misc_feature (1)..( 9): Result.005 file - promoters50/1398936
ttttcttag

SEQ ID NO: 170529 - DNA, 9 bp, Unknown
  misc_feature (1)..( 9): Result.005 file - promoters50/1398936
atttcatct

SEQ ID NO: 170530 - DNA, 12 bp, Unknown
  misc_feature (1)..( 12): Result.005 file - promoters50/1399037
tagaaaaatgga

SEQ ID NO: 170531 - DNA, 12 bp, Unknown
  misc_feature (1)..( 12): Result.005 file - promoters50/1399037
gggaaaaaacat

SEQ ID NO: 170532 - DNA, 12 bp, Unknown
  misc_feature (1)..( 12): Result.005 file - promoters50/1399037
ctaaaaaatcgt

SEQ ID NO: 170533 - DNA, 12 bp, Unknown
  misc_feature (1)..( 12): Result.005 file - promoters50/1399037
tagagaaacaaa

SEQ ID NO: 170534 - DNA, 13 bp, Unknown
  misc_feature (1)..( 13): Result.005 file - promoters50/1399037
cggaacaaaggag

SEQ ID NO: 170535 - DNA, 13 bp, Unknown
  misc_feature (1)..( 13): Result.005 file - promoters50/1399037
tactggaaattcg

SEQ ID NO: 170536 - DNA, 12 bp, Unknown
  misc_feature (1)..( 12): Result.005 file - promoters50/1399037
gtaaattcattt

SEQ ID NO: 170537 - DNA, 12 bp, Unknown
  misc_feature (1)..( 12): Result.005 file - promoters50/1399037
tccaatacatat

SEQ ID NO: 170538 - DNA, 12 bp, Unknown
  misc_feature (1)..( 12): Result.005 file - promoters50/1399037
ttcaattttaaa

SEQ ID NO: 170539 - DNA, 12 bp, Unknown
  misc_feature (1)..( 12): Result.005 file - promoters50/1399037
tcaaactcaaac

SEQ ID NO: 170540 - DNA, 12 bp, Unknown
  misc_feature (1)..( 12): Result.005 file - promoters50/1399037
caatatacttat

SEQ ID NO: 170541 - DNA, 12 bp, Unknown
  misc_feature (1)..( 12): Result.005 file - promoters50/1399037
atctgtttaaac

SEQ ID NO: 170542 - DNA, 8 bp, Unknown
  misc_feature (1)..( 8): Result.005 file - promoters50/1399074
cgtataga

SEQ ID NO: 170543 - DNA, 8 bp, Unknown
  misc_feature (1)..( 8): Result.005 file - promoters50/1399074
agtaaaga

SEQ ID NO: 170544 - DNA, 8 bp, Unknown
  misc_feature (1)..( 8): Result.005 file - promoters50/1399074
agtaaaaa

SEQ ID NO: 170545 - DNA, 10 bp, Unknown
  misc_feature (1)..( 10): Result.005 file - promoters50/1399074
ttaaggaagc

SEQ ID NO: 170546 - DNA, 10 bp, Unknown
  misc_feature (1)..( 10): Result.005 file - promoters50/1399074
gaaagaaagc

SEQ ID NO: 170547 - DNA, 10 bp, Unknown
  misc_feature (1)..( 10): Result.005 file - promoters50/1399074
gaaacaaaaa

SEQ ID NO: 170548 - DNA, 10 bp, Unknown
  misc_feature (1)..( 10): Result.005 file - promoters50/1399074
ggagaagcat

SEQ ID NO: 170549 - DNA, 10 bp, Unknown
  misc_feature (1)..( 10): Result.005 file - promoters50/1399074
ggaaaagaaa

SEQ ID NO: 170550 - DNA, 10 bp, Unknown
  misc_feature (1)..( 10): Result.005 file - promoters50/1399074
ggaaatgaaa

SEQ ID NO: 170551 - DNA, 9 bp, Unknown
  misc_feature (1)..( 9): Result.005 file - promoters50/1399140
gaaagacta

SEQ ID NO: 170552 - DNA, 9 bp, Unknown
  misc_feature (1)..( 9): Result.005 file - promoters50/1399140
gaaagattg

SEQ ID NO: 170553 - DNA, 9 bp, Unknown
  misc_feature (1)..( 9): Result.005 file - promoters50/1399140
taaagcttg

SEQ ID NO: 170554 - DNA, 9 bp, Unknown
  misc_feature (1)..( 9): Result.005 file - promoters50/1399140
taaaaattt

SEQ ID NO: 170555 - DNA, 9 bp, Unknown
  misc_feature (1)..( 9): Result.005 file - promoters50/1399140
taataatat

SEQ ID NO: 170556 - DNA, 9 bp, Unknown
  misc_feature (1)..( 9): Result.005 file - promoters50/1399140
gcataatat

SEQ ID NO: 170557 - DNA, 12 bp, Unknown
  misc_feature (1)..( 12): Result.005 file - promoters50/1399210
aatgtaaacaac

SEQ ID NO: 170558 - DNA, 12 bp, Unknown
  misc_feature (1)..( 12): Result.005 file - promoters50/1399210
tttataaacact

SEQ ID NO: 170559 - DNA, 12 bp, Unknown
  misc_feature (1)..( 12): Result.005 file - promoters50/1399210
aatttaaataac

SEQ ID NO: 170560 - DNA, 12 bp, Unknown
  misc_feature (1)..( 12): Result.005 file - promoters50/1399210
aatttagtataa

SEQ ID NO: 170561 - DNA, 7 bp, Unknown
  misc_feature (1)..( 7): Result.005 file - promoters50/1399210
cttttgg

SEQ ID NO: 170562 - DNA, 7 bp, Unknown
  misc_feature (1)..( 7): Result.005 file - promoters50/1399210
cttttgg

SEQ ID NO: 170563 - DNA, 7 bp, Unknown
  misc_feature (1)..( 7): Result.005 file - promoters50/1399210
attttgg

SEQ ID NO: 170564 - DNA, 12 bp, Unknown
  misc_feature (1)..( 12): Result.005 file - promoters50/1399210
ttactataaatt

SEQ ID NO: 170565 - DNA, 12 bp, Unknown
  misc_feature (1)..( 12): Result.005 file - promoters50/1399210
ttattatatatt

SEQ ID NO: 170566 - DNA, 12 bp, Unknown
  misc_feature (1)..( 12): Result.005 file - promoters50/1399210
agtctaaaaata

SEQ ID NO: 170567 - DNA, 8 bp, Unknown
  misc_feature (1)..( 8): Result.005 file - promoters50/1399210
gttttgtt

SEQ ID NO: 170568 - DNA, 8 bp, Unknown
  misc_feature (1)..( 8): Result.005 file - promoters50/1399210
ttttagtt

SEQ ID NO: 170569 - DNA, 8 bp, Unknown
  misc_feature (1)..( 8): Result.005 file - promoters50/1399210
gttttgta

SEQ ID NO: 170570 - DNA, 15 bp, Unknown
  misc_feature (1)..( 15): Result.005 file - promoters50/1399265
cttgtttcaaatagt

SEQ ID NO: 170571 - DNA, 15 bp, Unknown
  misc_feature (1)..( 15): Result.005 file - promoters50/1399265
agtatttaaaataat

SEQ ID NO: 170572 - DNA, 15 bp, Unknown
  misc_feature (1)..( 15): Result.005 file - promoters50/1399265
agtttttaaggtttt

SEQ ID NO: 170573 - DNA, 15 bp, Unknown
  misc_feature (1)..( 15): Result.005 file - promoters50/1399265
gaattctaaaatctt

SEQ ID NO: 170574 - DNA, 15 bp, Unknown
  misc_feature (1)..( 15): Result.005 file - promoters50/1399265
ggagaagaaactctc

SEQ ID NO: 170575 - DNA, 15 bp, Unknown
  misc_feature (1)..( 15): Result.005 file - promoters50/1399265
attgttgaaattctt

SEQ ID NO: 170576 - DNA, 14 bp, Unknown
  misc_feature (1)..( 14): Result.005 file - promoters50/1399265
caacaatagaggtt

SEQ ID NO: 170577 - DNA, 14 bp, Unknown
  misc_feature (1)..( 14): Result.005 file - promoters50/1399265
aaacaatttatatt

SEQ ID NO: 170578 - DNA, 14 bp, Unknown
  misc_feature (1)..( 14): Result.005 file - promoters50/1399265
caacaacttatatg

SEQ ID NO: 170579 - DNA, 14 bp, Unknown
  misc_feature (1)..( 14): Result.005 file - promoters50/1399265
aaaaaatgttatct

SEQ ID NO: 170580 - DNA, 14 bp, Unknown
  misc_feature (1)..( 14): Result.005 file - promoters50/1399265
gaaacacttattca

SEQ ID NO: 170581 - DNA, 14 bp, Unknown
  misc_feature (1)..( 14): Result.005 file - promoters50/1399265
tcatatattataaa

SEQ ID NO: 170582 - DNA, 14 bp, Unknown
  misc_feature (1)..( 14): Result.005 file - promoters50/1399265
tttaatttcttcac

SEQ ID NO: 170583 - DNA, 14 bp, Unknown
  misc_feature (1)..( 14): Result.005 file - promoters50/1399265
cttattttatgaaa

SEQ ID NO: 170584 - DNA, 14 bp, Unknown
  misc_feature (1)..( 14): Result.005 file - promoters50/1399265
tttagtttagaatt

SEQ ID NO: 170585 - DNA, 14 bp, Unknown
  misc_feature (1)..( 14): Result.005 file - promoters50/1399265
tttatattataaaa

SEQ ID NO: 170586 - DNA, 14 bp, Unknown
  misc_feature (1)..( 14): Result.005 file - promoters50/1399265
tttaaaaaatgtta

SEQ ID NO: 170587 - DNA, 14 bp, Unknown
  misc_feature (1)..( 14): Result.005 file - promoters50/1399265
cttattcacattgc

SEQ ID NO: 170588 - DNA, 10 bp, Unknown
  misc_feature (1)..( 10): Result.005 file - promoters50/1399265
tcatttttgt

SEQ ID NO: 170589 - DNA, 10 bp, Unknown
  misc_feature (1)..( 10): Result.005 file - promoters50/1399265
atatttttcc

SEQ ID NO: 170590 - DNA, 10 bp, Unknown
  misc_feature (1)..( 10): Result.005 file - promoters50/1399265
ttattttatg

SEQ ID NO: 170591 - DNA, 10 bp, Unknown
  misc_feature (1)..( 10): Result.005 file - promoters50/1399265
ttatttagaa

SEQ ID NO: 170592 - DNA, 10 bp, Unknown
  misc_feature (1)..( 10): Result.005 file - promoters50/1399265
gtctttttcc

SEQ ID NO: 170593 - DNA, 10 bp, Unknown
  misc_feature (1)..( 10): Result.005 file - promoters50/1399265
atattattgt

SEQ ID NO: 170594 - DNA, 8 bp, Unknown
  misc_feature (1)..( 8): Result.005 file - promoters50/1399265
tcataaaa

SEQ ID NO: 170595 - DNA, 8 bp, Unknown
  misc_feature (1)..( 8): Result.005 file - promoters50/1399265
ttataaaa

SEQ ID NO: 170596 - DNA, 9 bp, Unknown
  misc_feature (1)..( 9): Result.005 file - promoters50/1399265
aaatacaaa

SEQ ID NO: 170597 - DNA, 9 bp, Unknown
  misc_feature (1)..( 9): Result.005 file - promoters50/1399265
ttagaaaaa

SEQ ID NO: 170598 - DNA, 9 bp, Unknown
  misc_feature (1)..( 9): Result.005 file - promoters50/1399265
gaattcaaa

SEQ ID NO: 170599 - DNA, 9 bp, Unknown
  misc_feature (1)..( 9): Result.005 file - promoters50/1399265
taatacaat

SEQ ID NO: 170600 - DNA, 10 bp, Unknown
  misc_feature (1)..( 10): Result.005 file - promoters50/1399265
gatatttttt

SEQ ID NO: 170601 - DNA, 10 bp, Unknown
  misc_feature (1)..( 10): Result.005 file - promoters50/1399265
gttatttttg

SEQ ID NO: 170602 - DNA, 10 bp, Unknown
  misc_feature (1)..( 10): Result.005 file - promoters50/1399265
gatactttta

SEQ ID NO: 170603 - DNA, 10 bp, Unknown
  misc_feature (1)..( 10): Result.005 file - promoters50/1399265
actatttttt

SEQ ID NO: 170604 - DNA, 10 bp, Unknown
  misc_feature (1)..( 10): Result.005 file - promoters50/1399265
ggtactttca

SEQ ID NO: 170605 - DNA, 10 bp, Unknown
  misc_feature (1)..( 10): Result.005 file - promoters50/1399265
gctatttctt

SEQ ID NO: 170606 - DNA, 10 bp, Unknown
  misc_feature (1)..( 10): Result.005 file - promoters50/1399265
ggtacttgac

SEQ ID NO: 170607 - DNA, 17 bp, Unknown
  misc_feature (1)..( 17): Result.005 file - promoters50/1399277
ataaacacaaaaatttt

SEQ ID NO: 170608 - DNA, 17 bp, Unknown
  misc_feature (1)..( 17): Result.005 file - promoters50/1399277
ttaaacacaaaagttca

SEQ ID NO: 170609 - DNA, 17 bp, Unknown
  misc_feature (1)..( 17): Result.005 file - promoters50/1399277
ttaatcacaaaaacttt

SEQ ID NO: 170610 - DNA, 17 bp, Unknown
  misc_feature (1)..( 17): Result.005 file - promoters50/1399277
ttaatcacgtacgatac

SEQ ID NO: 170611 - DNA, 7 bp, Unknown
  misc_feature (1)..( 7): Result.005 file - promoters50/1399277
aagattt

SEQ ID NO: 170612 - DNA, 7 bp, Unknown
  misc_feature (1)..( 7): Result.005 file - promoters50/1399277
aagattt

SEQ ID NO: 170613 - DNA, 7 bp, Unknown
  misc_feature (1)..( 7): Result.005 file - promoters50/1399277
aagatta

SEQ ID NO: 170614 - DNA, 8 bp, Unknown
  misc_feature (1)..( 8): Result.005 file - promoters50/1399277
atttttta

SEQ ID NO: 170615 - DNA, 8 bp, Unknown
  misc_feature (1)..( 8): Result.005 file - promoters50/1399277
attttttt

SEQ ID NO: 170616 - DNA, 8 bp, Unknown
  misc_feature (1)..( 8): Result.005 file - promoters50/1399277
ctttctta

SEQ ID NO: 170617 - DNA, 9 bp, Unknown
  misc_feature (1)..( 9): Result.005 file - promoters50/1399277
attgttttt

SEQ ID NO: 170618 - DNA, 8 bp, Unknown
  misc_feature (1)..( 8): Result.005 file - promoters50/1399277
ataaccac

SEQ ID NO: 170619 - DNA, 8 bp, Unknown
  misc_feature (1)..( 8): Result.005 file - promoters50/1399277
atacccac

SEQ ID NO: 170620 - DNA, 8 bp, Unknown
  misc_feature (1)..( 8): Result.005 file - promoters50/1399277
cgaacaac

SEQ ID NO: 170621 - DNA, 9 bp, Unknown
  misc_feature (1)..( 9): Result.005 file - promoters50/1399277
aaaacaatt

SEQ ID NO: 170622 - DNA, 9 bp, Unknown
  misc_feature (1)..( 9): Result.005 file - promoters50/1399277
aaaacaaag

SEQ ID NO: 170623 - DNA, 9 bp, Unknown
  misc_feature (1)..( 9): Result.005 file - promoters50/1399277
ttaacgatt

SEQ ID NO: 170624 - DNA, 9 bp, Unknown
  misc_feature (1)..( 9): Result.005 file - promoters50/1399277
aaaaatttt

SEQ ID NO: 170625 - DNA, 9 bp, Unknown
  misc_feature (1)..( 9): Result.005 file - promoters50/1399277
aaaagtttt

SEQ ID NO: 170626 - DNA, 9 bp, Unknown
  misc_feature (1)..( 9): Result.005 file - promoters50/1399277
aaaaatcaa

SEQ ID NO: 170627 - DNA, 9 bp, Unknown
  misc_feature (1)..( 9): Result.005 file - promoters50/1399277
aaaagttca

SEQ ID NO: 170628 - DNA, 8 bp, Unknown
  misc_feature (1)..( 8): Result.005 file - promoters50/1399277
ttataaaa

SEQ ID NO: 170629 - DNA, 8 bp, Unknown
  misc_feature (1)..( 8): Result.005 file - promoters50/1399277
ttacaaaa

SEQ ID NO: 170630 - DNA, 8 bp, Unknown
  misc_feature (1)..( 8): Result.005 file - promoters50/1399277
acacaaaa

SEQ ID NO: 170631 - DNA, 7 bp, Unknown
  misc_feature (1)..( 7): Result.005 file - promoters50/1399277
gataaaa

SEQ ID NO: 170632 - DNA, 7 bp, Unknown
  misc_feature (1)..( 7): Result.005 file - promoters50/1399277
gataaag

SEQ ID NO: 170633 - DNA, 7 bp, Unknown
  misc_feature (1)..( 7): Result.005 file - promoters50/1399277
tataaag

SEQ ID NO: 170634 - DNA, 8 bp, Unknown
  misc_feature (1)..( 8): Result.005 file - promoters50/1399277
aaaccaat

SEQ ID NO: 170635 - DNA, 8 bp, Unknown
  misc_feature (1)..( 8): Result.005 file - promoters50/1399277
ttaccaat

SEQ ID NO: 170636 - DNA, 8 bp, Unknown
  misc_feature (1)..( 8): Result.005 file - promoters50/1399277
aaaacaat

SEQ ID NO: 170637 - DNA, 7 bp, Unknown
  misc_feature (1)..( 7): Result.005 file - promoters50/1399277
tatttaa

SEQ ID NO: 170638 - DNA, 7 bp, Unknown
  misc_feature (1)..( 7): Result.005 file - promoters50/1399277
tatttat

SEQ ID NO: 170639 - DNA, 7 bp, Unknown
  misc_feature (1)..( 7): Result.005 file - promoters50/1399277
aattttt

SEQ ID NO: 170640 - DNA, 9 bp, Unknown
  misc_feature (1)..( 9): Result.005 file - promoters50/1399277
ttttttaaa

SEQ ID NO: 170641 - DNA, 9 bp, Unknown
  misc_feature (1)..( 9): Result.005 file - promoters50/1399277
tttattaaa

SEQ ID NO: 170642 - DNA, 9 bp, Unknown
  misc_feature (1)..( 9): Result.005 file - promoters50/1399277
actatgaaa

SEQ ID NO: 170643 - DNA, 9 bp, Unknown
  misc_feature (1)..( 9): Result.005 file - promoters50/1399325
aaataaatc

SEQ ID NO: 170644 - DNA, 9 bp, Unknown
  misc_feature (1)..( 9): Result.005 file - promoters50/1399325
aaataaact

SEQ ID NO: 170645 - DNA, 10 bp, Unknown
  misc_feature (1)..( 10): Result.005 file - promoters50/1399325
aaagtaattt

SEQ ID NO: 170646 - DNA, 10 bp, Unknown
  misc_feature (1)..( 10): Result.005 file - promoters50/1399325
aaattaaatc

SEQ ID NO: 170647 - DNA, 10 bp, Unknown
  misc_feature (1)..( 10): Result.005 file - promoters50/1399325
aaaatattcg

SEQ ID NO: 170648 - DNA, 10 bp, Unknown
  misc_feature (1)..( 10): Result.005 file - promoters50/1399325
acagtagttt

SEQ ID NO: 170649 - DNA, 11 bp, Unknown
  misc_feature (1)..( 11): Result.005 file - promoters50/1399325
atcttaaattt

SEQ ID NO: 170650 - DNA, 11 bp, Unknown
  misc_feature (1)..( 11): Result.005 file - promoters50/1399325
cttttaatttt

SEQ ID NO: 170651 - DNA, 11 bp, Unknown
  misc_feature (1)..( 11): Result.005 file - promoters50/1399325
tatcaaaatta

SEQ ID NO: 170652 - DNA, 11 bp, Unknown
  misc_feature (1)..( 11): Result.005 file - promoters50/1399325
atctgaaatca

SEQ ID NO: 170653 - DNA, 11 bp, Unknown
  misc_feature (1)..( 11): Result.005 file - promoters50/1399325
aaaagaaatta

SEQ ID NO: 170654 - DNA, 11 bp, Unknown
  misc_feature (1)..( 11): Result.005 file - promoters50/1399325
tctagaaattc

SEQ ID NO: 170655 - DNA, 10 bp, Unknown
  misc_feature (1)..( 10): Result.005 file - promoters50/1399345
gtttttgtaa

SEQ ID NO: 170656 - DNA, 10 bp, Unknown
  misc_feature (1)..( 10): Result.005 file - promoters50/1399345
agttttgtaa

SEQ ID NO: 170657 - DNA, 10 bp, Unknown
  misc_feature (1)..( 10): Result.005 file - promoters50/1399345
atttttggtt

SEQ ID NO: 170658 - DNA, 10 bp, Unknown
  misc_feature (1)..( 10): Result.005 file - promoters50/1399345
agtgttgaga

SEQ ID NO: 170659 - DNA, 10 bp, Unknown
  misc_feature (1)..( 10): Result.005 file - promoters50/1399345
atttttactt

SEQ ID NO: 170660 - DNA, 10 bp, Unknown
  misc_feature (1)..( 10): Result.005 file - promoters50/1399345
gtttttgatg

SEQ ID NO: 170661 - DNA, 12 bp, Unknown
  misc_feature (1)..( 12): Result.005 file - promoters50/1399345
aataataactct

SEQ ID NO: 170662 - DNA, 12 bp, Unknown
  misc_feature (1)..( 12): Result.005 file - promoters50/1399345
attaataaattt

SEQ ID NO: 170663 - DNA, 12 bp, Unknown
  misc_feature (1)..( 12): Result.005 file - promoters50/1399345
aatattaatttg

SEQ ID NO: 170664 - DNA, 12 bp, Unknown
  misc_feature (1)..( 12): Result.005 file - promoters50/1399345
tatactaaagtt

SEQ ID NO: 170665 - DNA, 13 bp, Unknown
  misc_feature (1)..( 13): Result.005 file - promoters50/1399345
aaaacatataaaa

SEQ ID NO: 170666 - DNA, 13 bp, Unknown
  misc_feature (1)..( 13): Result.005 file - promoters50/1399345
ttttaacaaaaca

SEQ ID NO: 170667 - DNA, 16 bp, Unknown
  misc_feature (1)..( 16): Result.005 file - promoters50/1399345
aacttaattcttttta

SEQ ID NO: 170668 - DNA, 16 bp, Unknown
  misc_feature (1)..( 16): Result.005 file - promoters50/1399345
aacttaattttttttt

SEQ ID NO: 170669 - DNA, 16 bp, Unknown
  misc_feature (1)..( 16): Result.005 file - promoters50/1399345
cacggtattctttagt

SEQ ID NO: 170670 - DNA, 16 bp, Unknown
  misc_feature (1)..( 16): Result.005 file - promoters50/1399345
attgtaatccttttgt

SEQ ID NO: 170671 - DNA, 16 bp, Unknown
  misc_feature (1)..( 16): Result.005 file - promoters50/1399345
ttataataggttttta

SEQ ID NO: 170672 - DNA, 16 bp, Unknown
  misc_feature (1)..( 16): Result.005 file - promoters50/1399345
ttctctattttattat

SEQ ID NO: 170673 - DNA, 11 bp, Unknown
  misc_feature (1)..( 11): Result.005 file - promoters50/1399345
gttttgtatta

SEQ ID NO: 170674 - DNA, 11 bp, Unknown
  misc_feature (1)..( 11): Result.005 file - promoters50/1399345
tttttgtttaa

SEQ ID NO: 170675 - DNA, 11 bp, Unknown
  misc_feature (1)..( 11): Result.005 file - promoters50/1399345
ctttagtaaaa

SEQ ID NO: 170676 - DNA, 11 bp, Unknown
  misc_feature (1)..( 11): Result.005 file - promoters50/1399345
tttttatttct

SEQ ID NO: 170677 - DNA, 11 bp, Unknown
  misc_feature (1)..( 11): Result.005 file - promoters50/1399345
atatagcaaaa

SEQ ID NO: 170678 - DNA, 11 bp, Unknown
  misc_feature (1)..( 11): Result.005 file - promoters50/1399345
cttttgttgtt

SEQ ID NO: 170679 - DNA, 10 bp, Unknown
  misc_feature (1)..( 10): Result.005 file - promoters50/1399409
atatatttaa

SEQ ID NO: 170680 - DNA, 10 bp, Unknown
  misc_feature (1)..( 10): Result.005 file - promoters50/1399409
acataattat

SEQ ID NO: 170681 - DNA, 10 bp, Unknown
  misc_feature (1)..( 10): Result.005 file - promoters50/1399409
acaaaattat

SEQ ID NO: 170682 - DNA, 6 bp, Unknown
  misc_feature (1)..( 6): Result.005 file - promoters50/1399413
tctttg

SEQ ID NO: 170683 - DNA, 6 bp, Unknown
  misc_feature (1)..( 6): Result.005 file - promoters50/1399413
tctttg

SEQ ID NO: 170684 - DNA, 6 bp, Unknown
  misc_feature (1)..( 6): Result.005 file - promoters50/1399413
tctttg

SEQ ID NO: 170685 - DNA, 9 bp, Unknown
  misc_feature (1)..( 9): Result.005 file - promoters50/1399413
aaacttaac

SEQ ID NO: 170686 - DNA, 9 bp, Unknown
  misc_feature (1)..( 9): Result.005 file - promoters50/1399413
aaaattaaa

SEQ ID NO: 170687 - DNA, 9 bp, Unknown
  misc_feature (1)..( 9): Result.005 file - promoters50/1399413
tcaattaaa

SEQ ID NO: 170688 - DNA, 9 bp, Unknown
  misc_feature (1)..( 9): Result.005 file - promoters50/1399413
tctatataa

SEQ ID NO: 170689 - DNA, 9 bp, Unknown
  misc_feature (1)..( 9): Result.005 file - promoters50/1399413
tctatataa

SEQ ID NO: 170690 - DNA, 9 bp, Unknown
  misc_feature (1)..( 9): Result.005 file - promoters50/1399413
agtatataa

SEQ ID NO: 170691 - DNA, 7 bp, Unknown
  misc_feature (1)..( 7): Result.005 file - promoters50/1399413
attaaaa

SEQ ID NO: 170692 - DNA, 7 bp, Unknown
  misc_feature (1)..( 7): Result.005 file - promoters50/1399413
attaaaa

SEQ ID NO: 170693 - DNA, 8 bp, Unknown
  misc_feature (1)..( 8): Result.005 file - promoters50/1399413
cttataaa

SEQ ID NO: 170694 - DNA, 8 bp, Unknown
  misc_feature (1)..( 8): Result.005 file - promoters50/1399413
gaaaccta

SEQ ID NO: 170695 - DNA, 8 bp, Unknown
  misc_feature (1)..( 8): Result.005 file - promoters50/1399413
aaaatcta

SEQ ID NO: 170696 - DNA, 9 bp, Unknown
  misc_feature (1)..( 9): Result.005 file - promoters50/1399413
aaatatctt

SEQ ID NO: 170697 - DNA, 10 bp, Unknown
  misc_feature (1)..( 10): Result.005 file - promoters50/1399413
atcatttaaa

SEQ ID NO: 170698 - DNA, 10 bp, Unknown
  misc_feature (1)..( 10): Result.005 file - promoters50/1399413
atcaattaaa

SEQ ID NO: 170699 - DNA, 10 bp, Unknown
  misc_feature (1)..( 10): Result.005 file - promoters50/1399413
caaaattaaa

SEQ ID NO: 170700 - DNA, 12 bp, Unknown
  misc_feature (1)..( 12): Result.005 file - promoters50/1399417
taaaggcccaat

SEQ ID NO: 170701 - DNA, 12 bp, Unknown
  misc_feature (1)..( 12): Result.005 file - promoters50/1399417
tttaggcccatt

SEQ ID NO: 170702 - DNA, 12 bp, Unknown
  misc_feature (1)..( 12): Result.005 file - promoters50/1399417
taaaggcccaat

SEQ ID NO: 170703 - DNA, 12 bp, Unknown
  misc_feature (1)..( 12): Result.005 file - promoters50/1399417
ccgaggcccaat

SEQ ID NO: 170704 - DNA, 10 bp, Unknown
  misc_feature (1)..( 10): Result.005 file - promoters50/1399469
tcttccaaat

SEQ ID NO: 170705 - DNA, 10 bp, Unknown
  misc_feature (1)..( 10): Result.005 file - promoters50/1399469
tcttgcaagg

SEQ ID NO: 170706 - DNA, 10 bp, Unknown
  misc_feature (1)..( 10): Result.005 file - promoters50/1399469
tgttggaagg

SEQ ID NO: 170707 - DNA, 7 bp, Unknown
  misc_feature (1)..( 7): Result.005 file - promoters50/1399469
aaacttt

SEQ ID NO: 170708 - DNA, 7 bp, Unknown
  misc_feature (1)..( 7): Result.005 file - promoters50/1399469
aaaattt

SEQ ID NO: 170709 - DNA, 7 bp, Unknown
  misc_feature (1)..( 7): Result.005 file - promoters50/1399469
aaaattc

SEQ ID NO: 170710 - DNA, 11 bp, Unknown
  misc_feature (1)..( 11): Result.005 file - promoters50/1399541
tcctttaaaca

SEQ ID NO: 170711 - DNA, 11 bp, Unknown
  misc_feature (1)..( 11): Result.005 file - promoters50/1399541
tcctataagtc

SEQ ID NO: 170712 - DNA, 11 bp, Unknown
  misc_feature (1)..( 11): Result.005 file - promoters50/1399541
cactttaaaat

SEQ ID NO: 170713 - DNA, 11 bp, Unknown
  misc_feature (1)..( 11): Result.005 file - promoters50/1399541
ttttttaaaag

SEQ ID NO: 170714 - DNA, 12 bp, Unknown
  misc_feature (1)..( 12): Result.005 file - promoters50/1399541
agttttagaatc

SEQ ID NO: 170715 - DNA, 12 bp, Unknown
  misc_feature (1)..( 12): Result.005 file - promoters50/1399541
gtatttaaaata

SEQ ID NO: 170716 - DNA, 12 bp, Unknown
  misc_feature (1)..( 12): Result.005 file - promoters50/1399541
ttttgtactaat

SEQ ID NO: 170717 - DNA, 14 bp, Unknown
  misc_feature (1)..( 14): Result.005 file - promoters50/1399541
taaacattaaattg

SEQ ID NO: 170718 - DNA, 14 bp, Unknown
  misc_feature (1)..( 14): Result.005 file - promoters50/1399541
taaaaatttacact

SEQ ID NO: 170719 - DNA, 14 bp, Unknown
  misc_feature (1)..( 14): Result.005 file - promoters50/1399541
aaaagattccattg

SEQ ID NO: 170720 - DNA, 14 bp, Unknown
  misc_feature (1)..( 14): Result.005 file - promoters50/1399541
aaaagattttataa

SEQ ID NO: 170721 - DNA, 14 bp, Unknown
  misc_feature (1)..( 14): Result.005 file - promoters50/1399541
ccaagcttctattg

SEQ ID NO: 170722 - DNA, 14 bp, Unknown
  misc_feature (1)..( 14): Result.005 file - promoters50/1399541
tttagaatcctaat

SEQ ID NO: 170723 - DNA, 8 bp, Unknown
  misc_feature (1)..( 8): Result.005 file - promoters50/1399541
tttcaaac

SEQ ID NO: 170724 - DNA, 8 bp, Unknown
  misc_feature (1)..( 8): Result.005 file - promoters50/1399541
tttaaaat

SEQ ID NO: 170725 - DNA, 8 bp, Unknown
  misc_feature (1)..( 8): Result.005 file - promoters50/1399541
gttcaaaa

SEQ ID NO: 170726 - DNA, 8 bp, Unknown
  misc_feature (1)..( 8): Result.005 file - promoters50/1399541
tttagaat

SEQ ID NO: 170727 - DNA, 8 bp, Unknown
  misc_feature (1)..( 8): Result.005 file - promoters50/1399541
tatctaat

SEQ ID NO: 170728 - DNA, 8 bp, Unknown
  misc_feature (1)..( 8): Result.005 file - promoters50/1399541
attacaat

SEQ ID NO: 170729 - DNA, 13 bp, Unknown
  misc_feature (1)..( 13): Result.005 file - promoters50/1399541
aagcttctattga

SEQ ID NO: 170730 - DNA, 13 bp, Unknown
  misc_feature (1)..( 13): Result.005 file - promoters50/1399541
tctaatctattat

SEQ ID NO: 170731 - DNA, 13 bp, Unknown
  misc_feature (1)..( 13): Result.005 file - promoters50/1399541
aagattccattgg

SEQ ID NO: 170732 - DNA, 13 bp, Unknown
  misc_feature (1)..( 13): Result.005 file - promoters50/1399541
tagaatcctaatt

SEQ ID NO: 170733 - DNA, 13 bp, Unknown
  misc_feature (1)..( 13): Result.005 file - promoters50/1399541
aagtatttaaaat

SEQ ID NO: 170734 - DNA, 13 bp, Unknown
  misc_feature (1)..( 13): Result.005 file - promoters50/1399541
taaattacaatta

SEQ ID NO: 170735 - DNA, 14 bp, Unknown
  misc_feature (1)..( 14): Result.005 file - promoters50/1399541
taattttcataact

SEQ ID NO: 170736 - DNA, 14 bp, Unknown
  misc_feature (1)..( 14): Result.005 file - promoters50/1399541
aatctttaataatt

SEQ ID NO: 170737 - DNA, 15 bp, Unknown
  misc_feature (1)..( 15): Result.005 file - promoters50/1399541
ataatttacataaaa

SEQ ID NO: 170738 - DNA, 15 bp, Unknown
  misc_feature (1)..( 15): Result.005 file - promoters50/1399541
tattatctaatcctt

SEQ ID NO: 170739 - DNA, 15 bp, Unknown
  misc_feature (1)..( 15): Result.005 file - promoters50/1399541
tgtcatcaaatgtag

SEQ ID NO: 170740 - DNA, 15 bp, Unknown
  misc_feature (1)..( 15): Result.005 file - promoters50/1399541
taaattacaattatt

SEQ ID NO: 170741 - DNA, 11 bp, Unknown
  misc_feature (1)..( 11): Result.005 file - promoters50/1399638
tcctaacttaa

SEQ ID NO: 170742 - DNA, 11 bp, Unknown
  misc_feature (1)..( 11): Result.005 file - promoters50/1399638
tccaaacttta

SEQ ID NO: 170743 - DNA, 11 bp, Unknown
  misc_feature (1)..( 11): Result.005 file - promoters50/1399638
aaagaacataa

SEQ ID NO: 170744 - DNA, 10 bp, Unknown
  misc_feature (1)..( 10): Result.005 file - promoters50/1399638
taaccactaa

SEQ ID NO: 170745 - DNA, 10 bp, Unknown
  misc_feature (1)..( 10): Result.005 file - promoters50/1399638
taaacaccat

SEQ ID NO: 170746 - DNA, 10 bp, Unknown
  misc_feature (1)..( 10): Result.005 file - promoters50/1399638
aaaacaccat

SEQ ID NO: 170747 - DNA, 11 bp, Unknown
  misc_feature (1)..( 11): Result.005 file - promoters50/1399658
aaaaaaatctt

SEQ ID NO: 170748 - DNA, 11 bp, Unknown
  misc_feature (1)..( 11): Result.005 file - promoters50/1399658
agaaaaatgat

SEQ ID NO: 170749 - DNA, 11 bp, Unknown
  misc_feature (1)..( 11): Result.005 file - promoters50/1399658
caaaaaataat

SEQ ID NO: 170750 - DNA, 11 bp, Unknown
  misc_feature (1)..( 11): Result.005 file - promoters50/1399658
aaaaaaatcta

SEQ ID NO: 170751 - DNA, 11 bp, Unknown
  misc_feature (1)..( 11): Result.005 file - promoters50/1399658
tgaataattca

SEQ ID NO: 170752 - DNA, 11 bp, Unknown
  misc_feature (1)..( 11): Result.005 file - promoters50/1399658
attaaaatgtt

SEQ ID NO: 170753 - DNA, 11 bp, Unknown
  misc_feature (1)..( 11): Result.005 file - promoters50/1399658
tttaaaatttt

SEQ ID NO: 170754 - DNA, 11 bp, Unknown
  misc_feature (1)..( 11): Result.005 file - promoters50/1399658
tagaaactttt

SEQ ID NO: 170755 - DNA, 9 bp, Unknown
  misc_feature (1)..( 9): Result.005 file - promoters50/1399658
ggtcaaatt

SEQ ID NO: 170756 - DNA, 9 bp, Unknown
  misc_feature (1)..( 9): Result.005 file - promoters50/1399658
attcaaata

SEQ ID NO: 170757 - DNA, 9 bp, Unknown
  misc_feature (1)..( 9): Result.005 file - promoters50/1399658
taacaaatt

SEQ ID NO: 170758 - DNA, 9 bp, Unknown
  misc_feature (1)..( 9): Result.005 file - promoters50/1399658
attctaatt

SEQ ID NO: 170759 - DNA, 9 bp, Unknown
  misc_feature (1)..( 9): Result.005 file - promoters50/1399658
attccaatc

SEQ ID NO: 170760 - DNA, 9 bp, Unknown
  misc_feature (1)..( 9): Result.005 file - promoters50/1399658
catccaatc

SEQ ID NO: 170761 - DNA, 12 bp, Unknown
  misc_feature (1)..( 12): Result.005 file - promoters50/1399658
aaaaaagaattt

SEQ ID NO: 170762 - DNA, 12 bp, Unknown
  misc_feature (1)..( 12): Result.005 file - promoters50/1399658
caaacagatgtt

SEQ ID NO: 170763 - DNA, 12 bp, Unknown
  misc_feature (1)..( 12): Result.005 file - promoters50/1399658
gctaaagaaaat

SEQ ID NO: 170764 - DNA, 12 bp, Unknown
  misc_feature (1)..( 12): Result.005 file - promoters50/1399658
gaaaaaaaaaat

SEQ ID NO: 170765 - DNA, 12 bp, Unknown
  misc_feature (1)..( 12): Result.005 file - promoters50/1399658
cttcaagaaatg

SEQ ID NO: 170766 - DNA, 12 bp, Unknown
  misc_feature (1)..( 12): Result.005 file - promoters50/1399658
caaaaaaattca

SEQ ID NO: 170767 - DNA, 12 bp, Unknown
  misc_feature (1)..( 12): Result.005 file - promoters50/1399726
ccaattcattta

SEQ ID NO: 170768 - DNA, 12 bp, Unknown
  misc_feature (1)..( 12): Result.005 file - promoters50/1399726
ccaattaatttt

SEQ ID NO: 170769 - DNA, 12 bp, Unknown
  misc_feature (1)..( 12): Result.005 file - promoters50/1399726
ctaattcacaaa

SEQ ID NO: 170770 - DNA, 12 bp, Unknown
  misc_feature (1)..( 12): Result.005 file - promoters50/1399726
aaaattcctttc

SEQ ID NO: 170771 - DNA, 12 bp, Unknown
  misc_feature (1)..( 12): Result.005 file - promoters50/1399726
gtaataaatgag

SEQ ID NO: 170772 - DNA, 12 bp, Unknown
  misc_feature (1)..( 12): Result.005 file - promoters50/1399726
aatcataatttt

SEQ ID NO: 170773 - DNA, 19 bp, Unknown
  misc_feature (1)..( 19): Result.005 file - promoters50/1399726
aagatatttaaaacaaatt

SEQ ID NO: 170774 - DNA, 19 bp, Unknown
  misc_feature (1)..( 19): Result.005 file - promoters50/1399726
ttttattttaaaattaaag

SEQ ID NO: 170775 - DNA, 20 bp, Unknown
  misc_feature (1)..( 20): Result.005 file - promoters50/1399726
ttaactagttaaaaatgcat

SEQ ID NO: 170776 - DNA, 20 bp, Unknown
  misc_feature (1)..( 20): Result.005 file - promoters50/1399726
gtttgattctaagattaagt

SEQ ID NO: 170777 - DNA, 20 bp, Unknown
  misc_feature (1)..( 20): Result.005 file - promoters50/1399726
tcgaagtattacaattgctt

SEQ ID NO: 170778 - DNA, 20 bp, Unknown
  misc_feature (1)..( 20): Result.005 file - promoters50/1399726
gaagttgaatcgaattgagt

SEQ ID NO: 170779 - DNA, 20 bp, Unknown
  misc_feature (1)..( 20): Result.005 file - promoters50/1399726
atgagaaatcataatagaga

SEQ ID NO: 170780 - DNA, 12 bp, Unknown
  misc_feature (1)..( 12): Result.005 file - promoters50/1399726
aaaatgaaaaac

SEQ ID NO: 170781 - DNA, 12 bp, Unknown
  misc_feature (1)..( 12): Result.005 file - promoters50/1399726
aaaaagaaaacc

SEQ ID NO: 170782 - DNA, 12 bp, Unknown
  misc_feature (1)..( 12): Result.005 file - promoters50/1399726
ataataaaaaaa

SEQ ID NO: 170783 - DNA, 12 bp, Unknown
  misc_feature (1)..( 12): Result.005 file - promoters50/1399726
aaaatgggcact

SEQ ID NO: 170784 - DNA, 12 bp, Unknown
  misc_feature (1)..( 12): Result.005 file - promoters50/1399726
tggatgataaac

SEQ ID NO: 170785 - DNA, 12 bp, Unknown
  misc_feature (1)..( 12): Result.005 file - promoters50/1399726
caaaaaatattc

SEQ ID NO: 170786 - DNA, 12 bp, Unknown
  misc_feature (1)..( 12): Result.005 file - promoters50/1399726
tttataaacaca

SEQ ID NO: 170787 - DNA, 9 bp, Unknown
  misc_feature (1)..( 9): Result.005 file - promoters50/1399726
ataaagtac

SEQ ID NO: 170788 - DNA, 9 bp, Unknown
  misc_feature (1)..( 9): Result.005 file - promoters50/1399726
acaaaatac

SEQ ID NO: 170789 - DNA, 9 bp, Unknown
  misc_feature (1)..( 9): Result.005 file - promoters50/1399726
ataaattac

SEQ ID NO: 170790 - DNA, 9 bp, Unknown
  misc_feature (1)..( 9): Result.005 file - promoters50/1399726
tcaaaattt

SEQ ID NO: 170791 - DNA, 9 bp, Unknown
  misc_feature (1)..( 9): Result.005 file - promoters50/1399726
ataaatttt

SEQ ID NO: 170792 - DNA, 9 bp, Unknown
  misc_feature (1)..( 9): Result.005 file - promoters50/1399726
agaaagaca

SEQ ID NO: 170793 - DNA, 9 bp, Unknown
  misc_feature (1)..( 9): Result.005 file - promoters50/1399726
atagattag

SEQ ID NO: 170794 - DNA, 14 bp, Unknown
  misc_feature (1)..( 14): Result.005 file - promoters50/1399726
atgaaaaacgaaaa

SEQ ID NO: 170795 - DNA, 14 bp, Unknown
  misc_feature (1)..( 14): Result.005 file - promoters50/1399726
aaaaaaaaagaaga

SEQ ID NO: 170796 - DNA, 14 bp, Unknown
  misc_feature (1)..( 14): Result.005 file - promoters50/1399726
atgataaacttaaa

SEQ ID NO: 170797 - DNA, 14 bp, Unknown
  misc_feature (1)..( 14): Result.005 file - promoters50/1399726
ggtaaaaaagaaaa

SEQ ID NO: 170798 - DNA, 14 bp, Unknown
  misc_feature (1)..( 14): Result.005 file - promoters50/1399726
gtcaaaaaatattc

SEQ ID NO: 170799 - DNA, 14 bp, Unknown
  misc_feature (1)..( 14): Result.005 file - promoters50/1399726
tttataaacacatg

SEQ ID NO: 170800 - DNA, 11 bp, Unknown
  misc_feature (1)..( 11): Result.005 file - promoters50/1399726
ataaatatcta

SEQ ID NO: 170801 - DNA, 11 bp, Unknown
  misc_feature (1)..( 11): Result.005 file - promoters50/1399726
atatatatata

SEQ ID NO: 170802 - DNA, 11 bp, Unknown
  misc_feature (1)..( 11): Result.005 file - promoters50/1399726
tcgaatctctc

SEQ ID NO: 170803 - DNA, 11 bp, Unknown
  misc_feature (1)..( 11): Result.005 file - promoters50/1399726
tgaaatatttt

SEQ ID NO: 170804 - DNA, 11 bp, Unknown
  misc_feature (1)..( 11): Result.005 file - promoters50/1399726
gtaaattaatt

SEQ ID NO: 170805 - DNA, 11 bp, Unknown
  misc_feature (1)..( 11): Result.005 file - promoters50/1399726
acaaattcatt

SEQ ID NO: 170806 - DNA, 11 bp, Unknown
  misc_feature (1)..( 11): Result.005 file - promoters50/1399726
aatgattaata

SEQ ID NO: 170807 - DNA, 14 bp, Unknown
  misc_feature (1)..( 14): Result.005 file - promoters50/1399726
gagcttgtataagt

SEQ ID NO: 170808 - DNA, 14 bp, Unknown
  misc_feature (1)..( 14): Result.005 file - promoters50/1399726
taccttttatttat

SEQ ID NO: 170809 - DNA, 14 bp, Unknown
  misc_feature (1)..( 14): Result.005 file - promoters50/1399726
taatgtttaaagaa

SEQ ID NO: 170810 - DNA, 14 bp, Unknown
  misc_feature (1)..( 14): Result.005 file - promoters50/1399726
gacagttaaaattc

SEQ ID NO: 170811 - DNA, 14 bp, Unknown
  misc_feature (1)..( 14): Result.005 file - promoters50/1399726
tatacagtaacatt

SEQ ID NO: 170812 - DNA, 14 bp, Unknown
  misc_feature (1)..( 14): Result.005 file - promoters50/1399726
tttcttttgttttc

SEQ ID NO: 170813 - DNA, 12 bp, Unknown
  misc_feature (1)..( 12): Result.005 file - promoters50/1399726
tgatacttggta

SEQ ID NO: 170814 - DNA, 12 bp, Unknown
  misc_feature (1)..( 12): Result.005 file - promoters50/1399726
gttaactttgta

SEQ ID NO: 170815 - DNA, 12 bp, Unknown
  misc_feature (1)..( 12): Result.005 file - promoters50/1399726
aattacttgcac

SEQ ID NO: 170816 - DNA, 12 bp, Unknown
  misc_feature (1)..( 12): Result.005 file - promoters50/1399726
aagaactttaat

SEQ ID NO: 170817 - DNA, 12 bp, Unknown
  misc_feature (1)..( 12): Result.005 file - promoters50/1399726
ttgttcttcgat

SEQ ID NO: 170818 - DNA, 12 bp, Unknown
  misc_feature (1)..( 12): Result.005 file - promoters50/1399726
atatggttgttc

SEQ ID NO: 170819 - DNA, 15 bp, Unknown
  misc_feature (1)..( 15): Result.005 file - promoters50/1399726
atattaataattaaa

SEQ ID NO: 170820 - DNA, 15 bp, Unknown
  misc_feature (1)..( 15): Result.005 file - promoters50/1399726
tccataataatttag

SEQ ID NO: 170821 - DNA, 15 bp, Unknown
  misc_feature (1)..( 15): Result.005 file - promoters50/1399726
ttattattaactaaa

SEQ ID NO: 170822 - DNA, 15 bp, Unknown
  misc_feature (1)..( 15): Result.005 file - promoters50/1399726
aaagtaataataaca

SEQ ID NO: 170823 - DNA, 16 bp, Unknown
  misc_feature (1)..( 16): Result.005 file - promoters50/1399726
caatcagtaagttacc

SEQ ID NO: 170824 - DNA, 16 bp, Unknown
  misc_feature (1)..( 16): Result.005 file - promoters50/1399726
ttactattaatcatgg

SEQ ID NO: 170825 - DNA, 8 bp, Unknown
  misc_feature (1)..( 8): Result.005 file - promoters50/1399760
attttact

SEQ ID NO: 170826 - DNA, 8 bp, Unknown
  misc_feature (1)..( 8): Result.005 file - promoters50/1399760
atttaact

SEQ ID NO: 170827 - DNA, 8 bp, Unknown
  misc_feature (1)..( 8): Result.005 file - promoters50/1399760
attttaaa

SEQ ID NO: 170828 - DNA, 8 bp, Unknown
  misc_feature (1)..( 8): Result.005 file - promoters50/1403185
catcttta

SEQ ID NO: 170829 - DNA, 8 bp, Unknown
  misc_feature (1)..( 8): Result.005 file - promoters50/1403185
catctttt

SEQ ID NO: 170830 - DNA, 9 bp, Unknown
  misc_feature (1)..( 9): Result.005 file - promoters50/1403185
gttctgttc

SEQ ID NO: 170831 - DNA, 7 bp, Unknown
  misc_feature (1)..( 7): Result.005 file - promoters50/1403210
ttgaaat

SEQ ID NO: 170832 - DNA, 7 bp, Unknown
  misc_feature (1)..( 7): Result.005 file - promoters50/1403210
ttgaaaa

SEQ ID NO: 170833 - DNA, 7 bp, Unknown
  misc_feature (1)..( 7): Result.005 file - promoters50/1403210
tttaaaa

SEQ ID NO: 170834 - DNA, 10 bp, Unknown
  misc_feature (1)..( 10): Result.005 file - promoters50/1411578
gtcaaattta

SEQ ID NO: 170835 - DNA, 10 bp, Unknown
  misc_feature (1)..( 10): Result.005 file - promoters50/1411578
aaaaaactta

SEQ ID NO: 170836 - DNA, 10 bp, Unknown
  misc_feature (1)..( 10): Result.005 file - promoters50/1411578
gtctaattcg

SEQ ID NO: 170837 - DNA, 10 bp, Unknown
  misc_feature (1)..( 10): Result.005 file - promoters50/1411578
tcgaaactta

SEQ ID NO: 170838 - DNA, 9 bp, Unknown
  misc_feature (1)..( 9): Result.005 file - promoters50/1411578
agtagttca

SEQ ID NO: 170839 - DNA, 9 bp, Unknown
  misc_feature (1)..( 9): Result.005 file - promoters50/1411578
aaaagttca

SEQ ID NO: 170840 - DNA, 9 bp, Unknown
  misc_feature (1)..( 9): Result.005 file - promoters50/1411578
gttagatca

SEQ ID NO: 170841 - DNA, 9 bp, Unknown
  misc_feature (1)..( 9): Result.005 file - promoters50/1411578
gttagatcg

SEQ ID NO: 170842 - DNA, 9 bp, Unknown
  misc_feature (1)..( 9): Result.005 file - promoters50/1411578
ggtagatcc

SEQ ID NO: 170843 - DNA, 7 bp, Unknown
  misc_feature (1)..( 7): Result.005 file - promoters50/1411598
acaaaaa

SEQ ID NO: 170844 - DNA, 7 bp, Unknown
  misc_feature (1)..( 7): Result.005 file - promoters50/1411598
acataaa

SEQ ID NO: 170845 - DNA, 7 bp, Unknown
  misc_feature (1)..( 7): Result.005 file - promoters50/1411598
ccataaa

SEQ ID NO: 170846 - DNA, 11 bp, Unknown
  misc_feature (1)..( 11): Result.005 file - promoters50/1411616
tattgtttttc

SEQ ID NO: 170847 - DNA, 11 bp, Unknown
  misc_feature (1)..( 11): Result.005 file - promoters50/1411616
cgctgttttcc

SEQ ID NO: 170848 - DNA, 11 bp, Unknown
  misc_feature (1)..( 11): Result.005 file - promoters50/1411616
tattatttgtg

SEQ ID NO: 170849 - DNA, 11 bp, Unknown
  misc_feature (1)..( 11): Result.005 file - promoters50/1411616
catcgtttttg

SEQ ID NO: 170850 - DNA, 11 bp, Unknown
  misc_feature (1)..( 11): Result.005 file - promoters50/1411616
aattattttat

SEQ ID NO: 170851 - DNA, 11 bp, Unknown
  misc_feature (1)..( 11): Result.005 file - promoters50/1411616
tgatatttttt

SEQ ID NO: 170852 - DNA, 8 bp, Unknown
  misc_feature (1)..( 8): Result.005 file - promoters50/1411628
ccttccca

SEQ ID NO: 170853 - DNA, 8 bp, Unknown
  misc_feature (1)..( 8): Result.005 file - promoters50/1411628
ccttcctt

SEQ ID NO: 170854 - DNA, 8 bp, Unknown
  misc_feature (1)..( 8): Result.005 file - promoters50/1411628
ccttcctt

SEQ ID NO: 170855 - DNA, 8 bp, Unknown
  misc_feature (1)..( 8): Result.005 file - promoters50/1411628
ctttcttt

SEQ ID NO: 170856 - DNA, 11 bp, Unknown
  misc_feature (1)..( 11): Result.005 file - promoters50/1411628
ttaaatttgaa

SEQ ID NO: 170857 - DNA, 11 bp, Unknown
  misc_feature (1)..( 11): Result.005 file - promoters50/1411628
tgaaaattgtt

SEQ ID NO: 170858 - DNA, 11 bp, Unknown
  misc_feature (1)..( 11): Result.005 file - promoters50/1411628
ttatattttga

SEQ ID NO: 170859 - DNA, 11 bp, Unknown
  misc_feature (1)..( 11): Result.005 file - promoters50/1411628
aaacaattgtt

SEQ ID NO: 170860 - DNA, 9 bp, Unknown
  misc_feature (1)..( 9): Result.005 file - promoters50/1411628
ggatacatg

SEQ ID NO: 170861 - DNA, 9 bp, Unknown
  misc_feature (1)..( 9): Result.005 file - promoters50/1411628
caataaatg

SEQ ID NO: 170862 - DNA, 9 bp, Unknown
  misc_feature (1)..( 9): Result.005 file - promoters50/1411628
caacaaaca

SEQ ID NO: 170863 - DNA, 9 bp, Unknown
  misc_feature (1)..( 9): Result.005 file - promoters50/1411628
caaaaaact

SEQ ID NO: 170864 - DNA, 10 bp, Unknown
  misc_feature (1)..( 10): Result.005 file - promoters50/1411628
tgtatgtata

SEQ ID NO: 170865 - DNA, 10 bp, Unknown
  misc_feature (1)..( 10): Result.005 file - promoters50/1411628
tgtatttata

SEQ ID NO: 170866 - DNA, 10 bp, Unknown
  misc_feature (1)..( 10): Result.005 file - promoters50/1411628
attatttagc

SEQ ID NO: 170867 - DNA, 10 bp, Unknown
  misc_feature (1)..( 10): Result.005 file - promoters50/1411628
cgaatttttt

SEQ ID NO: 170868 - DNA, 9 bp, Unknown
  misc_feature (1)..( 9): Result.005 file - promoters50/1411703
tatacaaac

SEQ ID NO: 170869 - DNA, 9 bp, Unknown
  misc_feature (1)..( 9): Result.005 file - promoters50/1411703
aataaaaaa

SEQ ID NO: 170870 - DNA, 9 bp, Unknown
  misc_feature (1)..( 9): Result.005 file - promoters50/1411703
tataaaatg

SEQ ID NO: 170871 - DNA, 9 bp, Unknown
  misc_feature (1)..( 9): Result.005 file - promoters50/1411703
actaaaaat

SEQ ID NO: 170872 - DNA, 9 bp, Unknown
  misc_feature (1)..( 9): Result.005 file - promoters50/1411703
tattaaagt

SEQ ID NO: 170873 - DNA, 9 bp, Unknown
  misc_feature (1)..( 9): Result.005 file - promoters50/1411703
tattaaagt

SEQ ID NO: 170874 - DNA, 9 bp, Unknown
  misc_feature (1)..( 9): Result.005 file - promoters50/1411703
tgtaacatg

SEQ ID NO: 170875 - DNA, 9 bp, Unknown
  misc_feature (1)..( 9): Result.005 file - promoters50/1411722
aaaatataa

SEQ ID NO: 170876 - DNA, 9 bp, Unknown
  misc_feature (1)..( 9): Result.005 file - promoters50/1411722
ccaatttaa

SEQ ID NO: 170877 - DNA, 10 bp, Unknown
  misc_feature (1)..( 10): Result.005 file - promoters50/1411722
aaaactatgg

SEQ ID NO: 170878 - DNA, 10 bp, Unknown
  misc_feature (1)..( 10): Result.005 file - promoters50/1411722
tcaacaatga

SEQ ID NO: 170879 - DNA, 7 bp, Unknown
  misc_feature (1)..( 7): Result.005 file - promoters50/1411730
caaatca

SEQ ID NO: 170880 - DNA, 7 bp, Unknown
  misc_feature (1)..( 7): Result.005 file - promoters50/1411730
caaatct

SEQ ID NO: 170881 - DNA, 7 bp, Unknown
  misc_feature (1)..( 7): Result.005 file - promoters50/1411730
aaaatct

SEQ ID NO: 170882 - DNA, 7 bp, Unknown
  misc_feature (1)..( 7): Result.005 file - promoters50/1411730
ttaattc

SEQ ID NO: 170883 - DNA, 7 bp, Unknown
  misc_feature (1)..( 7): Result.005 file - promoters50/1411730
ttaattt

SEQ ID NO: 170884 - DNA, 7 bp, Unknown
  misc_feature (1)..( 7): Result.005 file - promoters50/1411730
taaatca

SEQ ID NO: 170885 - DNA, 8 bp, Unknown
  misc_feature (1)..( 8): Result.005 file - promoters50/1411730
aaaacaaa

SEQ ID NO: 170886 - DNA, 8 bp, Unknown
  misc_feature (1)..( 8): Result.005 file - promoters50/1411730
aaaaaaaa

SEQ ID NO: 170887 - DNA, 8 bp, Unknown
  misc_feature (1)..( 8): Result.005 file - promoters50/1411730
aaaacaag

SEQ ID NO: 170888 - DNA, 8 bp, Unknown
  misc_feature (1)..( 8): Result.005 file - promoters50/1411730
aaagcaaa

SEQ ID NO: 170889 - DNA, 8 bp, Unknown
  misc_feature (1)..( 8): Result.005 file - promoters50/1411730
actaaaag

SEQ ID NO: 170890 - DNA, 8 bp, Unknown
  misc_feature (1)..( 8): Result.005 file - promoters50/1411730
actgaaat

SEQ ID NO: 170891 - DNA, 8 bp, Unknown
  misc_feature (1)..( 8): Result.005 file - promoters50/1411730
actgtaat

SEQ ID NO: 170892 - DNA, 9 bp, Unknown
  misc_feature (1)..( 9): Result.005 file - promoters50/1411730
agtctaaaa

SEQ ID NO: 170893 - DNA, 9 bp, Unknown
  misc_feature (1)..( 9): Result.005 file - promoters50/1411730
agtttaaca

SEQ ID NO: 170894 - DNA, 9 bp, Unknown
  misc_feature (1)..( 9): Result.005 file - promoters50/1411730
tgtccaaaa

SEQ ID NO: 170895 - DNA, 8 bp, Unknown
  misc_feature (1)..( 8): Result.005 file - promoters50/1411730
cccattct

SEQ ID NO: 170896 - DNA, 8 bp, Unknown
  misc_feature (1)..( 8): Result.005 file - promoters50/1411730
cccattcc

SEQ ID NO: 170897 - DNA, 8 bp, Unknown
  misc_feature (1)..( 8): Result.005 file - promoters50/1411730
ctcattcc

SEQ ID NO: 170898 - DNA, 9 bp, Unknown
  misc_feature (1)..( 9): Result.005 file - promoters50/1411730
taactggaa

SEQ ID NO: 170899 - DNA, 9 bp, Unknown
  misc_feature (1)..( 9): Result.005 file - promoters50/1411730
taacttgaa

SEQ ID NO: 170900 - DNA, 9 bp, Unknown
  misc_feature (1)..( 9): Result.005 file - promoters50/1411730
taagttgca

SEQ ID NO: 170901 - DNA, 10 bp, Unknown
  misc_feature (1)..( 10): Result.005 file - promoters50/1411730
cgaaactaaa

SEQ ID NO: 170902 - DNA, 10 bp, Unknown
  misc_feature (1)..( 10): Result.005 file - promoters50/1411730
taaaaataaa

SEQ ID NO: 170903 - DNA, 11 bp, Unknown
  misc_feature (1)..( 11): Result.005 file - promoters50/1411730
gtaacaatcta

SEQ ID NO: 170904 - DNA, 13 bp, Unknown
  misc_feature (1)..( 13): Result.005 file - promoters50/1411762
atcttgtatctat

SEQ ID NO: 170905 - DNA, 13 bp, Unknown
  misc_feature (1)..( 13): Result.005 file - promoters50/1411762
atcttatatatat

SEQ ID NO: 170906 - DNA, 13 bp, Unknown
  misc_feature (1)..( 13): Result.005 file - promoters50/1411762
tttctatatataa

SEQ ID NO: 170907 - DNA, 9 bp, Unknown
  misc_feature (1)..( 9): Result.005 file - promoters50/1411762
acaaacctt

SEQ ID NO: 170908 - DNA, 9 bp, Unknown
  misc_feature (1)..( 9): Result.005 file - promoters50/1411762
acataccaa

SEQ ID NO: 170909 - DNA, 9 bp, Unknown
  misc_feature (1)..( 9): Result.005 file - promoters50/1411762
atatatcaa

SEQ ID NO: 170910 - DNA, 7 bp, Unknown
  misc_feature (1)..( 7): Result.005 file - promoters50/1411762
caaaact

SEQ ID NO: 170911 - DNA, 7 bp, Unknown
  misc_feature (1)..( 7): Result.005 file - promoters50/1411762
aaaaact

SEQ ID NO: 170912 - DNA, 8 bp, Unknown
  misc_feature (1)..( 8): Result.005 file - promoters50/1411762
aaaagact

SEQ ID NO: 170913 - DNA, 8 bp, Unknown
  misc_feature (1)..( 8): Result.005 file - promoters50/1411786
tttatttt

SEQ ID NO: 170914 - DNA, 8 bp, Unknown
  misc_feature (1)..( 8): Result.005 file - promoters50/1411786
aatatttt

SEQ ID NO: 170915 - DNA, 8 bp, Unknown
  misc_feature (1)..( 8): Result.005 file - promoters50/1411786
attattaa

SEQ ID NO: 170916 - DNA, 7 bp, Unknown
  misc_feature (1)..( 7): Result.005 file - promoters50/1411786
gatatac

SEQ ID NO: 170917 - DNA, 7 bp, Unknown
  misc_feature (1)..( 7): Result.005 file - promoters50/1411786
gatatat

SEQ ID NO: 170918 - DNA, 7 bp, Unknown
  misc_feature (1)..( 7): Result.005 file - promoters50/1411786
aatatat

SEQ ID NO: 170919 - DNA, 7 bp, Unknown
  misc_feature (1)..( 7): Result.005 file - promoters50/1411786
atacatt

SEQ ID NO: 170920 - DNA, 7 bp, Unknown
  misc_feature (1)..( 7): Result.005 file - promoters50/1411786
atatatt

SEQ ID NO: 170921 - DNA, 7 bp, Unknown
  misc_feature (1)..( 7): Result.005 file - promoters50/1411786
atatatg

SEQ ID NO: 170922 - DNA, 7 bp, Unknown
  misc_feature (1)..( 7): Result.005 file - promoters50/1413159
ctgtgat

SEQ ID NO: 170923 - DNA, 7 bp, Unknown
  misc_feature (1)..( 7): Result.005 file - promoters50/1413159
ttgtgat

SEQ ID NO: 170924 - DNA, 7 bp, Unknown
  misc_feature (1)..( 7): Result.005 file - promoters50/1413159
ttgtgaa

SEQ ID NO: 170925 - DNA, 9 bp, Unknown
  misc_feature (1)..( 9): Result.005 file - promoters50/1413191
cttaattta

SEQ ID NO: 170926 - DNA, 9 bp, Unknown
  misc_feature (1)..( 9): Result.005 file - promoters50/1413191
tttaattag

SEQ ID NO: 170927 - DNA, 9 bp, Unknown
  misc_feature (1)..( 9): Result.005 file - promoters50/1413191
cttattttt

SEQ ID NO: 170928 - DNA, 9 bp, Unknown
  misc_feature (1)..( 9): Result.005 file - promoters50/1413191
tataattta

SEQ ID NO: 170929 - DNA, 9 bp, Unknown
  misc_feature (1)..( 9): Result.005 file - promoters50/1413191
tttatttct

SEQ ID NO: 170930 - DNA, 9 bp, Unknown
  misc_feature (1)..( 9): Result.005 file - promoters50/1413191
agtatctct

SEQ ID NO: 170931 - DNA, 8 bp, Unknown
  misc_feature (1)..( 8): Result.005 file - promoters50/1413191
atataaaa

SEQ ID NO: 170932 - DNA, 8 bp, Unknown
  misc_feature (1)..( 8): Result.005 file - promoters50/1413191
atataaat

SEQ ID NO: 170933 - DNA, 8 bp, Unknown
  misc_feature (1)..( 8): Result.005 file - promoters50/1413191
ctataaag

SEQ ID NO: 170934 - DNA, 8 bp, Unknown
  misc_feature (1)..( 8): Result.005 file - promoters50/1413191
atataagt

SEQ ID NO: 170935 - DNA, 8 bp, Unknown
  misc_feature (1)..( 8): Result.005 file - promoters50/1413191
ttataaaa

SEQ ID NO: 170936 - DNA, 8 bp, Unknown
  misc_feature (1)..( 8): Result.005 file - promoters50/1413191
atataagt

SEQ ID NO: 170937 - DNA, 11 bp, Unknown
  misc_feature (1)..( 11): Result.005 file - promoters50/1413191
atttgttttac

SEQ ID NO: 170938 - DNA, 11 bp, Unknown
  misc_feature (1)..( 11): Result.005 file - promoters50/1413191
gtttctttttt

SEQ ID NO: 170939 - DNA, 11 bp, Unknown
  misc_feature (1)..( 11): Result.005 file - promoters50/1413191
ttttatttgtc

SEQ ID NO: 170940 - DNA, 11 bp, Unknown
  misc_feature (1)..( 11): Result.005 file - promoters50/1413191
ttttgttgtta

SEQ ID NO: 170941 - DNA, 11 bp, Unknown
  misc_feature (1)..( 11): Result.005 file - promoters50/1413191
atttgtagtga

SEQ ID NO: 170942 - DNA, 11 bp, Unknown
  misc_feature (1)..( 11): Result.005 file - promoters50/1413191
gcttctttttt

SEQ ID NO: 170943 - DNA, 13 bp, Unknown
  misc_feature (1)..( 13): Result.005 file - promoters50/1413191
ttgacttttttat

SEQ ID NO: 170944 - DNA, 13 bp, Unknown
  misc_feature (1)..( 13): Result.005 file - promoters50/1413191
ctttgtttcttaa

SEQ ID NO: 170945 - DNA, 13 bp, Unknown
  misc_feature (1)..( 13): Result.005 file - promoters50/1413191
ttgtctttttatt

SEQ ID NO: 170946 - DNA, 13 bp, Unknown
  misc_feature (1)..( 13): Result.005 file - promoters50/1413191
cttctttttttgg

SEQ ID NO: 170947 - DNA, 14 bp, Unknown
  misc_feature (1)..( 14): Result.005 file - promoters50/1413191
ttctaaaatcttaa

SEQ ID NO: 170948 - DNA, 14 bp, Unknown
  misc_feature (1)..( 14): Result.005 file - promoters50/1413191
aatgattgtctgcc

SEQ ID NO: 170949 - DNA, 12 bp, Unknown
  misc_feature (1)..( 12): Result.005 file - promoters50/1413191
agatttaaaata

SEQ ID NO: 170950 - DNA, 12 bp, Unknown
  misc_feature (1)..( 12): Result.005 file - promoters50/1413191
tgatataagatg

SEQ ID NO: 170951 - DNA, 12 bp, Unknown
  misc_feature (1)..( 12): Result.005 file - promoters50/1413191
atttttaaatat

SEQ ID NO: 170952 - DNA, 12 bp, Unknown
  misc_feature (1)..( 12): Result.005 file - promoters50/1413191
agatttatttct

SEQ ID NO: 170953 - DNA, 12 bp, Unknown
  misc_feature (1)..( 12): Result.005 file - promoters50/1413191
taatttaatgca

SEQ ID NO: 170954 - DNA, 12 bp, Unknown
  misc_feature (1)..( 12): Result.005 file - promoters50/1413191
agctttaattag

SEQ ID NO: 170955 - DNA, 15 bp, Unknown
  misc_feature (1)..( 15): Result.005 file - promoters50/1413191
tttcaaaataattca

SEQ ID NO: 170956 - DNA, 15 bp, Unknown
  misc_feature (1)..( 15): Result.005 file - promoters50/1413191
attccaaagaattat

SEQ ID NO: 170957 - DNA, 15 bp, Unknown
  misc_feature (1)..( 15): Result.005 file - promoters50/1413191
tatgcaaataatttt

SEQ ID NO: 170958 - DNA, 15 bp, Unknown
  misc_feature (1)..( 15): Result.005 file - promoters50/1413191
tttacaagttgaatt

SEQ ID NO: 170959 - DNA, 15 bp, Unknown
  misc_feature (1)..( 15): Result.005 file - promoters50/1413191
cgctcaagtaatttt

SEQ ID NO: 170960 - DNA, 15 bp, Unknown
  misc_feature (1)..( 15): Result.005 file - promoters50/1413191
ttctgaagaaattag

SEQ ID NO: 170961 - DNA, 15 bp, Unknown
  misc_feature (1)..( 15): Result.005 file - promoters50/1413191
gaatcaagaaacagt

SEQ ID NO: 170962 - DNA, 10 bp, Unknown
  misc_feature (1)..( 10): Result.005 file - promoters50/1413191
aaattataga

SEQ ID NO: 170963 - DNA, 10 bp, Unknown
  misc_feature (1)..( 10): Result.005 file - promoters50/1413191
gaatcatatg

SEQ ID NO: 170964 - DNA, 10 bp, Unknown
  misc_feature (1)..( 10): Result.005 file - promoters50/1413191
taattatttg

SEQ ID NO: 170965 - DNA, 10 bp, Unknown
  misc_feature (1)..( 10): Result.005 file - promoters50/1413191
aaataataag

SEQ ID NO: 170966 - DNA, 10 bp, Unknown
  misc_feature (1)..( 10): Result.005 file - promoters50/1413191
aaataaaaaa

SEQ ID NO: 170967 - DNA, 10 bp, Unknown
  misc_feature (1)..( 10): Result.005 file - promoters50/1413191
aatttattta

SEQ ID NO: 170968 - DNA, 9 bp, Unknown
  misc_feature (1)..( 9): Result.005 file - promoters50/1413211
atagtcaac

SEQ ID NO: 170969 - DNA, 9 bp, Unknown
  misc_feature (1)..( 9): Result.005 file - promoters50/1413211
ttagtcata

SEQ ID NO: 170970 - DNA, 9 bp, Unknown
  misc_feature (1)..( 9): Result.005 file - promoters50/1413211
ataatcaac

SEQ ID NO: 170971 - DNA, 9 bp, Unknown
  misc_feature (1)..( 9): Result.005 file - promoters50/1413211
aaaatagaa

SEQ ID NO: 170972 - DNA, 9 bp, Unknown
  misc_feature (1)..( 9): Result.005 file - promoters50/1413211
aaaaaagaa

SEQ ID NO: 170973 - DNA, 9 bp, Unknown
  misc_feature (1)..( 9): Result.005 file - promoters50/1413211
aaaatattt

SEQ ID NO: 170974 - DNA, 13 bp, Unknown
  misc_feature (1)..( 13): Result.005 file - promoters50/1413211
tgatgaaaaggat

SEQ ID NO: 170975 - DNA, 13 bp, Unknown
  misc_feature (1)..( 13): Result.005 file - promoters50/1413211
tgatgtaaatgat

SEQ ID NO: 170976 - DNA, 13 bp, Unknown
  misc_feature (1)..( 13): Result.005 file - promoters50/1413211
aatttaaaatgaa

SEQ ID NO: 170977 - DNA, 7 bp, Unknown
  misc_feature (1)..( 7): Result.005 file - promoters50/1413211
agatagt

SEQ ID NO: 170978 - DNA, 7 bp, Unknown
  misc_feature (1)..( 7): Result.005 file - promoters50/1413211
agatagt

SEQ ID NO: 170979 - DNA, 7 bp, Unknown
  misc_feature (1)..( 7): Result.005 file - promoters50/1413211
tgatata

SEQ ID NO: 170980 - DNA, 9 bp, Unknown
  misc_feature (1)..( 9): Result.005 file - promoters50/1413211
atttaaaat

SEQ ID NO: 170981 - DNA, 9 bp, Unknown
  misc_feature (1)..( 9): Result.005 file - promoters50/1413211
atttaatta

SEQ ID NO: 170982 - DNA, 9 bp, Unknown
  misc_feature (1)..( 9): Result.005 file - promoters50/1413211
ttttgatta

SEQ ID NO: 170983 - DNA, 9 bp, Unknown
  misc_feature (1)..( 9): Result.005 file - promoters50/1413211
aatgaatat

SEQ ID NO: 170984 - DNA, 9 bp, Unknown
  misc_feature (1)..( 9): Result.005 file - promoters50/1413211
tttgattat

SEQ ID NO: 170985 - DNA, 9 bp, Unknown
  misc_feature (1)..( 9): Result.005 file - promoters50/1413211
tttaattac

SEQ ID NO: 170986 - DNA, 10 bp, Unknown
  misc_feature (1)..( 10): Result.005 file - promoters50/1420845
aaagactttc

SEQ ID NO: 170987 - DNA, 10 bp, Unknown
  misc_feature (1)..( 10): Result.005 file - promoters50/1420845
aaagagtttc

SEQ ID NO: 170988 - DNA, 10 bp, Unknown
  misc_feature (1)..( 10): Result.005 file - promoters50/1420845
ttggagtttt

SEQ ID NO: 170989 - DNA, 9 bp, Unknown
  misc_feature (1)..( 9): Result.005 file - promoters50/1420853
ttctacatg

SEQ ID NO: 170990 - DNA, 9 bp, Unknown
  misc_feature (1)..( 9): Result.005 file - promoters50/1420853
ttcgacatt

SEQ ID NO: 170991 - DNA, 9 bp, Unknown
  misc_feature (1)..( 9): Result.005 file - promoters50/1420853
cccgatatt

SEQ ID NO: 170992 - DNA, 11 bp, Unknown
  misc_feature (1)..( 11): Result.005 file - promoters50/1420853
tattatggttt

SEQ ID NO: 170993 - DNA, 11 bp, Unknown
  misc_feature (1)..( 11): Result.005 file - promoters50/1420853
gaatatgtttt

SEQ ID NO: 170994 - DNA, 11 bp, Unknown
  misc_feature (1)..( 11): Result.005 file - promoters50/1420853
tattattgtta

SEQ ID NO: 170995 - DNA, 14 bp, Unknown
  misc_feature (1)..( 14): Result.005 file - promoters50/1420853
cgtatttaaacccc

SEQ ID NO: 170996 - DNA, 14 bp, Unknown
  misc_feature (1)..( 14): Result.005 file - promoters50/1420853
cgtatgtaatcgaa

SEQ ID NO: 170997 - DNA, 14 bp, Unknown
  misc_feature (1)..( 14): Result.005 file - promoters50/1420853
cctatttatacccc

SEQ ID NO: 170998 - DNA, 9 bp, Unknown
  misc_feature (1)..( 9): Result.005 file - promoters50/1420853
aaggcttta

SEQ ID NO: 170999 - DNA, 9 bp, Unknown
  misc_feature (1)..( 9): Result.005 file - promoters50/1420853
caggattta

SEQ ID NO: 171000 - DNA, 9 bp, Unknown
  misc_feature (1)..( 9): Result.005 file - promoters50/1420853
aaggctttt

SEQ ID NO: 171001 - DNA, 7 bp, Unknown
  misc_feature (1)..( 7): Result.005 file - promoters50/1420853
atgtctg

SEQ ID NO: 171002 - DNA, 7 bp, Unknown
  misc_feature (1)..( 7): Result.005 file - promoters50/1420853
atgtctt

SEQ ID NO: 171003 - DNA, 7 bp, Unknown
  misc_feature (1)..( 7): Result.005 file - promoters50/1420853
ttgtctg

SEQ ID NO: 171004 - DNA, 7 bp, Unknown
  misc_feature (1)..( 7): Result.005 file - promoters50/1420853
caaatgc

SEQ ID NO: 171005 - DNA, 7 bp, Unknown
  misc_feature (1)..( 7): Result.005 file - promoters50/1420853
taaatgc

SEQ ID NO: 171006 - DNA, 7 bp, Unknown
  misc_feature (1)..( 7): Result.005 file - promoters50/1420853
taaatga

SEQ ID NO: 171007 - DNA, 11 bp, Unknown
  misc_feature (1)..( 11): Result.005 file - promoters50/1440857
ttgacataatt

SEQ ID NO: 171008 - DNA, 11 bp, Unknown
  misc_feature (1)..( 11): Result.005 file - promoters50/1440857
ttgccatgatg

SEQ ID NO: 171009 - DNA, 11 bp, Unknown
  misc_feature (1)..( 11): Result.005 file - promoters50/1440857
ctgatataatt

SEQ ID NO: 171010 - DNA, 8 bp, Unknown
  misc_feature (1)..( 8): Result.005 file - promoters50/1440857
tttagtca

SEQ ID NO: 171011 - DNA, 8 bp, Unknown
  misc_feature (1)..( 8): Result.005 file - promoters50/1440857
tttggtct

SEQ ID NO: 171012 - DNA, 8 bp, Unknown
  misc_feature (1)..( 8): Result.005 file - promoters50/1440857
gttagtca

SEQ ID NO: 171013 - DNA, 11 bp, Unknown
  misc_feature (1)..( 11): Result.005 file - promoters50/1440865
aactaaaaata

SEQ ID NO: 171014 - DNA, 11 bp, Unknown
  misc_feature (1)..( 11): Result.005 file - promoters50/1440865
cttgaaaaatg

SEQ ID NO: 171015 - DNA, 11 bp, Unknown
  misc_feature (1)..( 11): Result.005 file - promoters50/1440865
acctaaatata

SEQ ID NO: 171016 - DNA, 11 bp, Unknown
  misc_feature (1)..( 11): Result.005 file - promoters50/1440865
accttaatgat

SEQ ID NO: 171017 - DNA, 7 bp, Unknown
  misc_feature (1)..( 7): Result.005 file - promoters50/1440865
agcaagt

SEQ ID NO: 171018 - DNA, 7 bp, Unknown
  misc_feature (1)..( 7): Result.005 file - promoters50/1440865
agcgagt

SEQ ID NO: 171019 - DNA, 7 bp, Unknown
  misc_feature (1)..( 7): Result.005 file - promoters50/1440865
agcaagt

SEQ ID NO: 171020 - DNA, 10 bp, Unknown
  misc_feature (1)..( 10): Result.005 file - promoters50/1440865
taagattcca

SEQ ID NO: 171021 - DNA, 10 bp, Unknown
  misc_feature (1)..( 10): Result.005 file - promoters50/1440865
taacatttgg

SEQ ID NO: 171022 - DNA, 10 bp, Unknown
  misc_feature (1)..( 10): Result.005 file - promoters50/1440865
acacattttc

SEQ ID NO: 171023 - DNA, 10 bp, Unknown
  misc_feature (1)..( 10): Result.005 file - promoters50/1440865
tttcattttc

SEQ ID NO: 171024 - DNA, 8 bp, Unknown
  misc_feature (1)..( 8): Result.005 file - promoters50/1440865
tcataagg

SEQ ID NO: 171025 - DNA, 8 bp, Unknown
  misc_feature (1)..( 8): Result.005 file - promoters50/1440865
tcaaaagc

SEQ ID NO: 171026 - DNA, 8 bp, Unknown
  misc_feature (1)..( 8): Result.005 file - promoters50/1440865
caaaaagc

SEQ ID NO: 171027 - DNA, 7 bp, Unknown
  misc_feature (1)..( 7): Result.005 file - promoters50/1440865
gacattt

SEQ ID NO: 171028 - DNA, 7 bp, Unknown
  misc_feature (1)..( 7): Result.005 file - promoters50/1440865
gaccttt

SEQ ID NO: 171029 - DNA, 7 bp, Unknown
  misc_feature (1)..( 7): Result.005 file - promoters50/1440865
tacattt

SEQ ID NO: 171030 - DNA, 12 bp, Unknown
  misc_feature (1)..( 12): Result.005 file - promoters50/1440865
ttttaattatta

SEQ ID NO: 171031 - DNA, 12 bp, Unknown
  misc_feature (1)..( 12): Result.005 file - promoters50/1440865
agacaatgatta

SEQ ID NO: 171032 - DNA, 12 bp, Unknown
  misc_feature (1)..( 12): Result.005 file - promoters50/1440865
tttgaataattc

SEQ ID NO: 171033 - DNA, 8 bp, Unknown
  misc_feature (1)..( 8): Result.005 file - promoters50/1440865
accaaaac

SEQ ID NO: 171034 - DNA, 8 bp, Unknown
  misc_feature (1)..( 8): Result.005 file - promoters50/1440865
acctaaat

SEQ ID NO: 171035 - DNA, 8 bp, Unknown
  misc_feature (1)..( 8): Result.005 file - promoters50/1440865
accttaat

SEQ ID NO: 171036 - DNA, 11 bp, Unknown
  misc_feature (1)..( 11): Result.005 file - promoters50/1440865
gtattaattta

SEQ ID NO: 171037 - DNA, 11 bp, Unknown
  misc_feature (1)..( 11): Result.005 file - promoters50/1440865
tttttaaatta

SEQ ID NO: 171038 - DNA, 12 bp, Unknown
  misc_feature (1)..( 12): Result.005 file - promoters50/1440865
tttttcaaaaaa

SEQ ID NO: 171039 - DNA, 8 bp, Unknown
  misc_feature (1)..( 8): Result.005 file - promoters50/1440865
tctttagt

SEQ ID NO: 171040 - DNA, 8 bp, Unknown
  misc_feature (1)..( 8): Result.005 file - promoters50/1440865
tcttgagt

SEQ ID NO: 171041 - DNA, 8 bp, Unknown
  misc_feature (1)..( 8): Result.005 file - promoters50/1440865
tcttgaaa

SEQ ID NO: 171042 - DNA, 8 bp, Unknown
  misc_feature (1)..( 8): Result.005 file - promoters50/1440865
cacaagta

SEQ ID NO: 171043 - DNA, 8 bp, Unknown
  misc_feature (1)..( 8): Result.005 file - promoters50/1440865
agcaagta

SEQ ID NO: 171044 - DNA, 8 bp, Unknown
  misc_feature (1)..( 8): Result.005 file - promoters50/1440865
agcgagtt

SEQ ID NO: 171045 - DNA, 8 bp, Unknown
  misc_feature (1)..( 8): Result.005 file - promoters50/1440865
ctttgtct

SEQ ID NO: 171046 - DNA, 8 bp, Unknown
  misc_feature (1)..( 8): Result.005 file - promoters50/1440865
ctttttct

SEQ ID NO: 171047 - DNA, 8 bp, Unknown
  misc_feature (1)..( 8): Result.005 file - promoters50/1440865
tattttct

SEQ ID NO: 171048 - DNA, 9 bp, Unknown
  misc_feature (1)..( 9): Result.005 file - promoters50/1440865
tttcaaaaa

SEQ ID NO: 171049 - DNA, 9 bp, Unknown
  misc_feature (1)..( 9): Result.005 file - promoters50/1440865
ccgcaaaaa

SEQ ID NO: 171050 - DNA, 9 bp, Unknown
  misc_feature (1)..( 9): Result.005 file - promoters50/1440865
tttcacaaa

SEQ ID NO: 171051 - DNA, 7 bp, Unknown
  misc_feature (1)..( 7): Result.005 file - promoters50/1440865
ctttttt

SEQ ID NO: 171052 - DNA, 7 bp, Unknown
  misc_feature (1)..( 7): Result.005 file - promoters50/1440865
atttttt

SEQ ID NO: 171053 - DNA, 7 bp, Unknown
  misc_feature (1)..( 7): Result.005 file - promoters50/1440865
atttttg

SEQ ID NO: 171054 - DNA, 7 bp, Unknown
  misc_feature (1)..( 7): Result.005 file - promoters50/1440865
cctttat

SEQ ID NO: 171055 - DNA, 7 bp, Unknown
  misc_feature (1)..( 7): Result.005 file - promoters50/1440865
tctttat

SEQ ID NO: 171056 - DNA, 7 bp, Unknown
  misc_feature (1)..( 7): Result.005 file - promoters50/1440865
cctttac

SEQ ID NO: 171057 - DNA, 7 bp, Unknown
  misc_feature (1)..( 7): Result.005 file - promoters50/1440873
ataaaaa

SEQ ID NO: 171058 - DNA, 7 bp, Unknown
  misc_feature (1)..( 7): Result.005 file - promoters50/1440873
ctaaaaa

SEQ ID NO: 171059 - DNA, 7 bp, Unknown
  misc_feature (1)..( 7): Result.005 file - promoters50/1440873
ataaaat

SEQ ID NO: 171060 - DNA, 7 bp, Unknown
  misc_feature (1)..( 7): Result.005 file - promoters50/1440873
gtaaaaa

SEQ ID NO: 171061 - DNA, 7 bp, Unknown
  misc_feature (1)..( 7): Result.005 file - promoters50/1440873
atagaaa

SEQ ID NO: 171062 - DNA, 7 bp, Unknown
  misc_feature (1)..( 7): Result.005 file - promoters50/1440873
ttaaaaa

SEQ ID NO: 171063 - DNA, 11 bp, Unknown
  misc_feature (1)..( 11): Result.005 file - promoters50/1440967
caatttgttta

SEQ ID NO: 171064 - DNA, 11 bp, Unknown
  misc_feature (1)..( 11): Result.005 file - promoters50/1440967
gactttttttt

SEQ ID NO: 171065 - DNA, 11 bp, Unknown
  misc_feature (1)..( 11): Result.005 file - promoters50/1440967
caagttgtaac

SEQ ID NO: 171066 - DNA, 11 bp, Unknown
  misc_feature (1)..( 11): Result.005 file - promoters50/1440967
tagtttttttt

SEQ ID NO: 171067 - DNA, 11 bp, Unknown
  misc_feature (1)..( 11): Result.005 file - promoters50/1440967
taatttgtctc

SEQ ID NO: 171068 - DNA, 11 bp, Unknown
  misc_feature (1)..( 11): Result.005 file - promoters50/1440967
taggttttaac

SEQ ID NO: 171069 - DNA, 13 bp, Unknown
  misc_feature (1)..( 13): Result.005 file - promoters50/1440967
atgacccaaaaga

SEQ ID NO: 171070 - DNA, 13 bp, Unknown
  misc_feature (1)..( 13): Result.005 file - promoters50/1440967
attataaaaaaga

SEQ ID NO: 171071 - DNA, 13 bp, Unknown
  misc_feature (1)..( 13): Result.005 file - promoters50/1440967
atatccaaaaaga

SEQ ID NO: 171072 - DNA, 13 bp, Unknown
  misc_feature (1)..( 13): Result.005 file - promoters50/1440967
attaaaaaaaagg

SEQ ID NO: 171073 - DNA, 13 bp, Unknown
  misc_feature (1)..( 13): Result.005 file - promoters50/1440967
tcaatcaataaga

SEQ ID NO: 171074 - DNA, 13 bp, Unknown
  misc_feature (1)..( 13): Result.005 file - promoters50/1440967
ttctcaaataaca

SEQ ID NO: 171075 - DNA, 13 bp, Unknown
  misc_feature (1)..( 13): Result.005 file - promoters50/1440967
aaatccaaataca

SEQ ID NO: 171076 - DNA, 13 bp, Unknown
  misc_feature (1)..( 13): Result.005 file - promoters50/1440967
atatcaaaagaca

SEQ ID NO: 171077 - DNA, 13 bp, Unknown
  misc_feature (1)..( 13): Result.005 file - promoters50/1440967
cacatcaaataaa

SEQ ID NO: 171078 - DNA, 13 bp, Unknown
  misc_feature (1)..( 13): Result.005 file - promoters50/1440967
tttttcaagtaat

SEQ ID NO: 171079 - DNA, 13 bp, Unknown
  misc_feature (1)..( 13): Result.005 file - promoters50/1440967
ttatgaaattaac

SEQ ID NO: 171080 - DNA, 13 bp, Unknown
  misc_feature (1)..( 13): Result.005 file - promoters50/1440967
gttttgatccacg

SEQ ID NO: 171081 - DNA, 13 bp, Unknown
  misc_feature (1)..( 13): Result.005 file - promoters50/1440967
tgattaagaaaaa

SEQ ID NO: 171082 - DNA, 13 bp, Unknown
  misc_feature (1)..( 13): Result.005 file - promoters50/1440967
gaataagatttta

SEQ ID NO: 171083 - DNA, 13 bp, Unknown
  misc_feature (1)..( 13): Result.005 file - promoters50/1440967
cgagaagattcta

SEQ ID NO: 171084 - DNA, 13 bp, Unknown
  misc_feature (1)..( 13): Result.005 file - promoters50/1440967
ttataaaattact

SEQ ID NO: 171085 - DNA, 13 bp, Unknown
  misc_feature (1)..( 13): Result.005 file - promoters50/1440967
gtgggagatatta

SEQ ID NO: 171086 - DNA, 13 bp, Unknown
  misc_feature (1)..( 13): Result.005 file - promoters50/1440967
ttataaatttgga

SEQ ID NO: 171087 - DNA, 13 bp, Unknown
  misc_feature (1)..( 13): Result.005 file - promoters50/1440967
ctatgaaagttta

SEQ ID NO: 171088 - DNA, 10 bp, Unknown
  misc_feature (1)..( 10): Result.005 file - promoters50/1441020
attttaaata

SEQ ID NO: 171089 - DNA, 10 bp, Unknown
  misc_feature (1)..( 10): Result.005 file - promoters50/1441020
cttttcaatt

SEQ ID NO: 171090 - DNA, 10 bp, Unknown
  misc_feature (1)..( 10): Result.005 file - promoters50/1441020
atttccaatt

SEQ ID NO: 171091 - DNA, 10 bp, Unknown
  misc_feature (1)..( 10): Result.005 file - promoters50/1441020
cttgtcacga

SEQ ID NO: 171092 - DNA, 11 bp, Unknown
  misc_feature (1)..( 11): Result.005 file - promoters50/1441020
aactttttaga

SEQ ID NO: 171093 - DNA, 11 bp, Unknown
  misc_feature (1)..( 11): Result.005 file - promoters50/1441020
aacgttttggg

SEQ ID NO: 171094 - DNA, 11 bp, Unknown
  misc_feature (1)..( 11): Result.005 file - promoters50/1441020
aacattttgaa

SEQ ID NO: 171095 - DNA, 11 bp, Unknown
  misc_feature (1)..( 11): Result.005 file - promoters50/1441020
tatattatgaa

SEQ ID NO: 171096 - DNA, 9 bp, Unknown
  misc_feature (1)..( 9): Result.005 file - promoters50/1441020
ttttagaaa

SEQ ID NO: 171097 - DNA, 9 bp, Unknown
  misc_feature (1)..( 9): Result.005 file - promoters50/1441020
attttgaag

SEQ ID NO: 171098 - DNA, 9 bp, Unknown
  misc_feature (1)..( 9): Result.005 file - promoters50/1441020
ctgttgaag

SEQ ID NO: 171099 - DNA, 9 bp, Unknown
  misc_feature (1)..( 9): Result.005 file - promoters50/1441020
attatgaaa

SEQ ID NO: 171100 - DNA, 9 bp, Unknown
  misc_feature (1)..( 9): Result.005 file - promoters50/1441044
aactaaacc

SEQ ID NO: 171101 - DNA, 9 bp, Unknown
  misc_feature (1)..( 9): Result.005 file - promoters50/1441044
aactaatca

SEQ ID NO: 171102 - DNA, 9 bp, Unknown
  misc_feature (1)..( 9): Result.005 file - promoters50/1441044
aactaaacc

SEQ ID NO: 171103 - DNA, 9 bp, Unknown
  misc_feature (1)..( 9): Result.005 file - promoters50/1441044
tactaaaga

SEQ ID NO: 171104 - DNA, 13 bp, Unknown
  misc_feature (1)..( 13): Result.005 file - promoters50/1441044
tcaaatttttttt

SEQ ID NO: 171105 - DNA, 13 bp, Unknown
  misc_feature (1)..( 13): Result.005 file - promoters50/1441044
acaaacttttttt

SEQ ID NO: 171106 - DNA, 13 bp, Unknown
  misc_feature (1)..( 13): Result.005 file - promoters50/1441044
accaatttttagt

SEQ ID NO: 171107 - DNA, 13 bp, Unknown
  misc_feature (1)..( 13): Result.005 file - promoters50/1441044
acaaacattaaga

SEQ ID NO: 171108 - DNA, 12 bp, Unknown
  misc_feature (1)..( 12): Result.005 file - promoters50/1441044
actcatatatat

SEQ ID NO: 171109 - DNA, 12 bp, Unknown
  misc_feature (1)..( 12): Result.005 file - promoters50/1441044
actcatatatat

SEQ ID NO: 171110 - DNA, 12 bp, Unknown
  misc_feature (1)..( 12): Result.005 file - promoters50/1441044
acgtatatataa

SEQ ID NO: 171111 - DNA, 12 bp, Unknown
  misc_feature (1)..( 12): Result.005 file - promoters50/1441044
aatcacatatta

SEQ ID NO: 171112 - DNA, 12 bp, Unknown
  misc_feature (1)..( 12): Result.005 file - promoters50/1441069
aaacataattat

SEQ ID NO: 171113 - DNA, 12 bp, Unknown
  misc_feature (1)..( 12): Result.005 file - promoters50/1441069
aaatataagtat

SEQ ID NO: 171114 - DNA, 12 bp, Unknown
  misc_feature (1)..( 12): Result.005 file - promoters50/1441069
aaatcaaattat

SEQ ID NO: 171115 - DNA, 10 bp, Unknown
  misc_feature (1)..( 10): Result.005 file - promoters50/1441069
taagaatttt

SEQ ID NO: 171116 - DNA, 10 bp, Unknown
  misc_feature (1)..( 10): Result.005 file - promoters50/1441069
aaagaatcaa

SEQ ID NO: 171117 - DNA, 10 bp, Unknown
  misc_feature (1)..( 10): Result.005 file - promoters50/1441069
aaagtatcaa

SEQ ID NO: 171118 - DNA, 8 bp, Unknown
  misc_feature (1)..( 8): Result.005 file - promoters50/1441134
attaacac

SEQ ID NO: 171119 - DNA, 8 bp, Unknown
  misc_feature (1)..( 8): Result.005 file - promoters50/1441134
attaacaa

SEQ ID NO: 171120 - DNA, 8 bp, Unknown
  misc_feature (1)..( 8): Result.005 file - promoters50/1441134
tttaacaa

SEQ ID NO: 171121 - DNA, 10 bp, Unknown
  misc_feature (1)..( 10): Result.005 file - promoters50/1441145
catatataat

SEQ ID NO: 171122 - DNA, 10 bp, Unknown
  misc_feature (1)..( 10): Result.005 file - promoters50/1441145
aatatattct

SEQ ID NO: 171123 - DNA, 10 bp, Unknown
  misc_feature (1)..( 10): Result.005 file - promoters50/1441145
cataaataat

SEQ ID NO: 171124 - DNA, 10 bp, Unknown
  misc_feature (1)..( 10): Result.005 file - promoters50/1441145
aaaaaattat

SEQ ID NO: 171125 - DNA, 7 bp, Unknown
  misc_feature (1)..( 7): Result.005 file - promoters50/1441145
aacaaat

SEQ ID NO: 171126 - DNA, 7 bp, Unknown
  misc_feature (1)..( 7): Result.005 file - promoters50/1441145
aacaaaa

SEQ ID NO: 171127 - DNA, 7 bp, Unknown
  misc_feature (1)..( 7): Result.005 file - promoters50/1441145
cacaaaa

SEQ ID NO: 171128 - DNA, 9 bp, Unknown
  misc_feature (1)..( 9): Result.005 file - promoters50/1441145
gaatttcaa

SEQ ID NO: 171129 - DNA, 9 bp, Unknown
  misc_feature (1)..( 9): Result.005 file - promoters50/1441145
gaattttag

SEQ ID NO: 171130 - DNA, 9 bp, Unknown
  misc_feature (1)..( 9): Result.005 file - promoters50/1441145
aaatgtcaa

SEQ ID NO: 171131 - DNA, 7 bp, Unknown
  misc_feature (1)..( 7): Result.005 file - promoters50/1441145
tttaata

SEQ ID NO: 171132 - DNA, 7 bp, Unknown
  misc_feature (1)..( 7): Result.005 file - promoters50/1441145
attaata

SEQ ID NO: 171133 - DNA, 7 bp, Unknown
  misc_feature (1)..( 7): Result.005 file - promoters50/1441145
attcata

SEQ ID NO: 171134 - DNA, 10 bp, Unknown
  misc_feature (1)..( 10): Result.005 file - promoters50/1441145
atatacaaat

SEQ ID NO: 171135 - DNA, 10 bp, Unknown
  misc_feature (1)..( 10): Result.005 file - promoters50/1441145
atatataaat

SEQ ID NO: 171136 - DNA, 10 bp, Unknown
  misc_feature (1)..( 10): Result.005 file - promoters50/1441145
tcatacaaaa

SEQ ID NO: 171137 - DNA, 10 bp, Unknown
  misc_feature (1)..( 10): Result.005 file - promoters50/1441145
gtggataaat

SEQ ID NO: 171138 - DNA, 7 bp, Unknown
  misc_feature (1)..( 7): Result.005 file - promoters50/1441145
attttaa

SEQ ID NO: 171139 - DNA, 7 bp, Unknown
  misc_feature (1)..( 7): Result.005 file - promoters50/1441145
attttaa

SEQ ID NO: 171140 - DNA, 7 bp, Unknown
  misc_feature (1)..( 7): Result.005 file - promoters50/1441145
attttag

SEQ ID NO: 171141 - DNA, 10 bp, Unknown
  misc_feature (1)..( 10): Result.005 file - promoters50/1441145
aaatacatat

SEQ ID NO: 171142 - DNA, 10 bp, Unknown
  misc_feature (1)..( 10): Result.005 file - promoters50/1441145
aaattcatat

SEQ ID NO: 171143 - DNA, 10 bp, Unknown
  misc_feature (1)..( 10): Result.005 file - promoters50/1441145
atattaataa

SEQ ID NO: 171144 - DNA, 9 bp, Unknown
  misc_feature (1)..( 9): Result.005 file - promoters50/1441145
ttaaaaaag

SEQ ID NO: 171145 - DNA, 9 bp, Unknown
  misc_feature (1)..( 9): Result.005 file - promoters50/1441145
ttaataaac

SEQ ID NO: 171146 - DNA, 9 bp, Unknown
  misc_feature (1)..( 9): Result.005 file - promoters50/1441145
tgtataaac

SEQ ID NO: 171147 - DNA, 11 bp, Unknown
  misc_feature (1)..( 11): Result.005 file - promoters50/1441170
aaaatcaaata

SEQ ID NO: 171148 - DNA, 11 bp, Unknown
  misc_feature (1)..( 11): Result.005 file - promoters50/1441170
aaagtcacgaa

SEQ ID NO: 171149 - DNA, 11 bp, Unknown
  misc_feature (1)..( 11): Result.005 file - promoters50/1441170
gaaaccaaaag

SEQ ID NO: 171150 - DNA, 11 bp, Unknown
  misc_feature (1)..( 11): Result.005 file - promoters50/1441170
acaatcaaaaa

SEQ ID NO: 171151 - DNA, 11 bp, Unknown
  misc_feature (1)..( 11): Result.005 file - promoters50/1441170
aaaattaaaag

SEQ ID NO: 171152 - DNA, 11 bp, Unknown
  misc_feature (1)..( 11): Result.005 file - promoters50/1441170
atagccacaag

SEQ ID NO: 171153 - DNA, 11 bp, Unknown
  misc_feature (1)..( 11): Result.005 file - promoters50/1441170
gccaccaagtg

SEQ ID NO: 171154 - DNA, 11 bp, Unknown
  misc_feature (1)..( 11): Result.005 file - promoters50/1441170
aacaccaaaga

SEQ ID NO: 171155 - DNA, 11 bp, Unknown
  misc_feature (1)..( 11): Result.005 file - promoters50/1441170
caaaccaaaaa

SEQ ID NO: 171156 - DNA, 11 bp, Unknown
  misc_feature (1)..( 11): Result.005 file - promoters50/1441170
aaaaacaaaaa

SEQ ID NO: 171157 - DNA, 11 bp, Unknown
  misc_feature (1)..( 11): Result.005 file - promoters50/1441170
agtaccaaaca

SEQ ID NO: 171158 - DNA, 11 bp, Unknown
  misc_feature (1)..( 11): Result.005 file - promoters50/1441170
aaaaataaaac

SEQ ID NO: 171159 - DNA, 9 bp, Unknown
  misc_feature (1)..( 9): Result.005 file - promoters50/1441174
agtttattt

SEQ ID NO: 171160 - DNA, 9 bp, Unknown
  misc_feature (1)..( 9): Result.005 file - promoters50/1441174
agttttttt

SEQ ID NO: 171161 - DNA, 9 bp, Unknown
  misc_feature (1)..( 9): Result.005 file - promoters50/1441174
agtgttttt

SEQ ID NO: 171162 - DNA, 9 bp, Unknown
  misc_feature (1)..( 9): Result.005 file - promoters50/1441174
agacaaact

SEQ ID NO: 171163 - DNA, 9 bp, Unknown
  misc_feature (1)..( 9): Result.005 file - promoters50/1441174
agataaaga

SEQ ID NO: 171164 - DNA, 9 bp, Unknown
  misc_feature (1)..( 9): Result.005 file - promoters50/1441174
ggataaaga

SEQ ID NO: 171165 - DNA, 9 bp, Unknown
  misc_feature (1)..( 9): Result.005 file - promoters50/1441184
atgtataaa

SEQ ID NO: 171166 - DNA, 9 bp, Unknown
  misc_feature (1)..( 9): Result.005 file - promoters50/1441184
cactataaa

SEQ ID NO: 171167 - DNA, 9 bp, Unknown
  misc_feature (1)..( 9): Result.005 file - promoters50/1441184
tcttataaa

SEQ ID NO: 171168 - DNA, 9 bp, Unknown
  misc_feature (1)..( 9): Result.005 file - promoters50/1441184
aactataaa

SEQ ID NO: 171169 - DNA, 9 bp, Unknown
  misc_feature (1)..( 9): Result.005 file - promoters50/1441184
gtatataaa

SEQ ID NO: 171170 - DNA, 9 bp, Unknown
  misc_feature (1)..( 9): Result.005 file - promoters50/1441184
ttatataaa

SEQ ID NO: 171171 - DNA, 9 bp, Unknown
  misc_feature (1)..( 9): Result.005 file - promoters50/1441184
tactttaac

SEQ ID NO: 171172 - DNA, 9 bp, Unknown
  misc_feature (1)..( 9): Result.005 file - promoters50/1441184
acaaattta

SEQ ID NO: 171173 - DNA, 9 bp, Unknown
  misc_feature (1)..( 9): Result.005 file - promoters50/1441184
tcaattttt

SEQ ID NO: 171174 - DNA, 9 bp, Unknown
  misc_feature (1)..( 9): Result.005 file - promoters50/1441184
acatattgg

SEQ ID NO: 171175 - DNA, 9 bp, Unknown
  misc_feature (1)..( 9): Result.005 file - promoters50/1441184
acattttgt

SEQ ID NO: 171176 - DNA, 9 bp, Unknown
  misc_feature (1)..( 9): Result.005 file - promoters50/1441184
taattttgc

SEQ ID NO: 171177 - DNA, 9 bp, Unknown
  misc_feature (1)..( 9): Result.005 file - promoters50/1441184
tcatcttgt

SEQ ID NO: 171178 - DNA, 9 bp, Unknown
  misc_feature (1)..( 9): Result.005 file - promoters50/1441237
aagagatta

SEQ ID NO: 171179 - DNA, 9 bp, Unknown
  misc_feature (1)..( 9): Result.005 file - promoters50/1441237
gagaaattc

SEQ ID NO: 171180 - DNA, 9 bp, Unknown
  misc_feature (1)..( 9): Result.005 file - promoters50/1441237
aacaaattc

SEQ ID NO: 171181 - DNA, 9 bp, Unknown
  misc_feature (1)..( 9): Result.005 file - promoters50/1441237
aagaaatcc

SEQ ID NO: 171182 - DNA, 9 bp, Unknown
  misc_feature (1)..( 9): Result.005 file - promoters50/1441237
tacaaattc

SEQ ID NO: 171183 - DNA, 9 bp, Unknown
  misc_feature (1)..( 9): Result.005 file - promoters50/1441237
aaggaatga

SEQ ID NO: 171184 - DNA, 14 bp, Unknown
  misc_feature (1)..( 14): Result.005 file - promoters50/1441237
actatttttagggt

SEQ ID NO: 171185 - DNA, 14 bp, Unknown
  misc_feature (1)..( 14): Result.005 file - promoters50/1441237
gttatttttgaaga

SEQ ID NO: 171186 - DNA, 14 bp, Unknown
  misc_feature (1)..( 14): Result.005 file - promoters50/1441237
aatattttaattca

SEQ ID NO: 171187 - DNA, 14 bp, Unknown
  misc_feature (1)..( 14): Result.005 file - promoters50/1441237
tttagtttgaatcg

SEQ ID NO: 171188 - DNA, 14 bp, Unknown
  misc_feature (1)..( 14): Result.005 file - promoters50/1441237
gttttttttttttt

SEQ ID NO: 171189 - DNA, 14 bp, Unknown
  misc_feature (1)..( 14): Result.005 file - promoters50/1441237
attattttacttaa

SEQ ID NO: 171190 - DNA, 14 bp, Unknown
  misc_feature (1)..( 14): Result.005 file - promoters50/1441237
ttcattttaaatca

SEQ ID NO: 171191 - DNA, 10 bp, Unknown
  misc_feature (1)..( 10): Result.005 file - promoters50/1441237
tatatataca

SEQ ID NO: 171192 - DNA, 10 bp, Unknown
  misc_feature (1)..( 10): Result.005 file - promoters50/1441237
cttatataaa

SEQ ID NO: 171193 - DNA, 10 bp, Unknown
  misc_feature (1)..( 10): Result.005 file - promoters50/1441237
agtatataaa

SEQ ID NO: 171194 - DNA, 10 bp, Unknown
  misc_feature (1)..( 10): Result.005 file - promoters50/1441237
gataaatatc

SEQ ID NO: 171195 - DNA, 10 bp, Unknown
  misc_feature (1)..( 10): Result.005 file - promoters50/1441237
tataaataaa

SEQ ID NO: 171196 - DNA, 10 bp, Unknown
  misc_feature (1)..( 10): Result.005 file - promoters50/1441237
tataaatatc

SEQ ID NO: 171197 - DNA, 10 bp, Unknown
  misc_feature (1)..( 10): Result.005 file - promoters50/1441237
tataaaatca

SEQ ID NO: 171198 - DNA, 10 bp, Unknown
  misc_feature (1)..( 10): Result.005 file - promoters50/1441237
cataaaagca

SEQ ID NO: 171199 - DNA, 10 bp, Unknown
  misc_feature (1)..( 10): Result.005 file - promoters50/1441237
ttcttcattt

SEQ ID NO: 171200 - DNA, 10 bp, Unknown
  misc_feature (1)..( 10): Result.005 file - promoters50/1441237
cgcttcataa

SEQ ID NO: 171201 - DNA, 10 bp, Unknown
  misc_feature (1)..( 10): Result.005 file - promoters50/1441237
atctttataa

SEQ ID NO: 171202 - DNA, 10 bp, Unknown
  misc_feature (1)..( 10): Result.005 file - promoters50/1441237
atctttatac

SEQ ID NO: 171203 - DNA, 10 bp, Unknown
  misc_feature (1)..( 10): Result.005 file - promoters50/1441237
caatttttaa

SEQ ID NO: 171204 - DNA, 10 bp, Unknown
  misc_feature (1)..( 10): Result.005 file - promoters50/1441237
aaatttgtaa

SEQ ID NO: 171205 - DNA, 10 bp, Unknown
  misc_feature (1)..( 10): Result.005 file - promoters50/1441237
tataaacaaa

SEQ ID NO: 171206 - DNA, 10 bp, Unknown
  misc_feature (1)..( 10): Result.005 file - promoters50/1441237
tataaaatca

SEQ ID NO: 171207 - DNA, 10 bp, Unknown
  misc_feature (1)..( 10): Result.005 file - promoters50/1441237
tataaataaa

SEQ ID NO: 171208 - DNA, 10 bp, Unknown
  misc_feature (1)..( 10): Result.005 file - promoters50/1441237
tataaatatc

SEQ ID NO: 171209 - DNA, 10 bp, Unknown
  misc_feature (1)..( 10): Result.005 file - promoters50/1441237
tataaactct

SEQ ID NO: 171210 - DNA, 10 bp, Unknown
  misc_feature (1)..( 10): Result.005 file - promoters50/1441237
gataaatatc

SEQ ID NO: 171211 - DNA, 10 bp, Unknown
  misc_feature (1)..( 10): Result.005 file - promoters50/1441237
cataaaagca

SEQ ID NO: 171212 - DNA, 15 bp, Unknown
  misc_feature (1)..( 15): Result.005 file - promoters50/1441237
aaacttataattatg

SEQ ID NO: 171213 - DNA, 15 bp, Unknown
  misc_feature (1)..( 15): Result.005 file - promoters50/1441237
caaataataataatg

SEQ ID NO: 171214 - DNA, 15 bp, Unknown
  misc_feature (1)..( 15): Result.005 file - promoters50/1441237
atctttataagtata

SEQ ID NO: 171215 - DNA, 15 bp, Unknown
  misc_feature (1)..( 15): Result.005 file - promoters50/1441237
cgcttcataacaaaa

SEQ ID NO: 171216 - DNA, 15 bp, Unknown
  misc_feature (1)..( 15): Result.005 file - promoters50/1441237
atctttatacaaaac

SEQ ID NO: 171217 - DNA, 15 bp, Unknown
  misc_feature (1)..( 15): Result.005 file - promoters50/1441237
aaatttgtaacttca

SEQ ID NO: 171218 - DNA, 18 bp, Unknown
  misc_feature (1)..( 18): Result.005 file - promoters50/1441249
aatgattcaaaattatca

SEQ ID NO: 171219 - DNA, 18 bp, Unknown
  misc_feature (1)..( 18): Result.005 file - promoters50/1441249
gattttcccaaattacat

SEQ ID NO: 171220 - DNA, 18 bp, Unknown
  misc_feature (1)..( 18): Result.005 file - promoters50/1441249
acaatgtacaaaatataa

SEQ ID NO: 171221 - DNA, 18 bp, Unknown
  misc_feature (1)..( 18): Result.005 file - promoters50/1441249
aatgtttctaaattctaa

SEQ ID NO: 171222 - DNA, 18 bp, Unknown
  misc_feature (1)..( 18): Result.005 file - promoters50/1441249
tctcacactatattttaa

SEQ ID NO: 171223 - DNA, 18 bp, Unknown
  misc_feature (1)..( 18): Result.005 file - promoters50/1441249
aatgattcaaaattatca

SEQ ID NO: 171224 - DNA, 18 bp, Unknown
  misc_feature (1)..( 18): Result.005 file - promoters50/1441249
caatgtacaaaatataat

SEQ ID NO: 171225 - DNA, 18 bp, Unknown
  misc_feature (1)..( 18): Result.005 file - promoters50/1441249
aatgtttctaaattctaa

SEQ ID NO: 171226 - DNA, 18 bp, Unknown
  misc_feature (1)..( 18): Result.005 file - promoters50/1441249
tctcacactatattttaa

SEQ ID NO: 171227 - DNA, 11 bp, Unknown
  misc_feature (1)..( 11): Result.005 file - promoters50/1441249
tagctaaaatt

SEQ ID NO: 171228 - DNA, 11 bp, Unknown
  misc_feature (1)..( 11): Result.005 file - promoters50/1441249
attctacaata

SEQ ID NO: 171229 - DNA, 11 bp, Unknown
  misc_feature (1)..( 11): Result.005 file - promoters50/1441249
attatacatat

SEQ ID NO: 171230 - DNA, 12 bp, Unknown
  misc_feature (1)..( 12): Result.005 file - promoters50/1441249
ctgataaatatg

SEQ ID NO: 171231 - DNA, 12 bp, Unknown
  misc_feature (1)..( 12): Result.005 file - promoters50/1441249
tttatacataac

SEQ ID NO: 171232 - DNA, 12 bp, Unknown
  misc_feature (1)..( 12): Result.005 file - promoters50/1441249
attatacatatg

SEQ ID NO: 171233 - DNA, 12 bp, Unknown
  misc_feature (1)..( 12): Result.005 file - promoters50/1441249
tttatacataac

SEQ ID NO: 171234 - DNA, 12 bp, Unknown
  misc_feature (1)..( 12): Result.005 file - promoters50/1441249
attctacaataa

SEQ ID NO: 171235 - DNA, 12 bp, Unknown
  misc_feature (1)..( 12): Result.005 file - promoters50/1441249
ctgataaatatg

SEQ ID NO: 171236 - DNA, 10 bp, Unknown
  misc_feature (1)..( 10): Result.005 file - promoters50/1441249
tgatatgaaa

SEQ ID NO: 171237 - DNA, 10 bp, Unknown
  misc_feature (1)..( 10): Result.005 file - promoters50/1441249
ttatattaaa

SEQ ID NO: 171238 - DNA, 10 bp, Unknown
  misc_feature (1)..( 10): Result.005 file - promoters50/1441249
ttatacataa

SEQ ID NO: 171239 - DNA, 10 bp, Unknown
  misc_feature (1)..( 10): Result.005 file - promoters50/1441249
caataataac

SEQ ID NO: 171240 - DNA, 9 bp, Unknown
  misc_feature (1)..( 9): Result.005 file - promoters50/1441326
aaagtcttg

SEQ ID NO: 171241 - DNA, 9 bp, Unknown
  misc_feature (1)..( 9): Result.005 file - promoters50/1441326
aaagtcacc

SEQ ID NO: 171242 - DNA, 9 bp, Unknown
  misc_feature (1)..( 9): Result.005 file - promoters50/1441326
aaagttttg

SEQ ID NO: 171243 - DNA, 9 bp, Unknown
  misc_feature (1)..( 9): Result.005 file - promoters50/1441326
aaaaaatta

SEQ ID NO: 171244 - DNA, 9 bp, Unknown
  misc_feature (1)..( 9): Result.005 file - promoters50/1441326
aaataatct

SEQ ID NO: 171245 - DNA, 9 bp, Unknown
  misc_feature (1)..( 9): Result.005 file - promoters50/1441326
caaacatta

SEQ ID NO: 171246 - DNA, 7 bp, Unknown
  misc_feature (1)..( 7): Result.005 file - promoters50/1441326
gaaaaaa

SEQ ID NO: 171247 - DNA, 7 bp, Unknown
  misc_feature (1)..( 7): Result.005 file - promoters50/1441326
caaaaaa

SEQ ID NO: 171248 - DNA, 7 bp, Unknown
  misc_feature (1)..( 7): Result.005 file - promoters50/1441326
caataaa

SEQ ID NO: 171249 - DNA, 13 bp, Unknown
  misc_feature (1)..( 13): Result.005 file - promoters50/1441395
aaagaatcaaatc

SEQ ID NO: 171250 - DNA, 13 bp, Unknown
  misc_feature (1)..( 13): Result.005 file - promoters50/1441395
acagaataaaaac

SEQ ID NO: 171251 - DNA, 13 bp, Unknown
  misc_feature (1)..( 13): Result.005 file - promoters50/1441395
aaaaaatcaaaaa

SEQ ID NO: 171252 - DNA, 13 bp, Unknown
  misc_feature (1)..( 13): Result.005 file - promoters50/1441395
attcaatcaaatc

SEQ ID NO: 171253 - DNA, 13 bp, Unknown
  misc_feature (1)..( 13): Result.005 file - promoters50/1441395
taagaaaaaaaaa

SEQ ID NO: 171254 - DNA, 13 bp, Unknown
  misc_feature (1)..( 13): Result.005 file - promoters50/1441395
ataaaaccaagac

SEQ ID NO: 171255 - DNA, 10 bp, Unknown
  misc_feature (1)..( 10): Result.005 file - promoters50/1441460
ttatgatttc

SEQ ID NO: 171256 - DNA, 10 bp, Unknown
  misc_feature (1)..( 10): Result.005 file - promoters50/1441460
aaatgttttg

SEQ ID NO: 171257 - DNA, 10 bp, Unknown
  misc_feature (1)..( 10): Result.005 file - promoters50/1441460
ttatgctttt

SEQ ID NO: 171258 - DNA, 10 bp, Unknown
  misc_feature (1)..( 10): Result.005 file - promoters50/1441460
caattttttg

SEQ ID NO: 171259 - DNA, 10 bp, Unknown
  misc_feature (1)..( 10): Result.005 file - promoters50/1441460
taattttaat

SEQ ID NO: 171260 - DNA, 10 bp, Unknown
  misc_feature (1)..( 10): Result.005 file - promoters50/1441460
aaattttaca

SEQ ID NO: 171261 - DNA, 11 bp, Unknown
  misc_feature (1)..( 11): Result.005 file - promoters50/1441465
taaaattaacc

SEQ ID NO: 171262 - DNA, 11 bp, Unknown
  misc_feature (1)..( 11): Result.005 file - promoters50/1441465
taatattattc

SEQ ID NO: 171263 - DNA, 11 bp, Unknown
  misc_feature (1)..( 11): Result.005 file - promoters50/1441465
tattatttgat

SEQ ID NO: 171264 - DNA, 12 bp, Unknown
  misc_feature (1)..( 12): Result.005 file - promoters50/1441465
taatcatactta

SEQ ID NO: 171265 - DNA, 12 bp, Unknown
  misc_feature (1)..( 12): Result.005 file - promoters50/1441465
ccataattgttt

SEQ ID NO: 171266 - DNA, 12 bp, Unknown
  misc_feature (1)..( 12): Result.005 file - promoters50/1441465
tctttattatac

SEQ ID NO: 171267 - DNA, 13 bp, Unknown
  misc_feature (1)..( 13): Result.005 file - promoters50/1441533
aaatttcaaattt

SEQ ID NO: 171268 - DNA, 13 bp, Unknown
  misc_feature (1)..( 13): Result.005 file - promoters50/1441533
aaatttcaaagac

SEQ ID NO: 171269 - DNA, 13 bp, Unknown
  misc_feature (1)..( 13): Result.005 file - promoters50/1441533
cattttcaatttt

SEQ ID NO: 171270 - DNA, 13 bp, Unknown
  misc_feature (1)..( 13): Result.005 file - promoters50/1441533
taattttagcaag

SEQ ID NO: 171271 - DNA, 14 bp, Unknown
  misc_feature (1)..( 14): Result.005 file - promoters50/1441533
aactttgcaatgag

SEQ ID NO: 171272 - DNA, 14 bp, Unknown
  misc_feature (1)..( 14): Result.005 file - promoters50/1441533
ttggattcagagaa

SEQ ID NO: 171273 - DNA, 7 bp, Unknown
  misc_feature (1)..( 7): Result.005 file - promoters50/1441539
tgatttg

SEQ ID NO: 171274 - DNA, 7 bp, Unknown
  misc_feature (1)..( 7): Result.005 file - promoters50/1441539
tgaattg

SEQ ID NO: 171275 - DNA, 7 bp, Unknown
  misc_feature (1)..( 7): Result.005 file - promoters50/1441539
ggaattg

SEQ ID NO: 171276 - DNA, 10 bp, Unknown
  misc_feature (1)..( 10): Result.005 file - promoters50/1441539
aattttcttt

SEQ ID NO: 171277 - DNA, 10 bp, Unknown
  misc_feature (1)..( 10): Result.005 file - promoters50/1441539
ggttttgttt

SEQ ID NO: 171278 - DNA, 10 bp, Unknown
  misc_feature (1)..( 10): Result.005 file - promoters50/1441539
ggtgttggtg

SEQ ID NO: 171279 - DNA, 11 bp, Unknown
  misc_feature (1)..( 11): Result.005 file - promoters50/1441548
taaacatatta

SEQ ID NO: 171280 - DNA, 11 bp, Unknown
  misc_feature (1)..( 11): Result.005 file - promoters50/1441548
taaaaatatcc

SEQ ID NO: 171281 - DNA, 11 bp, Unknown
  misc_feature (1)..( 11): Result.005 file - promoters50/1441548
agaacaaattt

SEQ ID NO: 171282 - DNA, 11 bp, Unknown
  misc_feature (1)..( 11): Result.005 file - promoters50/1441548
acaagaaattt

SEQ ID NO: 171283 - DNA, 11 bp, Unknown
  misc_feature (1)..( 11): Result.005 file - promoters50/1441548
gaagcaaattg

SEQ ID NO: 171284 - DNA, 16 bp, Unknown
  misc_feature (1)..( 16): Result.005 file - promoters50/1441548
atttttaaaaatacaa

SEQ ID NO: 171285 - DNA, 16 bp, Unknown
  misc_feature (1)..( 16): Result.005 file - promoters50/1441548
tatataacaaaaacaa

SEQ ID NO: 171286 - DNA, 16 bp, Unknown
  misc_feature (1)..( 16): Result.005 file - promoters50/1441548
ccttataataatacag

SEQ ID NO: 171287 - DNA, 16 bp, Unknown
  misc_feature (1)..( 16): Result.005 file - promoters50/1441548
aaaaataaaaataaaa

SEQ ID NO: 171288 - DNA, 16 bp, Unknown
  misc_feature (1)..( 16): Result.005 file - promoters50/1441548
tccaatccaaatacgc

SEQ ID NO: 171289 - DNA, 9 bp, Unknown
  misc_feature (1)..( 9): Result.005 file - promoters50/1441548
aaacattgt

SEQ ID NO: 171290 - DNA, 9 bp, Unknown
  misc_feature (1)..( 9): Result.005 file - promoters50/1441548
caacattat

SEQ ID NO: 171291 - DNA, 9 bp, Unknown
  misc_feature (1)..( 9): Result.005 file - promoters50/1441548
aaaaattta

SEQ ID NO: 171292 - DNA, 9 bp, Unknown
  misc_feature (1)..( 9): Result.005 file - promoters50/1441548
aaaaataat

SEQ ID NO: 171293 - DNA, 9 bp, Unknown
  misc_feature (1)..( 9): Result.005 file - promoters50/1441548
caaaattaa

SEQ ID NO: 171294 - DNA, 9 bp, Unknown
  misc_feature (1)..( 9): Result.005 file - promoters50/1441548
caagattca

SEQ ID NO: 171295 - DNA, 16 bp, Unknown
  misc_feature (1)..( 16): Result.005 file - promoters50/1441548
caaattaaatcagagg

SEQ ID NO: 171296 - DNA, 16 bp, Unknown
  misc_feature (1)..( 16): Result.005 file - promoters50/1441548
aaaaataaatcaacgt

SEQ ID NO: 171297 - DNA, 16 bp, Unknown
  misc_feature (1)..( 16): Result.005 file - promoters50/1441548
aaaaataaaaataaaa

SEQ ID NO: 171298 - DNA, 16 bp, Unknown
  misc_feature (1)..( 16): Result.005 file - promoters50/1441548
aaacataatcaattga

SEQ ID NO: 171299 - DNA, 16 bp, Unknown
  misc_feature (1)..( 16): Result.005 file - promoters50/1441548
aaaaataaagaaacct

SEQ ID NO: 171300 - DNA, 8 bp, Unknown
  misc_feature (1)..( 8): Result.005 file - promoters50/1441569
aattttgt

SEQ ID NO: 171301 - DNA, 8 bp, Unknown
  misc_feature (1)..( 8): Result.005 file - promoters50/1441569
aattttgt

SEQ ID NO: 171302 - DNA, 8 bp, Unknown
  misc_feature (1)..( 8): Result.005 file - promoters50/1441569
cattttgt

SEQ ID NO: 171303 - DNA, 11 bp, Unknown
  misc_feature (1)..( 11): Result.005 file - promoters50/1441569
gtatttttttt

SEQ ID NO: 171304 - DNA, 11 bp, Unknown
  misc_feature (1)..( 11): Result.005 file - promoters50/1441569
cagtttttttt

SEQ ID NO: 171305 - DNA, 11 bp, Unknown
  misc_feature (1)..( 11): Result.005 file - promoters50/1441569
tcattattttt

SEQ ID NO: 171306 - DNA, 12 bp, Unknown
  misc_feature (1)..( 12): Result.005 file - promoters50/1441569
gtatttcttttt

SEQ ID NO: 171307 - DNA, 8 bp, Unknown
  misc_feature (1)..( 8): Result.005 file - promoters50/1441569
tataaata

SEQ ID NO: 171308 - DNA, 8 bp, Unknown
  misc_feature (1)..( 8): Result.005 file - promoters50/1441569
tatatata

SEQ ID NO: 171309 - DNA, 8 bp, Unknown
  misc_feature (1)..( 8): Result.005 file - promoters50/1441569
tataaaaa

SEQ ID NO: 171310 - DNA, 8 bp, Unknown
  misc_feature (1)..( 8): Result.005 file - promoters50/1441569
gatatatc

SEQ ID NO: 171311 - DNA, 8 bp, Unknown
  misc_feature (1)..( 8): Result.005 file - promoters50/1441569
aatatatt

SEQ ID NO: 171312 - DNA, 8 bp, Unknown
  misc_feature (1)..( 8): Result.005 file - promoters50/1441569
aataaatt

SEQ ID NO: 171313 - DNA, 10 bp, Unknown
  misc_feature (1)..( 10): Result.005 file - promoters50/1441569
caataattta

SEQ ID NO: 171314 - DNA, 10 bp, Unknown
  misc_feature (1)..( 10): Result.005 file - promoters50/1441569
aaatacttta

SEQ ID NO: 171315 - DNA, 10 bp, Unknown
  misc_feature (1)..( 10): Result.005 file - promoters50/1441569
aaatacaatt

SEQ ID NO: 171316 - DNA, 12 bp, Unknown
  misc_feature (1)..( 12): Result.005 file - promoters50/1441569
aatcacaaaaac

SEQ ID NO: 171317 - DNA, 12 bp, Unknown
  misc_feature (1)..( 12): Result.005 file - promoters50/1441569
aattacaaaaaa

SEQ ID NO: 171318 - DNA, 12 bp, Unknown
  misc_feature (1)..( 12): Result.005 file - promoters50/1441569
aagagaaaaaac

SEQ ID NO: 171319 - DNA, 7 bp, Unknown
  misc_feature (1)..( 7): Result.005 file - promoters50/1441569
tttctta

SEQ ID NO: 171320 - DNA, 7 bp, Unknown
  misc_feature (1)..( 7): Result.005 file - promoters50/1441569
tttctta

SEQ ID NO: 171321 - DNA, 7 bp, Unknown
  misc_feature (1)..( 7): Result.005 file - promoters50/1441569
tttcttt

SEQ ID NO: 171322 - DNA, 9 bp, Unknown
  misc_feature (1)..( 9): Result.005 file - promoters50/1441569
cttgtacaa

SEQ ID NO: 171323 - DNA, 9 bp, Unknown
  misc_feature (1)..( 9): Result.005 file - promoters50/1441569
cttgttcaa

SEQ ID NO: 171324 - DNA, 9 bp, Unknown
  misc_feature (1)..( 9): Result.005 file - promoters50/1441569
tttgtactt

SEQ ID NO: 171325 - DNA, 9 bp, Unknown
  misc_feature (1)..( 9): Result.005 file - promoters50/1441614
ccattttac

SEQ ID NO: 171326 - DNA, 9 bp, Unknown
  misc_feature (1)..( 9): Result.005 file - promoters50/1441614
agattttac

SEQ ID NO: 171327 - DNA, 9 bp, Unknown
  misc_feature (1)..( 9): Result.005 file - promoters50/1441614
ccattttcg

SEQ ID NO: 171328 - DNA, 9 bp, Unknown
  misc_feature (1)..( 9): Result.005 file - promoters50/1441614
ccatttagt

SEQ ID NO: 171329 - DNA, 7 bp, Unknown
  misc_feature (1)..( 7): Result.005 file - promoters50/1441614
tgtgttt

SEQ ID NO: 171330 - DNA, 7 bp, Unknown
  misc_feature (1)..( 7): Result.005 file - promoters50/1441614
tgtgttg

SEQ ID NO: 171331 - DNA, 7 bp, Unknown
  misc_feature (1)..( 7): Result.005 file - promoters50/1441614
tgtgttt

SEQ ID NO: 171332 - DNA, 8 bp, Unknown
  misc_feature (1)..( 8): Result.005 file - promoters50/1441614
tgtttttt

SEQ ID NO: 171333 - DNA, 8 bp, Unknown
  misc_feature (1)..( 8): Result.005 file - promoters50/1441614
tatttttt

SEQ ID NO: 171334 - DNA, 8 bp, Unknown
  misc_feature (1)..( 8): Result.005 file - promoters50/1441614
tgtgtttc

SEQ ID NO: 171335 - DNA, 13 bp, Unknown
  misc_feature (1)..( 13): Result.005 file - promoters50/1441614
ctatctccatttt

SEQ ID NO: 171336 - DNA, 13 bp, Unknown
  misc_feature (1)..( 13): Result.005 file - promoters50/1441614
ctatgtccattta

SEQ ID NO: 171337 - DNA, 13 bp, Unknown
  misc_feature (1)..( 13): Result.005 file - promoters50/1441614
tgcaaaccatttt

SEQ ID NO: 171338 - DNA, 7 bp, Unknown
  misc_feature (1)..( 7): Result.005 file - promoters50/1441614
tttttag

SEQ ID NO: 171339 - DNA, 7 bp, Unknown
  misc_feature (1)..( 7): Result.005 file - promoters50/1441614
tttttat

SEQ ID NO: 171340 - DNA, 7 bp, Unknown
  misc_feature (1)..( 7): Result.005 file - promoters50/1441614
cttttat

SEQ ID NO: 171341 - DNA, 13 bp, Unknown
  misc_feature (1)..( 13): Result.005 file - promoters50/1441651
tgttataaatttc

SEQ ID NO: 171342 - DNA, 13 bp, Unknown
  misc_feature (1)..( 13): Result.005 file - promoters50/1441651
tgtgataaataag

SEQ ID NO: 171343 - DNA, 13 bp, Unknown
  misc_feature (1)..( 13): Result.005 file - promoters50/1441651
tcgcgtaagtttt

SEQ ID NO: 171344 - DNA, 13 bp, Unknown
  misc_feature (1)..( 13): Result.005 file - promoters50/1441651
ccatgtaattttc

SEQ ID NO: 171345 - DNA, 9 bp, Unknown
  misc_feature (1)..( 9): Result.005 file - promoters50/1441651
tgtttattt

SEQ ID NO: 171346 - DNA, 9 bp, Unknown
  misc_feature (1)..( 9): Result.005 file - promoters50/1441651
tgtttattt

SEQ ID NO: 171347 - DNA, 10 bp, Unknown
  misc_feature (1)..( 10): Result.005 file - promoters50/1441651
tttttacttt

SEQ ID NO: 171348 - DNA, 7 bp, Unknown
  misc_feature (1)..( 7): Result.005 file - promoters50/1441651
tgataaa

SEQ ID NO: 171349 - DNA, 7 bp, Unknown
  misc_feature (1)..( 7): Result.005 file - promoters50/1441651
tgaaaaa

SEQ ID NO: 171350 - DNA, 7 bp, Unknown
  misc_feature (1)..( 7): Result.005 file - promoters50/1441651
tgaaaac

SEQ ID NO: 171351 - DNA, 12 bp, Unknown
  misc_feature (1)..( 12): Result.005 file - promoters50/1441657
ataatttgcaag

SEQ ID NO: 171352 - DNA, 12 bp, Unknown
  misc_feature (1)..( 12): Result.005 file - promoters50/1441657
ataatttcgagg

SEQ ID NO: 171353 - DNA, 12 bp, Unknown
  misc_feature (1)..( 12): Result.005 file - promoters50/1441657
ttaatttgatag

SEQ ID NO: 171354 - DNA, 12 bp, Unknown
  misc_feature (1)..( 12): Result.005 file - promoters50/1441657
cccatttgattt

SEQ ID NO: 171355 - DNA, 12 bp, Unknown
  misc_feature (1)..( 12): Result.005 file - promoters50/1441657
tcgctttgataa

SEQ ID NO: 171356 - DNA, 12 bp, Unknown
  misc_feature (1)..( 12): Result.005 file - promoters50/1441657
agacttggatat

SEQ ID NO: 171357 - DNA, 9 bp, Unknown
  misc_feature (1)..( 9): Result.005 file - promoters50/1441722
tgcgtcagt

SEQ ID NO: 171358 - DNA, 9 bp, Unknown
  misc_feature (1)..( 9): Result.005 file - promoters50/1441722
tgcctcagg

SEQ ID NO: 171359 - DNA, 9 bp, Unknown
  misc_feature (1)..( 9): Result.005 file - promoters50/1441722
tctgtcagt

SEQ ID NO: 171360 - DNA, 7 bp, Unknown
  misc_feature (1)..( 7): Result.005 file - promoters50/1441722
caattta

SEQ ID NO: 171361 - DNA, 7 bp, Unknown
  misc_feature (1)..( 7): Result.005 file - promoters50/1441722
caatttc

SEQ ID NO: 171362 - DNA, 7 bp, Unknown
  misc_feature (1)..( 7): Result.005 file - promoters50/1441722
aaattta

SEQ ID NO: 171363 - DNA, 9 bp, Unknown
  misc_feature (1)..( 9): Result.005 file - promoters50/1441762
gatcacttt

SEQ ID NO: 171364 - DNA, 9 bp, Unknown
  misc_feature (1)..( 9): Result.005 file - promoters50/1441762
aatctcttt

SEQ ID NO: 171365 - DNA, 9 bp, Unknown
  misc_feature (1)..( 9): Result.005 file - promoters50/1441762
aatctccaa

SEQ ID NO: 171366 - DNA, 7 bp, Unknown
  misc_feature (1)..( 7): Result.005 file - promoters50/1441762
taagtta

SEQ ID NO: 171367 - DNA, 7 bp, Unknown
  misc_feature (1)..( 7): Result.005 file - promoters50/1441762
taattta

SEQ ID NO: 171368 - DNA, 7 bp, Unknown
  misc_feature (1)..( 7): Result.005 file - promoters50/1441762
taatttt

SEQ ID NO: 171369 - DNA, 12 bp, Unknown
  misc_feature (1)..( 12): Result.005 file - promoters50/1441814
agtaatatttga

SEQ ID NO: 171370 - DNA, 12 bp, Unknown
  misc_feature (1)..( 12): Result.005 file - promoters50/1441814
gagtatatttta

SEQ ID NO: 171371 - DNA, 12 bp, Unknown
  misc_feature (1)..( 12): Result.005 file - promoters50/1441814
cttaaaattgag

SEQ ID NO: 171372 - DNA, 12 bp, Unknown
  misc_feature (1)..( 12): Result.005 file - promoters50/1441814
cttacaatttca

SEQ ID NO: 171373 - DNA, 12 bp, Unknown
  misc_feature (1)..( 12): Result.005 file - promoters50/1441814
ttgtaaattttg

SEQ ID NO: 171374 - DNA, 12 bp, Unknown
  misc_feature (1)..( 12): Result.005 file - promoters50/1441814
caaaatattgca

SEQ ID NO: 171375 - DNA, 12 bp, Unknown
  misc_feature (1)..( 12): Result.005 file - promoters50/1441814
taataaagtatg

SEQ ID NO: 171376 - DNA, 11 bp, Unknown
  misc_feature (1)..( 11): Result.005 file - promoters50/1441814
ctttgcttaca

SEQ ID NO: 171377 - DNA, 11 bp, Unknown
  misc_feature (1)..( 11): Result.005 file - promoters50/1441814
ttttacttttt

SEQ ID NO: 171378 - DNA, 11 bp, Unknown
  misc_feature (1)..( 11): Result.005 file - promoters50/1441814
tttttcttttc

SEQ ID NO: 171379 - DNA, 11 bp, Unknown
  misc_feature (1)..( 11): Result.005 file - promoters50/1441814
gttttcttcca

SEQ ID NO: 171380 - DNA, 11 bp, Unknown
  misc_feature (1)..( 11): Result.005 file - promoters50/1441814
ttttaccagtg

SEQ ID NO: 171381 - DNA, 11 bp, Unknown
  misc_feature (1)..( 11): Result.005 file - promoters50/1441814
atatacttttt

SEQ ID NO: 171382 - DNA, 11 bp, Unknown
  misc_feature (1)..( 11): Result.005 file - promoters50/1441814
atattcttgct

SEQ ID NO: 171383 - DNA, 14 bp, Unknown
  misc_feature (1)..( 14): Result.005 file - promoters50/1441814
caacaatgtacaaa

SEQ ID NO: 171384 - DNA, 14 bp, Unknown
  misc_feature (1)..( 14): Result.005 file - promoters50/1441814
caataatttacatt

SEQ ID NO: 171385 - DNA, 14 bp, Unknown
  misc_feature (1)..( 14): Result.005 file - promoters50/1441814
gtataattttatat

SEQ ID NO: 171386 - DNA, 14 bp, Unknown
  misc_feature (1)..( 14): Result.005 file - promoters50/1441814
aagacatgtaaaat

SEQ ID NO: 171387 - DNA, 14 bp, Unknown
  misc_feature (1)..( 14): Result.005 file - promoters50/1441814
tgaaaatttatacg

SEQ ID NO: 171388 - DNA, 14 bp, Unknown
  misc_feature (1)..( 14): Result.005 file - promoters50/1441814
gaataataaaatgt

SEQ ID NO: 171389 - DNA, 10 bp, Unknown
  misc_feature (1)..( 10): Result.005 file - promoters50/1441835
ctataaaaag

SEQ ID NO: 171390 - DNA, 10 bp, Unknown
  misc_feature (1)..( 10): Result.005 file - promoters50/1441835
atataaaaat

SEQ ID NO: 171391 - DNA, 10 bp, Unknown
  misc_feature (1)..( 10): Result.005 file - promoters50/1441835
aaatagaaga

SEQ ID NO: 171392 - DNA, 10 bp, Unknown
  misc_feature (1)..( 10): Result.005 file - promoters50/1441835
gtattaaaat

SEQ ID NO: 171393 - DNA, 10 bp, Unknown
  misc_feature (1)..( 10): Result.005 file - promoters50/1441835
atataaacag

SEQ ID NO: 171394 - DNA, 10 bp, Unknown
  misc_feature (1)..( 10): Result.005 file - promoters50/1441835
agtttaaaat

SEQ ID NO: 171395 - DNA, 14 bp, Unknown
  misc_feature (1)..( 14): Result.005 file - promoters50/1441835
attaattaatcgaa

SEQ ID NO: 171396 - DNA, 14 bp, Unknown
  misc_feature (1)..( 14): Result.005 file - promoters50/1441835
attaataaattttg

SEQ ID NO: 171397 - DNA, 14 bp, Unknown
  misc_feature (1)..( 14): Result.005 file - promoters50/1441835
aataaataatcatt

SEQ ID NO: 171398 - DNA, 14 bp, Unknown
  misc_feature (1)..( 14): Result.005 file - promoters50/1441835
acaaaacaattcaa

SEQ ID NO: 171399 - DNA, 14 bp, Unknown
  misc_feature (1)..( 14): Result.005 file - promoters50/1441835
gttaaaaaatccaa

SEQ ID NO: 171400 - DNA, 14 bp, Unknown
  misc_feature (1)..( 14): Result.005 file - promoters50/1441835
atcaatatattttt

SEQ ID NO: 171401 - DNA, 12 bp, Unknown
  misc_feature (1)..( 12): Result.005 file - promoters50/1441841
ttggattttgca

SEQ ID NO: 171402 - DNA, 12 bp, Unknown
  misc_feature (1)..( 12): Result.005 file - promoters50/1441841
tccaattttgta

SEQ ID NO: 171403 - DNA, 12 bp, Unknown
  misc_feature (1)..( 12): Result.005 file - promoters50/1441841
atgtattttgtg

SEQ ID NO: 171404 - DNA, 12 bp, Unknown
  misc_feature (1)..( 12): Result.005 file - promoters50/1441841
aaaacttttgca

SEQ ID NO: 171405 - DNA, 12 bp, Unknown
  misc_feature (1)..( 12): Result.005 file - promoters50/1441841
atcaaatttgtt

SEQ ID NO: 171406 - DNA, 12 bp, Unknown
  misc_feature (1)..( 12): Result.005 file - promoters50/1441841
gtcaaattccac

SEQ ID NO: 171407 - DNA, 12 bp, Unknown
  misc_feature (1)..( 12): Result.005 file - promoters50/1441841
atgtctttttca

SEQ ID NO: 171408 - DNA, 14 bp, Unknown
  misc_feature (1)..( 14): Result.005 file - promoters50/1441841
aaatttgttataac

SEQ ID NO: 171409 - DNA, 14 bp, Unknown
  misc_feature (1)..( 14): Result.005 file - promoters50/1441841
tcattttttaattt

SEQ ID NO: 171410 - DNA, 14 bp, Unknown
  misc_feature (1)..( 14): Result.005 file - promoters50/1441841
caattttgtagata

SEQ ID NO: 171411 - DNA, 14 bp, Unknown
  misc_feature (1)..( 14): Result.005 file - promoters50/1441841
tcattgtttaattt

SEQ ID NO: 171412 - DNA, 14 bp, Unknown
  misc_feature (1)..( 14): Result.005 file - promoters50/1441841
ccacggtttaataa

SEQ ID NO: 171413 - DNA, 14 bp, Unknown
  misc_feature (1)..( 14): Result.005 file - promoters50/1441841
tcgttttgtgaaat

SEQ ID NO: 171414 - DNA, 10 bp, Unknown
  misc_feature (1)..( 10): Result.005 file - promoters50/1441859
atttattttg

SEQ ID NO: 171415 - DNA, 10 bp, Unknown
  misc_feature (1)..( 10): Result.005 file - promoters50/1441859
taatatttta

SEQ ID NO: 171416 - DNA, 10 bp, Unknown
  misc_feature (1)..( 10): Result.005 file - promoters50/1441859
tcttaattta

SEQ ID NO: 171417 - DNA, 10 bp, Unknown
  misc_feature (1)..( 10): Result.005 file - promoters50/1441859
aaatatcttg

SEQ ID NO: 171418 - DNA, 10 bp, Unknown
  misc_feature (1)..( 10): Result.005 file - promoters50/1441859
ctttattttt

SEQ ID NO: 171419 - DNA, 10 bp, Unknown
  misc_feature (1)..( 10): Result.005 file - promoters50/1441859
cttttttttt

SEQ ID NO: 171420 - DNA, 15 bp, Unknown
  misc_feature (1)..( 15): Result.005 file - promoters50/1441912
ccatgaattggcact

SEQ ID NO: 171421 - DNA, 15 bp, Unknown
  misc_feature (1)..( 15): Result.005 file - promoters50/1441912
tattgatttgttcct

SEQ ID NO: 171422 - DNA, 15 bp, Unknown
  misc_feature (1)..( 15): Result.005 file - promoters50/1441912
ttgtgatttggtgac

SEQ ID NO: 171423 - DNA, 15 bp, Unknown
  misc_feature (1)..( 15): Result.005 file - promoters50/1441912
tatttattttagatt

SEQ ID NO: 171424 - DNA, 15 bp, Unknown
  misc_feature (1)..( 15): Result.005 file - promoters50/1441912
acatgattttgtgaa

SEQ ID NO: 171425 - DNA, 15 bp, Unknown
  misc_feature (1)..( 15): Result.005 file - promoters50/1441912
tatctattttagatt

SEQ ID NO: 171426 - DNA, 8 bp, Unknown
  misc_feature (1)..( 8): Result.005 file - promoters50/1441937
caatttat

SEQ ID NO: 171427 - DNA, 8 bp, Unknown
  misc_feature (1)..( 8): Result.005 file - promoters50/1441937
taatgtat

SEQ ID NO: 171428 - DNA, 8 bp, Unknown
  misc_feature (1)..( 8): Result.005 file - promoters50/1441937
caatttgc

SEQ ID NO: 171429 - DNA, 8 bp, Unknown
  misc_feature (1)..( 8): Result.005 file - promoters50/1441937
taaaacaa

SEQ ID NO: 171430 - DNA, 8 bp, Unknown
  misc_feature (1)..( 8): Result.005 file - promoters50/1441937
aaaatcaa

SEQ ID NO: 171431 - DNA, 8 bp, Unknown
  misc_feature (1)..( 8): Result.005 file - promoters50/1441937
aaaatcgt

SEQ ID NO: 171432 - DNA, 8 bp, Unknown
  misc_feature (1)..( 8): Result.005 file - promoters50/1441937
taacaata

SEQ ID NO: 171433 - DNA, 8 bp, Unknown
  misc_feature (1)..( 8): Result.005 file - promoters50/1441937
taaaaatc

SEQ ID NO: 171434 - DNA, 8 bp, Unknown
  misc_feature (1)..( 8): Result.005 file - promoters50/1441937
ttaaaatc

SEQ ID NO: 171435 - DNA, 8 bp, Unknown
  misc_feature (1)..( 8): Result.005 file - promoters50/1441937
atgtcttg

SEQ ID NO: 171436 - DNA, 8 bp, Unknown
  misc_feature (1)..( 8): Result.005 file - promoters50/1441937
ctgtgttg

SEQ ID NO: 171437 - DNA, 8 bp, Unknown
  misc_feature (1)..( 8): Result.005 file - promoters50/1441937
ctgtgtct

SEQ ID NO: 171438 - DNA, 8 bp, Unknown
  misc_feature (1)..( 8): Result.005 file - promoters50/1441937
tcttattt

SEQ ID NO: 171439 - DNA, 8 bp, Unknown
  misc_feature (1)..( 8): Result.005 file - promoters50/1441937
tcttgttt

SEQ ID NO: 171440 - DNA, 8 bp, Unknown
  misc_feature (1)..( 8): Result.005 file - promoters50/1441937
tctggttg

SEQ ID NO: 171441 - DNA, 8 bp, Unknown
  misc_feature (1)..( 8): Result.005 file - promoters50/1441959
attataca

SEQ ID NO: 171442 - DNA, 8 bp, Unknown
  misc_feature (1)..( 8): Result.005 file - promoters50/1441959
tctataca

SEQ ID NO: 171443 - DNA, 8 bp, Unknown
  misc_feature (1)..( 8): Result.005 file - promoters50/1441959
tctttact

SEQ ID NO: 171444 - DNA, 7 bp, Unknown
  misc_feature (1)..( 7): Result.005 file - promoters50/1441959
aatattt

SEQ ID NO: 171445 - DNA, 7 bp, Unknown
  misc_feature (1)..( 7): Result.005 file - promoters50/1441959
aattttt

SEQ ID NO: 171446 - DNA, 7 bp, Unknown
  misc_feature (1)..( 7): Result.005 file - promoters50/1441959
aattttg

SEQ ID NO: 171447 - DNA, 7 bp, Unknown
  misc_feature (1)..( 7): Result.005 file - promoters50/1441959
ttaattt

SEQ ID NO: 171448 - DNA, 7 bp, Unknown
  misc_feature (1)..( 7): Result.005 file - promoters50/1441959
ataattt

SEQ ID NO: 171449 - DNA, 7 bp, Unknown
  misc_feature (1)..( 7): Result.005 file - promoters50/1441959
atatttt

SEQ ID NO: 171450 - DNA, 9 bp, Unknown
  misc_feature (1)..( 9): Result.005 file - promoters50/1441963
aaaaattat

SEQ ID NO: 171451 - DNA, 9 bp, Unknown
  misc_feature (1)..( 9): Result.005 file - promoters50/1441963
aaaaatttt

SEQ ID NO: 171452 - DNA, 9 bp, Unknown
  misc_feature (1)..( 9): Result.005 file - promoters50/1441963
aaaaaaagt

SEQ ID NO: 171453 - DNA, 9 bp, Unknown
  misc_feature (1)..( 9): Result.005 file - promoters50/1441963
acaaattta

SEQ ID NO: 171454 - DNA, 7 bp, Unknown
  misc_feature (1)..( 7): Result.005 file - promoters50/1441963
gtaaaaa

SEQ ID NO: 171455 - DNA, 7 bp, Unknown
  misc_feature (1)..( 7): Result.005 file - promoters50/1441963
ataaaaa

SEQ ID NO: 171456 - DNA, 8 bp, Unknown
  misc_feature (1)..( 8): Result.005 file - promoters50/1441963
ataataaa

SEQ ID NO: 171457 - DNA, 8 bp, Unknown
  misc_feature (1)..( 8): Result.005 file - promoters50/1441963
tcaataaa

SEQ ID NO: 171458 - DNA, 9 bp, Unknown
  misc_feature (1)..( 9): Result.005 file - promoters50/1441963
aaatattat

SEQ ID NO: 171459 - DNA, 9 bp, Unknown
  misc_feature (1)..( 9): Result.005 file - promoters50/1441963
aaaaattag

SEQ ID NO: 171460 - DNA, 9 bp, Unknown
  misc_feature (1)..( 9): Result.005 file - promoters50/1441963
gattattat

SEQ ID NO: 171461 - DNA, 9 bp, Unknown
  misc_feature (1)..( 9): Result.005 file - promoters50/1441963
ctttattat

SEQ ID NO: 171462 - DNA, 10 bp, Unknown
  misc_feature (1)..( 10): Result.005 file - promoters50/1441963
aaatttaata

SEQ ID NO: 171463 - DNA, 10 bp, Unknown
  misc_feature (1)..( 10): Result.005 file - promoters50/1441963
aaatataaga

SEQ ID NO: 171464 - DNA, 10 bp, Unknown
  misc_feature (1)..( 10): Result.005 file - promoters50/1441963
caatacaaga

SEQ ID NO: 171465 - DNA, 10 bp, Unknown
  misc_feature (1)..( 10): Result.005 file - promoters50/1441963
aaacatactc

SEQ ID NO: 171466 - DNA, 8 bp, Unknown
  misc_feature (1)..( 8): Result.005 file - promoters50/1441963
cttaaaga

SEQ ID NO: 171467 - DNA, 8 bp, Unknown
  misc_feature (1)..( 8): Result.005 file - promoters50/1441963
attaaaga

SEQ ID NO: 171468 - DNA, 8 bp, Unknown
  misc_feature (1)..( 8): Result.005 file - promoters50/1441963
tctaaaat

SEQ ID NO: 171469 - DNA, 8 bp, Unknown
  misc_feature (1)..( 8): Result.005 file - promoters50/1441963
tataaaac

SEQ ID NO: 171470 - DNA, 8 bp, Unknown
  misc_feature (1)..( 8): Result.005 file - promoters50/1441970
ctcttgtt

SEQ ID NO: 171471 - DNA, 8 bp, Unknown
  misc_feature (1)..( 8): Result.005 file - promoters50/1441970
atctcgtt

SEQ ID NO: 171472 - DNA, 8 bp, Unknown
  misc_feature (1)..( 8): Result.005 file - promoters50/1441970
ctcttgac

SEQ ID NO: 171473 - DNA, 7 bp, Unknown
  misc_feature (1)..( 7): Result.005 file - promoters50/1441970
gtttttc

SEQ ID NO: 171474 - DNA, 7 bp, Unknown
  misc_feature (1)..( 7): Result.005 file - promoters50/1441970
ctttttc

SEQ ID NO: 171475 - DNA, 7 bp, Unknown
  misc_feature (1)..( 7): Result.005 file - promoters50/1441970
gtttttg

SEQ ID NO: 171476 - DNA, 9 bp, Unknown
  misc_feature (1)..( 9): Result.005 file - promoters50/1441970
ttgttattg

SEQ ID NO: 171477 - DNA, 9 bp, Unknown
  misc_feature (1)..( 9): Result.005 file - promoters50/1441970
atgttcttg

SEQ ID NO: 171478 - DNA, 9 bp, Unknown
  misc_feature (1)..( 9): Result.005 file - promoters50/1441970
atgatctcg

SEQ ID NO: 171479 - DNA, 9 bp, Unknown
  misc_feature (1)..( 9): Result.005 file - promoters50/1441970
acattcatt

SEQ ID NO: 171480 - DNA, 9 bp, Unknown
  misc_feature (1)..( 9): Result.005 file - promoters50/1441970
gcatttatt

SEQ ID NO: 171481 - DNA, 9 bp, Unknown
  misc_feature (1)..( 9): Result.005 file - promoters50/1441970
acattcgaa

SEQ ID NO: 171482 - DNA, 8 bp, Unknown
  misc_feature (1)..( 8): Result.005 file - promoters50/1441970
cttttttt

SEQ ID NO: 171483 - DNA, 8 bp, Unknown
  misc_feature (1)..( 8): Result.005 file - promoters50/1441970
attttttt

SEQ ID NO: 171484 - DNA, 8 bp, Unknown
  misc_feature (1)..( 8): Result.005 file - promoters50/1441970
atttttct

SEQ ID NO: 171485 - DNA, 8 bp, Unknown
  misc_feature (1)..( 8): Result.005 file - promoters50/1441970
ttttttta

SEQ ID NO: 171486 - DNA, 8 bp, Unknown
  misc_feature (1)..( 8): Result.005 file - promoters50/1441970
atttttta

SEQ ID NO: 171487 - DNA, 8 bp, Unknown
  misc_feature (1)..( 8): Result.005 file - promoters50/1441970
atttttct

SEQ ID NO: 171488 - DNA, 10 bp, Unknown
  misc_feature (1)..( 10): Result.005 file - promoters50/1441985
caaattttgt

SEQ ID NO: 171489 - DNA, 10 bp, Unknown
  misc_feature (1)..( 10): Result.005 file - promoters50/1441985
acaattttgt

SEQ ID NO: 171490 - DNA, 10 bp, Unknown
  misc_feature (1)..( 10): Result.005 file - promoters50/1441985
tacattttgt

SEQ ID NO: 171491 - DNA, 10 bp, Unknown
  misc_feature (1)..( 10): Result.005 file - promoters50/1441985
acagtttctt

SEQ ID NO: 171492 - DNA, 11 bp, Unknown
  misc_feature (1)..( 11): Result.005 file - promoters50/1441985
gtatttttttt

SEQ ID NO: 171493 - DNA, 11 bp, Unknown
  misc_feature (1)..( 11): Result.005 file - promoters50/1441985
cagtttttttt

SEQ ID NO: 171494 - DNA, 11 bp, Unknown
  misc_feature (1)..( 11): Result.005 file - promoters50/1441985
tcattattttt

SEQ ID NO: 171495 - DNA, 12 bp, Unknown
  misc_feature (1)..( 12): Result.005 file - promoters50/1441985
gtatttcttttt

SEQ ID NO: 171496 - DNA, 8 bp, Unknown
  misc_feature (1)..( 8): Result.005 file - promoters50/1441985
ttttgttg

SEQ ID NO: 171497 - DNA, 8 bp, Unknown
  misc_feature (1)..( 8): Result.005 file - promoters50/1441985
ttttgtcg

SEQ ID NO: 171498 - DNA, 8 bp, Unknown
  misc_feature (1)..( 8): Result.005 file - promoters50/1441985
ttttgtat

SEQ ID NO: 171499 - DNA, 8 bp, Unknown
  misc_feature (1)..( 8): Result.005 file - promoters50/1441985
ctttatcg

SEQ ID NO: 171500 - DNA, 9 bp, Unknown
  misc_feature (1)..( 9): Result.005 file - promoters50/1441985
ttaatatat

SEQ ID NO: 171501 - DNA, 9 bp, Unknown
  misc_feature (1)..( 9): Result.005 file - promoters50/1441985
aaaatataa

SEQ ID NO: 171502 - DNA, 9 bp, Unknown
  misc_feature (1)..( 9): Result.005 file - promoters50/1441985
aaaaaataa

SEQ ID NO: 171503 - DNA, 9 bp, Unknown
  misc_feature (1)..( 9): Result.005 file - promoters50/1441985
aaagaattt

SEQ ID NO: 171504 - DNA, 11 bp, Unknown
  misc_feature (1)..( 11): Result.005 file - promoters50/1441985
aatcacaaaaa

SEQ ID NO: 171505 - DNA, 11 bp, Unknown
  misc_feature (1)..( 11): Result.005 file - promoters50/1441985
aattacaaaaa

SEQ ID NO: 171506 - DNA, 11 bp, Unknown
  misc_feature (1)..( 11): Result.005 file - promoters50/1441985
aaatactatga

SEQ ID NO: 171507 - DNA, 11 bp, Unknown
  misc_feature (1)..( 11): Result.005 file - promoters50/1441985
aaaaacacttt

SEQ ID NO: 171508 - DNA, 8 bp, Unknown
  misc_feature (1)..( 8): Result.005 file - promoters50/1441988
ttaaaaaa

SEQ ID NO: 171509 - DNA, 8 bp, Unknown
  misc_feature (1)..( 8): Result.005 file - promoters50/1441988
acaaaaaa

SEQ ID NO: 171510 - DNA, 8 bp, Unknown
  misc_feature (1)..( 8): Result.005 file - promoters50/1441988
acataaac

SEQ ID NO: 171511 - DNA, 10 bp, Unknown
  misc_feature (1)..( 10): Result.005 file - promoters50/1441990
aaacagaaaa

SEQ ID NO: 171512 - DNA, 10 bp, Unknown
  misc_feature (1)..( 10): Result.005 file - promoters50/1441990
gaacacaaag

SEQ ID NO: 171513 - DNA, 11 bp, Unknown
  misc_feature (1)..( 11): Result.005 file - promoters50/1441990
aactagataat

SEQ ID NO: 171514 - DNA, 11 bp, Unknown
  misc_feature (1)..( 11): Result.005 file - promoters50/1441990
ctagagaaaat

SEQ ID NO: 171515 - DNA, 11 bp, Unknown
  misc_feature (1)..( 11): Result.005 file - promoters50/1441990
aaaaagaaatg

SEQ ID NO: 171516 - DNA, 11 bp, Unknown
  misc_feature (1)..( 11): Result.005 file - promoters50/1441990
gagaataaaaa

SEQ ID NO: 171517 - DNA, 9 bp, Unknown
  misc_feature (1)..( 9): Result.005 file - promoters50/1441990
atatataaa

SEQ ID NO: 171518 - DNA, 9 bp, Unknown
  misc_feature (1)..( 9): Result.005 file - promoters50/1441990
atatatata

SEQ ID NO: 171519 - DNA, 9 bp, Unknown
  misc_feature (1)..( 9): Result.005 file - promoters50/1441990
ttatataga

SEQ ID NO: 171520 - DNA, 9 bp, Unknown
  misc_feature (1)..( 9): Result.005 file - promoters50/1441990
ataaaaagc

SEQ ID NO: 171521 - DNA, 9 bp, Unknown
  misc_feature (1)..( 9): Result.005 file - promoters50/1441990
atatataaa

SEQ ID NO: 171522 - DNA, 9 bp, Unknown
  misc_feature (1)..( 9): Result.005 file - promoters50/1441990
ttaaatagc

SEQ ID NO: 171523 - DNA, 11 bp, Unknown
  misc_feature (1)..( 11): Result.005 file - promoters50/1441990
tgttttaaaag

SEQ ID NO: 171524 - DNA, 11 bp, Unknown
  misc_feature (1)..( 11): Result.005 file - promoters50/1441990
agttataaatc

SEQ ID NO: 171525 - DNA, 11 bp, Unknown
  misc_feature (1)..( 11): Result.005 file - promoters50/1441990
tctttcaaaat

SEQ ID NO: 171526 - DNA, 11 bp, Unknown
  misc_feature (1)..( 11): Result.005 file - promoters50/1441990
agttatgaatc

SEQ ID NO: 171527 - DNA, 11 bp, Unknown
  misc_feature (1)..( 11): Result.005 file - promoters50/1441990
aaaaccaaaat

SEQ ID NO: 171528 - DNA, 11 bp, Unknown
  misc_feature (1)..( 11): Result.005 file - promoters50/1441990
ggcggcaaaat

SEQ ID NO: 171529 - DNA, 10 bp, Unknown
  misc_feature (1)..( 10): Result.005 file - promoters50/1442015
aaagaagaca

SEQ ID NO: 171530 - DNA, 10 bp, Unknown
  misc_feature (1)..( 10): Result.005 file - promoters50/1442015
aaagaagaag

SEQ ID NO: 171531 - DNA, 10 bp, Unknown
  misc_feature (1)..( 10): Result.005 file - promoters50/1442015
gaagaagaag

SEQ ID NO: 171532 - DNA, 10 bp, Unknown
  misc_feature (1)..( 10): Result.005 file - promoters50/1442015
ccagaaggaa

SEQ ID NO: 171533 - DNA, 6 bp, Unknown
  misc_feature (1)..( 6): Result.005 file - promoters50/1442015
tttttt

SEQ ID NO: 171534 - DNA, 6 bp, Unknown
  misc_feature (1)..( 6): Result.005 file - promoters50/1442015
tttttt

SEQ ID NO: 171535 - DNA, 6 bp, Unknown
  misc_feature (1)..( 6): Result.005 file - promoters50/1442015
tttttt

SEQ ID NO: 171536 - DNA, 11 bp, Unknown
  misc_feature (1)..( 11): Result.005 file - promoters50/1442015
ttaaatgaaga

SEQ ID NO: 171537 - DNA, 11 bp, Unknown
  misc_feature (1)..( 11): Result.005 file - promoters50/1442015
agaaatgaatt

SEQ ID NO: 171538 - DNA, 11 bp, Unknown
  misc_feature (1)..( 11): Result.005 file - promoters50/1442015
agaagtgaatt

SEQ ID NO: 171539 - DNA, 10 bp, Unknown
  misc_feature (1)..( 10): Result.005 file - promoters50/1442015
attctattag

SEQ ID NO: 171540 - DNA, 10 bp, Unknown
  misc_feature (1)..( 10): Result.005 file - promoters50/1442015
attctgttat

SEQ ID NO: 171541 - DNA, 10 bp, Unknown
  misc_feature (1)..( 10): Result.005 file - promoters50/1442015
acgctgttat

SEQ ID NO: 171542 - DNA, 10 bp, Unknown
  misc_feature (1)..( 10): Result.005 file - promoters50/1442104
caaacttatt

SEQ ID NO: 171543 - DNA, 10 bp, Unknown
  misc_feature (1)..( 10): Result.005 file - promoters50/1442104
ttttcttatt

SEQ ID NO: 171544 - DNA, 10 bp, Unknown
  misc_feature (1)..( 10): Result.005 file - promoters50/1442104
ttttcatatt

SEQ ID NO: 171545 - DNA, 10 bp, Unknown
  misc_feature (1)..( 10): Result.005 file - promoters50/1442104
ctacatttta

SEQ ID NO: 171546 - DNA, 10 bp, Unknown
  misc_feature (1)..( 10): Result.005 file - promoters50/1442104
ttggatttta

SEQ ID NO: 171547 - DNA, 10 bp, Unknown
  misc_feature (1)..( 10): Result.005 file - promoters50/1442104
ttggattttt

SEQ ID NO: 171548 - DNA, 12 bp, Unknown
  misc_feature (1)..( 12): Result.005 file - promoters50/1442156
atatagttataa

SEQ ID NO: 171549 - DNA, 12 bp, Unknown
  misc_feature (1)..( 12): Result.005 file - promoters50/1442156
aaataattaaac

SEQ ID NO: 171550 - DNA, 12 bp, Unknown
  misc_feature (1)..( 12): Result.005 file - promoters50/1442156
aaatagtttcaa

SEQ ID NO: 171551 - DNA, 12 bp, Unknown
  misc_feature (1)..( 12): Result.005 file - promoters50/1442156
ttattgttttct

SEQ ID NO: 171552 - DNA, 12 bp, Unknown
  misc_feature (1)..( 12): Result.005 file - promoters50/1442156
agaaagaatcaa

SEQ ID NO: 171553 - DNA, 12 bp, Unknown
  misc_feature (1)..( 12): Result.005 file - promoters50/1442156
aaaaagttgcaa

SEQ ID NO: 171554 - DNA, 10 bp, Unknown
  misc_feature (1)..( 10): Result.005 file - promoters50/1442156
caaaaaataa

SEQ ID NO: 171555 - DNA, 10 bp, Unknown
  misc_feature (1)..( 10): Result.005 file - promoters50/1442156
gaaaaaaaaa

SEQ ID NO: 171556 - DNA, 10 bp, Unknown
  misc_feature (1)..( 10): Result.005 file - promoters50/1442156
taaaaaagga

SEQ ID NO: 171557 - DNA, 10 bp, Unknown
  misc_feature (1)..( 10): Result.005 file - promoters50/1442156
taaaagataa

SEQ ID NO: 171558 - DNA, 11 bp, Unknown
  misc_feature (1)..( 11): Result.005 file - promoters50/1442156
taaacaaaatc

SEQ ID NO: 171559 - DNA, 11 bp, Unknown
  misc_feature (1)..( 11): Result.005 file - promoters50/1442156
gaaaaagtctt

SEQ ID NO: 171560 - DNA, 9 bp, Unknown
  misc_feature (1)..( 9): Result.005 file - promoters50/1442179
actcaacaa

SEQ ID NO: 171561 - DNA, 9 bp, Unknown
  misc_feature (1)..( 9): Result.005 file - promoters50/1442179
tgtcatcaa

SEQ ID NO: 171562 - DNA, 9 bp, Unknown
  misc_feature (1)..( 9): Result.005 file - promoters50/1442179
actaaactc

SEQ ID NO: 171563 - DNA, 9 bp, Unknown
  misc_feature (1)..( 9): Result.005 file - promoters50/1442179
tctatactg

SEQ ID NO: 171564 - DNA, 10 bp, Unknown
  misc_feature (1)..( 10): Result.005 file - promoters50/1442189
ggctactaga

SEQ ID NO: 171565 - DNA, 10 bp, Unknown
  misc_feature (1)..( 10): Result.005 file - promoters50/1442189
aaaaactaga

SEQ ID NO: 171566 - DNA, 10 bp, Unknown
  misc_feature (1)..( 10): Result.005 file - promoters50/1442189
aaaaattagt

SEQ ID NO: 171567 - DNA, 7 bp, Unknown
  misc_feature (1)..( 7): Result.005 file - promoters50/1442189
caaaaaa

SEQ ID NO: 171568 - DNA, 7 bp, Unknown
  misc_feature (1)..( 7): Result.005 file - promoters50/1442189
caataaa

SEQ ID NO: 171569 - DNA, 7 bp, Unknown
  misc_feature (1)..( 7): Result.005 file - promoters50/1442189
caataat

SEQ ID NO: 171570 - DNA, 12 bp, Unknown
  misc_feature (1)..( 12): Result.005 file - promoters50/1442189
aaaaatataatt

SEQ ID NO: 171571 - DNA, 12 bp, Unknown
  misc_feature (1)..( 12): Result.005 file - promoters50/1442189
aaatatatcaat

SEQ ID NO: 171572 - DNA, 12 bp, Unknown
  misc_feature (1)..( 12): Result.005 file - promoters50/1442189
ataagtatctca

SEQ ID NO: 171573 - DNA, 9 bp, Unknown
  misc_feature (1)..( 9): Result.005 file - promoters50/1442189
aaatgatat

SEQ ID NO: 171574 - DNA, 9 bp, Unknown
  misc_feature (1)..( 9): Result.005 file - promoters50/1442189
caataatat

SEQ ID NO: 171575 - DNA, 9 bp, Unknown
  misc_feature (1)..( 9): Result.005 file - promoters50/1442189
caataaacc

SEQ ID NO: 171576 - DNA, 6 bp, Unknown
  misc_feature (1)..( 6): Result.005 file - promoters50/1442189
aagata

SEQ ID NO: 171577 - DNA, 6 bp, Unknown
  misc_feature (1)..( 6): Result.005 file - promoters50/1442189
aagata

SEQ ID NO: 171578 - DNA, 6 bp, Unknown
  misc_feature (1)..( 6): Result.005 file - promoters50/1442189
aagata

SEQ ID NO: 171579 - DNA, 10 bp, Unknown
  misc_feature (1)..( 10): Result.005 file - promoters50/1442218
ataaagaaag

SEQ ID NO: 171580 - DNA, 10 bp, Unknown
  misc_feature (1)..( 10): Result.005 file - promoters50/1442218
atagagaata

SEQ ID NO: 171581 - DNA, 10 bp, Unknown
  misc_feature (1)..( 10): Result.005 file - promoters50/1442218
gcaaagaaag

SEQ ID NO: 171582 - DNA, 11 bp, Unknown
  misc_feature (1)..( 11): Result.005 file - promoters50/1442218
aaagaaagaag

SEQ ID NO: 171583 - DNA, 11 bp, Unknown
  misc_feature (1)..( 11): Result.005 file - promoters50/1442218
ggagaaagaag

SEQ ID NO: 171584 - DNA, 11 bp, Unknown
  misc_feature (1)..( 11): Result.005 file - promoters50/1442218
aaagaaagtag

SEQ ID NO: 171585 - DNA, 10 bp, Unknown
  misc_feature (1)..( 10): Result.005 file - promoters50/1442218
aagaaggtga

SEQ ID NO: 171586 - DNA, 10 bp, Unknown
  misc_feature (1)..( 10): Result.005 file - promoters50/1442218
gaagaggtga

SEQ ID NO: 171587 - DNA, 10 bp, Unknown
  misc_feature (1)..( 10): Result.005 file - promoters50/1442218
gagaaagtgt

SEQ ID NO: 171588 - DNA, 10 bp, Unknown
  misc_feature (1)..( 10): Result.005 file - promoters50/1442218
gagaaagaag

SEQ ID NO: 171589 - DNA, 7 bp, Unknown
  misc_feature (1)..( 7): Result.005 file - promoters50/1442218
tgaagag

SEQ ID NO: 171590 - DNA, 7 bp, Unknown
  misc_feature (1)..( 7): Result.005 file - promoters50/1442218
agaagag

SEQ ID NO: 171591 - DNA, 7 bp, Unknown
  misc_feature (1)..( 7): Result.005 file - promoters50/1442218
agaagaa

SEQ ID NO: 171592 - DNA, 10 bp, Unknown
  misc_feature (1)..( 10): Result.005 file - promoters50/1442218
aaggagaaag

SEQ ID NO: 171593 - DNA, 10 bp, Unknown
  misc_feature (1)..( 10): Result.005 file - promoters50/1442218
aagtagagaa

SEQ ID NO: 171594 - DNA, 10 bp, Unknown
  misc_feature (1)..( 10): Result.005 file - promoters50/1442218
gcgtagagaa

SEQ ID NO: 171595 - DNA, 7 bp, Unknown
  misc_feature (1)..( 7): Result.005 file - promoters50/1442218
aagtaga

SEQ ID NO: 171596 - DNA, 7 bp, Unknown
  misc_feature (1)..( 7): Result.005 file - promoters50/1442218
aagaaga

SEQ ID NO: 171597 - DNA, 7 bp, Unknown
  misc_feature (1)..( 7): Result.005 file - promoters50/1442218
gagaaga

SEQ ID NO: 171598 - DNA, 10 bp, Unknown
  misc_feature (1)..( 10): Result.005 file - promoters50/1442233
attcttctac

SEQ ID NO: 171599 - DNA, 10 bp, Unknown
  misc_feature (1)..( 10): Result.005 file - promoters50/1442233
attcttatca

SEQ ID NO: 171600 - DNA, 10 bp, Unknown
  misc_feature (1)..( 10): Result.005 file - promoters50/1442233
gttctaatca

SEQ ID NO: 171601 - DNA, 9 bp, Unknown
  misc_feature (1)..( 9): Result.005 file - promoters50/1442233
tttggaaga

SEQ ID NO: 171602 - DNA, 9 bp, Unknown
  misc_feature (1)..( 9): Result.005 file - promoters50/1442233
tttggatca

SEQ ID NO: 171603 - DNA, 9 bp, Unknown
  misc_feature (1)..( 9): Result.005 file - promoters50/1442233
cttggttca

SEQ ID NO: 171604 - DNA, 8 bp, Unknown
  misc_feature (1)..( 8): Result.005 file - promoters50/1442233
atttattt

SEQ ID NO: 171605 - DNA, 8 bp, Unknown
  misc_feature (1)..( 8): Result.005 file - promoters50/1442233
atttatgt

SEQ ID NO: 171606 - DNA, 8 bp, Unknown
  misc_feature (1)..( 8): Result.005 file - promoters50/1442233
ttttcttt

SEQ ID NO: 171607 - DNA, 15 bp, Unknown
  misc_feature (1)..( 15): Result.005 file - promoters50/1442240
tttttgatattgcta

SEQ ID NO: 171608 - DNA, 15 bp, Unknown
  misc_feature (1)..( 15): Result.005 file - promoters50/1442240
cgtttgataaaagaa

SEQ ID NO: 171609 - DNA, 15 bp, Unknown
  misc_feature (1)..( 15): Result.005 file - promoters50/1442240
attttgacatcatag

SEQ ID NO: 171610 - DNA, 15 bp, Unknown
  misc_feature (1)..( 15): Result.005 file - promoters50/1442240
tgttggatttttagg

SEQ ID NO: 171611 - DNA, 15 bp, Unknown
  misc_feature (1)..( 15): Result.005 file - promoters50/1442240
tgtttcatatgttat

SEQ ID NO: 171612 - DNA, 15 bp, Unknown
  misc_feature (1)..( 15): Result.005 file - promoters50/1442240
ctttcgaccaataac

SEQ ID NO: 171613 - DNA, 15 bp, Unknown
  misc_feature (1)..( 15): Result.005 file - promoters50/1442240
ctttcgaccaataac

SEQ ID NO: 171614 - DNA, 18 bp, Unknown
  misc_feature (1)..( 18): Result.005 file - promoters50/1442240
aacagtttgctgtcaaca

SEQ ID NO: 171615 - DNA, 18 bp, Unknown
  misc_feature (1)..( 18): Result.005 file - promoters50/1442240
gacattttgttacgagtt

SEQ ID NO: 171616 - DNA, 18 bp, Unknown
  misc_feature (1)..( 18): Result.005 file - promoters50/1442240
aacattttggttttgata

SEQ ID NO: 171617 - DNA, 18 bp, Unknown
  misc_feature (1)..( 18): Result.005 file - promoters50/1442240
tttcttttggtttcttgc

SEQ ID NO: 171618 - DNA, 18 bp, Unknown
  misc_feature (1)..( 18): Result.005 file - promoters50/1442240
aactttttctaatagaat

SEQ ID NO: 171619 - DNA, 18 bp, Unknown
  misc_feature (1)..( 18): Result.005 file - promoters50/1442240
ctcattttgacatcatag

SEQ ID NO: 171620 - DNA, 18 bp, Unknown
  misc_feature (1)..( 18): Result.005 file - promoters50/1442240
aatctttcgaccaataac

SEQ ID NO: 171621 - DNA, 15 bp, Unknown
  misc_feature (1)..( 15): Result.005 file - promoters50/1442240
ctttcgaccaataac

SEQ ID NO: 171622 - DNA, 12 bp, Unknown
  misc_feature (1)..( 12): Result.005 file - promoters50/1442244
gcagttacaaaa

SEQ ID NO: 171623 - DNA, 12 bp, Unknown
  misc_feature (1)..( 12): Result.005 file - promoters50/1442244
gcagttccaata

SEQ ID NO: 171624 - DNA, 12 bp, Unknown
  misc_feature (1)..( 12): Result.005 file - promoters50/1442244
ttctttaaaaaa

SEQ ID NO: 171625 - DNA, 9 bp, Unknown
  misc_feature (1)..( 9): Result.005 file - promoters50/1442244
ggatcatta

SEQ ID NO: 171626 - DNA, 9 bp, Unknown
  misc_feature (1)..( 9): Result.005 file - promoters50/1442244
acatcttta

SEQ ID NO: 171627 - DNA, 9 bp, Unknown
  misc_feature (1)..( 9): Result.005 file - promoters50/1442244
acatctttg

SEQ ID NO: 171628 - DNA, 12 bp, Unknown
  misc_feature (1)..( 12): Result.005 file - promoters50/1442244
atgtaatgacac

SEQ ID NO: 171629 - DNA, 12 bp, Unknown
  misc_feature (1)..( 12): Result.005 file - promoters50/1442244
atggaatagatc

SEQ ID NO: 171630 - DNA, 12 bp, Unknown
  misc_feature (1)..( 12): Result.005 file - promoters50/1442244
aagtaataacac

SEQ ID NO: 171631 - DNA, 7 bp, Unknown
  misc_feature (1)..( 7): Result.005 file - promoters50/1442244
taaaaaa

SEQ ID NO: 171632 - DNA, 7 bp, Unknown
  misc_feature (1)..( 7): Result.005 file - promoters50/1442244
gaaaaaa

SEQ ID NO: 171633 - DNA, 7 bp, Unknown
  misc_feature (1)..( 7): Result.005 file - promoters50/1442244
taaaaag

SEQ ID NO: 171634 - DNA, 8 bp, Unknown
  misc_feature (1)..( 8): Result.005 file - promoters50/1442244
attgaaaa

SEQ ID NO: 171635 - DNA, 8 bp, Unknown
  misc_feature (1)..( 8): Result.005 file - promoters50/1442244
attaaaaa

SEQ ID NO: 171636 - DNA, 8 bp, Unknown
  misc_feature (1)..( 8): Result.005 file - promoters50/1442244
attaaaag

SEQ ID NO: 171637 - DNA, 11 bp, Unknown
  misc_feature (1)..( 11): Result.005 file - promoters50/1442316
aaagaaaacaa

SEQ ID NO: 171638 - DNA, 11 bp, Unknown
  misc_feature (1)..( 11): Result.005 file - promoters50/1442316
attgaaaacta

SEQ ID NO: 171639 - DNA, 11 bp, Unknown
  misc_feature (1)..( 11): Result.005 file - promoters50/1442316
aaataaaacag

SEQ ID NO: 171640 - DNA, 11 bp, Unknown
  misc_feature (1)..( 11): Result.005 file - promoters50/1442316
taaaaaaatct

SEQ ID NO: 171641 - DNA, 11 bp, Unknown
  misc_feature (1)..( 11): Result.005 file - promoters50/1442316
aatgagaacat

SEQ ID NO: 171642 - DNA, 11 bp, Unknown
  misc_feature (1)..( 11): Result.005 file - promoters50/1442316
ctatgaaataa

SEQ ID NO: 171643 - DNA, 10 bp, Unknown
  misc_feature (1)..( 10): Result.005 file - promoters50/1442316
aaacaatttt

SEQ ID NO: 171644 - DNA, 10 bp, Unknown
  misc_feature (1)..( 10): Result.005 file - promoters50/1442316
ttacaaattt

SEQ ID NO: 171645 - DNA, 10 bp, Unknown
  misc_feature (1)..( 10): Result.005 file - promoters50/1442316
taacaattga

SEQ ID NO: 171646 - DNA, 10 bp, Unknown
  misc_feature (1)..( 10): Result.005 file - promoters50/1442316
aaataatgag

SEQ ID NO: 171647 - DNA, 10 bp, Unknown
  misc_feature (1)..( 10): Result.005 file - promoters50/1442316
aaaaaaatct

SEQ ID NO: 171648 - DNA, 10 bp, Unknown
  misc_feature (1)..( 10): Result.005 file - promoters50/1442316
taacaaataa

SEQ ID NO: 171649 - DNA, 16 bp, Unknown
  misc_feature (1)..( 16): Result.005 file - promoters50/1442316
aaaagaataaaagaaa

SEQ ID NO: 171650 - DNA, 16 bp, Unknown
  misc_feature (1)..( 16): Result.005 file - promoters50/1442316
taattaataaaaacta

SEQ ID NO: 171651 - DNA, 16 bp, Unknown
  misc_feature (1)..( 16): Result.005 file - promoters50/1442316
attttattaaaacaaa

SEQ ID NO: 171652 - DNA, 16 bp, Unknown
  misc_feature (1)..( 16): Result.005 file - promoters50/1442316
aggcaaagaaaagagg

SEQ ID NO: 171653 - DNA, 16 bp, Unknown
  misc_feature (1)..( 16): Result.005 file - promoters50/1442316
atttaaataaatacaa

SEQ ID NO: 171654 - DNA, 16 bp, Unknown
  misc_feature (1)..( 16): Result.005 file - promoters50/1442316
tgcccaattaaaaata

SEQ ID NO: 171655 - DNA, 12 bp, Unknown
  misc_feature (1)..( 12): Result.005 file - promoters50/1442316
attgtaatttag

SEQ ID NO: 171656 - DNA, 12 bp, Unknown
  misc_feature (1)..( 12): Result.005 file - promoters50/1442316
tttgcaattgaa

SEQ ID NO: 171657 - DNA, 12 bp, Unknown
  misc_feature (1)..( 12): Result.005 file - promoters50/1442316
caaataatttga

SEQ ID NO: 171658 - DNA, 12 bp, Unknown
  misc_feature (1)..( 12): Result.005 file - promoters50/1442316
attataagcaaa

SEQ ID NO: 171659 - DNA, 12 bp, Unknown
  misc_feature (1)..( 12): Result.005 file - promoters50/1442316
aagagaatcata

SEQ ID NO: 171660 - DNA, 12 bp, Unknown
  misc_feature (1)..( 12): Result.005 file - promoters50/1442316
actataagctag

SEQ ID NO: 171661 - DNA, 11 bp, Unknown
  misc_feature (1)..( 11): Result.005 file - promoters50/1442326
ctttgttgttg

SEQ ID NO: 171662 - DNA, 11 bp, Unknown
  misc_feature (1)..( 11): Result.005 file - promoters50/1442326
ccatgtttttg

SEQ ID NO: 171663 - DNA, 11 bp, Unknown
  misc_feature (1)..( 11): Result.005 file - promoters50/1442326
tcaacttgttg

SEQ ID NO: 171664 - DNA, 11 bp, Unknown
  misc_feature (1)..( 11): Result.005 file - promoters50/1442326
ttatgatttgc

SEQ ID NO: 171665 - DNA, 11 bp, Unknown
  misc_feature (1)..( 11): Result.005 file - promoters50/1442326
ctatgctttgg

SEQ ID NO: 171666 - DNA, 11 bp, Unknown
  misc_feature (1)..( 11): Result.005 file - promoters50/1442326
acttgctgagc

SEQ ID NO: 171667 - DNA, 17 bp, Unknown
  misc_feature (1)..( 17): Result.005 file - promoters50/1442408
gaccttaaaaaatcaaa

SEQ ID NO: 171668 - DNA, 17 bp, Unknown
  misc_feature (1)..( 17): Result.005 file - promoters50/1442408
tatatcaaacaataaaa

SEQ ID NO: 171669 - DNA, 17 bp, Unknown
  misc_feature (1)..( 17): Result.005 file - promoters50/1442408
cttttgaaaaaacccaa

SEQ ID NO: 171670 - DNA, 17 bp, Unknown
  misc_feature (1)..( 17): Result.005 file - promoters50/1442408
gacattataaaatacag

SEQ ID NO: 171671 - DNA, 17 bp, Unknown
  misc_feature (1)..( 17): Result.005 file - promoters50/1442408
tttccgaataaatcttg

SEQ ID NO: 171672 - DNA, 17 bp, Unknown
  misc_feature (1)..( 17): Result.005 file - promoters50/1442408
aagcatcgacatctttt

SEQ ID NO: 171673 - DNA, 12 bp, Unknown
  misc_feature (1)..( 12): Result.005 file - promoters50/1442408
gactctttttct

SEQ ID NO: 171674 - DNA, 12 bp, Unknown
  misc_feature (1)..( 12): Result.005 file - promoters50/1442408
gcttcttttaca

SEQ ID NO: 171675 - DNA, 12 bp, Unknown
  misc_feature (1)..( 12): Result.005 file - promoters50/1442408
gtctctttttct

SEQ ID NO: 171676 - DNA, 12 bp, Unknown
  misc_feature (1)..( 12): Result.005 file - promoters50/1442408
gacactttagaa

SEQ ID NO: 171677 - DNA, 12 bp, Unknown
  misc_feature (1)..( 12): Result.005 file - promoters50/1442408
ttctctttttct

SEQ ID NO: 171678 - DNA, 12 bp, Unknown
  misc_feature (1)..( 12): Result.005 file - promoters50/1442408
ccttcctttgat

SEQ ID NO: 171679 - DNA, 8 bp, Unknown
  misc_feature (1)..( 8): Result.005 file - promoters50/1442423
attatttg

SEQ ID NO: 171680 - DNA, 8 bp, Unknown
  misc_feature (1)..( 8): Result.005 file - promoters50/1442423
attctttt

SEQ ID NO: 171681 - DNA, 8 bp, Unknown
  misc_feature (1)..( 8): Result.005 file - promoters50/1442423
cttctttt

SEQ ID NO: 171682 - DNA, 8 bp, Unknown
  misc_feature (1)..( 8): Result.005 file - promoters50/1442423
tgaaaatc

SEQ ID NO: 171683 - DNA, 8 bp, Unknown
  misc_feature (1)..( 8): Result.005 file - promoters50/1442423
ataaaatc

SEQ ID NO: 171684 - DNA, 8 bp, Unknown
  misc_feature (1)..( 8): Result.005 file - promoters50/1442423
atacaatt

SEQ ID NO: 171685 - DNA, 6 bp, Unknown
  misc_feature (1)..( 6): Result.005 file - promoters50/1442423
tataaa

SEQ ID NO: 171686 - DNA, 6 bp, Unknown
  misc_feature (1)..( 6): Result.005 file - promoters50/1442423
tataaa

SEQ ID NO: 171687 - DNA, 6 bp, Unknown
  misc_feature (1)..( 6): Result.005 file - promoters50/1442423
tataaa

SEQ ID NO: 171688 - DNA, 10 bp, Unknown
  misc_feature (1)..( 10): Result.005 file - promoters50/1442423
acgaaagtta

SEQ ID NO: 171689 - DNA, 10 bp, Unknown
  misc_feature (1)..( 10): Result.005 file - promoters50/1442423
ataaaattta

SEQ ID NO: 171690 - DNA, 10 bp, Unknown
  misc_feature (1)..( 10): Result.005 file - promoters50/1442423
atataatttt

SEQ ID NO: 171691 - DNA, 8 bp, Unknown
  misc_feature (1)..( 8): Result.005 file - promoters50/1442423
tctttact

SEQ ID NO: 171692 - DNA, 8 bp, Unknown
  misc_feature (1)..( 8): Result.005 file - promoters50/1442423
tctttaat

SEQ ID NO: 171693 - DNA, 8 bp, Unknown
  misc_feature (1)..( 8): Result.005 file - promoters50/1442423
tctataat

SEQ ID NO: 171694 - DNA, 10 bp, Unknown
  misc_feature (1)..( 10): Result.005 file - promoters50/1442427
taaatttaaa

SEQ ID NO: 171695 - DNA, 10 bp, Unknown
  misc_feature (1)..( 10): Result.005 file - promoters50/1442427
taaatttgct

SEQ ID NO: 171696 - DNA, 10 bp, Unknown
  misc_feature (1)..( 10): Result.005 file - promoters50/1442427
tgaatctgct

SEQ ID NO: 171697 - DNA, 18 bp, Unknown
  misc_feature (1)..( 18): Result.005 file - promoters50/1442452
tttatattttagctgtct

SEQ ID NO: 171698 - DNA, 18 bp, Unknown
  misc_feature (1)..( 18): Result.005 file - promoters50/1442452
tttgtattttagagaaat

SEQ ID NO: 171699 - DNA, 18 bp, Unknown
  misc_feature (1)..( 18): Result.005 file - promoters50/1442452
aatcatgtttagaaaaat

SEQ ID NO: 171700 - DNA, 10 bp, Unknown
  misc_feature (1)..( 10): Result.005 file - promoters50/1442452
tcattttaaa

SEQ ID NO: 171701 - DNA, 10 bp, Unknown
  misc_feature (1)..( 10): Result.005 file - promoters50/1442452
aattttgaaa

SEQ ID NO: 171702 - DNA, 10 bp, Unknown
  misc_feature (1)..( 10): Result.005 file - promoters50/1442452
aattttgatg

SEQ ID NO: 171703 - DNA, 10 bp, Unknown
  misc_feature (1)..( 10): Result.005 file - promoters50/1442452
aaactgttag

SEQ ID NO: 171704 - DNA, 10 bp, Unknown
  misc_feature (1)..( 10): Result.005 file - promoters50/1442452
aaaatgttag

SEQ ID NO: 171705 - DNA, 10 bp, Unknown
  misc_feature (1)..( 10): Result.005 file - promoters50/1442452
taaattttaa

SEQ ID NO: 171706 - DNA, 8 bp, Unknown
  misc_feature (1)..( 8): Result.005 file - promoters50/1442452
actataaa

SEQ ID NO: 171707 - DNA, 8 bp, Unknown
  misc_feature (1)..( 8): Result.005 file - promoters50/1442452
tatataaa

SEQ ID NO: 171708 - DNA, 8 bp, Unknown
  misc_feature (1)..( 8): Result.005 file - promoters50/1442452
tatataat

SEQ ID NO: 171709 - DNA, 11 bp, Unknown
  misc_feature (1)..( 11): Result.005 file - promoters50/1442452
tttcaacggtt

SEQ ID NO: 171710 - DNA, 11 bp, Unknown
  misc_feature (1)..( 11): Result.005 file - promoters50/1442452
atccaacggca

SEQ ID NO: 171711 - DNA, 11 bp, Unknown
  misc_feature (1)..( 11): Result.005 file - promoters50/1442452
atcgaacagca

SEQ ID NO: 171712 - DNA, 9 bp, Unknown
  misc_feature (1)..( 9): Result.005 file - promoters50/1442468
ttttgtttg

SEQ ID NO: 171713 - DNA, 9 bp, Unknown
  misc_feature (1)..( 9): Result.005 file - promoters50/1442468
attttttta

SEQ ID NO: 171714 - DNA, 9 bp, Unknown
  misc_feature (1)..( 9): Result.005 file - promoters50/1442468
atttttttg

SEQ ID NO: 171715 - DNA, 9 bp, Unknown
  misc_feature (1)..( 9): Result.005 file - promoters50/1442468
gttttttct

SEQ ID NO: 171716 - DNA, 9 bp, Unknown
  misc_feature (1)..( 9): Result.005 file - promoters50/1442468
atttcttca

SEQ ID NO: 171717 - DNA, 9 bp, Unknown
  misc_feature (1)..( 9): Result.005 file - promoters50/1442468
attgcttat

SEQ ID NO: 171718 - DNA, 9 bp, Unknown
  misc_feature (1)..( 9): Result.005 file - promoters50/1442468
cctaaacat

SEQ ID NO: 171719 - DNA, 9 bp, Unknown
  misc_feature (1)..( 9): Result.005 file - promoters50/1442468
tctaaacaa

SEQ ID NO: 171720 - DNA, 9 bp, Unknown
  misc_feature (1)..( 9): Result.005 file - promoters50/1442468
gttaaacat

SEQ ID NO: 171721 - DNA, 9 bp, Unknown
  misc_feature (1)..( 9): Result.005 file - promoters50/1442468
ccttaacaa

SEQ ID NO: 171722 - DNA, 9 bp, Unknown
  misc_feature (1)..( 9): Result.005 file - promoters50/1442468
cataagcat

SEQ ID NO: 171723 - DNA, 16 bp, Unknown
  misc_feature (1)..( 16): Result.005 file - promoters50/1442468
tggttttggtttttgt

SEQ ID NO: 171724 - DNA, 16 bp, Unknown
  misc_feature (1)..( 16): Result.005 file - promoters50/1442468
agtcttttgtttttgt

SEQ ID NO: 171725 - DNA, 16 bp, Unknown
  misc_feature (1)..( 16): Result.005 file - promoters50/1442468
tctctaatttttatgt

SEQ ID NO: 171726 - DNA, 16 bp, Unknown
  misc_feature (1)..( 16): Result.005 file - promoters50/1442468
ataatttcgtttctca

SEQ ID NO: 171727 - DNA, 16 bp, Unknown
  misc_feature (1)..( 16): Result.005 file - promoters50/1442468
ataaattcttttctta

SEQ ID NO: 171728 - DNA, 10 bp, Unknown
  misc_feature (1)..( 10): Result.005 file - promoters50/1442468
cgtatgtaaa

SEQ ID NO: 171729 - DNA, 10 bp, Unknown
  misc_feature (1)..( 10): Result.005 file - promoters50/1442468
aaattgtaaa

SEQ ID NO: 171730 - DNA, 10 bp, Unknown
  misc_feature (1)..( 10): Result.005 file - promoters50/1442468
aaattataat

SEQ ID NO: 171731 - DNA, 10 bp, Unknown
  misc_feature (1)..( 10): Result.005 file - promoters50/1442468
aaaatatata

SEQ ID NO: 171732 - DNA, 10 bp, Unknown
  misc_feature (1)..( 10): Result.005 file - promoters50/1442468
aattgatatt

SEQ ID NO: 171733 - DNA, 10 bp, Unknown
  misc_feature (1)..( 10): Result.005 file - promoters50/1442468
gaaacaggcc

SEQ ID NO: 171734 - DNA, 10 bp, Unknown
  misc_feature (1)..( 10): Result.005 file - promoters50/1442468
gaaacaaaaa

SEQ ID NO: 171735 - DNA, 10 bp, Unknown
  misc_feature (1)..( 10): Result.005 file - promoters50/1442468
aaaacagcaa

SEQ ID NO: 171736 - DNA, 10 bp, Unknown
  misc_feature (1)..( 10): Result.005 file - promoters50/1442468
taaaaaaaaa

SEQ ID NO: 171737 - DNA, 10 bp, Unknown
  misc_feature (1)..( 10): Result.005 file - promoters50/1442468
aaaacataac

SEQ ID NO: 171738 - DNA, 13 bp, Unknown
  misc_feature (1)..( 13): Result.005 file - promoters50/1442476
ccaatcataaaag

SEQ ID NO: 171739 - DNA, 13 bp, Unknown
  misc_feature (1)..( 13): Result.005 file - promoters50/1442476
agaatcattaatc

SEQ ID NO: 171740 - DNA, 13 bp, Unknown
  misc_feature (1)..( 13): Result.005 file - promoters50/1442476
tggatctttagat

SEQ ID NO: 171741 - DNA, 13 bp, Unknown
  misc_feature (1)..( 13): Result.005 file - promoters50/1442476
agagtcaaaattt

SEQ ID NO: 171742 - DNA, 13 bp, Unknown
  misc_feature (1)..( 13): Result.005 file - promoters50/1442476
tgcttctttggat

SEQ ID NO: 171743 - DNA, 13 bp, Unknown
  misc_feature (1)..( 13): Result.005 file - promoters50/1442476
gaattctttcaaa

SEQ ID NO: 171744 - DNA, 13 bp, Unknown
  misc_feature (1)..( 13): Result.005 file - promoters50/1442476
ctcgtataattct

SEQ ID NO: 171745 - DNA, 13 bp, Unknown
  misc_feature (1)..( 13): Result.005 file - promoters50/1442476
ctcttatgatttg

SEQ ID NO: 171746 - DNA, 13 bp, Unknown
  misc_feature (1)..( 13): Result.005 file - promoters50/1442476
tgtgtatcattct

SEQ ID NO: 171747 - DNA, 13 bp, Unknown
  misc_feature (1)..( 13): Result.005 file - promoters50/1442476
cttccatgttttt

SEQ ID NO: 171748 - DNA, 13 bp, Unknown
  misc_feature (1)..( 13): Result.005 file - promoters50/1442476
tgagtttgatttg

SEQ ID NO: 171749 - DNA, 13 bp, Unknown
  misc_feature (1)..( 13): Result.005 file - promoters50/1442476
ttcttattggaag

SEQ ID NO: 171750 - DNA, 13 bp, Unknown
  misc_feature (1)..( 13): Result.005 file - promoters50/1442476
ctcttaaaagtct

SEQ ID NO: 171751 - DNA, 13 bp, Unknown
  misc_feature (1)..( 13): Result.005 file - promoters50/1442476
aagaaaaaaaaaa

SEQ ID NO: 171752 - DNA, 13 bp, Unknown
  misc_feature (1)..( 13): Result.005 file - promoters50/1442476
aagaaacaaagta

SEQ ID NO: 171753 - DNA, 13 bp, Unknown
  misc_feature (1)..( 13): Result.005 file - promoters50/1442476
tccaaacaaaaca

SEQ ID NO: 171754 - DNA, 13 bp, Unknown
  misc_feature (1)..( 13): Result.005 file - promoters50/1442476
ttcaatcaaatcg

SEQ ID NO: 171755 - DNA, 13 bp, Unknown
  misc_feature (1)..( 13): Result.005 file - promoters50/1442476
ataaaaccaagac

SEQ ID NO: 171756 - DNA, 13 bp, Unknown
  misc_feature (1)..( 13): Result.005 file - promoters50/1442476
cagacaccaagac

SEQ ID NO: 171757 - DNA, 13 bp, Unknown
  misc_feature (1)..( 13): Result.005 file - promoters50/1442504
gaagtgatgacca

SEQ ID NO: 171758 - DNA, 13 bp, Unknown
  misc_feature (1)..( 13): Result.005 file - promoters50/1442504
gaagtgaagacca

SEQ ID NO: 171759 - DNA, 13 bp, Unknown
  misc_feature (1)..( 13): Result.005 file - promoters50/1442504
cctttgatgattg

SEQ ID NO: 171760 - DNA, 13 bp, Unknown
  misc_feature (1)..( 13): Result.005 file - promoters50/1442504
gttaggatcattc

SEQ ID NO: 171761 - DNA, 13 bp, Unknown
  misc_feature (1)..( 13): Result.005 file - promoters50/1442504
atccggatcagga

SEQ ID NO: 171762 - DNA, 13 bp, Unknown
  misc_feature (1)..( 13): Result.005 file - promoters50/1442504
acatggattattc

SEQ ID NO: 171763 - DNA, 8 bp, Unknown
  misc_feature (1)..( 8): Result.005 file - promoters50/1442544
aaagttga

SEQ ID NO: 171764 - DNA, 8 bp, Unknown
  misc_feature (1)..( 8): Result.005 file - promoters50/1442544
aaagttat

SEQ ID NO: 171765 - DNA, 8 bp, Unknown
  misc_feature (1)..( 8): Result.005 file - promoters50/1442544
gaagttga

SEQ ID NO: 171766 - DNA, 9 bp, Unknown
  misc_feature (1)..( 9): Result.005 file - promoters50/1442544
agaaaacta

SEQ ID NO: 171767 - DNA, 9 bp, Unknown
  misc_feature (1)..( 9): Result.005 file - promoters50/1442544
agaaaactc

SEQ ID NO: 171768 - DNA, 9 bp, Unknown
  misc_feature (1)..( 9): Result.005 file - promoters50/1442544
cagaaacta

SEQ ID NO: 171769 - DNA, 12 bp, Unknown
  misc_feature (1)..( 12): Result.005 file - promoters50/1442548
gcccaaatttaa

SEQ ID NO: 171770 - DNA, 12 bp, Unknown
  misc_feature (1)..( 12): Result.005 file - promoters50/1442548
tactatatttaa

SEQ ID NO: 171771 - DNA, 12 bp, Unknown
  misc_feature (1)..( 12): Result.005 file - promoters50/1442548
tttcacatttca

SEQ ID NO: 171772 - DNA, 12 bp, Unknown
  misc_feature (1)..( 12): Result.005 file - promoters50/1442548
taatgtatctaa

SEQ ID NO: 171773 - DNA, 9 bp, Unknown
  misc_feature (1)..( 9): Result.005 file - promoters50/1442548
aataacaat

SEQ ID NO: 171774 - DNA, 9 bp, Unknown
  misc_feature (1)..( 9): Result.005 file - promoters50/1442548
cctaagaat

SEQ ID NO: 171775 - DNA, 9 bp, Unknown
  misc_feature (1)..( 9): Result.005 file - promoters50/1442548
aataacaat

SEQ ID NO: 171776 - DNA, 13 bp, Unknown
  misc_feature (1)..( 13): Result.005 file - promoters50/1442548
cttggttggaact

SEQ ID NO: 171777 - DNA, 13 bp, Unknown
  misc_feature (1)..( 13): Result.005 file - promoters50/1442548
atcttttgtaact

SEQ ID NO: 171778 - DNA, 13 bp, Unknown
  misc_feature (1)..( 13): Result.005 file - promoters50/1442548
atcttttgtagac

SEQ ID NO: 171779 - DNA, 7 bp, Unknown
  misc_feature (1)..( 7): Result.005 file - promoters50/1442552
aaaattc

SEQ ID NO: 171780 - DNA, 7 bp, Unknown
  misc_feature (1)..( 7): Result.005 file - promoters50/1442552
aaaattg

SEQ ID NO: 171781 - DNA, 7 bp, Unknown
  misc_feature (1)..( 7): Result.005 file - promoters50/1442552
gaaattc

SEQ ID NO: 171782 - DNA, 20 bp, Unknown
  misc_feature (1)..( 20): Result.005 file - promoters50/1442592
tccacgtcatcaatcctcgt

SEQ ID NO: 171783 - DNA, 20 bp, Unknown
  misc_feature (1)..( 20): Result.005 file - promoters50/1442592
ggatcgttatctgcaaccgt

SEQ ID NO: 171784 - DNA, 20 bp, Unknown
  misc_feature (1)..( 20): Result.005 file - promoters50/1442592
cccatctcatcgatcctcgt

SEQ ID NO: 171785 - DNA, 20 bp, Unknown
  misc_feature (1)..( 20): Result.005 file - promoters50/1442592
tccacgtcacgcatccgcgt

SEQ ID NO: 171786 - DNA, 20 bp, Unknown
  misc_feature (1)..( 20): Result.005 file - promoters50/1442592
ataacattatctaacggtga

SEQ ID NO: 171787 - DNA, 20 bp, Unknown
  misc_feature (1)..( 20): Result.005 file - promoters50/1442592
tccgcgtgattgtttattat

SEQ ID NO: 171788 - DNA, 12 bp, Unknown
  misc_feature (1)..( 12): Result.005 file - promoters50/1442592
atatatacatga

SEQ ID NO: 171789 - DNA, 12 bp, Unknown
  misc_feature (1)..( 12): Result.005 file - promoters50/1442592
gtatataaatga

SEQ ID NO: 171790 - DNA, 12 bp, Unknown
  misc_feature (1)..( 12): Result.005 file - promoters50/1442592
ttatataaacaa

SEQ ID NO: 171791 - DNA, 12 bp, Unknown
  misc_feature (1)..( 12): Result.005 file - promoters50/1442592
gtatatataata

SEQ ID NO: 171792 - DNA, 12 bp, Unknown
  misc_feature (1)..( 12): Result.005 file - promoters50/1442592
gtatataaactc

SEQ ID NO: 171793 - DNA, 12 bp, Unknown
  misc_feature (1)..( 12): Result.005 file - promoters50/1442592
ataaatatcccc

SEQ ID NO: 171794 - DNA, 12 bp, Unknown
  misc_feature (1)..( 12): Result.005 file - promoters50/1442592
tactataaaatc

SEQ ID NO: 171795 - DNA, 12 bp, Unknown
  misc_feature (1)..( 12): Result.005 file - promoters50/1442592
ccccataaaagc

SEQ ID NO: 171796 - DNA, 11 bp, Unknown
  misc_feature (1)..( 11): Result.005 file - promoters50/1442592
aaaagagatta

SEQ ID NO: 171797 - DNA, 11 bp, Unknown
  misc_feature (1)..( 11): Result.005 file - promoters50/1442592
tagagaaattc

SEQ ID NO: 171798 - DNA, 11 bp, Unknown
  misc_feature (1)..( 11): Result.005 file - promoters50/1442592
acaacaaattc

SEQ ID NO: 171799 - DNA, 11 bp, Unknown
  misc_feature (1)..( 11): Result.005 file - promoters50/1442592
tttagaaaaat

SEQ ID NO: 171800 - DNA, 11 bp, Unknown
  misc_feature (1)..( 11): Result.005 file - promoters50/1442592
gtaagaaatcc

SEQ ID NO: 171801 - DNA, 11 bp, Unknown
  misc_feature (1)..( 11): Result.005 file - promoters50/1442592
aaaaggaatga

SEQ ID NO: 171802 - DNA, 13 bp, Unknown
  misc_feature (1)..( 13): Result.005 file - promoters50/1442592
ctatttttagggt

SEQ ID NO: 171803 - DNA, 13 bp, Unknown
  misc_feature (1)..( 13): Result.005 file - promoters50/1442592
ttatttttgaaga

SEQ ID NO: 171804 - DNA, 13 bp, Unknown
  misc_feature (1)..( 13): Result.005 file - promoters50/1442592
atattttaattca

SEQ ID NO: 171805 - DNA, 13 bp, Unknown
  misc_feature (1)..( 13): Result.005 file - promoters50/1442592
tcattttaaatca

SEQ ID NO: 171806 - DNA, 13 bp, Unknown
  misc_feature (1)..( 13): Result.005 file - promoters50/1442592
ttagtttgaatcg

SEQ ID NO: 171807 - DNA, 13 bp, Unknown
  misc_feature (1)..( 13): Result.005 file - promoters50/1442592
ttattttacttaa

SEQ ID NO: 171808 - DNA, 19 bp, Unknown
  misc_feature (1)..( 19): Result.005 file - promoters50/1442592
cttgtgttaaatatgaata

SEQ ID NO: 171809 - DNA, 19 bp, Unknown
  misc_feature (1)..( 19): Result.005 file - promoters50/1442592
aaaatgttagataggaaaa

SEQ ID NO: 171810 - DNA, 19 bp, Unknown
  misc_feature (1)..( 19): Result.005 file - promoters50/1442592
aaactgttagtgcaagcct

SEQ ID NO: 171811 - DNA, 19 bp, Unknown
  misc_feature (1)..( 19): Result.005 file - promoters50/1442592
taaattttaaaattattca

SEQ ID NO: 171812 - DNA, 19 bp, Unknown
  misc_feature (1)..( 19): Result.005 file - promoters50/1442592
tgagaaatagatttgaaaa

SEQ ID NO: 171813 - DNA, 20 bp, Unknown
  misc_feature (1)..( 20): Result.005 file - promoters50/1442592
taaattttgaaataatttca

SEQ ID NO: 171814 - DNA, 20 bp, Unknown
  misc_feature (1)..( 20): Result.005 file - promoters50/1442592
taagcccagaaaaagctgat

SEQ ID NO: 171815 - DNA, 11 bp, Unknown
  misc_feature (1)..( 11): Result.005 file - promoters50/1442592
tttcgatgtat

SEQ ID NO: 171816 - DNA, 11 bp, Unknown
  misc_feature (1)..( 11): Result.005 file - promoters50/1442592
ttttgatgaat

SEQ ID NO: 171817 - DNA, 11 bp, Unknown
  misc_feature (1)..( 11): Result.005 file - promoters50/1442592
ttttgaagaat

SEQ ID NO: 171818 - DNA, 11 bp, Unknown
  misc_feature (1)..( 11): Result.005 file - promoters50/1442592
gtttgaatcgt

SEQ ID NO: 171819 - DNA, 11 bp, Unknown
  misc_feature (1)..( 11): Result.005 file - promoters50/1442592
atttgctgaat

SEQ ID NO: 171820 - DNA, 11 bp, Unknown
  misc_feature (1)..( 11): Result.005 file - promoters50/1442592
ttttaattcat

SEQ ID NO: 171821 - DNA, 12 bp, Unknown
  misc_feature (1)..( 12): Result.005 file - promoters50/1442592
cattttaaatca

SEQ ID NO: 171822 - DNA, 12 bp, Unknown
  misc_feature (1)..( 12): Result.005 file - promoters50/1442592
attttgaaagag

SEQ ID NO: 171823 - DNA, 12 bp, Unknown
  misc_feature (1)..( 12): Result.005 file - promoters50/1442592
agtttgaatcgt

SEQ ID NO: 171824 - DNA, 12 bp, Unknown
  misc_feature (1)..( 12): Result.005 file - promoters50/1442592
tattttaattca

SEQ ID NO: 171825 - DNA, 12 bp, Unknown
  misc_feature (1)..( 12): Result.005 file - promoters50/1442592
aattttgatgaa

SEQ ID NO: 171826 - DNA, 12 bp, Unknown
  misc_feature (1)..( 12): Result.005 file - promoters50/1442592
gatttgctgaat

SEQ ID NO: 171827 - DNA, 14 bp, Unknown
  misc_feature (1)..( 14): Result.005 file - promoters50/1442649
cacatttgttcaac

SEQ ID NO: 171828 - DNA, 14 bp, Unknown
  misc_feature (1)..( 14): Result.005 file - promoters50/1442649
ttaaatagttcaaa

SEQ ID NO: 171829 - DNA, 14 bp, Unknown
  misc_feature (1)..( 14): Result.005 file - promoters50/1442649
ttgcaatgttaaac

SEQ ID NO: 171830 - DNA, 14 bp, Unknown
  misc_feature (1)..( 14): Result.005 file - promoters50/1442649
atcagatgtacaag

SEQ ID NO: 171831 - DNA, 14 bp, Unknown
  misc_feature (1)..( 14): Result.005 file - promoters50/1442649
atgcataattcaac

SEQ ID NO: 171832 - DNA, 14 bp, Unknown
  misc_feature (1)..( 14): Result.005 file - promoters50/1442649
atattatgctaaat

SEQ ID NO: 171833 - DNA, 14 bp, Unknown
  misc_feature (1)..( 14): Result.005 file - promoters50/1442649
tatactaatttaac

SEQ ID NO: 171834 - DNA, 14 bp, Unknown
  misc_feature (1)..( 14): Result.005 file - promoters50/1442649
tgaatcaattaaac

SEQ ID NO: 171835 - DNA, 13 bp, Unknown
  misc_feature (1)..( 13): Result.005 file - promoters50/1442649
tcaatctttgtac

SEQ ID NO: 171836 - DNA, 13 bp, Unknown
  misc_feature (1)..( 13): Result.005 file - promoters50/1442649
aaaatctttgtag

SEQ ID NO: 171837 - DNA, 13 bp, Unknown
  misc_feature (1)..( 13): Result.005 file - promoters50/1442649
atttcatttatac

SEQ ID NO: 171838 - DNA, 13 bp, Unknown
  misc_feature (1)..( 13): Result.005 file - promoters50/1442649
tcaatctttcaaa

SEQ ID NO: 171839 - DNA, 13 bp, Unknown
  misc_feature (1)..( 13): Result.005 file - promoters50/1442649
aatggggttatac

SEQ ID NO: 171840 - DNA, 13 bp, Unknown
  misc_feature (1)..( 13): Result.005 file - promoters50/1442649
cgaaagatctgaa

SEQ ID NO: 171841 - DNA, 8 bp, Unknown
  misc_feature (1)..( 8): Result.005 file - promoters50/1442649
aaaacaat

SEQ ID NO: 171842 - DNA, 8 bp, Unknown
  misc_feature (1)..( 8): Result.005 file - promoters50/1442649
gaaacaaa

SEQ ID NO: 171843 - DNA, 9 bp, Unknown
  misc_feature (1)..( 9): Result.005 file - promoters50/1442649
aaaactaat

SEQ ID NO: 171844 - DNA, 9 bp, Unknown
  misc_feature (1)..( 9): Result.005 file - promoters50/1442649
ttaacaaat

SEQ ID NO: 171845 - DNA, 9 bp, Unknown
  misc_feature (1)..( 9): Result.005 file - promoters50/1442649
ctaaccata

SEQ ID NO: 171846 - DNA, 9 bp, Unknown
  misc_feature (1)..( 9): Result.005 file - promoters50/1442649
tgaaccatt

SEQ ID NO: 171847 - DNA, 14 bp, Unknown
  misc_feature (1)..( 14): Result.005 file - promoters50/1442777
gtccataacttgaa

SEQ ID NO: 171848 - DNA, 14 bp, Unknown
  misc_feature (1)..( 14): Result.005 file - promoters50/1442777
atgtataactaagc

SEQ ID NO: 171849 - DNA, 14 bp, Unknown
  misc_feature (1)..( 14): Result.005 file - promoters50/1442777
atgtataactttat

SEQ ID NO: 171850 - DNA, 14 bp, Unknown
  misc_feature (1)..( 14): Result.005 file - promoters50/1442777
atttgtaacttcag

SEQ ID NO: 171851 - DNA, 14 bp, Unknown
  misc_feature (1)..( 14): Result.005 file - promoters50/1442777
caaaatatctttat

SEQ ID NO: 171852 - DNA, 14 bp, Unknown
  misc_feature (1)..( 14): Result.005 file - promoters50/1442777
atgtatataccaca

SEQ ID NO: 171853 - DNA, 11 bp, Unknown
  misc_feature (1)..( 11): Result.005 file - promoters50/1442777
tgtatataaac

SEQ ID NO: 171854 - DNA, 11 bp, Unknown
  misc_feature (1)..( 11): Result.005 file - promoters50/1442777
tatatatacat

SEQ ID NO: 171855 - DNA, 11 bp, Unknown
  misc_feature (1)..( 11): Result.005 file - promoters50/1442777
tgtatataaat

SEQ ID NO: 171856 - DNA, 11 bp, Unknown
  misc_feature (1)..( 11): Result.005 file - promoters50/1442777
tttatatatta

SEQ ID NO: 171857 - DNA, 11 bp, Unknown
  misc_feature (1)..( 11): Result.005 file - promoters50/1442777
tatatataata

SEQ ID NO: 171858 - DNA, 11 bp, Unknown
  misc_feature (1)..( 11): Result.005 file - promoters50/1442777
tacctataaat

SEQ ID NO: 171859 - DNA, 10 bp, Unknown
  misc_feature (1)..( 10): Result.005 file - promoters50/1442777
aaatctgatg

SEQ ID NO: 171860 - DNA, 10 bp, Unknown
  misc_feature (1)..( 10): Result.005 file - promoters50/1442777
taatgtgaca

SEQ ID NO: 171861 - DNA, 10 bp, Unknown
  misc_feature (1)..( 10): Result.005 file - promoters50/1442777
taatgtaatt

SEQ ID NO: 171862 - DNA, 10 bp, Unknown
  misc_feature (1)..( 10): Result.005 file - promoters50/1442777
taatgcgacc

SEQ ID NO: 171863 - DNA, 10 bp, Unknown
  misc_feature (1)..( 10): Result.005 file - promoters50/1442777
ttgtgtcaca

SEQ ID NO: 171864 - DNA, 10 bp, Unknown
  misc_feature (1)..( 10): Result.005 file - promoters50/1442777
ttttgggtca

SEQ ID NO: 171865 - DNA, 15 bp, Unknown
  misc_feature (1)..( 15): Result.005 file - promoters50/1442777
aaattaatattgtca

SEQ ID NO: 171866 - DNA, 15 bp, Unknown
  misc_feature (1)..( 15): Result.005 file - promoters50/1442777
gaaataattttgttt

SEQ ID NO: 171867 - DNA, 15 bp, Unknown
  misc_feature (1)..( 15): Result.005 file - promoters50/1442777
atgtaaattttgaaa

SEQ ID NO: 171868 - DNA, 15 bp, Unknown
  misc_feature (1)..( 15): Result.005 file - promoters50/1442777
tctaaaatattgttc

SEQ ID NO: 171869 - DNA, 15 bp, Unknown
  misc_feature (1)..( 15): Result.005 file - promoters50/1442777
aaagtaagattttca

SEQ ID NO: 171870 - DNA, 15 bp, Unknown
  misc_feature (1)..( 15): Result.005 file - promoters50/1442777
ggctttttttagttg

SEQ ID NO: 171871 - DNA, 20 bp, Unknown
  misc_feature (1)..( 20): Result.005 file - promoters50/1442777
tcaagctgaatggtccataa

SEQ ID NO: 171872 - DNA, 20 bp, Unknown
  misc_feature (1)..( 20): Result.005 file - promoters50/1442777
tcaggctaaatttgttatgt

SEQ ID NO: 171873 - DNA, 20 bp, Unknown
  misc_feature (1)..( 20): Result.005 file - promoters50/1442777
gatgtataactttatgttat

SEQ ID NO: 171874 - DNA, 20 bp, Unknown
  misc_feature (1)..( 20): Result.005 file - promoters50/1442777
ccaaaatatctttataagta

SEQ ID NO: 171875 - DNA, 20 bp, Unknown
  misc_feature (1)..( 20): Result.005 file - promoters50/1442777
tattatacgttttaaaagta

SEQ ID NO: 171876 - DNA, 20 bp, Unknown
  misc_feature (1)..( 20): Result.005 file - promoters50/1442777
attagaaaaaagtcttgggt

SEQ ID NO: 171877 - DNA, 10 bp, Unknown
  misc_feature (1)..( 10): Result.005 file - promoters50/1442848
atttcaaatt

SEQ ID NO: 171878 - DNA, 10 bp, Unknown
  misc_feature (1)..( 10): Result.005 file - promoters50/1442848
attacaaaaa

SEQ ID NO: 171879 - DNA, 11 bp, Unknown
  misc_feature (1)..( 11): Result.005 file - promoters50/1442848
tttaccaaatt

SEQ ID NO: 171880 - DNA, 11 bp, Unknown
  misc_feature (1)..( 11): Result.005 file - promoters50/1442848
atcacctaatt

SEQ ID NO: 171881 - DNA, 11 bp, Unknown
  misc_feature (1)..( 11): Result.005 file - promoters50/1442887
gatcataatta

SEQ ID NO: 171882 - DNA, 11 bp, Unknown
  misc_feature (1)..( 11): Result.005 file - promoters50/1442887
ttacatgatta

SEQ ID NO: 171883 - DNA, 11 bp, Unknown
  misc_feature (1)..( 11): Result.005 file - promoters50/1442887
ttatatgatcg

SEQ ID NO: 171884 - DNA, 6 bp, Unknown
  misc_feature (1)..( 6): Result.005 file - promoters50/1442887
ttgggt

SEQ ID NO: 171885 - DNA, 6 bp, Unknown
  misc_feature (1)..( 6): Result.005 file - promoters50/1442887
ttgggt

SEQ ID NO: 171886 - DNA, 6 bp, Unknown
  misc_feature (1)..( 6): Result.005 file - promoters50/1442887
ttgggt

SEQ ID NO: 171887 - DNA, 7 bp, Unknown
  misc_feature (1)..( 7): Result.005 file - promoters50/1442887
tatatca

SEQ ID NO: 171888 - DNA, 7 bp, Unknown
  misc_feature (1)..( 7): Result.005 file - promoters50/1442887
aatatca

SEQ ID NO: 171889 - DNA, 7 bp, Unknown
  misc_feature (1)..( 7): Result.005 file - promoters50/1442887
aatatct

SEQ ID NO: 171890 - DNA, 8 bp, Unknown
  misc_feature (1)..( 8): Result.005 file - promoters50/1442887
attttggt

SEQ ID NO: 171891 - DNA, 8 bp, Unknown
  misc_feature (1)..( 8): Result.005 file - promoters50/1442887
tgtttggt

SEQ ID NO: 171892 - DNA, 8 bp, Unknown
  misc_feature (1)..( 8): Result.005 file - promoters50/1442887
tgttgggt

SEQ ID NO: 171893 - DNA, 9 bp, Unknown
  misc_feature (1)..( 9): Result.005 file - promoters50/1442887
gaaagaaag

SEQ ID NO: 171894 - DNA, 9 bp, Unknown
  misc_feature (1)..( 9): Result.005 file - promoters50/1442887
gaaacaaaa

SEQ ID NO: 171895 - DNA, 9 bp, Unknown
  misc_feature (1)..( 9): Result.005 file - promoters50/1442887
taaaaaaag

SEQ ID NO: 171896 - DNA, 9 bp, Unknown
  misc_feature (1)..( 9): Result.005 file - promoters50/1442887
aaagaaaag

SEQ ID NO: 171897 - DNA, 9 bp, Unknown
  misc_feature (1)..( 9): Result.005 file - promoters50/1442887
aaagtaaag

SEQ ID NO: 171898 - DNA, 9 bp, Unknown
  misc_feature (1)..( 9): Result.005 file - promoters50/1442887
taagtaaaa

SEQ ID NO: 171899 - DNA, 8 bp, Unknown
  misc_feature (1)..( 8): Result.005 file - promoters50/1442945
attataat

SEQ ID NO: 171900 - DNA, 8 bp, Unknown
  misc_feature (1)..( 8): Result.005 file - promoters50/1442945
attttaat

SEQ ID NO: 171901 - DNA, 8 bp, Unknown
  misc_feature (1)..( 8): Result.005 file - promoters50/1442945
tttataag

SEQ ID NO: 171902 - DNA, 8 bp, Unknown
  misc_feature (1)..( 8): Result.005 file - promoters50/1442945
cttttaat

SEQ ID NO: 171903 - DNA, 10 bp, Unknown
  misc_feature (1)..( 10): Result.005 file - promoters50/1442945
acataattaa

SEQ ID NO: 171904 - DNA, 10 bp, Unknown
  misc_feature (1)..( 10): Result.005 file - promoters50/1442945
ttttaattaa

SEQ ID NO: 171905 - DNA, 10 bp, Unknown
  misc_feature (1)..( 10): Result.005 file - promoters50/1442945
gaataaataa

SEQ ID NO: 171906 - DNA, 10 bp, Unknown
  misc_feature (1)..( 10): Result.005 file - promoters50/1442945
ttttcattca

SEQ ID NO: 171907 - DNA, 10 bp, Unknown
  misc_feature (1)..( 10): Result.005 file - promoters50/1442967
tgtaaaggtc

SEQ ID NO: 171908 - DNA, 10 bp, Unknown
  misc_feature (1)..( 10): Result.005 file - promoters50/1442967
gataagggta

SEQ ID NO: 171909 - DNA, 10 bp, Unknown
  misc_feature (1)..( 10): Result.005 file - promoters50/1442967
ccagaaggtc

SEQ ID NO: 171910 - DNA, 10 bp, Unknown
  misc_feature (1)..( 10): Result.005 file - promoters50/1442967
gattagggtt

SEQ ID NO: 171911 - DNA, 9 bp, Unknown
  misc_feature (1)..( 9): Result.005 file - promoters50/1442967
aaagaaacc

SEQ ID NO: 171912 - DNA, 9 bp, Unknown
  misc_feature (1)..( 9): Result.005 file - promoters50/1442967
taagaaaat

SEQ ID NO: 171913 - DNA, 9 bp, Unknown
  misc_feature (1)..( 9): Result.005 file - promoters50/1442967
aaagaaacg

SEQ ID NO: 171914 - DNA, 9 bp, Unknown
  misc_feature (1)..( 9): Result.005 file - promoters50/1442967
gtagaaaat

SEQ ID NO: 171915 - DNA, 10 bp, Unknown
  misc_feature (1)..( 10): Result.005 file - promoters50/1442967
tcaatagtta

SEQ ID NO: 171916 - DNA, 10 bp, Unknown
  misc_feature (1)..( 10): Result.005 file - promoters50/1442967
tcagtagtta

SEQ ID NO: 171917 - DNA, 10 bp, Unknown
  misc_feature (1)..( 10): Result.005 file - promoters50/1442967
taagtagtag

SEQ ID NO: 171918 - DNA, 10 bp, Unknown
  misc_feature (1)..( 10): Result.005 file - promoters50/1442967
tgagtggttt

SEQ ID NO: 171919 - DNA, 9 bp, Unknown
  misc_feature (1)..( 9): Result.005 file - promoters50/1442975
agaaaacga

SEQ ID NO: 171920 - DNA, 9 bp, Unknown
  misc_feature (1)..( 9): Result.005 file - promoters50/1442975
tgaaaacta

SEQ ID NO: 171921 - DNA, 9 bp, Unknown
  misc_feature (1)..( 9): Result.005 file - promoters50/1442975
tgaacactg

SEQ ID NO: 171922 - DNA, 9 bp, Unknown
  misc_feature (1)..( 9): Result.005 file - promoters50/1442975
tgagaacat

SEQ ID NO: 171923 - DNA, 9 bp, Unknown
  misc_feature (1)..( 9): Result.005 file - promoters50/1442975
acaaaacta

SEQ ID NO: 171924 - DNA, 11 bp, Unknown
  misc_feature (1)..( 11): Result.005 file - promoters50/1443011
aattatattat

SEQ ID NO: 171925 - DNA, 11 bp, Unknown
  misc_feature (1)..( 11): Result.005 file - promoters50/1443011
aataataatat

SEQ ID NO: 171926 - DNA, 11 bp, Unknown
  misc_feature (1)..( 11): Result.005 file - promoters50/1443011
cattttcagat

SEQ ID NO: 171927 - DNA, 11 bp, Unknown
  misc_feature (1)..( 11): Result.005 file - promoters50/1443019
tctgtttcttc

SEQ ID NO: 171928 - DNA, 11 bp, Unknown
  misc_feature (1)..( 11): Result.005 file - promoters50/1443019
ttggtttctag

SEQ ID NO: 171929 - DNA, 11 bp, Unknown
  misc_feature (1)..( 11): Result.005 file - promoters50/1443019
acggtttcttg

SEQ ID NO: 171930 - DNA, 11 bp, Unknown
  misc_feature (1)..( 11): Result.005 file - promoters50/1443019
ttggtatctat

SEQ ID NO: 171931 - DNA, 11 bp, Unknown
  misc_feature (1)..( 11): Result.005 file - promoters50/1443019
acggttttgta

SEQ ID NO: 171932 - DNA, 11 bp, Unknown
  misc_feature (1)..( 11): Result.005 file - promoters50/1443019
cttgtttattg

SEQ ID NO: 171933 - DNA, 12 bp, Unknown
  misc_feature (1)..( 12): Result.005 file - promoters50/1443021
atacaatatatc

SEQ ID NO: 171934 - DNA, 12 bp, Unknown
  misc_feature (1)..( 12): Result.005 file - promoters50/1443021
tcaaaatttatc

SEQ ID NO: 171935 - DNA, 12 bp, Unknown
  misc_feature (1)..( 12): Result.005 file - promoters50/1443021
tcagaatttgga

SEQ ID NO: 171936 - DNA, 10 bp, Unknown
  misc_feature (1)..( 10): Result.005 file - promoters50/1443021
caataaatat

SEQ ID NO: 171937 - DNA, 10 bp, Unknown
  misc_feature (1)..( 10): Result.005 file - promoters50/1443021
caacaaaagc

SEQ ID NO: 171938 - DNA, 10 bp, Unknown
  misc_feature (1)..( 10): Result.005 file - promoters50/1443021
ttatatatat

SEQ ID NO: 171939 - DNA, 8 bp, Unknown
  misc_feature (1)..( 8): Result.005 file - promoters50/1443021
ttgaaaat

SEQ ID NO: 171940 - DNA, 8 bp, Unknown
  misc_feature (1)..( 8): Result.005 file - promoters50/1443021
atgaaaac

SEQ ID NO: 171941 - DNA, 8 bp, Unknown
  misc_feature (1)..( 8): Result.005 file - promoters50/1443021
atgacaac

SEQ ID NO: 171942 - DNA, 8 bp, Unknown
  misc_feature (1)..( 8): Result.005 file - promoters50/1443021
aaaccttg

SEQ ID NO: 171943 - DNA, 8 bp, Unknown
  misc_feature (1)..( 8): Result.005 file - promoters50/1443021
aaagcttg

SEQ ID NO: 171944 - DNA, 8 bp, Unknown
  misc_feature (1)..( 8): Result.005 file - promoters50/1443021
tgagcttg

SEQ ID NO: 171945 - DNA, 12 bp, Unknown
  misc_feature (1)..( 12): Result.005 file - promoters50/1443029
aaaagtttttgt

SEQ ID NO: 171946 - DNA, 12 bp, Unknown
  misc_feature (1)..( 12): Result.005 file - promoters50/1443029
gtttgttgttgg

SEQ ID NO: 171947 - DNA, 12 bp, Unknown
  misc_feature (1)..( 12): Result.005 file - promoters50/1443029
gtatctttttgt

SEQ ID NO: 171948 - DNA, 12 bp, Unknown
  misc_feature (1)..( 12): Result.005 file - promoters50/1443029
tttagttttgta

SEQ ID NO: 171949 - DNA, 12 bp, Unknown
  misc_feature (1)..( 12): Result.005 file - promoters50/1443029
tatccttttcaa

SEQ ID NO: 171950 - DNA, 12 bp, Unknown
  misc_feature (1)..( 12): Result.005 file - promoters50/1443029
tttacttttaac

SEQ ID NO: 171951 - DNA, 9 bp, Unknown
  misc_feature (1)..( 9): Result.005 file - promoters50/1443029
tcaaaaata

SEQ ID NO: 171952 - DNA, 9 bp, Unknown
  misc_feature (1)..( 9): Result.005 file - promoters50/1443029
ttaaaaata

SEQ ID NO: 171953 - DNA, 9 bp, Unknown
  misc_feature (1)..( 9): Result.005 file - promoters50/1443029
acaaaaaag

SEQ ID NO: 171954 - DNA, 9 bp, Unknown
  misc_feature (1)..( 9): Result.005 file - promoters50/1443029
gtaaaaatt

SEQ ID NO: 171955 - DNA, 9 bp, Unknown
  misc_feature (1)..( 9): Result.005 file - promoters50/1443029
caaaacatt

SEQ ID NO: 171956 - DNA, 9 bp, Unknown
  misc_feature (1)..( 9): Result.005 file - promoters50/1443029
ttaaaaact

SEQ ID NO: 171957 - DNA, 9 bp, Unknown
  misc_feature (1)..( 9): Result.005 file - promoters50/1443029
agatttatg

SEQ ID NO: 171958 - DNA, 9 bp, Unknown
  misc_feature (1)..( 9): Result.005 file - promoters50/1443029
caatttata

SEQ ID NO: 171959 - DNA, 9 bp, Unknown
  misc_feature (1)..( 9): Result.005 file - promoters50/1443029
agatgtata

SEQ ID NO: 171960 - DNA, 9 bp, Unknown
  misc_feature (1)..( 9): Result.005 file - promoters50/1443029
aaatttacg

SEQ ID NO: 171961 - DNA, 9 bp, Unknown
  misc_feature (1)..( 9): Result.005 file - promoters50/1443029
cgatgtaaa

SEQ ID NO: 171962 - DNA, 9 bp, Unknown
  misc_feature (1)..( 9): Result.005 file - promoters50/1443029
cgatataaa

SEQ ID NO: 171963 - DNA, 10 bp, Unknown
  misc_feature (1)..( 10): Result.005 file - promoters50/1443067
gataacttta

SEQ ID NO: 171964 - DNA, 10 bp, Unknown
  misc_feature (1)..( 10): Result.005 file - promoters50/1443067
gataacctta

SEQ ID NO: 171965 - DNA, 10 bp, Unknown
  misc_feature (1)..( 10): Result.005 file - promoters50/1443067
cataagcttg

SEQ ID NO: 171966 - DNA, 9 bp, Unknown
  misc_feature (1)..( 9): Result.005 file - promoters50/1443067
aacattttg

SEQ ID NO: 171967 - DNA, 9 bp, Unknown
  misc_feature (1)..( 9): Result.005 file - promoters50/1443067
aacgttttg

SEQ ID NO: 171968 - DNA, 9 bp, Unknown
  misc_feature (1)..( 9): Result.005 file - promoters50/1443067
cacatttaa

SEQ ID NO: 171969 - DNA, 10 bp, Unknown
  misc_feature (1)..( 10): Result.005 file - promoters50/1443067
tttgaagcaa

SEQ ID NO: 171970 - DNA, 10 bp, Unknown
  misc_feature (1)..( 10): Result.005 file - promoters50/1443067
tttaaagctt

SEQ ID NO: 171971 - DNA, 10 bp, Unknown
  misc_feature (1)..( 10): Result.005 file - promoters50/1443067
aacaaagctt

SEQ ID NO: 171972 - DNA, 13 bp, Unknown
  misc_feature (1)..( 13): Result.005 file - promoters50/1443075
ttggcatttacaa

SEQ ID NO: 171973 - DNA, 13 bp, Unknown
  misc_feature (1)..( 13): Result.005 file - promoters50/1443075
aaataattttcaa

SEQ ID NO: 171974 - DNA, 13 bp, Unknown
  misc_feature (1)..( 13): Result.005 file - promoters50/1443075
aaatcattttttc

SEQ ID NO: 171975 - DNA, 9 bp, Unknown
  misc_feature (1)..( 9): Result.005 file - promoters50/1443083
tatagaaaa

SEQ ID NO: 171976 - DNA, 9 bp, Unknown
  misc_feature (1)..( 9): Result.005 file - promoters50/1443083
catataaat

SEQ ID NO: 171977 - DNA, 9 bp, Unknown
  misc_feature (1)..( 9): Result.005 file - promoters50/1443083
tatagaatg

SEQ ID NO: 171978 - DNA, 9 bp, Unknown
  misc_feature (1)..( 9): Result.005 file - promoters50/1443083
tttataaag

SEQ ID NO: 171979 - DNA, 9 bp, Unknown
  misc_feature (1)..( 9): Result.005 file - promoters50/1443083
caaataaat

SEQ ID NO: 171980 - DNA, 9 bp, Unknown
  misc_feature (1)..( 9): Result.005 file - promoters50/1443083
gaaacaaat

SEQ ID NO: 171981 - DNA, 9 bp, Unknown
  misc_feature (1)..( 9): Result.005 file - promoters50/1443083
ttaaccaat

SEQ ID NO: 171982 - DNA, 8 bp, Unknown
  misc_feature (1)..( 8): Result.005 file - promoters50/1443083
aaaaaaaa

SEQ ID NO: 171983 - DNA, 8 bp, Unknown
  misc_feature (1)..( 8): Result.005 file - promoters50/1443083
aaataaaa

SEQ ID NO: 171984 - DNA, 8 bp, Unknown
  misc_feature (1)..( 8): Result.005 file - promoters50/1443083
aaataaat

SEQ ID NO: 171985 - DNA, 8 bp, Unknown
  misc_feature (1)..( 8): Result.005 file - promoters50/1443083
aaacaaat

SEQ ID NO: 171986 - DNA, 8 bp, Unknown
  misc_feature (1)..( 8): Result.005 file - promoters50/1443083
taaccaat

SEQ ID NO: 171987 - DNA, 8 bp, Unknown
  misc_feature (1)..( 8): Result.005 file - promoters50/1443083
taaccata

SEQ ID NO: 171988 - DNA, 19 bp, Unknown
  misc_feature (1)..( 19): Result.005 file - promoters50/1443083
aatcattaacaaatacgaa

SEQ ID NO: 171989 - DNA, 19 bp, Unknown
  misc_feature (1)..( 19): Result.005 file - promoters50/1443083
ttgaggaaacaaatttttt

SEQ ID NO: 171990 - DNA, 19 bp, Unknown
  misc_feature (1)..( 19): Result.005 file - promoters50/1443083
cacaaaagacaaataaatc

SEQ ID NO: 171991 - DNA, 19 bp, Unknown
  misc_feature (1)..( 19): Result.005 file - promoters50/1443083
aatccttaaccaataagat

SEQ ID NO: 171992 - DNA, 17 bp, Unknown
  misc_feature (1)..( 17): Result.005 file - promoters50/1443083
acaaaaacaaattgttt

SEQ ID NO: 171993 - DNA, 19 bp, Unknown
  misc_feature (1)..( 19): Result.005 file - promoters50/1443083
aatggctaaccatatttga

SEQ ID NO: 171994 - DNA, 10 bp, Unknown
  misc_feature (1)..( 10): Result.005 file - promoters50/1443083
aaaaaaaata

SEQ ID NO: 171995 - DNA, 10 bp, Unknown
  misc_feature (1)..( 10): Result.005 file - promoters50/1443083
gaaataaatg

SEQ ID NO: 171996 - DNA, 10 bp, Unknown
  misc_feature (1)..( 10): Result.005 file - promoters50/1443083
taaataaaat

SEQ ID NO: 171997 - DNA, 10 bp, Unknown
  misc_feature (1)..( 10): Result.005 file - promoters50/1443083
tagatagatg

SEQ ID NO: 171998 - DNA, 10 bp, Unknown
  misc_feature (1)..( 10): Result.005 file - promoters50/1443083
cttatagatg

SEQ ID NO: 171999 - DNA, 10 bp, Unknown
  misc_feature (1)..( 10): Result.005 file - promoters50/1443083
gaaatagtat

SEQ ID NO: 172000 - DNA, 7 bp, Unknown
  misc_feature (1)..( 7): Result.005 file - promoters50/1443083
tattttc

SEQ ID NO: 172001 - DNA, 7 bp, Unknown
  misc_feature (1)..( 7): Result.005 file - promoters50/1443083
tatttta

SEQ ID NO: 172002 - DNA, 7 bp, Unknown
  misc_feature (1)..( 7): Result.005 file - promoters50/1443083
tattttt

SEQ ID NO: 172003 - DNA, 7 bp, Unknown
  misc_feature (1)..( 7): Result.005 file - promoters50/1443083
aatttta

SEQ ID NO: 172004 - DNA, 7 bp, Unknown
  misc_feature (1)..( 7): Result.005 file - promoters50/1443083
gatttta

SEQ ID NO: 172005 - DNA, 7 bp, Unknown
  misc_feature (1)..( 7): Result.005 file - promoters50/1443083
tatgtta

SEQ ID NO: 172006 - DNA, 11 bp, Unknown
  misc_feature (1)..( 11): Result.005 file - promoters50/1443083
cggtttcttga

SEQ ID NO: 172007 - DNA, 11 bp, Unknown
  misc_feature (1)..( 11): Result.005 file - promoters50/1443083
cactttcttcc

SEQ ID NO: 172008 - DNA, 11 bp, Unknown
  misc_feature (1)..( 11): Result.005 file - promoters50/1443083
aaatttattgt

SEQ ID NO: 172009 - DNA, 11 bp, Unknown
  misc_feature (1)..( 11): Result.005 file - promoters50/1443083
aatgttcttga

SEQ ID NO: 172010 - DNA, 11 bp, Unknown
  misc_feature (1)..( 11): Result.005 file - promoters50/1443083
attgtacttat

SEQ ID NO: 172011 - DNA, 11 bp, Unknown
  misc_feature (1)..( 11): Result.005 file - promoters50/1443083
aatgtatctac

SEQ ID NO: 172012 - DNA, 9 bp, Unknown
  misc_feature (1)..( 9): Result.005 file - promoters50/1443114
acaaagatt

SEQ ID NO: 172013 - DNA, 9 bp, Unknown
  misc_feature (1)..( 9): Result.005 file - promoters50/1443114
gaaaaaatt

SEQ ID NO: 172014 - DNA, 9 bp, Unknown
  misc_feature (1)..( 9): Result.005 file - promoters50/1443114
tcaaagacg

SEQ ID NO: 172015 - DNA, 9 bp, Unknown
  misc_feature (1)..( 9): Result.005 file - promoters50/1443114
tcagagata

SEQ ID NO: 172016 - DNA, 16 bp, Unknown
  misc_feature (1)..( 16): Result.005 file - promoters50/1443114
atctaaaaatggctat

SEQ ID NO: 172017 - DNA, 16 bp, Unknown
  misc_feature (1)..( 16): Result.005 file - promoters50/1443114
tagaaaaaatttattc

SEQ ID NO: 172018 - DNA, 16 bp, Unknown
  misc_feature (1)..( 16): Result.005 file - promoters50/1443114
cccaaaaactaagaat

SEQ ID NO: 172019 - DNA, 16 bp, Unknown
  misc_feature (1)..( 16): Result.005 file - promoters50/1443114
ccagaacaatatagca

SEQ ID NO: 172020 - DNA, 16 bp, Unknown
  misc_feature (1)..( 16): Result.005 file - promoters50/1443114
ccacaaccaaacggaa

SEQ ID NO: 172021 - DNA, 11 bp, Unknown
  misc_feature (1)..( 11): Result.005 file - promoters50/1443114
caatttaaatt

SEQ ID NO: 172022 - DNA, 11 bp, Unknown
  misc_feature (1)..( 11): Result.005 file - promoters50/1443114
gcatttaaatt

SEQ ID NO: 172023 - DNA, 11 bp, Unknown
  misc_feature (1)..( 11): Result.005 file - promoters50/1443114
gcaattagtac

SEQ ID NO: 172024 - DNA, 11 bp, Unknown
  misc_feature (1)..( 11): Result.005 file - promoters50/1443114
aaagttagttt

SEQ ID NO: 172025 - DNA, 13 bp, Unknown
  misc_feature (1)..( 13): Result.005 file - promoters50/1443114
tacaaaaatgtaa

SEQ ID NO: 172026 - DNA, 13 bp, Unknown
  misc_feature (1)..( 13): Result.005 file - promoters50/1443114
aagaaaaaagtaa

SEQ ID NO: 172027 - DNA, 13 bp, Unknown
  misc_feature (1)..( 13): Result.005 file - promoters50/1443114
gagaaaaaacaga

SEQ ID NO: 172028 - DNA, 13 bp, Unknown
  misc_feature (1)..( 13): Result.005 file - promoters50/1443114
gaggaaacatact

SEQ ID NO: 172029 - DNA, 12 bp, Unknown
  misc_feature (1)..( 12): Result.005 file - promoters50/1443178
aaagaaagaaaa

SEQ ID NO: 172030 - DNA, 12 bp, Unknown
  misc_feature (1)..( 12): Result.005 file - promoters50/1443178
aaataaaaacgg

SEQ ID NO: 172031 - DNA, 12 bp, Unknown
  misc_feature (1)..( 12): Result.005 file - promoters50/1443178
tgataacaacgg

SEQ ID NO: 172032 - DNA, 8 bp, Unknown
  misc_feature (1)..( 8): Result.005 file - promoters50/1443178
aaaaaccg

SEQ ID NO: 172033 - DNA, 8 bp, Unknown
  misc_feature (1)..( 8): Result.005 file - promoters50/1443178
aaaaacct

SEQ ID NO: 172034 - DNA, 8 bp, Unknown
  misc_feature (1)..( 8): Result.005 file - promoters50/1443178
ctaaaccg

SEQ ID NO: 172035 - DNA, 11 bp, Unknown
  misc_feature (1)..( 11): Result.005 file - promoters50/1443184
caaatgtgatt

SEQ ID NO: 172036 - DNA, 11 bp, Unknown
  misc_feature (1)..( 11): Result.005 file - promoters50/1443184
ataatttgagt

SEQ ID NO: 172037 - DNA, 11 bp, Unknown
  misc_feature (1)..( 11): Result.005 file - promoters50/1443184
atatttttagt

SEQ ID NO: 172038 - DNA, 10 bp, Unknown
  misc_feature (1)..( 10): Result.005 file - promoters50/1443184
aatttatcaa

SEQ ID NO: 172039 - DNA, 10 bp, Unknown
  misc_feature (1)..( 10): Result.005 file - promoters50/1443184
aatatataca

SEQ ID NO: 172040 - DNA, 10 bp, Unknown
  misc_feature (1)..( 10): Result.005 file - promoters50/1443184
agtttatttt

SEQ ID NO: 172041 - DNA, 11 bp, Unknown
  misc_feature (1)..( 11): Result.005 file - promoters50/1443184
agaaaaattgt

SEQ ID NO: 172042 - DNA, 11 bp, Unknown
  misc_feature (1)..( 11): Result.005 file - promoters50/1443184
agagaaaggat

SEQ ID NO: 172043 - DNA, 11 bp, Unknown
  misc_feature (1)..( 11): Result.005 file - promoters50/1443184
aaacaaagatt

SEQ ID NO: 172044 - DNA, 9 bp, Unknown
  misc_feature (1)..( 9): Result.005 file - promoters50/1443184
atatataaa

SEQ ID NO: 172045 - DNA, 9 bp, Unknown
  misc_feature (1)..( 9): Result.005 file - promoters50/1443184
atctataaa

SEQ ID NO: 172046 - DNA, 9 bp, Unknown
  misc_feature (1)..( 9): Result.005 file - promoters50/1443184
ccttataaa

SEQ ID NO: 172047 - DNA, 9 bp, Unknown
  misc_feature (1)..( 9): Result.005 file - promoters50/1443184
ccttttaaa

SEQ ID NO: 172048 - DNA, 8 bp, Unknown
  misc_feature (1)..( 8): Result.005 file - promoters50/1443184
aggaggaa

SEQ ID NO: 172049 - DNA, 8 bp, Unknown
  misc_feature (1)..( 8): Result.005 file - promoters50/1443184
aggaggaa

SEQ ID NO: 172050 - DNA, 8 bp, Unknown
  misc_feature (1)..( 8): Result.005 file - promoters50/1443184
tggaggat

SEQ ID NO: 172051 - DNA, 8 bp, Unknown
  misc_feature (1)..( 8): Result.005 file - promoters50/1443184
gttacaaa

SEQ ID NO: 172052 - DNA, 8 bp, Unknown
  misc_feature (1)..( 8): Result.005 file - promoters50/1443184
gttacaac

SEQ ID NO: 172053 - DNA, 8 bp, Unknown
  misc_feature (1)..( 8): Result.005 file - promoters50/1443184
gttataac

SEQ ID NO: 172054 - DNA, 18 bp, Unknown
  misc_feature (1)..( 18): Result.005 file - promoters50/1443192
aaaaattattaaagtata

SEQ ID NO: 172055 - DNA, 18 bp, Unknown
  misc_feature (1)..( 18): Result.005 file - promoters50/1443192
aaagattattaaattata

SEQ ID NO: 172056 - DNA, 18 bp, Unknown
  misc_feature (1)..( 18): Result.005 file - promoters50/1443192
aaaatttatctgtaaatg

SEQ ID NO: 172057 - DNA, 11 bp, Unknown
  misc_feature (1)..( 11): Result.005 file - promoters50/1443192
attacagtact

SEQ ID NO: 172058 - DNA, 18 bp, Unknown
  misc_feature (1)..( 18): Result.005 file - promoters50/1443192
tctcatttttaatcaaaa

SEQ ID NO: 172059 - DNA, 11 bp, Unknown
  misc_feature (1)..( 11): Result.005 file - promoters50/1443192
atttactaata

SEQ ID NO: 172060 - DNA, 11 bp, Unknown
  misc_feature (1)..( 11): Result.005 file - promoters50/1443192
aattattaaag

SEQ ID NO: 172061 - DNA, 11 bp, Unknown
  misc_feature (1)..( 11): Result.005 file - promoters50/1443192
atttacttaat

SEQ ID NO: 172062 - DNA, 11 bp, Unknown
  misc_feature (1)..( 11): Result.005 file - promoters50/1443192
ttttgctatac

SEQ ID NO: 172063 - DNA, 11 bp, Unknown
  misc_feature (1)..( 11): Result.005 file - promoters50/1443192
aaataccaatc

SEQ ID NO: 172064 - DNA, 11 bp, Unknown
  misc_feature (1)..( 11): Result.005 file - promoters50/1443192
ttataataatt

SEQ ID NO: 172065 - DNA, 13 bp, Unknown
  misc_feature (1)..( 13): Result.005 file - promoters50/1443192
ataattttagaga

SEQ ID NO: 172066 - DNA, 13 bp, Unknown
  misc_feature (1)..( 13): Result.005 file - promoters50/1443192
ctaattttaattt

SEQ ID NO: 172067 - DNA, 13 bp, Unknown
  misc_feature (1)..( 13): Result.005 file - promoters50/1443192
ataattatttggt

SEQ ID NO: 172068 - DNA, 13 bp, Unknown
  misc_feature (1)..( 13): Result.005 file - promoters50/1443192
atcattttcattt

SEQ ID NO: 172069 - DNA, 13 bp, Unknown
  misc_feature (1)..( 13): Result.005 file - promoters50/1443192
tacattttgtaac

SEQ ID NO: 172070 - DNA, 10 bp, Unknown
  misc_feature (1)..( 10): Result.005 file - promoters50/1443192
ctatatatat

SEQ ID NO: 172071 - DNA, 10 bp, Unknown
  misc_feature (1)..( 10): Result.005 file - promoters50/1443192
ttatttatat

SEQ ID NO: 172072 - DNA, 10 bp, Unknown
  misc_feature (1)..( 10): Result.005 file - promoters50/1443192
ctatataaac

SEQ ID NO: 172073 - DNA, 10 bp, Unknown
  misc_feature (1)..( 10): Result.005 file - promoters50/1443192
gtatatataa

SEQ ID NO: 172074 - DNA, 10 bp, Unknown
  misc_feature (1)..( 10): Result.005 file - promoters50/1443192
gtctataaat

SEQ ID NO: 172075 - DNA, 13 bp, Unknown
  misc_feature (1)..( 13): Result.005 file - promoters50/1443256
attcttaatttca

SEQ ID NO: 172076 - DNA, 13 bp, Unknown
  misc_feature (1)..( 13): Result.005 file - promoters50/1443256
atttttattttca

SEQ ID NO: 172077 - DNA, 13 bp, Unknown
  misc_feature (1)..( 13): Result.005 file - promoters50/1443256
acgtttaaacaat

SEQ ID NO: 172078 - DNA, 13 bp, Unknown
  misc_feature (1)..( 13): Result.005 file - promoters50/1443256
gttcataactgtt

SEQ ID NO: 172079 - DNA, 13 bp, Unknown
  misc_feature (1)..( 13): Result.005 file - promoters50/1443256
gttcttatcactg

SEQ ID NO: 172080 - DNA, 13 bp, Unknown
  misc_feature (1)..( 13): Result.005 file - promoters50/1443256
tctcttatgaact

SEQ ID NO: 172081 - DNA, 8 bp, Unknown
  misc_feature (1)..( 8): Result.005 file - promoters50/1443271
cattaaat

SEQ ID NO: 172082 - DNA, 8 bp, Unknown
  misc_feature (1)..( 8): Result.005 file - promoters50/1443271
cataaaaa

SEQ ID NO: 172083 - DNA, 8 bp, Unknown
  misc_feature (1)..( 8): Result.005 file - promoters50/1443271
ggtaaaaa

SEQ ID NO: 172084 - DNA, 8 bp, Unknown
  misc_feature (1)..( 8): Result.005 file - promoters50/1443271
tctttttc

SEQ ID NO: 172085 - DNA, 8 bp, Unknown
  misc_feature (1)..( 8): Result.005 file - promoters50/1443271
tgtttttc

SEQ ID NO: 172086 - DNA, 8 bp, Unknown
  misc_feature (1)..( 8): Result.005 file - promoters50/1443271
tgttttta

SEQ ID NO: 172087 - DNA, 9 bp, Unknown
  misc_feature (1)..( 9): Result.005 file - promoters50/1443271
gtttaattt

SEQ ID NO: 172088 - DNA, 9 bp, Unknown
  misc_feature (1)..( 9): Result.005 file - promoters50/1443271
ttttaattt

SEQ ID NO: 172089 - DNA, 9 bp, Unknown
  misc_feature (1)..( 9): Result.005 file - promoters50/1443271
gtttaaacc

SEQ ID NO: 172090 - DNA, 8 bp, Unknown
  misc_feature (1)..( 8): Result.005 file - promoters50/1443271
aaacatta

SEQ ID NO: 172091 - DNA, 8 bp, Unknown
  misc_feature (1)..( 8): Result.005 file - promoters50/1443271
aaaaatta

SEQ ID NO: 172092 - DNA, 8 bp, Unknown
  misc_feature (1)..( 8): Result.005 file - promoters50/1443271
aaaaatta

SEQ ID NO: 172093 - DNA, 9 bp, Unknown
  misc_feature (1)..( 9): Result.005 file - promoters50/1443276
aatttaata

SEQ ID NO: 172094 - DNA, 9 bp, Unknown
  misc_feature (1)..( 9): Result.005 file - promoters50/1443276
catttaatg

SEQ ID NO: 172095 - DNA, 9 bp, Unknown
  misc_feature (1)..( 9): Result.005 file - promoters50/1443276
aatttaata

SEQ ID NO: 172096 - DNA, 8 bp, Unknown
  misc_feature (1)..( 8): Result.005 file - promoters50/1443276
aaaaggaa

SEQ ID NO: 172097 - DNA, 8 bp, Unknown
  misc_feature (1)..( 8): Result.005 file - promoters50/1443276
aaatggaa

SEQ ID NO: 172098 - DNA, 8 bp, Unknown
  misc_feature (1)..( 8): Result.005 file - promoters50/1443276
aaaacgaa

SEQ ID NO: 172099 - DNA, 10 bp, Unknown
  misc_feature (1)..( 10): Result.005 file - promoters50/1443276
cgttattatg

SEQ ID NO: 172100 - DNA, 10 bp, Unknown
  misc_feature (1)..( 10): Result.005 file - promoters50/1443276
aaatattatt

SEQ ID NO: 172101 - DNA, 10 bp, Unknown
  misc_feature (1)..( 10): Result.005 file - promoters50/1443276
aaataatatt

SEQ ID NO: 172102 - DNA, 9 bp, Unknown
  misc_feature (1)..( 9): Result.005 file - promoters50/1443276
gactaaaag

SEQ ID NO: 172103 - DNA, 9 bp, Unknown
  misc_feature (1)..( 9): Result.005 file - promoters50/1443276
gactataag

SEQ ID NO: 172104 - DNA, 9 bp, Unknown
  misc_feature (1)..( 9): Result.005 file - promoters50/1443276
aactaaaat

SEQ ID NO: 172105 - DNA, 8 bp, Unknown
  misc_feature (1)..( 8): Result.005 file - promoters50/1443276
aaagtcta

SEQ ID NO: 172106 - DNA, 8 bp, Unknown
  misc_feature (1)..( 8): Result.005 file - promoters50/1443276
taagtctc

SEQ ID NO: 172107 - DNA, 8 bp, Unknown
  misc_feature (1)..( 8): Result.005 file - promoters50/1443276
aaaatcta

SEQ ID NO: 172108 - DNA, 8 bp, Unknown
  misc_feature (1)..( 8): Result.005 file - promoters50/1443276
tcaataaa

SEQ ID NO: 172109 - DNA, 8 bp, Unknown
  misc_feature (1)..( 8): Result.005 file - promoters50/1443276
tcattaaa

SEQ ID NO: 172110 - DNA, 8 bp, Unknown
  misc_feature (1)..( 8): Result.005 file - promoters50/1443276
tcaagaaa

SEQ ID NO: 172111 - DNA, 10 bp, Unknown
  misc_feature (1)..( 10): Result.005 file - promoters50/1443276
atacaaaaaa

SEQ ID NO: 172112 - DNA, 10 bp, Unknown
  misc_feature (1)..( 10): Result.005 file - promoters50/1443276
tattaaaaaa

SEQ ID NO: 172113 - DNA, 10 bp, Unknown
  misc_feature (1)..( 10): Result.005 file - promoters50/1443276
caagaaaaac

SEQ ID NO: 172114 - DNA, 8 bp, Unknown
  misc_feature (1)..( 8): Result.005 file - promoters50/1443276
agaaaaat

SEQ ID NO: 172115 - DNA, 8 bp, Unknown
  misc_feature (1)..( 8): Result.005 file - promoters50/1443276
acaaaaat

SEQ ID NO: 172116 - DNA, 8 bp, Unknown
  misc_feature (1)..( 8): Result.005 file - promoters50/1443276
agaaaaac

SEQ ID NO: 172117 - DNA, 11 bp, Unknown
  misc_feature (1)..( 11): Result.005 file - promoters50/1443276
tataaaaaagg

SEQ ID NO: 172118 - DNA, 11 bp, Unknown
  misc_feature (1)..( 11): Result.005 file - promoters50/1443276
tatataaatgc

SEQ ID NO: 172119 - DNA, 11 bp, Unknown
  misc_feature (1)..( 11): Result.005 file - promoters50/1443276
aataaatacat

SEQ ID NO: 172120 - DNA, 9 bp, Unknown
  misc_feature (1)..( 9): Result.005 file - promoters50/1443276
aaataaatg

SEQ ID NO: 172121 - DNA, 9 bp, Unknown
  misc_feature (1)..( 9): Result.005 file - promoters50/1443276
aaacaaaaa

SEQ ID NO: 172122 - DNA, 9 bp, Unknown
  misc_feature (1)..( 9): Result.005 file - promoters50/1443276
caacaaaaa

SEQ ID NO: 172123 - DNA, 8 bp, Unknown
  misc_feature (1)..( 8): Result.005 file - promoters50/1443283
gaaaaatg

SEQ ID NO: 172124 - DNA, 8 bp, Unknown
  misc_feature (1)..( 8): Result.005 file - promoters50/1443283
taaaaatg

SEQ ID NO: 172125 - DNA, 8 bp, Unknown
  misc_feature (1)..( 8): Result.005 file - promoters50/1443283
taacaatg

SEQ ID NO: 172126 - DNA, 15 bp, Unknown
  misc_feature (1)..( 15): Result.005 file - promoters50/1443306
agtataaaatacttt

SEQ ID NO: 172127 - DNA, 15 bp, Unknown
  misc_feature (1)..( 15): Result.005 file - promoters50/1443306
aactaaaaatatatt

SEQ ID NO: 172128 - DNA, 15 bp, Unknown
  misc_feature (1)..( 15): Result.005 file - promoters50/1443306
caagtaagatatttt

SEQ ID NO: 172129 - DNA, 15 bp, Unknown
  misc_feature (1)..( 15): Result.005 file - promoters50/1443306
agtatataattttag

SEQ ID NO: 172130 - DNA, 15 bp, Unknown
  misc_feature (1)..( 15): Result.005 file - promoters50/1443306
tttaaaaaatgttat

SEQ ID NO: 172131 - DNA, 16 bp, Unknown
  misc_feature (1)..( 16): Result.005 file - promoters50/1443306
gaaataacaattgaag

SEQ ID NO: 172132 - DNA, 16 bp, Unknown
  misc_feature (1)..( 16): Result.005 file - promoters50/1443306
ttacaaaaaaattcac

SEQ ID NO: 172133 - DNA, 16 bp, Unknown
  misc_feature (1)..( 16): Result.005 file - promoters50/1443306
tccacaataatttagg

SEQ ID NO: 172134 - DNA, 21 bp, Unknown
  misc_feature (1)..( 21): Result.005 file - promoters50/1443306
ttctttttcgagaatacaaag

SEQ ID NO: 172135 - DNA, 21 bp, Unknown
  misc_feature (1)..( 21): Result.005 file - promoters50/1443306
tactttatcgtccaatcaatc

SEQ ID NO: 172136 - DNA, 21 bp, Unknown
  misc_feature (1)..( 21): Result.005 file - promoters50/1443306
gtatttttttttaatatatat

SEQ ID NO: 172137 - DNA, 21 bp, Unknown
  misc_feature (1)..( 21): Result.005 file - promoters50/1443306
aatattattgtccaactagtg

SEQ ID NO: 172138 - DNA, 21 bp, Unknown
  misc_feature (1)..( 21): Result.005 file - promoters50/1443306
atcagtatcgtccaaacaatc

SEQ ID NO: 172139 - DNA, 21 bp, Unknown
  misc_feature (1)..( 21): Result.005 file - promoters50/1443306
atcattatttttactcagtaa

SEQ ID NO: 172140 - DNA, 21 bp, Unknown
  misc_feature (1)..( 21): Result.005 file - promoters50/1443306
ttcattttcaattttttttac

SEQ ID NO: 172141 - DNA, 21 bp, Unknown
  misc_feature (1)..( 21): Result.005 file - promoters50/1443306
agaattctcactttgtatgtt

SEQ ID NO: 172142 - DNA, 12 bp, Unknown
  misc_feature (1)..( 12): Result.005 file - promoters50/1443306
aatctataaaaa

SEQ ID NO: 172143 - DNA, 12 bp, Unknown
  misc_feature (1)..( 12): Result.005 file - promoters50/1443306
taactataaata

SEQ ID NO: 172144 - DNA, 12 bp, Unknown
  misc_feature (1)..( 12): Result.005 file - promoters50/1443306
tatatataaata

SEQ ID NO: 172145 - DNA, 12 bp, Unknown
  misc_feature (1)..( 12): Result.005 file - promoters50/1443306
tcaatataaata

SEQ ID NO: 172146 - DNA, 12 bp, Unknown
  misc_feature (1)..( 12): Result.005 file - promoters50/1443306
ttcatataaata

SEQ ID NO: 172147 - DNA, 12 bp, Unknown
  misc_feature (1)..( 12): Result.005 file - promoters50/1443306
actatatatatc

SEQ ID NO: 172148 - DNA, 14 bp, Unknown
  misc_feature (1)..( 14): Result.005 file - promoters50/1443306
actaattttagcaa

SEQ ID NO: 172149 - DNA, 14 bp, Unknown
  misc_feature (1)..( 14): Result.005 file - promoters50/1443306
ttcaatttttttta

SEQ ID NO: 172150 - DNA, 14 bp, Unknown
  misc_feature (1)..( 14): Result.005 file - promoters50/1443306
tttaatattatatc

SEQ ID NO: 172151 - DNA, 14 bp, Unknown
  misc_feature (1)..( 14): Result.005 file - promoters50/1443306
aataatagtataaa

SEQ ID NO: 172152 - DNA, 14 bp, Unknown
  misc_feature (1)..( 14): Result.005 file - promoters50/1443306
attatttttactca

SEQ ID NO: 172153 - DNA, 14 bp, Unknown
  misc_feature (1)..( 14): Result.005 file - promoters50/1443306
tgtattttttttta

SEQ ID NO: 172154 - DNA, 14 bp, Unknown
  misc_feature (1)..( 14): Result.005 file - promoters50/1443306
gtcatcagtatcgt

SEQ ID NO: 172155 - DNA, 14 bp, Unknown
  misc_feature (1)..( 14): Result.005 file - promoters50/1443306
agaattctcacttt

SEQ ID NO: 172156 - DNA, 11 bp, Unknown
  misc_feature (1)..( 11): Result.005 file - promoters50/1443306
tatttgtaatc

SEQ ID NO: 172157 - DNA, 11 bp, Unknown
  misc_feature (1)..( 11): Result.005 file - promoters50/1443306
gatttgttaca

SEQ ID NO: 172158 - DNA, 11 bp, Unknown
  misc_feature (1)..( 11): Result.005 file - promoters50/1443306
tctttttaatg

SEQ ID NO: 172159 - DNA, 11 bp, Unknown
  misc_feature (1)..( 11): Result.005 file - promoters50/1443306
aatttttttaa

SEQ ID NO: 172160 - DNA, 11 bp, Unknown
  misc_feature (1)..( 11): Result.005 file - promoters50/1443306
attttgttatt

SEQ ID NO: 172161 - DNA, 12 bp, Unknown
  misc_feature (1)..( 12): Result.005 file - promoters50/1443306
tattattttcac

SEQ ID NO: 172162 - DNA, 7 bp, Unknown
  misc_feature (1)..( 7): Result.005 file - promoters50/1443306
taaaaat

SEQ ID NO: 172163 - DNA, 7 bp, Unknown
  misc_feature (1)..( 7): Result.005 file - promoters50/1443306
taaaaaa

SEQ ID NO: 172164 - DNA, 7 bp, Unknown
  misc_feature (1)..( 7): Result.005 file - promoters50/1443306
taacaat

SEQ ID NO: 172165 - DNA, 7 bp, Unknown
  misc_feature (1)..( 7): Result.005 file - promoters50/1443306
caaaaaa

SEQ ID NO: 172166 - DNA, 7 bp, Unknown
  misc_feature (1)..( 7): Result.005 file - promoters50/1443306
caaaaaa

SEQ ID NO: 172167 - DNA, 7 bp, Unknown
  misc_feature (1)..( 7): Result.005 file - promoters50/1443306
taacaaa

SEQ ID NO: 172168 - DNA, 11 bp, Unknown
  misc_feature (1)..( 11): Result.005 file - promoters50/1443306
ttttgctatac

SEQ ID NO: 172169 - DNA, 11 bp, Unknown
  misc_feature (1)..( 11): Result.005 file - promoters50/1443306
atttactaata

SEQ ID NO: 172170 - DNA, 11 bp, Unknown
  misc_feature (1)..( 11): Result.005 file - promoters50/1443306
ttttgcaattg

SEQ ID NO: 172171 - DNA, 11 bp, Unknown
  misc_feature (1)..( 11): Result.005 file - promoters50/1443306
tgttattaact

SEQ ID NO: 172172 - DNA, 11 bp, Unknown
  misc_feature (1)..( 11): Result.005 file - promoters50/1443306
cttttcaagat

SEQ ID NO: 172173 - DNA, 11 bp, Unknown
  misc_feature (1)..( 11): Result.005 file - promoters50/1443306
aaatacaaata

SEQ ID NO: 172174 - DNA, 9 bp, Unknown
  misc_feature (1)..( 9): Result.005 file - promoters50/1443338
tcttataat

SEQ ID NO: 172175 - DNA, 9 bp, Unknown
  misc_feature (1)..( 9): Result.005 file - promoters50/1443338
tcttataaa

SEQ ID NO: 172176 - DNA, 9 bp, Unknown
  misc_feature (1)..( 9): Result.005 file - promoters50/1443338
aattacaat

SEQ ID NO: 172177 - DNA, 10 bp, Unknown
  misc_feature (1)..( 10): Result.005 file - promoters50/1443342
atagttaacc

SEQ ID NO: 172178 - DNA, 10 bp, Unknown
  misc_feature (1)..( 10): Result.005 file - promoters50/1443342
ataattaaca

SEQ ID NO: 172179 - DNA, 10 bp, Unknown
  misc_feature (1)..( 10): Result.005 file - promoters50/1443342
gactttaacc

SEQ ID NO: 172180 - DNA, 15 bp, Unknown
  misc_feature (1)..( 15): Result.005 file - promoters50/1443342
ttcatataagttaat

SEQ ID NO: 172181 - DNA, 15 bp, Unknown
  misc_feature (1)..( 15): Result.005 file - promoters50/1443342
ttcatatatgttaag

SEQ ID NO: 172182 - DNA, 15 bp, Unknown
  misc_feature (1)..( 15): Result.005 file - promoters50/1443342
aaatgtttagttaat

SEQ ID NO: 172183 - DNA, 14 bp, Unknown
  misc_feature (1)..( 14): Result.005 file - promoters50/1443342
aattttctttttgt

SEQ ID NO: 172184 - DNA, 14 bp, Unknown
  misc_feature (1)..( 14): Result.005 file - promoters50/1443342
caatttctatttgt

SEQ ID NO: 172185 - DNA, 14 bp, Unknown
  misc_feature (1)..( 14): Result.005 file - promoters50/1443342
caagttcaattact

SEQ ID NO: 172186 - DNA, 11 bp, Unknown
  misc_feature (1)..( 11): Result.005 file - promoters50/1443349
tcgtgatgaag

SEQ ID NO: 172187 - DNA, 11 bp, Unknown
  misc_feature (1)..( 11): Result.005 file - promoters50/1443349
ttttgatgaat

SEQ ID NO: 172188 - DNA, 11 bp, Unknown
  misc_feature (1)..( 11): Result.005 file - promoters50/1443349
aaaagatgaag

SEQ ID NO: 172189 - DNA, 11 bp, Unknown
  misc_feature (1)..( 11): Result.005 file - promoters50/1443349
tttcgatgtat

SEQ ID NO: 172190 - DNA, 11 bp, Unknown
  misc_feature (1)..( 11): Result.005 file - promoters50/1443349
ttttgaagaat

SEQ ID NO: 172191 - DNA, 11 bp, Unknown
  misc_feature (1)..( 11): Result.005 file - promoters50/1443349
tttagatactt

SEQ ID NO: 172192 - DNA, 16 bp, Unknown
  misc_feature (1)..( 16): Result.005 file - promoters50/1443349
tgagaaatagatttga

SEQ ID NO: 172193 - DNA, 16 bp, Unknown
  misc_feature (1)..( 16): Result.005 file - promoters50/1443349
taaaagtaagattttc

SEQ ID NO: 172194 - DNA, 16 bp, Unknown
  misc_feature (1)..( 16): Result.005 file - promoters50/1443349
aaaaaaagagatctga

SEQ ID NO: 172195 - DNA, 16 bp, Unknown
  misc_feature (1)..( 16): Result.005 file - promoters50/1443349
aaaaaaagagaagaaa

SEQ ID NO: 172196 - DNA, 16 bp, Unknown
  misc_feature (1)..( 16): Result.005 file - promoters50/1443349
taggaaaaagttgtta

SEQ ID NO: 172197 - DNA, 16 bp, Unknown
  misc_feature (1)..( 16): Result.005 file - promoters50/1443349
ccagaaaaagctgatt

SEQ ID NO: 172198 - DNA, 11 bp, Unknown
  misc_feature (1)..( 11): Result.005 file - promoters50/1443349
gtatataaact

SEQ ID NO: 172199 - DNA, 11 bp, Unknown
  misc_feature (1)..( 11): Result.005 file - promoters50/1443349
atatataataa

SEQ ID NO: 172200 - DNA, 11 bp, Unknown
  misc_feature (1)..( 11): Result.005 file - promoters50/1443349
ctttataaata

SEQ ID NO: 172201 - DNA, 11 bp, Unknown
  misc_feature (1)..( 11): Result.005 file - promoters50/1443349
acctataaata

SEQ ID NO: 172202 - DNA, 11 bp, Unknown
  misc_feature (1)..( 11): Result.005 file - promoters50/1443349
ttatatataaa

SEQ ID NO: 172203 - DNA, 11 bp, Unknown
  misc_feature (1)..( 11): Result.005 file - promoters50/1443349
gtatataaatg

SEQ ID NO: 172204 - DNA, 11 bp, Unknown
  misc_feature (1)..( 11): Result.005 file - promoters50/1443349
ttatataaaca

SEQ ID NO: 172205 - DNA, 11 bp, Unknown
  misc_feature (1)..( 11): Result.005 file - promoters50/1443349
gacgataaata

SEQ ID NO: 172206 - DNA, 15 bp, Unknown
  misc_feature (1)..( 15): Result.005 file - promoters50/1443349
ctcgcttcataacaa

SEQ ID NO: 172207 - DNA, 15 bp, Unknown
  misc_feature (1)..( 15): Result.005 file - promoters50/1443349
atatctttataagta

SEQ ID NO: 172208 - DNA, 15 bp, Unknown
  misc_feature (1)..( 15): Result.005 file - promoters50/1443349
agttcttcatttcca

SEQ ID NO: 172209 - DNA, 15 bp, Unknown
  misc_feature (1)..( 15): Result.005 file - promoters50/1443349
tacgttttaaaagta

SEQ ID NO: 172210 - DNA, 15 bp, Unknown
  misc_feature (1)..( 15): Result.005 file - promoters50/1443349
aacaatttttaaatt

SEQ ID NO: 172211 - DNA, 15 bp, Unknown
  misc_feature (1)..( 15): Result.005 file - promoters50/1443349
ataactttatgttat

SEQ ID NO: 172212 - DNA, 15 bp, Unknown
  misc_feature (1)..( 15): Result.005 file - promoters50/1443349
caatctttatacaaa

SEQ ID NO: 172213 - DNA, 16 bp, Unknown
  misc_feature (1)..( 16): Result.005 file - promoters50/1443349
tatacgttttaaaagt

SEQ ID NO: 172214 - DNA, 16 bp, Unknown
  misc_feature (1)..( 16): Result.005 file - promoters50/1443349
aacaatttttaaattt

SEQ ID NO: 172215 - DNA, 16 bp, Unknown
  misc_feature (1)..( 16): Result.005 file - promoters50/1443349
atatctttataagtat

SEQ ID NO: 172216 - DNA, 16 bp, Unknown
  misc_feature (1)..( 16): Result.005 file - promoters50/1443349
ataactttatgttatt

SEQ ID NO: 172217 - DNA, 16 bp, Unknown
  misc_feature (1)..( 16): Result.005 file - promoters50/1443349
gaaaacttataattat

SEQ ID NO: 172218 - DNA, 16 bp, Unknown
  misc_feature (1)..( 16): Result.005 file - promoters50/1443349
caatctttatacaaaa

SEQ ID NO: 172219 - DNA, 12 bp, Unknown
  misc_feature (1)..( 12): Result.005 file - promoters50/1443349
aaaaatatatac

SEQ ID NO: 172220 - DNA, 12 bp, Unknown
  misc_feature (1)..( 12): Result.005 file - promoters50/1443349
tttaatatgtac

SEQ ID NO: 172221 - DNA, 12 bp, Unknown
  misc_feature (1)..( 12): Result.005 file - promoters50/1443349
gatagtatatac

SEQ ID NO: 172222 - DNA, 12 bp, Unknown
  misc_feature (1)..( 12): Result.005 file - promoters50/1443349
tagaatatgttt

SEQ ID NO: 172223 - DNA, 12 bp, Unknown
  misc_feature (1)..( 12): Result.005 file - promoters50/1443349
caaaatttgtat

SEQ ID NO: 172224 - DNA, 12 bp, Unknown
  misc_feature (1)..( 12): Result.005 file - promoters50/1443349
agcaatatttta

SEQ ID NO: 172225 - DNA, 15 bp, Unknown
  misc_feature (1)..( 15): Result.005 file - promoters50/1443349
aaattttaaaattat

SEQ ID NO: 172226 - DNA, 15 bp, Unknown
  misc_feature (1)..( 15): Result.005 file - promoters50/1443349
tgattctaaaatatt

SEQ ID NO: 172227 - DNA, 15 bp, Unknown
  misc_feature (1)..( 15): Result.005 file - promoters50/1443349
aaatgttagatagga

SEQ ID NO: 172228 - DNA, 15 bp, Unknown
  misc_feature (1)..( 15): Result.005 file - promoters50/1443349
attttttaaaatata

SEQ ID NO: 172229 - DNA, 15 bp, Unknown
  misc_feature (1)..( 15): Result.005 file - promoters50/1443349
aggagaagaaatata

SEQ ID NO: 172230 - DNA, 15 bp, Unknown
  misc_feature (1)..( 15): Result.005 file - promoters50/1443349
ccattgtgaaataat

SEQ ID NO: 172231 - DNA, 9 bp, Unknown
  misc_feature (1)..( 9): Result.005 file - promoters50/1443356
cactgatta

SEQ ID NO: 172232 - DNA, 9 bp, Unknown
  misc_feature (1)..( 9): Result.005 file - promoters50/1443356
tactaattt

SEQ ID NO: 172233 - DNA, 9 bp, Unknown
  misc_feature (1)..( 9): Result.005 file - promoters50/1443356
caccgattt

SEQ ID NO: 172234 - DNA, 9 bp, Unknown
  misc_feature (1)..( 9): Result.005 file - promoters50/1443356
tggtaattt

SEQ ID NO: 172235 - DNA, 9 bp, Unknown
  misc_feature (1)..( 9): Result.005 file - promoters50/1443356
atccgattc

SEQ ID NO: 172236 - DNA, 9 bp, Unknown
  misc_feature (1)..( 9): Result.005 file - promoters50/1443356
aacccattc

SEQ ID NO: 172237 - DNA, 11 bp, Unknown
  misc_feature (1)..( 11): Result.005 file - promoters50/1443356
gtacaattttc

SEQ ID NO: 172238 - DNA, 11 bp, Unknown
  misc_feature (1)..( 11): Result.005 file - promoters50/1443356
atacaatattt

SEQ ID NO: 172239 - DNA, 11 bp, Unknown
  misc_feature (1)..( 11): Result.005 file - promoters50/1443356
aaacaaatttc

SEQ ID NO: 172240 - DNA, 11 bp, Unknown
  misc_feature (1)..( 11): Result.005 file - promoters50/1443356
caacaatagag

SEQ ID NO: 172241 - DNA, 12 bp, Unknown
  misc_feature (1)..( 12): Result.005 file - promoters50/1443356
aaacgaatcaat

SEQ ID NO: 172242 - DNA, 12 bp, Unknown
  misc_feature (1)..( 12): Result.005 file - promoters50/1443356
aaacgattccaa

SEQ ID NO: 172243 - DNA, 12 bp, Unknown
  misc_feature (1)..( 12): Result.005 file - promoters50/1443356
acatcaattttg

SEQ ID NO: 172244 - DNA, 9 bp, Unknown
  misc_feature (1)..( 9): Result.005 file - promoters50/1443387
atcaaccag

SEQ ID NO: 172245 - DNA, 9 bp, Unknown
  misc_feature (1)..( 9): Result.005 file - promoters50/1443387
atcaaccat

SEQ ID NO: 172246 - DNA, 9 bp, Unknown
  misc_feature (1)..( 9): Result.005 file - promoters50/1443387
tccaaacat

SEQ ID NO: 172247 - DNA, 8 bp, Unknown
  misc_feature (1)..( 8): Result.005 file - promoters50/1443387
aaaattgg

SEQ ID NO: 172248 - DNA, 8 bp, Unknown
  misc_feature (1)..( 8): Result.005 file - promoters50/1443387
aaaattga

SEQ ID NO: 172249 - DNA, 8 bp, Unknown
  misc_feature (1)..( 8): Result.005 file - promoters50/1443387
aaaacaat

SEQ ID NO: 172250 - DNA, 13 bp, Unknown
  misc_feature (1)..( 13): Result.005 file - promoters50/1443387
ctactcatttatc

SEQ ID NO: 172251 - DNA, 13 bp, Unknown
  misc_feature (1)..( 13): Result.005 file - promoters50/1443387
ttgttcaattact

SEQ ID NO: 172252 - DNA, 13 bp, Unknown
  misc_feature (1)..( 13): Result.005 file - promoters50/1443387
ttggtcatttact

SEQ ID NO: 172253 - DNA, 12 bp, Unknown
  misc_feature (1)..( 12): Result.005 file - promoters50/1443418
ttttattataaa

SEQ ID NO: 172254 - DNA, 12 bp, Unknown
  misc_feature (1)..( 12): Result.005 file - promoters50/1443418
ttttattgccgc

SEQ ID NO: 172255 - DNA, 12 bp, Unknown
  misc_feature (1)..( 12): Result.005 file - promoters50/1443418
atttcttaacct

SEQ ID NO: 172256 - DNA, 12 bp, Unknown
  misc_feature (1)..( 12): Result.005 file - promoters50/1443418
atttatttacta

SEQ ID NO: 172257 - DNA, 12 bp, Unknown
  misc_feature (1)..( 12): Result.005 file - promoters50/1443418
ggttattaatta

SEQ ID NO: 172258 - DNA, 12 bp, Unknown
  misc_feature (1)..( 12): Result.005 file - promoters50/1443418
gtttgtttaaca

SEQ ID NO: 172259 - DNA, 12 bp, Unknown
  misc_feature (1)..( 12): Result.005 file - promoters50/1443418
ttctgtttcaca

SEQ ID NO: 172260 - DNA, 10 bp, Unknown
  misc_feature (1)..( 10): Result.005 file - promoters50/1443418
gtatatttag

SEQ ID NO: 172261 - DNA, 10 bp, Unknown
  misc_feature (1)..( 10): Result.005 file - promoters50/1443418
ttttatttaa

SEQ ID NO: 172262 - DNA, 10 bp, Unknown
  misc_feature (1)..( 10): Result.005 file - promoters50/1443418
atttaattaa

SEQ ID NO: 172263 - DNA, 10 bp, Unknown
  misc_feature (1)..( 10): Result.005 file - promoters50/1443418
gttttttttt

SEQ ID NO: 172264 - DNA, 10 bp, Unknown
  misc_feature (1)..( 10): Result.005 file - promoters50/1443418
attcatttaa

SEQ ID NO: 172265 - DNA, 10 bp, Unknown
  misc_feature (1)..( 10): Result.005 file - promoters50/1443418
ccaaaattaa

SEQ ID NO: 172266 - DNA, 13 bp, Unknown
  misc_feature (1)..( 13): Result.005 file - promoters50/1443418
gatttaaagacaa

SEQ ID NO: 172267 - DNA, 13 bp, Unknown
  misc_feature (1)..( 13): Result.005 file - promoters50/1443418
tgtttaaaacaaa

SEQ ID NO: 172268 - DNA, 13 bp, Unknown
  misc_feature (1)..( 13): Result.005 file - promoters50/1443418
catttaaataaac

SEQ ID NO: 172269 - DNA, 13 bp, Unknown
  misc_feature (1)..( 13): Result.005 file - promoters50/1443418
tgttcaaaattgg

SEQ ID NO: 172270 - DNA, 13 bp, Unknown
  misc_feature (1)..( 13): Result.005 file - promoters50/1443418
tgttcaaggcttg

SEQ ID NO: 172271 - DNA, 13 bp, Unknown
  misc_feature (1)..( 13): Result.005 file - promoters50/1443418
taaacaaaattgg

SEQ ID NO: 172272 - DNA, 12 bp, Unknown
  misc_feature (1)..( 12): Result.005 file - promoters50/1443418
aaaatataaata

SEQ ID NO: 172273 - DNA, 12 bp, Unknown
  misc_feature (1)..( 12): Result.005 file - promoters50/1443418
tttatataagtg

SEQ ID NO: 172274 - DNA, 12 bp, Unknown
  misc_feature (1)..( 12): Result.005 file - promoters50/1443418
tatatataaata

SEQ ID NO: 172275 - DNA, 12 bp, Unknown
  misc_feature (1)..( 12): Result.005 file - promoters50/1443418
tttatacaaatc

SEQ ID NO: 172276 - DNA, 12 bp, Unknown
  misc_feature (1)..( 12): Result.005 file - promoters50/1443418
cacttataaata

SEQ ID NO: 172277 - DNA, 12 bp, Unknown
  misc_feature (1)..( 12): Result.005 file - promoters50/1443418
tatatatagaaa

SEQ ID NO: 172278 - DNA, 12 bp, Unknown
  misc_feature (1)..( 12): Result.005 file - promoters50/1443418
gctatttaagta

SEQ ID NO: 172279 - DNA, 11 bp, Unknown
  misc_feature (1)..( 11): Result.005 file - promoters50/1443418
ttataaagtta

SEQ ID NO: 172280 - DNA, 11 bp, Unknown
  misc_feature (1)..( 11): Result.005 file - promoters50/1443418
ttataatcaat

SEQ ID NO: 172281 - DNA, 11 bp, Unknown
  misc_feature (1)..( 11): Result.005 file - promoters50/1443418
gtataatgtta

SEQ ID NO: 172282 - DNA, 11 bp, Unknown
  misc_feature (1)..( 11): Result.005 file - promoters50/1443418
atagaatgttt

SEQ ID NO: 172283 - DNA, 11 bp, Unknown
  misc_feature (1)..( 11): Result.005 file - promoters50/1443418
taagaatgtca

SEQ ID NO: 172284 - DNA, 11 bp, Unknown
  misc_feature (1)..( 11): Result.005 file - promoters50/1443418
taacaatattt

SEQ ID NO: 172285 - DNA, 14 bp, Unknown
  misc_feature (1)..( 14): Result.005 file - promoters50/1443418
tttaaaagttaaaa

SEQ ID NO: 172286 - DNA, 14 bp, Unknown
  misc_feature (1)..( 14): Result.005 file - promoters50/1443418
ttaaaaagctaaaa

SEQ ID NO: 172287 - DNA, 14 bp, Unknown
  misc_feature (1)..( 14): Result.005 file - promoters50/1443418
aaaaaaagtcataa

SEQ ID NO: 172288 - DNA, 14 bp, Unknown
  misc_feature (1)..( 14): Result.005 file - promoters50/1443418
tttaaatcattaga

SEQ ID NO: 172289 - DNA, 14 bp, Unknown
  misc_feature (1)..( 14): Result.005 file - promoters50/1443418
ttaaaatcaagaat

SEQ ID NO: 172290 - DNA, 14 bp, Unknown
  misc_feature (1)..( 14): Result.005 file - promoters50/1443418
aataaagagaagta

SEQ ID NO: 172291 - DNA, 11 bp, Unknown
  misc_feature (1)..( 11): Result.005 file - promoters50/1443418
ttgttttattt

SEQ ID NO: 172292 - DNA, 11 bp, Unknown
  misc_feature (1)..( 11): Result.005 file - promoters50/1443418
aaatttaatta

SEQ ID NO: 172293 - DNA, 11 bp, Unknown
  misc_feature (1)..( 11): Result.005 file - promoters50/1443418
aagttttaaat

SEQ ID NO: 172294 - DNA, 11 bp, Unknown
  misc_feature (1)..( 11): Result.005 file - promoters50/1443418
aggtttttttt

SEQ ID NO: 172295 - DNA, 11 bp, Unknown
  misc_feature (1)..( 11): Result.005 file - promoters50/1443418
tcatttaagtc

SEQ ID NO: 172296 - DNA, 11 bp, Unknown
  misc_feature (1)..( 11): Result.005 file - promoters50/1443418
aaaattaaaat

SEQ ID NO: 172297 - DNA, 7 bp, Unknown
  misc_feature (1)..( 7): Result.005 file - promoters50/1443472
atgtata

SEQ ID NO: 172298 - DNA, 7 bp, Unknown
  misc_feature (1)..( 7): Result.005 file - promoters50/1443472
atgtatt

SEQ ID NO: 172299 - DNA, 7 bp, Unknown
  misc_feature (1)..( 7): Result.005 file - promoters50/1443472
atggatt

SEQ ID NO: 172300 - DNA, 8 bp, Unknown
  misc_feature (1)..( 8): Result.005 file - promoters50/1443472
ctgtattt

SEQ ID NO: 172301 - DNA, 8 bp, Unknown
  misc_feature (1)..( 8): Result.005 file - promoters50/1443472
ctgtgttt

SEQ ID NO: 172302 - DNA, 8 bp, Unknown
  misc_feature (1)..( 8): Result.005 file - promoters50/1443472
ctgtgtga

SEQ ID NO: 172303 - DNA, 7 bp, Unknown
  misc_feature (1)..( 7): Result.005 file - promoters50/1443475
ttttttc

SEQ ID NO: 172304 - DNA, 7 bp, Unknown
  misc_feature (1)..( 7): Result.005 file - promoters50/1443475
ttttttc

SEQ ID NO: 172305 - DNA, 7 bp, Unknown
  misc_feature (1)..( 7): Result.005 file - promoters50/1443475
ttttttt

SEQ ID NO: 172306 - DNA, 8 bp, Unknown
  misc_feature (1)..( 8): Result.005 file - promoters50/1443475
caagttta

SEQ ID NO: 172307 - DNA, 8 bp, Unknown
  misc_feature (1)..( 8): Result.005 file - promoters50/1443475
caagtttt

SEQ ID NO: 172308 - DNA, 8 bp, Unknown
  misc_feature (1)..( 8): Result.005 file - promoters50/1443475
ccagtttt

SEQ ID NO: 172309 - DNA, 9 bp, Unknown
  misc_feature (1)..( 9): Result.005 file - promoters50/1443479
caaataaag

SEQ ID NO: 172310 - DNA, 9 bp, Unknown
  misc_feature (1)..( 9): Result.005 file - promoters50/1443479
taaaaaaaa

SEQ ID NO: 172311 - DNA, 9 bp, Unknown
  misc_feature (1)..( 9): Result.005 file - promoters50/1443479
caaatagta

SEQ ID NO: 172312 - DNA, 9 bp, Unknown
  misc_feature (1)..( 9): Result.005 file - promoters50/1443479
ctaagaaac

SEQ ID NO: 172313 - DNA, 9 bp, Unknown
  misc_feature (1)..( 9): Result.005 file - promoters50/1443479
ttaaaaatg

SEQ ID NO: 172314 - DNA, 9 bp, Unknown
  misc_feature (1)..( 9): Result.005 file - promoters50/1443479
agaaaaagt

SEQ ID NO: 172315 - DNA, 11 bp, Unknown
  misc_feature (1)..( 11): Result.005 file - promoters50/1443479
tttcaaatcac

SEQ ID NO: 172316 - DNA, 11 bp, Unknown
  misc_feature (1)..( 11): Result.005 file - promoters50/1443479
tttcgaatcca

SEQ ID NO: 172317 - DNA, 11 bp, Unknown
  misc_feature (1)..( 11): Result.005 file - promoters50/1443479
ttttaaaaatg

SEQ ID NO: 172318 - DNA, 11 bp, Unknown
  misc_feature (1)..( 11): Result.005 file - promoters50/1443479
tccaaaatcat

SEQ ID NO: 172319 - DNA, 11 bp, Unknown
  misc_feature (1)..( 11): Result.005 file - promoters50/1443479
agagaaaacat

SEQ ID NO: 172320 - DNA, 11 bp, Unknown
  misc_feature (1)..( 11): Result.005 file - promoters50/1443479
tgttaaaaaaa

SEQ ID NO: 172321 - DNA, 12 bp, Unknown
  misc_feature (1)..( 12): Result.005 file - promoters50/1443509
ttatattttttt

SEQ ID NO: 172322 - DNA, 12 bp, Unknown
  misc_feature (1)..( 12): Result.005 file - promoters50/1443509
taatagtttctt

SEQ ID NO: 172323 - DNA, 12 bp, Unknown
  misc_feature (1)..( 12): Result.005 file - promoters50/1443509
gaatttttttaa

SEQ ID NO: 172324 - DNA, 12 bp, Unknown
  misc_feature (1)..( 12): Result.005 file - promoters50/1443509
caatatttggtc

SEQ ID NO: 172325 - DNA, 12 bp, Unknown
  misc_feature (1)..( 12): Result.005 file - promoters50/1443509
taagagttttac

SEQ ID NO: 172326 - DNA, 12 bp, Unknown
  misc_feature (1)..( 12): Result.005 file - promoters50/1443509
gacactttttaa

SEQ ID NO: 172327 - DNA, 15 bp, Unknown
  misc_feature (1)..( 15): Result.005 file - promoters50/1443509
tctctactatataaa

SEQ ID NO: 172328 - DNA, 15 bp, Unknown
  misc_feature (1)..( 15): Result.005 file - promoters50/1443509
gaaaatgtatatata

SEQ ID NO: 172329 - DNA, 15 bp, Unknown
  misc_feature (1)..( 15): Result.005 file - promoters50/1443509
aacgcactatataaa

SEQ ID NO: 172330 - DNA, 15 bp, Unknown
  misc_feature (1)..( 15): Result.005 file - promoters50/1443509
ggtttctaatataaa

SEQ ID NO: 172331 - DNA, 15 bp, Unknown
  misc_feature (1)..( 15): Result.005 file - promoters50/1443509
cttcaccaatataat

SEQ ID NO: 172332 - DNA, 15 bp, Unknown
  misc_feature (1)..( 15): Result.005 file - promoters50/1443509
tctctactatataaa

SEQ ID NO: 172333 - DNA, 7 bp, Unknown
  misc_feature (1)..( 7): Result.005 file - promoters50/1443527
gtggtat

SEQ ID NO: 172334 - DNA, 7 bp, Unknown
  misc_feature (1)..( 7): Result.005 file - promoters50/1443527
gtgatat

SEQ ID NO: 172335 - DNA, 7 bp, Unknown
  misc_feature (1)..( 7): Result.005 file - promoters50/1443527
gtgatac

SEQ ID NO: 172336 - DNA, 10 bp, Unknown
  misc_feature (1)..( 10): Result.005 file - promoters50/1443683
atatataaag

SEQ ID NO: 172337 - DNA, 10 bp, Unknown
  misc_feature (1)..( 10): Result.005 file - promoters50/1443683
ttatatagat

SEQ ID NO: 172338 - DNA, 10 bp, Unknown
  misc_feature (1)..( 10): Result.005 file - promoters50/1443683
ccatataaat

SEQ ID NO: 172339 - DNA, 10 bp, Unknown
  misc_feature (1)..( 10): Result.005 file - promoters50/1443683
atatatactt

SEQ ID NO: 172340 - DNA, 10 bp, Unknown
  misc_feature (1)..( 10): Result.005 file - promoters50/1443683
atatattaaa

SEQ ID NO: 172341 - DNA, 10 bp, Unknown
  misc_feature (1)..( 10): Result.005 file - promoters50/1443683
tactataaat

SEQ ID NO: 172342 - DNA, 14 bp, Unknown
  misc_feature (1)..( 14): Result.005 file - promoters50/1443687
aaacttattttttt

SEQ ID NO: 172343 - DNA, 14 bp, Unknown
  misc_feature (1)..( 14): Result.005 file - promoters50/1443687
aaatttatcatcag

SEQ ID NO: 172344 - DNA, 14 bp, Unknown
  misc_feature (1)..( 14): Result.005 file - promoters50/1443687
aaatttatttgttt

SEQ ID NO: 172345 - DNA, 14 bp, Unknown
  misc_feature (1)..( 14): Result.005 file - promoters50/1443687
taatatatcatata

SEQ ID NO: 172346 - DNA, 14 bp, Unknown
  misc_feature (1)..( 14): Result.005 file - promoters50/1443687
gaatatatctcaag

SEQ ID NO: 172347 - DNA, 14 bp, Unknown
  misc_feature (1)..( 14): Result.005 file - promoters50/1443687
taggttattttgaa

SEQ ID NO: 172348 - DNA, 13 bp, Unknown
  misc_feature (1)..( 13): Result.005 file - promoters50/1443687
tttaacaaagcat

SEQ ID NO: 172349 - DNA, 13 bp, Unknown
  misc_feature (1)..( 13): Result.005 file - promoters50/1443687
tttcacagtttat

SEQ ID NO: 172350 - DNA, 13 bp, Unknown
  misc_feature (1)..( 13): Result.005 file - promoters50/1443687
cttaaaaaacata

SEQ ID NO: 172351 - DNA, 13 bp, Unknown
  misc_feature (1)..( 13): Result.005 file - promoters50/1443687
tatcaaagaacaa

SEQ ID NO: 172352 - DNA, 13 bp, Unknown
  misc_feature (1)..( 13): Result.005 file - promoters50/1443687
atctcaaggacaa

SEQ ID NO: 172353 - DNA, 10 bp, Unknown
  misc_feature (1)..( 10): Result.005 file - promoters50/1443687
tttaacaaag

SEQ ID NO: 172354 - DNA, 10 bp, Unknown
  misc_feature (1)..( 10): Result.005 file - promoters50/1443687
aagaacaaat

SEQ ID NO: 172355 - DNA, 10 bp, Unknown
  misc_feature (1)..( 10): Result.005 file - promoters50/1443687
cttaaaaaac

SEQ ID NO: 172356 - DNA, 10 bp, Unknown
  misc_feature (1)..( 10): Result.005 file - promoters50/1443687
acgaataaaa

SEQ ID NO: 172357 - DNA, 10 bp, Unknown
  misc_feature (1)..( 10): Result.005 file - promoters50/1443687
cctaactaat

SEQ ID NO: 172358 - DNA, 10 bp, Unknown
  misc_feature (1)..( 10): Result.005 file - promoters50/1443687
aaggacaatg

SEQ ID NO: 172359 - DNA, 9 bp, Unknown
  misc_feature (1)..( 9): Result.005 file - promoters50/1443687
tattttgtt

SEQ ID NO: 172360 - DNA, 9 bp, Unknown
  misc_feature (1)..( 9): Result.005 file - promoters50/1443687
tattttgaa

SEQ ID NO: 172361 - DNA, 10 bp, Unknown
  misc_feature (1)..( 10): Result.005 file - promoters50/1443687
ttttcttgtt

SEQ ID NO: 172362 - DNA, 10 bp, Unknown
  misc_feature (1)..( 10): Result.005 file - promoters50/1443687
aggttttgaa

SEQ ID NO: 172363 - DNA, 10 bp, Unknown
  misc_feature (1)..( 10): Result.005 file - promoters50/1443687
cccttttgaa

SEQ ID NO: 172364 - DNA, 8 bp, Unknown
  misc_feature (1)..( 8): Result.005 file - promoters50/1443687
caaagcat

SEQ ID NO: 172365 - DNA, 8 bp, Unknown
  misc_feature (1)..( 8): Result.005 file - promoters50/1443687
aaaaacat

SEQ ID NO: 172366 - DNA, 8 bp, Unknown
  misc_feature (1)..( 8): Result.005 file - promoters50/1443687
aaaaactt

SEQ ID NO: 172367 - DNA, 9 bp, Unknown
  misc_feature (1)..( 9): Result.005 file - promoters50/1443687
aaagaacaa

SEQ ID NO: 172368 - DNA, 9 bp, Unknown
  misc_feature (1)..( 9): Result.005 file - promoters50/1443687
caaggacaa

SEQ ID NO: 172369 - DNA, 11 bp, Unknown
  misc_feature (1)..( 11): Result.005 file - promoters50/1443687
tcttattttac

SEQ ID NO: 172370 - DNA, 11 bp, Unknown
  misc_feature (1)..( 11): Result.005 file - promoters50/1443687
taaaattttag

SEQ ID NO: 172371 - DNA, 11 bp, Unknown
  misc_feature (1)..( 11): Result.005 file - promoters50/1443687
aactcttttac

SEQ ID NO: 172372 - DNA, 11 bp, Unknown
  misc_feature (1)..( 11): Result.005 file - promoters50/1443687
tcttctttttc

SEQ ID NO: 172373 - DNA, 11 bp, Unknown
  misc_feature (1)..( 11): Result.005 file - promoters50/1443687
aaaaactttat

SEQ ID NO: 172374 - DNA, 11 bp, Unknown
  misc_feature (1)..( 11): Result.005 file - promoters50/1443687
ctaaagtttaa

SEQ ID NO: 172375 - DNA, 7 bp, Unknown
  misc_feature (1)..( 7): Result.005 file - promoters50/1443711
aatataa

SEQ ID NO: 172376 - DNA, 7 bp, Unknown
  misc_feature (1)..( 7): Result.005 file - promoters50/1443711
aatatag

SEQ ID NO: 172377 - DNA, 7 bp, Unknown
  misc_feature (1)..( 7): Result.005 file - promoters50/1443711
aatttag

SEQ ID NO: 172378 - DNA, 10 bp, Unknown
  misc_feature (1)..( 10): Result.005 file - promoters50/1443711
attataaagt

SEQ ID NO: 172379 - DNA, 10 bp, Unknown
  misc_feature (1)..( 10): Result.005 file - promoters50/1443711
attttaaaat

SEQ ID NO: 172380 - DNA, 10 bp, Unknown
  misc_feature (1)..( 10): Result.005 file - promoters50/1443711
attagaatat

SEQ ID NO: 172381 - DNA, 9 bp, Unknown
  misc_feature (1)..( 9): Result.005 file - promoters50/1444131
atattaaca

SEQ ID NO: 172382 - DNA, 9 bp, Unknown
  misc_feature (1)..( 9): Result.005 file - promoters50/1444131
aaatttaca

SEQ ID NO: 172383 - DNA, 9 bp, Unknown
  misc_feature (1)..( 9): Result.005 file - promoters50/1444131
aaagttaaa

SEQ ID NO: 172384 - DNA, 9 bp, Unknown
  misc_feature (1)..( 9): Result.005 file - promoters50/1444131
atctttaca

SEQ ID NO: 172385 - DNA, 9 bp, Unknown
  misc_feature (1)..( 9): Result.005 file - promoters50/1444131
atagttaaa

SEQ ID NO: 172386 - DNA, 9 bp, Unknown
  misc_feature (1)..( 9): Result.005 file - promoters50/1444131
ctagttaat

SEQ ID NO: 172387 - DNA, 9 bp, Unknown
  misc_feature (1)..( 9): Result.005 file - promoters50/1444131
ttatttctt

SEQ ID NO: 172388 - DNA, 9 bp, Unknown
  misc_feature (1)..( 9): Result.005 file - promoters50/1444131
atatgtctg

SEQ ID NO: 172389 - DNA, 9 bp, Unknown
  misc_feature (1)..( 9): Result.005 file - promoters50/1444131
gtttttttc

SEQ ID NO: 172390 - DNA, 9 bp, Unknown
  misc_feature (1)..( 9): Result.005 file - promoters50/1444131
atttttttc

SEQ ID NO: 172391 - DNA, 9 bp, Unknown
  misc_feature (1)..( 9): Result.005 file - promoters50/1444131
ttattttgc

SEQ ID NO: 172392 - DNA, 9 bp, Unknown
  misc_feature (1)..( 9): Result.005 file - promoters50/1444131
ctttttttg

SEQ ID NO: 172393 - DNA, 9 bp, Unknown
  misc_feature (1)..( 9): Result.005 file - promoters50/1444131
ttatatctt

SEQ ID NO: 172394 - DNA, 9 bp, Unknown
  misc_feature (1)..( 9): Result.005 file - promoters50/1444156
aaaataaaa

SEQ ID NO: 172395 - DNA, 9 bp, Unknown
  misc_feature (1)..( 9): Result.005 file - promoters50/1444156
aaaataaaa

SEQ ID NO: 172396 - DNA, 9 bp, Unknown
  misc_feature (1)..( 9): Result.005 file - promoters50/1444156
gaaatgaaa

SEQ ID NO: 172397 - DNA, 10 bp, Unknown
  misc_feature (1)..( 10): Result.005 file - promoters50/1444156
ataaaagagt

SEQ ID NO: 172398 - DNA, 10 bp, Unknown
  misc_feature (1)..( 10): Result.005 file - promoters50/1444156
ggaaaagaaa

SEQ ID NO: 172399 - DNA, 10 bp, Unknown
  misc_feature (1)..( 10): Result.005 file - promoters50/1444156
ggaaatgaaa

SEQ ID NO: 172400 - DNA, 7 bp, Unknown
  misc_feature (1)..( 7): Result.005 file - promoters50/1444156
tttaatg

SEQ ID NO: 172401 - DNA, 7 bp, Unknown
  misc_feature (1)..( 7): Result.005 file - promoters50/1444156
tttaata

SEQ ID NO: 172402 - DNA, 7 bp, Unknown
  misc_feature (1)..( 7): Result.005 file - promoters50/1444156
gttaata

SEQ ID NO: 172403 - DNA, 11 bp, Unknown
  misc_feature (1)..( 11): Result.005 file - promoters50/1444156
cttcaaacaca

SEQ ID NO: 172404 - DNA, 11 bp, Unknown
  misc_feature (1)..( 11): Result.005 file - promoters50/1444156
cttgaaacaaa

SEQ ID NO: 172405 - DNA, 11 bp, Unknown
  misc_feature (1)..( 11): Result.005 file - promoters50/1444156
ggagaaagaaa

SEQ ID NO: 172406 - DNA, 9 bp, Unknown
  misc_feature (1)..( 9): Result.005 file - promoters50/1444156
aaatgaaga

SEQ ID NO: 172407 - DNA, 9 bp, Unknown
  misc_feature (1)..( 9): Result.005 file - promoters50/1444156
cgatggaga

SEQ ID NO: 172408 - DNA, 9 bp, Unknown
  misc_feature (1)..( 9): Result.005 file - promoters50/1444156
aaatgaaat

SEQ ID NO: 172409 - DNA, 9 bp, Unknown
  misc_feature (1)..( 9): Result.005 file - promoters50/1444180
gatacaaaa

SEQ ID NO: 172410 - DNA, 9 bp, Unknown
  misc_feature (1)..( 9): Result.005 file - promoters50/1444180
gaaacaaaa

SEQ ID NO: 172411 - DNA, 9 bp, Unknown
  misc_feature (1)..( 9): Result.005 file - promoters50/1444180
gaaagaaag

SEQ ID NO: 172412 - DNA, 7 bp, Unknown
  misc_feature (1)..( 7): Result.005 file - promoters50/1444180
tcatata

SEQ ID NO: 172413 - DNA, 7 bp, Unknown
  misc_feature (1)..( 7): Result.005 file - promoters50/1444180
tcatatc

SEQ ID NO: 172414 - DNA, 7 bp, Unknown
  misc_feature (1)..( 7): Result.005 file - promoters50/1444180
tcatatc

SEQ ID NO: 172415 - DNA, 9 bp, Unknown
  misc_feature (1)..( 9): Result.005 file - promoters50/1444180
ctatttttg

SEQ ID NO: 172416 - DNA, 9 bp, Unknown
  misc_feature (1)..( 9): Result.005 file - promoters50/1444180
atatctttg

SEQ ID NO: 172417 - DNA, 9 bp, Unknown
  misc_feature (1)..( 9): Result.005 file - promoters50/1444180
ataacttga

SEQ ID NO: 172418 - DNA, 8 bp, Unknown
  misc_feature (1)..( 8): Result.005 file - promoters50/1444180
gtatatat

SEQ ID NO: 172419 - DNA, 8 bp, Unknown
  misc_feature (1)..( 8): Result.005 file - promoters50/1444180
gtatataa

SEQ ID NO: 172420 - DNA, 8 bp, Unknown
  misc_feature (1)..( 8): Result.005 file - promoters50/1444180
gtatctaa

SEQ ID NO: 172421 - DNA, 11 bp, Unknown
  misc_feature (1)..( 11): Result.005 file - promoters50/1444196
tttttgtaatt

SEQ ID NO: 172422 - DNA, 11 bp, Unknown
  misc_feature (1)..( 11): Result.005 file - promoters50/1444196
cacttgtaaga

SEQ ID NO: 172423 - DNA, 11 bp, Unknown
  misc_feature (1)..( 11): Result.005 file - promoters50/1444196
tttttgaaatt

SEQ ID NO: 172424 - DNA, 11 bp, Unknown
  misc_feature (1)..( 11): Result.005 file - promoters50/1444196
tgattgaaaat

SEQ ID NO: 172425 - DNA, 10 bp, Unknown
  misc_feature (1)..( 10): Result.005 file - promoters50/1444196
tcttctgttt

SEQ ID NO: 172426 - DNA, 10 bp, Unknown
  misc_feature (1)..( 10): Result.005 file - promoters50/1444196
gcttttgtca

SEQ ID NO: 172427 - DNA, 10 bp, Unknown
  misc_feature (1)..( 10): Result.005 file - promoters50/1444196
tgatctgttt

SEQ ID NO: 172428 - DNA, 10 bp, Unknown
  misc_feature (1)..( 10): Result.005 file - promoters50/1444196
tcttcttcgg

SEQ ID NO: 172429 - DNA, 14 bp, Unknown
  misc_feature (1)..( 14): Result.005 file - promoters50/1444400
tgtgttcgtttggt

SEQ ID NO: 172430 - DNA, 14 bp, Unknown
  misc_feature (1)..( 14): Result.005 file - promoters50/1444400
tgtggtcggctaaa

SEQ ID NO: 172431 - DNA, 14 bp, Unknown
  misc_feature (1)..( 14): Result.005 file - promoters50/1444400
gatgttcgtttggt

SEQ ID NO: 172432 - DNA, 14 bp, Unknown
  misc_feature (1)..( 14): Result.005 file - promoters50/1444400
tgtagtcttgactg

SEQ ID NO: 172433 - DNA, 7 bp, Unknown
  misc_feature (1)..( 7): Result.005 file - promoters50/1444430
attcttt

SEQ ID NO: 172434 - DNA, 7 bp, Unknown
  misc_feature (1)..( 7): Result.005 file - promoters50/1444430
attcttt

SEQ ID NO: 172435 - DNA, 7 bp, Unknown
  misc_feature (1)..( 7): Result.005 file - promoters50/1444430
attattt

SEQ ID NO: 172436 - DNA, 14 bp, Unknown
  misc_feature (1)..( 14): Result.005 file - promoters50/1444441
aattattttaaata

SEQ ID NO: 172437 - DNA, 14 bp, Unknown
  misc_feature (1)..( 14): Result.005 file - promoters50/1444441
ttttaatttctttt

SEQ ID NO: 172438 - DNA, 14 bp, Unknown
  misc_feature (1)..( 14): Result.005 file - promoters50/1444441
caataatttacgaa

SEQ ID NO: 172439 - DNA, 14 bp, Unknown
  misc_feature (1)..( 14): Result.005 file - promoters50/1444441
aaagtttttgtaat

SEQ ID NO: 172440 - DNA, 14 bp, Unknown
  misc_feature (1)..( 14): Result.005 file - promoters50/1444441
tatccttttcaatt

SEQ ID NO: 172441 - DNA, 14 bp, Unknown
  misc_feature (1)..( 14): Result.005 file - promoters50/1444441
cttgtgtttgatta

SEQ ID NO: 172442 - DNA, 14 bp, Unknown
  misc_feature (1)..( 14): Result.005 file - promoters50/1444441
aaatagtttactat

SEQ ID NO: 172443 - DNA, 9 bp, Unknown
  misc_feature (1)..( 9): Result.005 file - promoters50/1444441
attttaaat

SEQ ID NO: 172444 - DNA, 9 bp, Unknown
  misc_feature (1)..( 9): Result.005 file - promoters50/1444441
tttttaatt

SEQ ID NO: 172445 - DNA, 10 bp, Unknown
  misc_feature (1)..( 10): Result.005 file - promoters50/1444441
cttttcaatt

SEQ ID NO: 172446 - DNA, 10 bp, Unknown
  misc_feature (1)..( 10): Result.005 file - promoters50/1444441
ttttgtaata

SEQ ID NO: 172447 - DNA, 10 bp, Unknown
  misc_feature (1)..( 10): Result.005 file - promoters50/1444441
gtttgattag

SEQ ID NO: 172448 - DNA, 10 bp, Unknown
  misc_feature (1)..( 10): Result.005 file - promoters50/1444441
aattgtgata

SEQ ID NO: 172449 - DNA, 14 bp, Unknown
  misc_feature (1)..( 14): Result.005 file - promoters50/1444441
tttataaatatttt

SEQ ID NO: 172450 - DNA, 14 bp, Unknown
  misc_feature (1)..( 14): Result.005 file - promoters50/1444441
cacatatatatagt

SEQ ID NO: 172451 - DNA, 14 bp, Unknown
  misc_feature (1)..( 14): Result.005 file - promoters50/1444441
tttatacataataa

SEQ ID NO: 172452 - DNA, 14 bp, Unknown
  misc_feature (1)..( 14): Result.005 file - promoters50/1444441
gttattaataaatt

SEQ ID NO: 172453 - DNA, 14 bp, Unknown
  misc_feature (1)..( 14): Result.005 file - promoters50/1444441
tcaattaatctttt

SEQ ID NO: 172454 - DNA, 14 bp, Unknown
  misc_feature (1)..( 14): Result.005 file - promoters50/1444441
tgtaataataactc

SEQ ID NO: 172455 - DNA, 14 bp, Unknown
  misc_feature (1)..( 14): Result.005 file - promoters50/1444441
ttgattagtaaaag

SEQ ID NO: 172456 - DNA, 14 bp, Unknown
  misc_feature (1)..( 14): Result.005 file - promoters50/1444441
actatttttaatta

SEQ ID NO: 172457 - DNA, 14 bp, Unknown
  misc_feature (1)..( 14): Result.005 file - promoters50/1444441
tggttttataatcg

SEQ ID NO: 172458 - DNA, 14 bp, Unknown
  misc_feature (1)..( 14): Result.005 file - promoters50/1444441
ctaattttgtcaaa

SEQ ID NO: 172459 - DNA, 14 bp, Unknown
  misc_feature (1)..( 14): Result.005 file - promoters50/1444441
ataaattttgatta

SEQ ID NO: 172460 - DNA, 14 bp, Unknown
  misc_feature (1)..( 14): Result.005 file - promoters50/1444441
ctatttttttatct

SEQ ID NO: 172461 - DNA, 14 bp, Unknown
  misc_feature (1)..( 14): Result.005 file - promoters50/1444441
aactcttttgaagt

SEQ ID NO: 172462 - DNA, 14 bp, Unknown
  misc_feature (1)..( 14): Result.005 file - promoters50/1444441
taatcttttggggt

SEQ ID NO: 172463 - DNA, 15 bp, Unknown
  misc_feature (1)..( 15): Result.005 file - promoters50/1444441
cgggtttttcggtta

SEQ ID NO: 172464 - DNA, 15 bp, Unknown
  misc_feature (1)..( 15): Result.005 file - promoters50/1444441
gacgtttttgtctat

SEQ ID NO: 172465 - DNA, 15 bp, Unknown
  misc_feature (1)..( 15): Result.005 file - promoters50/1444441
acggtttactaaggt

SEQ ID NO: 172466 - DNA, 15 bp, Unknown
  misc_feature (1)..( 15): Result.005 file - promoters50/1444441
tctttttttgtttct

SEQ ID NO: 172467 - DNA, 15 bp, Unknown
  misc_feature (1)..( 15): Result.005 file - promoters50/1444441
ttacttttttttttt

SEQ ID NO: 172468 - DNA, 15 bp, Unknown
  misc_feature (1)..( 15): Result.005 file - promoters50/1444441
accatttttgttcca

SEQ ID NO: 172469 - DNA, 17 bp, Unknown
  misc_feature (1)..( 17): Result.005 file - promoters50/1444441
attatttaatctagaaa

SEQ ID NO: 172470 - DNA, 17 bp, Unknown
  misc_feature (1)..( 17): Result.005 file - promoters50/1444441
taaattcaatcaaatcg

SEQ ID NO: 172471 - DNA, 17 bp, Unknown
  misc_feature (1)..( 17): Result.005 file - promoters50/1444441
atttttttatctataaa

SEQ ID NO: 172472 - DNA, 17 bp, Unknown
  misc_feature (1)..( 17): Result.005 file - promoters50/1444441
atggttttataatcgat

SEQ ID NO: 172473 - DNA, 17 bp, Unknown
  misc_feature (1)..( 17): Result.005 file - promoters50/1444441
aatattcaactatacat

SEQ ID NO: 172474 - DNA, 17 bp, Unknown
  misc_feature (1)..( 17): Result.005 file - promoters50/1444441
agaataaaaacagtgat

SEQ ID NO: 172475 - DNA, 13 bp, Unknown
  misc_feature (1)..( 13): Result.005 file - promoters50/1444441
aaatattttataa

SEQ ID NO: 172476 - DNA, 13 bp, Unknown
  misc_feature (1)..( 13): Result.005 file - promoters50/1444441
tattattttttgt

SEQ ID NO: 172477 - DNA, 13 bp, Unknown
  misc_feature (1)..( 13): Result.005 file - promoters50/1444441
taatcttttgggg

SEQ ID NO: 172478 - DNA, 13 bp, Unknown
  misc_feature (1)..( 13): Result.005 file - promoters50/1444441
ttttaatttcttt

SEQ ID NO: 172479 - DNA, 13 bp, Unknown
  misc_feature (1)..( 13): Result.005 file - promoters50/1444441
cttgtgtttgatt

SEQ ID NO: 172480 - DNA, 13 bp, Unknown
  misc_feature (1)..( 13): Result.005 file - promoters50/1444441
taatgtttttcta

SEQ ID NO: 172481 - DNA, 13 bp, Unknown
  misc_feature (1)..( 13): Result.005 file - promoters50/1444441
aactcttttgaag

SEQ ID NO: 172482 - DNA, 10 bp, Unknown
  misc_feature (1)..( 10): Result.005 file - promoters50/1444441
aaatattttc

SEQ ID NO: 172483 - DNA, 10 bp, Unknown
  misc_feature (1)..( 10): Result.005 file - promoters50/1444441
ttctattttt

SEQ ID NO: 172484 - DNA, 10 bp, Unknown
  misc_feature (1)..( 10): Result.005 file - promoters50/1444441
taatcttttg

SEQ ID NO: 172485 - DNA, 10 bp, Unknown
  misc_feature (1)..( 10): Result.005 file - promoters50/1444441
atttcttttc

SEQ ID NO: 172486 - DNA, 10 bp, Unknown
  misc_feature (1)..( 10): Result.005 file - promoters50/1444441
taatgttttt

SEQ ID NO: 172487 - DNA, 10 bp, Unknown
  misc_feature (1)..( 10): Result.005 file - promoters50/1444441
aactcttttg

SEQ ID NO: 172488 - DNA, 17 bp, Unknown
  misc_feature (1)..( 17): Result.005 file - promoters50/1444443
aactaaaaagtataaaa

SEQ ID NO: 172489 - DNA, 17 bp, Unknown
  misc_feature (1)..( 17): Result.005 file - promoters50/1444443
ggctagaaagtataaaa

SEQ ID NO: 172490 - DNA, 17 bp, Unknown
  misc_feature (1)..( 17): Result.005 file - promoters50/1444443
aacgaaacctatataac

SEQ ID NO: 172491 - DNA, 7 bp, Unknown
  misc_feature (1)..( 7): Result.005 file - promoters50/1444443
tttattt

SEQ ID NO: 172492 - DNA, 7 bp, Unknown
  misc_feature (1)..( 7): Result.005 file - promoters50/1444443
cttattt

SEQ ID NO: 172493 - DNA, 7 bp, Unknown
  misc_feature (1)..( 7): Result.005 file - promoters50/1444443
tttattt

SEQ ID NO: 172494 - DNA, 8 bp, Unknown
  misc_feature (1)..( 8): Result.005 file - promoters50/1444443
gtgtgttt

SEQ ID NO: 172495 - DNA, 8 bp, Unknown
  misc_feature (1)..( 8): Result.005 file - promoters50/1444443
atgttttt

SEQ ID NO: 172496 - DNA, 8 bp, Unknown
  misc_feature (1)..( 8): Result.005 file - promoters50/1444443
atgctttt

SEQ ID NO: 172497 - DNA, 7 bp, Unknown
  misc_feature (1)..( 7): Result.005 file - promoters50/1444448
tgtttta

SEQ ID NO: 172498 - DNA, 7 bp, Unknown
  misc_feature (1)..( 7): Result.005 file - promoters50/1444448
tgtttta

SEQ ID NO: 172499 - DNA, 7 bp, Unknown
  misc_feature (1)..( 7): Result.005 file - promoters50/1444448
tgttttt

SEQ ID NO: 172500 - DNA, 8 bp, Unknown
  misc_feature (1)..( 8): Result.005 file - promoters50/1444448
ataaatta

SEQ ID NO: 172501 - DNA, 8 bp, Unknown
  misc_feature (1)..( 8): Result.005 file - promoters50/1444448
ataaatcg

SEQ ID NO: 172502 - DNA, 8 bp, Unknown
  misc_feature (1)..( 8): Result.005 file - promoters50/1444448
ataaaaaa

SEQ ID NO: 172503 - DNA, 8 bp, Unknown
  misc_feature (1)..( 8): Result.005 file - promoters50/1444448
ttaaattt

SEQ ID NO: 172504 - DNA, 8 bp, Unknown
  misc_feature (1)..( 8): Result.005 file - promoters50/1444448
ctaaattg

SEQ ID NO: 172505 - DNA, 8 bp, Unknown
  misc_feature (1)..( 8): Result.005 file - promoters50/1444448
taaaattc

SEQ ID NO: 172506 - DNA, 7 bp, Unknown
  misc_feature (1)..( 7): Result.005 file - promoters50/1444448
tttttga

SEQ ID NO: 172507 - DNA, 7 bp, Unknown
  misc_feature (1)..( 7): Result.005 file - promoters50/1444448
tttttga

SEQ ID NO: 172508 - DNA, 7 bp, Unknown
  misc_feature (1)..( 7): Result.005 file - promoters50/1444448
tttttgt

SEQ ID NO: 172509 - DNA, 11 bp, Unknown
  misc_feature (1)..( 11): Result.005 file - promoters50/1444473
cttggttattg

SEQ ID NO: 172510 - DNA, 11 bp, Unknown
  misc_feature (1)..( 11): Result.005 file - promoters50/1444473
ccatgtttttg

SEQ ID NO: 172511 - DNA, 11 bp, Unknown
  misc_feature (1)..( 11): Result.005 file - promoters50/1444473
tcatctttttc

SEQ ID NO: 172512 - DNA, 11 bp, Unknown
  misc_feature (1)..( 11): Result.005 file - promoters50/1444473
gaatctttcga

SEQ ID NO: 172513 - DNA, 11 bp, Unknown
  misc_feature (1)..( 11): Result.005 file - promoters50/1444473
tattgttttct

SEQ ID NO: 172514 - DNA, 11 bp, Unknown
  misc_feature (1)..( 11): Result.005 file - promoters50/1444473
tatagttttaa

SEQ ID NO: 172515 - DNA, 18 bp, Unknown
  misc_feature (1)..( 18): Result.005 file - promoters50/1444479
aaagattattaaattata

SEQ ID NO: 172516 - DNA, 18 bp, Unknown
  misc_feature (1)..( 18): Result.005 file - promoters50/1444479
aaaaattattaaagtata

SEQ ID NO: 172517 - DNA, 18 bp, Unknown
  misc_feature (1)..( 18): Result.005 file - promoters50/1444479
atgtcttataataattga

SEQ ID NO: 172518 - DNA, 18 bp, Unknown
  misc_feature (1)..( 18): Result.005 file - promoters50/1444479
tctcatttttaatcaaaa

SEQ ID NO: 172519 - DNA, 18 bp, Unknown
  misc_feature (1)..( 18): Result.005 file - promoters50/1444479
atacattataatagtatg

SEQ ID NO: 172520 - DNA, 16 bp, Unknown
  misc_feature (1)..( 16): Result.005 file - promoters50/1444479
atatttgtaatcgata

SEQ ID NO: 172521 - DNA, 10 bp, Unknown
  misc_feature (1)..( 10): Result.005 file - promoters50/1444479
attattaaag

SEQ ID NO: 172522 - DNA, 10 bp, Unknown
  misc_feature (1)..( 10): Result.005 file - promoters50/1444479
tttactaata

SEQ ID NO: 172523 - DNA, 10 bp, Unknown
  misc_feature (1)..( 10): Result.005 file - promoters50/1444479
tataataatt

SEQ ID NO: 172524 - DNA, 10 bp, Unknown
  misc_feature (1)..( 10): Result.005 file - promoters50/1444479
tttgctatac

SEQ ID NO: 172525 - DNA, 10 bp, Unknown
  misc_feature (1)..( 10): Result.005 file - promoters50/1444479
aataccaatc

SEQ ID NO: 172526 - DNA, 10 bp, Unknown
  misc_feature (1)..( 10): Result.005 file - promoters50/1444479
gttactattc

SEQ ID NO: 172527 - DNA, 10 bp, Unknown
  misc_feature (1)..( 10): Result.005 file - promoters50/1444479
actaaaaata

SEQ ID NO: 172528 - DNA, 13 bp, Unknown
  misc_feature (1)..( 13): Result.005 file - promoters50/1444479
ctaattttaattt

SEQ ID NO: 172529 - DNA, 13 bp, Unknown
  misc_feature (1)..( 13): Result.005 file - promoters50/1444479
ataattttagaga

SEQ ID NO: 172530 - DNA, 13 bp, Unknown
  misc_feature (1)..( 13): Result.005 file - promoters50/1444479
atcattttcattt

SEQ ID NO: 172531 - DNA, 13 bp, Unknown
  misc_feature (1)..( 13): Result.005 file - promoters50/1444479
ataattatttggt

SEQ ID NO: 172532 - DNA, 13 bp, Unknown
  misc_feature (1)..( 13): Result.005 file - promoters50/1444479
atactttatcgtc

SEQ ID NO: 172533 - DNA, 13 bp, Unknown
  misc_feature (1)..( 13): Result.005 file - promoters50/1444479
tacattttgtaac

SEQ ID NO: 172534 - DNA, 9 bp, Unknown
  misc_feature (1)..( 9): Result.005 file - promoters50/1444479
atattttag

SEQ ID NO: 172535 - DNA, 9 bp, Unknown
  misc_feature (1)..( 9): Result.005 file - promoters50/1444479
tcattttac

SEQ ID NO: 172536 - DNA, 9 bp, Unknown
  misc_feature (1)..( 9): Result.005 file - promoters50/1444479
ttattttta

SEQ ID NO: 172537 - DNA, 9 bp, Unknown
  misc_feature (1)..( 9): Result.005 file - promoters50/1444479
atattttcc

SEQ ID NO: 172538 - DNA, 9 bp, Unknown
  misc_feature (1)..( 9): Result.005 file - promoters50/1444479
taattttag

SEQ ID NO: 172539 - DNA, 10 bp, Unknown
  misc_feature (1)..( 10): Result.005 file - promoters50/1444479
cagtttttac

SEQ ID NO: 172540 - DNA, 10 bp, Unknown
  misc_feature (1)..( 10): Result.005 file - promoters50/1444479
ccatctttaa

SEQ ID NO: 172541 - DNA, 13 bp, Unknown
  misc_feature (1)..( 13): Result.005 file - promoters50/1444479
ttatttatatgtt

SEQ ID NO: 172542 - DNA, 13 bp, Unknown
  misc_feature (1)..( 13): Result.005 file - promoters50/1444479
ctatatatatctc

SEQ ID NO: 172543 - DNA, 13 bp, Unknown
  misc_feature (1)..( 13): Result.005 file - promoters50/1444479
gtatatataaata

SEQ ID NO: 172544 - DNA, 13 bp, Unknown
  misc_feature (1)..( 13): Result.005 file - promoters50/1444479
ctgtctatatgac

SEQ ID NO: 172545 - DNA, 13 bp, Unknown
  misc_feature (1)..( 13): Result.005 file - promoters50/1444479
ctatataaacaca

SEQ ID NO: 172546 - DNA, 13 bp, Unknown
  misc_feature (1)..( 13): Result.005 file - promoters50/1444479
gtgtctataaata

SEQ ID NO: 172547 - DNA, 13 bp, Unknown
  misc_feature (1)..( 13): Result.005 file - promoters50/1444479
aaatctataaaaa

SEQ ID NO: 172548 - DNA, 9 bp, Unknown
  misc_feature (1)..( 9): Result.005 file - promoters50/1444502
ttgaatata

SEQ ID NO: 172549 - DNA, 9 bp, Unknown
  misc_feature (1)..( 9): Result.005 file - promoters50/1444502
gagaatata

SEQ ID NO: 172550 - DNA, 9 bp, Unknown
  misc_feature (1)..( 9): Result.005 file - promoters50/1444502
ttgcataac

SEQ ID NO: 172551 - DNA, 9 bp, Unknown
  misc_feature (1)..( 9): Result.005 file - promoters50/1444502
tgaaatata

SEQ ID NO: 172552 - DNA, 10 bp, Unknown
  misc_feature (1)..( 10): Result.005 file - promoters50/1444502
cattttttgt

SEQ ID NO: 172553 - DNA, 10 bp, Unknown
  misc_feature (1)..( 10): Result.005 file - promoters50/1444502
aattctttct

SEQ ID NO: 172554 - DNA, 10 bp, Unknown
  misc_feature (1)..( 10): Result.005 file - promoters50/1444502
catattttat

SEQ ID NO: 172555 - DNA, 10 bp, Unknown
  misc_feature (1)..( 10): Result.005 file - promoters50/1444502
gattgtttgt

SEQ ID NO: 172556 - DNA, 10 bp, Unknown
  misc_feature (1)..( 10): Result.005 file - promoters50/1444502
gaaaaaaaag

SEQ ID NO: 172557 - DNA, 10 bp, Unknown
  misc_feature (1)..( 10): Result.005 file - promoters50/1444502
caaaaaaaaa

SEQ ID NO: 172558 - DNA, 10 bp, Unknown
  misc_feature (1)..( 10): Result.005 file - promoters50/1444502
gaagaaaaag

SEQ ID NO: 172559 - DNA, 10 bp, Unknown
  misc_feature (1)..( 10): Result.005 file - promoters50/1444502
attcaaaaag

SEQ ID NO: 172560 - DNA, 11 bp, Unknown
  misc_feature (1)..( 11): Result.005 file - promoters50/1444502
ttttgtttgtt

SEQ ID NO: 172561 - DNA, 11 bp, Unknown
  misc_feature (1)..( 11): Result.005 file - promoters50/1444502
atttgtttgta

SEQ ID NO: 172562 - DNA, 11 bp, Unknown
  misc_feature (1)..( 11): Result.005 file - promoters50/1444502
atttgtctgtt

SEQ ID NO: 172563 - DNA, 11 bp, Unknown
  misc_feature (1)..( 11): Result.005 file - promoters50/1444502
ttttgtttttg

SEQ ID NO: 172564 - DNA, 18 bp, Unknown
  misc_feature (1)..( 18): Result.005 file - promoters50/1444506
aaaaattattaaagtata

SEQ ID NO: 172565 - DNA, 18 bp, Unknown
  misc_feature (1)..( 18): Result.005 file - promoters50/1444506
aaagattattaaattata

SEQ ID NO: 172566 - DNA, 18 bp, Unknown
  misc_feature (1)..( 18): Result.005 file - promoters50/1444506
aaaatttatctgtaaatg

SEQ ID NO: 172567 - DNA, 18 bp, Unknown
  misc_feature (1)..( 18): Result.005 file - promoters50/1444506
aaaatatgaatataatga

SEQ ID NO: 172568 - DNA, 18 bp, Unknown
  misc_feature (1)..( 18): Result.005 file - promoters50/1444506
tatgtatattgcggatta

SEQ ID NO: 172569 - DNA, 18 bp, Unknown
  misc_feature (1)..( 18): Result.005 file - promoters50/1444506
aaaacatgagtactcgat

SEQ ID NO: 172570 - DNA, 18 bp, Unknown
  misc_feature (1)..( 18): Result.005 file - promoters50/1444506
ttaatatgagaaactaaa

SEQ ID NO: 172571 - DNA, 10 bp, Unknown
  misc_feature (1)..( 10): Result.005 file - promoters50/1444506
attttacttt

SEQ ID NO: 172572 - DNA, 10 bp, Unknown
  misc_feature (1)..( 10): Result.005 file - promoters50/1444506
attttagtcg

SEQ ID NO: 172573 - DNA, 10 bp, Unknown
  misc_feature (1)..( 10): Result.005 file - promoters50/1444506
tttttactca

SEQ ID NO: 172574 - DNA, 10 bp, Unknown
  misc_feature (1)..( 10): Result.005 file - promoters50/1444506
tttttaccct

SEQ ID NO: 172575 - DNA, 10 bp, Unknown
  misc_feature (1)..( 10): Result.005 file - promoters50/1444506
attttagcaa

SEQ ID NO: 172576 - DNA, 10 bp, Unknown
  misc_feature (1)..( 10): Result.005 file - promoters50/1444506
tctttaacaa

SEQ ID NO: 172577 - DNA, 12 bp, Unknown
  misc_feature (1)..( 12): Result.005 file - promoters50/1444506
actatatatatc

SEQ ID NO: 172578 - DNA, 12 bp, Unknown
  misc_feature (1)..( 12): Result.005 file - promoters50/1444506
tttatttatatg

SEQ ID NO: 172579 - DNA, 12 bp, Unknown
  misc_feature (1)..( 12): Result.005 file - promoters50/1444506
actctatataaa

SEQ ID NO: 172580 - DNA, 12 bp, Unknown
  misc_feature (1)..( 12): Result.005 file - promoters50/1444506
cgtatatataaa

SEQ ID NO: 172581 - DNA, 12 bp, Unknown
  misc_feature (1)..( 12): Result.005 file - promoters50/1444506
tgtctatatgac

SEQ ID NO: 172582 - DNA, 12 bp, Unknown
  misc_feature (1)..( 12): Result.005 file - promoters50/1444506
aatctataaaaa

SEQ ID NO: 172583 - DNA, 12 bp, Unknown
  misc_feature (1)..( 12): Result.005 file - promoters50/1444506
ttcgtatatgaa

SEQ ID NO: 172584 - DNA, 10 bp, Unknown
  misc_feature (1)..( 10): Result.005 file - promoters50/1444506
aattttgtta

SEQ ID NO: 172585 - DNA, 10 bp, Unknown
  misc_feature (1)..( 10): Result.005 file - promoters50/1444506
ctttttgttt

SEQ ID NO: 172586 - DNA, 10 bp, Unknown
  misc_feature (1)..( 10): Result.005 file - promoters50/1444506
agatttgtta

SEQ ID NO: 172587 - DNA, 10 bp, Unknown
  misc_feature (1)..( 10): Result.005 file - promoters50/1444506
ttatttgtaa

SEQ ID NO: 172588 - DNA, 10 bp, Unknown
  misc_feature (1)..( 10): Result.005 file - promoters50/1444506
gtatatgtta

SEQ ID NO: 172589 - DNA, 10 bp, Unknown
  misc_feature (1)..( 10): Result.005 file - promoters50/1444506
ttatttgaag

SEQ ID NO: 172590 - DNA, 10 bp, Unknown
  misc_feature (1)..( 10): Result.005 file - promoters50/1444514
attaataaag

SEQ ID NO: 172591 - DNA, 13 bp, Unknown
  misc_feature (1)..( 13): Result.005 file - promoters50/1444514
aaaattattaaag

SEQ ID NO: 172592 - DNA, 13 bp, Unknown
  misc_feature (1)..( 13): Result.005 file - promoters50/1444514
aaaatttatctgt

SEQ ID NO: 172593 - DNA, 13 bp, Unknown
  misc_feature (1)..( 13): Result.005 file - promoters50/1444514
atgattatttttt

SEQ ID NO: 172594 - DNA, 13 bp, Unknown
  misc_feature (1)..( 13): Result.005 file - promoters50/1444514
gaaaatatgaata

SEQ ID NO: 172595 - DNA, 13 bp, Unknown
  misc_feature (1)..( 13): Result.005 file - promoters50/1444514
taaaacatgagta

SEQ ID NO: 172596 - DNA, 13 bp, Unknown
  misc_feature (1)..( 13): Result.005 file - promoters50/1444514
aattattaaagta

SEQ ID NO: 172597 - DNA, 13 bp, Unknown
  misc_feature (1)..( 13): Result.005 file - promoters50/1444514
atttactaataga

SEQ ID NO: 172598 - DNA, 13 bp, Unknown
  misc_feature (1)..( 13): Result.005 file - promoters50/1444514
ttataataattga

SEQ ID NO: 172599 - DNA, 13 bp, Unknown
  misc_feature (1)..( 13): Result.005 file - promoters50/1444514
aatgattattttt

SEQ ID NO: 172600 - DNA, 13 bp, Unknown
  misc_feature (1)..( 13): Result.005 file - promoters50/1444514
ttttgctatactc

SEQ ID NO: 172601 - DNA, 13 bp, Unknown
  misc_feature (1)..( 13): Result.005 file - promoters50/1444514
aaaaactaaatga

SEQ ID NO: 172602 - DNA, 13 bp, Unknown
  misc_feature (1)..( 13): Result.005 file - promoters50/1444514
tgaatataatgag

SEQ ID NO: 172603 - DNA, 12 bp, Unknown
  misc_feature (1)..( 12): Result.005 file - promoters50/1444514
atttatttatat

SEQ ID NO: 172604 - DNA, 12 bp, Unknown
  misc_feature (1)..( 12): Result.005 file - promoters50/1444514
cactatatatat

SEQ ID NO: 172605 - DNA, 12 bp, Unknown
  misc_feature (1)..( 12): Result.005 file - promoters50/1444514
tcgtatatataa

SEQ ID NO: 172606 - DNA, 12 bp, Unknown
  misc_feature (1)..( 12): Result.005 file - promoters50/1444514
atttgtttatgt

SEQ ID NO: 172607 - DNA, 12 bp, Unknown
  misc_feature (1)..( 12): Result.005 file - promoters50/1444514
ctgtctatatga

SEQ ID NO: 172608 - DNA, 12 bp, Unknown
  misc_feature (1)..( 12): Result.005 file - promoters50/1444514
tactctatataa

SEQ ID NO: 172609 - DNA, 12 bp, Unknown
  misc_feature (1)..( 12): Result.005 file - promoters50/1444514
attcgtatatga

SEQ ID NO: 172610 - DNA, 12 bp, Unknown
  misc_feature (1)..( 12): Result.005 file - promoters50/1444514
ttcgaattcaaa

SEQ ID NO: 172611 - DNA, 12 bp, Unknown
  misc_feature (1)..( 12): Result.005 file - promoters50/1444514
cccgaaatcata

SEQ ID NO: 172612 - DNA, 12 bp, Unknown
  misc_feature (1)..( 12): Result.005 file - promoters50/1444514
taacaaataata

SEQ ID NO: 172613 - DNA, 12 bp, Unknown
  misc_feature (1)..( 12): Result.005 file - promoters50/1444514
ccctaaattcct

SEQ ID NO: 172614 - DNA, 12 bp, Unknown
  misc_feature (1)..( 12): Result.005 file - promoters50/1444514
agctaaaacatt

SEQ ID NO: 172615 - DNA, 12 bp, Unknown
  misc_feature (1)..( 12): Result.005 file - promoters50/1444514
gttgtaatcatt

SEQ ID NO: 172616 - DNA, 10 bp, Unknown
  misc_feature (1)..( 10): Result.005 file - promoters50/1444514
ctaattttaa

SEQ ID NO: 172617 - DNA, 10 bp, Unknown
  misc_feature (1)..( 10): Result.005 file - promoters50/1444514
aaaatgttat

SEQ ID NO: 172618 - DNA, 10 bp, Unknown
  misc_feature (1)..( 10): Result.005 file - promoters50/1444514
ctaattttag

SEQ ID NO: 172619 - DNA, 10 bp, Unknown
  misc_feature (1)..( 10): Result.005 file - promoters50/1444514
atttttttaa

SEQ ID NO: 172620 - DNA, 10 bp, Unknown
  misc_feature (1)..( 10): Result.005 file - promoters50/1444514
taaatgatat

SEQ ID NO: 172621 - DNA, 10 bp, Unknown
  misc_feature (1)..( 10): Result.005 file - promoters50/1444514
tatatgttac

SEQ ID NO: 172622 - DNA, 11 bp, Unknown
  misc_feature (1)..( 11): Result.005 file - promoters50/1444514
attatttgtaa

SEQ ID NO: 172623 - DNA, 10 bp, Unknown
  misc_feature (1)..( 10): Result.005 file - promoters50/1444514
aattttgtta

SEQ ID NO: 172624 - DNA, 10 bp, Unknown
  misc_feature (1)..( 10): Result.005 file - promoters50/1444514
ctttttgttt

SEQ ID NO: 172625 - DNA, 10 bp, Unknown
  misc_feature (1)..( 10): Result.005 file - promoters50/1444514
agatttgtta

SEQ ID NO: 172626 - DNA, 10 bp, Unknown
  misc_feature (1)..( 10): Result.005 file - promoters50/1444514
aatcttgttt

SEQ ID NO: 172627 - DNA, 10 bp, Unknown
  misc_feature (1)..( 10): Result.005 file - promoters50/1444514
tattttttta

SEQ ID NO: 172628 - DNA, 10 bp, Unknown
  misc_feature (1)..( 10): Result.005 file - promoters50/1444514
ttatttgtaa

SEQ ID NO: 172629 - DNA, 10 bp, Unknown
  misc_feature (1)..( 10): Result.005 file - promoters50/1444514
gtatatgtta

SEQ ID NO: 172630 - DNA, 7 bp, Unknown
  misc_feature (1)..( 7): Result.005 file - promoters50/1444567
atagaat

SEQ ID NO: 172631 - DNA, 7 bp, Unknown
  misc_feature (1)..( 7): Result.005 file - promoters50/1444567
atagaaa

SEQ ID NO: 172632 - DNA, 7 bp, Unknown
  misc_feature (1)..( 7): Result.005 file - promoters50/1444567
ttagaat

SEQ ID NO: 172633 - DNA, 11 bp, Unknown
  misc_feature (1)..( 11): Result.005 file - promoters50/1444567
aaaaataatct

SEQ ID NO: 172634 - DNA, 11 bp, Unknown
  misc_feature (1)..( 11): Result.005 file - promoters50/1444567
aaaaatcaatc

SEQ ID NO: 172635 - DNA, 11 bp, Unknown
  misc_feature (1)..( 11): Result.005 file - promoters50/1444567
ccaaattcaat

SEQ ID NO: 172636 - DNA, 7 bp, Unknown
  misc_feature (1)..( 7): Result.005 file - promoters50/1444567
ctaaaat

SEQ ID NO: 172637 - DNA, 7 bp, Unknown
  misc_feature (1)..( 7): Result.005 file - promoters50/1444567
ttaaaat

SEQ ID NO: 172638 - DNA, 7 bp, Unknown
  misc_feature (1)..( 7): Result.005 file - promoters50/1444567
ttataat

SEQ ID NO: 172639 - DNA, 7 bp, Unknown
  misc_feature (1)..( 7): Result.005 file - promoters50/1444567
aataatc

SEQ ID NO: 172640 - DNA, 7 bp, Unknown
  misc_feature (1)..( 7): Result.005 file - promoters50/1444567
aataatt

SEQ ID NO: 172641 - DNA, 7 bp, Unknown
  misc_feature (1)..( 7): Result.005 file - promoters50/1444567
tataatc

SEQ ID NO: 172642 - DNA, 11 bp, Unknown
  misc_feature (1)..( 11): Result.005 file - promoters50/1444567
aatctcagtga

SEQ ID NO: 172643 - DNA, 11 bp, Unknown
  misc_feature (1)..( 11): Result.005 file - promoters50/1444567
aaattcaatga

SEQ ID NO: 172644 - DNA, 11 bp, Unknown
  misc_feature (1)..( 11): Result.005 file - promoters50/1444567
aaaatcaatct

SEQ ID NO: 172645 - DNA, 7 bp, Unknown
  misc_feature (1)..( 7): Result.005 file - promoters50/1444607
aagagat

SEQ ID NO: 172646 - DNA, 7 bp, Unknown
  misc_feature (1)..( 7): Result.005 file - promoters50/1444607
aagagaa

SEQ ID NO: 172647 - DNA, 7 bp, Unknown
  misc_feature (1)..( 7): Result.005 file - promoters50/1444607
cagagaa

SEQ ID NO: 172648 - DNA, 15 bp, Unknown
  misc_feature (1)..( 15): Result.005 file - promoters50/1444629
aggattcttactttt

SEQ ID NO: 172649 - DNA, 15 bp, Unknown
  misc_feature (1)..( 15): Result.005 file - promoters50/1444629
tatatttttaaattt

SEQ ID NO: 172650 - DNA, 15 bp, Unknown
  misc_feature (1)..( 15): Result.005 file - promoters50/1444629
gagattctttggtgg

SEQ ID NO: 172651 - DNA, 15 bp, Unknown
  misc_feature (1)..( 15): Result.005 file - promoters50/1444629
atcattcgtacctcg

SEQ ID NO: 172652 - DNA, 15 bp, Unknown
  misc_feature (1)..( 15): Result.005 file - promoters50/1444629
ataatttgagcccta

SEQ ID NO: 172653 - DNA, 15 bp, Unknown
  misc_feature (1)..( 15): Result.005 file - promoters50/1444629
atcaattttaataac

SEQ ID NO: 172654 - DNA, 15 bp, Unknown
  misc_feature (1)..( 15): Result.005 file - promoters50/1444629
ttaaattttacattt

SEQ ID NO: 172655 - DNA, 9 bp, Unknown
  misc_feature (1)..( 9): Result.005 file - promoters50/1446208
taaagataa

SEQ ID NO: 172656 - DNA, 9 bp, Unknown
  misc_feature (1)..( 9): Result.005 file - promoters50/1446208
taaatatat

SEQ ID NO: 172657 - DNA, 9 bp, Unknown
  misc_feature (1)..( 9): Result.005 file - promoters50/1446208
agtagataa

SEQ ID NO: 172658 - DNA, 6 bp, Unknown
  misc_feature (1)..( 6): Result.005 file - promoters50/1446208
tacaaa

SEQ ID NO: 172659 - DNA, 6 bp, Unknown
  misc_feature (1)..( 6): Result.005 file - promoters50/1446208
tacaaa

SEQ ID NO: 172660 - DNA, 6 bp, Unknown
  misc_feature (1)..( 6): Result.005 file - promoters50/1446208
tacaaa

SEQ ID NO: 172661 - DNA, 9 bp, Unknown
  misc_feature (1)..( 9): Result.005 file - promoters50/1446208
cttttgatg

SEQ ID NO: 172662 - DNA, 9 bp, Unknown
  misc_feature (1)..( 9): Result.005 file - promoters50/1446208
attttaatg

SEQ ID NO: 172663 - DNA, 9 bp, Unknown
  misc_feature (1)..( 9): Result.005 file - promoters50/1446208
attttattt

SEQ ID NO: 172664 - DNA, 8 bp, Unknown
  misc_feature (1)..( 8): Result.005 file - promoters50/1446368
aaagatta

SEQ ID NO: 172665 - DNA, 8 bp, Unknown
  misc_feature (1)..( 8): Result.005 file - promoters50/1446368
aaaaattc

SEQ ID NO: 172666 - DNA, 9 bp, Unknown
  misc_feature (1)..( 9): Result.005 file - promoters50/1446368
aaataataa

SEQ ID NO: 172667 - DNA, 9 bp, Unknown
  misc_feature (1)..( 9): Result.005 file - promoters50/1446368
ataaacttc

SEQ ID NO: 172668 - DNA, 9 bp, Unknown
  misc_feature (1)..( 9): Result.005 file - promoters50/1446368
ctaaattaa

SEQ ID NO: 172669 - DNA, 9 bp, Unknown
  misc_feature (1)..( 9): Result.005 file - promoters50/1446368
ccaaaataa

SEQ ID NO: 172670 - DNA, 9 bp, Unknown
  misc_feature (1)..( 9): Result.005 file - promoters50/1446368
ataatttat

SEQ ID NO: 172671 - DNA, 9 bp, Unknown
  misc_feature (1)..( 9): Result.005 file - promoters50/1446368
ataattaac

SEQ ID NO: 172672 - DNA, 10 bp, Unknown
  misc_feature (1)..( 10): Result.005 file - promoters50/1446456
atactttttt

SEQ ID NO: 172673 - DNA, 10 bp, Unknown
  misc_feature (1)..( 10): Result.005 file - promoters50/1446456
tcccttttta

SEQ ID NO: 172674 - DNA, 10 bp, Unknown
  misc_feature (1)..( 10): Result.005 file - promoters50/1446456
atactttttc

SEQ ID NO: 172675 - DNA, 10 bp, Unknown
  misc_feature (1)..( 10): Result.005 file - promoters50/1446456
gtacatttat

SEQ ID NO: 172676 - DNA, 10 bp, Unknown
  misc_feature (1)..( 10): Result.005 file - promoters50/1446456
agcattttta

SEQ ID NO: 172677 - DNA, 8 bp, Unknown
  misc_feature (1)..( 8): Result.005 file - promoters50/1446456
caatgaat

SEQ ID NO: 172678 - DNA, 8 bp, Unknown
  misc_feature (1)..( 8): Result.005 file - promoters50/1446456
aaataaat

SEQ ID NO: 172679 - DNA, 8 bp, Unknown
  misc_feature (1)..( 8): Result.005 file - promoters50/1446456
caataaaa

SEQ ID NO: 172680 - DNA, 8 bp, Unknown
  misc_feature (1)..( 8): Result.005 file - promoters50/1446456
aaataacc

SEQ ID NO: 172681 - DNA, 8 bp, Unknown
  misc_feature (1)..( 8): Result.005 file - promoters50/1446456
aaaaaaag

SEQ ID NO: 172682 - DNA, 10 bp, Unknown
  misc_feature (1)..( 10): Result.005 file - promoters50/1446584
ttaaagttgg

SEQ ID NO: 172683 - DNA, 10 bp, Unknown
  misc_feature (1)..( 10): Result.005 file - promoters50/1446584
ataaatttgt

SEQ ID NO: 172684 - DNA, 10 bp, Unknown
  misc_feature (1)..( 10): Result.005 file - promoters50/1446584
ataaatagat

SEQ ID NO: 172685 - DNA, 10 bp, Unknown
  misc_feature (1)..( 10): Result.005 file - promoters50/1446584
aaagatttgt

SEQ ID NO: 172686 - DNA, 10 bp, Unknown
  misc_feature (1)..( 10): Result.005 file - promoters50/1446636
aaaatggaac

SEQ ID NO: 172687 - DNA, 10 bp, Unknown
  misc_feature (1)..( 10): Result.005 file - promoters50/1446636
gaaaaggata

SEQ ID NO: 172688 - DNA, 10 bp, Unknown
  misc_feature (1)..( 10): Result.005 file - promoters50/1446636
cttaaggata

SEQ ID NO: 172689 - DNA, 10 bp, Unknown
  misc_feature (1)..( 10): Result.005 file - promoters50/1446636
tgaaaggata

SEQ ID NO: 172690 - DNA, 10 bp, Unknown
  misc_feature (1)..( 10): Result.005 file - promoters50/1446636
tcaaacgatt

SEQ ID NO: 172691 - DNA, 10 bp, Unknown
  misc_feature (1)..( 10): Result.005 file - promoters50/1446636
ttaaagattt

SEQ ID NO: 172692 - DNA, 11 bp, Unknown
  misc_feature (1)..( 11): Result.005 file - promoters50/1446636
aattttgatta

SEQ ID NO: 172693 - DNA, 11 bp, Unknown
  misc_feature (1)..( 11): Result.005 file - promoters50/1446636
acttttgatgt

SEQ ID NO: 172694 - DNA, 11 bp, Unknown
  misc_feature (1)..( 11): Result.005 file - promoters50/1446636
atttttaatta

SEQ ID NO: 172695 - DNA, 11 bp, Unknown
  misc_feature (1)..( 11): Result.005 file - promoters50/1446636
aattttgtcaa

SEQ ID NO: 172696 - DNA, 11 bp, Unknown
  misc_feature (1)..( 11): Result.005 file - promoters50/1446636
acttctgaccc

SEQ ID NO: 172697 - DNA, 11 bp, Unknown
  misc_feature (1)..( 11): Result.005 file - promoters50/1446636
aatttttggtc

SEQ ID NO: 172698 - DNA, 11 bp, Unknown
  misc_feature (1)..( 11): Result.005 file - promoters50/1446636
tttttttacga

SEQ ID NO: 172699 - DNA, 9 bp, Unknown
  misc_feature (1)..( 9): Result.005 file - promoters50/1446636
aaattttga

SEQ ID NO: 172700 - DNA, 9 bp, Unknown
  misc_feature (1)..( 9): Result.005 file - promoters50/1446636
aaatttttg

SEQ ID NO: 172701 - DNA, 9 bp, Unknown
  misc_feature (1)..( 9): Result.005 file - promoters50/1446636
taattttgt

SEQ ID NO: 172702 - DNA, 9 bp, Unknown
  misc_feature (1)..( 9): Result.005 file - promoters50/1446636
ctattttta

SEQ ID NO: 172703 - DNA, 9 bp, Unknown
  misc_feature (1)..( 9): Result.005 file - promoters50/1446636
aaagtttgc

SEQ ID NO: 172704 - DNA, 9 bp, Unknown
  misc_feature (1)..( 9): Result.005 file - promoters50/1446636
tttttttta

SEQ ID NO: 172705 - DNA, 9 bp, Unknown
  misc_feature (1)..( 9): Result.005 file - promoters50/1446636
gaattgttc

SEQ ID NO: 172706 - DNA, 9 bp, Unknown
  misc_feature (1)..( 9): Result.005 file - promoters50/1446636
acattgtta

SEQ ID NO: 172707 - DNA, 9 bp, Unknown
  misc_feature (1)..( 9): Result.005 file - promoters50/1446636
agatttttc

SEQ ID NO: 172708 - DNA, 9 bp, Unknown
  misc_feature (1)..( 9): Result.005 file - promoters50/1446636
gggtttttc

SEQ ID NO: 172709 - DNA, 9 bp, Unknown
  misc_feature (1)..( 9): Result.005 file - promoters50/1446636
acgtttttg

SEQ ID NO: 172710 - DNA, 9 bp, Unknown
  misc_feature (1)..( 9): Result.005 file - promoters50/1446636
agatgtttg

SEQ ID NO: 172711 - DNA, 18 bp, Unknown
  misc_feature (1)..( 18): Result.005 file - promoters50/1446854
tataaccaaaaataatag

SEQ ID NO: 172712 - DNA, 18 bp, Unknown
  misc_feature (1)..( 18): Result.005 file - promoters50/1446854
ttttttataaagtaattt

SEQ ID NO: 172713 - DNA, 18 bp, Unknown
  misc_feature (1)..( 18): Result.005 file - promoters50/1446854
tataacccaaaattgacc

SEQ ID NO: 172714 - DNA, 18 bp, Unknown
  misc_feature (1)..( 18): Result.005 file - promoters50/1446854
agatcttggaagcaatag

SEQ ID NO: 172715 - DNA, 18 bp, Unknown
  misc_feature (1)..( 18): Result.005 file - promoters50/1446854
gaaacgctaaagtggttc

SEQ ID NO: 172716 - DNA, 18 bp, Unknown
  misc_feature (1)..( 18): Result.005 file - promoters50/1446854
acccacaaacagtagttt

SEQ ID NO: 172717 - DNA, 8 bp, Unknown
  misc_feature (1)..( 8): Result.005 file - promoters50/1447035
gttgagag

SEQ ID NO: 172718 - DNA, 8 bp, Unknown
  misc_feature (1)..( 8): Result.005 file - promoters50/1447035
gttgaggt

SEQ ID NO: 172719 - DNA, 8 bp, Unknown
  misc_feature (1)..( 8): Result.005 file - promoters50/1447035
gttgtgag

SEQ ID NO: 172720 - DNA, 8 bp, Unknown
  misc_feature (1)..( 8): Result.005 file - promoters50/1447035
gaataaat

SEQ ID NO: 172721 - DNA, 8 bp, Unknown
  misc_feature (1)..( 8): Result.005 file - promoters50/1447035
gaaaaaag

SEQ ID NO: 172722 - DNA, 9 bp, Unknown
  misc_feature (1)..( 9): Result.005 file - promoters50/1447035
caagtaaaa

SEQ ID NO: 172723 - DNA, 9 bp, Unknown
  misc_feature (1)..( 9): Result.005 file - promoters50/1447035
tatgtataa

SEQ ID NO: 172724 - DNA, 9 bp, Unknown
  misc_feature (1)..( 9): Result.005 file - promoters50/1447035
tatttatat

SEQ ID NO: 172725 - DNA, 9 bp, Unknown
  misc_feature (1)..( 9): Result.005 file - promoters50/1447035
tttgtataa

SEQ ID NO: 172726 - DNA, 8 bp, Unknown
  misc_feature (1)..( 8): Result.005 file - promoters50/1447035
taaattcc

SEQ ID NO: 172727 - DNA, 8 bp, Unknown
  misc_feature (1)..( 8): Result.005 file - promoters50/1447035
aaaattcg

SEQ ID NO: 172728 - DNA, 8 bp, Unknown
  misc_feature (1)..( 8): Result.005 file - promoters50/1447035
aaaagtcg

SEQ ID NO: 172729 - DNA, 12 bp, Unknown
  misc_feature (1)..( 12): Result.005 file - promoters50/1447217
aaaaaaaaaata

SEQ ID NO: 172730 - DNA, 12 bp, Unknown
  misc_feature (1)..( 12): Result.005 file - promoters50/1447217
caaaaaaaaaaa

SEQ ID NO: 172731 - DNA, 12 bp, Unknown
  misc_feature (1)..( 12): Result.005 file - promoters50/1447217
gaaaaaaaaaaa

SEQ ID NO: 172732 - DNA, 12 bp, Unknown
  misc_feature (1)..( 12): Result.005 file - promoters50/1447217
taaacaatttta

SEQ ID NO: 172733 - DNA, 10 bp, Unknown
  misc_feature (1)..( 10): Result.005 file - promoters50/1447217
caaaacaaaa

SEQ ID NO: 172734 - DNA, 10 bp, Unknown
  misc_feature (1)..( 10): Result.005 file - promoters50/1447217
aaatacaaaa

SEQ ID NO: 172735 - DNA, 10 bp, Unknown
  misc_feature (1)..( 10): Result.005 file - promoters50/1447217
aaaaacaaat

SEQ ID NO: 172736 - DNA, 10 bp, Unknown
  misc_feature (1)..( 10): Result.005 file - promoters50/1447217
atatataaac

SEQ ID NO: 172737 - DNA, 14 bp, Unknown
  misc_feature (1)..( 14): Result.005 file - promoters50/1447217
gaaatattttaaca

SEQ ID NO: 172738 - DNA, 14 bp, Unknown
  misc_feature (1)..( 14): Result.005 file - promoters50/1447217
gaaataatttagac

SEQ ID NO: 172739 - DNA, 14 bp, Unknown
  misc_feature (1)..( 14): Result.005 file - promoters50/1447217
tcttttttttaaca

SEQ ID NO: 172740 - DNA, 14 bp, Unknown
  misc_feature (1)..( 14): Result.005 file - promoters50/1447217
acattgatttatta

SEQ ID NO: 172741 - DNA, 8 bp, Unknown
  misc_feature (1)..( 8): Result.005 file - promoters50/1447217
tataatta

SEQ ID NO: 172742 - DNA, 8 bp, Unknown
  misc_feature (1)..( 8): Result.005 file - promoters50/1447217
gataattc

SEQ ID NO: 172743 - DNA, 8 bp, Unknown
  misc_feature (1)..( 8): Result.005 file - promoters50/1447217
tattattg

SEQ ID NO: 172744 - DNA, 8 bp, Unknown
  misc_feature (1)..( 8): Result.005 file - promoters50/1447217
catactta

SEQ ID NO: 172745 - DNA, 8 bp, Unknown
  misc_feature (1)..( 8): Result.005 file - promoters50/1447217
gaaaaaaa

SEQ ID NO: 172746 - DNA, 8 bp, Unknown
  misc_feature (1)..( 8): Result.005 file - promoters50/1447217
aaaacaaa

SEQ ID NO: 172747 - DNA, 9 bp, Unknown
  misc_feature (1)..( 9): Result.005 file - promoters50/1447217
aaatacaaa

SEQ ID NO: 172748 - DNA, 9 bp, Unknown
  misc_feature (1)..( 9): Result.005 file - promoters50/1447217
atatataaa

SEQ ID NO: 172749 - DNA, 9 bp, Unknown
  misc_feature (1)..( 9): Result.005 file - promoters50/1447228
ttgggagaa

SEQ ID NO: 172750 - DNA, 9 bp, Unknown
  misc_feature (1)..( 9): Result.005 file - promoters50/1447228
ttggaagag

SEQ ID NO: 172751 - DNA, 9 bp, Unknown
  misc_feature (1)..( 9): Result.005 file - promoters50/1447228
gatgaagag

SEQ ID NO: 172752 - DNA, 8 bp, Unknown
  misc_feature (1)..( 8): Result.005 file - promoters50/1447321
atttgaat

SEQ ID NO: 172753 - DNA, 8 bp, Unknown
  misc_feature (1)..( 8): Result.005 file - promoters50/1447321
ttttgaag

SEQ ID NO: 172754 - DNA, 8 bp, Unknown
  misc_feature (1)..( 8): Result.005 file - promoters50/1447321
ttttgaat

SEQ ID NO: 172755 - DNA, 8 bp, Unknown
  misc_feature (1)..( 8): Result.005 file - promoters50/1447321
ttttgaca

SEQ ID NO: 172756 - DNA, 12 bp, Unknown
  misc_feature (1)..( 12): Result.005 file - promoters50/1447321
aaaaatgtgaaa

SEQ ID NO: 172757 - DNA, 12 bp, Unknown
  misc_feature (1)..( 12): Result.005 file - promoters50/1447321
aaaaataatttt

SEQ ID NO: 172758 - DNA, 12 bp, Unknown
  misc_feature (1)..( 12): Result.005 file - promoters50/1447321
aaaaatcgtcat

SEQ ID NO: 172759 - DNA, 12 bp, Unknown
  misc_feature (1)..( 12): Result.005 file - promoters50/1447321
caaactgtgaaa

SEQ ID NO: 172760 - DNA, 14 bp, Unknown
  misc_feature (1)..( 14): Result.005 file - promoters50/1447321
tatccaattttaag

SEQ ID NO: 172761 - DNA, 14 bp, Unknown
  misc_feature (1)..( 14): Result.005 file - promoters50/1447321
attattattctaag

SEQ ID NO: 172762 - DNA, 14 bp, Unknown
  misc_feature (1)..( 14): Result.005 file - promoters50/1447321
aaccaaatttggtg

SEQ ID NO: 172763 - DNA, 14 bp, Unknown
  misc_feature (1)..( 14): Result.005 file - promoters50/1447321
aaccaaagtcaaca

SEQ ID NO: 172764 - DNA, 10 bp, Unknown
  misc_feature (1)..( 10): Result.005 file - promoters50/1447321
tgtactatta

SEQ ID NO: 172765 - DNA, 10 bp, Unknown
  misc_feature (1)..( 10): Result.005 file - promoters50/1447321
tgtaatattt

SEQ ID NO: 172766 - DNA, 10 bp, Unknown
  misc_feature (1)..( 10): Result.005 file - promoters50/1447321
aataattttt

SEQ ID NO: 172767 - DNA, 10 bp, Unknown
  misc_feature (1)..( 10): Result.005 file - promoters50/1447321
agtaattttc

SEQ ID NO: 172768 - DNA, 8 bp, Unknown
  misc_feature (1)..( 8): Result.005 file - promoters50/1447321
tcattttt

SEQ ID NO: 172769 - DNA, 8 bp, Unknown
  misc_feature (1)..( 8): Result.005 file - promoters50/1447321
taattttt

SEQ ID NO: 172770 - DNA, 8 bp, Unknown
  misc_feature (1)..( 8): Result.005 file - promoters50/1447321
taatattt

SEQ ID NO: 172771 - DNA, 8 bp, Unknown
  misc_feature (1)..( 8): Result.005 file - promoters50/1447321
taattttc

SEQ ID NO: 172772 - DNA, 10 bp, Unknown
  misc_feature (1)..( 10): Result.005 file - promoters50/1447352
tgcgaattct

SEQ ID NO: 172773 - DNA, 10 bp, Unknown
  misc_feature (1)..( 10): Result.005 file - promoters50/1447352
cttgaattca

SEQ ID NO: 172774 - DNA, 10 bp, Unknown
  misc_feature (1)..( 10): Result.005 file - promoters50/1447352
caataattca

SEQ ID NO: 172775 - DNA, 10 bp, Unknown
  misc_feature (1)..( 10): Result.005 file - promoters50/1447352
cttgtatttg

SEQ ID NO: 172776 - DNA, 11 bp, Unknown
  misc_feature (1)..( 11): Result.005 file - promoters50/1447379
tatgcaatacc

SEQ ID NO: 172777 - DNA, 11 bp, Unknown
  misc_feature (1)..( 11): Result.005 file - promoters50/1447379
aatgaaatttg

SEQ ID NO: 172778 - DNA, 11 bp, Unknown
  misc_feature (1)..( 11): Result.005 file - promoters50/1447379
aatgaaaggaa

SEQ ID NO: 172779 - DNA, 7 bp, Unknown
  misc_feature (1)..( 7): Result.005 file - promoters50/1447379
tttcctc

SEQ ID NO: 172780 - DNA, 7 bp, Unknown
  misc_feature (1)..( 7): Result.005 file - promoters50/1447379
cttcctc

SEQ ID NO: 172781 - DNA, 7 bp, Unknown
  misc_feature (1)..( 7): Result.005 file - promoters50/1447379
ttttctc

SEQ ID NO: 172782 - DNA, 10 bp, Unknown
  misc_feature (1)..( 10): Result.005 file - promoters50/1447425
acaaacaatt

SEQ ID NO: 172783 - DNA, 10 bp, Unknown
  misc_feature (1)..( 10): Result.005 file - promoters50/1447425
ttctacaatt

SEQ ID NO: 172784 - DNA, 10 bp, Unknown
  misc_feature (1)..( 10): Result.005 file - promoters50/1447425
taaaagaatc

SEQ ID NO: 172785 - DNA, 10 bp, Unknown
  misc_feature (1)..( 10): Result.005 file - promoters50/1447425
ttctaaaatc

SEQ ID NO: 172786 - DNA, 10 bp, Unknown
  misc_feature (1)..( 10): Result.005 file - promoters50/1447543
aaaaaaaaac

SEQ ID NO: 172787 - DNA, 10 bp, Unknown
  misc_feature (1)..( 10): Result.005 file - promoters50/1447543
gtacaaaaac

SEQ ID NO: 172788 - DNA, 10 bp, Unknown
  misc_feature (1)..( 10): Result.005 file - promoters50/1447543
tactaaaatt

SEQ ID NO: 172789 - DNA, 10 bp, Unknown
  misc_feature (1)..( 10): Result.005 file - promoters50/1447543
gaaaaactca

SEQ ID NO: 172790 - DNA, 10 bp, Unknown
  misc_feature (1)..( 10): Result.005 file - promoters50/1447543
ttaaaaatca

SEQ ID NO: 172791 - DNA, 11 bp, Unknown
  misc_feature (1)..( 11): Result.005 file - promoters50/1447543
agaagaaccag

SEQ ID NO: 172792 - DNA, 11 bp, Unknown
  misc_feature (1)..( 11): Result.005 file - promoters50/1447543
ataaaaataat

SEQ ID NO: 172793 - DNA, 8 bp, Unknown
  misc_feature (1)..( 8): Result.005 file - promoters50/1447543
taataaaa

SEQ ID NO: 172794 - DNA, 8 bp, Unknown
  misc_feature (1)..( 8): Result.005 file - promoters50/1447543
taataata

SEQ ID NO: 172795 - DNA, 9 bp, Unknown
  misc_feature (1)..( 9): Result.005 file - promoters50/1447543
caattaaat

SEQ ID NO: 172796 - DNA, 16 bp, Unknown
  misc_feature (1)..( 16): Result.005 file - promoters50/1447543
atgtaaattaaattct

SEQ ID NO: 172797 - DNA, 16 bp, Unknown
  misc_feature (1)..( 16): Result.005 file - promoters50/1447543
atgaaaaataaattta

SEQ ID NO: 172798 - DNA, 16 bp, Unknown
  misc_feature (1)..( 16): Result.005 file - promoters50/1447543
tttgtttataagttta

SEQ ID NO: 172799 - DNA, 9 bp, Unknown
  misc_feature (1)..( 9): Result.005 file - promoters50/1447543
ttaagttac

SEQ ID NO: 172800 - DNA, 9 bp, Unknown
  misc_feature (1)..( 9): Result.005 file - promoters50/1447543
ttaagttag

SEQ ID NO: 172801 - DNA, 9 bp, Unknown
  misc_feature (1)..( 9): Result.005 file - promoters50/1447543
ttaagtaag

SEQ ID NO: 172802 - DNA, 9 bp, Unknown
  misc_feature (1)..( 9): Result.005 file - promoters50/1447543
ttaattaag

SEQ ID NO: 172803 - DNA, 9 bp, Unknown
  misc_feature (1)..( 9): Result.005 file - promoters50/1447543
acaattaaa

SEQ ID NO: 172804 - DNA, 9 bp, Unknown
  misc_feature (1)..( 9): Result.005 file - promoters50/1447543
ttaagtaag

SEQ ID NO: 172805 - DNA, 8 bp, Unknown
  misc_feature (1)..( 8): Result.005 file - promoters50/1447543
aaaactat

SEQ ID NO: 172806 - DNA, 8 bp, Unknown
  misc_feature (1)..( 8): Result.005 file - promoters50/1447543
taaaatat

SEQ ID NO: 172807 - DNA, 8 bp, Unknown
  misc_feature (1)..( 8): Result.005 file - promoters50/1447543
aaaaataa

SEQ ID NO: 172808 - DNA, 14 bp, Unknown
  misc_feature (1)..( 14): Result.005 file - promoters50/1447543
tatctatttattct

SEQ ID NO: 172809 - DNA, 14 bp, Unknown
  misc_feature (1)..( 14): Result.005 file - promoters50/1447543
tatatatttttatt

SEQ ID NO: 172810 - DNA, 14 bp, Unknown
  misc_feature (1)..( 14): Result.005 file - promoters50/1447543
aatatctttgtatt

SEQ ID NO: 172811 - DNA, 9 bp, Unknown
  misc_feature (1)..( 9): Result.005 file - promoters50/1447543
ttttttatc

SEQ ID NO: 172812 - DNA, 9 bp, Unknown
  misc_feature (1)..( 9): Result.005 file - promoters50/1447543
atttctatc

SEQ ID NO: 172813 - DNA, 9 bp, Unknown
  misc_feature (1)..( 9): Result.005 file - promoters50/1447543
atttttatt

SEQ ID NO: 172814 - DNA, 8 bp, Unknown
  misc_feature (1)..( 8): Result.005 file - promoters50/1447543
ttaagatt

SEQ ID NO: 172815 - DNA, 8 bp, Unknown
  misc_feature (1)..( 8): Result.005 file - promoters50/1447543
gtaaaatt

SEQ ID NO: 172816 - DNA, 8 bp, Unknown
  misc_feature (1)..( 8): Result.005 file - promoters50/1447543
gtaaaata

SEQ ID NO: 172817 - DNA, 7 bp, Unknown
  misc_feature (1)..( 7): Result.005 file - promoters50/1447543
tcataat

SEQ ID NO: 172818 - DNA, 7 bp, Unknown
  misc_feature (1)..( 7): Result.005 file - promoters50/1447543
tcataat

SEQ ID NO: 172819 - DNA, 7 bp, Unknown
  misc_feature (1)..( 7): Result.005 file - promoters50/1447543
tcagaat

SEQ ID NO: 172820 - DNA, 8 bp, Unknown
  misc_feature (1)..( 8): Result.005 file - promoters50/1447577
tcaaatat

SEQ ID NO: 172821 - DNA, 8 bp, Unknown
  misc_feature (1)..( 8): Result.005 file - promoters50/1447577
ccaattat

SEQ ID NO: 172822 - DNA, 8 bp, Unknown
  misc_feature (1)..( 8): Result.005 file - promoters50/1447577
tcatataa

SEQ ID NO: 172823 - DNA, 9 bp, Unknown
  misc_feature (1)..( 9): Result.005 file - promoters50/1447577
aataattat

SEQ ID NO: 172824 - DNA, 9 bp, Unknown
  misc_feature (1)..( 9): Result.005 file - promoters50/1447577
aataattaa

SEQ ID NO: 172825 - DNA, 9 bp, Unknown
  misc_feature (1)..( 9): Result.005 file - promoters50/1447577
taaaattat

SEQ ID NO: 172826 - DNA, 8 bp, Unknown
  misc_feature (1)..( 8): Result.005 file - promoters50/1447577
actaataa

SEQ ID NO: 172827 - DNA, 7 bp, Unknown
  misc_feature (1)..( 7): Result.005 file - promoters50/1447577
ataataa

SEQ ID NO: 172828 - DNA, 8 bp, Unknown
  misc_feature (1)..( 8): Result.005 file - promoters50/1447577
aattatac

SEQ ID NO: 172829 - DNA, 7 bp, Unknown
  misc_feature (1)..( 7): Result.005 file - promoters50/1447577
aatgata

SEQ ID NO: 172830 - DNA, 7 bp, Unknown
  misc_feature (1)..( 7): Result.005 file - promoters50/1447577
aataata

SEQ ID NO: 172831 - DNA, 7 bp, Unknown
  misc_feature (1)..( 7): Result.005 file - promoters50/1447577
aattata

SEQ ID NO: 172832 - DNA, 8 bp, Unknown
  misc_feature (1)..( 8): Result.005 file - promoters50/1447577
tatagtgg

SEQ ID NO: 172833 - DNA, 8 bp, Unknown
  misc_feature (1)..( 8): Result.005 file - promoters50/1447577
gataatgg

SEQ ID NO: 172834 - DNA, 8 bp, Unknown
  misc_feature (1)..( 8): Result.005 file - promoters50/1447577
aatagtaa

SEQ ID NO: 172835 - DNA, 7 bp, Unknown
  misc_feature (1)..( 7): Result.005 file - promoters50/1447591
acaaaag

SEQ ID NO: 172836 - DNA, 7 bp, Unknown
  misc_feature (1)..( 7): Result.005 file - promoters50/1447591
acaaaaa

SEQ ID NO: 172837 - DNA, 7 bp, Unknown
  misc_feature (1)..( 7): Result.005 file - promoters50/1447591
tcaaaaa

SEQ ID NO: 172838 - DNA, 11 bp, Unknown
  misc_feature (1)..( 11): Result.005 file - promoters50/1447591
acagacaaaac

SEQ ID NO: 172839 - DNA, 11 bp, Unknown
  misc_feature (1)..( 11): Result.005 file - promoters50/1447591
aaagacagaac

SEQ ID NO: 172840 - DNA, 11 bp, Unknown
  misc_feature (1)..( 11): Result.005 file - promoters50/1447591
acaaacaaaaa

SEQ ID NO: 172841 - DNA, 7 bp, Unknown
  misc_feature (1)..( 7): Result.005 file - promoters50/1447591
tttggat

SEQ ID NO: 172842 - DNA, 7 bp, Unknown
  misc_feature (1)..( 7): Result.005 file - promoters50/1447591
ttttgat

SEQ ID NO: 172843 - DNA, 7 bp, Unknown
  misc_feature (1)..( 7): Result.005 file - promoters50/1447591
ttttatt

SEQ ID NO: 172844 - DNA, 10 bp, Unknown
  misc_feature (1)..( 10): Result.005 file - promoters50/1447646
aagataaaga

SEQ ID NO: 172845 - DNA, 10 bp, Unknown
  misc_feature (1)..( 10): Result.005 file - promoters50/1447646
gggataaaga

SEQ ID NO: 172846 - DNA, 10 bp, Unknown
  misc_feature (1)..( 10): Result.005 file - promoters50/1447646
tggataaaat

SEQ ID NO: 172847 - DNA, 10 bp, Unknown
  misc_feature (1)..( 10): Result.005 file - promoters50/1447646
cagaaaaaga

SEQ ID NO: 172848 - DNA, 10 bp, Unknown
  misc_feature (1)..( 10): Result.005 file - promoters50/1447646
aaggtaaacc

SEQ ID NO: 172849 - DNA, 10 bp, Unknown
  misc_feature (1)..( 10): Result.005 file - promoters50/1447646
cttgtagacc

SEQ ID NO: 172850 - DNA, 10 bp, Unknown
  misc_feature (1)..( 10): Result.005 file - promoters50/1447646
agaagttgaa

SEQ ID NO: 172851 - DNA, 10 bp, Unknown
  misc_feature (1)..( 10): Result.005 file - promoters50/1447646
tgaagttgac

SEQ ID NO: 172852 - DNA, 10 bp, Unknown
  misc_feature (1)..( 10): Result.005 file - promoters50/1447646
tgaatttgta

SEQ ID NO: 172853 - DNA, 10 bp, Unknown
  misc_feature (1)..( 10): Result.005 file - promoters50/1447646
gaaagatgaa

SEQ ID NO: 172854 - DNA, 10 bp, Unknown
  misc_feature (1)..( 10): Result.005 file - promoters50/1447646
acaagtagta

SEQ ID NO: 172855 - DNA, 10 bp, Unknown
  misc_feature (1)..( 10): Result.005 file - promoters50/1447646
tgaagaagaa

SEQ ID NO: 172856 - DNA, 10 bp, Unknown
  misc_feature (1)..( 10): Result.005 file - promoters50/1447646
ttaagaagct

SEQ ID NO: 172857 - DNA, 10 bp, Unknown
  misc_feature (1)..( 10): Result.005 file - promoters50/1447646
ttaagaaatg

SEQ ID NO: 172858 - DNA, 11 bp, Unknown
  misc_feature (1)..( 11): Result.005 file - promoters50/1447646
tgaagttgact

SEQ ID NO: 172859 - DNA, 11 bp, Unknown
  misc_feature (1)..( 11): Result.005 file - promoters50/1447646
gggagttcact

SEQ ID NO: 172860 - DNA, 11 bp, Unknown
  misc_feature (1)..( 11): Result.005 file - promoters50/1447646
tgaatttgtac

SEQ ID NO: 172861 - DNA, 11 bp, Unknown
  misc_feature (1)..( 11): Result.005 file - promoters50/1447646
gtgatttgcaa

SEQ ID NO: 172862 - DNA, 11 bp, Unknown
  misc_feature (1)..( 11): Result.005 file - promoters50/1447646
tgaatttaatc

SEQ ID NO: 172863 - DNA, 11 bp, Unknown
  misc_feature (1)..( 11): Result.005 file - promoters50/1447646
aagatttaaga

SEQ ID NO: 172864 - DNA, 10 bp, Unknown
  misc_feature (1)..( 10): Result.005 file - promoters50/1447646
gaaagaagtt

SEQ ID NO: 172865 - DNA, 10 bp, Unknown
  misc_feature (1)..( 10): Result.005 file - promoters50/1447646
tgaagaagaa

SEQ ID NO: 172866 - DNA, 10 bp, Unknown
  misc_feature (1)..( 10): Result.005 file - promoters50/1447646
aaaagaagac

SEQ ID NO: 172867 - DNA, 10 bp, Unknown
  misc_feature (1)..( 10): Result.005 file - promoters50/1447646
ttaagaagct

SEQ ID NO: 172868 - DNA, 10 bp, Unknown
  misc_feature (1)..( 10): Result.005 file - promoters50/1447646
gaaagaagtt

SEQ ID NO: 172869 - DNA, 10 bp, Unknown
  misc_feature (1)..( 10): Result.005 file - promoters50/1447646
gaaagatgaa

SEQ ID NO: 172870 - DNA, 10 bp, Unknown
  misc_feature (1)..( 10): Result.005 file - promoters50/1447646
ttaagaaatg

SEQ ID NO: 172871 - DNA, 9 bp, Unknown
  misc_feature (1)..( 9): Result.005 file - promoters50/1447646
attgatttc

SEQ ID NO: 172872 - DNA, 9 bp, Unknown
  misc_feature (1)..( 9): Result.005 file - promoters50/1447646
attgattta

SEQ ID NO: 172873 - DNA, 9 bp, Unknown
  misc_feature (1)..( 9): Result.005 file - promoters50/1447646
attaatttg

SEQ ID NO: 172874 - DNA, 9 bp, Unknown
  misc_feature (1)..( 9): Result.005 file - promoters50/1447646
tttgatttt

SEQ ID NO: 172875 - DNA, 9 bp, Unknown
  misc_feature (1)..( 9): Result.005 file - promoters50/1447646
attgatttc

SEQ ID NO: 172876 - DNA, 9 bp, Unknown
  misc_feature (1)..( 9): Result.005 file - promoters50/1447646
cttgttttt

SEQ ID NO: 172877 - DNA, 9 bp, Unknown
  misc_feature (1)..( 9): Result.005 file - promoters50/1447646
agggttttt

SEQ ID NO: 172878 - DNA, 9 bp, Unknown
  misc_feature (1)..( 9): Result.005 file - promoters50/1447646
ttttttttt

SEQ ID NO: 172879 - DNA, 9 bp, Unknown
  misc_feature (1)..( 9): Result.005 file - promoters50/1447646
tatttattt

SEQ ID NO: 172880 - DNA, 9 bp, Unknown
  misc_feature (1)..( 9): Result.005 file - promoters50/1447646
actttcttt

SEQ ID NO: 172881 - DNA, 9 bp, Unknown
  misc_feature (1)..( 9): Result.005 file - promoters50/1447646
tttttcttt

SEQ ID NO: 172882 - DNA, 9 bp, Unknown
  misc_feature (1)..( 9): Result.005 file - promoters50/1447646
gttttctag

SEQ ID NO: 172883 - DNA, 9 bp, Unknown
  misc_feature (1)..( 9): Result.005 file - promoters50/1447646
gctttctgc

SEQ ID NO: 172884 - DNA, 7 bp, Unknown
  misc_feature (1)..( 7): Result.005 file - promoters50/1447649
tgagtag

SEQ ID NO: 172885 - DNA, 7 bp, Unknown
  misc_feature (1)..( 7): Result.005 file - promoters50/1447649
tgagtac

SEQ ID NO: 172886 - DNA, 7 bp, Unknown
  misc_feature (1)..( 7): Result.005 file - promoters50/1447649
tgaatac

SEQ ID NO: 172887 - DNA, 9 bp, Unknown
  misc_feature (1)..( 9): Result.005 file - promoters50/1447686
aatatatgt

SEQ ID NO: 172888 - DNA, 9 bp, Unknown
  misc_feature (1)..( 9): Result.005 file - promoters50/1447686
aatatctgt

SEQ ID NO: 172889 - DNA, 9 bp, Unknown
  misc_feature (1)..( 9): Result.005 file - promoters50/1447686
tatatatat

SEQ ID NO: 172890 - DNA, 9 bp, Unknown
  misc_feature (1)..( 9): Result.005 file - promoters50/1447686
aatctatat

SEQ ID NO: 172891 - DNA, 9 bp, Unknown
  misc_feature (1)..( 9): Result.005 file - promoters50/1447686
aatccatag

SEQ ID NO: 172892 - DNA, 9 bp, Unknown
  misc_feature (1)..( 9): Result.005 file - promoters50/1447686
aataaataa

SEQ ID NO: 172893 - DNA, 10 bp, Unknown
  misc_feature (1)..( 10): Result.005 file - promoters50/1447686
ggaattaaga

SEQ ID NO: 172894 - DNA, 10 bp, Unknown
  misc_feature (1)..( 10): Result.005 file - promoters50/1447686
caaattaagt

SEQ ID NO: 172895 - DNA, 10 bp, Unknown
  misc_feature (1)..( 10): Result.005 file - promoters50/1447686
ttctttaaga

SEQ ID NO: 172896 - DNA, 10 bp, Unknown
  misc_feature (1)..( 10): Result.005 file - promoters50/1447686
caatttaaca

SEQ ID NO: 172897 - DNA, 10 bp, Unknown
  misc_feature (1)..( 10): Result.005 file - promoters50/1447686
gaaagtaaat

SEQ ID NO: 172898 - DNA, 10 bp, Unknown
  misc_feature (1)..( 10): Result.005 file - promoters50/1447686
gtctttcaca

SEQ ID NO: 172899 - DNA, 12 bp, Unknown
  misc_feature (1)..( 12): Result.005 file - promoters50/1447686
ttttactcaaca

SEQ ID NO: 172900 - DNA, 12 bp, Unknown
  misc_feature (1)..( 12): Result.005 file - promoters50/1447686
atttactaaacc

SEQ ID NO: 172901 - DNA, 13 bp, Unknown
  misc_feature (1)..( 13): Result.005 file - promoters50/1447686
ttttaacttaaat

SEQ ID NO: 172902 - DNA, 13 bp, Unknown
  misc_feature (1)..( 13): Result.005 file - promoters50/1447686
gtttaacctcgtt

SEQ ID NO: 172903 - DNA, 14 bp, Unknown
  misc_feature (1)..( 14): Result.005 file - promoters50/1447686
tctataacccaaaa

SEQ ID NO: 172904 - DNA, 14 bp, Unknown
  misc_feature (1)..( 14): Result.005 file - promoters50/1447686
attataaaaaaagt

SEQ ID NO: 172905 - DNA, 8 bp, Unknown
  misc_feature (1)..( 8): Result.005 file - promoters50/1447943
ttttgatc

SEQ ID NO: 172906 - DNA, 8 bp, Unknown
  misc_feature (1)..( 8): Result.005 file - promoters50/1447943
tttttatc

SEQ ID NO: 172907 - DNA, 8 bp, Unknown
  misc_feature (1)..( 8): Result.005 file - promoters50/1447943
ttttaatc

SEQ ID NO: 172908 - DNA, 14 bp, Unknown
  misc_feature (1)..( 14): Result.005 file - promoters50/1447953
ctacttttgattag

SEQ ID NO: 172909 - DNA, 14 bp, Unknown
  misc_feature (1)..( 14): Result.005 file - promoters50/1447953
aatattttaattca

SEQ ID NO: 172910 - DNA, 14 bp, Unknown
  misc_feature (1)..( 14): Result.005 file - promoters50/1447953
aaaaagttggttat

SEQ ID NO: 172911 - DNA, 14 bp, Unknown
  misc_feature (1)..( 14): Result.005 file - promoters50/1447953
ctacatttgtattt

SEQ ID NO: 172912 - DNA, 14 bp, Unknown
  misc_feature (1)..( 14): Result.005 file - promoters50/1447953
aaaatataaatcat

SEQ ID NO: 172913 - DNA, 14 bp, Unknown
  misc_feature (1)..( 14): Result.005 file - promoters50/1447953
ctgattttacacca

SEQ ID NO: 172914 - DNA, 14 bp, Unknown
  misc_feature (1)..( 14): Result.005 file - promoters50/1447953
ctggttttggttta

SEQ ID NO: 172915 - DNA, 13 bp, Unknown
  misc_feature (1)..( 13): Result.005 file - promoters50/1447953
atatctttataag

SEQ ID NO: 172916 - DNA, 13 bp, Unknown
  misc_feature (1)..( 13): Result.005 file - promoters50/1447953
caatctttataca

SEQ ID NO: 172917 - DNA, 13 bp, Unknown
  misc_feature (1)..( 13): Result.005 file - promoters50/1447953
ttataattatgca

SEQ ID NO: 172918 - DNA, 13 bp, Unknown
  misc_feature (1)..( 13): Result.005 file - promoters50/1447953
acaactttaaaag

SEQ ID NO: 172919 - DNA, 13 bp, Unknown
  misc_feature (1)..( 13): Result.005 file - promoters50/1447953
aaggttttatatg

SEQ ID NO: 172920 - DNA, 13 bp, Unknown
  misc_feature (1)..( 13): Result.005 file - promoters50/1447953
atattattatttc

SEQ ID NO: 172921 - DNA, 14 bp, Unknown
  misc_feature (1)..( 14): Result.005 file - promoters50/1447953
ctttataagtataa

SEQ ID NO: 172922 - DNA, 14 bp, Unknown
  misc_feature (1)..( 14): Result.005 file - promoters50/1447953
taatataagtaaca

SEQ ID NO: 172923 - DNA, 14 bp, Unknown
  misc_feature (1)..( 14): Result.005 file - promoters50/1447953
acttataattatgc

SEQ ID NO: 172924 - DNA, 14 bp, Unknown
  misc_feature (1)..( 14): Result.005 file - promoters50/1447953
ctttaaaagcctta

SEQ ID NO: 172925 - DNA, 14 bp, Unknown
  misc_feature (1)..( 14): Result.005 file - promoters50/1447953
aagatgaagtcaca

SEQ ID NO: 172926 - DNA, 14 bp, Unknown
  misc_feature (1)..( 14): Result.005 file - promoters50/1447953
ttttatatgtaaac

SEQ ID NO: 172927 - DNA, 14 bp, Unknown
  misc_feature (1)..( 14): Result.005 file - promoters50/1447953
tgatattattattt

SEQ ID NO: 172928 - DNA, 11 bp, Unknown
  misc_feature (1)..( 11): Result.005 file - promoters50/1447972
atctgctaatg

SEQ ID NO: 172929 - DNA, 11 bp, Unknown
  misc_feature (1)..( 11): Result.005 file - promoters50/1447972
ttttgctaaaa

SEQ ID NO: 172930 - DNA, 11 bp, Unknown
  misc_feature (1)..( 11): Result.005 file - promoters50/1447972
tttttctaaaa

SEQ ID NO: 172931 - DNA, 9 bp, Unknown
  misc_feature (1)..( 9): Result.005 file - promoters50/1447972
atttctctt

SEQ ID NO: 172932 - DNA, 9 bp, Unknown
  misc_feature (1)..( 9): Result.005 file - promoters50/1447972
atttctgcc

SEQ ID NO: 172933 - DNA, 9 bp, Unknown
  misc_feature (1)..( 9): Result.005 file - promoters50/1447972
atttcactt

SEQ ID NO: 172934 - DNA, 7 bp, Unknown
  misc_feature (1)..( 7): Result.005 file - promoters50/1447972
tttaaca

SEQ ID NO: 172935 - DNA, 7 bp, Unknown
  misc_feature (1)..( 7): Result.005 file - promoters50/1447972
attaaca

SEQ ID NO: 172936 - DNA, 7 bp, Unknown
  misc_feature (1)..( 7): Result.005 file - promoters50/1447972
tttcaca

SEQ ID NO: 172937 - DNA, 10 bp, Unknown
  misc_feature (1)..( 10): Result.005 file - promoters50/1447972
ccggatcgtt

SEQ ID NO: 172938 - DNA, 10 bp, Unknown
  misc_feature (1)..( 10): Result.005 file - promoters50/1447972
ccggttcggt

SEQ ID NO: 172939 - DNA, 10 bp, Unknown
  misc_feature (1)..( 10): Result.005 file - promoters50/1447972
tgcgttcggt

SEQ ID NO: 172940 - DNA, 9 bp, Unknown
  misc_feature (1)..( 9): Result.005 file - promoters50/1448009
caaaattga

SEQ ID NO: 172941 - DNA, 9 bp, Unknown
  misc_feature (1)..( 9): Result.005 file - promoters50/1448009
caacattat

SEQ ID NO: 172942 - DNA, 9 bp, Unknown
  misc_feature (1)..( 9): Result.005 file - promoters50/1448009
ggaaattga

SEQ ID NO: 172943 - DNA, 11 bp, Unknown
  misc_feature (1)..( 11): Result.005 file - promoters50/1448009
aattaagaagg

SEQ ID NO: 172944 - DNA, 11 bp, Unknown
  misc_feature (1)..( 11): Result.005 file - promoters50/1448009
aattatgaaaa

SEQ ID NO: 172945 - DNA, 12 bp, Unknown
  misc_feature (1)..( 12): Result.005 file - promoters50/1448009
caaaatggaaac

SEQ ID NO: 172946 - DNA, 12 bp, Unknown
  misc_feature (1)..( 12): Result.005 file - promoters50/1448012
tttgtttttgat

SEQ ID NO: 172947 - DNA, 12 bp, Unknown
  misc_feature (1)..( 12): Result.005 file - promoters50/1448012
tatgtctttgtt

SEQ ID NO: 172948 - DNA, 12 bp, Unknown
  misc_feature (1)..( 12): Result.005 file - promoters50/1448012
tttgttgttggg

SEQ ID NO: 172949 - DNA, 12 bp, Unknown
  misc_feature (1)..( 12): Result.005 file - promoters50/1448012
gatatcttcgtt

SEQ ID NO: 172950 - DNA, 13 bp, Unknown
  misc_feature (1)..( 13): Result.005 file - promoters50/1448012
ctagtttattgtt

SEQ ID NO: 172951 - DNA, 13 bp, Unknown
  misc_feature (1)..( 13): Result.005 file - promoters50/1448012
caaatttttactt

SEQ ID NO: 172952 - DNA, 12 bp, Unknown
  misc_feature (1)..( 12): Result.005 file - promoters50/1448012
attttgtttttg

SEQ ID NO: 172953 - DNA, 12 bp, Unknown
  misc_feature (1)..( 12): Result.005 file - promoters50/1448012
tctttgttagtt

SEQ ID NO: 172954 - DNA, 12 bp, Unknown
  misc_feature (1)..( 12): Result.005 file - promoters50/1448012
ggtttgttgttg

SEQ ID NO: 172955 - DNA, 12 bp, Unknown
  misc_feature (1)..( 12): Result.005 file - promoters50/1448012
tcttcgttttcc

SEQ ID NO: 172956 - DNA, 12 bp, Unknown
  misc_feature (1)..( 12): Result.005 file - promoters50/1448012
ttattgttacaa

SEQ ID NO: 172957 - DNA, 12 bp, Unknown
  misc_feature (1)..( 12): Result.005 file - promoters50/1448012
aatttttacttt

SEQ ID NO: 172958 - DNA, 16 bp, Unknown
  misc_feature (1)..( 16): Result.005 file - promoters50/1448022
ttaagcaaaaaaaatt

SEQ ID NO: 172959 - DNA, 16 bp, Unknown
  misc_feature (1)..( 16): Result.005 file - promoters50/1448022
ccttccaaaaatgaga

SEQ ID NO: 172960 - DNA, 16 bp, Unknown
  misc_feature (1)..( 16): Result.005 file - promoters50/1448022
attaagaaaataaata

SEQ ID NO: 172961 - DNA, 16 bp, Unknown
  misc_feature (1)..( 16): Result.005 file - promoters50/1448022
attaataaaaaaatat

SEQ ID NO: 172962 - DNA, 16 bp, Unknown
  misc_feature (1)..( 16): Result.005 file - promoters50/1448022
tccatgtaaataaaat

SEQ ID NO: 172963 - DNA, 16 bp, Unknown
  misc_feature (1)..( 16): Result.005 file - promoters50/1448022
tatatgaaaacaaaat

SEQ ID NO: 172964 - DNA, 11 bp, Unknown
  misc_feature (1)..( 11): Result.005 file - promoters50/1448022
tactatataca

SEQ ID NO: 172965 - DNA, 11 bp, Unknown
  misc_feature (1)..( 11): Result.005 file - promoters50/1448022
aactctattgt

SEQ ID NO: 172966 - DNA, 11 bp, Unknown
  misc_feature (1)..( 11): Result.005 file - promoters50/1448022
tactattactt

SEQ ID NO: 172967 - DNA, 11 bp, Unknown
  misc_feature (1)..( 11): Result.005 file - promoters50/1448022
gtgtcttttgt

SEQ ID NO: 172968 - DNA, 11 bp, Unknown
  misc_feature (1)..( 11): Result.005 file - promoters50/1448022
tatgattttgt

SEQ ID NO: 172969 - DNA, 11 bp, Unknown
  misc_feature (1)..( 11): Result.005 file - promoters50/1448022
aatccttttgt

SEQ ID NO: 172970 - DNA, 10 bp, Unknown
  misc_feature (1)..( 10): Result.005 file - promoters50/1448022
aatttatata

SEQ ID NO: 172971 - DNA, 10 bp, Unknown
  misc_feature (1)..( 10): Result.005 file - promoters50/1448022
tacttatatt

SEQ ID NO: 172972 - DNA, 10 bp, Unknown
  misc_feature (1)..( 10): Result.005 file - promoters50/1448022
attttttatc

SEQ ID NO: 172973 - DNA, 10 bp, Unknown
  misc_feature (1)..( 10): Result.005 file - promoters50/1448022
tacttttatt

SEQ ID NO: 172974 - DNA, 11 bp, Unknown
  misc_feature (1)..( 11): Result.005 file - promoters50/1448022
agttttgtata

SEQ ID NO: 172975 - DNA, 11 bp, Unknown
  misc_feature (1)..( 11): Result.005 file - promoters50/1448022
tatttgatttc

SEQ ID NO: 172976 - DNA, 9 bp, Unknown
  misc_feature (1)..( 9): Result.005 file - promoters50/1448022
aatatgtaa

SEQ ID NO: 172977 - DNA, 9 bp, Unknown
  misc_feature (1)..( 9): Result.005 file - promoters50/1448022
aatttgttg

SEQ ID NO: 172978 - DNA, 9 bp, Unknown
  misc_feature (1)..( 9): Result.005 file - promoters50/1448022
tatatataa

SEQ ID NO: 172979 - DNA, 9 bp, Unknown
  misc_feature (1)..( 9): Result.005 file - promoters50/1448022
aatgtgtgc

SEQ ID NO: 172980 - DNA, 9 bp, Unknown
  misc_feature (1)..( 9): Result.005 file - promoters50/1448022
tatttgtta

SEQ ID NO: 172981 - DNA, 9 bp, Unknown
  misc_feature (1)..( 9): Result.005 file - promoters50/1448022
gatacaaaa

SEQ ID NO: 172982 - DNA, 13 bp, Unknown
  misc_feature (1)..( 13): Result.005 file - promoters50/1448022
ttgtatattaaaa

SEQ ID NO: 172983 - DNA, 13 bp, Unknown
  misc_feature (1)..( 13): Result.005 file - promoters50/1448022
atgtatatgtcat

SEQ ID NO: 172984 - DNA, 13 bp, Unknown
  misc_feature (1)..( 13): Result.005 file - promoters50/1448022
tcttatatgaaaa

SEQ ID NO: 172985 - DNA, 13 bp, Unknown
  misc_feature (1)..( 13): Result.005 file - promoters50/1448022
gcgtataaaaaag

SEQ ID NO: 172986 - DNA, 13 bp, Unknown
  misc_feature (1)..( 13): Result.005 file - promoters50/1448022
atgtaaataaaat

SEQ ID NO: 172987 - DNA, 13 bp, Unknown
  misc_feature (1)..( 13): Result.005 file - promoters50/1448022
tgattaataaaaa

SEQ ID NO: 172988 - DNA, 22 bp, Unknown
  misc_feature (1)..( 22): Result.005 file - promoters50/1448022
aaaaaatcaaaatcaaaattaa

SEQ ID NO: 172989 - DNA, 22 bp, Unknown
  misc_feature (1)..( 22): Result.005 file - promoters50/1448022
tgtcatttaaaaccaagcccaa

SEQ ID NO: 172990 - DNA, 22 bp, Unknown
  misc_feature (1)..( 22): Result.005 file - promoters50/1448022
cttatatgaaaacaaaattaaa

SEQ ID NO: 172991 - DNA, 22 bp, Unknown
  misc_feature (1)..( 22): Result.005 file - promoters50/1448022
tgagatgattaataaaaaaata

SEQ ID NO: 172992 - DNA, 22 bp, Unknown
  misc_feature (1)..( 22): Result.005 file - promoters50/1448022
tgattaagaaaataaataatca

SEQ ID NO: 172993 - DNA, 22 bp, Unknown
  misc_feature (1)..( 22): Result.005 file - promoters50/1448022
aaaaaaagaaaaaaaattccat

SEQ ID NO: 172994 - DNA, 15 bp, Unknown
  misc_feature (1)..( 15): Result.005 file - promoters50/1448022
ttaagcaaaaaaaat

SEQ ID NO: 172995 - DNA, 15 bp, Unknown
  misc_feature (1)..( 15): Result.005 file - promoters50/1448022
ttaagttaaataaat

SEQ ID NO: 172996 - DNA, 15 bp, Unknown
  misc_feature (1)..( 15): Result.005 file - promoters50/1448022
attaagaaaataaat

SEQ ID NO: 172997 - DNA, 15 bp, Unknown
  misc_feature (1)..( 15): Result.005 file - promoters50/1448022
gattaataaaaaaat

SEQ ID NO: 172998 - DNA, 15 bp, Unknown
  misc_feature (1)..( 15): Result.005 file - promoters50/1448022
cttttttacatatta

SEQ ID NO: 172999 - DNA, 15 bp, Unknown
  misc_feature (1)..( 15): Result.005 file - promoters50/1448022
tccatgtaaataaaa

SEQ ID NO: 173000 - DNA, 12 bp, Unknown
  misc_feature (1)..( 12): Result.005 file - promoters50/1448022
aaaagaaagttg

SEQ ID NO: 173001 - DNA, 12 bp, Unknown
  misc_feature (1)..( 12): Result.005 file - promoters50/1448022
aaaacaaaccac

SEQ ID NO: 173002 - DNA, 12 bp, Unknown
  misc_feature (1)..( 12): Result.005 file - promoters50/1448022
caaagaaatgaa

SEQ ID NO: 173003 - DNA, 12 bp, Unknown
  misc_feature (1)..( 12): Result.005 file - promoters50/1448022
gaaataaattaa

SEQ ID NO: 173004 - DNA, 12 bp, Unknown
  misc_feature (1)..( 12): Result.005 file - promoters50/1448022
gagagatgagag

SEQ ID NO: 173005 - DNA, 12 bp, Unknown
  misc_feature (1)..( 12): Result.005 file - promoters50/1448022
tcaataagttaa

SEQ ID NO: 173006 - DNA, 11 bp, Unknown
  misc_feature (1)..( 11): Result.005 file - promoters50/1448022
ctatttgtaat

SEQ ID NO: 173007 - DNA, 11 bp, Unknown
  misc_feature (1)..( 11): Result.005 file - promoters50/1448022
tgttttctaac

SEQ ID NO: 173008 - DNA, 11 bp, Unknown
  misc_feature (1)..( 11): Result.005 file - promoters50/1448022
aaaattgtaat

SEQ ID NO: 173009 - DNA, 11 bp, Unknown
  misc_feature (1)..( 11): Result.005 file - promoters50/1448022
tcttttgtata

SEQ ID NO: 173010 - DNA, 11 bp, Unknown
  misc_feature (1)..( 11): Result.005 file - promoters50/1448022
aacattgtaaa

SEQ ID NO: 173011 - DNA, 11 bp, Unknown
  misc_feature (1)..( 11): Result.005 file - promoters50/1448022
tctattgtttt

SEQ ID NO: 173012 - DNA, 11 bp, Unknown
  misc_feature (1)..( 11): Result.005 file - promoters50/1448022
atattaaaaaa

SEQ ID NO: 173013 - DNA, 11 bp, Unknown
  misc_feature (1)..( 11): Result.005 file - promoters50/1448022
cgtataaaaaa

SEQ ID NO: 173014 - DNA, 11 bp, Unknown
  misc_feature (1)..( 11): Result.005 file - promoters50/1448022
aaaagaaaaaa

SEQ ID NO: 173015 - DNA, 11 bp, Unknown
  misc_feature (1)..( 11): Result.005 file - promoters50/1448022
tatatgaaaac

SEQ ID NO: 173016 - DNA, 11 bp, Unknown
  misc_feature (1)..( 11): Result.005 file - promoters50/1448022
agactaaaaaa

SEQ ID NO: 173017 - DNA, 12 bp, Unknown
  misc_feature (1)..( 12): Result.005 file - promoters50/1448022
caatcgaagaaa

SEQ ID NO: 173018 - DNA, 14 bp, Unknown
  misc_feature (1)..( 14): Result.005 file - promoters50/1448022
ctattgttttgaat

SEQ ID NO: 173019 - DNA, 14 bp, Unknown
  misc_feature (1)..( 14): Result.005 file - promoters50/1448022
attttgttttctaa

SEQ ID NO: 173020 - DNA, 14 bp, Unknown
  misc_feature (1)..( 14): Result.005 file - promoters50/1448022
aaattatttttaat

SEQ ID NO: 173021 - DNA, 14 bp, Unknown
  misc_feature (1)..( 14): Result.005 file - promoters50/1448022
cttttgttgttact

SEQ ID NO: 173022 - DNA, 14 bp, Unknown
  misc_feature (1)..( 14): Result.005 file - promoters50/1448022
tgtttgatgtttca

SEQ ID NO: 173023 - DNA, 14 bp, Unknown
  misc_feature (1)..( 14): Result.005 file - promoters50/1448022
cttttgtatatttt

SEQ ID NO: 173024 - DNA, 11 bp, Unknown
  misc_feature (1)..( 11): Result.005 file - promoters50/1448054
atttttctact

SEQ ID NO: 173025 - DNA, 11 bp, Unknown
  misc_feature (1)..( 11): Result.005 file - promoters50/1448054
ttttttcttgg

SEQ ID NO: 173026 - DNA, 12 bp, Unknown
  misc_feature (1)..( 12): Result.005 file - promoters50/1448054
ggattttcttcg

SEQ ID NO: 173027 - DNA, 11 bp, Unknown
  misc_feature (1)..( 11): Result.005 file - promoters50/1448054
gtttttcttaa

SEQ ID NO: 173028 - DNA, 12 bp, Unknown
  misc_feature (1)..( 12): Result.005 file - promoters50/1448054
tttatttcttgg

SEQ ID NO: 173029 - DNA, 12 bp, Unknown
  misc_feature (1)..( 12): Result.005 file - promoters50/1448054
tcatttgattga

SEQ ID NO: 173030 - DNA, 16 bp, Unknown
  misc_feature (1)..( 16): Result.005 file - promoters50/1448054
tacattttttggctct

SEQ ID NO: 173031 - DNA, 16 bp, Unknown
  misc_feature (1)..( 16): Result.005 file - promoters50/1448054
tttatttcttggttca

SEQ ID NO: 173032 - DNA, 16 bp, Unknown
  misc_feature (1)..( 16): Result.005 file - promoters50/1448054
tttttttcttggaatt

SEQ ID NO: 173033 - DNA, 16 bp, Unknown
  misc_feature (1)..( 16): Result.005 file - promoters50/1448054
cttgtttttcttaaat

SEQ ID NO: 173034 - DNA, 16 bp, Unknown
  misc_feature (1)..( 16): Result.005 file - promoters50/1448054
aatatatcttgattca

SEQ ID NO: 173035 - DNA, 16 bp, Unknown
  misc_feature (1)..( 16): Result.005 file - promoters50/1448054
gaactatcttctcatt

SEQ ID NO: 173036 - DNA, 16 bp, Unknown
  misc_feature (1)..( 16): Result.005 file - promoters50/1448054
gtcatagcttagctcc

SEQ ID NO: 173037 - DNA, 16 bp, Unknown
  misc_feature (1)..( 16): Result.005 file - promoters50/1448054
aagcaaaaaaatcaat

SEQ ID NO: 173038 - DNA, 16 bp, Unknown
  misc_feature (1)..( 16): Result.005 file - promoters50/1448054
tttgaaaaaaatggtt

SEQ ID NO: 173039 - DNA, 16 bp, Unknown
  misc_feature (1)..( 16): Result.005 file - promoters50/1448054
agagaagaaaatgaaa

SEQ ID NO: 173040 - DNA, 16 bp, Unknown
  misc_feature (1)..( 16): Result.005 file - promoters50/1448054
attgataaattaagct

SEQ ID NO: 173041 - DNA, 16 bp, Unknown
  misc_feature (1)..( 16): Result.005 file - promoters50/1448054
gtaatgtttaatcgat

SEQ ID NO: 173042 - DNA, 16 bp, Unknown
  misc_feature (1)..( 16): Result.005 file - promoters50/1448054
attgttaatcaaatgt

SEQ ID NO: 173043 - DNA, 13 bp, Unknown
  misc_feature (1)..( 13): Result.005 file - promoters50/1448078
caaactttattaa

SEQ ID NO: 173044 - DNA, 13 bp, Unknown
  misc_feature (1)..( 13): Result.005 file - promoters50/1448078
ttcactttatacc

SEQ ID NO: 173045 - DNA, 13 bp, Unknown
  misc_feature (1)..( 13): Result.005 file - promoters50/1448078
tgttgtttattaa

SEQ ID NO: 173046 - DNA, 13 bp, Unknown
  misc_feature (1)..( 13): Result.005 file - promoters50/1448078
aaaactttttata

SEQ ID NO: 173047 - DNA, 13 bp, Unknown
  misc_feature (1)..( 13): Result.005 file - promoters50/1448078
caaacattaacca

SEQ ID NO: 173048 - DNA, 13 bp, Unknown
  misc_feature (1)..( 13): Result.005 file - promoters50/1448078
caagcataaaaag

SEQ ID NO: 173049 - DNA, 14 bp, Unknown
  misc_feature (1)..( 14): Result.005 file - promoters50/1448078
tttccctttaattt

SEQ ID NO: 173050 - DNA, 14 bp, Unknown
  misc_feature (1)..( 14): Result.005 file - promoters50/1448078
ataaactttaaata

SEQ ID NO: 173051 - DNA, 14 bp, Unknown
  misc_feature (1)..( 14): Result.005 file - promoters50/1448078
atatactgtaattg

SEQ ID NO: 173052 - DNA, 14 bp, Unknown
  misc_feature (1)..( 14): Result.005 file - promoters50/1448078
aggttatgtatttg

SEQ ID NO: 173053 - DNA, 14 bp, Unknown
  misc_feature (1)..( 14): Result.005 file - promoters50/1448078
aagagttttaaaat

SEQ ID NO: 173054 - DNA, 14 bp, Unknown
  misc_feature (1)..( 14): Result.005 file - promoters50/1448078
cataacattataac

SEQ ID NO: 173055 - DNA, 12 bp, Unknown
  misc_feature (1)..( 12): Result.005 file - promoters50/1448078
tatagaattatt

SEQ ID NO: 173056 - DNA, 12 bp, Unknown
  misc_feature (1)..( 12): Result.005 file - promoters50/1448078
tataaaataaaa

SEQ ID NO: 173057 - DNA, 12 bp, Unknown
  misc_feature (1)..( 12): Result.005 file - promoters50/1448078
cataaaatcatt

SEQ ID NO: 173058 - DNA, 12 bp, Unknown
  misc_feature (1)..( 12): Result.005 file - promoters50/1448078
attagaatcgtg

SEQ ID NO: 173059 - DNA, 12 bp, Unknown
  misc_feature (1)..( 12): Result.005 file - promoters50/1448078
caaaaaataaag

SEQ ID NO: 173060 - DNA, 12 bp, Unknown
  misc_feature (1)..( 12): Result.005 file - promoters50/1448078
ttaaaaatagtt

SEQ ID NO: 173061 - DNA, 8 bp, Unknown
  misc_feature (1)..( 8): Result.005 file - promoters50/1448078
taaaaatg

SEQ ID NO: 173062 - DNA, 8 bp, Unknown
  misc_feature (1)..( 8): Result.005 file - promoters50/1448078
gaaaaata

SEQ ID NO: 173063 - DNA, 8 bp, Unknown
  misc_feature (1)..( 8): Result.005 file - promoters50/1448078
taaaaaat

SEQ ID NO: 173064 - DNA, 8 bp, Unknown
  misc_feature (1)..( 8): Result.005 file - promoters50/1448078
aaaaaatt

SEQ ID NO: 173065 - DNA, 9 bp, Unknown
  misc_feature (1)..( 9): Result.005 file - promoters50/1448078
aaataaatg

SEQ ID NO: 173066 - DNA, 9 bp, Unknown
  misc_feature (1)..( 9): Result.005 file - promoters50/1448078
aacaaaatt

SEQ ID NO: 173067 - DNA, 9 bp, Unknown
  misc_feature (1)..( 9): Result.005 file - promoters50/1448101
ttttctaat

SEQ ID NO: 173068 - DNA, 9 bp, Unknown
  misc_feature (1)..( 9): Result.005 file - promoters50/1448101
ttttcttgc

SEQ ID NO: 173069 - DNA, 9 bp, Unknown
  misc_feature (1)..( 9): Result.005 file - promoters50/1448101
ttttctaat

SEQ ID NO: 173070 - DNA, 7 bp, Unknown
  misc_feature (1)..( 7): Result.005 file - promoters50/1448101
tttgttc

SEQ ID NO: 173071 - DNA, 7 bp, Unknown
  misc_feature (1)..( 7): Result.005 file - promoters50/1448101
tttattc

SEQ ID NO: 173072 - DNA, 7 bp, Unknown
  misc_feature (1)..( 7): Result.005 file - promoters50/1448101
ttttttc

SEQ ID NO: 173073 - DNA, 8 bp, Unknown
  misc_feature (1)..( 8): Result.005 file - promoters50/1448101
aatatata

SEQ ID NO: 173074 - DNA, 8 bp, Unknown
  misc_feature (1)..( 8): Result.005 file - promoters50/1448101
aatgtata

SEQ ID NO: 173075 - DNA, 8 bp, Unknown
  misc_feature (1)..( 8): Result.005 file - promoters50/1448101
aatttatt

SEQ ID NO: 173076 - DNA, 12 bp, Unknown
  misc_feature (1)..( 12): Result.005 file - promoters50/1448105
taaatatgatat

SEQ ID NO: 173077 - DNA, 12 bp, Unknown
  misc_feature (1)..( 12): Result.005 file - promoters50/1448105
caaagatgaggt

SEQ ID NO: 173078 - DNA, 12 bp, Unknown
  misc_feature (1)..( 12): Result.005 file - promoters50/1448105
taaataagtaaa

SEQ ID NO: 173079 - DNA, 12 bp, Unknown
  misc_feature (1)..( 12): Result.005 file - promoters50/1448105
cagggatcaggc

SEQ ID NO: 173080 - DNA, 12 bp, Unknown
  misc_feature (1)..( 12): Result.005 file - promoters50/1448105
ttgcgatgagac

SEQ ID NO: 173081 - DNA, 12 bp, Unknown
  misc_feature (1)..( 12): Result.005 file - promoters50/1448105
tttggattaata

SEQ ID NO: 173082 - DNA, 13 bp, Unknown
  misc_feature (1)..( 13): Result.005 file - promoters50/1448105
attctaattaata

SEQ ID NO: 173083 - DNA, 11 bp, Unknown
  misc_feature (1)..( 11): Result.005 file - promoters50/1448105
gattaatactt

SEQ ID NO: 173084 - DNA, 11 bp, Unknown
  misc_feature (1)..( 11): Result.005 file - promoters50/1448105
tataaatactt

SEQ ID NO: 173085 - DNA, 11 bp, Unknown
  misc_feature (1)..( 11): Result.005 file - promoters50/1448105
gattaatacat

SEQ ID NO: 173086 - DNA, 11 bp, Unknown
  misc_feature (1)..( 11): Result.005 file - promoters50/1448105
aattaatacaa

SEQ ID NO: 173087 - DNA, 11 bp, Unknown
  misc_feature (1)..( 11): Result.005 file - promoters50/1448105
cacaaattctt

SEQ ID NO: 173088 - DNA, 11 bp, Unknown
  misc_feature (1)..( 11): Result.005 file - promoters50/1448105
gataaataagt

SEQ ID NO: 173089 - DNA, 8 bp, Unknown
  misc_feature (1)..( 8): Result.005 file - promoters50/1448105
atttattg

SEQ ID NO: 173090 - DNA, 8 bp, Unknown
  misc_feature (1)..( 8): Result.005 file - promoters50/1448105
ttttatta

SEQ ID NO: 173091 - DNA, 8 bp, Unknown
  misc_feature (1)..( 8): Result.005 file - promoters50/1448105
ttttgtta

SEQ ID NO: 173092 - DNA, 8 bp, Unknown
  misc_feature (1)..( 8): Result.005 file - promoters50/1448105
ttttgttg

SEQ ID NO: 173093 - DNA, 8 bp, Unknown
  misc_feature (1)..( 8): Result.005 file - promoters50/1448105
atttttta

SEQ ID NO: 173094 - DNA, 8 bp, Unknown
  misc_feature (1)..( 8): Result.005 file - promoters50/1448105
ttttaacc

SEQ ID NO: 173095 - DNA, 9 bp, Unknown
  misc_feature (1)..( 9): Result.005 file - promoters50/1448135
tgatacaaa

SEQ ID NO: 173096 - DNA, 9 bp, Unknown
  misc_feature (1)..( 9): Result.005 file - promoters50/1448135
agatacagt

SEQ ID NO: 173097 - DNA, 9 bp, Unknown
  misc_feature (1)..( 9): Result.005 file - promoters50/1448135
tgaaacaga

SEQ ID NO: 173098 - DNA, 9 bp, Unknown
  misc_feature (1)..( 9): Result.005 file - promoters50/1448135
cgatccaga

SEQ ID NO: 173099 - DNA, 9 bp, Unknown
  misc_feature (1)..( 9): Result.005 file - promoters50/1448135
agagacatc

SEQ ID NO: 173100 - DNA, 9 bp, Unknown
  misc_feature (1)..( 9): Result.005 file - promoters50/1448135
agatccata

SEQ ID NO: 173101 - DNA, 9 bp, Unknown
  misc_feature (1)..( 9): Result.005 file - promoters50/1448135
tgagccatc

SEQ ID NO: 173102 - DNA, 10 bp, Unknown
  misc_feature (1)..( 10): Result.005 file - promoters50/1448135
aaaaaaattc

SEQ ID NO: 173103 - DNA, 10 bp, Unknown
  misc_feature (1)..( 10): Result.005 file - promoters50/1448135
agaaaatttc

SEQ ID NO: 173104 - DNA, 11 bp, Unknown
  misc_feature (1)..( 11): Result.005 file - promoters50/1448135
aaaacaaatag

SEQ ID NO: 173105 - DNA, 11 bp, Unknown
  misc_feature (1)..( 11): Result.005 file - promoters50/1448135
gaagaacattt

SEQ ID NO: 173106 - DNA, 11 bp, Unknown
  misc_feature (1)..( 11): Result.005 file - promoters50/1448135
taaaaacagtg

SEQ ID NO: 173107 - DNA, 11 bp, Unknown
  misc_feature (1)..( 11): Result.005 file - promoters50/1448135
gaagaatatca

SEQ ID NO: 173108 - DNA, 13 bp, Unknown
  misc_feature (1)..( 13): Result.005 file - promoters50/1448135
aagaagaaaaaaa

SEQ ID NO: 173109 - DNA, 13 bp, Unknown
  misc_feature (1)..( 13): Result.005 file - promoters50/1448135
tcgaagaacattt

SEQ ID NO: 173110 - DNA, 13 bp, Unknown
  misc_feature (1)..( 13): Result.005 file - promoters50/1448135
aagaagaatatca

SEQ ID NO: 173111 - DNA, 13 bp, Unknown
  misc_feature (1)..( 13): Result.005 file - promoters50/1448135
taaaagaaaattt

SEQ ID NO: 173112 - DNA, 13 bp, Unknown
  misc_feature (1)..( 13): Result.005 file - promoters50/1448135
gaaaacaaataga

SEQ ID NO: 173113 - DNA, 13 bp, Unknown
  misc_feature (1)..( 13): Result.005 file - promoters50/1448135
aaaaacagtgatc

SEQ ID NO: 173114 - DNA, 9 bp, Unknown
  misc_feature (1)..( 9): Result.005 file - promoters50/1448197
atgaagacg

SEQ ID NO: 173115 - DNA, 9 bp, Unknown
  misc_feature (1)..( 9): Result.005 file - promoters50/1448197
atgaagaat

SEQ ID NO: 173116 - DNA, 9 bp, Unknown
  misc_feature (1)..( 9): Result.005 file - promoters50/1448197
tagaacaat

SEQ ID NO: 173117 - DNA, 8 bp, Unknown
  misc_feature (1)..( 8): Result.005 file - promoters50/1448197
tttttttt

SEQ ID NO: 173118 - DNA, 8 bp, Unknown
  misc_feature (1)..( 8): Result.005 file - promoters50/1448197
tttgtttt

SEQ ID NO: 173119 - DNA, 8 bp, Unknown
  misc_feature (1)..( 8): Result.005 file - promoters50/1448197
ttttttta

SEQ ID NO: 173120 - DNA, 15 bp, Unknown
  misc_feature (1)..( 15): Result.005 file - promoters50/1448197
tctcaattgtatcaa

SEQ ID NO: 173121 - DNA, 15 bp, Unknown
  misc_feature (1)..( 15): Result.005 file - promoters50/1448197
actttattttattac

SEQ ID NO: 173122 - DNA, 15 bp, Unknown
  misc_feature (1)..( 15): Result.005 file - promoters50/1448197
tttttattttatttt

SEQ ID NO: 173123 - DNA, 13 bp, Unknown
  misc_feature (1)..( 13): Result.005 file - promoters50/1448251
gacataaaaaaaa

SEQ ID NO: 173124 - DNA, 13 bp, Unknown
  misc_feature (1)..( 13): Result.005 file - promoters50/1448251
tgattaaagaaac

SEQ ID NO: 173125 - DNA, 13 bp, Unknown
  misc_feature (1)..( 13): Result.005 file - promoters50/1448251
acattaaattaaa

SEQ ID NO: 173126 - DNA, 13 bp, Unknown
  misc_feature (1)..( 13): Result.005 file - promoters50/1448251
gattgaaaaaaaa

SEQ ID NO: 173127 - DNA, 13 bp, Unknown
  misc_feature (1)..( 13): Result.005 file - promoters50/1448251
ataaaccagaaac

SEQ ID NO: 173128 - DNA, 13 bp, Unknown
  misc_feature (1)..( 13): Result.005 file - promoters50/1448251
acattaaccaaat

SEQ ID NO: 173129 - DNA, 14 bp, Unknown
  misc_feature (1)..( 14): Result.005 file - promoters50/1448251
aaaataaaaataaa

SEQ ID NO: 173130 - DNA, 14 bp, Unknown
  misc_feature (1)..( 14): Result.005 file - promoters50/1448251
gaaaaaaaaattga

SEQ ID NO: 173131 - DNA, 14 bp, Unknown
  misc_feature (1)..( 14): Result.005 file - promoters50/1448251
aaaagaaaaaattc

SEQ ID NO: 173132 - DNA, 14 bp, Unknown
  misc_feature (1)..( 14): Result.005 file - promoters50/1448251
tgaagagagaatct

SEQ ID NO: 173133 - DNA, 14 bp, Unknown
  misc_feature (1)..( 14): Result.005 file - promoters50/1448251
gatctgaaaattag

SEQ ID NO: 173134 - DNA, 14 bp, Unknown
  misc_feature (1)..( 14): Result.005 file - promoters50/1448251
aagtataaacttag

SEQ ID NO: 173135 - DNA, 14 bp, Unknown
  misc_feature (1)..( 14): Result.005 file - promoters50/1448251
caatgaaagtagtt

SEQ ID NO: 173136 - DNA, 14 bp, Unknown
  misc_feature (1)..( 14): Result.005 file - promoters50/1448251
ttatgaaagaagtt

SEQ ID NO: 173137 - DNA, 14 bp, Unknown
  misc_feature (1)..( 14): Result.005 file - promoters50/1448251
aaattaaacccatt

SEQ ID NO: 173138 - DNA, 14 bp, Unknown
  misc_feature (1)..( 14): Result.005 file - promoters50/1448251
tcatctaagttgtt

SEQ ID NO: 173139 - DNA, 14 bp, Unknown
  misc_feature (1)..( 14): Result.005 file - promoters50/1448251
ttgaaaaaaaaggg

SEQ ID NO: 173140 - DNA, 14 bp, Unknown
  misc_feature (1)..( 14): Result.005 file - promoters50/1448251
aaattaaccaagaa

SEQ ID NO: 173141 - DNA, 10 bp, Unknown
  misc_feature (1)..( 10): Result.005 file - promoters50/1448251
ttaactgaaa

SEQ ID NO: 173142 - DNA, 10 bp, Unknown
  misc_feature (1)..( 10): Result.005 file - promoters50/1448251
ataattgact

SEQ ID NO: 173143 - DNA, 10 bp, Unknown
  misc_feature (1)..( 10): Result.005 file - promoters50/1448251
ctaattgtgt

SEQ ID NO: 173144 - DNA, 10 bp, Unknown
  misc_feature (1)..( 10): Result.005 file - promoters50/1448251
tcaattttgt

SEQ ID NO: 173145 - DNA, 10 bp, Unknown
  misc_feature (1)..( 10): Result.005 file - promoters50/1448251
ataattttcc

SEQ ID NO: 173146 - DNA, 10 bp, Unknown
  misc_feature (1)..( 10): Result.005 file - promoters50/1448251
acaatttaaa

SEQ ID NO: 173147 - DNA, 10 bp, Unknown
  misc_feature (1)..( 10): Result.005 file - promoters50/1448256
aaacattgac

SEQ ID NO: 173148 - DNA, 10 bp, Unknown
  misc_feature (1)..( 10): Result.005 file - promoters50/1448256
aaagatttga

SEQ ID NO: 173149 - DNA, 10 bp, Unknown
  misc_feature (1)..( 10): Result.005 file - promoters50/1448256
taagattgcc

SEQ ID NO: 173150 - DNA, 10 bp, Unknown
  misc_feature (1)..( 10): Result.005 file - promoters50/1448256
tgagatttga

SEQ ID NO: 173151 - DNA, 9 bp, Unknown
  misc_feature (1)..( 9): Result.005 file - promoters50/1450092
atatgtaaa

SEQ ID NO: 173152 - DNA, 9 bp, Unknown
  misc_feature (1)..( 9): Result.005 file - promoters50/1450092
tgttgtaaa

SEQ ID NO: 173153 - DNA, 9 bp, Unknown
  misc_feature (1)..( 9): Result.005 file - promoters50/1450092
atatttaat

SEQ ID NO: 173154 - DNA, 18 bp, Unknown
  misc_feature (1)..( 18): Result.005 file - promoters50/1450099
tcacctcttttatggtaa

SEQ ID NO: 173155 - DNA, 18 bp, Unknown
  misc_feature (1)..( 18): Result.005 file - promoters50/1450099
gggtttattttattacaa

SEQ ID NO: 173156 - DNA, 18 bp, Unknown
  misc_feature (1)..( 18): Result.005 file - promoters50/1450099
tatgattttttattagct

SEQ ID NO: 173157 - DNA, 18 bp, Unknown
  misc_feature (1)..( 18): Result.005 file - promoters50/1450099
gaaaacaatttatattat

SEQ ID NO: 173158 - DNA, 18 bp, Unknown
  misc_feature (1)..( 18): Result.005 file - promoters50/1450099
aaaaagaatttataaatt

SEQ ID NO: 173159 - DNA, 18 bp, Unknown
  misc_feature (1)..( 18): Result.005 file - promoters50/1450099
aaaaagtgataaaacaat

SEQ ID NO: 173160 - DNA, 18 bp, Unknown
  misc_feature (1)..( 18): Result.005 file - promoters50/1450099
caaaagatttattcaaga

SEQ ID NO: 173161 - DNA, 12 bp, Unknown
  misc_feature (1)..( 12): Result.005 file - promoters50/1450099
gaataaaaaaac

SEQ ID NO: 173162 - DNA, 12 bp, Unknown
  misc_feature (1)..( 12): Result.005 file - promoters50/1450099
tagtaataaaat

SEQ ID NO: 173163 - DNA, 12 bp, Unknown
  misc_feature (1)..( 12): Result.005 file - promoters50/1450099
aagtaaaaaaca

SEQ ID NO: 173164 - DNA, 12 bp, Unknown
  misc_feature (1)..( 12): Result.005 file - promoters50/1450099
tagaaataaaaa

SEQ ID NO: 173165 - DNA, 12 bp, Unknown
  misc_feature (1)..( 12): Result.005 file - promoters50/1450099
gagttatatgaa

SEQ ID NO: 173166 - DNA, 12 bp, Unknown
  misc_feature (1)..( 12): Result.005 file - promoters50/1450099
ttttaaacattg

SEQ ID NO: 173167 - DNA, 16 bp, Unknown
  misc_feature (1)..( 16): Result.005 file - promoters50/1450099
atacatattgagttaa

SEQ ID NO: 173168 - DNA, 16 bp, Unknown
  misc_feature (1)..( 16): Result.005 file - promoters50/1450099
aacaaaaatgaattaa

SEQ ID NO: 173169 - DNA, 16 bp, Unknown
  misc_feature (1)..( 16): Result.005 file - promoters50/1450099
tacaaaattgaatcta

SEQ ID NO: 173170 - DNA, 16 bp, Unknown
  misc_feature (1)..( 16): Result.005 file - promoters50/1450099
cacaaaagcacttcgc

SEQ ID NO: 173171 - DNA, 16 bp, Unknown
  misc_feature (1)..( 16): Result.005 file - promoters50/1450099
atccaaattgaacaat

SEQ ID NO: 173172 - DNA, 16 bp, Unknown
  misc_feature (1)..( 16): Result.005 file - promoters50/1450099
tactaaacagaaccat

SEQ ID NO: 173173 - DNA, 15 bp, Unknown
  misc_feature (1)..( 15): Result.005 file - promoters50/1450099
taaaatatatttaat

SEQ ID NO: 173174 - DNA, 15 bp, Unknown
  misc_feature (1)..( 15): Result.005 file - promoters50/1450099
tgacatatttttata

SEQ ID NO: 173175 - DNA, 15 bp, Unknown
  misc_feature (1)..( 15): Result.005 file - promoters50/1450099
aaaaataatctcatt

SEQ ID NO: 173176 - DNA, 15 bp, Unknown
  misc_feature (1)..( 15): Result.005 file - promoters50/1450099
acaaatctattaact

SEQ ID NO: 173177 - DNA, 15 bp, Unknown
  misc_feature (1)..( 15): Result.005 file - promoters50/1450099
gatgacgtattgctg

SEQ ID NO: 173178 - DNA, 15 bp, Unknown
  misc_feature (1)..( 15): Result.005 file - promoters50/1450099
gatattgtagtgcaa

SEQ ID NO: 173179 - DNA, 15 bp, Unknown
  misc_feature (1)..( 15): Result.005 file - promoters50/1450099
aaaaagattttataa

SEQ ID NO: 173180 - DNA, 10 bp, Unknown
  misc_feature (1)..( 10): Result.005 file - promoters50/1450137
ctaacttttg

SEQ ID NO: 173181 - DNA, 10 bp, Unknown
  misc_feature (1)..( 10): Result.005 file - promoters50/1450137
ttaaatttta

SEQ ID NO: 173182 - DNA, 10 bp, Unknown
  misc_feature (1)..( 10): Result.005 file - promoters50/1450137
gaaacgtttg

SEQ ID NO: 173183 - DNA, 10 bp, Unknown
  misc_feature (1)..( 10): Result.005 file - promoters50/1450137
ctaactccgt

SEQ ID NO: 173184 - DNA, 11 bp, Unknown
  misc_feature (1)..( 11): Result.005 file - promoters50/1450137
aactttttaaa

SEQ ID NO: 173185 - DNA, 11 bp, Unknown
  misc_feature (1)..( 11): Result.005 file - promoters50/1450137
ccctttttttt

SEQ ID NO: 173186 - DNA, 11 bp, Unknown
  misc_feature (1)..( 11): Result.005 file - promoters50/1450137
taatttttaaa

SEQ ID NO: 173187 - DNA, 11 bp, Unknown
  misc_feature (1)..( 11): Result.005 file - promoters50/1450137
cccatttgcta

SEQ ID NO: 173188 - DNA, 7 bp, Unknown
  misc_feature (1)..( 7): Result.005 file - promoters50/1450224
ttttcta

SEQ ID NO: 173189 - DNA, 7 bp, Unknown
  misc_feature (1)..( 7): Result.005 file - promoters50/1450224
ttttcta

SEQ ID NO: 173190 - DNA, 7 bp, Unknown
  misc_feature (1)..( 7): Result.005 file - promoters50/1450224
ttttcta

SEQ ID NO: 173191 - DNA, 9 bp, Unknown
  misc_feature (1)..( 9): Result.005 file - promoters50/1450224
ttaaatgaa

SEQ ID NO: 173192 - DNA, 9 bp, Unknown
  misc_feature (1)..( 9): Result.005 file - promoters50/1450224
ctaaatgaa

SEQ ID NO: 173193 - DNA, 9 bp, Unknown
  misc_feature (1)..( 9): Result.005 file - promoters50/1450224
ttacatgtt

SEQ ID NO: 173194 - DNA, 8 bp, Unknown
  misc_feature (1)..( 8): Result.005 file - promoters50/1450224
tattttac

SEQ ID NO: 173195 - DNA, 8 bp, Unknown
  misc_feature (1)..( 8): Result.005 file - promoters50/1450224
tattttat

SEQ ID NO: 173196 - DNA, 8 bp, Unknown
  misc_feature (1)..( 8): Result.005 file - promoters50/1450224
aattatat

SEQ ID NO: 173197 - DNA, 8 bp, Unknown
  misc_feature (1)..( 8): Result.005 file - promoters50/1450224
tataaata

SEQ ID NO: 173198 - DNA, 8 bp, Unknown
  misc_feature (1)..( 8): Result.005 file - promoters50/1450224
tataaacc

SEQ ID NO: 173199 - DNA, 8 bp, Unknown
  misc_feature (1)..( 8): Result.005 file - promoters50/1450224
aataaaaa

SEQ ID NO: 173200 - DNA, 9 bp, Unknown
  misc_feature (1)..( 9): Result.005 file - promoters50/1450224
atacaaaat

SEQ ID NO: 173201 - DNA, 9 bp, Unknown
  misc_feature (1)..( 9): Result.005 file - promoters50/1450224
gaacacaat

SEQ ID NO: 173202 - DNA, 9 bp, Unknown
  misc_feature (1)..( 9): Result.005 file - promoters50/1450224
gaaaacaaa

SEQ ID NO: 173203 - DNA, 12 bp, Unknown
  misc_feature (1)..( 12): Result.005 file - promoters50/1450224
gacgttttgtat

SEQ ID NO: 173204 - DNA, 12 bp, Unknown
  misc_feature (1)..( 12): Result.005 file - promoters50/1450224
aataaattgtat

SEQ ID NO: 173205 - DNA, 12 bp, Unknown
  misc_feature (1)..( 12): Result.005 file - promoters50/1450224
aataaagtgtac

SEQ ID NO: 173206 - DNA, 7 bp, Unknown
  misc_feature (1)..( 7): Result.005 file - promoters50/1450224
aaagtat

SEQ ID NO: 173207 - DNA, 7 bp, Unknown
  misc_feature (1)..( 7): Result.005 file - promoters50/1450224
aaattat

SEQ ID NO: 173208 - DNA, 7 bp, Unknown
  misc_feature (1)..( 7): Result.005 file - promoters50/1450224
attttat

SEQ ID NO: 173209 - DNA, 9 bp, Unknown
  misc_feature (1)..( 9): Result.005 file - promoters50/1450224
aaaatgatc

SEQ ID NO: 173210 - DNA, 9 bp, Unknown
  misc_feature (1)..( 9): Result.005 file - promoters50/1450224
aaaataatc

SEQ ID NO: 173211 - DNA, 9 bp, Unknown
  misc_feature (1)..( 9): Result.005 file - promoters50/1450224
ttaataatc

SEQ ID NO: 173212 - DNA, 9 bp, Unknown
  misc_feature (1)..( 9): Result.005 file - promoters50/1450224
caaaaaatc

SEQ ID NO: 173213 - DNA, 9 bp, Unknown
  misc_feature (1)..( 9): Result.005 file - promoters50/1450224
tctaaaatc

SEQ ID NO: 173214 - DNA, 10 bp, Unknown
  misc_feature (1)..( 10): Result.005 file - promoters50/1450224
tcaaagaata

SEQ ID NO: 173215 - DNA, 12 bp, Unknown
  misc_feature (1)..( 12): Result.005 file - promoters50/1450224
gaacaaaagttt

SEQ ID NO: 173216 - DNA, 12 bp, Unknown
  misc_feature (1)..( 12): Result.005 file - promoters50/1450224
gaataaattgta

SEQ ID NO: 173217 - DNA, 12 bp, Unknown
  misc_feature (1)..( 12): Result.005 file - promoters50/1450224
aaataaagtgta

SEQ ID NO: 173218 - DNA, 9 bp, Unknown
  misc_feature (1)..( 9): Result.005 file - promoters50/1450290
ttttttaaa

SEQ ID NO: 173219 - DNA, 9 bp, Unknown
  misc_feature (1)..( 9): Result.005 file - promoters50/1450290
gattttaat

SEQ ID NO: 173220 - DNA, 9 bp, Unknown
  misc_feature (1)..( 9): Result.005 file - promoters50/1450290
gtttttatt

SEQ ID NO: 173221 - DNA, 9 bp, Unknown
  misc_feature (1)..( 9): Result.005 file - promoters50/1450290
aatttcaat

SEQ ID NO: 173222 - DNA, 9 bp, Unknown
  misc_feature (1)..( 9): Result.005 file - promoters50/1450290
aatttctca

SEQ ID NO: 173223 - DNA, 12 bp, Unknown
  misc_feature (1)..( 12): Result.005 file - promoters50/1450301
caataaaaaaat

SEQ ID NO: 173224 - DNA, 12 bp, Unknown
  misc_feature (1)..( 12): Result.005 file - promoters50/1450301
aaatgaaatatc

SEQ ID NO: 173225 - DNA, 12 bp, Unknown
  misc_feature (1)..( 12): Result.005 file - promoters50/1450301
atataaaagtga

SEQ ID NO: 173226 - DNA, 10 bp, Unknown
  misc_feature (1)..( 10): Result.005 file - promoters50/1450301
atttgttatc

SEQ ID NO: 173227 - DNA, 10 bp, Unknown
  misc_feature (1)..( 10): Result.005 file - promoters50/1450301
atttgttatc

SEQ ID NO: 173228 - DNA, 10 bp, Unknown
  misc_feature (1)..( 10): Result.005 file - promoters50/1450301
atttgtaaat

SEQ ID NO: 173229 - DNA, 14 bp, Unknown
  misc_feature (1)..( 14): Result.005 file - promoters50/1450309
aataaatggaaata

SEQ ID NO: 173230 - DNA, 14 bp, Unknown
  misc_feature (1)..( 14): Result.005 file - promoters50/1450309
tacaaagggatatt

SEQ ID NO: 173231 - DNA, 14 bp, Unknown
  misc_feature (1)..( 14): Result.005 file - promoters50/1450309
aatatatgtaaacg

SEQ ID NO: 173232 - DNA, 14 bp, Unknown
  misc_feature (1)..( 14): Result.005 file - promoters50/1450309
actttatttaaaaa

SEQ ID NO: 173233 - DNA, 14 bp, Unknown
  misc_feature (1)..( 14): Result.005 file - promoters50/1450309
gtcgtatctaagac

SEQ ID NO: 173234 - DNA, 14 bp, Unknown
  misc_feature (1)..( 14): Result.005 file - promoters50/1450309
gaataatctatgac

SEQ ID NO: 173235 - DNA, 10 bp, Unknown
  misc_feature (1)..( 10): Result.005 file - promoters50/1450309
aaaaaaaaaa

SEQ ID NO: 173236 - DNA, 10 bp, Unknown
  misc_feature (1)..( 10): Result.005 file - promoters50/1450309
ataaagaaag

SEQ ID NO: 173237 - DNA, 10 bp, Unknown
  misc_feature (1)..( 10): Result.005 file - promoters50/1450309
gaaaacaaaa

SEQ ID NO: 173238 - DNA, 10 bp, Unknown
  misc_feature (1)..( 10): Result.005 file - promoters50/1450309
aaaaacaaaa

SEQ ID NO: 173239 - DNA, 10 bp, Unknown
  misc_feature (1)..( 10): Result.005 file - promoters50/1450309
agaaagaaag

SEQ ID NO: 173240 - DNA, 10 bp, Unknown
  misc_feature (1)..( 10): Result.005 file - promoters50/1450309
ataaaaatat

SEQ ID NO: 173241 - DNA, 12 bp, Unknown
  misc_feature (1)..( 12): Result.005 file - promoters50/1450357
taagccaaacgc

SEQ ID NO: 173242 - DNA, 12 bp, Unknown
  misc_feature (1)..( 12): Result.005 file - promoters50/1450357
taaggcaaattt

SEQ ID NO: 173243 - DNA, 12 bp, Unknown
  misc_feature (1)..( 12): Result.005 file - promoters50/1450357
ttttgcaatttt

SEQ ID NO: 173244 - DNA, 9 bp, Unknown
  misc_feature (1)..( 9): Result.005 file - promoters50/1450357
gcaatctag

SEQ ID NO: 173245 - DNA, 9 bp, Unknown
  misc_feature (1)..( 9): Result.005 file - promoters50/1450357
caaatttag

SEQ ID NO: 173246 - DNA, 9 bp, Unknown
  misc_feature (1)..( 9): Result.005 file - promoters50/1450357
gcaattttt

SEQ ID NO: 173247 - DNA, 8 bp, Unknown
  misc_feature (1)..( 8): Result.005 file - promoters50/1450357
atagatat

SEQ ID NO: 173248 - DNA, 8 bp, Unknown
  misc_feature (1)..( 8): Result.005 file - promoters50/1450357
atatataa

SEQ ID NO: 173249 - DNA, 8 bp, Unknown
  misc_feature (1)..( 8): Result.005 file - promoters50/1450357
ttatataa

SEQ ID NO: 173250 - DNA, 11 bp, Unknown
  misc_feature (1)..( 11): Result.005 file - promoters50/1450365
acagacaacta

SEQ ID NO: 173251 - DNA, 11 bp, Unknown
  misc_feature (1)..( 11): Result.005 file - promoters50/1450365
acaaacatgtg

SEQ ID NO: 173252 - DNA, 11 bp, Unknown
  misc_feature (1)..( 11): Result.005 file - promoters50/1450365
tgaaacatata

SEQ ID NO: 173253 - DNA, 11 bp, Unknown
  misc_feature (1)..( 11): Result.005 file - promoters50/1450365
ataaatatata

SEQ ID NO: 173254 - DNA, 9 bp, Unknown
  misc_feature (1)..( 9): Result.005 file - promoters50/1450369
ttattgtgg

SEQ ID NO: 173255 - DNA, 9 bp, Unknown
  misc_feature (1)..( 9): Result.005 file - promoters50/1450369
ttactgttg

SEQ ID NO: 173256 - DNA, 9 bp, Unknown
  misc_feature (1)..( 9): Result.005 file - promoters50/1450369
cgactgttg

SEQ ID NO: 173257 - DNA, 8 bp, Unknown
  misc_feature (1)..( 8): Result.005 file - promoters50/1450384
tatatata

SEQ ID NO: 173258 - DNA, 8 bp, Unknown
  misc_feature (1)..( 8): Result.005 file - promoters50/1450384
tatttata

SEQ ID NO: 173259 - DNA, 8 bp, Unknown
  misc_feature (1)..( 8): Result.005 file - promoters50/1450384
tatacaga

SEQ ID NO: 173260 - DNA, 8 bp, Unknown
  misc_feature (1)..( 8): Result.005 file - promoters50/1450384
aatatagt

SEQ ID NO: 173261 - DNA, 8 bp, Unknown
  misc_feature (1)..( 8): Result.005 file - promoters50/1450384
atatagat

SEQ ID NO: 173262 - DNA, 8 bp, Unknown
  misc_feature (1)..( 8): Result.005 file - promoters50/1450384
ttattgat

SEQ ID NO: 173263 - DNA, 8 bp, Unknown
  misc_feature (1)..( 8): Result.005 file - promoters50/1450384
atatagtt

SEQ ID NO: 173264 - DNA, 12 bp, Unknown
  misc_feature (1)..( 12): Result.005 file - promoters50/1450384
tatgtgtaaata

SEQ ID NO: 173265 - DNA, 12 bp, Unknown
  misc_feature (1)..( 12): Result.005 file - promoters50/1450384
tatttgttaata

SEQ ID NO: 173266 - DNA, 12 bp, Unknown
  misc_feature (1)..( 12): Result.005 file - promoters50/1450384
tctttgctaatc

SEQ ID NO: 173267 - DNA, 10 bp, Unknown
  misc_feature (1)..( 10): Result.005 file - promoters50/1450384
ctttgtttca

SEQ ID NO: 173268 - DNA, 10 bp, Unknown
  misc_feature (1)..( 10): Result.005 file - promoters50/1450384
gtttctttgg

SEQ ID NO: 173269 - DNA, 11 bp, Unknown
  misc_feature (1)..( 11): Result.005 file - promoters50/1450384
atttggtttct

SEQ ID NO: 173270 - DNA, 9 bp, Unknown
  misc_feature (1)..( 9): Result.005 file - promoters50/1450455
tcatacaaa

SEQ ID NO: 173271 - DNA, 9 bp, Unknown
  misc_feature (1)..( 9): Result.005 file - promoters50/1450455
tcatacaaa

SEQ ID NO: 173272 - DNA, 9 bp, Unknown
  misc_feature (1)..( 9): Result.005 file - promoters50/1450455
caatacaat

SEQ ID NO: 173273 - DNA, 8 bp, Unknown
  misc_feature (1)..( 8): Result.005 file - promoters50/1450455
aaaagaaa

SEQ ID NO: 173274 - DNA, 8 bp, Unknown
  misc_feature (1)..( 8): Result.005 file - promoters50/1450455
caaataaa

SEQ ID NO: 173275 - DNA, 8 bp, Unknown
  misc_feature (1)..( 8): Result.005 file - promoters50/1450455
caaataat

SEQ ID NO: 173276 - DNA, 10 bp, Unknown
  misc_feature (1)..( 10): Result.005 file - promoters50/1450455
ttatatttct

SEQ ID NO: 173277 - DNA, 10 bp, Unknown
  misc_feature (1)..( 10): Result.005 file - promoters50/1450455
ttatatatct

SEQ ID NO: 173278 - DNA, 10 bp, Unknown
  misc_feature (1)..( 10): Result.005 file - promoters50/1450455
ccgtatatca

SEQ ID NO: 173279 - DNA, 20 bp, Unknown
  misc_feature (1)..( 20): Result.005 file - promoters50/1450459
gaagtcgtatttgtgtttaa

SEQ ID NO: 173280 - DNA, 20 bp, Unknown
  misc_feature (1)..( 20): Result.005 file - promoters50/1450459
tttttcgtctttggaattgg

SEQ ID NO: 173281 - DNA, 20 bp, Unknown
  misc_feature (1)..( 20): Result.005 file - promoters50/1450459
gaaatcggattagggtttcg

SEQ ID NO: 173282 - DNA, 20 bp, Unknown
  misc_feature (1)..( 20): Result.005 file - promoters50/1450459
tttactgtattagtgattaa

SEQ ID NO: 173283 - DNA, 20 bp, Unknown
  misc_feature (1)..( 20): Result.005 file - promoters50/1450459
gtggaacaattacatgatta

SEQ ID NO: 173284 - DNA, 9 bp, Unknown
  misc_feature (1)..( 9): Result.005 file - promoters50/1450473
taaaaaaaa

SEQ ID NO: 173285 - DNA, 9 bp, Unknown
  misc_feature (1)..( 9): Result.005 file - promoters50/1450473
caaaagaaa

SEQ ID NO: 173286 - DNA, 9 bp, Unknown
  misc_feature (1)..( 9): Result.005 file - promoters50/1450473
taaaaagct

SEQ ID NO: 173287 - DNA, 8 bp, Unknown
  misc_feature (1)..( 8): Result.005 file - promoters50/1450473
gaataaca

SEQ ID NO: 173288 - DNA, 8 bp, Unknown
  misc_feature (1)..( 8): Result.005 file - promoters50/1450473
gaacaaca

SEQ ID NO: 173289 - DNA, 8 bp, Unknown
  misc_feature (1)..( 8): Result.005 file - promoters50/1450473
caatagta

SEQ ID NO: 173290 - DNA, 7 bp, Unknown
  misc_feature (1)..( 7): Result.005 file - promoters50/1450473
agaagaa

SEQ ID NO: 173291 - DNA, 7 bp, Unknown
  misc_feature (1)..( 7): Result.005 file - promoters50/1450473
tgaagaa

SEQ ID NO: 173292 - DNA, 7 bp, Unknown
  misc_feature (1)..( 7): Result.005 file - promoters50/1450473
agaagaa

SEQ ID NO: 173293 - DNA, 8 bp, Unknown
  misc_feature (1)..( 8): Result.005 file - promoters50/1450473
agattttg

SEQ ID NO: 173294 - DNA, 8 bp, Unknown
  misc_feature (1)..( 8): Result.005 file - promoters50/1450473
agagtttg

SEQ ID NO: 173295 - DNA, 8 bp, Unknown
  misc_feature (1)..( 8): Result.005 file - promoters50/1450473
agaaattg

SEQ ID NO: 173296 - DNA, 8 bp, Unknown
  misc_feature (1)..( 8): Result.005 file - promoters50/1450473
ggaggagg

SEQ ID NO: 173297 - DNA, 8 bp, Unknown
  misc_feature (1)..( 8): Result.005 file - promoters50/1450473
ggagaagg

SEQ ID NO: 173298 - DNA, 8 bp, Unknown
  misc_feature (1)..( 8): Result.005 file - promoters50/1450473
agagaaga

SEQ ID NO: 173299 - DNA, 9 bp, Unknown
  misc_feature (1)..( 9): Result.005 file - promoters50/1450477
taatttaag

SEQ ID NO: 173300 - DNA, 9 bp, Unknown
  misc_feature (1)..( 9): Result.005 file - promoters50/1450477
taattgaag

SEQ ID NO: 173301 - DNA, 9 bp, Unknown
  misc_feature (1)..( 9): Result.005 file - promoters50/1450477
gctttgaag

SEQ ID NO: 173302 - DNA, 9 bp, Unknown
  misc_feature (1)..( 9): Result.005 file - promoters50/1450477
aagcactta

SEQ ID NO: 173303 - DNA, 9 bp, Unknown
  misc_feature (1)..( 9): Result.005 file - promoters50/1450477
tagcattta

SEQ ID NO: 173304 - DNA, 9 bp, Unknown
  misc_feature (1)..( 9): Result.005 file - promoters50/1450477
aagcacgaa

SEQ ID NO: 173305 - DNA, 9 bp, Unknown
  misc_feature (1)..( 9): Result.005 file - promoters50/1450477
atccctata

SEQ ID NO: 173306 - DNA, 9 bp, Unknown
  misc_feature (1)..( 9): Result.005 file - promoters50/1450477
atctctatt

SEQ ID NO: 173307 - DNA, 9 bp, Unknown
  misc_feature (1)..( 9): Result.005 file - promoters50/1450477
tactccatt

SEQ ID NO: 173308 - DNA, 8 bp, Unknown
  misc_feature (1)..( 8): Result.005 file - promoters50/1450526
ggaaaaat

SEQ ID NO: 173309 - DNA, 8 bp, Unknown
  misc_feature (1)..( 8): Result.005 file - promoters50/1450526
ctaaaaat

SEQ ID NO: 173310 - DNA, 8 bp, Unknown
  misc_feature (1)..( 8): Result.005 file - promoters50/1450526
ctaaaaaa

SEQ ID NO: 173311 - DNA, 7 bp, Unknown
  misc_feature (1)..( 7): Result.005 file - promoters50/1450537
catttgt

SEQ ID NO: 173312 - DNA, 7 bp, Unknown
  misc_feature (1)..( 7): Result.005 file - promoters50/1450537
catttga

SEQ ID NO: 173313 - DNA, 7 bp, Unknown
  misc_feature (1)..( 7): Result.005 file - promoters50/1450537
aatttga

SEQ ID NO: 173314 - DNA, 8 bp, Unknown
  misc_feature (1)..( 8): Result.005 file - promoters50/1450537
atttttta

SEQ ID NO: 173315 - DNA, 8 bp, Unknown
  misc_feature (1)..( 8): Result.005 file - promoters50/1450537
attgtttg

SEQ ID NO: 173316 - DNA, 8 bp, Unknown
  misc_feature (1)..( 8): Result.005 file - promoters50/1450537
ttttatta

SEQ ID NO: 173317 - DNA, 9 bp, Unknown
  misc_feature (1)..( 9): Result.005 file - promoters50/1450537
aaaaaatat

SEQ ID NO: 173318 - DNA, 9 bp, Unknown
  misc_feature (1)..( 9): Result.005 file - promoters50/1450537
ttgaaatat

SEQ ID NO: 173319 - DNA, 9 bp, Unknown
  misc_feature (1)..( 9): Result.005 file - promoters50/1450537
aaaaaataa

SEQ ID NO: 173320 - DNA, 8 bp, Unknown
  misc_feature (1)..( 8): Result.005 file - promoters50/1450537
aaaataca

SEQ ID NO: 173321 - DNA, 8 bp, Unknown
  misc_feature (1)..( 8): Result.005 file - promoters50/1450537
gaaaaaca

SEQ ID NO: 173322 - DNA, 8 bp, Unknown
  misc_feature (1)..( 8): Result.005 file - promoters50/1450537
aaaaaaca

SEQ ID NO: 173323 - DNA, 7 bp, Unknown
  misc_feature (1)..( 7): Result.005 file - promoters50/1450537
ggaaaat

SEQ ID NO: 173324 - DNA, 7 bp, Unknown
  misc_feature (1)..( 7): Result.005 file - promoters50/1450537
ggaaaaa

SEQ ID NO: 173325 - DNA, 7 bp, Unknown
  misc_feature (1)..( 7): Result.005 file - promoters50/1450537
agaaaaa

SEQ ID NO: 173326 - DNA, 9 bp, Unknown
  misc_feature (1)..( 9): Result.005 file - promoters50/1450549
aacataatt

SEQ ID NO: 173327 - DNA, 7 bp, Unknown
  misc_feature (1)..( 7): Result.005 file - promoters50/1450549
tataatt

SEQ ID NO: 173328 - DNA, 9 bp, Unknown
  misc_feature (1)..( 9): Result.005 file - promoters50/1450549
aacataata

SEQ ID NO: 173329 - DNA, 8 bp, Unknown
  misc_feature (1)..( 8): Result.005 file - promoters50/1450549
aaatctaa

SEQ ID NO: 173330 - DNA, 8 bp, Unknown
  misc_feature (1)..( 8): Result.005 file - promoters50/1450549
aaaactat

SEQ ID NO: 173331 - DNA, 8 bp, Unknown
  misc_feature (1)..( 8): Result.005 file - promoters50/1450549
aaagctaa

SEQ ID NO: 173332 - DNA, 8 bp, Unknown
  misc_feature (1)..( 8): Result.005 file - promoters50/1450549
aacataat

SEQ ID NO: 173333 - DNA, 8 bp, Unknown
  misc_feature (1)..( 8): Result.005 file - promoters50/1450549
aacaaaat

SEQ ID NO: 173334 - DNA, 8 bp, Unknown
  misc_feature (1)..( 8): Result.005 file - promoters50/1450549
aacaaatg

SEQ ID NO: 173335 - DNA, 7 bp, Unknown
  misc_feature (1)..( 7): Result.005 file - promoters50/1450549
taaataa

SEQ ID NO: 173336 - DNA, 7 bp, Unknown
  misc_feature (1)..( 7): Result.005 file - promoters50/1450549
taattaa

SEQ ID NO: 173337 - DNA, 7 bp, Unknown
  misc_feature (1)..( 7): Result.005 file - promoters50/1450549
aaaataa

SEQ ID NO: 173338 - DNA, 7 bp, Unknown
  misc_feature (1)..( 7): Result.005 file - promoters50/1450549
caaagag

SEQ ID NO: 173339 - DNA, 7 bp, Unknown
  misc_feature (1)..( 7): Result.005 file - promoters50/1450549
taaagag

SEQ ID NO: 173340 - DNA, 7 bp, Unknown
  misc_feature (1)..( 7): Result.005 file - promoters50/1450549
taaagac

SEQ ID NO: 173341 - DNA, 8 bp, Unknown
  misc_feature (1)..( 8): Result.005 file - promoters50/1450549
aaaattta

SEQ ID NO: 173342 - DNA, 8 bp, Unknown
  misc_feature (1)..( 8): Result.005 file - promoters50/1450549
aaaattat

SEQ ID NO: 173343 - DNA, 8 bp, Unknown
  misc_feature (1)..( 8): Result.005 file - promoters50/1450549
aaaactat

SEQ ID NO: 173344 - DNA, 11 bp, Unknown
  misc_feature (1)..( 11): Result.005 file - promoters50/1450593
caataatatta

SEQ ID NO: 173345 - DNA, 11 bp, Unknown
  misc_feature (1)..( 11): Result.005 file - promoters50/1450593
tcataatatta

SEQ ID NO: 173346 - DNA, 11 bp, Unknown
  misc_feature (1)..( 11): Result.005 file - promoters50/1450593
tcaaaatgatg

SEQ ID NO: 173347 - DNA, 11 bp, Unknown
  misc_feature (1)..( 11): Result.005 file - promoters50/1450593
aatactattca

SEQ ID NO: 173348 - DNA, 11 bp, Unknown
  misc_feature (1)..( 11): Result.005 file - promoters50/1450593
aatattataaa

SEQ ID NO: 173349 - DNA, 11 bp, Unknown
  misc_feature (1)..( 11): Result.005 file - promoters50/1450593
ttaacttttca

SEQ ID NO: 173350 - DNA, 16 bp, Unknown
  misc_feature (1)..( 16): Result.005 file - promoters50/1450593
tcctcgtttctttcac

SEQ ID NO: 173351 - DNA, 16 bp, Unknown
  misc_feature (1)..( 16): Result.005 file - promoters50/1450593
tcctcatttttcaatt

SEQ ID NO: 173352 - DNA, 17 bp, Unknown
  misc_feature (1)..( 17): Result.005 file - promoters50/1450593
tgatcacttttcaattt

SEQ ID NO: 173353 - DNA, 9 bp, Unknown
  misc_feature (1)..( 9): Result.005 file - promoters50/1450593
taaaattag

SEQ ID NO: 173354 - DNA, 9 bp, Unknown
  misc_feature (1)..( 9): Result.005 file - promoters50/1450593
taatattat

SEQ ID NO: 173355 - DNA, 9 bp, Unknown
  misc_feature (1)..( 9): Result.005 file - promoters50/1450593
ctatattat

SEQ ID NO: 173356 - DNA, 13 bp, Unknown
  misc_feature (1)..( 13): Result.005 file - promoters50/1450610
gagaatcttcttc

SEQ ID NO: 173357 - DNA, 13 bp, Unknown
  misc_feature (1)..( 13): Result.005 file - promoters50/1450610
aacaatctgcttc

SEQ ID NO: 173358 - DNA, 13 bp, Unknown
  misc_feature (1)..( 13): Result.005 file - promoters50/1450610
aagaatctgatgt

SEQ ID NO: 173359 - DNA, 13 bp, Unknown
  misc_feature (1)..( 13): Result.005 file - promoters50/1450610
aatctgtttcttc

SEQ ID NO: 173360 - DNA, 13 bp, Unknown
  misc_feature (1)..( 13): Result.005 file - promoters50/1450610
aagaatattccat

SEQ ID NO: 173361 - DNA, 13 bp, Unknown
  misc_feature (1)..( 13): Result.005 file - promoters50/1450610
aaaaatttgaaaa

SEQ ID NO: 173362 - DNA, 13 bp, Unknown
  misc_feature (1)..( 13): Result.005 file - promoters50/1450610
aaggatagagata

SEQ ID NO: 173363 - DNA, 9 bp, Unknown
  misc_feature (1)..( 9): Result.005 file - promoters50/1450637
taactcttt

SEQ ID NO: 173364 - DNA, 9 bp, Unknown
  misc_feature (1)..( 9): Result.005 file - promoters50/1450637
taattcttt

SEQ ID NO: 173365 - DNA, 9 bp, Unknown
  misc_feature (1)..( 9): Result.005 file - promoters50/1450637
ctattattt

SEQ ID NO: 173366 - DNA, 8 bp, Unknown
  misc_feature (1)..( 8): Result.005 file - promoters50/1450662
attgttaa

SEQ ID NO: 173367 - DNA, 8 bp, Unknown
  misc_feature (1)..( 8): Result.005 file - promoters50/1450662
attgtttt

SEQ ID NO: 173368 - DNA, 8 bp, Unknown
  misc_feature (1)..( 8): Result.005 file - promoters50/1450662
attttttt

SEQ ID NO: 173369 - DNA, 8 bp, Unknown
  misc_feature (1)..( 8): Result.005 file - promoters50/1450662
cttttttc

SEQ ID NO: 173370 - DNA, 9 bp, Unknown
  misc_feature (1)..( 9): Result.005 file - promoters50/1450662
ggttttgga

SEQ ID NO: 173371 - DNA, 9 bp, Unknown
  misc_feature (1)..( 9): Result.005 file - promoters50/1450662
tgttttgta

SEQ ID NO: 173372 - DNA, 9 bp, Unknown
  misc_feature (1)..( 9): Result.005 file - promoters50/1450662
ggttttaaa

SEQ ID NO: 173373 - DNA, 9 bp, Unknown
  misc_feature (1)..( 9): Result.005 file - promoters50/1450662
cattttttt

SEQ ID NO: 173374 - DNA, 10 bp, Unknown
  misc_feature (1)..( 10): Result.005 file - promoters50/1450662
atgtttgagt

SEQ ID NO: 173375 - DNA, 10 bp, Unknown
  misc_feature (1)..( 10): Result.005 file - promoters50/1450662
atgtttgagt

SEQ ID NO: 173376 - DNA, 10 bp, Unknown
  misc_feature (1)..( 10): Result.005 file - promoters50/1450662
gtgattattt

SEQ ID NO: 173377 - DNA, 10 bp, Unknown
  misc_feature (1)..( 10): Result.005 file - promoters50/1450662
aagattattg

SEQ ID NO: 173378 - DNA, 7 bp, Unknown
  misc_feature (1)..( 7): Result.005 file - promoters50/1450662
ttaaaat

SEQ ID NO: 173379 - DNA, 7 bp, Unknown
  misc_feature (1)..( 7): Result.005 file - promoters50/1450662
ataaaat

SEQ ID NO: 173380 - DNA, 7 bp, Unknown
  misc_feature (1)..( 7): Result.005 file - promoters50/1450662
ttaaaat

SEQ ID NO: 173381 - DNA, 7 bp, Unknown
  misc_feature (1)..( 7): Result.005 file - promoters50/1450662
atgtttc

SEQ ID NO: 173382 - DNA, 7 bp, Unknown
  misc_feature (1)..( 7): Result.005 file - promoters50/1450662
gtgtttc

SEQ ID NO: 173383 - DNA, 7 bp, Unknown
  misc_feature (1)..( 7): Result.005 file - promoters50/1450662
gtgttta

SEQ ID NO: 173384 - DNA, 11 bp, Unknown
  misc_feature (1)..( 11): Result.005 file - promoters50/1450662
acaattcagcc

SEQ ID NO: 173385 - DNA, 11 bp, Unknown
  misc_feature (1)..( 11): Result.005 file - promoters50/1450662
acaattaagcc

SEQ ID NO: 173386 - DNA, 11 bp, Unknown
  misc_feature (1)..( 11): Result.005 file - promoters50/1450662
ggaatgaagat

SEQ ID NO: 173387 - DNA, 10 bp, Unknown
  misc_feature (1)..( 10): Result.005 file - promoters50/1450678
tccttaataa

SEQ ID NO: 173388 - DNA, 10 bp, Unknown
  misc_feature (1)..( 10): Result.005 file - promoters50/1450678
attttaatat

SEQ ID NO: 173389 - DNA, 8 bp, Unknown
  misc_feature (1)..( 8): Result.005 file - promoters50/1450678
actaataa

SEQ ID NO: 173390 - DNA, 8 bp, Unknown
  misc_feature (1)..( 8): Result.005 file - promoters50/1450678
cttaatta

SEQ ID NO: 173391 - DNA, 11 bp, Unknown
  misc_feature (1)..( 11): Result.005 file - promoters50/1450678
gatttcaattt

SEQ ID NO: 173392 - DNA, 11 bp, Unknown
  misc_feature (1)..( 11): Result.005 file - promoters50/1450678
gtcgctaatat

SEQ ID NO: 173393 - DNA, 12 bp, Unknown
  misc_feature (1)..( 12): Result.005 file - promoters50/1450678
gaatgttttaat

SEQ ID NO: 173394 - DNA, 12 bp, Unknown
  misc_feature (1)..( 12): Result.005 file - promoters50/1450678
taatattttata

SEQ ID NO: 173395 - DNA, 12 bp, Unknown
  misc_feature (1)..( 12): Result.005 file - promoters50/1450678
atcgatttcaat

SEQ ID NO: 173396 - DNA, 12 bp, Unknown
  misc_feature (1)..( 12): Result.005 file - promoters50/1450678
cgatatttcaaa

SEQ ID NO: 173397 - DNA, 12 bp, Unknown
  misc_feature (1)..( 12): Result.005 file - promoters50/1450678
aaatattgttaa

SEQ ID NO: 173398 - DNA, 12 bp, Unknown
  misc_feature (1)..( 12): Result.005 file - promoters50/1450678
taatatgctcct

SEQ ID NO: 173399 - DNA, 12 bp, Unknown
  misc_feature (1)..( 12): Result.005 file - promoters50/1450678
tccacaaactac

SEQ ID NO: 173400 - DNA, 12 bp, Unknown
  misc_feature (1)..( 12): Result.005 file - promoters50/1450678
cccaaaaatttg

SEQ ID NO: 173401 - DNA, 12 bp, Unknown
  misc_feature (1)..( 12): Result.005 file - promoters50/1450678
tccacaacgatg

SEQ ID NO: 173402 - DNA, 12 bp, Unknown
  misc_feature (1)..( 12): Result.005 file - promoters50/1450678
aacaaaaacatt

SEQ ID NO: 173403 - DNA, 12 bp, Unknown
  misc_feature (1)..( 12): Result.005 file - promoters50/1450678
ttgacaataact

SEQ ID NO: 173404 - DNA, 12 bp, Unknown
  misc_feature (1)..( 12): Result.005 file - promoters50/1450678
tataaaaaaaaa

SEQ ID NO: 173405 - DNA, 8 bp, Unknown
  misc_feature (1)..( 8): Result.005 file - promoters50/1450682
atatattt

SEQ ID NO: 173406 - DNA, 8 bp, Unknown
  misc_feature (1)..( 8): Result.005 file - promoters50/1450682
atatatac

SEQ ID NO: 173407 - DNA, 8 bp, Unknown
  misc_feature (1)..( 8): Result.005 file - promoters50/1450682
atacatac

SEQ ID NO: 173408 - DNA, 12 bp, Unknown
  misc_feature (1)..( 12): Result.005 file - promoters50/1450770
ttggaaaagtga

SEQ ID NO: 173409 - DNA, 12 bp, Unknown
  misc_feature (1)..( 12): Result.005 file - promoters50/1450770
attttaaaatga

SEQ ID NO: 173410 - DNA, 12 bp, Unknown
  misc_feature (1)..( 12): Result.005 file - promoters50/1450770
ttttgaaattct

SEQ ID NO: 173411 - DNA, 9 bp, Unknown
  misc_feature (1)..( 9): Result.005 file - promoters50/1450770
aaaaaaagc

SEQ ID NO: 173412 - DNA, 9 bp, Unknown
  misc_feature (1)..( 9): Result.005 file - promoters50/1450770
tataaaagc

SEQ ID NO: 173413 - DNA, 9 bp, Unknown
  misc_feature (1)..( 9): Result.005 file - promoters50/1450770
tatataaga

SEQ ID NO: 173414 - DNA, 7 bp, Unknown
  misc_feature (1)..( 7): Result.005 file - promoters50/1450785
aaaccaa

SEQ ID NO: 173415 - DNA, 7 bp, Unknown
  misc_feature (1)..( 7): Result.005 file - promoters50/1450785
aaaacaa

SEQ ID NO: 173416 - DNA, 7 bp, Unknown
  misc_feature (1)..( 7): Result.005 file - promoters50/1450785
aaaccac

SEQ ID NO: 173417 - DNA, 8 bp, Unknown
  misc_feature (1)..( 8): Result.005 file - promoters50/1450785
cttcacca

SEQ ID NO: 173418 - DNA, 8 bp, Unknown
  misc_feature (1)..( 8): Result.005 file - promoters50/1450785
cttcacac

SEQ ID NO: 173419 - DNA, 8 bp, Unknown
  misc_feature (1)..( 8): Result.005 file - promoters50/1450785
attcatca

SEQ ID NO: 173420 - DNA, 9 bp, Unknown
  misc_feature (1)..( 9): Result.005 file - promoters50/1450785
gcttgagcc

SEQ ID NO: 173421 - DNA, 9 bp, Unknown
  misc_feature (1)..( 9): Result.005 file - promoters50/1450785
tcttaagct

SEQ ID NO: 173422 - DNA, 9 bp, Unknown
  misc_feature (1)..( 9): Result.005 file - promoters50/1450785
gattaagct

SEQ ID NO: 173423 - DNA, 9 bp, Unknown
  misc_feature (1)..( 9): Result.005 file - promoters50/1450785
gataaaggg

SEQ ID NO: 173424 - DNA, 8 bp, Unknown
  misc_feature (1)..( 8): Result.005 file - promoters50/1450785
tttctttt

SEQ ID NO: 173425 - DNA, 8 bp, Unknown
  misc_feature (1)..( 8): Result.005 file - promoters50/1450785
tttctttt

SEQ ID NO: 173426 - DNA, 8 bp, Unknown
  misc_feature (1)..( 8): Result.005 file - promoters50/1450785
ttccttta

SEQ ID NO: 173427 - DNA, 10 bp, Unknown
  misc_feature (1)..( 10): Result.005 file - promoters50/1450785
tctcaaaaca

SEQ ID NO: 173428 - DNA, 10 bp, Unknown
  misc_feature (1)..( 10): Result.005 file - promoters50/1450785
tctgaaaata

SEQ ID NO: 173429 - DNA, 10 bp, Unknown
  misc_feature (1)..( 10): Result.005 file - promoters50/1450785
gaccaataca

SEQ ID NO: 173430 - DNA, 8 bp, Unknown
  misc_feature (1)..( 8): Result.005 file - promoters50/1450785
ttgttaaa

SEQ ID NO: 173431 - DNA, 8 bp, Unknown
  misc_feature (1)..( 8): Result.005 file - promoters50/1450785
atgtaaaa

SEQ ID NO: 173432 - DNA, 8 bp, Unknown
  misc_feature (1)..( 8): Result.005 file - promoters50/1450785
atggaaac

SEQ ID NO: 173433 - DNA, 9 bp, Unknown
  misc_feature (1)..( 9): Result.005 file - promoters50/1450785
ttaaacaat

SEQ ID NO: 173434 - DNA, 9 bp, Unknown
  misc_feature (1)..( 9): Result.005 file - promoters50/1450785
ttaatcaat

SEQ ID NO: 173435 - DNA, 9 bp, Unknown
  misc_feature (1)..( 9): Result.005 file - promoters50/1450785
ttattcatg

SEQ ID NO: 173436 - DNA, 16 bp, Unknown
  misc_feature (1)..( 16): Result.005 file - promoters50/1450785
caacaacacaagaaga

SEQ ID NO: 173437 - DNA, 16 bp, Unknown
  misc_feature (1)..( 16): Result.005 file - promoters50/1450785
caaaaactcaagattt

SEQ ID NO: 173438 - DNA, 16 bp, Unknown
  misc_feature (1)..( 16): Result.005 file - promoters50/1450785
agagctctcaaggttt

SEQ ID NO: 173439 - DNA, 14 bp, Unknown
  misc_feature (1)..( 14): Result.005 file - promoters50/1450792
aaatctctaaaaaa

SEQ ID NO: 173440 - DNA, 14 bp, Unknown
  misc_feature (1)..( 14): Result.005 file - promoters50/1450792
ttagcactataaaa

SEQ ID NO: 173441 - DNA, 14 bp, Unknown
  misc_feature (1)..( 14): Result.005 file - promoters50/1450792
attccaaaataaaa

SEQ ID NO: 173442 - DNA, 14 bp, Unknown
  misc_feature (1)..( 14): Result.005 file - promoters50/1450792
aaatccctaaaacc

SEQ ID NO: 173443 - DNA, 14 bp, Unknown
  misc_feature (1)..( 14): Result.005 file - promoters50/1450792
aaatagaaagaaaa

SEQ ID NO: 173444 - DNA, 15 bp, Unknown
  misc_feature (1)..( 15): Result.005 file - promoters50/1450792
gagttccaaaacaaa

SEQ ID NO: 173445 - DNA, 15 bp, Unknown
  misc_feature (1)..( 15): Result.005 file - promoters50/1450792
ttcgagttataaaga

SEQ ID NO: 173446 - DNA, 8 bp, Unknown
  misc_feature (1)..( 8): Result.005 file - promoters50/1450834
aaagaaaa

SEQ ID NO: 173447 - DNA, 8 bp, Unknown
  misc_feature (1)..( 8): Result.005 file - promoters50/1450834
taagtaaa

SEQ ID NO: 173448 - DNA, 8 bp, Unknown
  misc_feature (1)..( 8): Result.005 file - promoters50/1450834
taaataat

SEQ ID NO: 173449 - DNA, 8 bp, Unknown
  misc_feature (1)..( 8): Result.005 file - promoters50/1450834
tttaattg

SEQ ID NO: 173450 - DNA, 8 bp, Unknown
  misc_feature (1)..( 8): Result.005 file - promoters50/1450834
ttttatta

SEQ ID NO: 173451 - DNA, 8 bp, Unknown
  misc_feature (1)..( 8): Result.005 file - promoters50/1450834
gtttatta

SEQ ID NO: 173452 - DNA, 10 bp, Unknown
  misc_feature (1)..( 10): Result.005 file - promoters50/1450834
agaactttct

SEQ ID NO: 173453 - DNA, 10 bp, Unknown
  misc_feature (1)..( 10): Result.005 file - promoters50/1450834
caaacattct

SEQ ID NO: 173454 - DNA, 10 bp, Unknown
  misc_feature (1)..( 10): Result.005 file - promoters50/1450834
agatcttata

SEQ ID NO: 173455 - DNA, 11 bp, Unknown
  misc_feature (1)..( 11): Result.005 file - promoters50/1450834
tttgtttgatt

SEQ ID NO: 173456 - DNA, 11 bp, Unknown
  misc_feature (1)..( 11): Result.005 file - promoters50/1450834
tttgtatgatt

SEQ ID NO: 173457 - DNA, 11 bp, Unknown
  misc_feature (1)..( 11): Result.005 file - promoters50/1450834
cgaatttgatt

SEQ ID NO: 173458 - DNA, 9 bp, Unknown
  misc_feature (1)..( 9): Result.005 file - promoters50/1455879
agtatataa

SEQ ID NO: 173459 - DNA, 9 bp, Unknown
  misc_feature (1)..( 9): Result.005 file - promoters50/1455879
tgtatatat

SEQ ID NO: 173460 - DNA, 9 bp, Unknown
  misc_feature (1)..( 9): Result.005 file - promoters50/1455879
catatatac

SEQ ID NO: 173461 - DNA, 9 bp, Unknown
  misc_feature (1)..( 9): Result.005 file - promoters50/1455879
catatttac

SEQ ID NO: 173462 - DNA, 11 bp, Unknown
  misc_feature (1)..( 11): Result.005 file - promoters50/1455908
tttcatacaac

SEQ ID NO: 173463 - DNA, 11 bp, Unknown
  misc_feature (1)..( 11): Result.005 file - promoters50/1455908
tttaataattt

SEQ ID NO: 173464 - DNA, 11 bp, Unknown
  misc_feature (1)..( 11): Result.005 file - promoters50/1455908
ggtaataatgt

SEQ ID NO: 173465 - DNA, 11 bp, Unknown
  misc_feature (1)..( 11): Result.005 file - promoters50/1455908
cttaatagatg

SEQ ID NO: 173466 - DNA, 11 bp, Unknown
  misc_feature (1)..( 11): Result.005 file - promoters50/1455908
atgaatcatgt

SEQ ID NO: 173467 - DNA, 11 bp, Unknown
  misc_feature (1)..( 11): Result.005 file - promoters50/1455908
cttatttgttc

SEQ ID NO: 173468 - DNA, 11 bp, Unknown
  misc_feature (1)..( 11): Result.005 file - promoters50/1455908
aatatttgtaa

SEQ ID NO: 173469 - DNA, 11 bp, Unknown
  misc_feature (1)..( 11): Result.005 file - promoters50/1455908
tggatttattc

SEQ ID NO: 173470 - DNA, 11 bp, Unknown
  misc_feature (1)..( 11): Result.005 file - promoters50/1455908
tggatttaaca

SEQ ID NO: 173471 - DNA, 11 bp, Unknown
  misc_feature (1)..( 11): Result.005 file - promoters50/1455908
ttaattgaact

SEQ ID NO: 173472 - DNA, 10 bp, Unknown
  misc_feature (1)..( 10): Result.005 file - promoters50/1455908
tatatttaaa

SEQ ID NO: 173473 - DNA, 10 bp, Unknown
  misc_feature (1)..( 10): Result.005 file - promoters50/1455908
aatgtttaaa

SEQ ID NO: 173474 - DNA, 10 bp, Unknown
  misc_feature (1)..( 10): Result.005 file - promoters50/1455908
tggatttaac

SEQ ID NO: 173475 - DNA, 10 bp, Unknown
  misc_feature (1)..( 10): Result.005 file - promoters50/1455908
tggatttatt

SEQ ID NO: 173476 - DNA, 7 bp, Unknown
  misc_feature (1)..( 7): Result.005 file - promoters50/1455912
aaagaat

SEQ ID NO: 173477 - DNA, 7 bp, Unknown
  misc_feature (1)..( 7): Result.005 file - promoters50/1455912
aaacaat

SEQ ID NO: 173478 - DNA, 7 bp, Unknown
  misc_feature (1)..( 7): Result.005 file - promoters50/1455912
aaacaaa

SEQ ID NO: 173479 - DNA, 7 bp, Unknown
  misc_feature (1)..( 7): Result.005 file - promoters50/1455912
ttggtta

SEQ ID NO: 173480 - DNA, 7 bp, Unknown
  misc_feature (1)..( 7): Result.005 file - promoters50/1455912
ttggtta

SEQ ID NO: 173481 - DNA, 7 bp, Unknown
  misc_feature (1)..( 7): Result.005 file - promoters50/1455912
ttgctta

SEQ ID NO: 173482 - DNA, 8 bp, Unknown
  misc_feature (1)..( 8): Result.005 file - promoters50/1455916
cattttga

SEQ ID NO: 173483 - DNA, 8 bp, Unknown
  misc_feature (1)..( 8): Result.005 file - promoters50/1455916
catttttt

SEQ ID NO: 173484 - DNA, 9 bp, Unknown
  misc_feature (1)..( 9): Result.005 file - promoters50/1455916
aattgtttt

SEQ ID NO: 173485 - DNA, 11 bp, Unknown
  misc_feature (1)..( 11): Result.005 file - promoters50/1455916
atacattataa

SEQ ID NO: 173486 - DNA, 11 bp, Unknown
  misc_feature (1)..( 11): Result.005 file - promoters50/1455916
tttttttataa

SEQ ID NO: 173487 - DNA, 11 bp, Unknown
  misc_feature (1)..( 11): Result.005 file - promoters50/1455916
tttatttatac

SEQ ID NO: 173488 - DNA, 8 bp, Unknown
  misc_feature (1)..( 8): Result.005 file - promoters50/1455916
ctcttaga

SEQ ID NO: 173489 - DNA, 8 bp, Unknown
  misc_feature (1)..( 8): Result.005 file - promoters50/1455916
ctcttaaa

SEQ ID NO: 173490 - DNA, 8 bp, Unknown
  misc_feature (1)..( 8): Result.005 file - promoters50/1455916
gtctaaaa

SEQ ID NO: 173491 - DNA, 8 bp, Unknown
  misc_feature (1)..( 8): Result.005 file - promoters50/1455928
atgtattt

SEQ ID NO: 173492 - DNA, 8 bp, Unknown
  misc_feature (1)..( 8): Result.005 file - promoters50/1455928
ctgtgttt

SEQ ID NO: 173493 - DNA, 8 bp, Unknown
  misc_feature (1)..( 8): Result.005 file - promoters50/1455928
atgtcttt

SEQ ID NO: 173494 - DNA, 8 bp, Unknown
  misc_feature (1)..( 8): Result.005 file - promoters50/1455928
aggtattt

SEQ ID NO: 173495 - DNA, 14 bp, Unknown
  misc_feature (1)..( 14): Result.005 file - promoters50/1455928
aattagtaaaaaac

SEQ ID NO: 173496 - DNA, 14 bp, Unknown
  misc_feature (1)..( 14): Result.005 file - promoters50/1455928
tttatccaaaaaac

SEQ ID NO: 173497 - DNA, 14 bp, Unknown
  misc_feature (1)..( 14): Result.005 file - promoters50/1455928
aattaataaaaact

SEQ ID NO: 173498 - DNA, 14 bp, Unknown
  misc_feature (1)..( 14): Result.005 file - promoters50/1455928
taacaatataaatg

SEQ ID NO: 173499 - DNA, 9 bp, Unknown
  misc_feature (1)..( 9): Result.005 file - promoters50/1455932
taataaagt

SEQ ID NO: 173500 - DNA, 9 bp, Unknown
  misc_feature (1)..( 9): Result.005 file - promoters50/1455932
caatatagt

SEQ ID NO: 173501 - DNA, 9 bp, Unknown
  misc_feature (1)..( 9): Result.005 file - promoters50/1455932
taaaaaaga

SEQ ID NO: 173502 - DNA, 8 bp, Unknown
  misc_feature (1)..( 8): Result.005 file - promoters50/1455932
atttgtat

SEQ ID NO: 173503 - DNA, 8 bp, Unknown
  misc_feature (1)..( 8): Result.005 file - promoters50/1455932
attggtag

SEQ ID NO: 173504 - DNA, 8 bp, Unknown
  misc_feature (1)..( 8): Result.005 file - promoters50/1455932
atttttat

SEQ ID NO: 173505 - DNA, 9 bp, Unknown
  misc_feature (1)..( 9): Result.005 file - promoters50/1455932
atgtctttg

SEQ ID NO: 173506 - DNA, 9 bp, Unknown
  misc_feature (1)..( 9): Result.005 file - promoters50/1455932
atgtttttg

SEQ ID NO: 173507 - DNA, 9 bp, Unknown
  misc_feature (1)..( 9): Result.005 file - promoters50/1455932
tggtttttc

SEQ ID NO: 173508 - DNA, 8 bp, Unknown
  misc_feature (1)..( 8): Result.005 file - promoters50/1455932
aaaaacaa

SEQ ID NO: 173509 - DNA, 8 bp, Unknown
  misc_feature (1)..( 8): Result.005 file - promoters50/1455932
aaaaactt

SEQ ID NO: 173510 - DNA, 8 bp, Unknown
  misc_feature (1)..( 8): Result.005 file - promoters50/1455932
taaatcaa

SEQ ID NO: 173511 - DNA, 11 bp, Unknown
  misc_feature (1)..( 11): Result.005 file - promoters50/1455932
ccttttattta

SEQ ID NO: 173512 - DNA, 11 bp, Unknown
  misc_feature (1)..( 11): Result.005 file - promoters50/1455932
ccttttgtttt

SEQ ID NO: 173513 - DNA, 11 bp, Unknown
  misc_feature (1)..( 11): Result.005 file - promoters50/1455932
ggatatgtttt

SEQ ID NO: 173514 - DNA, 11 bp, Unknown
  misc_feature (1)..( 11): Result.005 file - promoters50/1455932
aagcctttgaa

SEQ ID NO: 173515 - DNA, 11 bp, Unknown
  misc_feature (1)..( 11): Result.005 file - promoters50/1455932
aagcttttctt

SEQ ID NO: 173516 - DNA, 11 bp, Unknown
  misc_feature (1)..( 11): Result.005 file - promoters50/1455932
tttcttctctt

SEQ ID NO: 173517 - DNA, 7 bp, Unknown
  misc_feature (1)..( 7): Result.005 file - promoters50/1455936
ttagtta

SEQ ID NO: 173518 - DNA, 7 bp, Unknown
  misc_feature (1)..( 7): Result.005 file - promoters50/1455936
ttagttt

SEQ ID NO: 173519 - DNA, 7 bp, Unknown
  misc_feature (1)..( 7): Result.005 file - promoters50/1455936
ttaatta

SEQ ID NO: 173520 - DNA, 9 bp, Unknown
  misc_feature (1)..( 9): Result.005 file - promoters50/1455936
aaaagctaa

SEQ ID NO: 173521 - DNA, 9 bp, Unknown
  misc_feature (1)..( 9): Result.005 file - promoters50/1455936
aaatgctct

SEQ ID NO: 173522 - DNA, 9 bp, Unknown
  misc_feature (1)..( 9): Result.005 file - promoters50/1455936
aaaagctaa

SEQ ID NO: 173523 - DNA, 7 bp, Unknown
  misc_feature (1)..( 7): Result.005 file - promoters50/1455936
aatttaa

SEQ ID NO: 173524 - DNA, 7 bp, Unknown
  misc_feature (1)..( 7): Result.005 file - promoters50/1455936
aatttag

SEQ ID NO: 173525 - DNA, 7 bp, Unknown
  misc_feature (1)..( 7): Result.005 file - promoters50/1455936
gatttag

SEQ ID NO: 173526 - DNA, 8 bp, Unknown
  misc_feature (1)..( 8): Result.005 file - promoters50/1455936
aaaaatac

SEQ ID NO: 173527 - DNA, 8 bp, Unknown
  misc_feature (1)..( 8): Result.005 file - promoters50/1455936
aaaaataa

SEQ ID NO: 173528 - DNA, 9 bp, Unknown
  misc_feature (1)..( 9): Result.005 file - promoters50/1455936
aaacaataa

SEQ ID NO: 173529 - DNA, 8 bp, Unknown
  misc_feature (1)..( 8): Result.005 file - promoters50/1455936
aatataaa

SEQ ID NO: 173530 - DNA, 8 bp, Unknown
  misc_feature (1)..( 8): Result.005 file - promoters50/1455936
aatctaaa

SEQ ID NO: 173531 - DNA, 8 bp, Unknown
  misc_feature (1)..( 8): Result.005 file - promoters50/1455936
catataat

SEQ ID NO: 173532 - DNA, 8 bp, Unknown
  misc_feature (1)..( 8): Result.005 file - promoters50/1455936
atgaaaag

SEQ ID NO: 173533 - DNA, 8 bp, Unknown
  misc_feature (1)..( 8): Result.005 file - promoters50/1455936
atgaaaag

SEQ ID NO: 173534 - DNA, 8 bp, Unknown
  misc_feature (1)..( 8): Result.005 file - promoters50/1455936
ctgaaaat

SEQ ID NO: 173535 - DNA, 11 bp, Unknown
  misc_feature (1)..( 11): Result.005 file - promoters50/1455944
tgctaaaattg

SEQ ID NO: 173536 - DNA, 11 bp, Unknown
  misc_feature (1)..( 11): Result.005 file - promoters50/1455944
acgtaagattg

SEQ ID NO: 173537 - DNA, 11 bp, Unknown
  misc_feature (1)..( 11): Result.005 file - promoters50/1455944
aaataaaatgt

SEQ ID NO: 173538 - DNA, 11 bp, Unknown
  misc_feature (1)..( 11): Result.005 file - promoters50/1455944
aaagaaaacat

SEQ ID NO: 173539 - DNA, 11 bp, Unknown
  misc_feature (1)..( 11): Result.005 file - promoters50/1455944
atgtaatatgt

SEQ ID NO: 173540 - DNA, 12 bp, Unknown
  misc_feature (1)..( 12): Result.005 file - promoters50/1455944
aaaagaaaacaa

SEQ ID NO: 173541 - DNA, 12 bp, Unknown
  misc_feature (1)..( 12): Result.005 file - promoters50/1455944
taaataaagctt

SEQ ID NO: 173542 - DNA, 12 bp, Unknown
  misc_feature (1)..( 12): Result.005 file - promoters50/1455944
aaaatagattga

SEQ ID NO: 173543 - DNA, 12 bp, Unknown
  misc_feature (1)..( 12): Result.005 file - promoters50/1455944
taaagagataca

SEQ ID NO: 173544 - DNA, 12 bp, Unknown
  misc_feature (1)..( 12): Result.005 file - promoters50/1455944
acaataaagtag

SEQ ID NO: 173545 - DNA, 11 bp, Unknown
  misc_feature (1)..( 11): Result.005 file - promoters50/1455944
ttatttaaaca

SEQ ID NO: 173546 - DNA, 11 bp, Unknown
  misc_feature (1)..( 11): Result.005 file - promoters50/1455944
ctatataaacc

SEQ ID NO: 173547 - DNA, 11 bp, Unknown
  misc_feature (1)..( 11): Result.005 file - promoters50/1455944
ctatataatag

SEQ ID NO: 173548 - DNA, 11 bp, Unknown
  misc_feature (1)..( 11): Result.005 file - promoters50/1455944
gtatatatacc

SEQ ID NO: 173549 - DNA, 11 bp, Unknown
  misc_feature (1)..( 11): Result.005 file - promoters50/1455944
ctaaataaata

SEQ ID NO: 173550 - DNA, 9 bp, Unknown
  misc_feature (1)..( 9): Result.005 file - promoters50/1455948
tttcttgaa

SEQ ID NO: 173551 - DNA, 9 bp, Unknown
  misc_feature (1)..( 9): Result.005 file - promoters50/1455948
tttattgat

SEQ ID NO: 173552 - DNA, 9 bp, Unknown
  misc_feature (1)..( 9): Result.005 file - promoters50/1455948
ggtctagaa

SEQ ID NO: 173553 - DNA, 9 bp, Unknown
  misc_feature (1)..( 9): Result.005 file - promoters50/1455948
caaaacaaa

SEQ ID NO: 173554 - DNA, 9 bp, Unknown
  misc_feature (1)..( 9): Result.005 file - promoters50/1455948
aaaagcaaa

SEQ ID NO: 173555 - DNA, 9 bp, Unknown
  misc_feature (1)..( 9): Result.005 file - promoters50/1455948
caaaactcc

SEQ ID NO: 173556 - DNA, 8 bp, Unknown
  misc_feature (1)..( 8): Result.005 file - promoters50/1455948
tcaaaaaa

SEQ ID NO: 173557 - DNA, 8 bp, Unknown
  misc_feature (1)..( 8): Result.005 file - promoters50/1455948
ataaaaaa

SEQ ID NO: 173558 - DNA, 8 bp, Unknown
  misc_feature (1)..( 8): Result.005 file - promoters50/1455948
tcacaaag

SEQ ID NO: 173559 - DNA, 11 bp, Unknown
  misc_feature (1)..( 11): Result.005 file - promoters50/1455956
taaatttgtta

SEQ ID NO: 173560 - DNA, 11 bp, Unknown
  misc_feature (1)..( 11): Result.005 file - promoters50/1455956
taattttttca

SEQ ID NO: 173561 - DNA, 11 bp, Unknown
  misc_feature (1)..( 11): Result.005 file - promoters50/1455956
caaattttttt

SEQ ID NO: 173562 - DNA, 11 bp, Unknown
  misc_feature (1)..( 11): Result.005 file - promoters50/1455956
aagattcattg

SEQ ID NO: 173563 - DNA, 11 bp, Unknown
  misc_feature (1)..( 11): Result.005 file - promoters50/1455956
ttaattgtctc

SEQ ID NO: 173564 - DNA, 11 bp, Unknown
  misc_feature (1)..( 11): Result.005 file - promoters50/1455956
gatatttattt

SEQ ID NO: 173565 - DNA, 12 bp, Unknown
  misc_feature (1)..( 12): Result.005 file - promoters50/1455972
cacaaacataac

SEQ ID NO: 173566 - DNA, 12 bp, Unknown
  misc_feature (1)..( 12): Result.005 file - promoters50/1455972
ttcaaatatatt

SEQ ID NO: 173567 - DNA, 12 bp, Unknown
  misc_feature (1)..( 12): Result.005 file - promoters50/1455972
agtaaaaatatc

SEQ ID NO: 173568 - DNA, 12 bp, Unknown
  misc_feature (1)..( 12): Result.005 file - promoters50/1455972
aacaatcatcca

SEQ ID NO: 173569 - DNA, 12 bp, Unknown
  misc_feature (1)..( 12): Result.005 file - promoters50/1455972
gacagacagaaa

SEQ ID NO: 173570 - DNA, 12 bp, Unknown
  misc_feature (1)..( 12): Result.005 file - promoters50/1455972
ttcagataaaac

SEQ ID NO: 173571 - DNA, 12 bp, Unknown
  misc_feature (1)..( 12): Result.005 file - promoters50/1455972
aaaccatatatt

SEQ ID NO: 173572 - DNA, 16 bp, Unknown
  misc_feature (1)..( 16): Result.005 file - promoters50/1455972
aggttaatcacaatgc

SEQ ID NO: 173573 - DNA, 16 bp, Unknown
  misc_feature (1)..( 16): Result.005 file - promoters50/1455972
aatattttcaaaatca

SEQ ID NO: 173574 - DNA, 16 bp, Unknown
  misc_feature (1)..( 16): Result.005 file - promoters50/1455972
aataattttaaaaaag

SEQ ID NO: 173575 - DNA, 16 bp, Unknown
  misc_feature (1)..( 16): Result.005 file - promoters50/1455972
caaataagcaaaaatg

SEQ ID NO: 173576 - DNA, 16 bp, Unknown
  misc_feature (1)..( 16): Result.005 file - promoters50/1455972
tagggtttcgaaatct

SEQ ID NO: 173577 - DNA, 17 bp, Unknown
  misc_feature (1)..( 17): Result.005 file - promoters50/1455972
aggacagtcaaatatga

SEQ ID NO: 173578 - DNA, 11 bp, Unknown
  misc_feature (1)..( 11): Result.005 file - promoters50/1456000
aacaaaacaaa

SEQ ID NO: 173579 - DNA, 11 bp, Unknown
  misc_feature (1)..( 11): Result.005 file - promoters50/1456000
aacaaaacaaa

SEQ ID NO: 173580 - DNA, 12 bp, Unknown
  misc_feature (1)..( 12): Result.005 file - promoters50/1456000
gacataaattca

SEQ ID NO: 173581 - DNA, 12 bp, Unknown
  misc_feature (1)..( 12): Result.005 file - promoters50/1456000
tacaaaaacatt

SEQ ID NO: 173582 - DNA, 12 bp, Unknown
  misc_feature (1)..( 12): Result.005 file - promoters50/1456000
aaaaaaaaaaaa

SEQ ID NO: 173583 - DNA, 12 bp, Unknown
  misc_feature (1)..( 12): Result.005 file - promoters50/1456000
aaacaaaaaaaa

SEQ ID NO: 173584 - DNA, 12 bp, Unknown
  misc_feature (1)..( 12): Result.005 file - promoters50/1456000
tgacataaattc

SEQ ID NO: 173585 - DNA, 10 bp, Unknown
  misc_feature (1)..( 10): Result.005 file - promoters50/1456000
gagtaacaat

SEQ ID NO: 173586 - DNA, 10 bp, Unknown
  misc_feature (1)..( 10): Result.005 file - promoters50/1456000
gagcaacaga

SEQ ID NO: 173587 - DNA, 10 bp, Unknown
  misc_feature (1)..( 10): Result.005 file - promoters50/1456000
aaccaaaaga

SEQ ID NO: 173588 - DNA, 11 bp, Unknown
  misc_feature (1)..( 11): Result.005 file - promoters50/1456000
agaaaacaatc

SEQ ID NO: 173589 - DNA, 11 bp, Unknown
  misc_feature (1)..( 11): Result.005 file - promoters50/1456000
ataaaaaaatt

SEQ ID NO: 173590 - DNA, 11 bp, Unknown
  misc_feature (1)..( 11): Result.005 file - promoters50/1456000
tttaaaaaatc

SEQ ID NO: 173591 - DNA, 11 bp, Unknown
  misc_feature (1)..( 11): Result.005 file - promoters50/1456000
agaaaacaaaa

SEQ ID NO: 173592 - DNA, 13 bp, Unknown
  misc_feature (1)..( 13): Result.005 file - promoters50/1456000
gagtaaacacatc

SEQ ID NO: 173593 - DNA, 13 bp, Unknown
  misc_feature (1)..( 13): Result.005 file - promoters50/1456000
caaaaaaaacaaa

SEQ ID NO: 173594 - DNA, 13 bp, Unknown
  misc_feature (1)..( 13): Result.005 file - promoters50/1456000
caagaaaaaaaaa

SEQ ID NO: 173595 - DNA, 9 bp, Unknown
  misc_feature (1)..( 9): Result.005 file - promoters50/1456000
taaacaaag

SEQ ID NO: 173596 - DNA, 9 bp, Unknown
  misc_feature (1)..( 9): Result.005 file - promoters50/1456000
taaaaaaaa

SEQ ID NO: 173597 - DNA, 9 bp, Unknown
  misc_feature (1)..( 9): Result.005 file - promoters50/1456000
aaaagaaag

SEQ ID NO: 173598 - DNA, 8 bp, Unknown
  misc_feature (1)..( 8): Result.005 file - promoters50/1456000
caacagaa

SEQ ID NO: 173599 - DNA, 8 bp, Unknown
  misc_feature (1)..( 8): Result.005 file - promoters50/1456000
caaaagaa

SEQ ID NO: 173600 - DNA, 8 bp, Unknown
  misc_feature (1)..( 8): Result.005 file - promoters50/1456000
caacagat

SEQ ID NO: 173601 - DNA, 8 bp, Unknown
  misc_feature (1)..( 8): Result.005 file - promoters50/1456000
caaatatt

SEQ ID NO: 173602 - DNA, 8 bp, Unknown
  misc_feature (1)..( 8): Result.005 file - promoters50/1456000
aaaacatt

SEQ ID NO: 173603 - DNA, 8 bp, Unknown
  misc_feature (1)..( 8): Result.005 file - promoters50/1456000
aaaacaaa

SEQ ID NO: 173604 - DNA, 9 bp, Unknown
  misc_feature (1)..( 9): Result.005 file - promoters50/1456000
aaaatcatg

SEQ ID NO: 173605 - DNA, 9 bp, Unknown
  misc_feature (1)..( 9): Result.005 file - promoters50/1456000
ccaaaatta

SEQ ID NO: 173606 - DNA, 9 bp, Unknown
  misc_feature (1)..( 9): Result.005 file - promoters50/1456000
ccaaaaaag

SEQ ID NO: 173607 - DNA, 9 bp, Unknown
  misc_feature (1)..( 9): Result.005 file - promoters50/1456000
ccaaattta

SEQ ID NO: 173608 - DNA, 9 bp, Unknown
  misc_feature (1)..( 9): Result.005 file - promoters50/1456064
tacttaaaa

SEQ ID NO: 173609 - DNA, 9 bp, Unknown
  misc_feature (1)..( 9): Result.005 file - promoters50/1456064
agcttcaaa

SEQ ID NO: 173610 - DNA, 9 bp, Unknown
  misc_feature (1)..( 9): Result.005 file - promoters50/1456064
tttttaaaa

SEQ ID NO: 173611 - DNA, 9 bp, Unknown
  misc_feature (1)..( 9): Result.005 file - promoters50/1456064
tttttaaac

SEQ ID NO: 173612 - DNA, 8 bp, Unknown
  misc_feature (1)..( 8): Result.005 file - promoters50/1456064
gaaccttt

SEQ ID NO: 173613 - DNA, 8 bp, Unknown
  misc_feature (1)..( 8): Result.005 file - promoters50/1456064
aaactttt

SEQ ID NO: 173614 - DNA, 8 bp, Unknown
  misc_feature (1)..( 8): Result.005 file - promoters50/1456064
gaacctgc

SEQ ID NO: 173615 - DNA, 8 bp, Unknown
  misc_feature (1)..( 8): Result.005 file - promoters50/1456083
tatatata

SEQ ID NO: 173616 - DNA, 8 bp, Unknown
  misc_feature (1)..( 8): Result.005 file - promoters50/1456083
tatatatt

SEQ ID NO: 173617 - DNA, 8 bp, Unknown
  misc_feature (1)..( 8): Result.005 file - promoters50/1456083
tatatata

SEQ ID NO: 173618 - DNA, 8 bp, Unknown
  misc_feature (1)..( 8): Result.005 file - promoters50/1456083
tatataaa

SEQ ID NO: 173619 - DNA, 8 bp, Unknown
  misc_feature (1)..( 8): Result.005 file - promoters50/1456083
tatttata

SEQ ID NO: 173620 - DNA, 8 bp, Unknown
  misc_feature (1)..( 8): Result.005 file - promoters50/1456083
tttaaatt

SEQ ID NO: 173621 - DNA, 10 bp, Unknown
  misc_feature (1)..( 10): Result.005 file - promoters50/1456128
gttttttttt

SEQ ID NO: 173622 - DNA, 10 bp, Unknown
  misc_feature (1)..( 10): Result.005 file - promoters50/1456128
atttatttgt

SEQ ID NO: 173623 - DNA, 10 bp, Unknown
  misc_feature (1)..( 10): Result.005 file - promoters50/1456128
ttttattctc

SEQ ID NO: 173624 - DNA, 9 bp, Unknown
  misc_feature (1)..( 9): Result.005 file - promoters50/1456128
tttattaaa

SEQ ID NO: 173625 - DNA, 9 bp, Unknown
  misc_feature (1)..( 9): Result.005 file - promoters50/1456128
tgtatcaaa

SEQ ID NO: 173626 - DNA, 9 bp, Unknown
  misc_feature (1)..( 9): Result.005 file - promoters50/1456128
tttaataaa

SEQ ID NO: 173627 - DNA, 7 bp, Unknown
  misc_feature (1)..( 7): Result.005 file - promoters50/1456128
agaaaaa

SEQ ID NO: 173628 - DNA, 7 bp, Unknown
  misc_feature (1)..( 7): Result.005 file - promoters50/1456128
agaaaaa

SEQ ID NO: 173629 - DNA, 7 bp, Unknown
  misc_feature (1)..( 7): Result.005 file - promoters50/1456128
agaaaat

SEQ ID NO: 173630 - DNA, 8 bp, Unknown
  misc_feature (1)..( 8): Result.005 file - promoters50/1456128
aaaaaaaa

SEQ ID NO: 173631 - DNA, 8 bp, Unknown
  misc_feature (1)..( 8): Result.005 file - promoters50/1456128
gaaaaaaa

SEQ ID NO: 173632 - DNA, 8 bp, Unknown
  misc_feature (1)..( 8): Result.005 file - promoters50/1456128
gaataaat

SEQ ID NO: 173633 - DNA, 11 bp, Unknown
  misc_feature (1)..( 11): Result.005 file - promoters50/1456131
tttcatcaata

SEQ ID NO: 173634 - DNA, 11 bp, Unknown
  misc_feature (1)..( 11): Result.005 file - promoters50/1456131
cctcaacaaat

SEQ ID NO: 173635 - DNA, 11 bp, Unknown
  misc_feature (1)..( 11): Result.005 file - promoters50/1456131
ttttatcaata

SEQ ID NO: 173636 - DNA, 14 bp, Unknown
  misc_feature (1)..( 14): Result.005 file - promoters50/1456131
ctacaacaattatc

SEQ ID NO: 173637 - DNA, 14 bp, Unknown
  misc_feature (1)..( 14): Result.005 file - promoters50/1456131
agagaaccattggg

SEQ ID NO: 173638 - DNA, 14 bp, Unknown
  misc_feature (1)..( 14): Result.005 file - promoters50/1456131
caaaatcaatgatc

SEQ ID NO: 173639 - DNA, 14 bp, Unknown
  misc_feature (1)..( 14): Result.005 file - promoters50/1456131
caaaagcaatgtcc

SEQ ID NO: 173640 - DNA, 10 bp, Unknown
  misc_feature (1)..( 10): Result.005 file - promoters50/1456228
aaagaaaacc

SEQ ID NO: 173641 - DNA, 10 bp, Unknown
  misc_feature (1)..( 10): Result.005 file - promoters50/1456228
ttggaaaacc

SEQ ID NO: 173642 - DNA, 10 bp, Unknown
  misc_feature (1)..( 10): Result.005 file - promoters50/1456228
aaagaaaaaa

SEQ ID NO: 173643 - DNA, 8 bp, Unknown
  misc_feature (1)..( 8): Result.005 file - promoters50/1456228
tatttaaa

SEQ ID NO: 173644 - DNA, 8 bp, Unknown
  misc_feature (1)..( 8): Result.005 file - promoters50/1456228
tatataaa

SEQ ID NO: 173645 - DNA, 8 bp, Unknown
  misc_feature (1)..( 8): Result.005 file - promoters50/1456228
tatttatt

SEQ ID NO: 173646 - DNA, 10 bp, Unknown
  misc_feature (1)..( 10): Result.005 file - promoters50/1456228
aaatatgaat

SEQ ID NO: 173647 - DNA, 10 bp, Unknown
  misc_feature (1)..( 10): Result.005 file - promoters50/1456228
aaatatctta

SEQ ID NO: 173648 - DNA, 10 bp, Unknown
  misc_feature (1)..( 10): Result.005 file - promoters50/1456228
aaataaaata

SEQ ID NO: 173649 - DNA, 8 bp, Unknown
  misc_feature (1)..( 8): Result.005 file - promoters50/1456239
tacacaca

SEQ ID NO: 173650 - DNA, 8 bp, Unknown
  misc_feature (1)..( 8): Result.005 file - promoters50/1456239
tacacaaa

SEQ ID NO: 173651 - DNA, 8 bp, Unknown
  misc_feature (1)..( 8): Result.005 file - promoters50/1456239
cacaaaaa

SEQ ID NO: 173652 - DNA, 8 bp, Unknown
  misc_feature (1)..( 8): Result.005 file - promoters50/1456622
aaatattt

SEQ ID NO: 173653 - DNA, 8 bp, Unknown
  misc_feature (1)..( 8): Result.005 file - promoters50/1456622
taattttt

SEQ ID NO: 173654 - DNA, 8 bp, Unknown
  misc_feature (1)..( 8): Result.005 file - promoters50/1456622
aaatatag

SEQ ID NO: 173655 - DNA, 10 bp, Unknown
  misc_feature (1)..( 10): Result.005 file - promoters50/1456622
tataattatt

SEQ ID NO: 173656 - DNA, 10 bp, Unknown
  misc_feature (1)..( 10): Result.005 file - promoters50/1456622
gataattagt

SEQ ID NO: 173657 - DNA, 10 bp, Unknown
  misc_feature (1)..( 10): Result.005 file - promoters50/1456622
tattattatt

SEQ ID NO: 173658 - DNA, 11 bp, Unknown
  misc_feature (1)..( 11): Result.005 file - promoters50/1458991
agaattttttt

SEQ ID NO: 173659 - DNA, 11 bp, Unknown
  misc_feature (1)..( 11): Result.005 file - promoters50/1458991
tgaagtttttg

SEQ ID NO: 173660 - DNA, 11 bp, Unknown
  misc_feature (1)..( 11): Result.005 file - promoters50/1458991
gaggttttttt

SEQ ID NO: 173661 - DNA, 11 bp, Unknown
  misc_feature (1)..( 11): Result.005 file - promoters50/1458991
aatattttttt

SEQ ID NO: 173662 - DNA, 11 bp, Unknown
  misc_feature (1)..( 11): Result.005 file - promoters50/1458991
agactttgctt

SEQ ID NO: 173663 - DNA, 11 bp, Unknown
  misc_feature (1)..( 11): Result.005 file - promoters50/1458991
cacagttttag

SEQ ID NO: 173664 - DNA, 8 bp, Unknown
  misc_feature (1)..( 8): Result.005 file - promoters50/1459039
actataaa

SEQ ID NO: 173665 - DNA, 8 bp, Unknown
  misc_feature (1)..( 8): Result.005 file - promoters50/1459039
actataaa

SEQ ID NO: 173666 - DNA, 8 bp, Unknown
  misc_feature (1)..( 8): Result.005 file - promoters50/1459039
catataaa

SEQ ID NO: 173667 - DNA, 8 bp, Unknown
  misc_feature (1)..( 8): Result.005 file - promoters50/1459039
actataaa

SEQ ID NO: 173668 - DNA, 8 bp, Unknown
  misc_feature (1)..( 8): Result.005 file - promoters50/1459039
aatataaa

SEQ ID NO: 173669 - DNA, 8 bp, Unknown
  misc_feature (1)..( 8): Result.005 file - promoters50/1459039
tatataaa

SEQ ID NO: 173670 - DNA, 13 bp, Unknown
  misc_feature (1)..( 13): Result.005 file - promoters50/1459199
taatttatttgtg

SEQ ID NO: 173671 - DNA, 13 bp, Unknown
  misc_feature (1)..( 13): Result.005 file - promoters50/1459199
tcgtttacttgct

SEQ ID NO: 173672 - DNA, 13 bp, Unknown
  misc_feature (1)..( 13): Result.005 file - promoters50/1459199
tactttattctta

SEQ ID NO: 173673 - DNA, 13 bp, Unknown
  misc_feature (1)..( 13): Result.005 file - promoters50/1459199
acatttttttctg

SEQ ID NO: 173674 - DNA, 13 bp, Unknown
  misc_feature (1)..( 13): Result.005 file - promoters50/1459199
acatttattagtg

SEQ ID NO: 173675 - DNA, 13 bp, Unknown
  misc_feature (1)..( 13): Result.005 file - promoters50/1459199
taaattattctca

SEQ ID NO: 173676 - DNA, 12 bp, Unknown
  misc_feature (1)..( 12): Result.005 file - promoters50/1459199
ttaatatcttct

SEQ ID NO: 173677 - DNA, 12 bp, Unknown
  misc_feature (1)..( 12): Result.005 file - promoters50/1459199
tatttattttct

SEQ ID NO: 173678 - DNA, 12 bp, Unknown
  misc_feature (1)..( 12): Result.005 file - promoters50/1459199
attatattttca

SEQ ID NO: 173679 - DNA, 12 bp, Unknown
  misc_feature (1)..( 12): Result.005 file - promoters50/1459199
gttagatttttg

SEQ ID NO: 173680 - DNA, 12 bp, Unknown
  misc_feature (1)..( 12): Result.005 file - promoters50/1459199
gtttgatctttt

SEQ ID NO: 173681 - DNA, 12 bp, Unknown
  misc_feature (1)..( 12): Result.005 file - promoters50/1459199
aataggttttta

SEQ ID NO: 173682 - DNA, 12 bp, Unknown
  misc_feature (1)..( 12): Result.005 file - promoters50/1459223
attttgattaaa

SEQ ID NO: 173683 - DNA, 12 bp, Unknown
  misc_feature (1)..( 12): Result.005 file - promoters50/1459223
tttttaattatt

SEQ ID NO: 173684 - DNA, 12 bp, Unknown
  misc_feature (1)..( 12): Result.005 file - promoters50/1459223
cttttgaagttt

SEQ ID NO: 173685 - DNA, 12 bp, Unknown
  misc_feature (1)..( 12): Result.005 file - promoters50/1459223
ggtttggttacg

SEQ ID NO: 173686 - DNA, 12 bp, Unknown
  misc_feature (1)..( 12): Result.005 file - promoters50/1459223
gtgataaatatt

SEQ ID NO: 173687 - DNA, 12 bp, Unknown
  misc_feature (1)..( 12): Result.005 file - promoters50/1459223
tttttatctata

SEQ ID NO: 173688 - DNA, 17 bp, Unknown
  misc_feature (1)..( 17): Result.005 file - promoters50/1459223
taaattcaatcaaatcg

SEQ ID NO: 173689 - DNA, 17 bp, Unknown
  misc_feature (1)..( 17): Result.005 file - promoters50/1459223
attatttaatctagaaa

SEQ ID NO: 173690 - DNA, 17 bp, Unknown
  misc_feature (1)..( 17): Result.005 file - promoters50/1459223
aatattcaactatacat

SEQ ID NO: 173691 - DNA, 17 bp, Unknown
  misc_feature (1)..( 17): Result.005 file - promoters50/1459223
gatgtccaaacaaaaca

SEQ ID NO: 173692 - DNA, 17 bp, Unknown
  misc_feature (1)..( 17): Result.005 file - promoters50/1459223
ttgagtcaaagaaattc

SEQ ID NO: 173693 - DNA, 17 bp, Unknown
  misc_feature (1)..( 17): Result.005 file - promoters50/1459223
atttttttatctataaa

SEQ ID NO: 173694 - DNA, 10 bp, Unknown
  misc_feature (1)..( 10): Result.005 file - promoters50/1460386
gaaaaaattg

SEQ ID NO: 173695 - DNA, 10 bp, Unknown
  misc_feature (1)..( 10): Result.005 file - promoters50/1460386
taaacaattc

SEQ ID NO: 173696 - DNA, 10 bp, Unknown
  misc_feature (1)..( 10): Result.005 file - promoters50/1460386
gaataaatag

SEQ ID NO: 173697 - DNA, 10 bp, Unknown
  misc_feature (1)..( 10): Result.005 file - promoters50/1460386
aaaaacattg

SEQ ID NO: 173698 - DNA, 7 bp, Unknown
  misc_feature (1)..( 7): Result.005 file - promoters50/1461720
aaatata

SEQ ID NO: 173699 - DNA, 7 bp, Unknown
  misc_feature (1)..( 7): Result.005 file - promoters50/1461720
aaacata

SEQ ID NO: 173700 - DNA, 7 bp, Unknown
  misc_feature (1)..( 7): Result.005 file - promoters50/1461720
atatata

SEQ ID NO: 173701 - DNA, 10 bp, Unknown
  misc_feature (1)..( 10): Result.005 file - promoters50/1461720
atttatttga

SEQ ID NO: 173702 - DNA, 10 bp, Unknown
  misc_feature (1)..( 10): Result.005 file - promoters50/1461720
ctttatatga

SEQ ID NO: 173703 - DNA, 10 bp, Unknown
  misc_feature (1)..( 10): Result.005 file - promoters50/1461720
attaattgta

SEQ ID NO: 173704 - DNA, 10 bp, Unknown
  misc_feature (1)..( 10): Result.005 file - promoters50/1461720
tagagttatt

SEQ ID NO: 173705 - DNA, 10 bp, Unknown
  misc_feature (1)..( 10): Result.005 file - promoters50/1461720
attagtaatt

SEQ ID NO: 173706 - DNA, 10 bp, Unknown
  misc_feature (1)..( 10): Result.005 file - promoters50/1461720
attaataatt

SEQ ID NO: 173707 - DNA, 7 bp, Unknown
  misc_feature (1)..( 7): Result.005 file - promoters50/1461756
agaagaa

SEQ ID NO: 173708 - DNA, 7 bp, Unknown
  misc_feature (1)..( 7): Result.005 file - promoters50/1461756
agatgaa

SEQ ID NO: 173709 - DNA, 7 bp, Unknown
  misc_feature (1)..( 7): Result.005 file - promoters50/1461756
agaagag

SEQ ID NO: 173710 - DNA, 11 bp, Unknown
  misc_feature (1)..( 11): Result.005 file - promoters50/1461768
tgtctaagaaa

SEQ ID NO: 173711 - DNA, 11 bp, Unknown
  misc_feature (1)..( 11): Result.005 file - promoters50/1461768
tcttcaagaaa

SEQ ID NO: 173712 - DNA, 11 bp, Unknown
  misc_feature (1)..( 11): Result.005 file - promoters50/1461768
ttttcgagaat

SEQ ID NO: 173713 - DNA, 11 bp, Unknown
  misc_feature (1)..( 11): Result.005 file - promoters50/1461768
gtttcaagatg

SEQ ID NO: 173714 - DNA, 11 bp, Unknown
  misc_feature (1)..( 11): Result.005 file - promoters50/1461768
gttgcaacttg

SEQ ID NO: 173715 - DNA, 11 bp, Unknown
  misc_feature (1)..( 11): Result.005 file - promoters50/1461768
ttttcaaaatg

SEQ ID NO: 173716 - DNA, 14 bp, Unknown
  misc_feature (1)..( 14): Result.005 file - promoters50/1461768
tgtattatttcagg

SEQ ID NO: 173717 - DNA, 14 bp, Unknown
  misc_feature (1)..( 14): Result.005 file - promoters50/1461768
gatattataggaaa

SEQ ID NO: 173718 - DNA, 14 bp, Unknown
  misc_feature (1)..( 14): Result.005 file - promoters50/1461768
caaattcttttatt

SEQ ID NO: 173719 - DNA, 14 bp, Unknown
  misc_feature (1)..( 14): Result.005 file - promoters50/1461768
acgattctttaaat

SEQ ID NO: 173720 - DNA, 14 bp, Unknown
  misc_feature (1)..( 14): Result.005 file - promoters50/1461768
tgttttagttaaca

SEQ ID NO: 173721 - DNA, 14 bp, Unknown
  misc_feature (1)..( 14): Result.005 file - promoters50/1461768
aagattctcttatt

SEQ ID NO: 173722 - DNA, 12 bp, Unknown
  misc_feature (1)..( 12): Result.005 file - promoters50/1461768
gtttgagtgtat

SEQ ID NO: 173723 - DNA, 12 bp, Unknown
  misc_feature (1)..( 12): Result.005 file - promoters50/1461768
atctgactgtat

SEQ ID NO: 173724 - DNA, 12 bp, Unknown
  misc_feature (1)..( 12): Result.005 file - promoters50/1461768
atgggagtgtaa

SEQ ID NO: 173725 - DNA, 12 bp, Unknown
  misc_feature (1)..( 12): Result.005 file - promoters50/1461768
gttttagttaac

SEQ ID NO: 173726 - DNA, 12 bp, Unknown
  misc_feature (1)..( 12): Result.005 file - promoters50/1461768
cttttattttca

SEQ ID NO: 173727 - DNA, 12 bp, Unknown
  misc_feature (1)..( 12): Result.005 file - promoters50/1461768
aagttagtttag

SEQ ID NO: 173728 - DNA, 14 bp, Unknown
  misc_feature (1)..( 14): Result.005 file - promoters50/1461768
tcaagaaagtttaa

SEQ ID NO: 173729 - DNA, 14 bp, Unknown
  misc_feature (1)..( 14): Result.005 file - promoters50/1461768
tcatgaaagacatt

SEQ ID NO: 173730 - DNA, 14 bp, Unknown
  misc_feature (1)..( 14): Result.005 file - promoters50/1461768
ataagaaaatgggt

SEQ ID NO: 173731 - DNA, 14 bp, Unknown
  misc_feature (1)..( 14): Result.005 file - promoters50/1461768
atttgaaactttaa

SEQ ID NO: 173732 - DNA, 14 bp, Unknown
  misc_feature (1)..( 14): Result.005 file - promoters50/1461768
attggaaacacagc

SEQ ID NO: 173733 - DNA, 14 bp, Unknown
  misc_feature (1)..( 14): Result.005 file - promoters50/1461768
catttaattttttg

SEQ ID NO: 173734 - DNA, 14 bp, Unknown
  misc_feature (1)..( 14): Result.005 file - promoters50/1461768
gaattaaacgttac

SEQ ID NO: 173735 - DNA, 10 bp, Unknown
  misc_feature (1)..( 10): Result.005 file - promoters50/1461768
attatttcag

SEQ ID NO: 173736 - DNA, 10 bp, Unknown
  misc_feature (1)..( 10): Result.005 file - promoters50/1461768
tttattttca

SEQ ID NO: 173737 - DNA, 10 bp, Unknown
  misc_feature (1)..( 10): Result.005 file - promoters50/1461768
attctttaaa

SEQ ID NO: 173738 - DNA, 11 bp, Unknown
  misc_feature (1)..( 11): Result.005 file - promoters50/1461768
attctcttatt

SEQ ID NO: 173739 - DNA, 11 bp, Unknown
  misc_feature (1)..( 11): Result.005 file - promoters50/1461768
tttgttttagt

SEQ ID NO: 173740 - DNA, 11 bp, Unknown
  misc_feature (1)..( 11): Result.005 file - promoters50/1461768
gttagtttaga

SEQ ID NO: 173741 - DNA, 14 bp, Unknown
  misc_feature (1)..( 14): Result.005 file - promoters50/1461776
ttgtttgtttttat

SEQ ID NO: 173742 - DNA, 14 bp, Unknown
  misc_feature (1)..( 14): Result.005 file - promoters50/1461776
aacttggtttttca

SEQ ID NO: 173743 - DNA, 14 bp, Unknown
  misc_feature (1)..( 14): Result.005 file - promoters50/1461776
actttggatttatt

SEQ ID NO: 173744 - DNA, 14 bp, Unknown
  misc_feature (1)..( 14): Result.005 file - promoters50/1461776
aaccttgattaatt

SEQ ID NO: 173745 - DNA, 14 bp, Unknown
  misc_feature (1)..( 14): Result.005 file - promoters50/1461776
agataagttcttaa

SEQ ID NO: 173746 - DNA, 14 bp, Unknown
  misc_feature (1)..( 14): Result.005 file - promoters50/1461776
agatgagtttgagg

SEQ ID NO: 173747 - DNA, 14 bp, Unknown
  misc_feature (1)..( 14): Result.005 file - promoters50/1461776
cctagagattgtga

SEQ ID NO: 173748 - DNA, 11 bp, Unknown
  misc_feature (1)..( 11): Result.005 file - promoters50/1461776
catattttgct

SEQ ID NO: 173749 - DNA, 11 bp, Unknown
  misc_feature (1)..( 11): Result.005 file - promoters50/1461776
aatattttgca

SEQ ID NO: 173750 - DNA, 11 bp, Unknown
  misc_feature (1)..( 11): Result.005 file - promoters50/1461776
gatatttattt

SEQ ID NO: 173751 - DNA, 11 bp, Unknown
  misc_feature (1)..( 11): Result.005 file - promoters50/1461776
aattttttgtt

SEQ ID NO: 173752 - DNA, 11 bp, Unknown
  misc_feature (1)..( 11): Result.005 file - promoters50/1461776
ccttttttgtt

SEQ ID NO: 173753 - DNA, 11 bp, Unknown
  misc_feature (1)..( 11): Result.005 file - promoters50/1461776
agtatctatat

SEQ ID NO: 173754 - DNA, 13 bp, Unknown
  misc_feature (1)..( 13): Result.005 file - promoters50/1461776
gaatcttttatct

SEQ ID NO: 173755 - DNA, 13 bp, Unknown
  misc_feature (1)..( 13): Result.005 file - promoters50/1461776
gattaatttctct

SEQ ID NO: 173756 - DNA, 13 bp, Unknown
  misc_feature (1)..( 13): Result.005 file - promoters50/1461776
acaatttttttct

SEQ ID NO: 173757 - DNA, 13 bp, Unknown
  misc_feature (1)..( 13): Result.005 file - promoters50/1461776
agataagttctta

SEQ ID NO: 173758 - DNA, 13 bp, Unknown
  misc_feature (1)..( 13): Result.005 file - promoters50/1461776
agatgagtttgag

SEQ ID NO: 173759 - DNA, 13 bp, Unknown
  misc_feature (1)..( 13): Result.005 file - promoters50/1461776
ctagagattgtga

SEQ ID NO: 173760 - DNA, 11 bp, Unknown
  misc_feature (1)..( 11): Result.005 file - promoters50/1461780
ttttctcttcc

SEQ ID NO: 173761 - DNA, 11 bp, Unknown
  misc_feature (1)..( 11): Result.005 file - promoters50/1461780
tttactccatt

SEQ ID NO: 173762 - DNA, 11 bp, Unknown
  misc_feature (1)..( 11): Result.005 file - promoters50/1461780
aatactcaatt

SEQ ID NO: 173763 - DNA, 16 bp, Unknown
  misc_feature (1)..( 16): Result.005 file - promoters50/1461784
tatcaaataatataac

SEQ ID NO: 173764 - DNA, 16 bp, Unknown
  misc_feature (1)..( 16): Result.005 file - promoters50/1461784
catcaaataataaata

SEQ ID NO: 173765 - DNA, 16 bp, Unknown
  misc_feature (1)..( 16): Result.005 file - promoters50/1461784
ttgttaattatataca

SEQ ID NO: 173766 - DNA, 16 bp, Unknown
  misc_feature (1)..( 16): Result.005 file - promoters50/1461784
tataaaatattatata

SEQ ID NO: 173767 - DNA, 16 bp, Unknown
  misc_feature (1)..( 16): Result.005 file - promoters50/1461784
gattttataatataaa

SEQ ID NO: 173768 - DNA, 16 bp, Unknown
  misc_feature (1)..( 16): Result.005 file - promoters50/1461784
tttacggttttttaat

SEQ ID NO: 173769 - DNA, 12 bp, Unknown
  misc_feature (1)..( 12): Result.005 file - promoters50/1461784
tttaaaaaaata

SEQ ID NO: 173770 - DNA, 12 bp, Unknown
  misc_feature (1)..( 12): Result.005 file - promoters50/1461784
gataaaacaatc

SEQ ID NO: 173771 - DNA, 12 bp, Unknown
  misc_feature (1)..( 12): Result.005 file - promoters50/1461784
gtttaaactatt

SEQ ID NO: 173772 - DNA, 12 bp, Unknown
  misc_feature (1)..( 12): Result.005 file - promoters50/1461784
tttcaaataaga

SEQ ID NO: 173773 - DNA, 12 bp, Unknown
  misc_feature (1)..( 12): Result.005 file - promoters50/1461784
gttaaaatctta

SEQ ID NO: 173774 - DNA, 12 bp, Unknown
  misc_feature (1)..( 12): Result.005 file - promoters50/1461784
cataaaaatttg

SEQ ID NO: 173775 - DNA, 12 bp, Unknown
  misc_feature (1)..( 12): Result.005 file - promoters50/1461784
tttagaatttga

SEQ ID NO: 173776 - DNA, 12 bp, Unknown
  misc_feature (1)..( 12): Result.005 file - promoters50/1461784
tggagaatatga

SEQ ID NO: 173777 - DNA, 11 bp, Unknown
  misc_feature (1)..( 11): Result.005 file - promoters50/1461784
gtttaatatat

SEQ ID NO: 173778 - DNA, 11 bp, Unknown
  misc_feature (1)..( 11): Result.005 file - promoters50/1461784
cgacaatgtat

SEQ ID NO: 173779 - DNA, 11 bp, Unknown
  misc_feature (1)..( 11): Result.005 file - promoters50/1461784
ttttaatatta

SEQ ID NO: 173780 - DNA, 11 bp, Unknown
  misc_feature (1)..( 11): Result.005 file - promoters50/1461784
ttataatataa

SEQ ID NO: 173781 - DNA, 11 bp, Unknown
  misc_feature (1)..( 11): Result.005 file - promoters50/1461784
ttttaattttt

SEQ ID NO: 173782 - DNA, 11 bp, Unknown
  misc_feature (1)..( 11): Result.005 file - promoters50/1461784
ttttaaagttg

SEQ ID NO: 173783 - DNA, 13 bp, Unknown
  misc_feature (1)..( 13): Result.005 file - promoters50/1461784
ttataaaaagttt

SEQ ID NO: 173784 - DNA, 13 bp, Unknown
  misc_feature (1)..( 13): Result.005 file - promoters50/1461784
aattaaaatgttt

SEQ ID NO: 173785 - DNA, 13 bp, Unknown
  misc_feature (1)..( 13): Result.005 file - promoters50/1461784
gccttaaattttt

SEQ ID NO: 173786 - DNA, 13 bp, Unknown
  misc_feature (1)..( 13): Result.005 file - promoters50/1461784
ttataaaatatta

SEQ ID NO: 173787 - DNA, 13 bp, Unknown
  misc_feature (1)..( 13): Result.005 file - promoters50/1461784
tcataaaaaaaga

SEQ ID NO: 173788 - DNA, 13 bp, Unknown
  misc_feature (1)..( 13): Result.005 file - promoters50/1461784
ttttttaattttt

SEQ ID NO: 173789 - DNA, 11 bp, Unknown
  misc_feature (1)..( 11): Result.005 file - promoters50/1461784
gtttaaaaaaa

SEQ ID NO: 173790 - DNA, 11 bp, Unknown
  misc_feature (1)..( 11): Result.005 file - promoters50/1461784
gtttaaactat

SEQ ID NO: 173791 - DNA, 12 bp, Unknown
  misc_feature (1)..( 12): Result.005 file - promoters50/1461784
ttttcaaataag

SEQ ID NO: 173792 - DNA, 12 bp, Unknown
  misc_feature (1)..( 12): Result.005 file - promoters50/1461784
gagttaaaatct

SEQ ID NO: 173793 - DNA, 12 bp, Unknown
  misc_feature (1)..( 12): Result.005 file - promoters50/1461784
atttgaaaacaa

SEQ ID NO: 173794 - DNA, 12 bp, Unknown
  misc_feature (1)..( 12): Result.005 file - promoters50/1461784
tttagaatttga

SEQ ID NO: 173795 - DNA, 12 bp, Unknown
  misc_feature (1)..( 12): Result.005 file - promoters50/1461784
tggagaatatga

SEQ ID NO: 173796 - DNA, 9 bp, Unknown
  misc_feature (1)..( 9): Result.005 file - promoters50/1461784
taatattta

SEQ ID NO: 173797 - DNA, 9 bp, Unknown
  misc_feature (1)..( 9): Result.005 file - promoters50/1461784
taaaattaa

SEQ ID NO: 173798 - DNA, 9 bp, Unknown
  misc_feature (1)..( 9): Result.005 file - promoters50/1461784
aaatttttt

SEQ ID NO: 173799 - DNA, 9 bp, Unknown
  misc_feature (1)..( 9): Result.005 file - promoters50/1461784
caatttttt

SEQ ID NO: 173800 - DNA, 9 bp, Unknown
  misc_feature (1)..( 9): Result.005 file - promoters50/1461784
ggattttta

SEQ ID NO: 173801 - DNA, 9 bp, Unknown
  misc_feature (1)..( 9): Result.005 file - promoters50/1461784
actttttta

SEQ ID NO: 173802 - DNA, 9 bp, Unknown
  misc_feature (1)..( 9): Result.005 file - promoters50/1461784
caaaaataa

SEQ ID NO: 173803 - DNA, 11 bp, Unknown
  misc_feature (1)..( 11): Result.005 file - promoters50/1461784
aagtttaatat

SEQ ID NO: 173804 - DNA, 11 bp, Unknown
  misc_feature (1)..( 11): Result.005 file - promoters50/1461784
ttttttaattt

SEQ ID NO: 173805 - DNA, 11 bp, Unknown
  misc_feature (1)..( 11): Result.005 file - promoters50/1461784
ccttttaatat

SEQ ID NO: 173806 - DNA, 11 bp, Unknown
  misc_feature (1)..( 11): Result.005 file - promoters50/1461784
agattttataa

SEQ ID NO: 173807 - DNA, 11 bp, Unknown
  misc_feature (1)..( 11): Result.005 file - promoters50/1461784
caaattaaaat

SEQ ID NO: 173808 - DNA, 11 bp, Unknown
  misc_feature (1)..( 11): Result.005 file - promoters50/1461784
ttttttaaagt

SEQ ID NO: 173809 - DNA, 18 bp, Unknown
  misc_feature (1)..( 18): Result.005 file - promoters50/1461784
gaacatatattaaccaat

SEQ ID NO: 173810 - DNA, 18 bp, Unknown
  misc_feature (1)..( 18): Result.005 file - promoters50/1461784
cacaaaggattgaccact

SEQ ID NO: 173811 - DNA, 18 bp, Unknown
  misc_feature (1)..( 18): Result.005 file - promoters50/1461784
gaacaaatagtaaaacaa

SEQ ID NO: 173812 - DNA, 18 bp, Unknown
  misc_feature (1)..( 18): Result.005 file - promoters50/1461784
ttatattatgaaacgaat

SEQ ID NO: 173813 - DNA, 18 bp, Unknown
  misc_feature (1)..( 18): Result.005 file - promoters50/1461784
caatgaaaatgaaaacag

SEQ ID NO: 173814 - DNA, 18 bp, Unknown
  misc_feature (1)..( 18): Result.005 file - promoters50/1461784
gctccaatattaactgac

SEQ ID NO: 173815 - DNA, 14 bp, Unknown
  misc_feature (1)..( 14): Result.005 file - promoters50/1461791
atttgtgaaacaca

SEQ ID NO: 173816 - DNA, 14 bp, Unknown
  misc_feature (1)..( 14): Result.005 file - promoters50/1461791
gtccttgaaacaaa

SEQ ID NO: 173817 - DNA, 14 bp, Unknown
  misc_feature (1)..( 14): Result.005 file - promoters50/1461791
atttttgaagcaca

SEQ ID NO: 173818 - DNA, 14 bp, Unknown
  misc_feature (1)..( 14): Result.005 file - promoters50/1461791
aacaattaaataaa

SEQ ID NO: 173819 - DNA, 14 bp, Unknown
  misc_feature (1)..( 14): Result.005 file - promoters50/1461791
cactctaaaaaaaa

SEQ ID NO: 173820 - DNA, 14 bp, Unknown
  misc_feature (1)..( 14): Result.005 file - promoters50/1461791
atttttgacaataa

SEQ ID NO: 173821 - DNA, 10 bp, Unknown
  misc_feature (1)..( 10): Result.005 file - promoters50/1461791
ttgatatata

SEQ ID NO: 173822 - DNA, 10 bp, Unknown
  misc_feature (1)..( 10): Result.005 file - promoters50/1461791
tgtatatatt

SEQ ID NO: 173823 - DNA, 10 bp, Unknown
  misc_feature (1)..( 10): Result.005 file - promoters50/1461791
ggtatatata

SEQ ID NO: 173824 - DNA, 10 bp, Unknown
  misc_feature (1)..( 10): Result.005 file - promoters50/1461791
tttatagatt

SEQ ID NO: 173825 - DNA, 10 bp, Unknown
  misc_feature (1)..( 10): Result.005 file - promoters50/1461791
actataaata

SEQ ID NO: 173826 - DNA, 10 bp, Unknown
  misc_feature (1)..( 10): Result.005 file - promoters50/1461791
actttaaatt

SEQ ID NO: 173827 - DNA, 9 bp, Unknown
  misc_feature (1)..( 9): Result.005 file - promoters50/1461791
tatataaaa

SEQ ID NO: 173828 - DNA, 9 bp, Unknown
  misc_feature (1)..( 9): Result.005 file - promoters50/1461791
aatataaag

SEQ ID NO: 173829 - DNA, 9 bp, Unknown
  misc_feature (1)..( 9): Result.005 file - promoters50/1461791
tatatatat

SEQ ID NO: 173830 - DNA, 9 bp, Unknown
  misc_feature (1)..( 9): Result.005 file - promoters50/1461791
actataaat

SEQ ID NO: 173831 - DNA, 9 bp, Unknown
  misc_feature (1)..( 9): Result.005 file - promoters50/1461791
tatttattt

SEQ ID NO: 173832 - DNA, 9 bp, Unknown
  misc_feature (1)..( 9): Result.005 file - promoters50/1461791
actttaaat

SEQ ID NO: 173833 - DNA, 13 bp, Unknown
  misc_feature (1)..( 13): Result.005 file - promoters50/1461791
tttgttttaatta

SEQ ID NO: 173834 - DNA, 13 bp, Unknown
  misc_feature (1)..( 13): Result.005 file - promoters50/1461791
cttgttttctacc

SEQ ID NO: 173835 - DNA, 13 bp, Unknown
  misc_feature (1)..( 13): Result.005 file - promoters50/1461791
tttgtttacttta

SEQ ID NO: 173836 - DNA, 13 bp, Unknown
  misc_feature (1)..( 13): Result.005 file - promoters50/1461791
gaagttttagcaa

SEQ ID NO: 173837 - DNA, 13 bp, Unknown
  misc_feature (1)..( 13): Result.005 file - promoters50/1461791
tgattttttgcat

SEQ ID NO: 173838 - DNA, 13 bp, Unknown
  misc_feature (1)..( 13): Result.005 file - promoters50/1461791
ttcatttaagcaa

SEQ ID NO: 173839 - DNA, 14 bp, Unknown
  misc_feature (1)..( 14): Result.005 file - promoters50/1461791
aaacaaaaacattg

SEQ ID NO: 173840 - DNA, 14 bp, Unknown
  misc_feature (1)..( 14): Result.005 file - promoters50/1461791
tgacaataacttct

SEQ ID NO: 173841 - DNA, 14 bp, Unknown
  misc_feature (1)..( 14): Result.005 file - promoters50/1461791
ttaaataaatatct

SEQ ID NO: 173842 - DNA, 14 bp, Unknown
  misc_feature (1)..( 14): Result.005 file - promoters50/1461791
cacataaaactttg

SEQ ID NO: 173843 - DNA, 14 bp, Unknown
  misc_feature (1)..( 14): Result.005 file - promoters50/1461791
ctaaaaaaaaggat

SEQ ID NO: 173844 - DNA, 14 bp, Unknown
  misc_feature (1)..( 14): Result.005 file - promoters50/1461791
tgagaatcatggtg

SEQ ID NO: 173845 - DNA, 8 bp, Unknown
  misc_feature (1)..( 8): Result.005 file - promoters50/1461803
aataatta

SEQ ID NO: 173846 - DNA, 8 bp, Unknown
  misc_feature (1)..( 8): Result.005 file - promoters50/1461803
aataattt

SEQ ID NO: 173847 - DNA, 8 bp, Unknown
  misc_feature (1)..( 8): Result.005 file - promoters50/1461803
tatactta

SEQ ID NO: 173848 - DNA, 9 bp, Unknown
  misc_feature (1)..( 9): Result.005 file - promoters50/1461803
gctaagttt

SEQ ID NO: 173849 - DNA, 10 bp, Unknown
  misc_feature (1)..( 10): Result.005 file - promoters50/1461803
tttaatgtta

SEQ ID NO: 173850 - DNA, 10 bp, Unknown
  misc_feature (1)..( 10): Result.005 file - promoters50/1461803
cctaaattta

SEQ ID NO: 173851 - DNA, 11 bp, Unknown
  misc_feature (1)..( 11): Result.005 file - promoters50/1461803
ccaaatcttaa

SEQ ID NO: 173852 - DNA, 11 bp, Unknown
  misc_feature (1)..( 11): Result.005 file - promoters50/1461803
aataattttaa

SEQ ID NO: 173853 - DNA, 11 bp, Unknown
  misc_feature (1)..( 11): Result.005 file - promoters50/1461803
tttaatgttat

SEQ ID NO: 173854 - DNA, 11 bp, Unknown
  misc_feature (1)..( 11): Result.005 file - promoters50/1461803
gctaagtttga

SEQ ID NO: 173855 - DNA, 11 bp, Unknown
  misc_feature (1)..( 11): Result.005 file - promoters50/1461803
cctaaatttac

SEQ ID NO: 173856 - DNA, 11 bp, Unknown
  misc_feature (1)..( 11): Result.005 file - promoters50/1461803
gttaaatgtat

SEQ ID NO: 173857 - DNA, 8 bp, Unknown
  misc_feature (1)..( 8): Result.005 file - promoters50/1461837
gggattca

SEQ ID NO: 173858 - DNA, 8 bp, Unknown
  misc_feature (1)..( 8): Result.005 file - promoters50/1461837
tggattca

SEQ ID NO: 173859 - DNA, 8 bp, Unknown
  misc_feature (1)..( 8): Result.005 file - promoters50/1461837
tggatttt

SEQ ID NO: 173860 - DNA, 9 bp, Unknown
  misc_feature (1)..( 9): Result.005 file - promoters50/1461837
ttttgttat

SEQ ID NO: 173861 - DNA, 9 bp, Unknown
  misc_feature (1)..( 9): Result.005 file - promoters50/1461837
ttttgttat

SEQ ID NO: 173862 - DNA, 9 bp, Unknown
  misc_feature (1)..( 9): Result.005 file - promoters50/1461837
ctttgttct

SEQ ID NO: 173863 - DNA, 16 bp, Unknown
  misc_feature (1)..( 16): Result.005 file - promoters50/1461839
gaaaaagaaaaagaaa

SEQ ID NO: 173864 - DNA, 16 bp, Unknown
  misc_feature (1)..( 16): Result.005 file - promoters50/1461839
gaaaaagaaaaaaaga

SEQ ID NO: 173865 - DNA, 16 bp, Unknown
  misc_feature (1)..( 16): Result.005 file - promoters50/1461839
caaccagaaaagaaat

SEQ ID NO: 173866 - DNA, 16 bp, Unknown
  misc_feature (1)..( 16): Result.005 file - promoters50/1461839
tacaaacaaaaaaaat

SEQ ID NO: 173867 - DNA, 16 bp, Unknown
  misc_feature (1)..( 16): Result.005 file - promoters50/1461839
gatttagataagtaaa

SEQ ID NO: 173868 - DNA, 16 bp, Unknown
  misc_feature (1)..( 16): Result.005 file - promoters50/1461839
gtggcggataagcaaa

SEQ ID NO: 173869 - DNA, 16 bp, Unknown
  misc_feature (1)..( 16): Result.005 file - promoters50/1461839
aaatgacaaaactatt

SEQ ID NO: 173870 - DNA, 12 bp, Unknown
  misc_feature (1)..( 12): Result.005 file - promoters50/1461839
aaaagaaaaaaa

SEQ ID NO: 173871 - DNA, 12 bp, Unknown
  misc_feature (1)..( 12): Result.005 file - promoters50/1461839
aaaagaaagaat

SEQ ID NO: 173872 - DNA, 13 bp, Unknown
  misc_feature (1)..( 13): Result.005 file - promoters50/1461839
ataagtaaagtat

SEQ ID NO: 173873 - DNA, 13 bp, Unknown
  misc_feature (1)..( 13): Result.005 file - promoters50/1461839
gaaaagaaatatg

SEQ ID NO: 173874 - DNA, 13 bp, Unknown
  misc_feature (1)..( 13): Result.005 file - promoters50/1461839
acaaacaaaaaaa

SEQ ID NO: 173875 - DNA, 13 bp, Unknown
  misc_feature (1)..( 13): Result.005 file - promoters50/1461839
ataagcaaaaaca

SEQ ID NO: 173876 - DNA, 13 bp, Unknown
  misc_feature (1)..( 13): Result.005 file - promoters50/1461839
aatgacaaaacta

SEQ ID NO: 173877 - DNA, 16 bp, Unknown
  misc_feature (1)..( 16): Result.005 file - promoters50/1461839
aaagaaaagaaagaat

SEQ ID NO: 173878 - DNA, 16 bp, Unknown
  misc_feature (1)..( 16): Result.005 file - promoters50/1461839
aaaagaaagaatcaga

SEQ ID NO: 173879 - DNA, 16 bp, Unknown
  misc_feature (1)..( 16): Result.005 file - promoters50/1461839
ccagaaaagaaatatg

SEQ ID NO: 173880 - DNA, 16 bp, Unknown
  misc_feature (1)..( 16): Result.005 file - promoters50/1461839
aaacaaaaaaaataaa

SEQ ID NO: 173881 - DNA, 16 bp, Unknown
  misc_feature (1)..( 16): Result.005 file - promoters50/1461839
ttagataagtaaagta

SEQ ID NO: 173882 - DNA, 16 bp, Unknown
  misc_feature (1)..( 16): Result.005 file - promoters50/1461839
tgacaaaactattaaa

SEQ ID NO: 173883 - DNA, 17 bp, Unknown
  misc_feature (1)..( 17): Result.005 file - promoters50/1461839
aaaagaaaagaaagaat

SEQ ID NO: 173884 - DNA, 17 bp, Unknown
  misc_feature (1)..( 17): Result.005 file - promoters50/1461839
tttagataagtaaagta

SEQ ID NO: 173885 - DNA, 17 bp, Unknown
  misc_feature (1)..( 17): Result.005 file - promoters50/1461839
aaaagaaatatggataa

SEQ ID NO: 173886 - DNA, 17 bp, Unknown
  misc_feature (1)..( 17): Result.005 file - promoters50/1461839
caaacaaaaaaaataaa

SEQ ID NO: 173887 - DNA, 17 bp, Unknown
  misc_feature (1)..( 17): Result.005 file - promoters50/1461839
aaaagaaaagaaagaat

SEQ ID NO: 173888 - DNA, 17 bp, Unknown
  misc_feature (1)..( 17): Result.005 file - promoters50/1461839
atgacaaaactattaaa

SEQ ID NO: 173889 - DNA, 20 bp, Unknown
  misc_feature (1)..( 20): Result.005 file - promoters50/1461839
aaaaagctaattttgattca

SEQ ID NO: 173890 - DNA, 20 bp, Unknown
  misc_feature (1)..( 20): Result.005 file - promoters50/1461839
taatccctaattttacattt

SEQ ID NO: 173891 - DNA, 20 bp, Unknown
  misc_feature (1)..( 20): Result.005 file - promoters50/1461839
ggtacagtaatttgattttg

SEQ ID NO: 173892 - DNA, 20 bp, Unknown
  misc_feature (1)..( 20): Result.005 file - promoters50/1461839
aaaaaactaatcaggactaa

SEQ ID NO: 173893 - DNA, 20 bp, Unknown
  misc_feature (1)..( 20): Result.005 file - promoters50/1461839
aaaaagctaattttgattca

SEQ ID NO: 173894 - DNA, 20 bp, Unknown
  misc_feature (1)..( 20): Result.005 file - promoters50/1461839
gaaaattaaattttacattt

SEQ ID NO: 173895 - DNA, 20 bp, Unknown
  misc_feature (1)..( 20): Result.005 file - promoters50/1461839
tatttttaaattttcgtttt

SEQ ID NO: 173896 - DNA, 8 bp, Unknown
  misc_feature (1)..( 8): Result.005 file - promoters50/1461848
acgaaagt

SEQ ID NO: 173897 - DNA, 8 bp, Unknown
  misc_feature (1)..( 8): Result.005 file - promoters50/1461848
ctgaaagt

SEQ ID NO: 173898 - DNA, 8 bp, Unknown
  misc_feature (1)..( 8): Result.005 file - promoters50/1461848
ctgcaagc

SEQ ID NO: 173899 - DNA, 11 bp, Unknown
  misc_feature (1)..( 11): Result.005 file - promoters50/1461857
gttttcttgaa

SEQ ID NO: 173900 - DNA, 11 bp, Unknown
  misc_feature (1)..( 11): Result.005 file - promoters50/1461857
atttacttaat

SEQ ID NO: 173901 - DNA, 11 bp, Unknown
  misc_feature (1)..( 11): Result.005 file - promoters50/1461857
atttaattaat

SEQ ID NO: 173902 - DNA, 10 bp, Unknown
  misc_feature (1)..( 10): Result.005 file - promoters50/1461857
ctttattcaa

SEQ ID NO: 173903 - DNA, 10 bp, Unknown
  misc_feature (1)..( 10): Result.005 file - promoters50/1461857
ttttatgcaa

SEQ ID NO: 173904 - DNA, 10 bp, Unknown
  misc_feature (1)..( 10): Result.005 file - promoters50/1461857
ttttatcttc

SEQ ID NO: 173905 - DNA, 14 bp, Unknown
  misc_feature (1)..( 14): Result.005 file - promoters50/1465855
atggagaacatctt

SEQ ID NO: 173906 - DNA, 14 bp, Unknown
  misc_feature (1)..( 14): Result.005 file - promoters50/1465855
aagattaacaactt

SEQ ID NO: 173907 - DNA, 14 bp, Unknown
  misc_feature (1)..( 14): Result.005 file - promoters50/1465855
aattttatcatctt

SEQ ID NO: 173908 - DNA, 14 bp, Unknown
  misc_feature (1)..( 14): Result.005 file - promoters50/1465855
aacgttaacatgtg

SEQ ID NO: 173909 - DNA, 8 bp, Unknown
  misc_feature (1)..( 8): Result.005 file - promoters50/1465855
aatttttc

SEQ ID NO: 173910 - DNA, 8 bp, Unknown
  misc_feature (1)..( 8): Result.005 file - promoters50/1465855
aatatttc

SEQ ID NO: 173911 - DNA, 8 bp, Unknown
  misc_feature (1)..( 8): Result.005 file - promoters50/1465855
tatattta

SEQ ID NO: 173912 - DNA, 8 bp, Unknown
  misc_feature (1)..( 8): Result.005 file - promoters50/1465855
aatattaa

SEQ ID NO: 173913 - DNA, 6 bp, Unknown
  misc_feature (1)..( 6): Result.005 file - promoters50/1465863
tcgttt

SEQ ID NO: 173914 - DNA, 6 bp, Unknown
  misc_feature (1)..( 6): Result.005 file - promoters50/1465863
tcgttt

SEQ ID NO: 173915 - DNA, 7 bp, Unknown
  misc_feature (1)..( 7): Result.005 file - promoters50/1465863
tcgcttt

SEQ ID NO: 173916 - DNA, 9 bp, Unknown
  misc_feature (1)..( 9): Result.005 file - promoters50/1465863
ttcttagct

SEQ ID NO: 173917 - DNA, 9 bp, Unknown
  misc_feature (1)..( 9): Result.005 file - promoters50/1465863
ttcttatca

SEQ ID NO: 173918 - DNA, 9 bp, Unknown
  misc_feature (1)..( 9): Result.005 file - promoters50/1465863
atctgagct

SEQ ID NO: 173919 - DNA, 9 bp, Unknown
  misc_feature (1)..( 9): Result.005 file - promoters50/1465863
agaaagcgg

SEQ ID NO: 173920 - DNA, 9 bp, Unknown
  misc_feature (1)..( 9): Result.005 file - promoters50/1465863
agaaagctt

SEQ ID NO: 173921 - DNA, 9 bp, Unknown
  misc_feature (1)..( 9): Result.005 file - promoters50/1465863
tgaaacaaa

SEQ ID NO: 173922 - DNA, 8 bp, Unknown
  misc_feature (1)..( 8): Result.005 file - promoters50/1465863
gaaagatt

SEQ ID NO: 173923 - DNA, 8 bp, Unknown
  misc_feature (1)..( 8): Result.005 file - promoters50/1465863
gaaagaaa

SEQ ID NO: 173924 - DNA, 8 bp, Unknown
  misc_feature (1)..( 8): Result.005 file - promoters50/1465863
aaaacatt

SEQ ID NO: 173925 - DNA, 8 bp, Unknown
  misc_feature (1)..( 8): Result.005 file - promoters50/1465863
tccaaagt

SEQ ID NO: 173926 - DNA, 8 bp, Unknown
  misc_feature (1)..( 8): Result.005 file - promoters50/1465863
tccaaagg

SEQ ID NO: 173927 - DNA, 8 bp, Unknown
  misc_feature (1)..( 8): Result.005 file - promoters50/1465863
ctcaaagg

SEQ ID NO: 173928 - DNA, 9 bp, Unknown
  misc_feature (1)..( 9): Result.005 file - promoters50/1465863
ctagggttt

SEQ ID NO: 173929 - DNA, 9 bp, Unknown
  misc_feature (1)..( 9): Result.005 file - promoters50/1465863
ttagggttt

SEQ ID NO: 173930 - DNA, 9 bp, Unknown
  misc_feature (1)..( 9): Result.005 file - promoters50/1465863
ctagggttc

SEQ ID NO: 173931 - DNA, 8 bp, Unknown
  misc_feature (1)..( 8): Result.005 file - promoters50/1465863
agtttaat

SEQ ID NO: 173932 - DNA, 8 bp, Unknown
  misc_feature (1)..( 8): Result.005 file - promoters50/1465863
agtctaaa

SEQ ID NO: 173933 - DNA, 8 bp, Unknown
  misc_feature (1)..( 8): Result.005 file - promoters50/1465863
tttttaat

SEQ ID NO: 173934 - DNA, 9 bp, Unknown
  misc_feature (1)..( 9): Result.005 file - promoters50/1465863
tgatttttc

SEQ ID NO: 173935 - DNA, 9 bp, Unknown
  misc_feature (1)..( 9): Result.005 file - promoters50/1465863
atatttttt

SEQ ID NO: 173936 - DNA, 9 bp, Unknown
  misc_feature (1)..( 9): Result.005 file - promoters50/1465863
atattttct

SEQ ID NO: 173937 - DNA, 10 bp, Unknown
  misc_feature (1)..( 10): Result.005 file - promoters50/1465863
caatttgtta

SEQ ID NO: 173938 - DNA, 8 bp, Unknown
  misc_feature (1)..( 8): Result.005 file - promoters50/1470567
atctctta

SEQ ID NO: 173939 - DNA, 8 bp, Unknown
  misc_feature (1)..( 8): Result.005 file - promoters50/1470567
gactctta

SEQ ID NO: 173940 - DNA, 8 bp, Unknown
  misc_feature (1)..( 8): Result.005 file - promoters50/1470567
ctctctta

SEQ ID NO: 173941 - DNA, 8 bp, Unknown
  misc_feature (1)..( 8): Result.005 file - promoters50/1470567
ctctctaa

SEQ ID NO: 173942 - DNA, 8 bp, Unknown
  misc_feature (1)..( 8): Result.005 file - promoters50/1470567
tactctta

SEQ ID NO: 173943 - DNA, 8 bp, Unknown
  misc_feature (1)..( 8): Result.005 file - promoters50/1470567
tgctctta

SEQ ID NO: 173944 - DNA, 20 bp, Unknown
  misc_feature (1)..( 20): Result.005 file - promoters50/1470567
tgtaaatattcacttgaatt

SEQ ID NO: 173945 - DNA, 20 bp, Unknown
  misc_feature (1)..( 20): Result.005 file - promoters50/1470567
attaaattttctttttcttt

SEQ ID NO: 173946 - DNA, 20 bp, Unknown
  misc_feature (1)..( 20): Result.005 file - promoters50/1470567
tgttaatgggaataaggaaa

SEQ ID NO: 173947 - DNA, 20 bp, Unknown
  misc_feature (1)..( 20): Result.005 file - promoters50/1470567
tgacaatttttcaatttttg

SEQ ID NO: 173948 - DNA, 20 bp, Unknown
  misc_feature (1)..( 20): Result.005 file - promoters50/1470567
ggtcaattgtctcttagtta

SEQ ID NO: 173949 - DNA, 20 bp, Unknown
  misc_feature (1)..( 20): Result.005 file - promoters50/1470567
gatttagtttcgtttatggg

SEQ ID NO: 173950 - DNA, 12 bp, Unknown
  misc_feature (1)..( 12): Result.005 file - promoters50/1470567
gatatcttgcaa

SEQ ID NO: 173951 - DNA, 12 bp, Unknown
  misc_feature (1)..( 12): Result.005 file - promoters50/1470567
tgtattttgtgt

SEQ ID NO: 173952 - DNA, 12 bp, Unknown
  misc_feature (1)..( 12): Result.005 file - promoters50/1470567
ttaatcttccaa

SEQ ID NO: 173953 - DNA, 12 bp, Unknown
  misc_feature (1)..( 12): Result.005 file - promoters50/1470567
ctaatcttgtac

SEQ ID NO: 173954 - DNA, 12 bp, Unknown
  misc_feature (1)..( 12): Result.005 file - promoters50/1470567
tttatttttgtt

SEQ ID NO: 173955 - DNA, 12 bp, Unknown
  misc_feature (1)..( 12): Result.005 file - promoters50/1470567
tttaatttgttg

SEQ ID NO: 173956 - DNA, 16 bp, Unknown
  misc_feature (1)..( 16): Result.005 file - promoters50/1470582
atggattgttaaattt

SEQ ID NO: 173957 - DNA, 16 bp, Unknown
  misc_feature (1)..( 16): Result.005 file - promoters50/1470582
ttattcggtttaattt

SEQ ID NO: 173958 - DNA, 16 bp, Unknown
  misc_feature (1)..( 16): Result.005 file - promoters50/1470582
tattattcttaattta

SEQ ID NO: 173959 - DNA, 16 bp, Unknown
  misc_feature (1)..( 16): Result.005 file - promoters50/1470582
tattactcttttacaa

SEQ ID NO: 173960 - DNA, 16 bp, Unknown
  misc_feature (1)..( 16): Result.005 file - promoters50/1470582
ctctacacttcatttt

SEQ ID NO: 173961 - DNA, 16 bp, Unknown
  misc_feature (1)..( 16): Result.005 file - promoters50/1470582
aaaaaatctgaaaatc

SEQ ID NO: 173962 - DNA, 12 bp, Unknown
  misc_feature (1)..( 12): Result.005 file - promoters50/1470582
tttcttagttta

SEQ ID NO: 173963 - DNA, 12 bp, Unknown
  misc_feature (1)..( 12): Result.005 file - promoters50/1470582
attcttaattta

SEQ ID NO: 173964 - DNA, 12 bp, Unknown
  misc_feature (1)..( 12): Result.005 file - promoters50/1470582
tttcttgttgga

SEQ ID NO: 173965 - DNA, 12 bp, Unknown
  misc_feature (1)..( 12): Result.005 file - promoters50/1470582
attattactctt

SEQ ID NO: 173966 - DNA, 12 bp, Unknown
  misc_feature (1)..( 12): Result.005 file - promoters50/1470582
atcaagaattta

SEQ ID NO: 173967 - DNA, 12 bp, Unknown
  misc_feature (1)..( 12): Result.005 file - promoters50/1470582
aatctttattcg

SEQ ID NO: 173968 - DNA, 12 bp, Unknown
  misc_feature (1)..( 12): Result.005 file - promoters50/1470582
tttcttcagctg

SEQ ID NO: 173969 - DNA, 8 bp, Unknown
  misc_feature (1)..( 8): Result.005 file - promoters50/1470903
gaagagaa

SEQ ID NO: 173970 - DNA, 8 bp, Unknown
  misc_feature (1)..( 8): Result.005 file - promoters50/1470903
gaaaagaa

SEQ ID NO: 173971 - DNA, 8 bp, Unknown
  misc_feature (1)..( 8): Result.005 file - promoters50/1470903
gaaaagaa

SEQ ID NO: 173972 - DNA, 14 bp, Unknown
  misc_feature (1)..( 14): Result.005 file - promoters50/1470903
agagagagaggtga

SEQ ID NO: 173973 - DNA, 14 bp, Unknown
  misc_feature (1)..( 14): Result.005 file - promoters50/1470903
agagagagagagag

SEQ ID NO: 173974 - DNA, 14 bp, Unknown
  misc_feature (1)..( 14): Result.005 file - promoters50/1470903
agagagagagagag

SEQ ID NO: 173975 - DNA, 17 bp, Unknown
  misc_feature (1)..( 17): Result.005 file - promoters50/1470993
tttaaatgggcctaggc

SEQ ID NO: 173976 - DNA, 17 bp, Unknown
  misc_feature (1)..( 17): Result.005 file - promoters50/1470993
tttaaaatcacatcttc

SEQ ID NO: 173977 - DNA, 17 bp, Unknown
  misc_feature (1)..( 17): Result.005 file - promoters50/1470993
tttgaatttgatgaatc

SEQ ID NO: 173978 - DNA, 17 bp, Unknown
  misc_feature (1)..( 17): Result.005 file - promoters50/1470993
tctgaatatgatgatga

SEQ ID NO: 173979 - DNA, 17 bp, Unknown
  misc_feature (1)..( 17): Result.005 file - promoters50/1470993
tttgatcatgattggtg

SEQ ID NO: 173980 - DNA, 17 bp, Unknown
  misc_feature (1)..( 17): Result.005 file - promoters50/1470993
ccccattattacaaatt

SEQ ID NO: 173981 - DNA, 15 bp, Unknown
  misc_feature (1)..( 15): Result.005 file - promoters50/1470993
tgaagaaaggaattg

SEQ ID NO: 173982 - DNA, 15 bp, Unknown
  misc_feature (1)..( 15): Result.005 file - promoters50/1470993
tgatgaatggtgatg

SEQ ID NO: 173983 - DNA, 15 bp, Unknown
  misc_feature (1)..( 15): Result.005 file - promoters50/1470993
tgatgaatcaaatca

SEQ ID NO: 173984 - DNA, 15 bp, Unknown
  misc_feature (1)..( 15): Result.005 file - promoters50/1470993
tgatcatgattggtg

SEQ ID NO: 173985 - DNA, 15 bp, Unknown
  misc_feature (1)..( 15): Result.005 file - promoters50/1470993
ggataaattacaatt

SEQ ID NO: 173986 - DNA, 15 bp, Unknown
  misc_feature (1)..( 15): Result.005 file - promoters50/1470993
ccattattacaaatt

SEQ ID NO: 173987 - DNA, 10 bp, Unknown
  misc_feature (1)..( 10): Result.005 file - promoters50/1471001
atataattaa

SEQ ID NO: 173988 - DNA, 10 bp, Unknown
  misc_feature (1)..( 10): Result.005 file - promoters50/1471001
atatatttat

SEQ ID NO: 173989 - DNA, 10 bp, Unknown
  misc_feature (1)..( 10): Result.005 file - promoters50/1471001
cgatatgtat

SEQ ID NO: 173990 - DNA, 10 bp, Unknown
  misc_feature (1)..( 10): Result.005 file - promoters50/1471001
tttaatgtat

SEQ ID NO: 173991 - DNA, 7 bp, Unknown
  misc_feature (1)..( 7): Result.005 file - promoters50/1471001
atataaa

SEQ ID NO: 173992 - DNA, 7 bp, Unknown
  misc_feature (1)..( 7): Result.005 file - promoters50/1471001
ctataaa

SEQ ID NO: 173993 - DNA, 7 bp, Unknown
  misc_feature (1)..( 7): Result.005 file - promoters50/1471001
ttataaa

SEQ ID NO: 173994 - DNA, 7 bp, Unknown
  misc_feature (1)..( 7): Result.005 file - promoters50/1471001
ttataaa

SEQ ID NO: 173995 - DNA, 13 bp, Unknown
  misc_feature (1)..( 13): Result.005 file - promoters50/1471001
gttattaaattaa

SEQ ID NO: 173996 - DNA, 13 bp, Unknown
  misc_feature (1)..( 13): Result.005 file - promoters50/1471001
attatcaaatttt

SEQ ID NO: 173997 - DNA, 13 bp, Unknown
  misc_feature (1)..( 13): Result.005 file - promoters50/1471001
atgtgaaaatttt

SEQ ID NO: 173998 - DNA, 13 bp, Unknown
  misc_feature (1)..( 13): Result.005 file - promoters50/1471001
attatctagggac

SEQ ID NO: 173999 - DNA, 11 bp, Unknown
  misc_feature (1)..( 11): Result.005 file - promoters50/1471009
aaattaacaac

SEQ ID NO: 174000 - DNA, 11 bp, Unknown
  misc_feature (1)..( 11): Result.005 file - promoters50/1471009
cgaataacaat

SEQ ID NO: 174001 - DNA, 11 bp, Unknown
  misc_feature (1)..( 11): Result.005 file - promoters50/1471009
catttaacact

SEQ ID NO: 174002 - DNA, 11 bp, Unknown
  misc_feature (1)..( 11): Result.005 file - promoters50/1471009
aatttaacaac

SEQ ID NO: 174003 - DNA, 11 bp, Unknown
  misc_feature (1)..( 11): Result.005 file - promoters50/1471009
tcattaacatg

SEQ ID NO: 174004 - DNA, 11 bp, Unknown
  misc_feature (1)..( 11): Result.005 file - promoters50/1471009
taattacagta

SEQ ID NO: 174005 - DNA, 11 bp, Unknown
  misc_feature (1)..( 11): Result.005 file - promoters50/1471009
gtatttactac

SEQ ID NO: 174006 - DNA, 9 bp, Unknown
  misc_feature (1)..( 9): Result.005 file - promoters50/1471009
ataattagg

SEQ ID NO: 174007 - DNA, 9 bp, Unknown
  misc_feature (1)..( 9): Result.005 file - promoters50/1471009
ctaattaag

SEQ ID NO: 174008 - DNA, 9 bp, Unknown
  misc_feature (1)..( 9): Result.005 file - promoters50/1471009
atacttaaa

SEQ ID NO: 174009 - DNA, 9 bp, Unknown
  misc_feature (1)..( 9): Result.005 file - promoters50/1471009
ataaataaa

SEQ ID NO: 174010 - DNA, 9 bp, Unknown
  misc_feature (1)..( 9): Result.005 file - promoters50/1471009
ataaataag

SEQ ID NO: 174011 - DNA, 9 bp, Unknown
  misc_feature (1)..( 9): Result.005 file - promoters50/1471009
gaaatgaat

SEQ ID NO: 174012 - DNA, 11 bp, Unknown
  misc_feature (1)..( 11): Result.005 file - promoters50/1471009
tgatgatattc

SEQ ID NO: 174013 - DNA, 11 bp, Unknown
  misc_feature (1)..( 11): Result.005 file - promoters50/1471009
agataatagtc

SEQ ID NO: 174014 - DNA, 11 bp, Unknown
  misc_feature (1)..( 11): Result.005 file - promoters50/1471009
agaaaatttac

SEQ ID NO: 174015 - DNA, 11 bp, Unknown
  misc_feature (1)..( 11): Result.005 file - promoters50/1471009
actaaatttta

SEQ ID NO: 174016 - DNA, 11 bp, Unknown
  misc_feature (1)..( 11): Result.005 file - promoters50/1471009
cccaaatttta

SEQ ID NO: 174017 - DNA, 11 bp, Unknown
  misc_feature (1)..( 11): Result.005 file - promoters50/1471009
agacaattatt

SEQ ID NO: 174018 - DNA, 12 bp, Unknown
  misc_feature (1)..( 12): Result.005 file - promoters50/1471009
tcctatatatca

SEQ ID NO: 174019 - DNA, 12 bp, Unknown
  misc_feature (1)..( 12): Result.005 file - promoters50/1471009
tcctataaattg

SEQ ID NO: 174020 - DNA, 12 bp, Unknown
  misc_feature (1)..( 12): Result.005 file - promoters50/1471009
tcctataaatat

SEQ ID NO: 174021 - DNA, 12 bp, Unknown
  misc_feature (1)..( 12): Result.005 file - promoters50/1471009
ttctatatatat

SEQ ID NO: 174022 - DNA, 12 bp, Unknown
  misc_feature (1)..( 12): Result.005 file - promoters50/1471009
ttaaataaatac

SEQ ID NO: 174023 - DNA, 12 bp, Unknown
  misc_feature (1)..( 12): Result.005 file - promoters50/1471009
ttttatatataa

SEQ ID NO: 174024 - DNA, 12 bp, Unknown
  misc_feature (1)..( 12): Result.005 file - promoters50/1471009
tgagatataata

SEQ ID NO: 174025 - DNA, 11 bp, Unknown
  misc_feature (1)..( 11): Result.005 file - promoters50/1471009
gaaagaattaa

SEQ ID NO: 174026 - DNA, 11 bp, Unknown
  misc_feature (1)..( 11): Result.005 file - promoters50/1471009
caaagaatcgt

SEQ ID NO: 174027 - DNA, 11 bp, Unknown
  misc_feature (1)..( 11): Result.005 file - promoters50/1471009
gaacgaacagg

SEQ ID NO: 174028 - DNA, 11 bp, Unknown
  misc_feature (1)..( 11): Result.005 file - promoters50/1471009
aaaagaaataa

SEQ ID NO: 174029 - DNA, 11 bp, Unknown
  misc_feature (1)..( 11): Result.005 file - promoters50/1471009
caaaaaaaact

SEQ ID NO: 174030 - DNA, 11 bp, Unknown
  misc_feature (1)..( 11): Result.005 file - promoters50/1471009
taattaatatt

SEQ ID NO: 174031 - DNA, 7 bp, Unknown
  misc_feature (1)..( 7): Result.005 file - promoters50/1471009
ataaatt

SEQ ID NO: 174032 - DNA, 7 bp, Unknown
  misc_feature (1)..( 7): Result.005 file - promoters50/1471009
ataaata

SEQ ID NO: 174033 - DNA, 7 bp, Unknown
  misc_feature (1)..( 7): Result.005 file - promoters50/1471009
ataaata

SEQ ID NO: 174034 - DNA, 7 bp, Unknown
  misc_feature (1)..( 7): Result.005 file - promoters50/1471009
atatata

SEQ ID NO: 174035 - DNA, 7 bp, Unknown
  misc_feature (1)..( 7): Result.005 file - promoters50/1471009
atatata

SEQ ID NO: 174036 - DNA, 8 bp, Unknown
  misc_feature (1)..( 8): Result.005 file - promoters50/1471009
atataata

SEQ ID NO: 174037 - DNA, 12 bp, Unknown
  misc_feature (1)..( 12): Result.005 file - promoters50/1471041
agaattaaaatc

SEQ ID NO: 174038 - DNA, 12 bp, Unknown
  misc_feature (1)..( 12): Result.005 file - promoters50/1471041
aacattaatatc

SEQ ID NO: 174039 - DNA, 12 bp, Unknown
  misc_feature (1)..( 12): Result.005 file - promoters50/1471041
agaagtaaaggt

SEQ ID NO: 174040 - DNA, 12 bp, Unknown
  misc_feature (1)..( 12): Result.005 file - promoters50/1471041
attattaattta

SEQ ID NO: 174041 - DNA, 12 bp, Unknown
  misc_feature (1)..( 12): Result.005 file - promoters50/1471041
acttttatttta

SEQ ID NO: 174042 - DNA, 12 bp, Unknown
  misc_feature (1)..( 12): Result.005 file - promoters50/1471041
taaattaatttg

SEQ ID NO: 174043 - DNA, 13 bp, Unknown
  misc_feature (1)..( 13): Result.005 file - promoters50/1471041
ggtttgattagat

SEQ ID NO: 174044 - DNA, 13 bp, Unknown
  misc_feature (1)..( 13): Result.005 file - promoters50/1471041
tattttattacca

SEQ ID NO: 174045 - DNA, 13 bp, Unknown
  misc_feature (1)..( 13): Result.005 file - promoters50/1471041
aatttgatataca

SEQ ID NO: 174046 - DNA, 13 bp, Unknown
  misc_feature (1)..( 13): Result.005 file - promoters50/1471041
tatattattaatt

SEQ ID NO: 174047 - DNA, 13 bp, Unknown
  misc_feature (1)..( 13): Result.005 file - promoters50/1471041
tttttgattaaat

SEQ ID NO: 174048 - DNA, 13 bp, Unknown
  misc_feature (1)..( 13): Result.005 file - promoters50/1471041
acggagatcaaat

SEQ ID NO: 174049 - DNA, 8 bp, Unknown
  misc_feature (1)..( 8): Result.005 file - promoters50/1471073
aaaaaata

SEQ ID NO: 174050 - DNA, 8 bp, Unknown
  misc_feature (1)..( 8): Result.005 file - promoters50/1471073
aaaaaata

SEQ ID NO: 174051 - DNA, 8 bp, Unknown
  misc_feature (1)..( 8): Result.005 file - promoters50/1471073
taaaaatt

SEQ ID NO: 174052 - DNA, 7 bp, Unknown
  misc_feature (1)..( 7): Result.005 file - promoters50/1471073
aataaaa

SEQ ID NO: 174053 - DNA, 7 bp, Unknown
  misc_feature (1)..( 7): Result.005 file - promoters50/1471073
gataaaa

SEQ ID NO: 174054 - DNA, 7 bp, Unknown
  misc_feature (1)..( 7): Result.005 file - promoters50/1471073
aataaat

SEQ ID NO: 174055 - DNA, 8 bp, Unknown
  misc_feature (1)..( 8): Result.005 file - promoters50/1471073
ataaaata

SEQ ID NO: 174056 - DNA, 8 bp, Unknown
  misc_feature (1)..( 8): Result.005 file - promoters50/1471073
atataata

SEQ ID NO: 174057 - DNA, 8 bp, Unknown
  misc_feature (1)..( 8): Result.005 file - promoters50/1471073
ttaaaatg

SEQ ID NO: 174058 - DNA, 10 bp, Unknown
  misc_feature (1)..( 10): Result.005 file - promoters50/1471073
ataaaatcat

SEQ ID NO: 174059 - DNA, 10 bp, Unknown
  misc_feature (1)..( 10): Result.005 file - promoters50/1471073
agacaatcat

SEQ ID NO: 174060 - DNA, 10 bp, Unknown
  misc_feature (1)..( 10): Result.005 file - promoters50/1471073
ataaaaccat

SEQ ID NO: 174061 - DNA, 10 bp, Unknown
  misc_feature (1)..( 10): Result.005 file - promoters50/1471073
acttatttgc

SEQ ID NO: 174062 - DNA, 10 bp, Unknown
  misc_feature (1)..( 10): Result.005 file - promoters50/1471073
tattaattgc

SEQ ID NO: 174063 - DNA, 10 bp, Unknown
  misc_feature (1)..( 10): Result.005 file - promoters50/1471073
atttattttt

SEQ ID NO: 174064 - DNA, 8 bp, Unknown
  misc_feature (1)..( 8): Result.005 file - promoters50/1471073
attcaaat

SEQ ID NO: 174065 - DNA, 8 bp, Unknown
  misc_feature (1)..( 8): Result.005 file - promoters50/1471073
attaaaaa

SEQ ID NO: 174066 - DNA, 9 bp, Unknown
  misc_feature (1)..( 9): Result.005 file - promoters50/1471073
aataataat

SEQ ID NO: 174067 - DNA, 8 bp, Unknown
  misc_feature (1)..( 8): Result.005 file - promoters50/1471106
gttagtat

SEQ ID NO: 174068 - DNA, 8 bp, Unknown
  misc_feature (1)..( 8): Result.005 file - promoters50/1471106
tttattat

SEQ ID NO: 174069 - DNA, 8 bp, Unknown
  misc_feature (1)..( 8): Result.005 file - promoters50/1471106
attattat

SEQ ID NO: 174070 - DNA, 8 bp, Unknown
  misc_feature (1)..( 8): Result.005 file - promoters50/1471106
tttattaa

SEQ ID NO: 174071 - DNA, 8 bp, Unknown
  misc_feature (1)..( 8): Result.005 file - promoters50/1471106
attagttt

SEQ ID NO: 174072 - DNA, 8 bp, Unknown
  misc_feature (1)..( 8): Result.005 file - promoters50/1471106
cgtattaa

SEQ ID NO: 174073 - DNA, 15 bp, Unknown
  misc_feature (1)..( 15): Result.005 file - promoters50/1471114
agatatagtattgag

SEQ ID NO: 174074 - DNA, 15 bp, Unknown
  misc_feature (1)..( 15): Result.005 file - promoters50/1471114
attcctagaattgtt

SEQ ID NO: 174075 - DNA, 15 bp, Unknown
  misc_feature (1)..( 15): Result.005 file - promoters50/1471114
catgattgtattgtt

SEQ ID NO: 174076 - DNA, 15 bp, Unknown
  misc_feature (1)..( 15): Result.005 file - promoters50/1471114
gatacaagatttgag

SEQ ID NO: 174077 - DNA, 15 bp, Unknown
  misc_feature (1)..( 15): Result.005 file - promoters50/1471114
tcaaaatgttttgtt

SEQ ID NO: 174078 - DNA, 15 bp, Unknown
  misc_feature (1)..( 15): Result.005 file - promoters50/1471114
aaattttttgttgtt

SEQ ID NO: 174079 - DNA, 11 bp, Unknown
  misc_feature (1)..( 11): Result.005 file - promoters50/1471114
tgtaaaaatgt

SEQ ID NO: 174080 - DNA, 11 bp, Unknown
  misc_feature (1)..( 11): Result.005 file - promoters50/1471114
tgttaaacagt

SEQ ID NO: 174081 - DNA, 11 bp, Unknown
  misc_feature (1)..( 11): Result.005 file - promoters50/1471114
ggttaaataat

SEQ ID NO: 174082 - DNA, 11 bp, Unknown
  misc_feature (1)..( 11): Result.005 file - promoters50/1471114
gtttaaacagt

SEQ ID NO: 174083 - DNA, 11 bp, Unknown
  misc_feature (1)..( 11): Result.005 file - promoters50/1471114
aattatataaa

SEQ ID NO: 174084 - DNA, 11 bp, Unknown
  misc_feature (1)..( 11): Result.005 file - promoters50/1471114
agttgaatttt

SEQ ID NO: 174085 - DNA, 10 bp, Unknown
  misc_feature (1)..( 10): Result.005 file - promoters50/1471114
atctcactca

SEQ ID NO: 174086 - DNA, 10 bp, Unknown
  misc_feature (1)..( 10): Result.005 file - promoters50/1471114
taatcaatca

SEQ ID NO: 174087 - DNA, 10 bp, Unknown
  misc_feature (1)..( 10): Result.005 file - promoters50/1471114
gaataaattc

SEQ ID NO: 174088 - DNA, 10 bp, Unknown
  misc_feature (1)..( 10): Result.005 file - promoters50/1471114
aaatcaaaat

SEQ ID NO: 174089 - DNA, 10 bp, Unknown
  misc_feature (1)..( 10): Result.005 file - promoters50/1471114
gaatcaaacg

SEQ ID NO: 174090 - DNA, 10 bp, Unknown
  misc_feature (1)..( 10): Result.005 file - promoters50/1471114
aaataaaaat

SEQ ID NO: 174091 - DNA, 10 bp, Unknown
  misc_feature (1)..( 10): Result.005 file - promoters50/1471140
ctacttcttt

SEQ ID NO: 174092 - DNA, 10 bp, Unknown
  misc_feature (1)..( 10): Result.005 file - promoters50/1471140
ctaattctga

SEQ ID NO: 174093 - DNA, 10 bp, Unknown
  misc_feature (1)..( 10): Result.005 file - promoters50/1471140
cttatttcat

SEQ ID NO: 174094 - DNA, 10 bp, Unknown
  misc_feature (1)..( 10): Result.005 file - promoters50/1471140
ttaaatctaa

SEQ ID NO: 174095 - DNA, 11 bp, Unknown
  misc_feature (1)..( 11): Result.005 file - promoters50/1471140
tttatatctaa

SEQ ID NO: 174096 - DNA, 8 bp, Unknown
  misc_feature (1)..( 8): Result.005 file - promoters50/1471140
caaacaaa

SEQ ID NO: 174097 - DNA, 8 bp, Unknown
  misc_feature (1)..( 8): Result.005 file - promoters50/1471140
caaacaca

SEQ ID NO: 174098 - DNA, 8 bp, Unknown
  misc_feature (1)..( 8): Result.005 file - promoters50/1471140
aaaataaa

SEQ ID NO: 174099 - DNA, 8 bp, Unknown
  misc_feature (1)..( 8): Result.005 file - promoters50/1471140
aaaacaaa

SEQ ID NO: 174100 - DNA, 8 bp, Unknown
  misc_feature (1)..( 8): Result.005 file - promoters50/1471140
gaaagaaa

SEQ ID NO: 174101 - DNA, 10 bp, Unknown
  misc_feature (1)..( 10): Result.005 file - promoters50/1471140
agttttttat

SEQ ID NO: 174102 - DNA, 10 bp, Unknown
  misc_feature (1)..( 10): Result.005 file - promoters50/1471140
gatttattac

SEQ ID NO: 174103 - DNA, 10 bp, Unknown
  misc_feature (1)..( 10): Result.005 file - promoters50/1471140
gttttatttt

SEQ ID NO: 174104 - DNA, 10 bp, Unknown
  misc_feature (1)..( 10): Result.005 file - promoters50/1471140
aatttatcaa

SEQ ID NO: 174105 - DNA, 10 bp, Unknown
  misc_feature (1)..( 10): Result.005 file - promoters50/1471140
aatttatcaa

SEQ ID NO: 174106 - DNA, 10 bp, Unknown
  misc_feature (1)..( 10): Result.005 file - promoters50/1471140
catttattca

SEQ ID NO: 174107 - DNA, 11 bp, Unknown
  misc_feature (1)..( 11): Result.005 file - promoters50/1471140
attttatttgg

SEQ ID NO: 174108 - DNA, 11 bp, Unknown
  misc_feature (1)..( 11): Result.005 file - promoters50/1471140
cacatatttga

SEQ ID NO: 174109 - DNA, 11 bp, Unknown
  misc_feature (1)..( 11): Result.005 file - promoters50/1471140
atttaatttgt

SEQ ID NO: 174110 - DNA, 11 bp, Unknown
  misc_feature (1)..( 11): Result.005 file - promoters50/1471140
aattaattttg

SEQ ID NO: 174111 - DNA, 11 bp, Unknown
  misc_feature (1)..( 11): Result.005 file - promoters50/1471140
tctctatataa

SEQ ID NO: 174112 - DNA, 13 bp, Unknown
  misc_feature (1)..( 13): Result.005 file - promoters50/1471140
ggtctatctttct

SEQ ID NO: 174113 - DNA, 13 bp, Unknown
  misc_feature (1)..( 13): Result.005 file - promoters50/1471140
gatctatatttca

SEQ ID NO: 174114 - DNA, 13 bp, Unknown
  misc_feature (1)..( 13): Result.005 file - promoters50/1471140
gatttatttaaaa

SEQ ID NO: 174115 - DNA, 13 bp, Unknown
  misc_feature (1)..( 13): Result.005 file - promoters50/1471140
catcaatacttac

SEQ ID NO: 174116 - DNA, 7 bp, Unknown
  misc_feature (1)..( 7): Result.005 file - promoters50/1471140
tatttca

SEQ ID NO: 174117 - DNA, 9 bp, Unknown
  misc_feature (1)..( 9): Result.005 file - promoters50/1472766
atgaagatt

SEQ ID NO: 174118 - DNA, 9 bp, Unknown
  misc_feature (1)..( 9): Result.005 file - promoters50/1472766
ttgaagaat

SEQ ID NO: 174119 - DNA, 9 bp, Unknown
  misc_feature (1)..( 9): Result.005 file - promoters50/1472766
ttgaaaaat

SEQ ID NO: 174120 - DNA, 8 bp, Unknown
  misc_feature (1)..( 8): Result.005 file - promoters50/1472766
aaaagaag

SEQ ID NO: 174121 - DNA, 8 bp, Unknown
  misc_feature (1)..( 8): Result.005 file - promoters50/1472766
aaaacaag

SEQ ID NO: 174122 - DNA, 8 bp, Unknown
  misc_feature (1)..( 8): Result.005 file - promoters50/1472766
caaagaag

SEQ ID NO: 174123 - DNA, 12 bp, Unknown
  misc_feature (1)..( 12): Result.005 file - promoters50/1472778
tattaattagtc

SEQ ID NO: 174124 - DNA, 12 bp, Unknown
  misc_feature (1)..( 12): Result.005 file - promoters50/1472778
gattaattcttt

SEQ ID NO: 174125 - DNA, 12 bp, Unknown
  misc_feature (1)..( 12): Result.005 file - promoters50/1472778
tatgaattggat

SEQ ID NO: 174126 - DNA, 12 bp, Unknown
  misc_feature (1)..( 12): Result.005 file - promoters50/1472778
ttttatttcttt

SEQ ID NO: 174127 - DNA, 12 bp, Unknown
  misc_feature (1)..( 12): Result.005 file - promoters50/1472778
atttaatttgta

SEQ ID NO: 174128 - DNA, 12 bp, Unknown
  misc_feature (1)..( 12): Result.005 file - promoters50/1472778
ttttattataaa

SEQ ID NO: 174129 - DNA, 13 bp, Unknown
  misc_feature (1)..( 13): Result.005 file - promoters50/1472778
ggataacttgtaa

SEQ ID NO: 174130 - DNA, 13 bp, Unknown
  misc_feature (1)..( 13): Result.005 file - promoters50/1472778
ttctttaattttc

SEQ ID NO: 174131 - DNA, 13 bp, Unknown
  misc_feature (1)..( 13): Result.005 file - promoters50/1472778
aaccttacttttt

SEQ ID NO: 174132 - DNA, 13 bp, Unknown
  misc_feature (1)..( 13): Result.005 file - promoters50/1472778
tactgtaatgttc

SEQ ID NO: 174133 - DNA, 13 bp, Unknown
  misc_feature (1)..( 13): Result.005 file - promoters50/1472778
aattttaataaac

SEQ ID NO: 174134 - DNA, 13 bp, Unknown
  misc_feature (1)..( 13): Result.005 file - promoters50/1472778
ttcattaataaga

SEQ ID NO: 174135 - DNA, 13 bp, Unknown
  misc_feature (1)..( 13): Result.005 file - promoters50/1472778
gagatttattcat

SEQ ID NO: 174136 - DNA, 13 bp, Unknown
  misc_feature (1)..( 13): Result.005 file - promoters50/1472778
aatttgaattttc

SEQ ID NO: 174137 - DNA, 13 bp, Unknown
  misc_feature (1)..( 13): Result.005 file - promoters50/1472778
taattttcgtttc

SEQ ID NO: 174138 - DNA, 13 bp, Unknown
  misc_feature (1)..( 13): Result.005 file - promoters50/1472778
tttttttagtttg

SEQ ID NO: 174139 - DNA, 13 bp, Unknown
  misc_feature (1)..( 13): Result.005 file - promoters50/1472778
taatgttcactaa

SEQ ID NO: 174140 - DNA, 13 bp, Unknown
  misc_feature (1)..( 13): Result.005 file - promoters50/1472778
ctattttatttta

SEQ ID NO: 174141 - DNA, 13 bp, Unknown
  misc_feature (1)..( 13): Result.005 file - promoters50/1472778
aatgtttatttaa

SEQ ID NO: 174142 - DNA, 13 bp, Unknown
  misc_feature (1)..( 13): Result.005 file - promoters50/1472778
gaattttcctaca

SEQ ID NO: 174143 - DNA, 13 bp, Unknown
  misc_feature (1)..( 13): Result.005 file - promoters50/1472778
agatgatcaacaa

SEQ ID NO: 174144 - DNA, 13 bp, Unknown
  misc_feature (1)..( 13): Result.005 file - promoters50/1472778
ctataaaacgtgt

SEQ ID NO: 174145 - DNA, 13 bp, Unknown
  misc_feature (1)..( 13): Result.005 file - promoters50/1472778
gtttaaaacaaag

SEQ ID NO: 174146 - DNA, 13 bp, Unknown
  misc_feature (1)..( 13): Result.005 file - promoters50/1472778
gtatataacccaa

SEQ ID NO: 174147 - DNA, 13 bp, Unknown
  misc_feature (1)..( 13): Result.005 file - promoters50/1472778
aaataaaaagttt

SEQ ID NO: 174148 - DNA, 13 bp, Unknown
  misc_feature (1)..( 13): Result.005 file - promoters50/1472778
gtatattattaat

SEQ ID NO: 174149 - DNA, 13 bp, Unknown
  misc_feature (1)..( 13): Result.005 file - promoters50/1472778
cagcaaaacgaag

SEQ ID NO: 174150 - DNA, 13 bp, Unknown
  misc_feature (1)..( 13): Result.005 file - promoters50/1472778
ggttaaaaaagaa

SEQ ID NO: 174151 - DNA, 13 bp, Unknown
  misc_feature (1)..( 13): Result.005 file - promoters50/1472778
ggctaaaaatgac

SEQ ID NO: 174152 - DNA, 11 bp, Unknown
  misc_feature (1)..( 11): Result.005 file - promoters50/1472778
ggttattaatt

SEQ ID NO: 174153 - DNA, 11 bp, Unknown
  misc_feature (1)..( 11): Result.005 file - promoters50/1472778
ttttattataa

SEQ ID NO: 174154 - DNA, 11 bp, Unknown
  misc_feature (1)..( 11): Result.005 file - promoters50/1472778
agatatgaatt

SEQ ID NO: 174155 - DNA, 11 bp, Unknown
  misc_feature (1)..( 11): Result.005 file - promoters50/1472778
ttagatggatt

SEQ ID NO: 174156 - DNA, 11 bp, Unknown
  misc_feature (1)..( 11): Result.005 file - promoters50/1472778
attaatgtatt

SEQ ID NO: 174157 - DNA, 11 bp, Unknown
  misc_feature (1)..( 11): Result.005 file - promoters50/1472778
ctaaatggata

SEQ ID NO: 174158 - DNA, 11 bp, Unknown
  misc_feature (1)..( 11): Result.005 file - promoters50/1472778
ttttatttctt

SEQ ID NO: 174159 - DNA, 9 bp, Unknown
  misc_feature (1)..( 9): Result.005 file - promoters50/1472778
ctacagttc

SEQ ID NO: 174160 - DNA, 9 bp, Unknown
  misc_feature (1)..( 9): Result.005 file - promoters50/1472778
atacagtta

SEQ ID NO: 174161 - DNA, 9 bp, Unknown
  misc_feature (1)..( 9): Result.005 file - promoters50/1472778
aaacactta

SEQ ID NO: 174162 - DNA, 9 bp, Unknown
  misc_feature (1)..( 9): Result.005 file - promoters50/1472778
ataaagtta

SEQ ID NO: 174163 - DNA, 9 bp, Unknown
  misc_feature (1)..( 9): Result.005 file - promoters50/1472778
atacagtat

SEQ ID NO: 174164 - DNA, 9 bp, Unknown
  misc_feature (1)..( 9): Result.005 file - promoters50/1472778
tgacagtaa

SEQ ID NO: 174165 - DNA, 11 bp, Unknown
  misc_feature (1)..( 11): Result.005 file - promoters50/1472778
ttttatataaa

SEQ ID NO: 174166 - DNA, 11 bp, Unknown
  misc_feature (1)..( 11): Result.005 file - promoters50/1472778
taaaatagaaa

SEQ ID NO: 174167 - DNA, 11 bp, Unknown
  misc_feature (1)..( 11): Result.005 file - promoters50/1472778
tttcataaaaa

SEQ ID NO: 174168 - DNA, 11 bp, Unknown
  misc_feature (1)..( 11): Result.005 file - promoters50/1472778
acgcatgaaat

SEQ ID NO: 174169 - DNA, 11 bp, Unknown
  misc_feature (1)..( 11): Result.005 file - promoters50/1472778
ataaatataaa

SEQ ID NO: 174170 - DNA, 11 bp, Unknown
  misc_feature (1)..( 11): Result.005 file - promoters50/1472778
gataagaaaaa

SEQ ID NO: 174171 - DNA, 10 bp, Unknown
  misc_feature (1)..( 10): Result.005 file - promoters50/1472778
gaatcacttc

SEQ ID NO: 174172 - DNA, 10 bp, Unknown
  misc_feature (1)..( 10): Result.005 file - promoters50/1472778
gaaacactta

SEQ ID NO: 174173 - DNA, 10 bp, Unknown
  misc_feature (1)..( 10): Result.005 file - promoters50/1472778
gatacagtta

SEQ ID NO: 174174 - DNA, 10 bp, Unknown
  misc_feature (1)..( 10): Result.005 file - promoters50/1472778
tataaagtta

SEQ ID NO: 174175 - DNA, 10 bp, Unknown
  misc_feature (1)..( 10): Result.005 file - promoters50/1472778
gatacagtat

SEQ ID NO: 174176 - DNA, 10 bp, Unknown
  misc_feature (1)..( 10): Result.005 file - promoters50/1472778
atgacagtaa

SEQ ID NO: 174177 - DNA, 13 bp, Unknown
  misc_feature (1)..( 13): Result.005 file - promoters50/1472778
caaaatagacaaa

SEQ ID NO: 174178 - DNA, 13 bp, Unknown
  misc_feature (1)..( 13): Result.005 file - promoters50/1472778
taaaaaagaaata

SEQ ID NO: 174179 - DNA, 13 bp, Unknown
  misc_feature (1)..( 13): Result.005 file - promoters50/1472778
acaaaaagaaaaa

SEQ ID NO: 174180 - DNA, 13 bp, Unknown
  misc_feature (1)..( 13): Result.005 file - promoters50/1472778
taaaaaaactaat

SEQ ID NO: 174181 - DNA, 13 bp, Unknown
  misc_feature (1)..( 13): Result.005 file - promoters50/1472778
ggcaaaagataag

SEQ ID NO: 174182 - DNA, 13 bp, Unknown
  misc_feature (1)..( 13): Result.005 file - promoters50/1472778
ataaataaaagaa

SEQ ID NO: 174183 - DNA, 16 bp, Unknown
  misc_feature (1)..( 16): Result.005 file - promoters50/1472778
agctgtgttatattga

SEQ ID NO: 174184 - DNA, 16 bp, Unknown
  misc_feature (1)..( 16): Result.005 file - promoters50/1472778
ttattttttaaattag

SEQ ID NO: 174185 - DNA, 16 bp, Unknown
  misc_feature (1)..( 16): Result.005 file - promoters50/1472778
ctaacgtttatatata

SEQ ID NO: 174186 - DNA, 16 bp, Unknown
  misc_feature (1)..( 16): Result.005 file - promoters50/1472778
aacctttttataatca

SEQ ID NO: 174187 - DNA, 16 bp, Unknown
  misc_feature (1)..( 16): Result.005 file - promoters50/1472778
caaacaataaaattaa

SEQ ID NO: 174188 - DNA, 16 bp, Unknown
  misc_feature (1)..( 16): Result.005 file - promoters50/1472778
ttaataattaaattaa

SEQ ID NO: 174189 - DNA, 8 bp, Unknown
  misc_feature (1)..( 8): Result.005 file - promoters50/1472799
atcatatt

SEQ ID NO: 174190 - DNA, 8 bp, Unknown
  misc_feature (1)..( 8): Result.005 file - promoters50/1472799
atcatatt

SEQ ID NO: 174191 - DNA, 8 bp, Unknown
  misc_feature (1)..( 8): Result.005 file - promoters50/1472799
atcatatt

SEQ ID NO: 174192 - DNA, 8 bp, Unknown
  misc_feature (1)..( 8): Result.005 file - promoters50/1472799
gatttgtt

SEQ ID NO: 174193 - DNA, 8 bp, Unknown
  misc_feature (1)..( 8): Result.005 file - promoters50/1472799
gatatgta

SEQ ID NO: 174194 - DNA, 8 bp, Unknown
  misc_feature (1)..( 8): Result.005 file - promoters50/1472799
tgtttgtt

SEQ ID NO: 174195 - DNA, 12 bp, Unknown
  misc_feature (1)..( 12): Result.005 file - promoters50/1472799
agtttgttcaat

SEQ ID NO: 174196 - DNA, 12 bp, Unknown
  misc_feature (1)..( 12): Result.005 file - promoters50/1472799
agtatgttgttg

SEQ ID NO: 174197 - DNA, 12 bp, Unknown
  misc_feature (1)..( 12): Result.005 file - promoters50/1472799
gatttgttcaat

SEQ ID NO: 174198 - DNA, 7 bp, Unknown
  misc_feature (1)..( 7): Result.005 file - promoters50/1472799
tgtttgg

SEQ ID NO: 174199 - DNA, 7 bp, Unknown
  misc_feature (1)..( 7): Result.005 file - promoters50/1472799
tgtttgt

SEQ ID NO: 174200 - DNA, 7 bp, Unknown
  misc_feature (1)..( 7): Result.005 file - promoters50/1472799
agtttgt

SEQ ID NO: 174201 - DNA, 6 bp, Unknown
  misc_feature (1)..( 6): Result.005 file - promoters50/1472799
tttgtt

SEQ ID NO: 174202 - DNA, 6 bp, Unknown
  misc_feature (1)..( 6): Result.005 file - promoters50/1472799
tttgtt

SEQ ID NO: 174203 - DNA, 6 bp, Unknown
  misc_feature (1)..( 6): Result.005 file - promoters50/1472799
tttgtt

SEQ ID NO: 174204 - DNA, 9 bp, Unknown
  misc_feature (1)..( 9): Result.005 file - promoters50/1472799
tttgttgtg

SEQ ID NO: 174205 - DNA, 9 bp, Unknown
  misc_feature (1)..( 9): Result.005 file - promoters50/1472799
tttgtagtg

SEQ ID NO: 174206 - DNA, 9 bp, Unknown
  misc_feature (1)..( 9): Result.005 file - promoters50/1472799
attgtagct

SEQ ID NO: 174207 - DNA, 8 bp, Unknown
  misc_feature (1)..( 8): Result.005 file - promoters50/1472799
tgatttgg

SEQ ID NO: 174208 - DNA, 8 bp, Unknown
  misc_feature (1)..( 8): Result.005 file - promoters50/1472799
tgatttgt

SEQ ID NO: 174209 - DNA, 8 bp, Unknown
  misc_feature (1)..( 8): Result.005 file - promoters50/1472799
agatatgt

SEQ ID NO: 174210 - DNA, 8 bp, Unknown
  misc_feature (1)..( 8): Result.005 file - promoters50/1472908
aaaaattt

SEQ ID NO: 174211 - DNA, 8 bp, Unknown
  misc_feature (1)..( 8): Result.005 file - promoters50/1472908
aaaacttt

SEQ ID NO: 174212 - DNA, 8 bp, Unknown
  misc_feature (1)..( 8): Result.005 file - promoters50/1472908
aaaaaacc

SEQ ID NO: 174213 - DNA, 8 bp, Unknown
  misc_feature (1)..( 8): Result.005 file - promoters50/1472908
gaagaaaa

SEQ ID NO: 174214 - DNA, 8 bp, Unknown
  misc_feature (1)..( 8): Result.005 file - promoters50/1472908
gaagaaaa

SEQ ID NO: 174215 - DNA, 8 bp, Unknown
  misc_feature (1)..( 8): Result.005 file - promoters50/1472908
taagaaag

SEQ ID NO: 174216 - DNA, 8 bp, Unknown
  misc_feature (1)..( 8): Result.005 file - promoters50/1472908
taaaaaaa

SEQ ID NO: 174217 - DNA, 9 bp, Unknown
  misc_feature (1)..( 9): Result.005 file - promoters50/1472908
tttttaaaa

SEQ ID NO: 174218 - DNA, 9 bp, Unknown
  misc_feature (1)..( 9): Result.005 file - promoters50/1472908
tttataaac

SEQ ID NO: 174219 - DNA, 9 bp, Unknown
  misc_feature (1)..( 9): Result.005 file - promoters50/1472908
tatataaac

SEQ ID NO: 174220 - DNA, 11 bp, Unknown
  misc_feature (1)..( 11): Result.005 file - promoters50/1472908
aattaaggaaa

SEQ ID NO: 174221 - DNA, 11 bp, Unknown
  misc_feature (1)..( 11): Result.005 file - promoters50/1472908
aattaattttt

SEQ ID NO: 174222 - DNA, 11 bp, Unknown
  misc_feature (1)..( 11): Result.005 file - promoters50/1472908
gattgattttt

SEQ ID NO: 174223 - DNA, 9 bp, Unknown
  misc_feature (1)..( 9): Result.005 file - promoters50/1472908
attttctgt

SEQ ID NO: 174224 - DNA, 9 bp, Unknown
  misc_feature (1)..( 9): Result.005 file - promoters50/1472908
attttgtgt

SEQ ID NO: 174225 - DNA, 9 bp, Unknown
  misc_feature (1)..( 9): Result.005 file - promoters50/1472908
actgtatgt

SEQ ID NO: 174226 - DNA, 8 bp, Unknown
  misc_feature (1)..( 8): Result.005 file - promoters50/1472908
cttgtaga

SEQ ID NO: 174227 - DNA, 8 bp, Unknown
  misc_feature (1)..( 8): Result.005 file - promoters50/1472908
attgtagt

SEQ ID NO: 174228 - DNA, 8 bp, Unknown
  misc_feature (1)..( 8): Result.005 file - promoters50/1472908
cttgtaga

SEQ ID NO: 174229 - DNA, 8 bp, Unknown
  misc_feature (1)..( 8): Result.005 file - promoters50/1472908
aatttaac

SEQ ID NO: 174230 - DNA, 8 bp, Unknown
  misc_feature (1)..( 8): Result.005 file - promoters50/1472908
aatttaat

SEQ ID NO: 174231 - DNA, 8 bp, Unknown
  misc_feature (1)..( 8): Result.005 file - promoters50/1472908
tgtttaat

SEQ ID NO: 174232 - DNA, 10 bp, Unknown
  misc_feature (1)..( 10): Result.005 file - promoters50/1472908
ttttataatg

SEQ ID NO: 174233 - DNA, 10 bp, Unknown
  misc_feature (1)..( 10): Result.005 file - promoters50/1472908
ttttatgttt

SEQ ID NO: 174234 - DNA, 10 bp, Unknown
  misc_feature (1)..( 10): Result.005 file - promoters50/1472908
gtttctgttt

SEQ ID NO: 174235 - DNA, 10 bp, Unknown
  misc_feature (1)..( 10): Result.005 file - promoters50/1472908
ataatgattt

SEQ ID NO: 174236 - DNA, 10 bp, Unknown
  misc_feature (1)..( 10): Result.005 file - promoters50/1472908
tttatgtttt

SEQ ID NO: 174237 - DNA, 10 bp, Unknown
  misc_feature (1)..( 10): Result.005 file - promoters50/1472908
tttctgtttc

SEQ ID NO: 174238 - DNA, 8 bp, Unknown
  misc_feature (1)..( 8): Result.005 file - promoters50/1472908
gaaaaaaa

SEQ ID NO: 174239 - DNA, 8 bp, Unknown
  misc_feature (1)..( 8): Result.005 file - promoters50/1472908
taaaaaaa

SEQ ID NO: 174240 - DNA, 8 bp, Unknown
  misc_feature (1)..( 8): Result.005 file - promoters50/1472908
taagaaag

SEQ ID NO: 174241 - DNA, 13 bp, Unknown
  misc_feature (1)..( 13): Result.005 file - promoters50/1473010
acaaacacttaaa

SEQ ID NO: 174242 - DNA, 13 bp, Unknown
  misc_feature (1)..( 13): Result.005 file - promoters50/1473010
acaaaaactttat

SEQ ID NO: 174243 - DNA, 13 bp, Unknown
  misc_feature (1)..( 13): Result.005 file - promoters50/1473010
attaaaatttaat

SEQ ID NO: 174244 - DNA, 13 bp, Unknown
  misc_feature (1)..( 13): Result.005 file - promoters50/1473010
acacaaattcgag

SEQ ID NO: 174245 - DNA, 13 bp, Unknown
  misc_feature (1)..( 13): Result.005 file - promoters50/1473010
aaacgaattaaat

SEQ ID NO: 174246 - DNA, 8 bp, Unknown
  misc_feature (1)..( 8): Result.005 file - promoters50/1473010
aataaatt

SEQ ID NO: 174247 - DNA, 8 bp, Unknown
  misc_feature (1)..( 8): Result.005 file - promoters50/1473010
aataaaaa

SEQ ID NO: 174248 - DNA, 8 bp, Unknown
  misc_feature (1)..( 8): Result.005 file - promoters50/1473010
cataaaaa

SEQ ID NO: 174249 - DNA, 8 bp, Unknown
  misc_feature (1)..( 8): Result.005 file - promoters50/1473010
tatacaaa

SEQ ID NO: 174250 - DNA, 8 bp, Unknown
  misc_feature (1)..( 8): Result.005 file - promoters50/1473010
ttattaat

SEQ ID NO: 174251 - DNA, 8 bp, Unknown
  misc_feature (1)..( 8): Result.005 file - promoters50/1473010
ttattaaa

SEQ ID NO: 174252 - DNA, 8 bp, Unknown
  misc_feature (1)..( 8): Result.005 file - promoters50/1473010
gaattaaa

SEQ ID NO: 174253 - DNA, 8 bp, Unknown
  misc_feature (1)..( 8): Result.005 file - promoters50/1473010
ttatattc

SEQ ID NO: 174254 - DNA, 8 bp, Unknown
  misc_feature (1)..( 8): Result.005 file - promoters50/1473010
attaaagt

SEQ ID NO: 174255 - DNA, 8 bp, Unknown
  misc_feature (1)..( 8): Result.005 file - promoters50/1473010
attaaatt

SEQ ID NO: 174256 - DNA, 8 bp, Unknown
  misc_feature (1)..( 8): Result.005 file - promoters50/1473010
attaaaat

SEQ ID NO: 174257 - DNA, 8 bp, Unknown
  misc_feature (1)..( 8): Result.005 file - promoters50/1473010
tttatatt

SEQ ID NO: 174258 - DNA, 7 bp, Unknown
  misc_feature (1)..( 7): Result.005 file - promoters50/1473014
aagtcat

SEQ ID NO: 174259 - DNA, 7 bp, Unknown
  misc_feature (1)..( 7): Result.005 file - promoters50/1473014
aagtcag

SEQ ID NO: 174260 - DNA, 7 bp, Unknown
  misc_feature (1)..( 7): Result.005 file - promoters50/1473014
gagtcat

SEQ ID NO: 174261 - DNA, 13 bp, Unknown
  misc_feature (1)..( 13): Result.005 file - promoters50/1473014
gcttcttcaccca

SEQ ID NO: 174262 - DNA, 13 bp, Unknown
  misc_feature (1)..( 13): Result.005 file - promoters50/1473014
gcttattcactct

SEQ ID NO: 174263 - DNA, 13 bp, Unknown
  misc_feature (1)..( 13): Result.005 file - promoters50/1473014
acatgttcgctct

SEQ ID NO: 174264 - DNA, 13 bp, Unknown
  misc_feature (1)..( 13): Result.005 file - promoters50/1473014
acccattttctgc

SEQ ID NO: 174265 - DNA, 13 bp, Unknown
  misc_feature (1)..( 13): Result.005 file - promoters50/1473014
tagtcttttgtgc

SEQ ID NO: 174266 - DNA, 13 bp, Unknown
  misc_feature (1)..( 13): Result.005 file - promoters50/1473014
cccagtttcattg

SEQ ID NO: 174267 - DNA, 9 bp, Unknown
  misc_feature (1)..( 9): Result.005 file - promoters50/1473014
catatctaa

SEQ ID NO: 174268 - DNA, 9 bp, Unknown
  misc_feature (1)..( 9): Result.005 file - promoters50/1473014
tataactaa

SEQ ID NO: 174269 - DNA, 9 bp, Unknown
  misc_feature (1)..( 9): Result.005 file - promoters50/1473014
tataacatt

SEQ ID NO: 174270 - DNA, 9 bp, Unknown
  misc_feature (1)..( 9): Result.005 file - promoters50/1473014
catatcatc

SEQ ID NO: 174271 - DNA, 10 bp, Unknown
  misc_feature (1)..( 10): Result.005 file - promoters50/1473014
ttataactaa

SEQ ID NO: 174272 - DNA, 10 bp, Unknown
  misc_feature (1)..( 10): Result.005 file - promoters50/1473014
ttaaaaccct

SEQ ID NO: 174273 - DNA, 10 bp, Unknown
  misc_feature (1)..( 10): Result.005 file - promoters50/1473014
aaaaaaccct

SEQ ID NO: 174274 - DNA, 6 bp, Unknown
  misc_feature (1)..( 6): Result.005 file - promoters50/1473014
catttt

SEQ ID NO: 174275 - DNA, 6 bp, Unknown
  misc_feature (1)..( 6): Result.005 file - promoters50/1473014
catttt

SEQ ID NO: 174276 - DNA, 7 bp, Unknown
  misc_feature (1)..( 7): Result.005 file - promoters50/1473014
catattt

SEQ ID NO: 174277 - DNA, 7 bp, Unknown
  misc_feature (1)..( 7): Result.005 file - promoters50/1473050
atttttt

SEQ ID NO: 174278 - DNA, 7 bp, Unknown
  misc_feature (1)..( 7): Result.005 file - promoters50/1473050
atttttt

SEQ ID NO: 174279 - DNA, 7 bp, Unknown
  misc_feature (1)..( 7): Result.005 file - promoters50/1473050
atttttt

SEQ ID NO: 174280 - DNA, 7 bp, Unknown
  misc_feature (1)..( 7): Result.005 file - promoters50/1473050
gatgaaa

SEQ ID NO: 174281 - DNA, 7 bp, Unknown
  misc_feature (1)..( 7): Result.005 file - promoters50/1473050
gataaaa

SEQ ID NO: 174282 - DNA, 7 bp, Unknown
  misc_feature (1)..( 7): Result.005 file - promoters50/1473050
tatgaaa

SEQ ID NO: 174283 - DNA, 9 bp, Unknown
  misc_feature (1)..( 9): Result.005 file - promoters50/1473050
ttaaattat

SEQ ID NO: 174284 - DNA, 9 bp, Unknown
  misc_feature (1)..( 9): Result.005 file - promoters50/1473050
ttaaatccg

SEQ ID NO: 174285 - DNA, 9 bp, Unknown
  misc_feature (1)..( 9): Result.005 file - promoters50/1473050
ataaagtat

SEQ ID NO: 174286 - DNA, 8 bp, Unknown
  misc_feature (1)..( 8): Result.005 file - promoters50/1473050
aaaaccaa

SEQ ID NO: 174287 - DNA, 8 bp, Unknown
  misc_feature (1)..( 8): Result.005 file - promoters50/1473050
caaatcaa

SEQ ID NO: 174288 - DNA, 8 bp, Unknown
  misc_feature (1)..( 8): Result.005 file - promoters50/1473050
aaaaccta

SEQ ID NO: 174289 - DNA, 11 bp, Unknown
  misc_feature (1)..( 11): Result.005 file - promoters50/1473050
aaatcaaaatt

SEQ ID NO: 174290 - DNA, 11 bp, Unknown
  misc_feature (1)..( 11): Result.005 file - promoters50/1473050
aaatcataatg

SEQ ID NO: 174291 - DNA, 11 bp, Unknown
  misc_feature (1)..( 11): Result.005 file - promoters50/1473050
caaaaataatg

SEQ ID NO: 174292 - DNA, 7 bp, Unknown
  misc_feature (1)..( 7): Result.005 file - promoters50/1481416
accaaac

SEQ ID NO: 174293 - DNA, 7 bp, Unknown
  misc_feature (1)..( 7): Result.005 file - promoters50/1481416
accaaag

SEQ ID NO: 174294 - DNA, 7 bp, Unknown
  misc_feature (1)..( 7): Result.005 file - promoters50/1481416
accaaac

SEQ ID NO: 174295 - DNA, 7 bp, Unknown
  misc_feature (1)..( 7): Result.005 file - promoters50/1481416
ttaaaaa

SEQ ID NO: 174296 - DNA, 7 bp, Unknown
  misc_feature (1)..( 7): Result.005 file - promoters50/1481416
ttaaaat

SEQ ID NO: 174297 - DNA, 7 bp, Unknown
  misc_feature (1)..( 7): Result.005 file - promoters50/1481416
ataaaat

SEQ ID NO: 174298 - DNA, 12 bp, Unknown
  misc_feature (1)..( 12): Result.005 file - promoters50/1481416
aaggaatcaaac

SEQ ID NO: 174299 - DNA, 12 bp, Unknown
  misc_feature (1)..( 12): Result.005 file - promoters50/1481416
cttgaaccaaac

SEQ ID NO: 174300 - DNA, 12 bp, Unknown
  misc_feature (1)..( 12): Result.005 file - promoters50/1481416
aagcaattaaat

SEQ ID NO: 174301 - DNA, 9 bp, Unknown
  misc_feature (1)..( 9): Result.005 file - promoters50/1481416
ctatataaa

SEQ ID NO: 174302 - DNA, 9 bp, Unknown
  misc_feature (1)..( 9): Result.005 file - promoters50/1481416
caatataaa

SEQ ID NO: 174303 - DNA, 9 bp, Unknown
  misc_feature (1)..( 9): Result.005 file - promoters50/1481416
ctatataat

SEQ ID NO: 174304 - DNA, 7 bp, Unknown
  misc_feature (1)..( 7): Result.005 file - promoters50/1481416
aaaaata

SEQ ID NO: 174305 - DNA, 7 bp, Unknown
  misc_feature (1)..( 7): Result.005 file - promoters50/1481416
taaaata

SEQ ID NO: 174306 - DNA, 7 bp, Unknown
  misc_feature (1)..( 7): Result.005 file - promoters50/1481416
taaaatt

SEQ ID NO: 174307 - DNA, 7 bp, Unknown
  misc_feature (1)..( 7): Result.005 file - promoters50/1481416
aaaaaaa

SEQ ID NO: 174308 - DNA, 7 bp, Unknown
  misc_feature (1)..( 7): Result.005 file - promoters50/1481416
aaaaaat

SEQ ID NO: 174309 - DNA, 7 bp, Unknown
  misc_feature (1)..( 7): Result.005 file - promoters50/1481416
aaagaat

SEQ ID NO: 174310 - DNA, 9 bp, Unknown
  misc_feature (1)..( 9): Result.005 file - promoters50/1481516
gaggaagaa

SEQ ID NO: 174311 - DNA, 9 bp, Unknown
  misc_feature (1)..( 9): Result.005 file - promoters50/1481516
gaggaagat

SEQ ID NO: 174312 - DNA, 9 bp, Unknown
  misc_feature (1)..( 9): Result.005 file - promoters50/1481516
aaagaagaa

SEQ ID NO: 174313 - DNA, 7 bp, Unknown
  misc_feature (1)..( 7): Result.005 file - promoters50/1481516
tgttgcc

SEQ ID NO: 174314 - DNA, 7 bp, Unknown
  misc_feature (1)..( 7): Result.005 file - promoters50/1481516
tgttgct

SEQ ID NO: 174315 - DNA, 7 bp, Unknown
  misc_feature (1)..( 7): Result.005 file - promoters50/1481516
cgttgcc

SEQ ID NO: 174316 - DNA, 9 bp, Unknown
  misc_feature (1)..( 9): Result.005 file - promoters50/1481544
aaattgaca

SEQ ID NO: 174317 - DNA, 9 bp, Unknown
  misc_feature (1)..( 9): Result.005 file - promoters50/1481544
aaagtgatt

SEQ ID NO: 174318 - DNA, 9 bp, Unknown
  misc_feature (1)..( 9): Result.005 file - promoters50/1481544
atagttatt

SEQ ID NO: 174319 - DNA, 9 bp, Unknown
  misc_feature (1)..( 9): Result.005 file - promoters50/1481568
aagagtaag

SEQ ID NO: 174320 - DNA, 9 bp, Unknown
  misc_feature (1)..( 9): Result.005 file - promoters50/1481568
aagagtaaa

SEQ ID NO: 174321 - DNA, 9 bp, Unknown
  misc_feature (1)..( 9): Result.005 file - promoters50/1481568
ataagtaaa

SEQ ID NO: 174322 - DNA, 10 bp, Unknown
  misc_feature (1)..( 10): Result.005 file - promoters50/1481568
cgaattgaag

SEQ ID NO: 174323 - DNA, 10 bp, Unknown
  misc_feature (1)..( 10): Result.005 file - promoters50/1481568
ggaaatgaaa

SEQ ID NO: 174324 - DNA, 10 bp, Unknown
  misc_feature (1)..( 10): Result.005 file - promoters50/1481568
ggaaaagaaa

SEQ ID NO: 174325 - DNA, 9 bp, Unknown
  misc_feature (1)..( 9): Result.005 file - promoters50/1481572
agaatttgt

SEQ ID NO: 174326 - DNA, 9 bp, Unknown
  misc_feature (1)..( 9): Result.005 file - promoters50/1481572
agaatctgt

SEQ ID NO: 174327 - DNA, 9 bp, Unknown
  misc_feature (1)..( 9): Result.005 file - promoters50/1481572
acaatatgt

SEQ ID NO: 174328 - DNA, 8 bp, Unknown
  misc_feature (1)..( 8): Result.005 file - promoters50/1481572
ttgatatt

SEQ ID NO: 174329 - DNA, 8 bp, Unknown
  misc_feature (1)..( 8): Result.005 file - promoters50/1481572
tggatatt

SEQ ID NO: 174330 - DNA, 8 bp, Unknown
  misc_feature (1)..( 8): Result.005 file - promoters50/1481572
tggttatg

SEQ ID NO: 174331 - DNA, 11 bp, Unknown
  misc_feature (1)..( 11): Result.005 file - promoters50/1481572
caacttcgatc

SEQ ID NO: 174332 - DNA, 11 bp, Unknown
  misc_feature (1)..( 11): Result.005 file - promoters50/1481572
aaacttcatct

SEQ ID NO: 174333 - DNA, 11 bp, Unknown
  misc_feature (1)..( 11): Result.005 file - promoters50/1481572
aaagttcatct

SEQ ID NO: 174334 - DNA, 8 bp, Unknown
  misc_feature (1)..( 8): Result.005 file - promoters50/1481576
atttattt

SEQ ID NO: 174335 - DNA, 8 bp, Unknown
  misc_feature (1)..( 8): Result.005 file - promoters50/1481576
ttttgttt

SEQ ID NO: 174336 - DNA, 8 bp, Unknown
  misc_feature (1)..( 8): Result.005 file - promoters50/1481576
ttttgttg

SEQ ID NO: 174337 - DNA, 9 bp, Unknown
  misc_feature (1)..( 9): Result.005 file - promoters50/1481576
atatttgta

SEQ ID NO: 174338 - DNA, 9 bp, Unknown
  misc_feature (1)..( 9): Result.005 file - promoters50/1481576
atattagta

SEQ ID NO: 174339 - DNA, 9 bp, Unknown
  misc_feature (1)..( 9): Result.005 file - promoters50/1481576
ttattaagg

SEQ ID NO: 174340 - DNA, 12 bp, Unknown
  misc_feature (1)..( 12): Result.005 file - promoters50/1481606
ttttctaattaa

SEQ ID NO: 174341 - DNA, 12 bp, Unknown
  misc_feature (1)..( 12): Result.005 file - promoters50/1481606
aaacataaataa

SEQ ID NO: 174342 - DNA, 12 bp, Unknown
  misc_feature (1)..( 12): Result.005 file - promoters50/1481606
ttttctatttag

SEQ ID NO: 174343 - DNA, 12 bp, Unknown
  misc_feature (1)..( 12): Result.005 file - promoters50/1481606
aaacataaataa

SEQ ID NO: 174344 - DNA, 9 bp, Unknown
  misc_feature (1)..( 9): Result.005 file - promoters50/1481606
ttgcaactt

SEQ ID NO: 174345 - DNA, 9 bp, Unknown
  misc_feature (1)..( 9): Result.005 file - promoters50/1481606
taacaactt

SEQ ID NO: 174346 - DNA, 9 bp, Unknown
  misc_feature (1)..( 9): Result.005 file - promoters50/1481606
taacatctt

SEQ ID NO: 174347 - DNA, 7 bp, Unknown
  misc_feature (1)..( 7): Result.005 file - promoters50/1481606
atgatga

SEQ ID NO: 174348 - DNA, 7 bp, Unknown
  misc_feature (1)..( 7): Result.005 file - promoters50/1481606
atgttga

SEQ ID NO: 174349 - DNA, 7 bp, Unknown
  misc_feature (1)..( 7): Result.005 file - promoters50/1481606
atgttgc

SEQ ID NO: 174350 - DNA, 8 bp, Unknown
  misc_feature (1)..( 8): Result.005 file - promoters50/1481606
acatattt

SEQ ID NO: 174351 - DNA, 8 bp, Unknown
  misc_feature (1)..( 8): Result.005 file - promoters50/1481606
taatattt

SEQ ID NO: 174352 - DNA, 8 bp, Unknown
  misc_feature (1)..( 8): Result.005 file - promoters50/1481606
taatatta

SEQ ID NO: 174353 - DNA, 7 bp, Unknown
  misc_feature (1)..( 7): Result.005 file - promoters50/1481606
atgatgc

SEQ ID NO: 174354 - DNA, 7 bp, Unknown
  misc_feature (1)..( 7): Result.005 file - promoters50/1481606
atgttgc

SEQ ID NO: 174355 - DNA, 7 bp, Unknown
  misc_feature (1)..( 7): Result.005 file - promoters50/1481606
atgttga

SEQ ID NO: 174356 - DNA, 8 bp, Unknown
  misc_feature (1)..( 8): Result.005 file - promoters50/1481606
ttcttttc

SEQ ID NO: 174357 - DNA, 8 bp, Unknown
  misc_feature (1)..( 8): Result.005 file - promoters50/1481606
ttcgtttc

SEQ ID NO: 174358 - DNA, 8 bp, Unknown
  misc_feature (1)..( 8): Result.005 file - promoters50/1481606
ttctttaa

SEQ ID NO: 174359 - DNA, 11 bp, Unknown
  misc_feature (1)..( 11): Result.005 file - promoters50/1481658
taaaatgaata

SEQ ID NO: 174360 - DNA, 11 bp, Unknown
  misc_feature (1)..( 11): Result.005 file - promoters50/1481658
agaaatcaatg

SEQ ID NO: 174361 - DNA, 11 bp, Unknown
  misc_feature (1)..( 11): Result.005 file - promoters50/1481658
caaaatcatgg

SEQ ID NO: 174362 - DNA, 11 bp, Unknown
  misc_feature (1)..( 11): Result.005 file - promoters50/1481658
caaaaccatcc

SEQ ID NO: 174363 - DNA, 11 bp, Unknown
  misc_feature (1)..( 11): Result.005 file - promoters50/1481658
gcacaccctcc

SEQ ID NO: 174364 - DNA, 10 bp, Unknown
  misc_feature (1)..( 10): Result.005 file - promoters50/1481658
aaaatccatc

SEQ ID NO: 174365 - DNA, 10 bp, Unknown
  misc_feature (1)..( 10): Result.005 file - promoters50/1481658
aaaatcatgg

SEQ ID NO: 174366 - DNA, 10 bp, Unknown
  misc_feature (1)..( 10): Result.005 file - promoters50/1481658
aaaaccatcc

SEQ ID NO: 174367 - DNA, 10 bp, Unknown
  misc_feature (1)..( 10): Result.005 file - promoters50/1481658
gaaatcaatg

SEQ ID NO: 174368 - DNA, 10 bp, Unknown
  misc_feature (1)..( 10): Result.005 file - promoters50/1481658
cacaccctcc

SEQ ID NO: 174369 - DNA, 14 bp, Unknown
  misc_feature (1)..( 14): Result.005 file - promoters50/1481696
tacgttaaaaataa

SEQ ID NO: 174370 - DNA, 14 bp, Unknown
  misc_feature (1)..( 14): Result.005 file - promoters50/1481696
aactttaaaaactt

SEQ ID NO: 174371 - DNA, 14 bp, Unknown
  misc_feature (1)..( 14): Result.005 file - promoters50/1481696
cgatgtaaaaatta

SEQ ID NO: 174372 - DNA, 14 bp, Unknown
  misc_feature (1)..( 14): Result.005 file - promoters50/1481696
ttatttcaaatgac

SEQ ID NO: 174373 - DNA, 14 bp, Unknown
  misc_feature (1)..( 14): Result.005 file - promoters50/1481696
aactttgaaagcaa

SEQ ID NO: 174374 - DNA, 14 bp, Unknown
  misc_feature (1)..( 14): Result.005 file - promoters50/1481696
aacaacaaaatact

SEQ ID NO: 174375 - DNA, 10 bp, Unknown
  misc_feature (1)..( 10): Result.005 file - promoters50/1481696
ttaaatttac

SEQ ID NO: 174376 - DNA, 10 bp, Unknown
  misc_feature (1)..( 10): Result.005 file - promoters50/1481696
atcaatttat

SEQ ID NO: 174377 - DNA, 10 bp, Unknown
  misc_feature (1)..( 10): Result.005 file - promoters50/1481696
aaaaattttt

SEQ ID NO: 174378 - DNA, 10 bp, Unknown
  misc_feature (1)..( 10): Result.005 file - promoters50/1481696
tgaaattttc

SEQ ID NO: 174379 - DNA, 10 bp, Unknown
  misc_feature (1)..( 10): Result.005 file - promoters50/1481696
tgagatttat

SEQ ID NO: 174380 - DNA, 10 bp, Unknown
  misc_feature (1)..( 10): Result.005 file - promoters50/1481696
aaaaattgta

SEQ ID NO: 174381 - DNA, 12 bp, Unknown
  misc_feature (1)..( 12): Result.005 file - promoters50/1481851
cagaaatttggt

SEQ ID NO: 174382 - DNA, 12 bp, Unknown
  misc_feature (1)..( 12): Result.005 file - promoters50/1481851
tttgtgtttggt

SEQ ID NO: 174383 - DNA, 12 bp, Unknown
  misc_feature (1)..( 12): Result.005 file - promoters50/1481851
tttctgtttggg

SEQ ID NO: 174384 - DNA, 12 bp, Unknown
  misc_feature (1)..( 12): Result.005 file - promoters50/1481851
gttctttttgac

SEQ ID NO: 174385 - DNA, 12 bp, Unknown
  misc_feature (1)..( 12): Result.005 file - promoters50/1481851
cttcctttcttc

SEQ ID NO: 174386 - DNA, 12 bp, Unknown
  misc_feature (1)..( 12): Result.005 file - promoters50/1481851
ggtccattctct

SEQ ID NO: 174387 - DNA, 9 bp, Unknown
  misc_feature (1)..( 9): Result.005 file - promoters50/1481930
tgtcacata

SEQ ID NO: 174388 - DNA, 9 bp, Unknown
  misc_feature (1)..( 9): Result.005 file - promoters50/1481930
atacacata

SEQ ID NO: 174389 - DNA, 9 bp, Unknown
  misc_feature (1)..( 9): Result.005 file - promoters50/1481930
atacaaata

SEQ ID NO: 174390 - DNA, 7 bp, Unknown
  misc_feature (1)..( 7): Result.005 file - promoters50/1481930
tagtgtg

SEQ ID NO: 174391 - DNA, 7 bp, Unknown
  misc_feature (1)..( 7): Result.005 file - promoters50/1481930
aagtgtg

SEQ ID NO: 174392 - DNA, 7 bp, Unknown
  misc_feature (1)..( 7): Result.005 file - promoters50/1481930
aagtgtt

SEQ ID NO: 174393 - DNA, 7 bp, Unknown
  misc_feature (1)..( 7): Result.005 file - promoters50/1481930
aatataa

SEQ ID NO: 174394 - DNA, 7 bp, Unknown
  misc_feature (1)..( 7): Result.005 file - promoters50/1481930
aatatat

SEQ ID NO: 174395 - DNA, 7 bp, Unknown
  misc_feature (1)..( 7): Result.005 file - promoters50/1481930
gatatat

SEQ ID NO: 174396 - DNA, 7 bp, Unknown
  misc_feature (1)..( 7): Result.005 file - promoters50/1481961
tcttttt

SEQ ID NO: 174397 - DNA, 7 bp, Unknown
  misc_feature (1)..( 7): Result.005 file - promoters50/1481961
tcttttg

SEQ ID NO: 174398 - DNA, 7 bp, Unknown
  misc_feature (1)..( 7): Result.005 file - promoters50/1481961
acttttt

SEQ ID NO: 174399 - DNA, 7 bp, Unknown
  misc_feature (1)..( 7): Result.005 file - promoters50/1481961
tcttttc

SEQ ID NO: 174400 - DNA, 8 bp, Unknown
  misc_feature (1)..( 8): Result.005 file - promoters50/1481961
atttctta

SEQ ID NO: 174401 - DNA, 8 bp, Unknown
  misc_feature (1)..( 8): Result.005 file - promoters50/1481961
ttttttta

SEQ ID NO: 174402 - DNA, 8 bp, Unknown
  misc_feature (1)..( 8): Result.005 file - promoters50/1481961
attttttt

SEQ ID NO: 174403 - DNA, 8 bp, Unknown
  misc_feature (1)..( 8): Result.005 file - promoters50/1481961
agttttta

SEQ ID NO: 174404 - DNA, 9 bp, Unknown
  misc_feature (1)..( 9): Result.005 file - promoters50/1481961
aatcggttc

SEQ ID NO: 174405 - DNA, 9 bp, Unknown
  misc_feature (1)..( 9): Result.005 file - promoters50/1481961
tttcgtttc

SEQ ID NO: 174406 - DNA, 9 bp, Unknown
  misc_feature (1)..( 9): Result.005 file - promoters50/1481961
ttttgtttt

SEQ ID NO: 174407 - DNA, 9 bp, Unknown
  misc_feature (1)..( 9): Result.005 file - promoters50/1481961
attcgttgt

SEQ ID NO: 174408 - DNA, 11 bp, Unknown
  misc_feature (1)..( 11): Result.005 file - promoters50/1482017
cttttgtttag

SEQ ID NO: 174409 - DNA, 11 bp, Unknown
  misc_feature (1)..( 11): Result.005 file - promoters50/1482017
tttttgtttag

SEQ ID NO: 174410 - DNA, 11 bp, Unknown
  misc_feature (1)..( 11): Result.005 file - promoters50/1482017
atttttttctt

SEQ ID NO: 174411 - DNA, 11 bp, Unknown
  misc_feature (1)..( 11): Result.005 file - promoters50/1482017
tttttgttgca

SEQ ID NO: 174412 - DNA, 12 bp, Unknown
  misc_feature (1)..( 12): Result.005 file - promoters50/1482017
tttcttgtctaa

SEQ ID NO: 174413 - DNA, 12 bp, Unknown
  misc_feature (1)..( 12): Result.005 file - promoters50/1482017
tgatttatttaa

SEQ ID NO: 174414 - DNA, 14 bp, Unknown
  misc_feature (1)..( 14): Result.005 file - promoters50/1482017
taattaaataaaca

SEQ ID NO: 174415 - DNA, 14 bp, Unknown
  misc_feature (1)..( 14): Result.005 file - promoters50/1482017
tgtttagataaaac

SEQ ID NO: 174416 - DNA, 14 bp, Unknown
  misc_feature (1)..( 14): Result.005 file - promoters50/1482017
ttgtctaataaaaa

SEQ ID NO: 174417 - DNA, 14 bp, Unknown
  misc_feature (1)..( 14): Result.005 file - promoters50/1482017
tttttatatatata

SEQ ID NO: 174418 - DNA, 14 bp, Unknown
  misc_feature (1)..( 14): Result.005 file - promoters50/1482017
tttttctatgaaca

SEQ ID NO: 174419 - DNA, 14 bp, Unknown
  misc_feature (1)..( 14): Result.005 file - promoters50/1482017
aaatacactaaaaa

SEQ ID NO: 174420 - DNA, 10 bp, Unknown
  misc_feature (1)..( 10): Result.005 file - promoters50/1482017
atttttgttt

SEQ ID NO: 174421 - DNA, 10 bp, Unknown
  misc_feature (1)..( 10): Result.005 file - promoters50/1482017
cttttttttt

SEQ ID NO: 174422 - DNA, 10 bp, Unknown
  misc_feature (1)..( 10): Result.005 file - promoters50/1482017
attgttggga

SEQ ID NO: 174423 - DNA, 10 bp, Unknown
  misc_feature (1)..( 10): Result.005 file - promoters50/1482017
atttttatat

SEQ ID NO: 174424 - DNA, 10 bp, Unknown
  misc_feature (1)..( 10): Result.005 file - promoters50/1482017
gttttttcta

SEQ ID NO: 174425 - DNA, 10 bp, Unknown
  misc_feature (1)..( 10): Result.005 file - promoters50/1482017
tgttttgtgt

SEQ ID NO: 174426 - DNA, 12 bp, Unknown
  misc_feature (1)..( 12): Result.005 file - promoters50/1482017
tcaaatatgcac

SEQ ID NO: 174427 - DNA, 12 bp, Unknown
  misc_feature (1)..( 12): Result.005 file - promoters50/1482017
gcaaatacattt

SEQ ID NO: 174428 - DNA, 12 bp, Unknown
  misc_feature (1)..( 12): Result.005 file - promoters50/1482017
caaaatattata

SEQ ID NO: 174429 - DNA, 12 bp, Unknown
  misc_feature (1)..( 12): Result.005 file - promoters50/1482017
aaaaataacagt

SEQ ID NO: 174430 - DNA, 13 bp, Unknown
  misc_feature (1)..( 13): Result.005 file - promoters50/1482017
gaaagatatagca

SEQ ID NO: 174431 - DNA, 13 bp, Unknown
  misc_feature (1)..( 13): Result.005 file - promoters50/1482017
tttaaatactttt

SEQ ID NO: 174432 - DNA, 13 bp, Unknown
  misc_feature (1)..( 13): Result.005 file - promoters50/1482017
ccataatattatt

SEQ ID NO: 174433 - DNA, 10 bp, Unknown
  misc_feature (1)..( 10): Result.005 file - promoters50/1482017
atttatggat

SEQ ID NO: 174434 - DNA, 10 bp, Unknown
  misc_feature (1)..( 10): Result.005 file - promoters50/1482017
atttattcac

SEQ ID NO: 174435 - DNA, 10 bp, Unknown
  misc_feature (1)..( 10): Result.005 file - promoters50/1482017
atttatcaag

SEQ ID NO: 174436 - DNA, 10 bp, Unknown
  misc_feature (1)..( 10): Result.005 file - promoters50/1482017
atttctcatt

SEQ ID NO: 174437 - DNA, 10 bp, Unknown
  misc_feature (1)..( 10): Result.005 file - promoters50/1482017
attgatccta

SEQ ID NO: 174438 - DNA, 10 bp, Unknown
  misc_feature (1)..( 10): Result.005 file - promoters50/1482017
gtttcacatt

SEQ ID NO: 174439 - DNA, 11 bp, Unknown
  misc_feature (1)..( 11): Result.005 file - promoters50/1482017
aaacatttttg

SEQ ID NO: 174440 - DNA, 11 bp, Unknown
  misc_feature (1)..( 11): Result.005 file - promoters50/1482017
gaacaatttat

SEQ ID NO: 174441 - DNA, 11 bp, Unknown
  misc_feature (1)..( 11): Result.005 file - promoters50/1482017
aaataatcata

SEQ ID NO: 174442 - DNA, 11 bp, Unknown
  misc_feature (1)..( 11): Result.005 file - promoters50/1482017
tgttattgttg

SEQ ID NO: 174443 - DNA, 11 bp, Unknown
  misc_feature (1)..( 11): Result.005 file - promoters50/1482017
aggtattttta

SEQ ID NO: 174444 - DNA, 11 bp, Unknown
  misc_feature (1)..( 11): Result.005 file - promoters50/1482017
acttattatta

SEQ ID NO: 174445 - DNA, 12 bp, Unknown
  misc_feature (1)..( 12): Result.005 file - promoters50/1482017
aaacagttatat

SEQ ID NO: 174446 - DNA, 12 bp, Unknown
  misc_feature (1)..( 12): Result.005 file - promoters50/1482017
atacaattaatt

SEQ ID NO: 174447 - DNA, 12 bp, Unknown
  misc_feature (1)..( 12): Result.005 file - promoters50/1482017
aaagagtttaat

SEQ ID NO: 174448 - DNA, 12 bp, Unknown
  misc_feature (1)..( 12): Result.005 file - promoters50/1482017
aaatagtaatat

SEQ ID NO: 174449 - DNA, 12 bp, Unknown
  misc_feature (1)..( 12): Result.005 file - promoters50/1482017
ataaaataacaa

SEQ ID NO: 174450 - DNA, 12 bp, Unknown
  misc_feature (1)..( 12): Result.005 file - promoters50/1482017
taaaaatagaaa

SEQ ID NO: 174451 - DNA, 9 bp, Unknown
  misc_feature (1)..( 9): Result.005 file - promoters50/1482017
cgaataaaa

SEQ ID NO: 174452 - DNA, 9 bp, Unknown
  misc_feature (1)..( 9): Result.005 file - promoters50/1482017
ataattaaa

SEQ ID NO: 174453 - DNA, 9 bp, Unknown
  misc_feature (1)..( 9): Result.005 file - promoters50/1482017
agaataaac

SEQ ID NO: 174454 - DNA, 9 bp, Unknown
  misc_feature (1)..( 9): Result.005 file - promoters50/1482017
tagataaac

SEQ ID NO: 174455 - DNA, 9 bp, Unknown
  misc_feature (1)..( 9): Result.005 file - promoters50/1482017
gtaatgaaa

SEQ ID NO: 174456 - DNA, 9 bp, Unknown
  misc_feature (1)..( 9): Result.005 file - promoters50/1482017
ataatcaaa

SEQ ID NO: 174457 - DNA, 10 bp, Unknown
  misc_feature (1)..( 10): Result.005 file - promoters50/1482025
tttaagaaaa

SEQ ID NO: 174458 - DNA, 10 bp, Unknown
  misc_feature (1)..( 10): Result.005 file - promoters50/1482025
tttaagtaaa

SEQ ID NO: 174459 - DNA, 10 bp, Unknown
  misc_feature (1)..( 10): Result.005 file - promoters50/1482025
ggaaagaaag

SEQ ID NO: 174460 - DNA, 10 bp, Unknown
  misc_feature (1)..( 10): Result.005 file - promoters50/1482025
ggtaaataaa

SEQ ID NO: 174461 - DNA, 12 bp, Unknown
  misc_feature (1)..( 12): Result.005 file - promoters50/1482025
aatcactaaatt

SEQ ID NO: 174462 - DNA, 12 bp, Unknown
  misc_feature (1)..( 12): Result.005 file - promoters50/1482025
tcaaactaaata

SEQ ID NO: 174463 - DNA, 12 bp, Unknown
  misc_feature (1)..( 12): Result.005 file - promoters50/1482025
agataataaata

SEQ ID NO: 174464 - DNA, 12 bp, Unknown
  misc_feature (1)..( 12): Result.005 file - promoters50/1482025
aataactaatca

SEQ ID NO: 174465 - DNA, 9 bp, Unknown
  misc_feature (1)..( 9): Result.005 file - promoters50/1482201
agatacagt

SEQ ID NO: 174466 - DNA, 9 bp, Unknown
  misc_feature (1)..( 9): Result.005 file - promoters50/1482201
cgatccaga

SEQ ID NO: 174467 - DNA, 9 bp, Unknown
  misc_feature (1)..( 9): Result.005 file - promoters50/1482201
ttataaagt

SEQ ID NO: 174468 - DNA, 9 bp, Unknown
  misc_feature (1)..( 9): Result.005 file - promoters50/1482201
agagacatc

SEQ ID NO: 174469 - DNA, 9 bp, Unknown
  misc_feature (1)..( 9): Result.005 file - promoters50/1482201
aaagtcaga

SEQ ID NO: 174470 - DNA, 9 bp, Unknown
  misc_feature (1)..( 9): Result.005 file - promoters50/1482201
aaagtccct

SEQ ID NO: 174471 - DNA, 10 bp, Unknown
  misc_feature (1)..( 10): Result.005 file - promoters50/1482201
tcaatgcaag

SEQ ID NO: 174472 - DNA, 10 bp, Unknown
  misc_feature (1)..( 10): Result.005 file - promoters50/1482201
acaatgaaag

SEQ ID NO: 174473 - DNA, 10 bp, Unknown
  misc_feature (1)..( 10): Result.005 file - promoters50/1482201
tcaatgctta

SEQ ID NO: 174474 - DNA, 10 bp, Unknown
  misc_feature (1)..( 10): Result.005 file - promoters50/1482201
tcaattaaaa

SEQ ID NO: 174475 - DNA, 10 bp, Unknown
  misc_feature (1)..( 10): Result.005 file - promoters50/1482201
gtgattaaat

SEQ ID NO: 174476 - DNA, 10 bp, Unknown
  misc_feature (1)..( 10): Result.005 file - promoters50/1482201
aaaatccttg

SEQ ID NO: 174477 - DNA, 9 bp, Unknown
  misc_feature (1)..( 9): Result.005 file - promoters50/1482448
caatcaaaa

SEQ ID NO: 174478 - DNA, 9 bp, Unknown
  misc_feature (1)..( 9): Result.005 file - promoters50/1482448
aaatcaatg

SEQ ID NO: 174479 - DNA, 9 bp, Unknown
  misc_feature (1)..( 9): Result.005 file - promoters50/1482448
aaataaaaa

SEQ ID NO: 174480 - DNA, 9 bp, Unknown
  misc_feature (1)..( 9): Result.005 file - promoters50/1482448
caattaaat

SEQ ID NO: 174481 - DNA, 9 bp, Unknown
  misc_feature (1)..( 9): Result.005 file - promoters50/1482448
taatcaaat

SEQ ID NO: 174482 - DNA, 9 bp, Unknown
  misc_feature (1)..( 9): Result.005 file - promoters50/1482448
gaattaatt

SEQ ID NO: 174483 - DNA, 10 bp, Unknown
  misc_feature (1)..( 10): Result.005 file - promoters50/1482448
actatatata

SEQ ID NO: 174484 - DNA, 10 bp, Unknown
  misc_feature (1)..( 10): Result.005 file - promoters50/1482448
actatataat

SEQ ID NO: 174485 - DNA, 10 bp, Unknown
  misc_feature (1)..( 10): Result.005 file - promoters50/1482448
aatatatata

SEQ ID NO: 174486 - DNA, 10 bp, Unknown
  misc_feature (1)..( 10): Result.005 file - promoters50/1482448
tctatataat

SEQ ID NO: 174487 - DNA, 10 bp, Unknown
  misc_feature (1)..( 10): Result.005 file - promoters50/1482448
ctaatataaa

SEQ ID NO: 174488 - DNA, 10 bp, Unknown
  misc_feature (1)..( 10): Result.005 file - promoters50/1482448
ccaatataat

SEQ ID NO: 174489 - DNA, 10 bp, Unknown
  misc_feature (1)..( 10): Result.005 file - promoters50/1482457
taaaaagttt

SEQ ID NO: 174490 - DNA, 10 bp, Unknown
  misc_feature (1)..( 10): Result.005 file - promoters50/1482457
aggaaatttt

SEQ ID NO: 174491 - DNA, 10 bp, Unknown
  misc_feature (1)..( 10): Result.005 file - promoters50/1482457
taaaaagttt

SEQ ID NO: 174492 - DNA, 10 bp, Unknown
  misc_feature (1)..( 10): Result.005 file - promoters50/1532660
ttaaatttgt

SEQ ID NO: 174493 - DNA, 10 bp, Unknown
  misc_feature (1)..( 10): Result.005 file - promoters50/1532660
caaaatttac

SEQ ID NO: 174494 - DNA, 10 bp, Unknown
  misc_feature (1)..( 10): Result.005 file - promoters50/1532660
ttaactttaa

SEQ ID NO: 174495 - DNA, 10 bp, Unknown
  misc_feature (1)..( 10): Result.005 file - promoters50/1532660
gtaaatttgt

SEQ ID NO: 174496 - DNA, 10 bp, Unknown
  misc_feature (1)..( 10): Result.005 file - promoters50/1532660
cttaatttgg

SEQ ID NO: 174497 - DNA, 10 bp, Unknown
  misc_feature (1)..( 10): Result.005 file - promoters50/1532660
taaaatttgt

SEQ ID NO: 174498 - DNA, 10 bp, Unknown
  misc_feature (1)..( 10): Result.005 file - promoters50/1532660
gagaatatgg

SEQ ID NO: 174499 - DNA, 12 bp, Unknown
  misc_feature (1)..( 12): Result.005 file - promoters50/1532821
tactaacatatg

SEQ ID NO: 174500 - DNA, 12 bp, Unknown
  misc_feature (1)..( 12): Result.005 file - promoters50/1532821
tactcacatatg

SEQ ID NO: 174501 - DNA, 12 bp, Unknown
  misc_feature (1)..( 12): Result.005 file - promoters50/1532821
tcaaaacataat

SEQ ID NO: 174502 - DNA, 8 bp, Unknown
  misc_feature (1)..( 8): Result.005 file - promoters50/1532821
aaatattg

SEQ ID NO: 174503 - DNA, 8 bp, Unknown
  misc_feature (1)..( 8): Result.005 file - promoters50/1532821
caatcttg

SEQ ID NO: 174504 - DNA, 9 bp, Unknown
  misc_feature (1)..( 9): Result.005 file - promoters50/1532821
aaattatcc

SEQ ID NO: 174505 - DNA, 12 bp, Unknown
  misc_feature (1)..( 12): Result.005 file - promoters50/1532821
ccatcacgcgga

SEQ ID NO: 174506 - DNA, 12 bp, Unknown
  misc_feature (1)..( 12): Result.005 file - promoters50/1532821
ccaccacttttt

SEQ ID NO: 174507 - DNA, 12 bp, Unknown
  misc_feature (1)..( 12): Result.005 file - promoters50/1532821
atacctcttttt

SEQ ID NO: 174508 - DNA, 7 bp, Unknown
  misc_feature (1)..( 7): Result.005 file - promoters50/1532823
ttaatat

SEQ ID NO: 174509 - DNA, 7 bp, Unknown
  misc_feature (1)..( 7): Result.005 file - promoters50/1532823
ttattat

SEQ ID NO: 174510 - DNA, 7 bp, Unknown
  misc_feature (1)..( 7): Result.005 file - promoters50/1532823
ttattac

SEQ ID NO: 174511 - DNA, 9 bp, Unknown
  misc_feature (1)..( 9): Result.005 file - promoters50/1532925
cgtctgatt

SEQ ID NO: 174512 - DNA, 9 bp, Unknown
  misc_feature (1)..( 9): Result.005 file - promoters50/1532925
tttcttatt

SEQ ID NO: 174513 - DNA, 9 bp, Unknown
  misc_feature (1)..( 9): Result.005 file - promoters50/1532925
cgtttgaat

SEQ ID NO: 174514 - DNA, 9 bp, Unknown
  misc_feature (1)..( 9): Result.005 file - promoters50/1532925
gatttttta

SEQ ID NO: 174515 - DNA, 11 bp, Unknown
  misc_feature (1)..( 11): Result.005 file - promoters50/1532937
aattttgatta

SEQ ID NO: 174516 - DNA, 11 bp, Unknown
  misc_feature (1)..( 11): Result.005 file - promoters50/1532937
ggttttgacta

SEQ ID NO: 174517 - DNA, 11 bp, Unknown
  misc_feature (1)..( 11): Result.005 file - promoters50/1532937
tcttttgaagt

SEQ ID NO: 174518 - DNA, 11 bp, Unknown
  misc_feature (1)..( 11): Result.005 file - promoters50/1532937
atttttaatta

SEQ ID NO: 174519 - DNA, 11 bp, Unknown
  misc_feature (1)..( 11): Result.005 file - promoters50/1532937
tcttttggggt

SEQ ID NO: 174520 - DNA, 11 bp, Unknown
  misc_feature (1)..( 11): Result.005 file - promoters50/1532937
tcttttcacat

SEQ ID NO: 174521 - DNA, 14 bp, Unknown
  misc_feature (1)..( 14): Result.005 file - promoters50/1532937
cttcaaacaaaact

SEQ ID NO: 174522 - DNA, 14 bp, Unknown
  misc_feature (1)..( 14): Result.005 file - promoters50/1532937
cttcaaaattatat

SEQ ID NO: 174523 - DNA, 14 bp, Unknown
  misc_feature (1)..( 14): Result.005 file - promoters50/1532937
ctttaaaaacttct

SEQ ID NO: 174524 - DNA, 14 bp, Unknown
  misc_feature (1)..( 14): Result.005 file - promoters50/1532937
tttcaaaaatactt

SEQ ID NO: 174525 - DNA, 15 bp, Unknown
  misc_feature (1)..( 15): Result.005 file - promoters50/1532937
cttctaaaatcttaa

SEQ ID NO: 174526 - DNA, 15 bp, Unknown
  misc_feature (1)..( 15): Result.005 file - promoters50/1532937
gttttaaaatttagt

SEQ ID NO: 174527 - DNA, 15 bp, Unknown
  misc_feature (1)..( 15): Result.005 file - promoters50/1532937
aatctaaacgttaaa

SEQ ID NO: 174528 - DNA, 10 bp, Unknown
  misc_feature (1)..( 10): Result.005 file - promoters50/1532937
taataaattt

SEQ ID NO: 174529 - DNA, 10 bp, Unknown
  misc_feature (1)..( 10): Result.005 file - promoters50/1532937
gaataaaaat

SEQ ID NO: 174530 - DNA, 10 bp, Unknown
  misc_feature (1)..( 10): Result.005 file - promoters50/1532937
aaataaaata

SEQ ID NO: 174531 - DNA, 10 bp, Unknown
  misc_feature (1)..( 10): Result.005 file - promoters50/1532937
taataactct

SEQ ID NO: 174532 - DNA, 10 bp, Unknown
  misc_feature (1)..( 10): Result.005 file - promoters50/1532937
caattaatct

SEQ ID NO: 174533 - DNA, 10 bp, Unknown
  misc_feature (1)..( 10): Result.005 file - promoters50/1532937
ttataaatat

SEQ ID NO: 174534 - DNA, 10 bp, Unknown
  misc_feature (1)..( 10): Result.005 file - promoters50/1532937
acatatatat

SEQ ID NO: 174535 - DNA, 8 bp, Unknown
  misc_feature (1)..( 8): Result.005 file - promoters50/1532948
attccatt

SEQ ID NO: 174536 - DNA, 8 bp, Unknown
  misc_feature (1)..( 8): Result.005 file - promoters50/1532948
attccaaa

SEQ ID NO: 174537 - DNA, 8 bp, Unknown
  misc_feature (1)..( 8): Result.005 file - promoters50/1532948
tttccatt

SEQ ID NO: 174538 - DNA, 8 bp, Unknown
  misc_feature (1)..( 8): Result.005 file - promoters50/1532948
ttttgtaa

SEQ ID NO: 174539 - DNA, 8 bp, Unknown
  misc_feature (1)..( 8): Result.005 file - promoters50/1532948
ttttgttg

SEQ ID NO: 174540 - DNA, 8 bp, Unknown
  misc_feature (1)..( 8): Result.005 file - promoters50/1532948
ctttgtaa

SEQ ID NO: 174541 - DNA, 8 bp, Unknown
  misc_feature (1)..( 8): Result.005 file - promoters50/1532948
accaataa

SEQ ID NO: 174542 - DNA, 8 bp, Unknown
  misc_feature (1)..( 8): Result.005 file - promoters50/1532948
cccactaa

SEQ ID NO: 174543 - DNA, 8 bp, Unknown
  misc_feature (1)..( 8): Result.005 file - promoters50/1532948
cccactag

SEQ ID NO: 174544 - DNA, 9 bp, Unknown
  misc_feature (1)..( 9): Result.005 file - promoters50/1532948
ggagaaaaa

SEQ ID NO: 174545 - DNA, 9 bp, Unknown
  misc_feature (1)..( 9): Result.005 file - promoters50/1532948
ggagaaaac

SEQ ID NO: 174546 - DNA, 9 bp, Unknown
  misc_feature (1)..( 9): Result.005 file - promoters50/1532948
atggaaaaa

SEQ ID NO: 174547 - DNA, 12 bp, Unknown
  misc_feature (1)..( 12): Result.005 file - promoters50/1532948
gttggaatttag

SEQ ID NO: 174548 - DNA, 12 bp, Unknown
  misc_feature (1)..( 12): Result.005 file - promoters50/1532948
aaaagaaattaa

SEQ ID NO: 174549 - DNA, 12 bp, Unknown
  misc_feature (1)..( 12): Result.005 file - promoters50/1532948
aaatgaaatatc

SEQ ID NO: 174550 - DNA, 12 bp, Unknown
  misc_feature (1)..( 12): Result.005 file - promoters50/1532948
aaaagaaaataa

SEQ ID NO: 174551 - DNA, 12 bp, Unknown
  misc_feature (1)..( 12): Result.005 file - promoters50/1532948
ataagacaacac

SEQ ID NO: 174552 - DNA, 12 bp, Unknown
  misc_feature (1)..( 12): Result.005 file - promoters50/1532948
ttgagacaaaaa

SEQ ID NO: 174553 - DNA, 12 bp, Unknown
  misc_feature (1)..( 12): Result.005 file - promoters50/1532948
ttgaaacaaaaa

SEQ ID NO: 174554 - DNA, 6 bp, Unknown
  misc_feature (1)..( 6): Result.005 file - promoters50/1532948
agtaaa

SEQ ID NO: 174555 - DNA, 6 bp, Unknown
  misc_feature (1)..( 6): Result.005 file - promoters50/1532948
agtaaa

SEQ ID NO: 174556 - DNA, 6 bp, Unknown
  misc_feature (1)..( 6): Result.005 file - promoters50/1532948
agtaaa

SEQ ID NO: 174557 - DNA, 12 bp, Unknown
  misc_feature (1)..( 12): Result.005 file - promoters50/1532948
ttgaaacaaaaa

SEQ ID NO: 174558 - DNA, 12 bp, Unknown
  misc_feature (1)..( 12): Result.005 file - promoters50/1532948
gagaaagaaagc

SEQ ID NO: 174559 - DNA, 12 bp, Unknown
  misc_feature (1)..( 12): Result.005 file - promoters50/1532948
ttgagacaaaaa

SEQ ID NO: 174560 - DNA, 11 bp, Unknown
  misc_feature (1)..( 11): Result.005 file - promoters50/1532948
ggaaatgaaat

SEQ ID NO: 174561 - DNA, 11 bp, Unknown
  misc_feature (1)..( 11): Result.005 file - promoters50/1532948
ggaaaagaaaa

SEQ ID NO: 174562 - DNA, 11 bp, Unknown
  misc_feature (1)..( 11): Result.005 file - promoters50/1532948
caaaaagaaat

SEQ ID NO: 174563 - DNA, 8 bp, Unknown
  misc_feature (1)..( 8): Result.005 file - promoters50/1532975
taacttaa

SEQ ID NO: 174564 - DNA, 8 bp, Unknown
  misc_feature (1)..( 8): Result.005 file - promoters50/1532975
taacttga

SEQ ID NO: 174565 - DNA, 8 bp, Unknown
  misc_feature (1)..( 8): Result.005 file - promoters50/1532975
taatttaa

SEQ ID NO: 174566 - DNA, 10 bp, Unknown
  misc_feature (1)..( 10): Result.005 file - promoters50/1532975
tgtaatcggg

SEQ ID NO: 174567 - DNA, 10 bp, Unknown
  misc_feature (1)..( 10): Result.005 file - promoters50/1532975
ctaaattggg

SEQ ID NO: 174568 - DNA, 10 bp, Unknown
  misc_feature (1)..( 10): Result.005 file - promoters50/1532975
tgtgatcgaa

SEQ ID NO: 174569 - DNA, 9 bp, Unknown
  misc_feature (1)..( 9): Result.005 file - promoters50/1532975
tcgttgtaa

SEQ ID NO: 174570 - DNA, 9 bp, Unknown
  misc_feature (1)..( 9): Result.005 file - promoters50/1532975
tcggtgttg

SEQ ID NO: 174571 - DNA, 9 bp, Unknown
  misc_feature (1)..( 9): Result.005 file - promoters50/1532975
tgggttttg

SEQ ID NO: 174572 - DNA, 8 bp, Unknown
  misc_feature (1)..( 8): Result.005 file - promoters50/1533080
atattaac

SEQ ID NO: 174573 - DNA, 8 bp, Unknown
  misc_feature (1)..( 8): Result.005 file - promoters50/1533080
atattata

SEQ ID NO: 174574 - DNA, 8 bp, Unknown
  misc_feature (1)..( 8): Result.005 file - promoters50/1533080
ataatata

SEQ ID NO: 174575 - DNA, 9 bp, Unknown
  misc_feature (1)..( 9): Result.005 file - promoters50/1533080
gttatcaaa

SEQ ID NO: 174576 - DNA, 9 bp, Unknown
  misc_feature (1)..( 9): Result.005 file - promoters50/1533080
gttatcaat

SEQ ID NO: 174577 - DNA, 9 bp, Unknown
  misc_feature (1)..( 9): Result.005 file - promoters50/1533080
tttattaaa

SEQ ID NO: 174578 - DNA, 8 bp, Unknown
  misc_feature (1)..( 8): Result.005 file - promoters50/1533080
ttagatat

SEQ ID NO: 174579 - DNA, 8 bp, Unknown
  misc_feature (1)..( 8): Result.005 file - promoters50/1533080
ttatatat

SEQ ID NO: 174580 - DNA, 8 bp, Unknown
  misc_feature (1)..( 8): Result.005 file - promoters50/1533080
ttacataa

SEQ ID NO: 174581 - DNA, 8 bp, Unknown
  misc_feature (1)..( 8): Result.005 file - promoters50/1533080
acttaaaa

SEQ ID NO: 174582 - DNA, 8 bp, Unknown
  misc_feature (1)..( 8): Result.005 file - promoters50/1533080
tattaaaa

SEQ ID NO: 174583 - DNA, 8 bp, Unknown
  misc_feature (1)..( 8): Result.005 file - promoters50/1533080
tatgaaac

SEQ ID NO: 174584 - DNA, 9 bp, Unknown
  misc_feature (1)..( 9): Result.005 file - promoters50/1533080
tttttgatt

SEQ ID NO: 174585 - DNA, 9 bp, Unknown
  misc_feature (1)..( 9): Result.005 file - promoters50/1533080
tttatgaaa

SEQ ID NO: 174586 - DNA, 9 bp, Unknown
  misc_feature (1)..( 9): Result.005 file - promoters50/1533080
tatattaaa

SEQ ID NO: 174587 - DNA, 12 bp, Unknown
  misc_feature (1)..( 12): Result.005 file - promoters50/1533159
atatttaataaa

SEQ ID NO: 174588 - DNA, 12 bp, Unknown
  misc_feature (1)..( 12): Result.005 file - promoters50/1533159
aatcataaaaaa

SEQ ID NO: 174589 - DNA, 12 bp, Unknown
  misc_feature (1)..( 12): Result.005 file - promoters50/1533159
gtcgctaataaa

SEQ ID NO: 174590 - DNA, 12 bp, Unknown
  misc_feature (1)..( 12): Result.005 file - promoters50/1533159
atatataataat

SEQ ID NO: 174591 - DNA, 12 bp, Unknown
  misc_feature (1)..( 12): Result.005 file - promoters50/1533159
tttgataaaaga

SEQ ID NO: 174592 - DNA, 11 bp, Unknown
  misc_feature (1)..( 11): Result.005 file - promoters50/1533159
agtataaaatg

SEQ ID NO: 174593 - DNA, 12 bp, Unknown
  misc_feature (1)..( 12): Result.005 file - promoters50/1533159
catagtatgtat

SEQ ID NO: 174594 - DNA, 16 bp, Unknown
  misc_feature (1)..( 16): Result.005 file - promoters50/1533159
aaactttaactattta

SEQ ID NO: 174595 - DNA, 16 bp, Unknown
  misc_feature (1)..( 16): Result.005 file - promoters50/1533159
tataaataattataaa

SEQ ID NO: 174596 - DNA, 16 bp, Unknown
  misc_feature (1)..( 16): Result.005 file - promoters50/1533159
tgattttaaaaaaaaa

SEQ ID NO: 174597 - DNA, 16 bp, Unknown
  misc_feature (1)..( 16): Result.005 file - promoters50/1533159
aaatgacaataataaa

SEQ ID NO: 174598 - DNA, 16 bp, Unknown
  misc_feature (1)..( 16): Result.005 file - promoters50/1533159
atatttttataaatag

SEQ ID NO: 174599 - DNA, 16 bp, Unknown
  misc_feature (1)..( 16): Result.005 file - promoters50/1533159
atatttttaatatata

SEQ ID NO: 174600 - DNA, 16 bp, Unknown
  misc_feature (1)..( 16): Result.005 file - promoters50/1533159
tttttttaacaaattt

SEQ ID NO: 174601 - DNA, 11 bp, Unknown
  misc_feature (1)..( 11): Result.005 file - promoters50/1533159
agtttaatatt

SEQ ID NO: 174602 - DNA, 11 bp, Unknown
  misc_feature (1)..( 11): Result.005 file - promoters50/1533159
cgtttgataaa

SEQ ID NO: 174603 - DNA, 11 bp, Unknown
  misc_feature (1)..( 11): Result.005 file - promoters50/1533159
agtataaaatg

SEQ ID NO: 174604 - DNA, 11 bp, Unknown
  misc_feature (1)..( 11): Result.005 file - promoters50/1533159
ataataatatt

SEQ ID NO: 174605 - DNA, 11 bp, Unknown
  misc_feature (1)..( 11): Result.005 file - promoters50/1533159
ccaatcataaa

SEQ ID NO: 174606 - DNA, 11 bp, Unknown
  misc_feature (1)..( 11): Result.005 file - promoters50/1533159
atcatagtatg

SEQ ID NO: 174607 - DNA, 11 bp, Unknown
  misc_feature (1)..( 11): Result.005 file - promoters50/1533159
caacaaatatt

SEQ ID NO: 174608 - DNA, 10 bp, Unknown
  misc_feature (1)..( 10): Result.005 file - promoters50/1533159
tataatatct

SEQ ID NO: 174609 - DNA, 10 bp, Unknown
  misc_feature (1)..( 10): Result.005 file - promoters50/1533159
tgtaaaatcc

SEQ ID NO: 174610 - DNA, 10 bp, Unknown
  misc_feature (1)..( 10): Result.005 file - promoters50/1533159
cctaatttct

SEQ ID NO: 174611 - DNA, 10 bp, Unknown
  misc_feature (1)..( 10): Result.005 file - promoters50/1533159
aaaaatgtct

SEQ ID NO: 174612 - DNA, 10 bp, Unknown
  misc_feature (1)..( 10): Result.005 file - promoters50/1533159
tctattttgt

SEQ ID NO: 174613 - DNA, 10 bp, Unknown
  misc_feature (1)..( 10): Result.005 file - promoters50/1533159
tcttttttgt

SEQ ID NO: 174614 - DNA, 14 bp, Unknown
  misc_feature (1)..( 14): Result.005 file - promoters50/1533159
gatgtaaaaaaaaa

SEQ ID NO: 174615 - DNA, 14 bp, Unknown
  misc_feature (1)..( 14): Result.005 file - promoters50/1533159
atagtaaaaaaatc

SEQ ID NO: 174616 - DNA, 14 bp, Unknown
  misc_feature (1)..( 14): Result.005 file - promoters50/1533159
tttttaacaaattt

SEQ ID NO: 174617 - DNA, 14 bp, Unknown
  misc_feature (1)..( 14): Result.005 file - promoters50/1533159
attttaaaaaaaaa

SEQ ID NO: 174618 - DNA, 14 bp, Unknown
  misc_feature (1)..( 14): Result.005 file - promoters50/1533159
acaataataaacaa

SEQ ID NO: 174619 - DNA, 14 bp, Unknown
  misc_feature (1)..( 14): Result.005 file - promoters50/1533159
aatataaataatta

SEQ ID NO: 174620 - DNA, 14 bp, Unknown
  misc_feature (1)..( 14): Result.005 file - promoters50/1533159
tttttaatatatag

SEQ ID NO: 174621 - DNA, 14 bp, Unknown
  misc_feature (1)..( 14): Result.005 file - promoters50/1533159
atagtcaaatatca

SEQ ID NO: 174622 - DNA, 11 bp, Unknown
  misc_feature (1)..( 11): Result.005 file - promoters50/1533159
aataaatgaag

SEQ ID NO: 174623 - DNA, 11 bp, Unknown
  misc_feature (1)..( 11): Result.005 file - promoters50/1533159
caaaaatgaat

SEQ ID NO: 174624 - DNA, 12 bp, Unknown
  misc_feature (1)..( 12): Result.005 file - promoters50/1533159
acaaaattgaat

SEQ ID NO: 174625 - DNA, 12 bp, Unknown
  misc_feature (1)..( 12): Result.005 file - promoters50/1533159
gtgaaattgtct

SEQ ID NO: 174626 - DNA, 12 bp, Unknown
  misc_feature (1)..( 12): Result.005 file - promoters50/1533159
acagaatatgtg

SEQ ID NO: 174627 - DNA, 12 bp, Unknown
  misc_feature (1)..( 12): Result.005 file - promoters50/1533159
gtagagtatatc

SEQ ID NO: 174628 - DNA, 12 bp, Unknown
  misc_feature (1)..( 12): Result.005 file - promoters50/1533159
actatttgatgt

SEQ ID NO: 174629 - DNA, 12 bp, Unknown
  misc_feature (1)..( 12): Result.005 file - promoters50/1533159
acttttttttta

SEQ ID NO: 174630 - DNA, 12 bp, Unknown
  misc_feature (1)..( 12): Result.005 file - promoters50/1533159
atttttaatata

SEQ ID NO: 174631 - DNA, 13 bp, Unknown
  misc_feature (1)..( 13): Result.005 file - promoters50/1533159
attttataatata

SEQ ID NO: 174632 - DNA, 13 bp, Unknown
  misc_feature (1)..( 13): Result.005 file - promoters50/1533159
tgacaataataaa

SEQ ID NO: 174633 - DNA, 13 bp, Unknown
  misc_feature (1)..( 13): Result.005 file - promoters50/1533159
atatttttataaa

SEQ ID NO: 174634 - DNA, 12 bp, Unknown
  misc_feature (1)..( 12): Result.005 file - promoters50/1533159
aactttaactat

SEQ ID NO: 174635 - DNA, 12 bp, Unknown
  misc_feature (1)..( 12): Result.005 file - promoters50/1533159
ttttttaacaaa

SEQ ID NO: 174636 - DNA, 12 bp, Unknown
  misc_feature (1)..( 12): Result.005 file - promoters50/1533159
gattttataata

SEQ ID NO: 174637 - DNA, 12 bp, Unknown
  misc_feature (1)..( 12): Result.005 file - promoters50/1533159
gattttaaaaaa

SEQ ID NO: 174638 - DNA, 12 bp, Unknown
  misc_feature (1)..( 12): Result.005 file - promoters50/1533159
atttttaatata

SEQ ID NO: 174639 - DNA, 12 bp, Unknown
  misc_feature (1)..( 12): Result.005 file - promoters50/1533159
atttttataaat

SEQ ID NO: 174640 - DNA, 12 bp, Unknown
  misc_feature (1)..( 12): Result.005 file - promoters50/1533159
tataataatatt

SEQ ID NO: 174641 - DNA, 12 bp, Unknown
  misc_feature (1)..( 12): Result.005 file - promoters50/1533159
aattataaagta

SEQ ID NO: 174642 - DNA, 12 bp, Unknown
  misc_feature (1)..( 12): Result.005 file - promoters50/1533159
agagatatagtc

SEQ ID NO: 174643 - DNA, 12 bp, Unknown
  misc_feature (1)..( 12): Result.005 file - promoters50/1533159
gattttaaaaaa

SEQ ID NO: 174644 - DNA, 12 bp, Unknown
  misc_feature (1)..( 12): Result.005 file - promoters50/1533159
aataataaacaa

SEQ ID NO: 174645 - DNA, 12 bp, Unknown
  misc_feature (1)..( 12): Result.005 file - promoters50/1533159
aatagtaaaaaa

SEQ ID NO: 174646 - DNA, 12 bp, Unknown
  misc_feature (1)..( 12): Result.005 file - promoters50/1533159
taatatatagaa

SEQ ID NO: 174647 - DNA, 12 bp, Unknown
  misc_feature (1)..( 12): Result.005 file - promoters50/1533159
atgtatttagaa

SEQ ID NO: 174648 - DNA, 13 bp, Unknown
  misc_feature (1)..( 13): Result.005 file - promoters50/1533159
tacataaaaattt

SEQ ID NO: 174649 - DNA, 13 bp, Unknown
  misc_feature (1)..( 13): Result.005 file - promoters50/1533159
gatttaagaatat

SEQ ID NO: 174650 - DNA, 13 bp, Unknown
  misc_feature (1)..( 13): Result.005 file - promoters50/1533159
catataaaaaata

SEQ ID NO: 174651 - DNA, 13 bp, Unknown
  misc_feature (1)..( 13): Result.005 file - promoters50/1533159
aaaaaaagaattt

SEQ ID NO: 174652 - DNA, 13 bp, Unknown
  misc_feature (1)..( 13): Result.005 file - promoters50/1533159
aaaaaaaaaatac

SEQ ID NO: 174653 - DNA, 13 bp, Unknown
  misc_feature (1)..( 13): Result.005 file - promoters50/1533159
cataagagaattt

SEQ ID NO: 174654 - DNA, 14 bp, Unknown
  misc_feature (1)..( 14): Result.005 file - promoters50/1533159
gattttataatata

SEQ ID NO: 174655 - DNA, 14 bp, Unknown
  misc_feature (1)..( 14): Result.005 file - promoters50/1533159
atttttataaatag

SEQ ID NO: 174656 - DNA, 14 bp, Unknown
  misc_feature (1)..( 14): Result.005 file - promoters50/1533159
ttttttttaacaaa

SEQ ID NO: 174657 - DNA, 14 bp, Unknown
  misc_feature (1)..( 14): Result.005 file - promoters50/1533159
gattttaaaaaaaa

SEQ ID NO: 174658 - DNA, 14 bp, Unknown
  misc_feature (1)..( 14): Result.005 file - promoters50/1533159
atatttttaatata

SEQ ID NO: 174659 - DNA, 14 bp, Unknown
  misc_feature (1)..( 14): Result.005 file - promoters50/1533159
tatataataatatt

SEQ ID NO: 174660 - DNA, 13 bp, Unknown
  misc_feature (1)..( 13): Result.005 file - promoters50/1533159
aaaacaatttata

SEQ ID NO: 174661 - DNA, 13 bp, Unknown
  misc_feature (1)..( 13): Result.005 file - promoters50/1533159
aaaagaatttata

SEQ ID NO: 174662 - DNA, 13 bp, Unknown
  misc_feature (1)..( 13): Result.005 file - promoters50/1533159
aaaaaaatacatt

SEQ ID NO: 174663 - DNA, 13 bp, Unknown
  misc_feature (1)..( 13): Result.005 file - promoters50/1533159
taaacaaacaaat

SEQ ID NO: 174664 - DNA, 13 bp, Unknown
  misc_feature (1)..( 13): Result.005 file - promoters50/1533159
ttaagaatattcc

SEQ ID NO: 174665 - DNA, 13 bp, Unknown
  misc_feature (1)..( 13): Result.005 file - promoters50/1533159
aagagaatttcat

SEQ ID NO: 174666 - DNA, 13 bp, Unknown
  misc_feature (1)..( 13): Result.005 file - promoters50/1533159
cttattttatgaa

SEQ ID NO: 174667 - DNA, 13 bp, Unknown
  misc_feature (1)..( 13): Result.005 file - promoters50/1533159
tttattttaagaa

SEQ ID NO: 174668 - DNA, 13 bp, Unknown
  misc_feature (1)..( 13): Result.005 file - promoters50/1533159
tttatttatttat

SEQ ID NO: 174669 - DNA, 13 bp, Unknown
  misc_feature (1)..( 13): Result.005 file - promoters50/1533159
tctattttgtcgt

SEQ ID NO: 174670 - DNA, 13 bp, Unknown
  misc_feature (1)..( 13): Result.005 file - promoters50/1533159
ctaatttcttcgt

SEQ ID NO: 174671 - DNA, 13 bp, Unknown
  misc_feature (1)..( 13): Result.005 file - promoters50/1533159
atttttttaaaaa

SEQ ID NO: 174672 - DNA, 8 bp, Unknown
  misc_feature (1)..( 8): Result.005 file - promoters50/1533201
aagagaaa

SEQ ID NO: 174673 - DNA, 8 bp, Unknown
  misc_feature (1)..( 8): Result.005 file - promoters50/1533201
cagagaag

SEQ ID NO: 174674 - DNA, 8 bp, Unknown
  misc_feature (1)..( 8): Result.005 file - promoters50/1533201
gagaaaag

SEQ ID NO: 174675 - DNA, 8 bp, Unknown
  misc_feature (1)..( 8): Result.005 file - promoters50/1533201
ctgacaaa

SEQ ID NO: 174676 - DNA, 9 bp, Unknown
  misc_feature (1)..( 9): Result.005 file - promoters50/1533294
aaatgaaaa

SEQ ID NO: 174677 - DNA, 9 bp, Unknown
  misc_feature (1)..( 9): Result.005 file - promoters50/1533294
aaattaaaa

SEQ ID NO: 174678 - DNA, 9 bp, Unknown
  misc_feature (1)..( 9): Result.005 file - promoters50/1533294
ttatgtaaa

SEQ ID NO: 174679 - DNA, 9 bp, Unknown
  misc_feature (1)..( 9): Result.005 file - promoters50/1533294
tttgatttg

SEQ ID NO: 174680 - DNA, 9 bp, Unknown
  misc_feature (1)..( 9): Result.005 file - promoters50/1533294
tttaatttg

SEQ ID NO: 174681 - DNA, 9 bp, Unknown
  misc_feature (1)..( 9): Result.005 file - promoters50/1533294
ttcgatttg

SEQ ID NO: 174682 - DNA, 10 bp, Unknown
  misc_feature (1)..( 10): Result.005 file - promoters50/1533294
gcccataacg

SEQ ID NO: 174683 - DNA, 10 bp, Unknown
  misc_feature (1)..( 10): Result.005 file - promoters50/1533294
gcccaaaact

SEQ ID NO: 174684 - DNA, 10 bp, Unknown
  misc_feature (1)..( 10): Result.005 file - promoters50/1533294
aaacaaaact

SEQ ID NO: 174685 - DNA, 12 bp, Unknown
  misc_feature (1)..( 12): Result.005 file - promoters50/1533294
catttattttcc

SEQ ID NO: 174686 - DNA, 12 bp, Unknown
  misc_feature (1)..( 12): Result.005 file - promoters50/1533294
catttatcttct

SEQ ID NO: 174687 - DNA, 12 bp, Unknown
  misc_feature (1)..( 12): Result.005 file - promoters50/1533294
agtccctcttct

SEQ ID NO: 174688 - DNA, 6 bp, Unknown
  misc_feature (1)..( 6): Result.005 file - promoters50/1533294
gatttg

SEQ ID NO: 174689 - DNA, 6 bp, Unknown
  misc_feature (1)..( 6): Result.005 file - promoters50/1533294
gatttg

SEQ ID NO: 174690 - DNA, 6 bp, Unknown
  misc_feature (1)..( 6): Result.005 file - promoters50/1533294
gatttg

SEQ ID NO: 174691 - DNA, 8 bp, Unknown
  misc_feature (1)..( 8): Result.005 file - promoters50/1533294
aaatatgt

SEQ ID NO: 174692 - DNA, 8 bp, Unknown
  misc_feature (1)..( 8): Result.005 file - promoters50/1533294
aaatttgt

SEQ ID NO: 174693 - DNA, 8 bp, Unknown
  misc_feature (1)..( 8): Result.005 file - promoters50/1533294
aaacttga

SEQ ID NO: 174694 - DNA, 12 bp, Unknown
  misc_feature (1)..( 12): Result.005 file - promoters50/1533330
atgagaatcaaa

SEQ ID NO: 174695 - DNA, 12 bp, Unknown
  misc_feature (1)..( 12): Result.005 file - promoters50/1533330
gactgaaacaag

SEQ ID NO: 174696 - DNA, 12 bp, Unknown
  misc_feature (1)..( 12): Result.005 file - promoters50/1533330
aattgaaccaaa

SEQ ID NO: 174697 - DNA, 12 bp, Unknown
  misc_feature (1)..( 12): Result.005 file - promoters50/1533330
tattgaacacat

SEQ ID NO: 174698 - DNA, 12 bp, Unknown
  misc_feature (1)..( 12): Result.005 file - promoters50/1533330
tagagaaacaaa

SEQ ID NO: 174699 - DNA, 12 bp, Unknown
  misc_feature (1)..( 12): Result.005 file - promoters50/1533330
tatcgaactcta

SEQ ID NO: 174700 - DNA, 11 bp, Unknown
  misc_feature (1)..( 11): Result.005 file - promoters50/1533352
taaaaaaacat

SEQ ID NO: 174701 - DNA, 11 bp, Unknown
  misc_feature (1)..( 11): Result.005 file - promoters50/1533352
taataaaccat

SEQ ID NO: 174702 - DNA, 11 bp, Unknown
  misc_feature (1)..( 11): Result.005 file - promoters50/1533352
gaaacaaacca

SEQ ID NO: 174703 - DNA, 10 bp, Unknown
  misc_feature (1)..( 10): Result.005 file - promoters50/1533352
ttttttataa

SEQ ID NO: 174704 - DNA, 10 bp, Unknown
  misc_feature (1)..( 10): Result.005 file - promoters50/1533352
atttctatct

SEQ ID NO: 174705 - DNA, 10 bp, Unknown
  misc_feature (1)..( 10): Result.005 file - promoters50/1533352
attttttttt

SEQ ID NO: 174706 - DNA, 9 bp, Unknown
  misc_feature (1)..( 9): Result.005 file - promoters50/1533352
aaagaagaa

SEQ ID NO: 174707 - DNA, 9 bp, Unknown
  misc_feature (1)..( 9): Result.005 file - promoters50/1533352
aaagaaaaa

SEQ ID NO: 174708 - DNA, 9 bp, Unknown
  misc_feature (1)..( 9): Result.005 file - promoters50/1533352
aaacaaaaa

SEQ ID NO: 174709 - DNA, 8 bp, Unknown
  misc_feature (1)..( 8): Result.005 file - promoters50/1533352
gaggaagg

SEQ ID NO: 174710 - DNA, 8 bp, Unknown
  misc_feature (1)..( 8): Result.005 file - promoters50/1533352
gagaaagc

SEQ ID NO: 174711 - DNA, 8 bp, Unknown
  misc_feature (1)..( 8): Result.005 file - promoters50/1533352
aagaaaaa

SEQ ID NO: 174712 - DNA, 7 bp, Unknown
  misc_feature (1)..( 7): Result.005 file - promoters50/1533384
catcaag

SEQ ID NO: 174713 - DNA, 7 bp, Unknown
  misc_feature (1)..( 7): Result.005 file - promoters50/1533384
catcaaa

SEQ ID NO: 174714 - DNA, 7 bp, Unknown
  misc_feature (1)..( 7): Result.005 file - promoters50/1533384
aatcaaa

SEQ ID NO: 174715 - DNA, 10 bp, Unknown
  misc_feature (1)..( 10): Result.005 file - promoters50/1533533
gttttggtaa

SEQ ID NO: 174716 - DNA, 10 bp, Unknown
  misc_feature (1)..( 10): Result.005 file - promoters50/1533533
cacttggtaa

SEQ ID NO: 174717 - DNA, 10 bp, Unknown
  misc_feature (1)..( 10): Result.005 file - promoters50/1533533
attttagtaa

SEQ ID NO: 174718 - DNA, 10 bp, Unknown
  misc_feature (1)..( 10): Result.005 file - promoters50/1533533
attctagaac

SEQ ID NO: 174719 - DNA, 10 bp, Unknown
  misc_feature (1)..( 10): Result.005 file - promoters50/1533533
gctctataac

SEQ ID NO: 174720 - DNA, 10 bp, Unknown
  misc_feature (1)..( 10): Result.005 file - promoters50/1533533
tttttagcca

SEQ ID NO: 174721 - DNA, 10 bp, Unknown
  misc_feature (1)..( 10): Result.005 file - promoters50/1533533
caattttttc

SEQ ID NO: 174722 - DNA, 10 bp, Unknown
  misc_feature (1)..( 10): Result.005 file - promoters50/1533533
taatatttca

SEQ ID NO: 174723 - DNA, 10 bp, Unknown
  misc_feature (1)..( 10): Result.005 file - promoters50/1533533
ttattttttt

SEQ ID NO: 174724 - DNA, 10 bp, Unknown
  misc_feature (1)..( 10): Result.005 file - promoters50/1533533
tcatttttat

SEQ ID NO: 174725 - DNA, 10 bp, Unknown
  misc_feature (1)..( 10): Result.005 file - promoters50/1533533
taatatgaag

SEQ ID NO: 174726 - DNA, 10 bp, Unknown
  misc_feature (1)..( 10): Result.005 file - promoters50/1533533
ggctttttat

SEQ ID NO: 174727 - DNA, 11 bp, Unknown
  misc_feature (1)..( 11): Result.005 file - promoters50/1533533
tgaatttacaa

SEQ ID NO: 174728 - DNA, 11 bp, Unknown
  misc_feature (1)..( 11): Result.005 file - promoters50/1533533
ttcatttccaa

SEQ ID NO: 174729 - DNA, 11 bp, Unknown
  misc_feature (1)..( 11): Result.005 file - promoters50/1533533
tttttttacaa

SEQ ID NO: 174730 - DNA, 11 bp, Unknown
  misc_feature (1)..( 11): Result.005 file - promoters50/1533533
tttatttcctt

SEQ ID NO: 174731 - DNA, 11 bp, Unknown
  misc_feature (1)..( 11): Result.005 file - promoters50/1533533
tctgtttacag

SEQ ID NO: 174732 - DNA, 11 bp, Unknown
  misc_feature (1)..( 11): Result.005 file - promoters50/1533533
tttttttccca

SEQ ID NO: 174733 - DNA, 10 bp, Unknown
  misc_feature (1)..( 10): Result.005 file - promoters50/1533533
tggttaaaac

SEQ ID NO: 174734 - DNA, 10 bp, Unknown
  misc_feature (1)..( 10): Result.005 file - promoters50/1533533
ccgttaaaaa

SEQ ID NO: 174735 - DNA, 10 bp, Unknown
  misc_feature (1)..( 10): Result.005 file - promoters50/1533533
ttattaaaaa

SEQ ID NO: 174736 - DNA, 10 bp, Unknown
  misc_feature (1)..( 10): Result.005 file - promoters50/1533533
actataaaaa

SEQ ID NO: 174737 - DNA, 10 bp, Unknown
  misc_feature (1)..( 10): Result.005 file - promoters50/1533533
ttcataaaat

SEQ ID NO: 174738 - DNA, 10 bp, Unknown
  misc_feature (1)..( 10): Result.005 file - promoters50/1533533
tttatgaaat

SEQ ID NO: 174739 - DNA, 10 bp, Unknown
  misc_feature (1)..( 10): Result.005 file - promoters50/1533533
aaaacaaaaa

SEQ ID NO: 174740 - DNA, 10 bp, Unknown
  misc_feature (1)..( 10): Result.005 file - promoters50/1533533
taaataaaaa

SEQ ID NO: 174741 - DNA, 10 bp, Unknown
  misc_feature (1)..( 10): Result.005 file - promoters50/1533533
taaacaatta

SEQ ID NO: 174742 - DNA, 10 bp, Unknown
  misc_feature (1)..( 10): Result.005 file - promoters50/1533533
aaaacaaagg

SEQ ID NO: 174743 - DNA, 10 bp, Unknown
  misc_feature (1)..( 10): Result.005 file - promoters50/1533533
actataaaac

SEQ ID NO: 174744 - DNA, 10 bp, Unknown
  misc_feature (1)..( 10): Result.005 file - promoters50/1533533
tatataaccc

SEQ ID NO: 174745 - DNA, 12 bp, Unknown
  misc_feature (1)..( 12): Result.005 file - promoters50/1533533
aaaaaacaaaaa

SEQ ID NO: 174746 - DNA, 12 bp, Unknown
  misc_feature (1)..( 12): Result.005 file - promoters50/1533533
ataaaacattta

SEQ ID NO: 174747 - DNA, 12 bp, Unknown
  misc_feature (1)..( 12): Result.005 file - promoters50/1533533
ttaaaacaaagg

SEQ ID NO: 174748 - DNA, 12 bp, Unknown
  misc_feature (1)..( 12): Result.005 file - promoters50/1533533
taaaaacattta

SEQ ID NO: 174749 - DNA, 12 bp, Unknown
  misc_feature (1)..( 12): Result.005 file - promoters50/1533533
ataaaacgtgtt

SEQ ID NO: 174750 - DNA, 12 bp, Unknown
  misc_feature (1)..( 12): Result.005 file - promoters50/1533533
atataacccaat

SEQ ID NO: 174751 - DNA, 15 bp, Unknown
  misc_feature (1)..( 15): Result.005 file - promoters50/1533533
tatacaagaaaactc

SEQ ID NO: 174752 - DNA, 15 bp, Unknown
  misc_feature (1)..( 15): Result.005 file - promoters50/1533533
gtaataagaaaaaaa

SEQ ID NO: 174753 - DNA, 15 bp, Unknown
  misc_feature (1)..( 15): Result.005 file - promoters50/1533533
acatgaagacttatt

SEQ ID NO: 174754 - DNA, 15 bp, Unknown
  misc_feature (1)..( 15): Result.005 file - promoters50/1533533
aataaaagaattaaa

SEQ ID NO: 174755 - DNA, 15 bp, Unknown
  misc_feature (1)..( 15): Result.005 file - promoters50/1533533
atcacaacaaattta

SEQ ID NO: 174756 - DNA, 15 bp, Unknown
  misc_feature (1)..( 15): Result.005 file - promoters50/1533533
gagaaaataaaaaag

SEQ ID NO: 174757 - DNA, 15 bp, Unknown
  misc_feature (1)..( 15): Result.005 file - promoters50/1533533
tctttttttaaaaaa

SEQ ID NO: 174758 - DNA, 7 bp, Unknown
  misc_feature (1)..( 7): Result.005 file - promoters50/1533684
aaaaaat

SEQ ID NO: 174759 - DNA, 7 bp, Unknown
  misc_feature (1)..( 7): Result.005 file - promoters50/1533684
aaataat

SEQ ID NO: 174760 - DNA, 7 bp, Unknown
  misc_feature (1)..( 7): Result.005 file - promoters50/1533684
gaaaaat

SEQ ID NO: 174761 - DNA, 7 bp, Unknown
  misc_feature (1)..( 7): Result.005 file - promoters50/1533684
cttttta

SEQ ID NO: 174762 - DNA, 7 bp, Unknown
  misc_feature (1)..( 7): Result.005 file - promoters50/1533684
cttatta

SEQ ID NO: 174763 - DNA, 7 bp, Unknown
  misc_feature (1)..( 7): Result.005 file - promoters50/1533684
cttctta

SEQ ID NO: 174764 - DNA, 8 bp, Unknown
  misc_feature (1)..( 8): Result.005 file - promoters50/1533684
ttttaggt

SEQ ID NO: 174765 - DNA, 8 bp, Unknown
  misc_feature (1)..( 8): Result.005 file - promoters50/1533684
ttttcggt

SEQ ID NO: 174766 - DNA, 8 bp, Unknown
  misc_feature (1)..( 8): Result.005 file - promoters50/1533684
atttcggg

SEQ ID NO: 174767 - DNA, 12 bp, Unknown
  misc_feature (1)..( 12): Result.005 file - promoters50/1533684
attcttaccaaa

SEQ ID NO: 174768 - DNA, 12 bp, Unknown
  misc_feature (1)..( 12): Result.005 file - promoters50/1533684
ttctttactaaa

SEQ ID NO: 174769 - DNA, 12 bp, Unknown
  misc_feature (1)..( 12): Result.005 file - promoters50/1533684
ttctttattaat

SEQ ID NO: 174770 - DNA, 15 bp, Unknown
  misc_feature (1)..( 15): Result.005 file - promoters50/1533750
tagaagagatattat

SEQ ID NO: 174771 - DNA, 15 bp, Unknown
  misc_feature (1)..( 15): Result.005 file - promoters50/1533750
cagaagattaagaaa

SEQ ID NO: 174772 - DNA, 15 bp, Unknown
  misc_feature (1)..( 15): Result.005 file - promoters50/1533750
cagaagtaataactc

SEQ ID NO: 174773 - DNA, 15 bp, Unknown
  misc_feature (1)..( 15): Result.005 file - promoters50/1533750
gagaaaattacgaaa

SEQ ID NO: 174774 - DNA, 12 bp, Unknown
  misc_feature (1)..( 12): Result.005 file - promoters50/1533750
gtgtacataaat

SEQ ID NO: 174775 - DNA, 12 bp, Unknown
  misc_feature (1)..( 12): Result.005 file - promoters50/1533750
caaaacaaaaat

SEQ ID NO: 174776 - DNA, 12 bp, Unknown
  misc_feature (1)..( 12): Result.005 file - promoters50/1533750
caaagcaaaaca

SEQ ID NO: 174777 - DNA, 15 bp, Unknown
  misc_feature (1)..( 15): Result.005 file - promoters50/1533750
aagtaataactctcc

SEQ ID NO: 174778 - DNA, 15 bp, Unknown
  misc_feature (1)..( 15): Result.005 file - promoters50/1533750
aagaaatgaggtact

SEQ ID NO: 174779 - DNA, 15 bp, Unknown
  misc_feature (1)..( 15): Result.005 file - promoters50/1533750
gagaaaattacgaaa

SEQ ID NO: 174780 - DNA, 8 bp, Unknown
  misc_feature (1)..( 8): Result.005 file - promoters50/1533750
ccaaaaat

SEQ ID NO: 174781 - DNA, 8 bp, Unknown
  misc_feature (1)..( 8): Result.005 file - promoters50/1533750
ccaaaaaa

SEQ ID NO: 174782 - DNA, 8 bp, Unknown
  misc_feature (1)..( 8): Result.005 file - promoters50/1533750
agaaaaaa

SEQ ID NO: 174783 - DNA, 7 bp, Unknown
  misc_feature (1)..( 7): Result.005 file - promoters50/1533762
tgaaaaa

SEQ ID NO: 174784 - DNA, 7 bp, Unknown
  misc_feature (1)..( 7): Result.005 file - promoters50/1533762
ggaaaaa

SEQ ID NO: 174785 - DNA, 7 bp, Unknown
  misc_feature (1)..( 7): Result.005 file - promoters50/1533762
ggaaaag

SEQ ID NO: 174786 - DNA, 6 bp, Unknown
  misc_feature (1)..( 6): Result.005 file - promoters50/1533762
gaatct

SEQ ID NO: 174787 - DNA, 6 bp, Unknown
  misc_feature (1)..( 6): Result.005 file - promoters50/1533762
gaatct

SEQ ID NO: 174788 - DNA, 6 bp, Unknown
  misc_feature (1)..( 6): Result.005 file - promoters50/1533762
gaatct

SEQ ID NO: 174789 - DNA, 11 bp, Unknown
  misc_feature (1)..( 11): Result.005 file - promoters50/1533878
accgcctaata

SEQ ID NO: 174790 - DNA, 11 bp, Unknown
  misc_feature (1)..( 11): Result.005 file - promoters50/1533878
ttctccttata

SEQ ID NO: 174791 - DNA, 11 bp, Unknown
  misc_feature (1)..( 11): Result.005 file - promoters50/1533878
ttctccttaga

SEQ ID NO: 174792 - DNA, 10 bp, Unknown
  misc_feature (1)..( 10): Result.005 file - promoters50/1533878
gaaattgatt

SEQ ID NO: 174793 - DNA, 10 bp, Unknown
  misc_feature (1)..( 10): Result.005 file - promoters50/1533878
ataatttatt

SEQ ID NO: 174794 - DNA, 10 bp, Unknown
  misc_feature (1)..( 10): Result.005 file - promoters50/1533878
ataattttat

SEQ ID NO: 174795 - DNA, 11 bp, Unknown
  misc_feature (1)..( 11): Result.005 file - promoters50/1533878
atacataccca

SEQ ID NO: 174796 - DNA, 11 bp, Unknown
  misc_feature (1)..( 11): Result.005 file - promoters50/1533878
atatatacaag

SEQ ID NO: 174797 - DNA, 11 bp, Unknown
  misc_feature (1)..( 11): Result.005 file - promoters50/1533878
aaacatgccca

SEQ ID NO: 174798 - DNA, 8 bp, Unknown
  misc_feature (1)..( 8): Result.005 file - promoters50/1533882
gttcaact

SEQ ID NO: 174799 - DNA, 8 bp, Unknown
  misc_feature (1)..( 8): Result.005 file - promoters50/1533882
tttcgact

SEQ ID NO: 174800 - DNA, 8 bp, Unknown
  misc_feature (1)..( 8): Result.005 file - promoters50/1533882
gttcaatc

SEQ ID NO: 174801 - DNA, 13 bp, Unknown
  misc_feature (1)..( 13): Result.005 file - promoters50/1533882
gatccatcacaat

SEQ ID NO: 174802 - DNA, 13 bp, Unknown
  misc_feature (1)..( 13): Result.005 file - promoters50/1533882
ttaaatccacaat

SEQ ID NO: 174803 - DNA, 13 bp, Unknown
  misc_feature (1)..( 13): Result.005 file - promoters50/1533882
ttagatcctcaag

SEQ ID NO: 174804 - DNA, 11 bp, Unknown
  misc_feature (1)..( 11): Result.005 file - promoters50/1533912
ctaaataaata

SEQ ID NO: 174805 - DNA, 11 bp, Unknown
  misc_feature (1)..( 11): Result.005 file - promoters50/1533912
ctatataaacc

SEQ ID NO: 174806 - DNA, 11 bp, Unknown
  misc_feature (1)..( 11): Result.005 file - promoters50/1533912
taaaacaaact

SEQ ID NO: 174807 - DNA, 11 bp, Unknown
  misc_feature (1)..( 11): Result.005 file - promoters50/1533912
ctatataatgg

SEQ ID NO: 174808 - DNA, 11 bp, Unknown
  misc_feature (1)..( 11): Result.005 file - promoters50/1533912
atatataaaga

SEQ ID NO: 174809 - DNA, 11 bp, Unknown
  misc_feature (1)..( 11): Result.005 file - promoters50/1533912
ttatttaaaca

SEQ ID NO: 174810 - DNA, 11 bp, Unknown
  misc_feature (1)..( 11): Result.005 file - promoters50/1533912
gtatatatacc

SEQ ID NO: 174811 - DNA, 8 bp, Unknown
  misc_feature (1)..( 8): Result.005 file - promoters50/1533912
tatatata

SEQ ID NO: 174812 - DNA, 8 bp, Unknown
  misc_feature (1)..( 8): Result.005 file - promoters50/1533912
tatatata

SEQ ID NO: 174813 - DNA, 8 bp, Unknown
  misc_feature (1)..( 8): Result.005 file - promoters50/1533912
tatataaa

SEQ ID NO: 174814 - DNA, 8 bp, Unknown
  misc_feature (1)..( 8): Result.005 file - promoters50/1533912
tatttaaa

SEQ ID NO: 174815 - DNA, 8 bp, Unknown
  misc_feature (1)..( 8): Result.005 file - promoters50/1533912
aatataaa

SEQ ID NO: 174816 - DNA, 8 bp, Unknown
  misc_feature (1)..( 8): Result.005 file - promoters50/1533912
tatataat

SEQ ID NO: 174817 - DNA, 13 bp, Unknown
  misc_feature (1)..( 13): Result.005 file - promoters50/1533912
agttaacatctaa

SEQ ID NO: 174818 - DNA, 13 bp, Unknown
  misc_feature (1)..( 13): Result.005 file - promoters50/1533912
ttttaacacttca

SEQ ID NO: 174819 - DNA, 13 bp, Unknown
  misc_feature (1)..( 13): Result.005 file - promoters50/1533912
ttttcacaaactt

SEQ ID NO: 174820 - DNA, 13 bp, Unknown
  misc_feature (1)..( 13): Result.005 file - promoters50/1533912
ttttcattgtagt

SEQ ID NO: 174821 - DNA, 13 bp, Unknown
  misc_feature (1)..( 13): Result.005 file - promoters50/1533912
tttttacatattt

SEQ ID NO: 174822 - DNA, 13 bp, Unknown
  misc_feature (1)..( 13): Result.005 file - promoters50/1533912
gttttattgtagt

SEQ ID NO: 174823 - DNA, 13 bp, Unknown
  misc_feature (1)..( 13): Result.005 file - promoters50/1534128
attctcaaccttg

SEQ ID NO: 174824 - DNA, 13 bp, Unknown
  misc_feature (1)..( 13): Result.005 file - promoters50/1534128
aatctaaacgcaa

SEQ ID NO: 174825 - DNA, 13 bp, Unknown
  misc_feature (1)..( 13): Result.005 file - promoters50/1534128
agtttcaatcttc

SEQ ID NO: 174826 - DNA, 13 bp, Unknown
  misc_feature (1)..( 13): Result.005 file - promoters50/1534128
atgttaaaagcat

SEQ ID NO: 174827 - DNA, 13 bp, Unknown
  misc_feature (1)..( 13): Result.005 file - promoters50/1534128
aatttaagggtct

SEQ ID NO: 174828 - DNA, 13 bp, Unknown
  misc_feature (1)..( 13): Result.005 file - promoters50/1534128
ataaacaaccttc

SEQ ID NO: 174829 - DNA, 10 bp, Unknown
  misc_feature (1)..( 10): Result.005 file - promoters50/1534228
taaactcttc

SEQ ID NO: 174830 - DNA, 10 bp, Unknown
  misc_feature (1)..( 10): Result.005 file - promoters50/1534228
aaaactattc

SEQ ID NO: 174831 - DNA, 10 bp, Unknown
  misc_feature (1)..( 10): Result.005 file - promoters50/1534228
taatctctga

SEQ ID NO: 174832 - DNA, 10 bp, Unknown
  misc_feature (1)..( 10): Result.005 file - promoters50/1534228
aaaactgata

SEQ ID NO: 174833 - DNA, 7 bp, Unknown
  misc_feature (1)..( 7): Result.005 file - promoters50/1534228
taatttc

SEQ ID NO: 174834 - DNA, 7 bp, Unknown
  misc_feature (1)..( 7): Result.005 file - promoters50/1534228
taattta

SEQ ID NO: 174835 - DNA, 7 bp, Unknown
  misc_feature (1)..( 7): Result.005 file - promoters50/1534228
aaattta

SEQ ID NO: 174836 - DNA, 18 bp, Unknown
  misc_feature (1)..( 18): Result.005 file - promoters50/1534228
ctcgtgtatataaattca

SEQ ID NO: 174837 - DNA, 18 bp, Unknown
  misc_feature (1)..( 18): Result.005 file - promoters50/1534228
tcattgacaataaattac

SEQ ID NO: 174838 - DNA, 18 bp, Unknown
  misc_feature (1)..( 18): Result.005 file - promoters50/1534228
ctcctgtctatatattca

SEQ ID NO: 174839 - DNA, 18 bp, Unknown
  misc_feature (1)..( 18): Result.005 file - promoters50/1534228
cactcgtgtatataaatt

SEQ ID NO: 174840 - DNA, 18 bp, Unknown
  misc_feature (1)..( 18): Result.005 file - promoters50/1534228
ttctaatctatttaaccc

SEQ ID NO: 174841 - DNA, 18 bp, Unknown
  misc_feature (1)..( 18): Result.005 file - promoters50/1534228
ctcctgtctatatattca

SEQ ID NO: 174842 - DNA, 7 bp, Unknown
  misc_feature (1)..( 7): Result.005 file - promoters50/1534228
taattta

SEQ ID NO: 174843 - DNA, 7 bp, Unknown
  misc_feature (1)..( 7): Result.005 file - promoters50/1534228
taatttg

SEQ ID NO: 174844 - DNA, 7 bp, Unknown
  misc_feature (1)..( 7): Result.005 file - promoters50/1534228
aaatttg

SEQ ID NO: 174845 - DNA, 8 bp, Unknown
  misc_feature (1)..( 8): Result.005 file - promoters50/1534269
tatcttct

SEQ ID NO: 174846 - DNA, 8 bp, Unknown
  misc_feature (1)..( 8): Result.005 file - promoters50/1534269
tatcttct

SEQ ID NO: 174847 - DNA, 8 bp, Unknown
  misc_feature (1)..( 8): Result.005 file - promoters50/1534269
tattttcg

SEQ ID NO: 174848 - DNA, 10 bp, Unknown
  misc_feature (1)..( 10): Result.005 file - promoters50/1534269
agattcttga

SEQ ID NO: 174849 - DNA, 10 bp, Unknown
  misc_feature (1)..( 10): Result.005 file - promoters50/1534269
ggatttttgt

SEQ ID NO: 174850 - DNA, 10 bp, Unknown
  misc_feature (1)..( 10): Result.005 file - promoters50/1534269
agattgttga

SEQ ID NO: 174851 - DNA, 8 bp, Unknown
  misc_feature (1)..( 8): Result.005 file - promoters50/1534269
tatcaaat

SEQ ID NO: 174852 - DNA, 8 bp, Unknown
  misc_feature (1)..( 8): Result.005 file - promoters50/1534269
tttcaaat

SEQ ID NO: 174853 - DNA, 8 bp, Unknown
  misc_feature (1)..( 8): Result.005 file - promoters50/1534269
ttttaaat

SEQ ID NO: 174854 - DNA, 11 bp, Unknown
  misc_feature (1)..( 11): Result.005 file - promoters50/1534269
gttgattgttc

SEQ ID NO: 174855 - DNA, 11 bp, Unknown
  misc_feature (1)..( 11): Result.005 file - promoters50/1534269
ccaaatttttc

SEQ ID NO: 174856 - DNA, 11 bp, Unknown
  misc_feature (1)..( 11): Result.005 file - promoters50/1534269
ccaaactttat

SEQ ID NO: 174857 - DNA, 9 bp, Unknown
  misc_feature (1)..( 9): Result.005 file - promoters50/1534269
tgaaagaat

SEQ ID NO: 174858 - DNA, 9 bp, Unknown
  misc_feature (1)..( 9): Result.005 file - promoters50/1534269
ccaaagaaa

SEQ ID NO: 174859 - DNA, 9 bp, Unknown
  misc_feature (1)..( 9): Result.005 file - promoters50/1534269
tgaaaaaat

SEQ ID NO: 174860 - DNA, 8 bp, Unknown
  misc_feature (1)..( 8): Result.005 file - promoters50/1534269
gatgtatt

SEQ ID NO: 174861 - DNA, 8 bp, Unknown
  misc_feature (1)..( 8): Result.005 file - promoters50/1534269
gatatata

SEQ ID NO: 174862 - DNA, 8 bp, Unknown
  misc_feature (1)..( 8): Result.005 file - promoters50/1534269
tatggatt

SEQ ID NO: 174863 - DNA, 10 bp, Unknown
  misc_feature (1)..( 10): Result.005 file - promoters50/1534276
atgaaattct

SEQ ID NO: 174864 - DNA, 10 bp, Unknown
  misc_feature (1)..( 10): Result.005 file - promoters50/1534276
atcaaattct

SEQ ID NO: 174865 - DNA, 10 bp, Unknown
  misc_feature (1)..( 10): Result.005 file - promoters50/1534276
atcaaattta

SEQ ID NO: 174866 - DNA, 7 bp, Unknown
  misc_feature (1)..( 7): Result.005 file - promoters50/1534276
aagcaac

SEQ ID NO: 174867 - DNA, 7 bp, Unknown
  misc_feature (1)..( 7): Result.005 file - promoters50/1534276
cagcaac

SEQ ID NO: 174868 - DNA, 7 bp, Unknown
  misc_feature (1)..( 7): Result.005 file - promoters50/1534276
aagcaaa

SEQ ID NO: 174869 - DNA, 8 bp, Unknown
  misc_feature (1)..( 8): Result.005 file - promoters50/1534276
taaataaa

SEQ ID NO: 174870 - DNA, 8 bp, Unknown
  misc_feature (1)..( 8): Result.005 file - promoters50/1534276
aaaataaa

SEQ ID NO: 174871 - DNA, 8 bp, Unknown
  misc_feature (1)..( 8): Result.005 file - promoters50/1534276
aaaataca

SEQ ID NO: 174872 - DNA, 13 bp, Unknown
  misc_feature (1)..( 13): Result.005 file - promoters50/1534341
caattaaactatg

SEQ ID NO: 174873 - DNA, 13 bp, Unknown
  misc_feature (1)..( 13): Result.005 file - promoters50/1534341
taattaagctatg

SEQ ID NO: 174874 - DNA, 14 bp, Unknown
  misc_feature (1)..( 14): Result.005 file - promoters50/1534341
tattttaaacagac

SEQ ID NO: 174875 - DNA, 13 bp, Unknown
  misc_feature (1)..( 13): Result.005 file - promoters50/1534341
caagtaaaaacca

SEQ ID NO: 174876 - DNA, 13 bp, Unknown
  misc_feature (1)..( 13): Result.005 file - promoters50/1534341
taattagaaaatg

SEQ ID NO: 174877 - DNA, 14 bp, Unknown
  misc_feature (1)..( 14): Result.005 file - promoters50/1534341
aaagttaaataaag

SEQ ID NO: 174878 - DNA, 8 bp, Unknown
  misc_feature (1)..( 8): Result.005 file - promoters50/1534341
tatatata

SEQ ID NO: 174879 - DNA, 8 bp, Unknown
  misc_feature (1)..( 8): Result.005 file - promoters50/1534341
tatatata

SEQ ID NO: 174880 - DNA, 8 bp, Unknown
  misc_feature (1)..( 8): Result.005 file - promoters50/1534341
tatataaa

SEQ ID NO: 174881 - DNA, 8 bp, Unknown
  misc_feature (1)..( 8): Result.005 file - promoters50/1534341
aatataaa

SEQ ID NO: 174882 - DNA, 8 bp, Unknown
  misc_feature (1)..( 8): Result.005 file - promoters50/1534341
tatataaa

SEQ ID NO: 174883 - DNA, 8 bp, Unknown
  misc_feature (1)..( 8): Result.005 file - promoters50/1534341
aatataat

SEQ ID NO: 174884 - DNA, 9 bp, Unknown
  misc_feature (1)..( 9): Result.005 file - promoters50/1534378
cgtcttctc

SEQ ID NO: 174885 - DNA, 9 bp, Unknown
  misc_feature (1)..( 9): Result.005 file - promoters50/1534378
tatcttctt

SEQ ID NO: 174886 - DNA, 9 bp, Unknown
  misc_feature (1)..( 9): Result.005 file - promoters50/1534378
tattttcaa

SEQ ID NO: 174887 - DNA, 9 bp, Unknown
  misc_feature (1)..( 9): Result.005 file - promoters50/1534378
tatgttttg

SEQ ID NO: 174888 - DNA, 9 bp, Unknown
  misc_feature (1)..( 9): Result.005 file - promoters50/1534378
tgtgttgat

SEQ ID NO: 174889 - DNA, 9 bp, Unknown
  misc_feature (1)..( 9): Result.005 file - promoters50/1534378
acttttcat

SEQ ID NO: 174890 - DNA, 9 bp, Unknown
  misc_feature (1)..( 9): Result.005 file - promoters50/1534390
gacggaaga

SEQ ID NO: 174891 - DNA, 9 bp, Unknown
  misc_feature (1)..( 9): Result.005 file - promoters50/1534390
cacggaact

SEQ ID NO: 174892 - DNA, 9 bp, Unknown
  misc_feature (1)..( 9): Result.005 file - promoters50/1534390
cactgaact

SEQ ID NO: 174893 - DNA, 9 bp, Unknown
  misc_feature (1)..( 9): Result.005 file - promoters50/1534455
tttttagtg

SEQ ID NO: 174894 - DNA, 9 bp, Unknown
  misc_feature (1)..( 9): Result.005 file - promoters50/1534455
gattttgtg

SEQ ID NO: 174895 - DNA, 9 bp, Unknown
  misc_feature (1)..( 9): Result.005 file - promoters50/1534455
gatgttgat

SEQ ID NO: 174896 - DNA, 12 bp, Unknown
  misc_feature (1)..( 12): Result.005 file - promoters50/1534455
aatcaaagattt

SEQ ID NO: 174897 - DNA, 12 bp, Unknown
  misc_feature (1)..( 12): Result.005 file - promoters50/1534455
tatcaaacaaac

SEQ ID NO: 174898 - DNA, 12 bp, Unknown
  misc_feature (1)..( 12): Result.005 file - promoters50/1534455
aataaaacattt

SEQ ID NO: 174899 - DNA, 9 bp, Unknown
  misc_feature (1)..( 9): Result.005 file - promoters50/1534455
tatataata

SEQ ID NO: 174900 - DNA, 9 bp, Unknown
  misc_feature (1)..( 9): Result.005 file - promoters50/1534455
catattata

SEQ ID NO: 174901 - DNA, 9 bp, Unknown
  misc_feature (1)..( 9): Result.005 file - promoters50/1534455
tatatatat

SEQ ID NO: 174902 - DNA, 9 bp, Unknown
  misc_feature (1)..( 9): Result.005 file - promoters50/1534455
atttttata

SEQ ID NO: 174903 - DNA, 9 bp, Unknown
  misc_feature (1)..( 9): Result.005 file - promoters50/1534455
ttttttata

SEQ ID NO: 174904 - DNA, 10 bp, Unknown
  misc_feature (1)..( 10): Result.005 file - promoters50/1534455
tttatttata

SEQ ID NO: 174905 - DNA, 12 bp, Unknown
  misc_feature (1)..( 12): Result.005 file - promoters50/1534455
tcttattatgat

SEQ ID NO: 174906 - DNA, 12 bp, Unknown
  misc_feature (1)..( 12): Result.005 file - promoters50/1534455
tctttttaggat

SEQ ID NO: 174907 - DNA, 12 bp, Unknown
  misc_feature (1)..( 12): Result.005 file - promoters50/1534455
tctgatttattt

SEQ ID NO: 174908 - DNA, 9 bp, Unknown
  misc_feature (1)..( 9): Result.005 file - promoters50/1534455
tgagtattc

SEQ ID NO: 174909 - DNA, 9 bp, Unknown
  misc_feature (1)..( 9): Result.005 file - promoters50/1534455
tgattattt

SEQ ID NO: 174910 - DNA, 9 bp, Unknown
  misc_feature (1)..( 9): Result.005 file - promoters50/1534455
tatttattt

SEQ ID NO: 174911 - DNA, 6 bp, Unknown
  misc_feature (1)..( 6): Result.005 file - promoters50/1534501
aaaaaa

SEQ ID NO: 174912 - DNA, 6 bp, Unknown
  misc_feature (1)..( 6): Result.005 file - promoters50/1534501
aaaaaa

SEQ ID NO: 174913 - DNA, 7 bp, Unknown
  misc_feature (1)..( 7): Result.005 file - promoters50/1534501
aaagaaa

SEQ ID NO: 174914 - DNA, 11 bp, Unknown
  misc_feature (1)..( 11): Result.005 file - promoters50/1534501
cacgttagttg

SEQ ID NO: 174915 - DNA, 11 bp, Unknown
  misc_feature (1)..( 11): Result.005 file - promoters50/1534501
aaaattaattg

SEQ ID NO: 174916 - DNA, 11 bp, Unknown
  misc_feature (1)..( 11): Result.005 file - promoters50/1534501
aaatttaatca

SEQ ID NO: 174917 - DNA, 9 bp, Unknown
  misc_feature (1)..( 9): Result.005 file - promoters50/1534501
tttttttta

SEQ ID NO: 174918 - DNA, 9 bp, Unknown
  misc_feature (1)..( 9): Result.005 file - promoters50/1534501
aatttatta

SEQ ID NO: 174919 - DNA, 9 bp, Unknown
  misc_feature (1)..( 9): Result.005 file - promoters50/1534501
aatttatat

SEQ ID NO: 174920 - DNA, 7 bp, Unknown
  misc_feature (1)..( 7): Result.005 file - promoters50/1534501
agatcaa

SEQ ID NO: 174921 - DNA, 7 bp, Unknown
  misc_feature (1)..( 7): Result.005 file - promoters50/1534501
ggatcaa

SEQ ID NO: 174922 - DNA, 7 bp, Unknown
  misc_feature (1)..( 7): Result.005 file - promoters50/1534501
agaccaa

SEQ ID NO: 174923 - DNA, 18 bp, Unknown
  misc_feature (1)..( 18): Result.005 file - promoters50/1534524
ctcctgtctatatattca

SEQ ID NO: 174924 - DNA, 18 bp, Unknown
  misc_feature (1)..( 18): Result.005 file - promoters50/1534524
ctcgtgtatataaattca

SEQ ID NO: 174925 - DNA, 18 bp, Unknown
  misc_feature (1)..( 18): Result.005 file - promoters50/1534524
aagtttgggatatatcat

SEQ ID NO: 174926 - DNA, 18 bp, Unknown
  misc_feature (1)..( 18): Result.005 file - promoters50/1534524
aatctctctataaatacc

SEQ ID NO: 174927 - DNA, 18 bp, Unknown
  misc_feature (1)..( 18): Result.005 file - promoters50/1534524
caaccttctataaatact

SEQ ID NO: 174928 - DNA, 18 bp, Unknown
  misc_feature (1)..( 18): Result.005 file - promoters50/1534524
tatatttatacaaatccc

SEQ ID NO: 174929 - DNA, 14 bp, Unknown
  misc_feature (1)..( 14): Result.005 file - promoters50/1534524
acgtattcagctat

SEQ ID NO: 174930 - DNA, 14 bp, Unknown
  misc_feature (1)..( 14): Result.005 file - promoters50/1534524
gaatatacagaatg

SEQ ID NO: 174931 - DNA, 14 bp, Unknown
  misc_feature (1)..( 14): Result.005 file - promoters50/1534524
tagtatacagttgg

SEQ ID NO: 174932 - DNA, 14 bp, Unknown
  misc_feature (1)..( 14): Result.005 file - promoters50/1534524
tcaaatatagtata

SEQ ID NO: 174933 - DNA, 14 bp, Unknown
  misc_feature (1)..( 14): Result.005 file - promoters50/1534524
gaaaatactttact

SEQ ID NO: 174934 - DNA, 13 bp, Unknown
  misc_feature (1)..( 13): Result.005 file - promoters50/1534524
caaacacaatcct

SEQ ID NO: 174935 - DNA, 13 bp, Unknown
  misc_feature (1)..( 13): Result.005 file - promoters50/1534524
aaaaaacaagaaa

SEQ ID NO: 174936 - DNA, 13 bp, Unknown
  misc_feature (1)..( 13): Result.005 file - promoters50/1534524
agttcacaaacct

SEQ ID NO: 174937 - DNA, 13 bp, Unknown
  misc_feature (1)..( 13): Result.005 file - promoters50/1534524
cacatacatgaat

SEQ ID NO: 174938 - DNA, 13 bp, Unknown
  misc_feature (1)..( 13): Result.005 file - promoters50/1534524
aaaaaagatgcaa

SEQ ID NO: 174939 - DNA, 9 bp, Unknown
  misc_feature (1)..( 9): Result.005 file - promoters50/1534570
ctaatttta

SEQ ID NO: 174940 - DNA, 9 bp, Unknown
  misc_feature (1)..( 9): Result.005 file - promoters50/1534570
tcaattttg

SEQ ID NO: 174941 - DNA, 9 bp, Unknown
  misc_feature (1)..( 9): Result.005 file - promoters50/1534570
gtaatttaa

SEQ ID NO: 174942 - DNA, 9 bp, Unknown
  misc_feature (1)..( 9): Result.005 file - promoters50/1534570
atcattttt

SEQ ID NO: 174943 - DNA, 7 bp, Unknown
  misc_feature (1)..( 7): Result.005 file - promoters50/1534570
atttaat

SEQ ID NO: 174944 - DNA, 7 bp, Unknown
  misc_feature (1)..( 7): Result.005 file - promoters50/1534570
atttaac

SEQ ID NO: 174945 - DNA, 7 bp, Unknown
  misc_feature (1)..( 7): Result.005 file - promoters50/1534570
gtttaac

SEQ ID NO: 174946 - DNA, 9 bp, Unknown
  misc_feature (1)..( 9): Result.005 file - promoters50/1534570
aatttattt

SEQ ID NO: 174947 - DNA, 9 bp, Unknown
  misc_feature (1)..( 9): Result.005 file - promoters50/1534570
aatgtatcg

SEQ ID NO: 174948 - DNA, 9 bp, Unknown
  misc_feature (1)..( 9): Result.005 file - promoters50/1534570
cattttttt

SEQ ID NO: 174949 - DNA, 9 bp, Unknown
  misc_feature (1)..( 9): Result.005 file - promoters50/1534570
cattttcgt

SEQ ID NO: 174950 - DNA, 9 bp, Unknown
  misc_feature (1)..( 9): Result.005 file - promoters50/1534570
tatttttac

SEQ ID NO: 174951 - DNA, 9 bp, Unknown
  misc_feature (1)..( 9): Result.005 file - promoters50/1534570
aattcttac

SEQ ID NO: 174952 - DNA, 9 bp, Unknown
  misc_feature (1)..( 9): Result.005 file - promoters50/1534570
aatccttga

SEQ ID NO: 174953 - DNA, 8 bp, Unknown
  misc_feature (1)..( 8): Result.005 file - promoters50/1534570
aatttgtt

SEQ ID NO: 174954 - DNA, 8 bp, Unknown
  misc_feature (1)..( 8): Result.005 file - promoters50/1534570
attttgtt

SEQ ID NO: 174955 - DNA, 8 bp, Unknown
  misc_feature (1)..( 8): Result.005 file - promoters50/1534570
attttgtg

SEQ ID NO: 174956 - DNA, 11 bp, Unknown
  misc_feature (1)..( 11): Result.005 file - promoters50/1534570
attagaaatat

SEQ ID NO: 174957 - DNA, 11 bp, Unknown
  misc_feature (1)..( 11): Result.005 file - promoters50/1534570
attaaaaaaat

SEQ ID NO: 174958 - DNA, 11 bp, Unknown
  misc_feature (1)..( 11): Result.005 file - promoters50/1534570
agtaaaagaat

SEQ ID NO: 174959 - DNA, 7 bp, Unknown
  misc_feature (1)..( 7): Result.005 file - promoters50/1534570
acacaga

SEQ ID NO: 174960 - DNA, 7 bp, Unknown
  misc_feature (1)..( 7): Result.005 file - promoters50/1534570
acagaga

SEQ ID NO: 174961 - DNA, 7 bp, Unknown
  misc_feature (1)..( 7): Result.005 file - promoters50/1534570
acagaaa

SEQ ID NO: 174962 - DNA, 8 bp, Unknown
  misc_feature (1)..( 8): Result.005 file - promoters50/1534591
tatataag

SEQ ID NO: 174963 - DNA, 8 bp, Unknown
  misc_feature (1)..( 8): Result.005 file - promoters50/1534591
tatataat

SEQ ID NO: 174964 - DNA, 8 bp, Unknown
  misc_feature (1)..( 8): Result.005 file - promoters50/1534591
aatacaat

SEQ ID NO: 174965 - DNA, 11 bp, Unknown
  misc_feature (1)..( 11): Result.005 file - promoters50/1534591
attattagaca

SEQ ID NO: 174966 - DNA, 11 bp, Unknown
  misc_feature (1)..( 11): Result.005 file - promoters50/1534591
attcttacaca

SEQ ID NO: 174967 - DNA, 11 bp, Unknown
  misc_feature (1)..( 11): Result.005 file - promoters50/1534591
gttattaatca

SEQ ID NO: 174968 - DNA, 8 bp, Unknown
  misc_feature (1)..( 8): Result.005 file - promoters50/1534591
aatcgaat

SEQ ID NO: 174969 - DNA, 8 bp, Unknown
  misc_feature (1)..( 8): Result.005 file - promoters50/1534591
aatagaaa

SEQ ID NO: 174970 - DNA, 8 bp, Unknown
  misc_feature (1)..( 8): Result.005 file - promoters50/1534591
gataaaaa

SEQ ID NO: 174971 - DNA, 10 bp, Unknown
  misc_feature (1)..( 10): Result.005 file - promoters50/1534615
tcaaataaaa

SEQ ID NO: 174972 - DNA, 10 bp, Unknown
  misc_feature (1)..( 10): Result.005 file - promoters50/1534615
tcaaatatta

SEQ ID NO: 174973 - DNA, 10 bp, Unknown
  misc_feature (1)..( 10): Result.005 file - promoters50/1534615
cgaaagaaag

SEQ ID NO: 174974 - DNA, 10 bp, Unknown
  misc_feature (1)..( 10): Result.005 file - promoters50/1534615
aagaataaaa

SEQ ID NO: 174975 - DNA, 10 bp, Unknown
  misc_feature (1)..( 10): Result.005 file - promoters50/1534615
gaaaatgtta

SEQ ID NO: 174976 - DNA, 10 bp, Unknown
  misc_feature (1)..( 10): Result.005 file - promoters50/1534615
ttcaataaac

SEQ ID NO: 174977 - DNA, 10 bp, Unknown
  misc_feature (1)..( 10): Result.005 file - promoters50/1534629
gtttatcagc

SEQ ID NO: 174978 - DNA, 10 bp, Unknown
  misc_feature (1)..( 10): Result.005 file - promoters50/1534629
ttttatcatc

SEQ ID NO: 174979 - DNA, 10 bp, Unknown
  misc_feature (1)..( 10): Result.005 file - promoters50/1534629
ttttatttat

SEQ ID NO: 174980 - DNA, 11 bp, Unknown
  misc_feature (1)..( 11): Result.005 file - promoters50/1534667
aaaacaaaaat

SEQ ID NO: 174981 - DNA, 11 bp, Unknown
  misc_feature (1)..( 11): Result.005 file - promoters50/1534667
tgcccaaaaaa

SEQ ID NO: 174982 - DNA, 11 bp, Unknown
  misc_feature (1)..( 11): Result.005 file - promoters50/1534667
aaaagaaaaat

SEQ ID NO: 174983 - DNA, 11 bp, Unknown
  misc_feature (1)..( 11): Result.005 file - promoters50/1534667
tactaattaac

SEQ ID NO: 174984 - DNA, 11 bp, Unknown
  misc_feature (1)..( 11): Result.005 file - promoters50/1534667
caataaataat

SEQ ID NO: 174985 - DNA, 11 bp, Unknown
  misc_feature (1)..( 11): Result.005 file - promoters50/1534667
caaaaaataat

SEQ ID NO: 174986 - DNA, 12 bp, Unknown
  misc_feature (1)..( 12): Result.005 file - promoters50/1534671
tctttagagctt

SEQ ID NO: 174987 - DNA, 12 bp, Unknown
  misc_feature (1)..( 12): Result.005 file - promoters50/1534671
ttattagaactt

SEQ ID NO: 174988 - DNA, 12 bp, Unknown
  misc_feature (1)..( 12): Result.005 file - promoters50/1534671
tcttttgagtat

SEQ ID NO: 174989 - DNA, 12 bp, Unknown
  misc_feature (1)..( 12): Result.005 file - promoters50/1534671
tcttaagatttc

SEQ ID NO: 174990 - DNA, 12 bp, Unknown
  misc_feature (1)..( 12): Result.005 file - promoters50/1534671
ttgtaatatttg

SEQ ID NO: 174991 - DNA, 12 bp, Unknown
  misc_feature (1)..( 12): Result.005 file - promoters50/1534671
tcattaaaattc

SEQ ID NO: 174992 - DNA, 10 bp, Unknown
  misc_feature (1)..( 10): Result.005 file - promoters50/1534671
caaaatgagt

SEQ ID NO: 174993 - DNA, 10 bp, Unknown
  misc_feature (1)..( 10): Result.005 file - promoters50/1534671
caagatgaga

SEQ ID NO: 174994 - DNA, 10 bp, Unknown
  misc_feature (1)..( 10): Result.005 file - promoters50/1534671
caacatgaat

SEQ ID NO: 174995 - DNA, 10 bp, Unknown
  misc_feature (1)..( 10): Result.005 file - promoters50/1534671
ttacatgagt

SEQ ID NO: 174996 - DNA, 10 bp, Unknown
  misc_feature (1)..( 10): Result.005 file - promoters50/1534671
aaaaatgcaa

SEQ ID NO: 174997 - DNA, 10 bp, Unknown
  misc_feature (1)..( 10): Result.005 file - promoters50/1534671
tacgatcaga

SEQ ID NO: 174998 - DNA, 19 bp, Unknown
  misc_feature (1)..( 19): Result.005 file - promoters50/1534671
tttctagtatttgttttgt

SEQ ID NO: 174999 - DNA, 19 bp, Unknown
  misc_feature (1)..( 19): Result.005 file - promoters50/1534671
gactagaactttgatttga

SEQ ID NO: 175000 - DNA, 19 bp, Unknown
  misc_feature (1)..( 19): Result.005 file - promoters50/1534671
atttttttatttatttttt

SEQ ID NO: 175001 - DNA, 19 bp, Unknown
  misc_feature (1)..( 19): Result.005 file - promoters50/1534671
ctaaatgacaatgatgtga

SEQ ID NO: 175002 - DNA, 19 bp, Unknown
  misc_feature (1)..( 19): Result.005 file - promoters50/1534671
attttcttaattattatga

SEQ ID NO: 175003 - DNA, 19 bp, Unknown
  misc_feature (1)..( 19): Result.005 file - promoters50/1534671
ctcaatttttttaattatt

SEQ ID NO: 175004 - DNA, 11 bp, Unknown
  misc_feature (1)..( 11): Result.005 file - promoters50/1535124
tcagacacaac

SEQ ID NO: 175005 - DNA, 11 bp, Unknown
  misc_feature (1)..( 11): Result.005 file - promoters50/1535124
ttgaacaaaac

SEQ ID NO: 175006 - DNA, 11 bp, Unknown
  misc_feature (1)..( 11): Result.005 file - promoters50/1535124
ttgatcaaaca

SEQ ID NO: 175007 - DNA, 9 bp, Unknown
  misc_feature (1)..( 9): Result.005 file - promoters50/1535124
gtttgcaag

SEQ ID NO: 175008 - DNA, 9 bp, Unknown
  misc_feature (1)..( 9): Result.005 file - promoters50/1535124
ttttacaat

SEQ ID NO: 175009 - DNA, 9 bp, Unknown
  misc_feature (1)..( 9): Result.005 file - promoters50/1535124
ttttataat

SEQ ID NO: 175010 - DNA, 6 bp, Unknown
  misc_feature (1)..( 6): Result.005 file - promoters50/1535124
tttatt

SEQ ID NO: 175011 - DNA, 6 bp, Unknown
  misc_feature (1)..( 6): Result.005 file - promoters50/1535124
tttatt

SEQ ID NO: 175012 - DNA, 6 bp, Unknown
  misc_feature (1)..( 6): Result.005 file - promoters50/1535124
tttatt

SEQ ID NO: 175013 - DNA, 9 bp, Unknown
  misc_feature (1)..( 9): Result.005 file - promoters50/1535124
tcagacaca

SEQ ID NO: 175014 - DNA, 9 bp, Unknown
  misc_feature (1)..( 9): Result.005 file - promoters50/1535124
tcaaacaac

SEQ ID NO: 175015 - DNA, 9 bp, Unknown
  misc_feature (1)..( 9): Result.005 file - promoters50/1535124
ttgaacaaa

SEQ ID NO: 175016 - DNA, 9 bp, Unknown
  misc_feature (1)..( 9): Result.005 file - promoters50/1535124
gtttggatg

SEQ ID NO: 175017 - DNA, 9 bp, Unknown
  misc_feature (1)..( 9): Result.005 file - promoters50/1535124
ttttgcatg

SEQ ID NO: 175018 - DNA, 9 bp, Unknown
  misc_feature (1)..( 9): Result.005 file - promoters50/1535124
ttttgcttt

SEQ ID NO: 175019 - DNA, 8 bp, Unknown
  misc_feature (1)..( 8): Result.005 file - promoters50/1535124
tttatttt

SEQ ID NO: 175020 - DNA, 8 bp, Unknown
  misc_feature (1)..( 8): Result.005 file - promoters50/1535124
tttatttt

SEQ ID NO: 175021 - DNA, 8 bp, Unknown
  misc_feature (1)..( 8): Result.005 file - promoters50/1535124
tttattgt

SEQ ID NO: 175022 - DNA, 8 bp, Unknown
  misc_feature (1)..( 8): Result.005 file - promoters50/1535124
gattttgg

SEQ ID NO: 175023 - DNA, 8 bp, Unknown
  misc_feature (1)..( 8): Result.005 file - promoters50/1535124
tattttgg

SEQ ID NO: 175024 - DNA, 8 bp, Unknown
  misc_feature (1)..( 8): Result.005 file - promoters50/1535124
tattttta

SEQ ID NO: 175025 - DNA, 9 bp, Unknown
  misc_feature (1)..( 9): Result.005 file - promoters50/1535124
gcccattaa

SEQ ID NO: 175026 - DNA, 9 bp, Unknown
  misc_feature (1)..( 9): Result.005 file - promoters50/1535124
tttcattaa

SEQ ID NO: 175027 - DNA, 9 bp, Unknown
  misc_feature (1)..( 9): Result.005 file - promoters50/1535124
tttcattat

SEQ ID NO: 175028 - DNA, 8 bp, Unknown
  misc_feature (1)..( 8): Result.005 file - promoters50/1535145
tagattct

SEQ ID NO: 175029 - DNA, 8 bp, Unknown
  misc_feature (1)..( 8): Result.005 file - promoters50/1535145
tagattca

SEQ ID NO: 175030 - DNA, 8 bp, Unknown
  misc_feature (1)..( 8): Result.005 file - promoters50/1535145
gagagtca

SEQ ID NO: 175031 - DNA, 9 bp, Unknown
  misc_feature (1)..( 9): Result.005 file - promoters50/1537300
cgaggcttt

SEQ ID NO: 175032 - DNA, 9 bp, Unknown
  misc_feature (1)..( 9): Result.005 file - promoters50/1537300
agaggcttg

SEQ ID NO: 175033 - DNA, 9 bp, Unknown
  misc_feature (1)..( 9): Result.005 file - promoters50/1537300
agaggattg

SEQ ID NO: 175034 - DNA, 10 bp, Unknown
  misc_feature (1)..( 10): Result.005 file - promoters50/1537314
ataagaaaag

SEQ ID NO: 175035 - DNA, 10 bp, Unknown
  misc_feature (1)..( 10): Result.005 file - promoters50/1537314
tgaagaaaaa

SEQ ID NO: 175036 - DNA, 10 bp, Unknown
  misc_feature (1)..( 10): Result.005 file - promoters50/1537314
ctaataaaaa

SEQ ID NO: 175037 - DNA, 10 bp, Unknown
  misc_feature (1)..( 10): Result.005 file - promoters50/1537314
tgatgaaaca

SEQ ID NO: 175038 - DNA, 10 bp, Unknown
  misc_feature (1)..( 10): Result.005 file - promoters50/1537314
tgaagaaaaa

SEQ ID NO: 175039 - DNA, 10 bp, Unknown
  misc_feature (1)..( 10): Result.005 file - promoters50/1537314
ttgtgaaact

SEQ ID NO: 175040 - DNA, 17 bp, Unknown
  misc_feature (1)..( 17): Result.005 file - promoters50/1537314
atatttgattttgtttg

SEQ ID NO: 175041 - DNA, 17 bp, Unknown
  misc_feature (1)..( 17): Result.005 file - promoters50/1537314
attaaaatgtttgttgt

SEQ ID NO: 175042 - DNA, 17 bp, Unknown
  misc_feature (1)..( 17): Result.005 file - promoters50/1537314
ttgtttttttttgtaag

SEQ ID NO: 175043 - DNA, 17 bp, Unknown
  misc_feature (1)..( 17): Result.005 file - promoters50/1537314
aaaatataaattgtttg

SEQ ID NO: 175044 - DNA, 17 bp, Unknown
  misc_feature (1)..( 17): Result.005 file - promoters50/1537314
catcggagatttgttag

SEQ ID NO: 175045 - DNA, 17 bp, Unknown
  misc_feature (1)..( 17): Result.005 file - promoters50/1537314
ttcatctaatttgtttg

SEQ ID NO: 175046 - DNA, 9 bp, Unknown
  misc_feature (1)..( 9): Result.005 file - promoters50/1537314
ataaaatgc

SEQ ID NO: 175047 - DNA, 9 bp, Unknown
  misc_feature (1)..( 9): Result.005 file - promoters50/1537314
caaaaatgg

SEQ ID NO: 175048 - DNA, 9 bp, Unknown
  misc_feature (1)..( 9): Result.005 file - promoters50/1537314
tgaaaatgc

SEQ ID NO: 175049 - DNA, 9 bp, Unknown
  misc_feature (1)..( 9): Result.005 file - promoters50/1537314
aaaaaatgt

SEQ ID NO: 175050 - DNA, 10 bp, Unknown
  misc_feature (1)..( 10): Result.005 file - promoters50/1537314
aaaaacatgt

SEQ ID NO: 175051 - DNA, 10 bp, Unknown
  misc_feature (1)..( 10): Result.005 file - promoters50/1537314
aaaacaattt

SEQ ID NO: 175052 - DNA, 9 bp, Unknown
  misc_feature (1)..( 9): Result.005 file - promoters50/1537314
ttttataaa

SEQ ID NO: 175053 - DNA, 9 bp, Unknown
  misc_feature (1)..( 9): Result.005 file - promoters50/1537314
ttttaaaaa

SEQ ID NO: 175054 - DNA, 9 bp, Unknown
  misc_feature (1)..( 9): Result.005 file - promoters50/1537314
ttttttaaa

SEQ ID NO: 175055 - DNA, 9 bp, Unknown
  misc_feature (1)..( 9): Result.005 file - promoters50/1537314
tattataat

SEQ ID NO: 175056 - DNA, 9 bp, Unknown
  misc_feature (1)..( 9): Result.005 file - promoters50/1537314
aattaaaat

SEQ ID NO: 175057 - DNA, 9 bp, Unknown
  misc_feature (1)..( 9): Result.005 file - promoters50/1537314
ggttttaat

SEQ ID NO: 175058 - DNA, 11 bp, Unknown
  misc_feature (1)..( 11): Result.005 file - promoters50/1537314
ggataacgtgg

SEQ ID NO: 175059 - DNA, 11 bp, Unknown
  misc_feature (1)..( 11): Result.005 file - promoters50/1537314
aacaaacatgg

SEQ ID NO: 175060 - DNA, 11 bp, Unknown
  misc_feature (1)..( 11): Result.005 file - promoters50/1537314
ggattacgtgg

SEQ ID NO: 175061 - DNA, 11 bp, Unknown
  misc_feature (1)..( 11): Result.005 file - promoters50/1537314
taaaaacatgt

SEQ ID NO: 175062 - DNA, 11 bp, Unknown
  misc_feature (1)..( 11): Result.005 file - promoters50/1537314
gaaaaaaatgt

SEQ ID NO: 175063 - DNA, 10 bp, Unknown
  misc_feature (1)..( 10): Result.005 file - promoters50/1537314
caaaacaatt

SEQ ID NO: 175064 - DNA, 10 bp, Unknown
  misc_feature (1)..( 10): Result.005 file - promoters50/1537336
ctatatatct

SEQ ID NO: 175065 - DNA, 10 bp, Unknown
  misc_feature (1)..( 10): Result.005 file - promoters50/1537336
caatagatct

SEQ ID NO: 175066 - DNA, 10 bp, Unknown
  misc_feature (1)..( 10): Result.005 file - promoters50/1537336
ttgtatatca

SEQ ID NO: 175067 - DNA, 10 bp, Unknown
  misc_feature (1)..( 10): Result.005 file - promoters50/1537336
caaaagaaac

SEQ ID NO: 175068 - DNA, 10 bp, Unknown
  misc_feature (1)..( 10): Result.005 file - promoters50/1537336
agaaagaacg

SEQ ID NO: 175069 - DNA, 10 bp, Unknown
  misc_feature (1)..( 10): Result.005 file - promoters50/1537336
atatagatac

SEQ ID NO: 175070 - DNA, 10 bp, Unknown
  misc_feature (1)..( 10): Result.005 file - promoters50/1537336
acatatatct

SEQ ID NO: 175071 - DNA, 10 bp, Unknown
  misc_feature (1)..( 10): Result.005 file - promoters50/1537336
aagtatatat

SEQ ID NO: 175072 - DNA, 10 bp, Unknown
  misc_feature (1)..( 10): Result.005 file - promoters50/1537336
gcagaaattg

SEQ ID NO: 175073 - DNA, 10 bp, Unknown
  misc_feature (1)..( 10): Result.005 file - promoters50/1537336
agcgaatttg

SEQ ID NO: 175074 - DNA, 10 bp, Unknown
  misc_feature (1)..( 10): Result.005 file - promoters50/1537336
taagaatttg

SEQ ID NO: 175075 - DNA, 10 bp, Unknown
  misc_feature (1)..( 10): Result.005 file - promoters50/1537336
ttagagttta

SEQ ID NO: 175076 - DNA, 10 bp, Unknown
  misc_feature (1)..( 10): Result.005 file - promoters50/1537336
taaaaattta

SEQ ID NO: 175077 - DNA, 10 bp, Unknown
  misc_feature (1)..( 10): Result.005 file - promoters50/1537336
gtataattta

SEQ ID NO: 175078 - DNA, 8 bp, Unknown
  misc_feature (1)..( 8): Result.005 file - promoters50/1537456
cttccttt

SEQ ID NO: 175079 - DNA, 8 bp, Unknown
  misc_feature (1)..( 8): Result.005 file - promoters50/1537456
ctttcttc

SEQ ID NO: 175080 - DNA, 8 bp, Unknown
  misc_feature (1)..( 8): Result.005 file - promoters50/1537456
ctttcttt

SEQ ID NO: 175081 - DNA, 7 bp, Unknown
  misc_feature (1)..( 7): Result.005 file - promoters50/1537605
attaaaa

SEQ ID NO: 175082 - DNA, 7 bp, Unknown
  misc_feature (1)..( 7): Result.005 file - promoters50/1537605
atttaaa

SEQ ID NO: 175083 - DNA, 7 bp, Unknown
  misc_feature (1)..( 7): Result.005 file - promoters50/1537605
attaaat

SEQ ID NO: 175084 - DNA, 9 bp, Unknown
  misc_feature (1)..( 9): Result.005 file - promoters50/1537605
aaattatta

SEQ ID NO: 175085 - DNA, 9 bp, Unknown
  misc_feature (1)..( 9): Result.005 file - promoters50/1537605
ccattatta

SEQ ID NO: 175086 - DNA, 9 bp, Unknown
  misc_feature (1)..( 9): Result.005 file - promoters50/1537605
aaattataa

SEQ ID NO: 175087 - DNA, 7 bp, Unknown
  misc_feature (1)..( 7): Result.005 file - promoters50/1537605
cttttgt

SEQ ID NO: 175088 - DNA, 7 bp, Unknown
  misc_feature (1)..( 7): Result.005 file - promoters50/1537605
cttttga

SEQ ID NO: 175089 - DNA, 7 bp, Unknown
  misc_feature (1)..( 7): Result.005 file - promoters50/1537605
tttttgt

SEQ ID NO: 175090 - DNA, 12 bp, Unknown
  misc_feature (1)..( 12): Result.005 file - promoters50/1537605
cctagtgatcca

SEQ ID NO: 175091 - DNA, 12 bp, Unknown
  misc_feature (1)..( 12): Result.005 file - promoters50/1537605
cctagtaatctc

SEQ ID NO: 175092 - DNA, 12 bp, Unknown
  misc_feature (1)..( 12): Result.005 file - promoters50/1537605
attgataaactc

SEQ ID NO: 175093 - DNA, 9 bp, Unknown
  misc_feature (1)..( 9): Result.005 file - promoters50/1537617
tgtatgcat

SEQ ID NO: 175094 - DNA, 9 bp, Unknown
  misc_feature (1)..( 9): Result.005 file - promoters50/1537617
agtaagcat

SEQ ID NO: 175095 - DNA, 9 bp, Unknown
  misc_feature (1)..( 9): Result.005 file - promoters50/1537617
tgtatggtg

SEQ ID NO: 175096 - DNA, 10 bp, Unknown
  misc_feature (1)..( 10): Result.005 file - promoters50/1537617
tcaattttat

SEQ ID NO: 175097 - DNA, 10 bp, Unknown
  misc_feature (1)..( 10): Result.005 file - promoters50/1537617
tcaatcttat

SEQ ID NO: 175098 - DNA, 10 bp, Unknown
  misc_feature (1)..( 10): Result.005 file - promoters50/1537617
ttaattttta

SEQ ID NO: 175099 - DNA, 8 bp, Unknown
  misc_feature (1)..( 8): Result.005 file - promoters50/1537617
taacatta

SEQ ID NO: 175100 - DNA, 8 bp, Unknown
  misc_feature (1)..( 8): Result.005 file - promoters50/1537617
taaaattt

SEQ ID NO: 175101 - DNA, 8 bp, Unknown
  misc_feature (1)..( 8): Result.005 file - promoters50/1537617
ataaattt

SEQ ID NO: 175102 - DNA, 8 bp, Unknown
  misc_feature (1)..( 8): Result.005 file - promoters50/1537617
ttataaat

SEQ ID NO: 175103 - DNA, 8 bp, Unknown
  misc_feature (1)..( 8): Result.005 file - promoters50/1537617
gtattaat

SEQ ID NO: 175104 - DNA, 8 bp, Unknown
  misc_feature (1)..( 8): Result.005 file - promoters50/1537617
taattaaa

SEQ ID NO: 175105 - DNA, 7 bp, Unknown
  misc_feature (1)..( 7): Result.005 file - promoters50/1537617
attattt

SEQ ID NO: 175106 - DNA, 7 bp, Unknown
  misc_feature (1)..( 7): Result.005 file - promoters50/1537617
attcttt

SEQ ID NO: 175107 - DNA, 7 bp, Unknown
  misc_feature (1)..( 7): Result.005 file - promoters50/1537617
tttattt

SEQ ID NO: 175108 - DNA, 8 bp, Unknown
  misc_feature (1)..( 8): Result.005 file - promoters50/1537617
tctcttaa

SEQ ID NO: 175109 - DNA, 8 bp, Unknown
  misc_feature (1)..( 8): Result.005 file - promoters50/1537617
tatcttaa

SEQ ID NO: 175110 - DNA, 8 bp, Unknown
  misc_feature (1)..( 8): Result.005 file - promoters50/1537617
tattttat

SEQ ID NO: 175111 - DNA, 9 bp, Unknown
  misc_feature (1)..( 9): Result.005 file - promoters50/1537617
aatcaatag

SEQ ID NO: 175112 - DNA, 9 bp, Unknown
  misc_feature (1)..( 9): Result.005 file - promoters50/1537617
aataaatag

SEQ ID NO: 175113 - DNA, 9 bp, Unknown
  misc_feature (1)..( 9): Result.005 file - promoters50/1537617
gatatataa

SEQ ID NO: 175114 - DNA, 7 bp, Unknown
  misc_feature (1)..( 7): Result.005 file - promoters50/1538641
ataaaat

SEQ ID NO: 175115 - DNA, 7 bp, Unknown
  misc_feature (1)..( 7): Result.005 file - promoters50/1538641
ataaaat

SEQ ID NO: 175116 - DNA, 7 bp, Unknown
  misc_feature (1)..( 7): Result.005 file - promoters50/1538641
gtaaaat

SEQ ID NO: 175117 - DNA, 9 bp, Unknown
  misc_feature (1)..( 9): Result.005 file - promoters50/1538641
atcaattct

SEQ ID NO: 175118 - DNA, 9 bp, Unknown
  misc_feature (1)..( 9): Result.005 file - promoters50/1538641
atctatttt

SEQ ID NO: 175119 - DNA, 9 bp, Unknown
  misc_feature (1)..( 9): Result.005 file - promoters50/1538641
aactatttt

SEQ ID NO: 175120 - DNA, 10 bp, Unknown
  misc_feature (1)..( 10): Result.005 file - promoters50/1538782
aatagaaagt

SEQ ID NO: 175121 - DNA, 10 bp, Unknown
  misc_feature (1)..( 10): Result.005 file - promoters50/1538782
tatataaaga

SEQ ID NO: 175122 - DNA, 10 bp, Unknown
  misc_feature (1)..( 10): Result.005 file - promoters50/1538782
aatataaaac

SEQ ID NO: 175123 - DNA, 10 bp, Unknown
  misc_feature (1)..( 10): Result.005 file - promoters50/1538782
tttataaaac

SEQ ID NO: 175124 - DNA, 10 bp, Unknown
  misc_feature (1)..( 10): Result.005 file - promoters50/1538782
catataaatt

SEQ ID NO: 175125 - DNA, 10 bp, Unknown
  misc_feature (1)..( 10): Result.005 file - promoters50/1538782
catatatact

SEQ ID NO: 175126 - DNA, 7 bp, Unknown
  misc_feature (1)..( 7): Result.005 file - promoters50/1538804
gtttgag

SEQ ID NO: 175127 - DNA, 7 bp, Unknown
  misc_feature (1)..( 7): Result.005 file - promoters50/1538804
gttagag

SEQ ID NO: 175128 - DNA, 7 bp, Unknown
  misc_feature (1)..( 7): Result.005 file - promoters50/1538804
gttggag

SEQ ID NO: 175129 - DNA, 8 bp, Unknown
  misc_feature (1)..( 8): Result.005 file - promoters50/1538843
aaaatcaa

SEQ ID NO: 175130 - DNA, 8 bp, Unknown
  misc_feature (1)..( 8): Result.005 file - promoters50/1538843
caaaacaa

SEQ ID NO: 175131 - DNA, 8 bp, Unknown
  misc_feature (1)..( 8): Result.005 file - promoters50/1538843
caaaacga

SEQ ID NO: 175132 - DNA, 11 bp, Unknown
  misc_feature (1)..( 11): Result.005 file - promoters50/1538947
tattgaaatat

SEQ ID NO: 175133 - DNA, 11 bp, Unknown
  misc_feature (1)..( 11): Result.005 file - promoters50/1538947
aatttaaattg

SEQ ID NO: 175134 - DNA, 11 bp, Unknown
  misc_feature (1)..( 11): Result.005 file - promoters50/1538947
aatctaatcag

SEQ ID NO: 175135 - DNA, 11 bp, Unknown
  misc_feature (1)..( 11): Result.005 file - promoters50/1538947
agtttaaattg

SEQ ID NO: 175136 - DNA, 11 bp, Unknown
  misc_feature (1)..( 11): Result.005 file - promoters50/1538947
tttttaaacga

SEQ ID NO: 175137 - DNA, 8 bp, Unknown
  misc_feature (1)..( 8): Result.005 file - promoters50/1538947
agaaaaga

SEQ ID NO: 175138 - DNA, 8 bp, Unknown
  misc_feature (1)..( 8): Result.005 file - promoters50/1538947
aaaaaaga

SEQ ID NO: 175139 - DNA, 8 bp, Unknown
  misc_feature (1)..( 8): Result.005 file - promoters50/1538947
gaaaaagt

SEQ ID NO: 175140 - DNA, 8 bp, Unknown
  misc_feature (1)..( 8): Result.005 file - promoters50/1538947
gaaaaagt

SEQ ID NO: 175141 - DNA, 8 bp, Unknown
  misc_feature (1)..( 8): Result.005 file - promoters50/1538947
gaacaaga

SEQ ID NO: 175142 - DNA, 12 bp, Unknown
  misc_feature (1)..( 12): Result.005 file - promoters50/1538947
acaaattattag

SEQ ID NO: 175143 - DNA, 12 bp, Unknown
  misc_feature (1)..( 12): Result.005 file - promoters50/1538947
acaatttattga

SEQ ID NO: 175144 - DNA, 12 bp, Unknown
  misc_feature (1)..( 12): Result.005 file - promoters50/1538947
acaaatcctagt

SEQ ID NO: 175145 - DNA, 13 bp, Unknown
  misc_feature (1)..( 13): Result.005 file - promoters50/1538947
caaactttcttga

SEQ ID NO: 175146 - DNA, 13 bp, Unknown
  misc_feature (1)..( 13): Result.005 file - promoters50/1538947
tgaactttctccg

SEQ ID NO: 175147 - DNA, 10 bp, Unknown
  misc_feature (1)..( 10): Result.005 file - promoters50/1557475
caaatttttt

SEQ ID NO: 175148 - DNA, 10 bp, Unknown
  misc_feature (1)..( 10): Result.005 file - promoters50/1557475
caattttttt

SEQ ID NO: 175149 - DNA, 10 bp, Unknown
  misc_feature (1)..( 10): Result.005 file - promoters50/1557475
aaaatttaca

SEQ ID NO: 175150 - DNA, 10 bp, Unknown
  misc_feature (1)..( 10): Result.005 file - promoters50/1557475
gtatttttta

SEQ ID NO: 175151 - DNA, 11 bp, Unknown
  misc_feature (1)..( 11): Result.005 file - promoters50/1557475
tactttatttt

SEQ ID NO: 175152 - DNA, 11 bp, Unknown
  misc_feature (1)..( 11): Result.005 file - promoters50/1557475
ttcttagtttc

SEQ ID NO: 175153 - DNA, 10 bp, Unknown
  misc_feature (1)..( 10): Result.005 file - promoters50/1557475
attaaaatac

SEQ ID NO: 175154 - DNA, 10 bp, Unknown
  misc_feature (1)..( 10): Result.005 file - promoters50/1557475
gtaaaaatac

SEQ ID NO: 175155 - DNA, 11 bp, Unknown
  misc_feature (1)..( 11): Result.005 file - promoters50/1557475
attaataatcc

SEQ ID NO: 175156 - DNA, 11 bp, Unknown
  misc_feature (1)..( 11): Result.005 file - promoters50/1557475
gttaaaaacta

SEQ ID NO: 175157 - DNA, 11 bp, Unknown
  misc_feature (1)..( 11): Result.005 file - promoters50/1557475
ttcaaaaatta

SEQ ID NO: 175158 - DNA, 11 bp, Unknown
  misc_feature (1)..( 11): Result.005 file - promoters50/1557475
ttcaaaaatct

SEQ ID NO: 175159 - DNA, 15 bp, Unknown
  misc_feature (1)..( 15): Result.005 file - promoters50/1557475
cgaaaaaacaaaaac

SEQ ID NO: 175160 - DNA, 15 bp, Unknown
  misc_feature (1)..( 15): Result.005 file - promoters50/1557475
cgacaaaacaaaaag

SEQ ID NO: 175161 - DNA, 15 bp, Unknown
  misc_feature (1)..( 15): Result.005 file - promoters50/1557475
cgccaaaccaaaaac

SEQ ID NO: 175162 - DNA, 15 bp, Unknown
  misc_feature (1)..( 15): Result.005 file - promoters50/1557475
taataaaacaaccag

SEQ ID NO: 175163 - DNA, 15 bp, Unknown
  misc_feature (1)..( 15): Result.005 file - promoters50/1557475
aagctgtccacaaat

SEQ ID NO: 175164 - DNA, 15 bp, Unknown
  misc_feature (1)..( 15): Result.005 file - promoters50/1557475
acccgaaccgaaatt

SEQ ID NO: 175165 - DNA, 9 bp, Unknown
  misc_feature (1)..( 9): Result.005 file - promoters50/1557486
aaaaatttc

SEQ ID NO: 175166 - DNA, 9 bp, Unknown
  misc_feature (1)..( 9): Result.005 file - promoters50/1557486
aaagatttc

SEQ ID NO: 175167 - DNA, 9 bp, Unknown
  misc_feature (1)..( 9): Result.005 file - promoters50/1557486
aaatattct

SEQ ID NO: 175168 - DNA, 8 bp, Unknown
  misc_feature (1)..( 8): Result.005 file - promoters50/1557486
attatatg

SEQ ID NO: 175169 - DNA, 8 bp, Unknown
  misc_feature (1)..( 8): Result.005 file - promoters50/1557486
tttatatg

SEQ ID NO: 175170 - DNA, 9 bp, Unknown
  misc_feature (1)..( 9): Result.005 file - promoters50/1557486
attaataca

SEQ ID NO: 175171 - DNA, 11 bp, Unknown
  misc_feature (1)..( 11): Result.005 file - promoters50/1557486
catctaagaaa

SEQ ID NO: 175172 - DNA, 11 bp, Unknown
  misc_feature (1)..( 11): Result.005 file - promoters50/1557486
tctctgagatg

SEQ ID NO: 175173 - DNA, 11 bp, Unknown
  misc_feature (1)..( 11): Result.005 file - promoters50/1557486
ccaataaaaaa

SEQ ID NO: 175174 - DNA, 11 bp, Unknown
  misc_feature (1)..( 11): Result.005 file - promoters50/1557486
tctctgatctt

SEQ ID NO: 175175 - DNA, 7 bp, Unknown
  misc_feature (1)..( 7): Result.005 file - promoters50/1557486
taagaaa

SEQ ID NO: 175176 - DNA, 7 bp, Unknown
  misc_feature (1)..( 7): Result.005 file - promoters50/1557486
aaagaaa

SEQ ID NO: 175177 - DNA, 7 bp, Unknown
  misc_feature (1)..( 7): Result.005 file - promoters50/1557486
taaaaaa

SEQ ID NO: 175178 - DNA, 13 bp, Unknown
  misc_feature (1)..( 13): Result.005 file - promoters50/1557486
ttataatttaacc

SEQ ID NO: 175179 - DNA, 13 bp, Unknown
  misc_feature (1)..( 13): Result.005 file - promoters50/1557486
tgatacttttttt

SEQ ID NO: 175180 - DNA, 13 bp, Unknown
  misc_feature (1)..( 13): Result.005 file - promoters50/1557486
ttatgatttccct

SEQ ID NO: 175181 - DNA, 13 bp, Unknown
  misc_feature (1)..( 13): Result.005 file - promoters50/1557486
tatgattttctga

SEQ ID NO: 175182 - DNA, 10 bp, Unknown
  misc_feature (1)..( 10): Result.005 file - promoters50/1557486
ttttctgttt

SEQ ID NO: 175183 - DNA, 10 bp, Unknown
  misc_feature (1)..( 10): Result.005 file - promoters50/1557486
ttttcttcag

SEQ ID NO: 175184 - DNA, 10 bp, Unknown
  misc_feature (1)..( 10): Result.005 file - promoters50/1557486
ttttatgttt

SEQ ID NO: 175185 - DNA, 10 bp, Unknown
  misc_feature (1)..( 10): Result.005 file - promoters50/1557486
ttttctgttt

SEQ ID NO: 175186 - DNA, 10 bp, Unknown
  misc_feature (1)..( 10): Result.005 file - promoters50/1557486
tcttcagttt

SEQ ID NO: 175187 - DNA, 10 bp, Unknown
  misc_feature (1)..( 10): Result.005 file - promoters50/1557486
ttttatgttt

SEQ ID NO: 175188 - DNA, 8 bp, Unknown
  misc_feature (1)..( 8): Result.005 file - promoters50/1557486
aaacaaaa

SEQ ID NO: 175189 - DNA, 8 bp, Unknown
  misc_feature (1)..( 8): Result.005 file - promoters50/1557486
taacaaaa

SEQ ID NO: 175190 - DNA, 8 bp, Unknown
  misc_feature (1)..( 8): Result.005 file - promoters50/1557486
taataaag

SEQ ID NO: 175191 - DNA, 10 bp, Unknown
  misc_feature (1)..( 10): Result.005 file - promoters50/1557486
tcttattcta

SEQ ID NO: 175192 - DNA, 10 bp, Unknown
  misc_feature (1)..( 10): Result.005 file - promoters50/1557486
tctcatttat

SEQ ID NO: 175193 - DNA, 10 bp, Unknown
  misc_feature (1)..( 10): Result.005 file - promoters50/1557486
cctcatatat

SEQ ID NO: 175194 - DNA, 8 bp, Unknown
  misc_feature (1)..( 8): Result.005 file - promoters50/1557486
tttctgac

SEQ ID NO: 175195 - DNA, 8 bp, Unknown
  misc_feature (1)..( 8): Result.005 file - promoters50/1557486
cctctgac

SEQ ID NO: 175196 - DNA, 8 bp, Unknown
  misc_feature (1)..( 8): Result.005 file - promoters50/1557486
tttatgat

SEQ ID NO: 175197 - DNA, 7 bp, Unknown
  misc_feature (1)..( 7): Result.005 file - promoters50/1557486
gatttcc

SEQ ID NO: 175198 - DNA, 7 bp, Unknown
  misc_feature (1)..( 7): Result.005 file - promoters50/1557486
gatttcg

SEQ ID NO: 175199 - DNA, 7 bp, Unknown
  misc_feature (1)..( 7): Result.005 file - promoters50/1557486
aatttcg

SEQ ID NO: 175200 - DNA, 11 bp, Unknown
  misc_feature (1)..( 11): Result.005 file - promoters50/1557501
aattatttatc

SEQ ID NO: 175201 - DNA, 11 bp, Unknown
  misc_feature (1)..( 11): Result.005 file - promoters50/1557501
atctatgtata

SEQ ID NO: 175202 - DNA, 11 bp, Unknown
  misc_feature (1)..( 11): Result.005 file - promoters50/1557501
gatcattgatc

SEQ ID NO: 175203 - DNA, 11 bp, Unknown
  misc_feature (1)..( 11): Result.005 file - promoters50/1557501
atgtatatatg

SEQ ID NO: 175204 - DNA, 11 bp, Unknown
  misc_feature (1)..( 11): Result.005 file - promoters50/1557501
atcaatttttt

SEQ ID NO: 175205 - DNA, 11 bp, Unknown
  misc_feature (1)..( 11): Result.005 file - promoters50/1557501
atcaattatca

SEQ ID NO: 175206 - DNA, 10 bp, Unknown
  misc_feature (1)..( 10): Result.005 file - promoters50/1557501
gtttaacaaa

SEQ ID NO: 175207 - DNA, 10 bp, Unknown
  misc_feature (1)..( 10): Result.005 file - promoters50/1557501
aaataaaaaa

SEQ ID NO: 175208 - DNA, 10 bp, Unknown
  misc_feature (1)..( 10): Result.005 file - promoters50/1557501
caataaaaaa

SEQ ID NO: 175209 - DNA, 10 bp, Unknown
  misc_feature (1)..( 10): Result.005 file - promoters50/1557501
gtttgacaaa

SEQ ID NO: 175210 - DNA, 11 bp, Unknown
  misc_feature (1)..( 11): Result.005 file - promoters50/1557501
gaagaaagaaa

SEQ ID NO: 175211 - DNA, 11 bp, Unknown
  misc_feature (1)..( 11): Result.005 file - promoters50/1557501
gccaaaataaa

SEQ ID NO: 175212 - DNA, 15 bp, Unknown
  misc_feature (1)..( 15): Result.005 file - promoters50/1557501
tttatcaaagagttt

SEQ ID NO: 175213 - DNA, 15 bp, Unknown
  misc_feature (1)..( 15): Result.005 file - promoters50/1557501
attatcaaggttacc

SEQ ID NO: 175214 - DNA, 15 bp, Unknown
  misc_feature (1)..( 15): Result.005 file - promoters50/1557501
ttaatcaaacagttt

SEQ ID NO: 175215 - DNA, 15 bp, Unknown
  misc_feature (1)..( 15): Result.005 file - promoters50/1557501
tttctcattgatttc

SEQ ID NO: 175216 - DNA, 15 bp, Unknown
  misc_feature (1)..( 15): Result.005 file - promoters50/1557501
gttctcaagagaaaa

SEQ ID NO: 175217 - DNA, 15 bp, Unknown
  misc_feature (1)..( 15): Result.005 file - promoters50/1557501
ataatcaatgaatgt

SEQ ID NO: 175218 - DNA, 14 bp, Unknown
  misc_feature (1)..( 14): Result.005 file - promoters50/1557501
acttttctagcaaa

SEQ ID NO: 175219 - DNA, 14 bp, Unknown
  misc_feature (1)..( 14): Result.005 file - promoters50/1557501
ggatttctagatct

SEQ ID NO: 175220 - DNA, 14 bp, Unknown
  misc_feature (1)..( 14): Result.005 file - promoters50/1557501
gtttttctttcttt

SEQ ID NO: 175221 - DNA, 14 bp, Unknown
  misc_feature (1)..( 14): Result.005 file - promoters50/1557501
ttgtttcttctcct

SEQ ID NO: 175222 - DNA, 14 bp, Unknown
  misc_feature (1)..( 14): Result.005 file - promoters50/1557501
gtttttgtttgttt

SEQ ID NO: 175223 - DNA, 14 bp, Unknown
  misc_feature (1)..( 14): Result.005 file - promoters50/1557501
ctatttctcttgtt

SEQ ID NO: 175224 - DNA, 9 bp, Unknown
  misc_feature (1)..( 9): Result.005 file - promoters50/1557561
ttttaattg

SEQ ID NO: 175225 - DNA, 9 bp, Unknown
  misc_feature (1)..( 9): Result.005 file - promoters50/1557561
ttttaattt

SEQ ID NO: 175226 - DNA, 9 bp, Unknown
  misc_feature (1)..( 9): Result.005 file - promoters50/1557561
gggtaattt

SEQ ID NO: 175227 - DNA, 8 bp, Unknown
  misc_feature (1)..( 8): Result.005 file - promoters50/1557561
attgtaaa

SEQ ID NO: 175228 - DNA, 8 bp, Unknown
  misc_feature (1)..( 8): Result.005 file - promoters50/1557561
tatgtaaa

SEQ ID NO: 175229 - DNA, 8 bp, Unknown
  misc_feature (1)..( 8): Result.005 file - promoters50/1557561
attttaag

SEQ ID NO: 175230 - DNA, 10 bp, Unknown
  misc_feature (1)..( 10): Result.005 file - promoters50/1557561
ttttgggtta

SEQ ID NO: 175231 - DNA, 10 bp, Unknown
  misc_feature (1)..( 10): Result.005 file - promoters50/1557561
ttttcggtac

SEQ ID NO: 175232 - DNA, 10 bp, Unknown
  misc_feature (1)..( 10): Result.005 file - promoters50/1557561
cattcgttac

SEQ ID NO: 175233 - DNA, 12 bp, Unknown
  misc_feature (1)..( 12): Result.005 file - promoters50/1557565
ctattaattatg

SEQ ID NO: 175234 - DNA, 12 bp, Unknown
  misc_feature (1)..( 12): Result.005 file - promoters50/1557565
aaattaattatg

SEQ ID NO: 175235 - DNA, 12 bp, Unknown
  misc_feature (1)..( 12): Result.005 file - promoters50/1557565
agtttatttata

SEQ ID NO: 175236 - DNA, 12 bp, Unknown
  misc_feature (1)..( 12): Result.005 file - promoters50/1557565
aaaataacgtca

SEQ ID NO: 175237 - DNA, 7 bp, Unknown
  misc_feature (1)..( 7): Result.005 file - promoters50/1557573
ttaaaaa

SEQ ID NO: 175238 - DNA, 7 bp, Unknown
  misc_feature (1)..( 7): Result.005 file - promoters50/1557573
ttataaa

SEQ ID NO: 175239 - DNA, 7 bp, Unknown
  misc_feature (1)..( 7): Result.005 file - promoters50/1557573
ttaaaag

SEQ ID NO: 175240 - DNA, 9 bp, Unknown
  misc_feature (1)..( 9): Result.005 file - promoters50/1557573
attttagta

SEQ ID NO: 175241 - DNA, 9 bp, Unknown
  misc_feature (1)..( 9): Result.005 file - promoters50/1557573
attgtagtc

SEQ ID NO: 175242 - DNA, 9 bp, Unknown
  misc_feature (1)..( 9): Result.005 file - promoters50/1557573
tatgtggtc

SEQ ID NO: 175243 - DNA, 8 bp, Unknown
  misc_feature (1)..( 8): Result.005 file - promoters50/1557573
gtatattc

SEQ ID NO: 175244 - DNA, 8 bp, Unknown
  misc_feature (1)..( 8): Result.005 file - promoters50/1557573
gtagattt

SEQ ID NO: 175245 - DNA, 8 bp, Unknown
  misc_feature (1)..( 8): Result.005 file - promoters50/1557573
cgagattt

SEQ ID NO: 175246 - DNA, 8 bp, Unknown
  misc_feature (1)..( 8): Result.005 file - promoters50/1557573
gtatttta

SEQ ID NO: 175247 - DNA, 8 bp, Unknown
  misc_feature (1)..( 8): Result.005 file - promoters50/1557573
atattttc

SEQ ID NO: 175248 - DNA, 8 bp, Unknown
  misc_feature (1)..( 8): Result.005 file - promoters50/1557573
ataatttc

SEQ ID NO: 175249 - DNA, 7 bp, Unknown
  misc_feature (1)..( 7): Result.005 file - promoters50/1557573
taatttt

SEQ ID NO: 175250 - DNA, 7 bp, Unknown
  misc_feature (1)..( 7): Result.005 file - promoters50/1557573
taatttt

SEQ ID NO: 175251 - DNA, 7 bp, Unknown
  misc_feature (1)..( 7): Result.005 file - promoters50/1557573
taatttc

SEQ ID NO: 175252 - DNA, 13 bp, Unknown
  misc_feature (1)..( 13): Result.005 file - promoters50/1557584
taacaaataaagt

SEQ ID NO: 175253 - DNA, 13 bp, Unknown
  misc_feature (1)..( 13): Result.005 file - promoters50/1557584
aacagaataaaaa

SEQ ID NO: 175254 - DNA, 14 bp, Unknown
  misc_feature (1)..( 14): Result.005 file - promoters50/1557584
tttgaaatataaat

SEQ ID NO: 175255 - DNA, 14 bp, Unknown
  misc_feature (1)..( 14): Result.005 file - promoters50/1557584
ttggatttataaat

SEQ ID NO: 175256 - DNA, 14 bp, Unknown
  misc_feature (1)..( 14): Result.005 file - promoters50/1557584
ttaatgatataatc

SEQ ID NO: 175257 - DNA, 14 bp, Unknown
  misc_feature (1)..( 14): Result.005 file - promoters50/1557584
tttaaaatatattt

SEQ ID NO: 175258 - DNA, 8 bp, Unknown
  misc_feature (1)..( 8): Result.005 file - promoters50/1557584
gaaataaa

SEQ ID NO: 175259 - DNA, 8 bp, Unknown
  misc_feature (1)..( 8): Result.005 file - promoters50/1557584
agaataaa

SEQ ID NO: 175260 - DNA, 8 bp, Unknown
  misc_feature (1)..( 8): Result.005 file - promoters50/1557584
aaaataat

SEQ ID NO: 175261 - DNA, 9 bp, Unknown
  misc_feature (1)..( 9): Result.005 file - promoters50/1557584
taaatgaaa

SEQ ID NO: 175262 - DNA, 9 bp, Unknown
  misc_feature (1)..( 9): Result.005 file - promoters50/1557584
caaaataca

SEQ ID NO: 175263 - DNA, 9 bp, Unknown
  misc_feature (1)..( 9): Result.005 file - promoters50/1557584
aaaaacagt

SEQ ID NO: 175264 - DNA, 14 bp, Unknown
  misc_feature (1)..( 14): Result.005 file - promoters50/1557584
ttttttatacaaaa

SEQ ID NO: 175265 - DNA, 14 bp, Unknown
  misc_feature (1)..( 14): Result.005 file - promoters50/1557584
tttgaaatataaat

SEQ ID NO: 175266 - DNA, 14 bp, Unknown
  misc_feature (1)..( 14): Result.005 file - promoters50/1557584
aacagaataaaaac

SEQ ID NO: 175267 - DNA, 14 bp, Unknown
  misc_feature (1)..( 14): Result.005 file - promoters50/1557584
ttggatttataaat

SEQ ID NO: 175268 - DNA, 14 bp, Unknown
  misc_feature (1)..( 14): Result.005 file - promoters50/1557584
ttaatgatataatc

SEQ ID NO: 175269 - DNA, 14 bp, Unknown
  misc_feature (1)..( 14): Result.005 file - promoters50/1557584
tttaaaatatattt

SEQ ID NO: 175270 - DNA, 12 bp, Unknown
  misc_feature (1)..( 12): Result.005 file - promoters50/1557595
aaatattaggaa

SEQ ID NO: 175271 - DNA, 12 bp, Unknown
  misc_feature (1)..( 12): Result.005 file - promoters50/1557595
aaattttaggaa

SEQ ID NO: 175272 - DNA, 12 bp, Unknown
  misc_feature (1)..( 12): Result.005 file - promoters50/1557595
taatattattat

SEQ ID NO: 175273 - DNA, 12 bp, Unknown
  misc_feature (1)..( 12): Result.005 file - promoters50/1557595
ctattttaacgg

SEQ ID NO: 175274 - DNA, 9 bp, Unknown
  misc_feature (1)..( 9): Result.005 file - promoters50/1557595
aagaagata

SEQ ID NO: 175275 - DNA, 9 bp, Unknown
  misc_feature (1)..( 9): Result.005 file - promoters50/1557595
aagaaaata

SEQ ID NO: 175276 - DNA, 9 bp, Unknown
  misc_feature (1)..( 9): Result.005 file - promoters50/1557595
tagagaatt

SEQ ID NO: 175277 - DNA, 9 bp, Unknown
  misc_feature (1)..( 9): Result.005 file - promoters50/1557595
aagaagaag

SEQ ID NO: 175278 - DNA, 10 bp, Unknown
  misc_feature (1)..( 10): Result.005 file - promoters50/1557606
ggttgcaaaa

SEQ ID NO: 175279 - DNA, 10 bp, Unknown
  misc_feature (1)..( 10): Result.005 file - promoters50/1557606
ttttgtaaat

SEQ ID NO: 175280 - DNA, 10 bp, Unknown
  misc_feature (1)..( 10): Result.005 file - promoters50/1557606
tattgcaatc

SEQ ID NO: 175281 - DNA, 10 bp, Unknown
  misc_feature (1)..( 10): Result.005 file - promoters50/1557606
agttgcagaa

SEQ ID NO: 175282 - DNA, 10 bp, Unknown
  misc_feature (1)..( 10): Result.005 file - promoters50/1557606
tatttcaagt

SEQ ID NO: 175283 - DNA, 10 bp, Unknown
  misc_feature (1)..( 10): Result.005 file - promoters50/1557606
ttgtgtaaat

SEQ ID NO: 175284 - DNA, 8 bp, Unknown
  misc_feature (1)..( 8): Result.005 file - promoters50/1557618
ataagatc

SEQ ID NO: 175285 - DNA, 8 bp, Unknown
  misc_feature (1)..( 8): Result.005 file - promoters50/1557618
ttaagatc

SEQ ID NO: 175286 - DNA, 8 bp, Unknown
  misc_feature (1)..( 8): Result.005 file - promoters50/1557618
atacgatg

SEQ ID NO: 175287 - DNA, 9 bp, Unknown
  misc_feature (1)..( 9): Result.005 file - promoters50/1557618
atttatttt

SEQ ID NO: 175288 - DNA, 9 bp, Unknown
  misc_feature (1)..( 9): Result.005 file - promoters50/1557618
atttttttt

SEQ ID NO: 175289 - DNA, 9 bp, Unknown
  misc_feature (1)..( 9): Result.005 file - promoters50/1557618
atttatcag

SEQ ID NO: 175290 - DNA, 6 bp, Unknown
  misc_feature (1)..( 6): Result.005 file - promoters50/1557618
tttctt

SEQ ID NO: 175291 - DNA, 6 bp, Unknown
  misc_feature (1)..( 6): Result.005 file - promoters50/1557618
tttctt

SEQ ID NO: 175292 - DNA, 6 bp, Unknown
  misc_feature (1)..( 6): Result.005 file - promoters50/1557618
tttctt

SEQ ID NO: 175293 - DNA, 9 bp, Unknown
  misc_feature (1)..( 9): Result.005 file - promoters50/1557618
actatcaat

SEQ ID NO: 175294 - DNA, 9 bp, Unknown
  misc_feature (1)..( 9): Result.005 file - promoters50/1557618
aaaatcaat

SEQ ID NO: 175295 - DNA, 9 bp, Unknown
  misc_feature (1)..( 9): Result.005 file - promoters50/1557618
aaaatcaaa

SEQ ID NO: 175296 - DNA, 8 bp, Unknown
  misc_feature (1)..( 8): Result.005 file - promoters50/1557618
gtgtttaa

SEQ ID NO: 175297 - DNA, 8 bp, Unknown
  misc_feature (1)..( 8): Result.005 file - promoters50/1557618
gtgtttaa

SEQ ID NO: 175298 - DNA, 8 bp, Unknown
  misc_feature (1)..( 8): Result.005 file - promoters50/1557618
ttgtttat

SEQ ID NO: 175299 - DNA, 7 bp, Unknown
  misc_feature (1)..( 7): Result.005 file - promoters50/1557618
ttttttc

SEQ ID NO: 175300 - DNA, 7 bp, Unknown
  misc_feature (1)..( 7): Result.005 file - promoters50/1557618
tttcttc

SEQ ID NO: 175301 - DNA, 7 bp, Unknown
  misc_feature (1)..( 7): Result.005 file - promoters50/1557618
tttcttg

SEQ ID NO: 175302 - DNA, 9 bp, Unknown
  misc_feature (1)..( 9): Result.005 file - promoters50/1557618
aagattaat

SEQ ID NO: 175303 - DNA, 9 bp, Unknown
  misc_feature (1)..( 9): Result.005 file - promoters50/1557618
aagagtaat

SEQ ID NO: 175304 - DNA, 9 bp, Unknown
  misc_feature (1)..( 9): Result.005 file - promoters50/1557618
tcgattaaa

SEQ ID NO: 175305 - DNA, 10 bp, Unknown
  misc_feature (1)..( 10): Result.005 file - promoters50/1557648
cgatttgtag

SEQ ID NO: 175306 - DNA, 10 bp, Unknown
  misc_feature (1)..( 10): Result.005 file - promoters50/1557648
aaattggtag

SEQ ID NO: 175307 - DNA, 10 bp, Unknown
  misc_feature (1)..( 10): Result.005 file - promoters50/1557648
aaatcggtca

SEQ ID NO: 175308 - DNA, 8 bp, Unknown
  misc_feature (1)..( 8): Result.005 file - promoters50/1557648
gtagaatt

SEQ ID NO: 175309 - DNA, 8 bp, Unknown
  misc_feature (1)..( 8): Result.005 file - promoters50/1557648
gtacaatc

SEQ ID NO: 175310 - DNA, 8 bp, Unknown
  misc_feature (1)..( 8): Result.005 file - promoters50/1557648
gtattaca

SEQ ID NO: 175311 - DNA, 11 bp, Unknown
  misc_feature (1)..( 11): Result.005 file - promoters50/1557648
taaatagtatc

SEQ ID NO: 175312 - DNA, 11 bp, Unknown
  misc_feature (1)..( 11): Result.005 file - promoters50/1557648
aatttagaatc

SEQ ID NO: 175313 - DNA, 11 bp, Unknown
  misc_feature (1)..( 11): Result.005 file - promoters50/1557648
aattttgaacg

SEQ ID NO: 175314 - DNA, 17 bp, Unknown
  misc_feature (1)..( 17): Result.005 file - promoters50/1557648
ttaaatatttaaatatt

SEQ ID NO: 175315 - DNA, 17 bp, Unknown
  misc_feature (1)..( 17): Result.005 file - promoters50/1557648
cggttatagaaaacatt

SEQ ID NO: 175316 - DNA, 17 bp, Unknown
  misc_feature (1)..( 17): Result.005 file - promoters50/1557648
gagagaaaaaaaacaaa

SEQ ID NO: 175317 - DNA, 18 bp, Unknown
  misc_feature (1)..( 18): Result.005 file - promoters50/1557648
aaagaaaagaaaatgata

SEQ ID NO: 175318 - DNA, 9 bp, Unknown
  misc_feature (1)..( 9): Result.005 file - promoters50/1557648
aaatctcac

SEQ ID NO: 175319 - DNA, 9 bp, Unknown
  misc_feature (1)..( 9): Result.005 file - promoters50/1557648
cattctcac

SEQ ID NO: 175320 - DNA, 9 bp, Unknown
  misc_feature (1)..( 9): Result.005 file - promoters50/1557648
caatatcaa

SEQ ID NO: 175321 - DNA, 9 bp, Unknown
  misc_feature (1)..( 9): Result.005 file - promoters50/1557648
caatattgg

SEQ ID NO: 175322 - DNA, 8 bp, Unknown
  misc_feature (1)..( 8): Result.005 file - promoters50/1557648
aaataaaa

SEQ ID NO: 175323 - DNA, 8 bp, Unknown
  misc_feature (1)..( 8): Result.005 file - promoters50/1557648
aaagaaat

SEQ ID NO: 175324 - DNA, 8 bp, Unknown
  misc_feature (1)..( 8): Result.005 file - promoters50/1557648
aaaaaaaa

SEQ ID NO: 175325 - DNA, 8 bp, Unknown
  misc_feature (1)..( 8): Result.005 file - promoters50/1557648
aaagaaaa

SEQ ID NO: 175326 - DNA, 7 bp, Unknown
  misc_feature (1)..( 7): Result.005 file - promoters50/1557648
aaaatga

SEQ ID NO: 175327 - DNA, 7 bp, Unknown
  misc_feature (1)..( 7): Result.005 file - promoters50/1557648
aaactga

SEQ ID NO: 175328 - DNA, 7 bp, Unknown
  misc_feature (1)..( 7): Result.005 file - promoters50/1557648
aaaatga

SEQ ID NO: 175329 - DNA, 8 bp, Unknown
  misc_feature (1)..( 8): Result.005 file - promoters50/1557648
aaaattga

SEQ ID NO: 175330 - DNA, 8 bp, Unknown
  misc_feature (1)..( 8): Result.005 file - promoters50/1557648
aaatttga

SEQ ID NO: 175331 - DNA, 8 bp, Unknown
  misc_feature (1)..( 8): Result.005 file - promoters50/1557648
tcatttga

SEQ ID NO: 175332 - DNA, 6 bp, Unknown
  misc_feature (1)..( 6): Result.005 file - promoters50/1557648
agaaaa

SEQ ID NO: 175333 - DNA, 6 bp, Unknown
  misc_feature (1)..( 6): Result.005 file - promoters50/1557648
agaaaa

SEQ ID NO: 175334 - DNA, 6 bp, Unknown
  misc_feature (1)..( 6): Result.005 file - promoters50/1557648
agaaaa

SEQ ID NO: 175335 - DNA, 10 bp, Unknown
  misc_feature (1)..( 10): Result.005 file - promoters50/1557648
caaaagaaat

SEQ ID NO: 175336 - DNA, 10 bp, Unknown
  misc_feature (1)..( 10): Result.005 file - promoters50/1557648
caaaaggaaa

SEQ ID NO: 175337 - DNA, 10 bp, Unknown
  misc_feature (1)..( 10): Result.005 file - promoters50/1557648
aaaaagaaaa

SEQ ID NO: 175338 - DNA, 9 bp, Unknown
  misc_feature (1)..( 9): Result.005 file - promoters50/1557648
ctttaaatg

SEQ ID NO: 175339 - DNA, 9 bp, Unknown
  misc_feature (1)..( 9): Result.005 file - promoters50/1557648
ctttaaatt

SEQ ID NO: 175340 - DNA, 9 bp, Unknown
  misc_feature (1)..( 9): Result.005 file - promoters50/1557648
aaataaatt

SEQ ID NO: 175341 - DNA, 10 bp, Unknown
  misc_feature (1)..( 10): Result.005 file - promoters50/1557660
ttacttatta

SEQ ID NO: 175342 - DNA, 10 bp, Unknown
  misc_feature (1)..( 10): Result.005 file - promoters50/1557660
ttatttaaca

SEQ ID NO: 175343 - DNA, 10 bp, Unknown
  misc_feature (1)..( 10): Result.005 file - promoters50/1557660
aaattgaaca

SEQ ID NO: 175344 - DNA, 9 bp, Unknown
  misc_feature (1)..( 9): Result.005 file - promoters50/1557672
aatttcttt

SEQ ID NO: 175345 - DNA, 9 bp, Unknown
  misc_feature (1)..( 9): Result.005 file - promoters50/1557672
aatttccca

SEQ ID NO: 175346 - DNA, 9 bp, Unknown
  misc_feature (1)..( 9): Result.005 file - promoters50/1557672
tatttattt

SEQ ID NO: 175347 - DNA, 9 bp, Unknown
  misc_feature (1)..( 9): Result.005 file - promoters50/1557672
agattcgtt

SEQ ID NO: 175348 - DNA, 9 bp, Unknown
  misc_feature (1)..( 9): Result.005 file - promoters50/1557672
aaattagtt

SEQ ID NO: 175349 - DNA, 9 bp, Unknown
  misc_feature (1)..( 9): Result.005 file - promoters50/1557672
agatttgtt

SEQ ID NO: 175350 - DNA, 9 bp, Unknown
  misc_feature (1)..( 9): Result.005 file - promoters50/1557672
ggattcgtt

SEQ ID NO: 175351 - DNA, 8 bp, Unknown
  misc_feature (1)..( 8): Result.005 file - promoters50/1557672
ttgaatta

SEQ ID NO: 175352 - DNA, 8 bp, Unknown
  misc_feature (1)..( 8): Result.005 file - promoters50/1557672
gggaatta

SEQ ID NO: 175353 - DNA, 8 bp, Unknown
  misc_feature (1)..( 8): Result.005 file - promoters50/1557672
ttggattc

SEQ ID NO: 175354 - DNA, 11 bp, Unknown
  misc_feature (1)..( 11): Result.005 file - promoters50/1557672
ttccaaaaaca

SEQ ID NO: 175355 - DNA, 11 bp, Unknown
  misc_feature (1)..( 11): Result.005 file - promoters50/1557672
ctccaaaatat

SEQ ID NO: 175356 - DNA, 11 bp, Unknown
  misc_feature (1)..( 11): Result.005 file - promoters50/1557672
ttcgaaagaca

SEQ ID NO: 175357 - DNA, 11 bp, Unknown
  misc_feature (1)..( 11): Result.005 file - promoters50/1557672
ttccaaaagaa

SEQ ID NO: 175358 - DNA, 8 bp, Unknown
  misc_feature (1)..( 8): Result.005 file - promoters50/1557672
caaatctg

SEQ ID NO: 175359 - DNA, 8 bp, Unknown
  misc_feature (1)..( 8): Result.005 file - promoters50/1557672
gaaaactg

SEQ ID NO: 175360 - DNA, 8 bp, Unknown
  misc_feature (1)..( 8): Result.005 file - promoters50/1557672
gaacacta

SEQ ID NO: 175361 - DNA, 7 bp, Unknown
  misc_feature (1)..( 7): Result.005 file - promoters50/1557672
tcgttaa

SEQ ID NO: 175362 - DNA, 7 bp, Unknown
  misc_feature (1)..( 7): Result.005 file - promoters50/1557672
tcgttat

SEQ ID NO: 175363 - DNA, 7 bp, Unknown
  misc_feature (1)..( 7): Result.005 file - promoters50/1557672
tcgatat

SEQ ID NO: 175364 - DNA, 8 bp, Unknown
  misc_feature (1)..( 8): Result.005 file - promoters50/1557672
tatgtcat

SEQ ID NO: 175365 - DNA, 8 bp, Unknown
  misc_feature (1)..( 8): Result.005 file - promoters50/1557672
tatttcaa

SEQ ID NO: 175366 - DNA, 8 bp, Unknown
  misc_feature (1)..( 8): Result.005 file - promoters50/1557672
gatttcaa

SEQ ID NO: 175367 - DNA, 8 bp, Unknown
  misc_feature (1)..( 8): Result.005 file - promoters50/1557672
taagagaa

SEQ ID NO: 175368 - DNA, 8 bp, Unknown
  misc_feature (1)..( 8): Result.005 file - promoters50/1557672
agagagaa

SEQ ID NO: 175369 - DNA, 8 bp, Unknown
  misc_feature (1)..( 8): Result.005 file - promoters50/1557672
agagggaa

SEQ ID NO: 175370 - DNA, 11 bp, Unknown
  misc_feature (1)..( 11): Result.005 file - promoters50/1557712
gtattttgatt

SEQ ID NO: 175371 - DNA, 11 bp, Unknown
  misc_feature (1)..( 11): Result.005 file - promoters50/1557712
ttatcttgcaa

SEQ ID NO: 175372 - DNA, 11 bp, Unknown
  misc_feature (1)..( 11): Result.005 file - promoters50/1557712
ttattttgaag

SEQ ID NO: 175373 - DNA, 11 bp, Unknown
  misc_feature (1)..( 11): Result.005 file - promoters50/1557712
aaattttaaag

SEQ ID NO: 175374 - DNA, 11 bp, Unknown
  misc_feature (1)..( 11): Result.005 file - promoters50/1557712
ggattgtaaca

SEQ ID NO: 175375 - DNA, 11 bp, Unknown
  misc_feature (1)..( 11): Result.005 file - promoters50/1557712
aaattttaaaa

SEQ ID NO: 175376 - DNA, 10 bp, Unknown
  misc_feature (1)..( 10): Result.005 file - promoters50/1557712
tgtttaaagc

SEQ ID NO: 175377 - DNA, 10 bp, Unknown
  misc_feature (1)..( 10): Result.005 file - promoters50/1557712
aattttaagt

SEQ ID NO: 175378 - DNA, 10 bp, Unknown
  misc_feature (1)..( 10): Result.005 file - promoters50/1557712
atgttaaaac

SEQ ID NO: 175379 - DNA, 10 bp, Unknown
  misc_feature (1)..( 10): Result.005 file - promoters50/1557712
atgtttaact

SEQ ID NO: 175380 - DNA, 10 bp, Unknown
  misc_feature (1)..( 10): Result.005 file - promoters50/1557712
ttcataaaac

SEQ ID NO: 175381 - DNA, 10 bp, Unknown
  misc_feature (1)..( 10): Result.005 file - promoters50/1557712
attctaatat

SEQ ID NO: 175382 - DNA, 10 bp, Unknown
  misc_feature (1)..( 10): Result.005 file - promoters50/1557712
gttttgagta

SEQ ID NO: 175383 - DNA, 10 bp, Unknown
  misc_feature (1)..( 10): Result.005 file - promoters50/1557712
gttgtgactg

SEQ ID NO: 175384 - DNA, 7 bp, Unknown
  misc_feature (1)..( 7): Result.005 file - promoters50/1557751
aaacata

SEQ ID NO: 175385 - DNA, 7 bp, Unknown
  misc_feature (1)..( 7): Result.005 file - promoters50/1557751
taacata

SEQ ID NO: 175386 - DNA, 8 bp, Unknown
  misc_feature (1)..( 8): Result.005 file - promoters50/1557751
gaatcatc

SEQ ID NO: 175387 - DNA, 11 bp, Unknown
  misc_feature (1)..( 11): Result.005 file - promoters50/1557765
atattttgaat

SEQ ID NO: 175388 - DNA, 11 bp, Unknown
  misc_feature (1)..( 11): Result.005 file - promoters50/1557765
aaattttgaaa

SEQ ID NO: 175389 - DNA, 11 bp, Unknown
  misc_feature (1)..( 11): Result.005 file - promoters50/1557765
aaaatttcaaa

SEQ ID NO: 175390 - DNA, 11 bp, Unknown
  misc_feature (1)..( 11): Result.005 file - promoters50/1557765
tttaaaaatta

SEQ ID NO: 175391 - DNA, 11 bp, Unknown
  misc_feature (1)..( 11): Result.005 file - promoters50/1557765
ttacaaaatta

SEQ ID NO: 175392 - DNA, 11 bp, Unknown
  misc_feature (1)..( 11): Result.005 file - promoters50/1557765
tttcaaaataa

SEQ ID NO: 175393 - DNA, 11 bp, Unknown
  misc_feature (1)..( 11): Result.005 file - promoters50/1557765
tttcttatttt

SEQ ID NO: 175394 - DNA, 11 bp, Unknown
  misc_feature (1)..( 11): Result.005 file - promoters50/1557765
ttttttaaaaa

SEQ ID NO: 175395 - DNA, 11 bp, Unknown
  misc_feature (1)..( 11): Result.005 file - promoters50/1557765
attctcatttt

SEQ ID NO: 175396 - DNA, 9 bp, Unknown
  misc_feature (1)..( 9): Result.005 file - promoters50/1557765
aaacaaaat

SEQ ID NO: 175397 - DNA, 9 bp, Unknown
  misc_feature (1)..( 9): Result.005 file - promoters50/1557765
aaagaaaaa

SEQ ID NO: 175398 - DNA, 9 bp, Unknown
  misc_feature (1)..( 9): Result.005 file - promoters50/1557765
attcaaaat

SEQ ID NO: 175399 - DNA, 8 bp, Unknown
  misc_feature (1)..( 8): Result.005 file - promoters50/1557765
ttttaaat

SEQ ID NO: 175400 - DNA, 8 bp, Unknown
  misc_feature (1)..( 8): Result.005 file - promoters50/1557765
tttgaaat

SEQ ID NO: 175401 - DNA, 8 bp, Unknown
  misc_feature (1)..( 8): Result.005 file - promoters50/1557765
tttcaaac

SEQ ID NO: 175402 - DNA, 8 bp, Unknown
  misc_feature (1)..( 8): Result.005 file - promoters50/1557765
ttaattga

SEQ ID NO: 175403 - DNA, 8 bp, Unknown
  misc_feature (1)..( 8): Result.005 file - promoters50/1557765
ttaattat

SEQ ID NO: 175404 - DNA, 8 bp, Unknown
  misc_feature (1)..( 8): Result.005 file - promoters50/1557765
gtaagtat

SEQ ID NO: 175405 - DNA, 11 bp, Unknown
  misc_feature (1)..( 11): Result.005 file - promoters50/1557765
attttttaaaa

SEQ ID NO: 175406 - DNA, 11 bp, Unknown
  misc_feature (1)..( 11): Result.005 file - promoters50/1557765
aaatttcaaaa

SEQ ID NO: 175407 - DNA, 11 bp, Unknown
  misc_feature (1)..( 11): Result.005 file - promoters50/1557765
aaattttgaaa

SEQ ID NO: 175408 - DNA, 8 bp, Unknown
  misc_feature (1)..( 8): Result.005 file - promoters50/1557765
attgaaaa

SEQ ID NO: 175409 - DNA, 8 bp, Unknown
  misc_feature (1)..( 8): Result.005 file - promoters50/1557765
tttgaaaa

SEQ ID NO: 175410 - DNA, 8 bp, Unknown
  misc_feature (1)..( 8): Result.005 file - promoters50/1557765
ttttaaat

SEQ ID NO: 175411 - DNA, 8 bp, Unknown
  misc_feature (1)..( 8): Result.005 file - promoters50/1557765
tttgaata

SEQ ID NO: 175412 - DNA, 8 bp, Unknown
  misc_feature (1)..( 8): Result.005 file - promoters50/1557765
ttttgaaa

SEQ ID NO: 175413 - DNA, 8 bp, Unknown
  misc_feature (1)..( 8): Result.005 file - promoters50/1557765
ttttgaat

SEQ ID NO: 175414 - DNA, 8 bp, Unknown
  misc_feature (1)..( 8): Result.005 file - promoters50/1557765
gtttcaaa

SEQ ID NO: 175415 - DNA, 9 bp, Unknown
  misc_feature (1)..( 9): Result.005 file - promoters50/1557765
aattttaaa

SEQ ID NO: 175416 - DNA, 9 bp, Unknown
  misc_feature (1)..( 9): Result.005 file - promoters50/1557765
aattataaa

SEQ ID NO: 175417 - DNA, 9 bp, Unknown
  misc_feature (1)..( 9): Result.005 file - promoters50/1557765
cgtttgaaa

SEQ ID NO: 175418 - DNA, 12 bp, Unknown
  misc_feature (1)..( 12): Result.005 file - promoters50/1557769
gatttttcattt

SEQ ID NO: 175419 - DNA, 12 bp, Unknown
  misc_feature (1)..( 12): Result.005 file - promoters50/1557769
taattttcaaat

SEQ ID NO: 175420 - DNA, 12 bp, Unknown
  misc_feature (1)..( 12): Result.005 file - promoters50/1557769
atctttacattt

SEQ ID NO: 175421 - DNA, 12 bp, Unknown
  misc_feature (1)..( 12): Result.005 file - promoters50/1557769
ccattttcgttt

SEQ ID NO: 175422 - DNA, 12 bp, Unknown
  misc_feature (1)..( 12): Result.005 file - promoters50/1557769
ttttttacagct

SEQ ID NO: 175423 - DNA, 12 bp, Unknown
  misc_feature (1)..( 12): Result.005 file - promoters50/1557769
ccattttatgtg

SEQ ID NO: 175424 - DNA, 9 bp, Unknown
  misc_feature (1)..( 9): Result.005 file - promoters50/1557769
cattttttt

SEQ ID NO: 175425 - DNA, 9 bp, Unknown
  misc_feature (1)..( 9): Result.005 file - promoters50/1557769
aatttttct

SEQ ID NO: 175426 - DNA, 9 bp, Unknown
  misc_feature (1)..( 9): Result.005 file - promoters50/1557769
acttttttt

SEQ ID NO: 175427 - DNA, 9 bp, Unknown
  misc_feature (1)..( 9): Result.005 file - promoters50/1557769
tcttttttt

SEQ ID NO: 175428 - DNA, 9 bp, Unknown
  misc_feature (1)..( 9): Result.005 file - promoters50/1557769
catttttgt

SEQ ID NO: 175429 - DNA, 9 bp, Unknown
  misc_feature (1)..( 9): Result.005 file - promoters50/1557769
aatctttac

SEQ ID NO: 175430 - DNA, 12 bp, Unknown
  misc_feature (1)..( 12): Result.005 file - promoters50/1557769
aacgatattaat

SEQ ID NO: 175431 - DNA, 12 bp, Unknown
  misc_feature (1)..( 12): Result.005 file - promoters50/1557769
acagatattact

SEQ ID NO: 175432 - DNA, 12 bp, Unknown
  misc_feature (1)..( 12): Result.005 file - promoters50/1557769
tgtaataataac

SEQ ID NO: 175433 - DNA, 12 bp, Unknown
  misc_feature (1)..( 12): Result.005 file - promoters50/1557769
tacgaaattgtg

SEQ ID NO: 175434 - DNA, 12 bp, Unknown
  misc_feature (1)..( 12): Result.005 file - promoters50/1557769
atcgttattaat

SEQ ID NO: 175435 - DNA, 12 bp, Unknown
  misc_feature (1)..( 12): Result.005 file - promoters50/1557769
taagacattttt

SEQ ID NO: 175436 - DNA, 12 bp, Unknown
  misc_feature (1)..( 12): Result.005 file - promoters50/1557769
taccaaactgaa

SEQ ID NO: 175437 - DNA, 12 bp, Unknown
  misc_feature (1)..( 12): Result.005 file - promoters50/1557769
ttgattagtaaa

SEQ ID NO: 175438 - DNA, 11 bp, Unknown
  misc_feature (1)..( 11): Result.005 file - promoters50/1557769
gaaaaaaaaga

SEQ ID NO: 175439 - DNA, 11 bp, Unknown
  misc_feature (1)..( 11): Result.005 file - promoters50/1557769
caaaaaagatg

SEQ ID NO: 175440 - DNA, 12 bp, Unknown
  misc_feature (1)..( 12): Result.005 file - promoters50/1557769
caaacaaaacta

SEQ ID NO: 175441 - DNA, 12 bp, Unknown
  misc_feature (1)..( 12): Result.005 file - promoters50/1557769
aaaagaaagaaa

SEQ ID NO: 175442 - DNA, 12 bp, Unknown
  misc_feature (1)..( 12): Result.005 file - promoters50/1557769
gaacgaagaggc

SEQ ID NO: 175443 - DNA, 12 bp, Unknown
  misc_feature (1)..( 12): Result.005 file - promoters50/1557769
tttcaaaaatac

SEQ ID NO: 175444 - DNA, 12 bp, Unknown
  misc_feature (1)..( 12): Result.005 file - promoters50/1557769
ctaaaaatcctt

SEQ ID NO: 175445 - DNA, 12 bp, Unknown
  misc_feature (1)..( 12): Result.005 file - promoters50/1557769
caataaaatata

SEQ ID NO: 175446 - DNA, 12 bp, Unknown
  misc_feature (1)..( 12): Result.005 file - promoters50/1557769
ctataaaaaatt

SEQ ID NO: 175447 - DNA, 12 bp, Unknown
  misc_feature (1)..( 12): Result.005 file - promoters50/1557769
caatcaaatcgg

SEQ ID NO: 175448 - DNA, 12 bp, Unknown
  misc_feature (1)..( 12): Result.005 file - promoters50/1557769
gaataaaaacag

SEQ ID NO: 175449 - DNA, 12 bp, Unknown
  misc_feature (1)..( 12): Result.005 file - promoters50/1557769
taagaaaaaaaa

SEQ ID NO: 175450 - DNA, 12 bp, Unknown
  misc_feature (1)..( 12): Result.005 file - promoters50/1557769
ccatcgaatttg

SEQ ID NO: 175451 - DNA, 9 bp, Unknown
  misc_feature (1)..( 9): Result.005 file - promoters50/1557783
gattgtaat

SEQ ID NO: 175452 - DNA, 9 bp, Unknown
  misc_feature (1)..( 9): Result.005 file - promoters50/1557783
tattataaa

SEQ ID NO: 175453 - DNA, 9 bp, Unknown
  misc_feature (1)..( 9): Result.005 file - promoters50/1557783
atttgtaaa

SEQ ID NO: 175454 - DNA, 9 bp, Unknown
  misc_feature (1)..( 9): Result.005 file - promoters50/1557783
ttttgtaaa

SEQ ID NO: 175455 - DNA, 9 bp, Unknown
  misc_feature (1)..( 9): Result.005 file - promoters50/1557783
tattaaagt

SEQ ID NO: 175456 - DNA, 9 bp, Unknown
  misc_feature (1)..( 9): Result.005 file - promoters50/1557783
gaatgtaaa

SEQ ID NO: 175457 - DNA, 12 bp, Unknown
  misc_feature (1)..( 12): Result.005 file - promoters50/1557783
gtttatgaatta

SEQ ID NO: 175458 - DNA, 12 bp, Unknown
  misc_feature (1)..( 12): Result.005 file - promoters50/1557783
gtatatgaattg

SEQ ID NO: 175459 - DNA, 12 bp, Unknown
  misc_feature (1)..( 12): Result.005 file - promoters50/1557783
agttataaataa

SEQ ID NO: 175460 - DNA, 12 bp, Unknown
  misc_feature (1)..( 12): Result.005 file - promoters50/1557783
tgtaataaattc

SEQ ID NO: 175461 - DNA, 12 bp, Unknown
  misc_feature (1)..( 12): Result.005 file - promoters50/1557783
gtagatgagatc

SEQ ID NO: 175462 - DNA, 12 bp, Unknown
  misc_feature (1)..( 12): Result.005 file - promoters50/1557783
gacgacgaagat

SEQ ID NO: 175463 - DNA, 10 bp, Unknown
  misc_feature (1)..( 10): Result.005 file - promoters50/1557806
aagaatctgt

SEQ ID NO: 175464 - DNA, 10 bp, Unknown
  misc_feature (1)..( 10): Result.005 file - promoters50/1557806
gataatttgt

SEQ ID NO: 175465 - DNA, 10 bp, Unknown
  misc_feature (1)..( 10): Result.005 file - promoters50/1557806
gatgatttga

SEQ ID NO: 175466 - DNA, 11 bp, Unknown
  misc_feature (1)..( 11): Result.005 file - promoters50/1565820
tagaataacac

SEQ ID NO: 175467 - DNA, 11 bp, Unknown
  misc_feature (1)..( 11): Result.005 file - promoters50/1565820
tagaaaaacaa

SEQ ID NO: 175468 - DNA, 11 bp, Unknown
  misc_feature (1)..( 11): Result.005 file - promoters50/1565820
cctaattacag

SEQ ID NO: 175469 - DNA, 11 bp, Unknown
  misc_feature (1)..( 11): Result.005 file - promoters50/1565820
tggaataattt

SEQ ID NO: 175470 - DNA, 11 bp, Unknown
  misc_feature (1)..( 11): Result.005 file - promoters50/1565820
tggtaaatcaa

SEQ ID NO: 175471 - DNA, 11 bp, Unknown
  misc_feature (1)..( 11): Result.005 file - promoters50/1565820
cagaaaaatgg

SEQ ID NO: 175472 - DNA, 9 bp, Unknown
  misc_feature (1)..( 9): Result.005 file - promoters50/1566423
tatattatt

SEQ ID NO: 175473 - DNA, 9 bp, Unknown
  misc_feature (1)..( 9): Result.005 file - promoters50/1566423
tattttatt

SEQ ID NO: 175474 - DNA, 9 bp, Unknown
  misc_feature (1)..( 9): Result.005 file - promoters50/1566423
tatattgaa

SEQ ID NO: 175475 - DNA, 10 bp, Unknown
  misc_feature (1)..( 10): Result.005 file - promoters50/1566423
cattgttaaa

SEQ ID NO: 175476 - DNA, 9 bp, Unknown
  misc_feature (1)..( 9): Result.005 file - promoters50/1566423
ttcaatatt

SEQ ID NO: 175477 - DNA, 9 bp, Unknown
  misc_feature (1)..( 9): Result.005 file - promoters50/1566423
ttccataaa

SEQ ID NO: 175478 - DNA, 9 bp, Unknown
  misc_feature (1)..( 9): Result.005 file - promoters50/1566423
atccaaaaa

SEQ ID NO: 175479 - DNA, 9 bp, Unknown
  misc_feature (1)..( 9): Result.005 file - promoters50/1566423
ctccaaata

SEQ ID NO: 175480 - DNA, 9 bp, Unknown
  misc_feature (1)..( 9): Result.005 file - promoters50/1566423
atttcttag

SEQ ID NO: 175481 - DNA, 9 bp, Unknown
  misc_feature (1)..( 9): Result.005 file - promoters50/1566423
atttgttag

SEQ ID NO: 175482 - DNA, 9 bp, Unknown
  misc_feature (1)..( 9): Result.005 file - promoters50/1566423
ctttcttct

SEQ ID NO: 175483 - DNA, 9 bp, Unknown
  misc_feature (1)..( 9): Result.005 file - promoters50/1566423
cttccttca

SEQ ID NO: 175484 - DNA, 10 bp, Unknown
  misc_feature (1)..( 10): Result.005 file - promoters50/1566948
ttaaaaacta

SEQ ID NO: 175485 - DNA, 10 bp, Unknown
  misc_feature (1)..( 10): Result.005 file - promoters50/1566948
ctaaaaatcc

SEQ ID NO: 175486 - DNA, 10 bp, Unknown
  misc_feature (1)..( 10): Result.005 file - promoters50/1566948
ctaaatacta

SEQ ID NO: 175487 - DNA, 10 bp, Unknown
  misc_feature (1)..( 10): Result.005 file - promoters50/1566948
ttaacaattt

SEQ ID NO: 175488 - DNA, 10 bp, Unknown
  misc_feature (1)..( 10): Result.005 file - promoters50/1566948
ctagatacag

SEQ ID NO: 175489 - DNA, 10 bp, Unknown
  misc_feature (1)..( 10): Result.005 file - promoters50/1566948
tgaaaaattt

SEQ ID NO: 175490 - DNA, 11 bp, Unknown
  misc_feature (1)..( 11): Result.005 file - promoters50/1567007
ttaaaaaaaat

SEQ ID NO: 175491 - DNA, 11 bp, Unknown
  misc_feature (1)..( 11): Result.005 file - promoters50/1567007
ctaaaaaaccg

SEQ ID NO: 175492 - DNA, 11 bp, Unknown
  misc_feature (1)..( 11): Result.005 file - promoters50/1567007
ttaaaatcaca

SEQ ID NO: 175493 - DNA, 11 bp, Unknown
  misc_feature (1)..( 11): Result.005 file - promoters50/1567007
agaaaacaatt

SEQ ID NO: 175494 - DNA, 11 bp, Unknown
  misc_feature (1)..( 11): Result.005 file - promoters50/1567007
ctaaaagaacg

SEQ ID NO: 175495 - DNA, 11 bp, Unknown
  misc_feature (1)..( 11): Result.005 file - promoters50/1567007
tgaaagaacct

SEQ ID NO: 175496 - DNA, 12 bp, Unknown
  misc_feature (1)..( 12): Result.005 file - promoters50/1567092
caataatttaca

SEQ ID NO: 175497 - DNA, 12 bp, Unknown
  misc_feature (1)..( 12): Result.005 file - promoters50/1567092
tgaaaatttata

SEQ ID NO: 175498 - DNA, 12 bp, Unknown
  misc_feature (1)..( 12): Result.005 file - promoters50/1567092
ttacaatttaca

SEQ ID NO: 175499 - DNA, 12 bp, Unknown
  misc_feature (1)..( 12): Result.005 file - promoters50/1567092
gtataattttat

SEQ ID NO: 175500 - DNA, 12 bp, Unknown
  misc_feature (1)..( 12): Result.005 file - promoters50/1567092
caacaatgtaca

SEQ ID NO: 175501 - DNA, 12 bp, Unknown
  misc_feature (1)..( 12): Result.005 file - promoters50/1567092
tgaaaattactc

SEQ ID NO: 175502 - DNA, 12 bp, Unknown
  misc_feature (1)..( 12): Result.005 file - promoters50/1567092
agaaaataaata

SEQ ID NO: 175503 - DNA, 13 bp, Unknown
  misc_feature (1)..( 13): Result.005 file - promoters50/1567092
ttcatgtttaatc

SEQ ID NO: 175504 - DNA, 13 bp, Unknown
  misc_feature (1)..( 13): Result.005 file - promoters50/1567092
cacatatttagca

SEQ ID NO: 175505 - DNA, 13 bp, Unknown
  misc_feature (1)..( 13): Result.005 file - promoters50/1567092
aagttgtttatat

SEQ ID NO: 175506 - DNA, 13 bp, Unknown
  misc_feature (1)..( 13): Result.005 file - promoters50/1567092
tatgagttcataa

SEQ ID NO: 175507 - DNA, 13 bp, Unknown
  misc_feature (1)..( 13): Result.005 file - promoters50/1567092
cacagattgaaga

SEQ ID NO: 175508 - DNA, 13 bp, Unknown
  misc_feature (1)..( 13): Result.005 file - promoters50/1567092
tctttgcttacaa

SEQ ID NO: 175509 - DNA, 13 bp, Unknown
  misc_feature (1)..( 13): Result.005 file - promoters50/1567092
gcgtgtttttctt

SEQ ID NO: 175510 - DNA, 10 bp, Unknown
  misc_feature (1)..( 10): Result.005 file - promoters50/1567092
aaactttaga

SEQ ID NO: 175511 - DNA, 10 bp, Unknown
  misc_feature (1)..( 10): Result.005 file - promoters50/1567092
aaagtttttg

SEQ ID NO: 175512 - DNA, 10 bp, Unknown
  misc_feature (1)..( 10): Result.005 file - promoters50/1567092
aaacttatca

SEQ ID NO: 175513 - DNA, 10 bp, Unknown
  misc_feature (1)..( 10): Result.005 file - promoters50/1567092
gaactttgtt

SEQ ID NO: 175514 - DNA, 10 bp, Unknown
  misc_feature (1)..( 10): Result.005 file - promoters50/1567092
aaggttttaa

SEQ ID NO: 175515 - DNA, 10 bp, Unknown
  misc_feature (1)..( 10): Result.005 file - promoters50/1567092
ccggttataa

SEQ ID NO: 175516 - DNA, 13 bp, Unknown
  misc_feature (1)..( 13): Result.005 file - promoters50/1567547
ctcttatgatttg

SEQ ID NO: 175517 - DNA, 13 bp, Unknown
  misc_feature (1)..( 13): Result.005 file - promoters50/1567547
ctcgtataattct

SEQ ID NO: 175518 - DNA, 13 bp, Unknown
  misc_feature (1)..( 13): Result.005 file - promoters50/1567547
ttcttattggaag

SEQ ID NO: 175519 - DNA, 13 bp, Unknown
  misc_feature (1)..( 13): Result.005 file - promoters50/1567547
ttcttaggattca

SEQ ID NO: 175520 - DNA, 13 bp, Unknown
  misc_feature (1)..( 13): Result.005 file - promoters50/1567547
gtccgataattta

SEQ ID NO: 175521 - DNA, 13 bp, Unknown
  misc_feature (1)..( 13): Result.005 file - promoters50/1567547
tgtgtatcattct

SEQ ID NO: 175522 - DNA, 14 bp, Unknown
  misc_feature (1)..( 14): Result.005 file - promoters50/1567547
aaaatttgtttttg

SEQ ID NO: 175523 - DNA, 14 bp, Unknown
  misc_feature (1)..( 14): Result.005 file - promoters50/1567547
tgtctttgttagtt

SEQ ID NO: 175524 - DNA, 14 bp, Unknown
  misc_feature (1)..( 14): Result.005 file - promoters50/1567547
aaagtttgttatca

SEQ ID NO: 175525 - DNA, 14 bp, Unknown
  misc_feature (1)..( 14): Result.005 file - promoters50/1567547
atcatttgtacaaa

SEQ ID NO: 175526 - DNA, 14 bp, Unknown
  misc_feature (1)..( 14): Result.005 file - promoters50/1567547
gaattttgtttttg

SEQ ID NO: 175527 - DNA, 14 bp, Unknown
  misc_feature (1)..( 14): Result.005 file - promoters50/1567547
gttgattgataggt

SEQ ID NO: 175528 - DNA, 12 bp, Unknown
  misc_feature (1)..( 12): Result.005 file - promoters50/1567949
aaacaaattaaa

SEQ ID NO: 175529 - DNA, 12 bp, Unknown
  misc_feature (1)..( 12): Result.005 file - promoters50/1567949
taacaaaaagtt

SEQ ID NO: 175530 - DNA, 12 bp, Unknown
  misc_feature (1)..( 12): Result.005 file - promoters50/1567949
gaacaaaaccca

SEQ ID NO: 175531 - DNA, 12 bp, Unknown
  misc_feature (1)..( 12): Result.005 file - promoters50/1567949
aaataaattaaa

SEQ ID NO: 175532 - DNA, 12 bp, Unknown
  misc_feature (1)..( 12): Result.005 file - promoters50/1567949
tgacaaaaagaa

SEQ ID NO: 175533 - DNA, 12 bp, Unknown
  misc_feature (1)..( 12): Result.005 file - promoters50/1567949
tgagaaagcacc

SEQ ID NO: 175534 - DNA, 8 bp, Unknown
  misc_feature (1)..( 8): Result.005 file - promoters50/1567957
tttcaaca

SEQ ID NO: 175535 - DNA, 8 bp, Unknown
  misc_feature (1)..( 8): Result.005 file - promoters50/1567957
tttcaaag

SEQ ID NO: 175536 - DNA, 8 bp, Unknown
  misc_feature (1)..( 8): Result.005 file - promoters50/1567957
tttaaaca

SEQ ID NO: 175537 - DNA, 8 bp, Unknown
  misc_feature (1)..( 8): Result.005 file - promoters50/1567957
gttcaaaa

SEQ ID NO: 175538 - DNA, 8 bp, Unknown
  misc_feature (1)..( 8): Result.005 file - promoters50/1567957
tttaaata

SEQ ID NO: 175539 - DNA, 8 bp, Unknown
  misc_feature (1)..( 8): Result.005 file - promoters50/1567957
tttaaaaa

SEQ ID NO: 175540 - DNA, 16 bp, Unknown
  misc_feature (1)..( 16): Result.005 file - promoters50/1567957
cttgtttcaatattgg

SEQ ID NO: 175541 - DNA, 16 bp, Unknown
  misc_feature (1)..( 16): Result.005 file - promoters50/1567957
attattttaattttgg

SEQ ID NO: 175542 - DNA, 16 bp, Unknown
  misc_feature (1)..( 16): Result.005 file - promoters50/1567957
aatttttcaaataaaa

SEQ ID NO: 175543 - DNA, 16 bp, Unknown
  misc_feature (1)..( 16): Result.005 file - promoters50/1567957
aggattaggcccaaaa

SEQ ID NO: 175544 - DNA, 16 bp, Unknown
  misc_feature (1)..( 16): Result.005 file - promoters50/1567957
atttttttaaaaatgt

SEQ ID NO: 175545 - DNA, 16 bp, Unknown
  misc_feature (1)..( 16): Result.005 file - promoters50/1567957
aagattttcaaagcaa

SEQ ID NO: 175546 - DNA, 14 bp, Unknown
  misc_feature (1)..( 14): Result.005 file - promoters50/1567957
ccaaatacgataat

SEQ ID NO: 175547 - DNA, 14 bp, Unknown
  misc_feature (1)..( 14): Result.005 file - promoters50/1567957
tcaaataaaacatt

SEQ ID NO: 175548 - DNA, 14 bp, Unknown
  misc_feature (1)..( 14): Result.005 file - promoters50/1567957
ccatatatattact

SEQ ID NO: 175549 - DNA, 14 bp, Unknown
  misc_feature (1)..( 14): Result.005 file - promoters50/1567957
agaaaaaaaacatt

SEQ ID NO: 175550 - DNA, 14 bp, Unknown
  misc_feature (1)..( 14): Result.005 file - promoters50/1567957
caaaacaaaacgac

SEQ ID NO: 175551 - DNA, 14 bp, Unknown
  misc_feature (1)..( 14): Result.005 file - promoters50/1567957
taaaacaaaatcat

SEQ ID NO: 175552 - DNA, 10 bp, Unknown
  misc_feature (1)..( 10): Result.005 file - promoters50/1568230
ttaatataaa

SEQ ID NO: 175553 - DNA, 10 bp, Unknown
  misc_feature (1)..( 10): Result.005 file - promoters50/1568230
acaatttaaa

SEQ ID NO: 175554 - DNA, 10 bp, Unknown
  misc_feature (1)..( 10): Result.005 file - promoters50/1568230
ttattataaa

SEQ ID NO: 175555 - DNA, 10 bp, Unknown
  misc_feature (1)..( 10): Result.005 file - promoters50/1568386
gtatttaatt

SEQ ID NO: 175556 - DNA, 10 bp, Unknown
  misc_feature (1)..( 10): Result.005 file - promoters50/1568386
aaattaaatc

SEQ ID NO: 175557 - DNA, 10 bp, Unknown
  misc_feature (1)..( 10): Result.005 file - promoters50/1568386
aaagtaattt

SEQ ID NO: 175558 - DNA, 10 bp, Unknown
  misc_feature (1)..( 10): Result.005 file - promoters50/1568386
aaaataaact

SEQ ID NO: 175559 - DNA, 10 bp, Unknown
  misc_feature (1)..( 10): Result.005 file - promoters50/1568386
caaataaatc

SEQ ID NO: 175560 - DNA, 10 bp, Unknown
  misc_feature (1)..( 10): Result.005 file - promoters50/1568386
gaagcaatag

SEQ ID NO: 175561 - DNA, 12 bp, Unknown
  misc_feature (1)..( 12): Result.005 file - promoters50/1568386
tcttaattgtat

SEQ ID NO: 175562 - DNA, 12 bp, Unknown
  misc_feature (1)..( 12): Result.005 file - promoters50/1568386
atttaatttcaa

SEQ ID NO: 175563 - DNA, 12 bp, Unknown
  misc_feature (1)..( 12): Result.005 file - promoters50/1568386
tgttatttgagt

SEQ ID NO: 175564 - DNA, 12 bp, Unknown
  misc_feature (1)..( 12): Result.005 file - promoters50/1568386
ttttattttttt

SEQ ID NO: 175565 - DNA, 12 bp, Unknown
  misc_feature (1)..( 12): Result.005 file - promoters50/1568386
tttttttttttc

SEQ ID NO: 175566 - DNA, 12 bp, Unknown
  misc_feature (1)..( 12): Result.005 file - promoters50/1568386
ttttcagattgc

SEQ ID NO: 175567 - DNA, 13 bp, Unknown
  misc_feature (1)..( 13): Result.005 file - promoters50/1568386
gttttatttataa

SEQ ID NO: 175568 - DNA, 13 bp, Unknown
  misc_feature (1)..( 13): Result.005 file - promoters50/1568386
tacatatatatgt

SEQ ID NO: 175569 - DNA, 13 bp, Unknown
  misc_feature (1)..( 13): Result.005 file - promoters50/1568386
gttttatttcacg

SEQ ID NO: 175570 - DNA, 13 bp, Unknown
  misc_feature (1)..( 13): Result.005 file - promoters50/1568386
ctttaattttgac

SEQ ID NO: 175571 - DNA, 13 bp, Unknown
  misc_feature (1)..( 13): Result.005 file - promoters50/1568386
tttttagttacag

SEQ ID NO: 175572 - DNA, 13 bp, Unknown
  misc_feature (1)..( 13): Result.005 file - promoters50/1568386
tcacaatacatgt

SEQ ID NO: 175573 - DNA, 13 bp, Unknown
  misc_feature (1)..( 13): Result.005 file - promoters50/1568386
aaactttttacgg

SEQ ID NO: 175574 - DNA, 14 bp, Unknown
  misc_feature (1)..( 14): Result.005 file - promoters50/1568386
ttaattgtataatt

SEQ ID NO: 175575 - DNA, 14 bp, Unknown
  misc_feature (1)..( 14): Result.005 file - promoters50/1568386
tcaattgtacttat

SEQ ID NO: 175576 - DNA, 14 bp, Unknown
  misc_feature (1)..( 14): Result.005 file - promoters50/1568386
ttatttgagttatg

SEQ ID NO: 175577 - DNA, 14 bp, Unknown
  misc_feature (1)..( 14): Result.005 file - promoters50/1568386
ttctttgaacttat

SEQ ID NO: 175578 - DNA, 14 bp, Unknown
  misc_feature (1)..( 14): Result.005 file - promoters50/1568386
atcttggaagcaat

SEQ ID NO: 175579 - DNA, 14 bp, Unknown
  misc_feature (1)..( 14): Result.005 file - promoters50/1568386
ccaactgtgtacgt

SEQ ID NO: 175580 - DNA, 13 bp, Unknown
  misc_feature (1)..( 13): Result.005 file - promoters50/1568386
gattcaatcagtt

SEQ ID NO: 175581 - DNA, 13 bp, Unknown
  misc_feature (1)..( 13): Result.005 file - promoters50/1568386
gattaaatatgtt

SEQ ID NO: 175582 - DNA, 13 bp, Unknown
  misc_feature (1)..( 13): Result.005 file - promoters50/1568386
aaataaataacat

SEQ ID NO: 175583 - DNA, 13 bp, Unknown
  misc_feature (1)..( 13): Result.005 file - promoters50/1568386
ttatatatatata

SEQ ID NO: 175584 - DNA, 13 bp, Unknown
  misc_feature (1)..( 13): Result.005 file - promoters50/1568386
atttttatgtata

SEQ ID NO: 175585 - DNA, 13 bp, Unknown
  misc_feature (1)..( 13): Result.005 file - promoters50/1568386
gtttaaattttaa

SEQ ID NO: 175586 - DNA, 8 bp, Unknown
  misc_feature (1)..( 8): Result.005 file - promoters50/1568386
gaaagttt

SEQ ID NO: 175587 - DNA, 8 bp, Unknown
  misc_feature (1)..( 8): Result.005 file - promoters50/1568386
aaaatttt

SEQ ID NO: 175588 - DNA, 8 bp, Unknown
  misc_feature (1)..( 8): Result.005 file - promoters50/1568386
gaatgttg

SEQ ID NO: 175589 - DNA, 8 bp, Unknown
  misc_feature (1)..( 8): Result.005 file - promoters50/1568386
ctattttt

SEQ ID NO: 175590 - DNA, 8 bp, Unknown
  misc_feature (1)..( 8): Result.005 file - promoters50/1568386
gaaacttt

SEQ ID NO: 175591 - DNA, 8 bp, Unknown
  misc_feature (1)..( 8): Result.005 file - promoters50/1568386
taatatta

SEQ ID NO: 175592 - DNA, 8 bp, Unknown
  misc_feature (1)..( 8): Result.005 file - promoters50/1568405
attaatac

SEQ ID NO: 175593 - DNA, 8 bp, Unknown
  misc_feature (1)..( 8): Result.005 file - promoters50/1568405
tttaataa

SEQ ID NO: 175594 - DNA, 8 bp, Unknown
  misc_feature (1)..( 8): Result.005 file - promoters50/1568405
ttttataa

SEQ ID NO: 175595 - DNA, 7 bp, Unknown
  misc_feature (1)..( 7): Result.005 file - promoters50/1568405
atagaaa

SEQ ID NO: 175596 - DNA, 7 bp, Unknown
  misc_feature (1)..( 7): Result.005 file - promoters50/1568405
ataaaaa

SEQ ID NO: 175597 - DNA, 7 bp, Unknown
  misc_feature (1)..( 7): Result.005 file - promoters50/1568405
ataaaat

SEQ ID NO: 175598 - DNA, 11 bp, Unknown
  misc_feature (1)..( 11): Result.005 file - promoters50/1568405
gaaatcagtgt

SEQ ID NO: 175599 - DNA, 11 bp, Unknown
  misc_feature (1)..( 11): Result.005 file - promoters50/1568405
tttatcattgt

SEQ ID NO: 175600 - DNA, 11 bp, Unknown
  misc_feature (1)..( 11): Result.005 file - promoters50/1568405
tttatcatatt

SEQ ID NO: 175601 - DNA, 11 bp, Unknown
  misc_feature (1)..( 11): Result.005 file - promoters50/1568409
tgtgaatctac

SEQ ID NO: 175602 - DNA, 11 bp, Unknown
  misc_feature (1)..( 11): Result.005 file - promoters50/1568409
tgtcaatcttg

SEQ ID NO: 175603 - DNA, 11 bp, Unknown
  misc_feature (1)..( 11): Result.005 file - promoters50/1568409
taagaattttg

SEQ ID NO: 175604 - DNA, 9 bp, Unknown
  misc_feature (1)..( 9): Result.005 file - promoters50/1568409
atatcattc

SEQ ID NO: 175605 - DNA, 9 bp, Unknown
  misc_feature (1)..( 9): Result.005 file - promoters50/1568409
caatctttc

SEQ ID NO: 175606 - DNA, 9 bp, Unknown
  misc_feature (1)..( 9): Result.005 file - promoters50/1568409
caatttttg

SEQ ID NO: 175607 - DNA, 8 bp, Unknown
  misc_feature (1)..( 8): Result.005 file - promoters50/1568409
aaagtctt

SEQ ID NO: 175608 - DNA, 8 bp, Unknown
  misc_feature (1)..( 8): Result.005 file - promoters50/1568409
aaagtcga

SEQ ID NO: 175609 - DNA, 8 bp, Unknown
  misc_feature (1)..( 8): Result.005 file - promoters50/1568409
aaaggctt

SEQ ID NO: 175610 - DNA, 9 bp, Unknown
  misc_feature (1)..( 9): Result.005 file - promoters50/1568409
ctttatttt

SEQ ID NO: 175611 - DNA, 9 bp, Unknown
  misc_feature (1)..( 9): Result.005 file - promoters50/1568409
cttgattgg

SEQ ID NO: 175612 - DNA, 9 bp, Unknown
  misc_feature (1)..( 9): Result.005 file - promoters50/1568409
cattatttt

SEQ ID NO: 175613 - DNA, 16 bp, Unknown
  misc_feature (1)..( 16): Result.005 file - promoters50/1568409
aattattatcttccta

SEQ ID NO: 175614 - DNA, 16 bp, Unknown
  misc_feature (1)..( 16): Result.005 file - promoters50/1568409
atttattaactttcta

SEQ ID NO: 175615 - DNA, 16 bp, Unknown
  misc_feature (1)..( 16): Result.005 file - promoters50/1568409
aattattatcgtctta

SEQ ID NO: 175616 - DNA, 9 bp, Unknown
  misc_feature (1)..( 9): Result.005 file - promoters50/1568409
tttttttat

SEQ ID NO: 175617 - DNA, 9 bp, Unknown
  misc_feature (1)..( 9): Result.005 file - promoters50/1568409
ttattttat

SEQ ID NO: 175618 - DNA, 9 bp, Unknown
  misc_feature (1)..( 9): Result.005 file - promoters50/1568409
ttagtttac

SEQ ID NO: 175619 - DNA, 8 bp, Unknown
  misc_feature (1)..( 8): Result.005 file - promoters50/1568409
tattaaac

SEQ ID NO: 175620 - DNA, 8 bp, Unknown
  misc_feature (1)..( 8): Result.005 file - promoters50/1568409
tataaaat

SEQ ID NO: 175621 - DNA, 8 bp, Unknown
  misc_feature (1)..( 8): Result.005 file - promoters50/1568409
tataaaac

SEQ ID NO: 175622 - DNA, 8 bp, Unknown
  misc_feature (1)..( 8): Result.005 file - promoters50/1568409
gaaatgtc

SEQ ID NO: 175623 - DNA, 8 bp, Unknown
  misc_feature (1)..( 8): Result.005 file - promoters50/1568409
gaaaagtc

SEQ ID NO: 175624 - DNA, 8 bp, Unknown
  misc_feature (1)..( 8): Result.005 file - promoters50/1568409
gaaacgtc

SEQ ID NO: 175625 - DNA, 8 bp, Unknown
  misc_feature (1)..( 8): Result.005 file - promoters50/1568508
tcttataa

SEQ ID NO: 175626 - DNA, 8 bp, Unknown
  misc_feature (1)..( 8): Result.005 file - promoters50/1568508
tcttataa

SEQ ID NO: 175627 - DNA, 8 bp, Unknown
  misc_feature (1)..( 8): Result.005 file - promoters50/1568508
acttatat

SEQ ID NO: 175628 - DNA, 9 bp, Unknown
  misc_feature (1)..( 9): Result.005 file - promoters50/1568924
aaaaagaaa

SEQ ID NO: 175629 - DNA, 9 bp, Unknown
  misc_feature (1)..( 9): Result.005 file - promoters50/1568924
aaaaagatt

SEQ ID NO: 175630 - DNA, 9 bp, Unknown
  misc_feature (1)..( 9): Result.005 file - promoters50/1568924
aaaaataaa

SEQ ID NO: 175631 - DNA, 9 bp, Unknown
  misc_feature (1)..( 9): Result.005 file - promoters50/1568924
aaaagaaaa

SEQ ID NO: 175632 - DNA, 9 bp, Unknown
  misc_feature (1)..( 9): Result.005 file - promoters50/1568924
aaaataaaa

SEQ ID NO: 175633 - DNA, 9 bp, Unknown
  misc_feature (1)..( 9): Result.005 file - promoters50/1568924
tttataaaa

SEQ ID NO: 175634 - DNA, 7 bp, Unknown
  misc_feature (1)..( 7): Result.005 file - promoters50/1568924
tatatat

SEQ ID NO: 175635 - DNA, 7 bp, Unknown
  misc_feature (1)..( 7): Result.005 file - promoters50/1568924
tatataa

SEQ ID NO: 175636 - DNA, 7 bp, Unknown
  misc_feature (1)..( 7): Result.005 file - promoters50/1568924
catataa

SEQ ID NO: 175637 - DNA, 14 bp, Unknown
  misc_feature (1)..( 14): Result.005 file - promoters50/1569568
taaataaacttaat

SEQ ID NO: 175638 - DNA, 14 bp, Unknown
  misc_feature (1)..( 14): Result.005 file - promoters50/1569568
attaaaaacttttt

SEQ ID NO: 175639 - DNA, 14 bp, Unknown
  misc_feature (1)..( 14): Result.005 file - promoters50/1569568
acttcaaaattaaa

SEQ ID NO: 175640 - DNA, 14 bp, Unknown
  misc_feature (1)..( 14): Result.005 file - promoters50/1569568
ataataaaattagt

SEQ ID NO: 175641 - DNA, 14 bp, Unknown
  misc_feature (1)..( 14): Result.005 file - promoters50/1569568
ttatataactattt

SEQ ID NO: 175642 - DNA, 14 bp, Unknown
  misc_feature (1)..( 14): Result.005 file - promoters50/1569568
gtatgctactattc

SEQ ID NO: 175643 - DNA, 14 bp, Unknown
  misc_feature (1)..( 14): Result.005 file - promoters50/1569568
ataacaaacatcgt

SEQ ID NO: 175644 - DNA, 11 bp, Unknown
  misc_feature (1)..( 11): Result.005 file - promoters50/1569568
tctatatatat

SEQ ID NO: 175645 - DNA, 11 bp, Unknown
  misc_feature (1)..( 11): Result.005 file - promoters50/1569568
cttatatattc

SEQ ID NO: 175646 - DNA, 11 bp, Unknown
  misc_feature (1)..( 11): Result.005 file - promoters50/1569568
cctataaatat

SEQ ID NO: 175647 - DNA, 11 bp, Unknown
  misc_feature (1)..( 11): Result.005 file - promoters50/1569568
cctatatatca

SEQ ID NO: 175648 - DNA, 11 bp, Unknown
  misc_feature (1)..( 11): Result.005 file - promoters50/1569568
ataataaatac

SEQ ID NO: 175649 - DNA, 11 bp, Unknown
  misc_feature (1)..( 11): Result.005 file - promoters50/1569568
aatataaatat

SEQ ID NO: 175650 - DNA, 11 bp, Unknown
  misc_feature (1)..( 11): Result.005 file - promoters50/1569568
cctttaaaaaa

SEQ ID NO: 175651 - DNA, 11 bp, Unknown
  misc_feature (1)..( 11): Result.005 file - promoters50/1569568
aatttagataa

SEQ ID NO: 175652 - DNA, 11 bp, Unknown
  misc_feature (1)..( 11): Result.005 file - promoters50/1569568
tatttatataa

SEQ ID NO: 175653 - DNA, 11 bp, Unknown
  misc_feature (1)..( 11): Result.005 file - promoters50/1569568
gattaataatt

SEQ ID NO: 175654 - DNA, 11 bp, Unknown
  misc_feature (1)..( 11): Result.005 file - promoters50/1569568
gattaaaaact

SEQ ID NO: 175655 - DNA, 11 bp, Unknown
  misc_feature (1)..( 11): Result.005 file - promoters50/1569568
ccttaatatcg

SEQ ID NO: 175656 - DNA, 11 bp, Unknown
  misc_feature (1)..( 11): Result.005 file - promoters50/1569568
tctctatataa

SEQ ID NO: 175657 - DNA, 11 bp, Unknown
  misc_feature (1)..( 11): Result.005 file - promoters50/1569568
atttaaaaatt

SEQ ID NO: 175658 - DNA, 11 bp, Unknown
  misc_feature (1)..( 11): Result.005 file - promoters50/1569568
tggtatttact

SEQ ID NO: 175659 - DNA, 11 bp, Unknown
  misc_feature (1)..( 11): Result.005 file - promoters50/1569568
gtttatttact

SEQ ID NO: 175660 - DNA, 11 bp, Unknown
  misc_feature (1)..( 11): Result.005 file - promoters50/1569568
ttttatttcat

SEQ ID NO: 175661 - DNA, 11 bp, Unknown
  misc_feature (1)..( 11): Result.005 file - promoters50/1569568
atttattcacc

SEQ ID NO: 175662 - DNA, 11 bp, Unknown
  misc_feature (1)..( 11): Result.005 file - promoters50/1569568
ttttatttcac

SEQ ID NO: 175663 - DNA, 11 bp, Unknown
  misc_feature (1)..( 11): Result.005 file - promoters50/1569568
taatatctcat

SEQ ID NO: 175664 - DNA, 11 bp, Unknown
  misc_feature (1)..( 11): Result.005 file - promoters50/1569568
aattattttca

SEQ ID NO: 175665 - DNA, 15 bp, Unknown
  misc_feature (1)..( 15): Result.005 file - promoters50/1569568
ttcttctatatatat

SEQ ID NO: 175666 - DNA, 15 bp, Unknown
  misc_feature (1)..( 15): Result.005 file - promoters50/1569568
gtctcctataataaa

SEQ ID NO: 175667 - DNA, 15 bp, Unknown
  misc_feature (1)..( 15): Result.005 file - promoters50/1569568
gtctcttatatattc

SEQ ID NO: 175668 - DNA, 15 bp, Unknown
  misc_feature (1)..( 15): Result.005 file - promoters50/1569568
ttgtcctataaatat

SEQ ID NO: 175669 - DNA, 15 bp, Unknown
  misc_feature (1)..( 15): Result.005 file - promoters50/1569568
aattcctatatatca

SEQ ID NO: 175670 - DNA, 15 bp, Unknown
  misc_feature (1)..( 15): Result.005 file - promoters50/1569568
gtagcctttaaaaaa

SEQ ID NO: 175671 - DNA, 11 bp, Unknown
  misc_feature (1)..( 11): Result.005 file - promoters50/1569568
ttttatttcat

SEQ ID NO: 175672 - DNA, 11 bp, Unknown
  misc_feature (1)..( 11): Result.005 file - promoters50/1569568
taatatctcat

SEQ ID NO: 175673 - DNA, 11 bp, Unknown
  misc_feature (1)..( 11): Result.005 file - promoters50/1569568
aattattttca

SEQ ID NO: 175674 - DNA, 11 bp, Unknown
  misc_feature (1)..( 11): Result.005 file - promoters50/1569568
gtttatttact

SEQ ID NO: 175675 - DNA, 11 bp, Unknown
  misc_feature (1)..( 11): Result.005 file - promoters50/1569568
ttttatttcac

SEQ ID NO: 175676 - DNA, 12 bp, Unknown
  misc_feature (1)..( 12): Result.005 file - promoters50/1569568
acctatattctt

SEQ ID NO: 175677 - DNA, 35 bp, Unknown; identical to SEQ ID NO: 133959
  misc_feature (1)..( 35): Result.005 file - promoters50/1569721

SEQ ID NO: 175678 - DNA, 35 bp, Unknown; identical to SEQ ID NO: 133958
  misc_feature (1)..( 35): Result.005 file - promoters50/1569721

SEQ ID NO: 175679 - DNA, 35 bp, Unknown; identical to SEQ ID NO: 164299
  misc_feature (1)..( 35): Result.005 file - promoters50/1569721

SEQ ID NO: 175680 - DNA, 35 bp, Unknown
  misc_feature (1)..( 35): Result.005 file - promoters50/1569721
aaccattttatagaaatattaaaatcaaaaatgat

SEQ ID NO: 175681 - DNA, 35 bp, Unknown
  misc_feature (1)..( 35): Result.005 file - promoters50/1569721
gaaatagtttggttatgccgtttaagtgataaacc

SEQ ID NO: 175682 - DNA, 35 bp, Unknown
  misc_feature (1)..( 35): Result.005 file - promoters50/1569721
ttccatttcataccttttttctctttcaagcttat

SEQ ID NO: 175683 - DNA, 11 bp, Unknown
  misc_feature (1)..( 11): Result.005 file - promoters50/1569721
tattctagatg

SEQ ID NO: 175684 - DNA, 11 bp, Unknown
  misc_feature (1)..( 11): Result.005 file - promoters50/1569721
gtttctagggt

SEQ ID NO: 175685 - DNA, 11 bp, Unknown
  misc_feature (1)..( 11): Result.005 file - promoters50/1569721
tattatagatg

SEQ ID NO: 175686 - DNA, 11 bp, Unknown
  misc_feature (1)..( 11): Result.005 file - promoters50/1569721
ttttctacaaa

SEQ ID NO: 175687 - DNA, 11 bp, Unknown
  misc_feature (1)..( 11): Result.005 file - promoters50/1569721
tcttcaaggtt

SEQ ID NO: 175688 - DNA, 11 bp, Unknown
  misc_feature (1)..( 11): Result.005 file - promoters50/1569721
cattataaaat

SEQ ID NO: 175689 - DNA, 8 bp, Unknown
  misc_feature (1)..( 8): Result.005 file - promoters50/1570085
ttatataa

SEQ ID NO: 175690 - DNA, 8 bp, Unknown
  misc_feature (1)..( 8): Result.005 file - promoters50/1570085
atatatac

SEQ ID NO: 175691 - DNA, 8 bp, Unknown
  misc_feature (1)..( 8): Result.005 file - promoters50/1570085
atatttac

SEQ ID NO: 175692 - DNA, 7 bp, Unknown
  misc_feature (1)..( 7): Result.005 file - promoters50/1570085
tttgttt

SEQ ID NO: 175693 - DNA, 7 bp, Unknown
  misc_feature (1)..( 7): Result.005 file - promoters50/1570085
tttattt

SEQ ID NO: 175694 - DNA, 7 bp, Unknown
  misc_feature (1)..( 7): Result.005 file - promoters50/1570085
cttattt

SEQ ID NO: 175695 - DNA, 16 bp, Unknown
  misc_feature (1)..( 16): Result.005 file - promoters50/1570107
caattaccttaattat

SEQ ID NO: 175696 - DNA, 16 bp, Unknown
  misc_feature (1)..( 16): Result.005 file - promoters50/1570107
caataaccataataaa

SEQ ID NO: 175697 - DNA, 16 bp, Unknown
  misc_feature (1)..( 16): Result.005 file - promoters50/1570107
acggtcacataataaa

SEQ ID NO: 175698 - DNA, 8 bp, Unknown
  misc_feature (1)..( 8): Result.005 file - promoters50/1570107
aattcttc

SEQ ID NO: 175699 - DNA, 8 bp, Unknown
  misc_feature (1)..( 8): Result.005 file - promoters50/1570107
aattgttc

SEQ ID NO: 175700 - DNA, 8 bp, Unknown
  misc_feature (1)..( 8): Result.005 file - promoters50/1570107
atttgttc

SEQ ID NO: 175701 - DNA, 8 bp, Unknown
  misc_feature (1)..( 8): Result.005 file - promoters50/1570107
ttttaaaa

SEQ ID NO: 175702 - DNA, 8 bp, Unknown
  misc_feature (1)..( 8): Result.005 file - promoters50/1570107
tttcaaaa

SEQ ID NO: 175703 - DNA, 8 bp, Unknown
  misc_feature (1)..( 8): Result.005 file - promoters50/1570107
aattaaaa

SEQ ID NO: 175704 - DNA, 7 bp, Unknown
  misc_feature (1)..( 7): Result.005 file - promoters50/1570107
caaaaaa

SEQ ID NO: 175705 - DNA, 7 bp, Unknown
  misc_feature (1)..( 7): Result.005 file - promoters50/1570107
caaaaaa

SEQ ID NO: 175706 - DNA, 7 bp, Unknown
  misc_feature (1)..( 7): Result.005 file - promoters50/1570107
gaaaaaa

SEQ ID NO: 175707 - DNA, 7 bp, Unknown
  misc_feature (1)..( 7): Result.005 file - promoters50/1570107
gaaaaaa

SEQ ID NO: 175708 - DNA, 8 bp, Unknown
  misc_feature (1)..( 8): Result.005 file - promoters50/1570107
cttttttt

SEQ ID NO: 175709 - DNA, 8 bp, Unknown
  misc_feature (1)..( 8): Result.005 file - promoters50/1570107
cttttttc

SEQ ID NO: 175710 - DNA, 8 bp, Unknown
  misc_feature (1)..( 8): Result.005 file - promoters50/1570107
tttttttt

SEQ ID NO: 175711 - DNA, 11 bp, Unknown
  misc_feature (1)..( 11): Result.005 file - promoters50/1570107
taagatacgta

SEQ ID NO: 175712 - DNA, 11 bp, Unknown
  misc_feature (1)..( 11): Result.005 file - promoters50/1570107
agagattcgta

SEQ ID NO: 175713 - DNA, 11 bp, Unknown
  misc_feature (1)..( 11): Result.005 file - promoters50/1570107
agagagtcggc

SEQ ID NO: 175714 - DNA, 8 bp, Unknown
  misc_feature (1)..( 8): Result.005 file - promoters50/1570107
tcaacaac

SEQ ID NO: 175715 - DNA, 8 bp, Unknown
  misc_feature (1)..( 8): Result.005 file - promoters50/1570107
tcaataac

SEQ ID NO: 175716 - DNA, 8 bp, Unknown
  misc_feature (1)..( 8): Result.005 file - promoters50/1570107
tcaataac

SEQ ID NO: 175717 - DNA, 7 bp, Unknown
  misc_feature (1)..( 7): Result.005 file - promoters50/1570107
aattaag

SEQ ID NO: 175718 - DNA, 7 bp, Unknown
  misc_feature (1)..( 7): Result.005 file - promoters50/1570107
aattaag

SEQ ID NO: 175719 - DNA, 7 bp, Unknown
  misc_feature (1)..( 7): Result.005 file - promoters50/1570107
aattaaa

SEQ ID NO: 175720 - DNA, 6 bp, Unknown
  misc_feature (1)..( 6): Result.005 file - promoters50/1570107
gaaatg

SEQ ID NO: 175721 - DNA, 6 bp, Unknown
  misc_feature (1)..( 6): Result.005 file - promoters50/1570107
gaaatg

SEQ ID NO: 175722 - DNA, 6 bp, Unknown
  misc_feature (1)..( 6): Result.005 file - promoters50/1570107
gaaatg

SEQ ID NO: 175723 - DNA, 8 bp, Unknown
  misc_feature (1)..( 8): Result.005 file - promoters50/1570107
gatattaa

SEQ ID NO: 175724 - DNA, 8 bp, Unknown
  misc_feature (1)..( 8): Result.005 file - promoters50/1570107
cataataa

SEQ ID NO: 175725 - DNA, 8 bp, Unknown
  misc_feature (1)..( 8): Result.005 file - promoters50/1570107
catcatac

SEQ ID NO: 175726 - DNA, 9 bp, Unknown
  misc_feature (1)..( 9): Result.005 file - promoters50/1570116
aaaataact

SEQ ID NO: 175727 - DNA, 9 bp, Unknown
  misc_feature (1)..( 9): Result.005 file - promoters50/1570116
aaagtaatg

SEQ ID NO: 175728 - DNA, 9 bp, Unknown
  misc_feature (1)..( 9): Result.005 file - promoters50/1570116
aaaataata

SEQ ID NO: 175729 - DNA, 9 bp, Unknown
  misc_feature (1)..( 9): Result.005 file - promoters50/1570116
aaaaaaact

SEQ ID NO: 175730 - DNA, 9 bp, Unknown
  misc_feature (1)..( 9): Result.005 file - promoters50/1570116
aaactaatt

SEQ ID NO: 175731 - DNA, 9 bp, Unknown
  misc_feature (1)..( 9): Result.005 file - promoters50/1570116
aaaatactt

SEQ ID NO: 175732 - DNA, 13 bp, Unknown
  misc_feature (1)..( 13): Result.005 file - promoters50/1570116
aaaaaaaaattct

SEQ ID NO: 175733 - DNA, 13 bp, Unknown
  misc_feature (1)..( 13): Result.005 file - promoters50/1570116
attgaaaaatcat

SEQ ID NO: 175734 - DNA, 13 bp, Unknown
  misc_feature (1)..( 13): Result.005 file - promoters50/1570116
gagtcaaaatttc

SEQ ID NO: 175735 - DNA, 13 bp, Unknown
  misc_feature (1)..( 13): Result.005 file - promoters50/1570116
aaaaaaaaatgga

SEQ ID NO: 175736 - DNA, 13 bp, Unknown
  misc_feature (1)..( 13): Result.005 file - promoters50/1570116
aaaaaaaaaatct

SEQ ID NO: 175737 - DNA, 13 bp, Unknown
  misc_feature (1)..( 13): Result.005 file - promoters50/1570116
tcataaaagtttt

SEQ ID NO: 175738 - DNA, 13 bp, Unknown
  misc_feature (1)..( 13): Result.005 file - promoters50/1570116
ctacaaaagttag

SEQ ID NO: 175739 - DNA, 12 bp, Unknown
  misc_feature (1)..( 12): Result.005 file - promoters50/1570116
tcgagacattat

SEQ ID NO: 175740 - DNA, 12 bp, Unknown
  misc_feature (1)..( 12): Result.005 file - promoters50/1570116
attagaaatttt

SEQ ID NO: 175741 - DNA, 12 bp, Unknown
  misc_feature (1)..( 12): Result.005 file - promoters50/1570116
cataaacattaa

SEQ ID NO: 175742 - DNA, 12 bp, Unknown
  misc_feature (1)..( 12): Result.005 file - promoters50/1570116
tttataaaagtt

SEQ ID NO: 175743 - DNA, 12 bp, Unknown
  misc_feature (1)..( 12): Result.005 file - promoters50/1570116
ttgaaaaagttt

SEQ ID NO: 175744 - DNA, 12 bp, Unknown
  misc_feature (1)..( 12): Result.005 file - promoters50/1570116
attaaaaagtct

SEQ ID NO: 175745 - DNA, 9 bp, Unknown
  misc_feature (1)..( 9): Result.005 file - promoters50/1570179
tcaccacat

SEQ ID NO: 175746 - DNA, 9 bp, Unknown
  misc_feature (1)..( 9): Result.005 file - promoters50/1570179
acactacaa

SEQ ID NO: 175747 - DNA, 9 bp, Unknown
  misc_feature (1)..( 9): Result.005 file - promoters50/1570179
acaatacaa

SEQ ID NO: 175748 - DNA, 7 bp, Unknown
  misc_feature (1)..( 7): Result.005 file - promoters50/1570179
ccaagaa

SEQ ID NO: 175749 - DNA, 7 bp, Unknown
  misc_feature (1)..( 7): Result.005 file - promoters50/1570179
acaagaa

SEQ ID NO: 175750 - DNA, 7 bp, Unknown
  misc_feature (1)..( 7): Result.005 file - promoters50/1570179
acaagat

SEQ ID NO: 175751 - DNA, 16 bp, Unknown
  misc_feature (1)..( 16): Result.005 file - promoters50/1570293
aatggatagtggctaa

SEQ ID NO: 175752 - DNA, 16 bp, Unknown
  misc_feature (1)..( 16): Result.005 file - promoters50/1570293
ccgggaaagtgtgatt

SEQ ID NO: 175753 - DNA, 16 bp, Unknown
  misc_feature (1)..( 16): Result.005 file - promoters50/1570293
aatagataactatgcc

SEQ ID NO: 175754 - DNA, 16 bp, Unknown
  misc_feature (1)..( 16): Result.005 file - promoters50/1570293
cgaggaaggtgtgatt

SEQ ID NO: 175755 - DNA, 16 bp, Unknown
  misc_feature (1)..( 16): Result.005 file - promoters50/1570293
gacagataacgttgtg

SEQ ID NO: 175756 - DNA, 8 bp, Unknown
  misc_feature (1)..( 8): Result.005 file - promoters50/1570293
gaatttta

SEQ ID NO: 175757 - DNA, 8 bp, Unknown
  misc_feature (1)..( 8): Result.005 file - promoters50/1570293
aaattttc

SEQ ID NO: 175758 - DNA, 9 bp, Unknown
  misc_feature (1)..( 9): Result.005 file - promoters50/1570293
aaagtttta

SEQ ID NO: 175759 - DNA, 9 bp, Unknown
  misc_feature (1)..( 9): Result.005 file - promoters50/1570293
aagatttaa

SEQ ID NO: 175760 - DNA, 9 bp, Unknown
  misc_feature (1)..( 9): Result.005 file - promoters50/1570293
aagaattaa

SEQ ID NO: 175761 - DNA, 9 bp, Unknown
  misc_feature (1)..( 9): Result.005 file - promoters50/1570622
aaacataac

SEQ ID NO: 175762 - DNA, 9 bp, Unknown
  misc_feature (1)..( 9): Result.005 file - promoters50/1570622
caacttaat

SEQ ID NO: 175763 - DNA, 9 bp, Unknown
  misc_feature (1)..( 9): Result.005 file - promoters50/1570622
aaaaataca

SEQ ID NO: 175764 - DNA, 9 bp, Unknown
  misc_feature (1)..( 9): Result.005 file - promoters50/1570622
tgacataaa

SEQ ID NO: 175765 - DNA, 9 bp, Unknown
  misc_feature (1)..( 9): Result.005 file - promoters50/1570622
taaaatata

SEQ ID NO: 175766 - DNA, 9 bp, Unknown
  misc_feature (1)..( 9): Result.005 file - promoters50/1570622
aaaaattca

SEQ ID NO: 175767 - DNA, 9 bp, Unknown
  misc_feature (1)..( 9): Result.005 file - promoters50/1570622
aaaaacagt

SEQ ID NO: 175768 - DNA, 20 bp, Unknown
  misc_feature (1)..( 20): Result.005 file - promoters50/1570622
ttaatacaattgagagataa

SEQ ID NO: 175769 - DNA, 20 bp, Unknown
  misc_feature (1)..( 20): Result.005 file - promoters50/1570622
gtaaaacaaaacacaccctt

SEQ ID NO: 175770 - DNA, 20 bp, Unknown
  misc_feature (1)..( 20): Result.005 file - promoters50/1570622
tcggtacaattctggttgaa

SEQ ID NO: 175771 - DNA, 20 bp, Unknown
  misc_feature (1)..( 20): Result.005 file - promoters50/1570622
gaaaaaaaaaaaaggaaaac

SEQ ID NO: 175772 - DNA, 20 bp, Unknown
  misc_feature (1)..( 20): Result.005 file - promoters50/1570622
ggaaaaatgactgctgacta

SEQ ID NO: 175773 - DNA, 20 bp, Unknown
  misc_feature (1)..( 20): Result.005 file - promoters50/1570622
gttaaacaagttttgtttag

SEQ ID NO: 175774 - DNA, 11 bp, Unknown
  misc_feature (1)..( 11): Result.005 file - promoters50/1570622
ttaattatatt

SEQ ID NO: 175775 - DNA, 11 bp, Unknown
  misc_feature (1)..( 11): Result.005 file - promoters50/1570622
ctaaatataaa

SEQ ID NO: 175776 - DNA, 11 bp, Unknown
  misc_feature (1)..( 11): Result.005 file - promoters50/1570622
tcaaatataga

SEQ ID NO: 175777 - DNA, 11 bp, Unknown
  misc_feature (1)..( 11): Result.005 file - promoters50/1570622
ataaaaagtta

SEQ ID NO: 175778 - DNA, 11 bp, Unknown
  misc_feature (1)..( 11): Result.005 file - promoters50/1570622
aaaaaaagtta

SEQ ID NO: 175779 - DNA, 11 bp, Unknown
  misc_feature (1)..( 11): Result.005 file - promoters50/1570622
gaaaacaaacc

SEQ ID NO: 175780 - DNA, 9 bp, Unknown
  misc_feature (1)..( 9): Result.005 file - promoters50/1570735
actaactct

SEQ ID NO: 175781 - DNA, 9 bp, Unknown
  misc_feature (1)..( 9): Result.005 file - promoters50/1570735
tttaaatct

SEQ ID NO: 175782 - DNA, 9 bp, Unknown
  misc_feature (1)..( 9): Result.005 file - promoters50/1570735
tttatatca

SEQ ID NO: 175783 - DNA, 10 bp, Unknown
  misc_feature (1)..( 10): Result.005 file - promoters50/1570735
tctttcttgt

SEQ ID NO: 175784 - DNA, 10 bp, Unknown
  misc_feature (1)..( 10): Result.005 file - promoters50/1570735
tctttctttt

SEQ ID NO: 175785 - DNA, 10 bp, Unknown
  misc_feature (1)..( 10): Result.005 file - promoters50/1570735
tatttgtttt

SEQ ID NO: 175786 - DNA, 8 bp, Unknown
  misc_feature (1)..( 8): Result.005 file - promoters50/1570735
gttgtttg

SEQ ID NO: 175787 - DNA, 8 bp, Unknown
  misc_feature (1)..( 8): Result.005 file - promoters50/1570735
tttgtttt

SEQ ID NO: 175788 - DNA, 8 bp, Unknown
  misc_feature (1)..( 8): Result.005 file - promoters50/1570735
tttctttt

SEQ ID NO: 175789 - DNA, 12 bp, Unknown
  misc_feature (1)..( 12): Result.005 file - promoters50/1570860
aagaaaaaattc

SEQ ID NO: 175790 - DNA, 12 bp, Unknown
  misc_feature (1)..( 12): Result.005 file - promoters50/1570860
tcaacaaaatta

SEQ ID NO: 175791 - DNA, 13 bp, Unknown
  misc_feature (1)..( 13): Result.005 file - promoters50/1570860
aaataaaacattg

SEQ ID NO: 175792 - DNA, 13 bp, Unknown
  misc_feature (1)..( 13): Result.005 file - promoters50/1570860
tgtgctgaaatta

SEQ ID NO: 175793 - DNA, 13 bp, Unknown
  misc_feature (1)..( 13): Result.005 file - promoters50/1570860
atccaaaccatat

SEQ ID NO: 175794 - DNA, 13 bp, Unknown
  misc_feature (1)..( 13): Result.005 file - promoters50/1570860
aagagtaccgtat

SEQ ID NO: 175795 - DNA, 13 bp, Unknown
  misc_feature (1)..( 13): Result.005 file - promoters50/1570860
ccatgaatgattt

SEQ ID NO: 175796 - DNA, 14 bp, Unknown
  misc_feature (1)..( 14): Result.005 file - promoters50/1570860
aaaccaaacatgtt

SEQ ID NO: 175797 - DNA, 14 bp, Unknown
  misc_feature (1)..( 14): Result.005 file - promoters50/1570860
caaaaaaaaatgtt

SEQ ID NO: 175798 - DNA, 14 bp, Unknown
  misc_feature (1)..( 14): Result.005 file - promoters50/1570860
aaactaaagatgac

SEQ ID NO: 175799 - DNA, 14 bp, Unknown
  misc_feature (1)..( 14): Result.005 file - promoters50/1570860
gagaaagagatgag

SEQ ID NO: 175800 - DNA, 14 bp, Unknown
  misc_feature (1)..( 14): Result.005 file - promoters50/1570860
ttgttaaagatgta

SEQ ID NO: 175801 - DNA, 14 bp, Unknown
  misc_feature (1)..( 14): Result.005 file - promoters50/1570860
aatacttaaattaa

SEQ ID NO: 175802 - DNA, 9 bp, Unknown
  misc_feature (1)..( 9): Result.005 file - promoters50/1570860
tctaaaaaa

SEQ ID NO: 175803 - DNA, 9 bp, Unknown
  misc_feature (1)..( 9): Result.005 file - promoters50/1570860
tgtaataaa

SEQ ID NO: 175804 - DNA, 9 bp, Unknown
  misc_feature (1)..( 9): Result.005 file - promoters50/1570860
attcgaaaa

SEQ ID NO: 175805 - DNA, 9 bp, Unknown
  misc_feature (1)..( 9): Result.005 file - promoters50/1570860
attcgaatc

SEQ ID NO: 175806 - DNA, 9 bp, Unknown
  misc_feature (1)..( 9): Result.005 file - promoters50/1570860
attagaaac

SEQ ID NO: 175807 - DNA, 9 bp, Unknown
  misc_feature (1)..( 9): Result.005 file - promoters50/1570860
ttgcgaaaa

SEQ ID NO: 175808 - DNA, 16 bp, Unknown
  misc_feature (1)..( 16): Result.005 file - promoters50/1570869
aacaatttttaaattt

SEQ ID NO: 175809 - DNA, 16 bp, Unknown
  misc_feature (1)..( 16): Result.005 file - promoters50/1570869
atatctttataagtat

SEQ ID NO: 175810 - DNA, 16 bp, Unknown
  misc_feature (1)..( 16): Result.005 file - promoters50/1570869
tatacgttttaaaagt

SEQ ID NO: 175811 - DNA, 16 bp, Unknown
  misc_feature (1)..( 16): Result.005 file - promoters50/1570869
ctcgcttcataacaaa

SEQ ID NO: 175812 - DNA, 16 bp, Unknown
  misc_feature (1)..( 16): Result.005 file - promoters50/1570869
ataactttatgttatt

SEQ ID NO: 175813 - DNA, 16 bp, Unknown
  misc_feature (1)..( 16): Result.005 file - promoters50/1570869
gaaaacttataattat

SEQ ID NO: 175814 - DNA, 16 bp, Unknown
  misc_feature (1)..( 16): Result.005 file - promoters50/1570869
cgaaatttgtaacttc

SEQ ID NO: 175815 - DNA, 11 bp, Unknown
  misc_feature (1)..( 11): Result.005 file - promoters50/1570869
taaatttttta

SEQ ID NO: 175816 - DNA, 11 bp, Unknown
  misc_feature (1)..( 11): Result.005 file - promoters50/1570869
ttaatcttttg

SEQ ID NO: 175817 - DNA, 11 bp, Unknown
  misc_feature (1)..( 11): Result.005 file - promoters50/1570869
gaaatttcctc

SEQ ID NO: 175818 - DNA, 11 bp, Unknown
  misc_feature (1)..( 11): Result.005 file - promoters50/1570869
ataattttgtt

SEQ ID NO: 175819 - DNA, 11 bp, Unknown
  misc_feature (1)..( 11): Result.005 file - promoters50/1570869
taaatttgtta

SEQ ID NO: 175820 - DNA, 12 bp, Unknown
  misc_feature (1)..( 12): Result.005 file - promoters50/1570869
tatattgtgtta

SEQ ID NO: 175821 - DNA, 13 bp, Unknown
  misc_feature (1)..( 13): Result.005 file - promoters50/1570869
tgcattagttctt

SEQ ID NO: 175822 - DNA, 15 bp, Unknown
  misc_feature (1)..( 15): Result.005 file - promoters50/1570869
ttttaaaatatatgg

SEQ ID NO: 175823 - DNA, 15 bp, Unknown
  misc_feature (1)..( 15): Result.005 file - promoters50/1570869
ttctaaaatattgtt

SEQ ID NO: 175824 - DNA, 15 bp, Unknown
  misc_feature (1)..( 15): Result.005 file - promoters50/1570869
ttttaaaagtaagat

SEQ ID NO: 175825 - DNA, 15 bp, Unknown
  misc_feature (1)..( 15): Result.005 file - promoters50/1570869
ttttgaaataatttc

SEQ ID NO: 175826 - DNA, 15 bp, Unknown
  misc_feature (1)..( 15): Result.005 file - promoters50/1570869
gtgttaaatatgaat

SEQ ID NO: 175827 - DNA, 15 bp, Unknown
  misc_feature (1)..( 15): Result.005 file - promoters50/1570869
ctgagaaatagattt

SEQ ID NO: 175828 - DNA, 15 bp, Unknown
  misc_feature (1)..( 15): Result.005 file - promoters50/1570869
atgttagataggaaa

SEQ ID NO: 175829 - DNA, 15 bp, Unknown
  misc_feature (1)..( 15): Result.005 file - promoters50/1570869
gtgttaaactgttag

SEQ ID NO: 175830 - DNA, 12 bp, Unknown
  misc_feature (1)..( 12): Result.005 file - promoters50/1570869
tttataaataaa

SEQ ID NO: 175831 - DNA, 12 bp, Unknown
  misc_feature (1)..( 12): Result.005 file - promoters50/1570869
cctataaatatc

SEQ ID NO: 175832 - DNA, 12 bp, Unknown
  misc_feature (1)..( 12): Result.005 file - promoters50/1570869
tatataaactct

SEQ ID NO: 175833 - DNA, 12 bp, Unknown
  misc_feature (1)..( 12): Result.005 file - promoters50/1570869
tatataaatgac

SEQ ID NO: 175834 - DNA, 12 bp, Unknown
  misc_feature (1)..( 12): Result.005 file - promoters50/1570869
tatataaacaaa

SEQ ID NO: 175835 - DNA, 12 bp, Unknown
  misc_feature (1)..( 12): Result.005 file - promoters50/1570869
actataaaatca

SEQ ID NO: 175836 - DNA, 12 bp, Unknown
  misc_feature (1)..( 12): Result.005 file - promoters50/1570869
tatataataacc

SEQ ID NO: 175837 - DNA, 12 bp, Unknown
  misc_feature (1)..( 12): Result.005 file - promoters50/1570869
cccataaaagca

SEQ ID NO: 175838 - DNA, 16 bp, Unknown
  misc_feature (1)..( 16): Result.005 file - promoters50/1570869
ggatagtaaaaaaaga

SEQ ID NO: 175839 - DNA, 16 bp, Unknown
  misc_feature (1)..( 16): Result.005 file - promoters50/1570869
aaatctgagaaataga

SEQ ID NO: 175840 - DNA, 16 bp, Unknown
  misc_feature (1)..( 16): Result.005 file - promoters50/1570869
ttagataggaaaaagt

SEQ ID NO: 175841 - DNA, 16 bp, Unknown
  misc_feature (1)..( 16): Result.005 file - promoters50/1570869
ataaattttaaaatta

SEQ ID NO: 175842 - DNA, 16 bp, Unknown
  misc_feature (1)..( 16): Result.005 file - promoters50/1570869
tactagtatatatatt

SEQ ID NO: 175843 - DNA, 16 bp, Unknown
  misc_feature (1)..( 16): Result.005 file - promoters50/1570869
taaattttgaaataat

SEQ ID NO: 175844 - DNA, 16 bp, Unknown
  misc_feature (1)..( 16): Result.005 file - promoters50/1570869
atatggatagtaaaaa

SEQ ID NO: 175845 - DNA, 16 bp, Unknown
  misc_feature (1)..( 16): Result.005 file - promoters50/1570869
tgttagataggaaaaa

SEQ ID NO: 175846 - DNA, 16 bp, Unknown
  misc_feature (1)..( 16): Result.005 file - promoters50/1570869
aaatagatttgaaaaa

SEQ ID NO: 175847 - DNA, 16 bp, Unknown
  misc_feature (1)..( 16): Result.005 file - promoters50/1570869
tcataaattttaaaat

SEQ ID NO: 175848 - DNA, 16 bp, Unknown
  misc_feature (1)..( 16): Result.005 file - promoters50/1570869
tgttaaatatgaatat

SEQ ID NO: 175849 - DNA, 16 bp, Unknown
  misc_feature (1)..( 16): Result.005 file - promoters50/1570869
tgtaaattttgaaata

SEQ ID NO: 175850 - DNA, 10 bp, Unknown
  misc_feature (1)..( 10): Result.005 file - promoters50/1570869
ttttgattct

SEQ ID NO: 175851 - DNA, 10 bp, Unknown
  misc_feature (1)..( 10): Result.005 file - promoters50/1570869
gttttattta

SEQ ID NO: 175852 - DNA, 10 bp, Unknown
  misc_feature (1)..( 10): Result.005 file - promoters50/1570869
ttttgaaata

SEQ ID NO: 175853 - DNA, 10 bp, Unknown
  misc_feature (1)..( 10): Result.005 file - promoters50/1570869
atttgaaaaa

SEQ ID NO: 175854 - DNA, 10 bp, Unknown
  misc_feature (1)..( 10): Result.005 file - promoters50/1570869
tattgtgtta

SEQ ID NO: 175855 - DNA, 10 bp, Unknown
  misc_feature (1)..( 10): Result.005 file - promoters50/1570869
attttaaaat

SEQ ID NO: 175856 - DNA, 9 bp, Unknown
  misc_feature (1)..( 9): Result.005 file - promoters50/1570966
aaagtttat

SEQ ID NO: 175857 - DNA, 9 bp, Unknown
  misc_feature (1)..( 9): Result.005 file - promoters50/1570966
aaattttga

SEQ ID NO: 175858 - DNA, 9 bp, Unknown
  misc_feature (1)..( 9): Result.005 file - promoters50/1570966
taagtttca

SEQ ID NO: 175859 - DNA, 9 bp, Unknown
  misc_feature (1)..( 9): Result.005 file - promoters50/1570966
atattctga

SEQ ID NO: 175860 - DNA, 9 bp, Unknown
  misc_feature (1)..( 9): Result.005 file - promoters50/1570966
taactttga

SEQ ID NO: 175861 - DNA, 9 bp, Unknown
  misc_feature (1)..( 9): Result.005 file - promoters50/1570966
gaagtatca

SEQ ID NO: 175862 - DNA, 10 bp, Unknown
  misc_feature (1)..( 10): Result.005 file - promoters50/1570966
aattaactta

SEQ ID NO: 175863 - DNA, 10 bp, Unknown
  misc_feature (1)..( 10): Result.005 file - promoters50/1570966
agttaacttt

SEQ ID NO: 175864 - DNA, 10 bp, Unknown
  misc_feature (1)..( 10): Result.005 file - promoters50/1570966
tattaacttt

SEQ ID NO: 175865 - DNA, 10 bp, Unknown
  misc_feature (1)..( 10): Result.005 file - promoters50/1570966
agtcaacttg

SEQ ID NO: 175866 - DNA, 10 bp, Unknown
  misc_feature (1)..( 10): Result.005 file - promoters50/1570966
cgttaatttt

SEQ ID NO: 175867 - DNA, 11 bp, Unknown
  misc_feature (1)..( 11): Result.005 file - promoters50/1570966
tattaaccttg

SEQ ID NO: 175868 - DNA, 12 bp, Unknown
  misc_feature (1)..( 12): Result.005 file - promoters50/1570966
tttattttttat

SEQ ID NO: 175869 - DNA, 12 bp, Unknown
  misc_feature (1)..( 12): Result.005 file - promoters50/1570966
aaacctttttat

SEQ ID NO: 175870 - DNA, 12 bp, Unknown
  misc_feature (1)..( 12): Result.005 file - promoters50/1570966
gttaatttttga

SEQ ID NO: 175871 - DNA, 12 bp, Unknown
  misc_feature (1)..( 12): Result.005 file - promoters50/1570966
ttctatttctat

SEQ ID NO: 175872 - DNA, 12 bp, Unknown
  misc_feature (1)..( 12): Result.005 file - promoters50/1570966
gttaactttgta

SEQ ID NO: 175873 - DNA, 12 bp, Unknown
  misc_feature (1)..( 12): Result.005 file - promoters50/1570966
attaaccttgag

SEQ ID NO: 175874 - DNA, 11 bp, Unknown
  misc_feature (1)..( 11): Result.005 file - promoters50/1570966
tatataacaca

SEQ ID NO: 175875 - DNA, 11 bp, Unknown
  misc_feature (1)..( 11): Result.005 file - promoters50/1570966
gatataataca

SEQ ID NO: 175876 - DNA, 11 bp, Unknown
  misc_feature (1)..( 11): Result.005 file - promoters50/1570966
catataaattt

SEQ ID NO: 175877 - DNA, 11 bp, Unknown
  misc_feature (1)..( 11): Result.005 file - promoters50/1570966
tatatatagaa

SEQ ID NO: 175878 - DNA, 11 bp, Unknown
  misc_feature (1)..( 11): Result.005 file - promoters50/1570966
tatatataaaa

SEQ ID NO: 175879 - DNA, 11 bp, Unknown
  misc_feature (1)..( 11): Result.005 file - promoters50/1570966
tatataagaaa

SEQ ID NO: 175880 - DNA, 11 bp, Unknown
  misc_feature (1)..( 11): Result.005 file - promoters50/1570966
tatatataacc

SEQ ID NO: 175881 - DNA, 12 bp, Unknown
  misc_feature (1)..( 12): Result.005 file - promoters50/1571014
tttttaacaaga

SEQ ID NO: 175882 - DNA, 12 bp, Unknown
  misc_feature (1)..( 12): Result.005 file - promoters50/1571014
tatttgacagac

SEQ ID NO: 175883 - DNA, 12 bp, Unknown
  misc_feature (1)..( 12): Result.005 file - promoters50/1571014
gtactaacaaga

SEQ ID NO: 175884 - DNA, 12 bp, Unknown
  misc_feature (1)..( 12): Result.005 file - promoters50/1571014
aacataactaga

SEQ ID NO: 175885 - DNA, 12 bp, Unknown
  misc_feature (1)..( 12): Result.005 file - promoters50/1571014
gttttaaggtga

SEQ ID NO: 175886 - DNA, 12 bp, Unknown
  misc_feature (1)..( 12): Result.005 file - promoters50/1571014
gttttaccacga

SEQ ID NO: 175887 - DNA, 12 bp, Unknown
  misc_feature (1)..( 12): Result.005 file - promoters50/1571014
aatttaaagaaa

SEQ ID NO: 175888 - DNA, 12 bp, Unknown
  misc_feature (1)..( 12): Result.005 file - promoters50/1571014
tgattctttgac

SEQ ID NO: 175889 - DNA, 12 bp, Unknown
  misc_feature (1)..( 12): Result.005 file - promoters50/1571014
ggatgcttttta

SEQ ID NO: 175890 - DNA, 12 bp, Unknown
  misc_feature (1)..( 12): Result.005 file - promoters50/1571014
tgattcatgcta

SEQ ID NO: 175891 - DNA, 12 bp, Unknown
  misc_feature (1)..( 12): Result.005 file - promoters50/1571014
agattctagaaa

SEQ ID NO: 175892 - DNA, 12 bp, Unknown
  misc_feature (1)..( 12): Result.005 file - promoters50/1571014
aaatgcttttta

SEQ ID NO: 175893 - DNA, 12 bp, Unknown
  misc_feature (1)..( 12): Result.005 file - promoters50/1571014
atatgatttagc

SEQ ID NO: 175894 - DNA, 12 bp, Unknown
  misc_feature (1)..( 12): Result.005 file - promoters50/1571014
ggatatagaaaa

SEQ ID NO: 175895 - DNA, 10 bp, Unknown
  misc_feature (1)..( 10): Result.005 file - promoters50/1571014
agataattaa

SEQ ID NO: 175896 - DNA, 10 bp, Unknown
  misc_feature (1)..( 10): Result.005 file - promoters50/1571014
agagaatttt

SEQ ID NO: 175897 - DNA, 10 bp, Unknown
  misc_feature (1)..( 10): Result.005 file - promoters50/1571014
agatatttaa

SEQ ID NO: 175898 - DNA, 10 bp, Unknown
  misc_feature (1)..( 10): Result.005 file - promoters50/1571014
gaataagtaa

SEQ ID NO: 175899 - DNA, 10 bp, Unknown
  misc_feature (1)..( 10): Result.005 file - promoters50/1571014
acataattca

SEQ ID NO: 175900 - DNA, 9 bp, Unknown
  misc_feature (1)..( 9): Result.005 file - promoters50/1571014
gatttttct

SEQ ID NO: 175901 - DNA, 10 bp, Unknown
  misc_feature (1)..( 10): Result.005 file - promoters50/1571014
tacaatttaa

SEQ ID NO: 175902 - DNA, 8 bp, Unknown
  misc_feature (1)..( 8): Result.005 file - promoters50/1571079
tttttcaa

SEQ ID NO: 175903 - DNA, 8 bp, Unknown
  misc_feature (1)..( 8): Result.005 file - promoters50/1571079
atttccaa

SEQ ID NO: 175904 - DNA, 8 bp, Unknown
  misc_feature (1)..( 8): Result.005 file - promoters50/1571079
tttttctt

SEQ ID NO: 175905 - DNA, 9 bp, Unknown
  misc_feature (1)..( 9): Result.005 file - promoters50/1571079
aaatttaaa

SEQ ID NO: 175906 - DNA, 9 bp, Unknown
  misc_feature (1)..( 9): Result.005 file - promoters50/1571079
agttttaaa

SEQ ID NO: 175907 - DNA, 9 bp, Unknown
  misc_feature (1)..( 9): Result.005 file - promoters50/1571079
agtattaat

SEQ ID NO: 175908 - DNA, 8 bp, Unknown
  misc_feature (1)..( 8): Result.005 file - promoters50/1571079
ccataaaa

SEQ ID NO: 175909 - DNA, 8 bp, Unknown
  misc_feature (1)..( 8): Result.005 file - promoters50/1571079
gcattaaa

SEQ ID NO: 175910 - DNA, 8 bp, Unknown
  misc_feature (1)..( 8): Result.005 file - promoters50/1571079
gcagtaat

SEQ ID NO: 175911 - DNA, 9 bp, Unknown
  misc_feature (1)..( 9): Result.005 file - promoters50/1571079
gaaaaatta

SEQ ID NO: 175912 - DNA, 9 bp, Unknown
  misc_feature (1)..( 9): Result.005 file - promoters50/1571079
taaacatta

SEQ ID NO: 175913 - DNA, 9 bp, Unknown
  misc_feature (1)..( 9): Result.005 file - promoters50/1571079
taaacacac

SEQ ID NO: 175914 - DNA, 12 bp, Unknown
  misc_feature (1)..( 12): Result.005 file - promoters50/1571422
tatatattaatg

SEQ ID NO: 175915 - DNA, 12 bp, Unknown
  misc_feature (1)..( 12): Result.005 file - promoters50/1571422
cataaattaatg

SEQ ID NO: 175916 - DNA, 12 bp, Unknown
  misc_feature (1)..( 12): Result.005 file - promoters50/1571422
tatatatgttgg

SEQ ID NO: 175917 - DNA, 12 bp, Unknown
  misc_feature (1)..( 12): Result.005 file - promoters50/1571422
tataaggttgcc

SEQ ID NO: 175918 - DNA, 12 bp, Unknown
  misc_feature (1)..( 12): Result.005 file - promoters50/1571422
tgtaaattatat

SEQ ID NO: 175919 - DNA, 12 bp, Unknown
  misc_feature (1)..( 12): Result.005 file - promoters50/1571422
agtaaataatta

SEQ ID NO: 175920 - DNA, 12 bp, Unknown
  misc_feature (1)..( 12): Result.005 file - promoters50/1571422
agtatatcacaa

SEQ ID NO: 175921 - DNA, 12 bp, Unknown
  misc_feature (1)..( 12): Result.005 file - promoters50/1571422
tctaaggtcagt

SEQ ID NO: 175922 - DNA, 13 bp, Unknown
  misc_feature (1)..( 13): Result.005 file - promoters50/1571422
tttatttgaacat

SEQ ID NO: 175923 - DNA, 13 bp, Unknown
  misc_feature (1)..( 13): Result.005 file - promoters50/1571422
tttttttgagttt

SEQ ID NO: 175924 - DNA, 13 bp, Unknown
  misc_feature (1)..( 13): Result.005 file - promoters50/1571422
ttaatttatcaat

SEQ ID NO: 175925 - DNA, 13 bp, Unknown
  misc_feature (1)..( 13): Result.005 file - promoters50/1571422
tatttttgatcat

SEQ ID NO: 175926 - DNA, 13 bp, Unknown
  misc_feature (1)..( 13): Result.005 file - promoters50/1571422
acttttcgagaac

SEQ ID NO: 175927 - DNA, 13 bp, Unknown
  misc_feature (1)..( 13): Result.005 file - promoters50/1571422
ctaattttgctaa

SEQ ID NO: 175928 - DNA, 9 bp, Unknown
  misc_feature (1)..( 9): Result.005 file - promoters50/1571422
tttatttta

SEQ ID NO: 175929 - DNA, 9 bp, Unknown
  misc_feature (1)..( 9): Result.005 file - promoters50/1571422
actattttc

SEQ ID NO: 175930 - DNA, 9 bp, Unknown
  misc_feature (1)..( 9): Result.005 file - promoters50/1571422
agtattttt

SEQ ID NO: 175931 - DNA, 9 bp, Unknown
  misc_feature (1)..( 9): Result.005 file - promoters50/1571422
attagttta

SEQ ID NO: 175932 - DNA, 9 bp, Unknown
  misc_feature (1)..( 9): Result.005 file - promoters50/1571422
actcttttt

SEQ ID NO: 175933 - DNA, 9 bp, Unknown
  misc_feature (1)..( 9): Result.005 file - promoters50/1571422
cttaattta

SEQ ID NO: 175934 - DNA, 7 bp, Unknown
  misc_feature (1)..( 7): Result.005 file - promoters50/1571916
aaagaaa

SEQ ID NO: 175935 - DNA, 7 bp, Unknown
  misc_feature (1)..( 7): Result.005 file - promoters50/1571916
aaataaa

SEQ ID NO: 175936 - DNA, 7 bp, Unknown
  misc_feature (1)..( 7): Result.005 file - promoters50/1571916
aaataac

SEQ ID NO: 175937 - DNA, 8 bp, Unknown
  misc_feature (1)..( 8): Result.005 file - promoters50/1571916
caaagaat

SEQ ID NO: 175938 - DNA, 8 bp, Unknown
  misc_feature (1)..( 8): Result.005 file - promoters50/1571916
caaagaaa

SEQ ID NO: 175939 - DNA, 8 bp, Unknown
  misc_feature (1)..( 8): Result.005 file - promoters50/1571916
gaaaaaat

SEQ ID NO: 175940 - DNA, 12 bp, Unknown
  misc_feature (1)..( 12): Result.005 file - promoters50/1571916
atatataagccg

SEQ ID NO: 175941 - DNA, 12 bp, Unknown
  misc_feature (1)..( 12): Result.005 file - promoters50/1571916
caatataaaccg

SEQ ID NO: 175942 - DNA, 12 bp, Unknown
  misc_feature (1)..( 12): Result.005 file - promoters50/1571916
ataaataatcta

SEQ ID NO: 175943 - DNA, 10 bp, Unknown
  misc_feature (1)..( 10): Result.005 file - promoters50/1572143
acatcaaagc

SEQ ID NO: 175944 - DNA, 10 bp, Unknown
  misc_feature (1)..( 10): Result.005 file - promoters50/1572143
tgatcgaagc

SEQ ID NO: 175945 - DNA, 10 bp, Unknown
  misc_feature (1)..( 10): Result.005 file - promoters50/1572143
agatggaatt

SEQ ID NO: 175946 - DNA, 10 bp, Unknown
  misc_feature (1)..( 10): Result.005 file - promoters50/1572143
agacggagga

SEQ ID NO: 175947 - DNA, 10 bp, Unknown
  misc_feature (1)..( 10): Result.005 file - promoters50/1572143
agatcgatga

SEQ ID NO: 175948 - DNA, 13 bp, Unknown
  misc_feature (1)..( 13): Result.005 file - promoters50/1572151
ttttaattaaaaa

SEQ ID NO: 175949 - DNA, 13 bp, Unknown
  misc_feature (1)..( 13): Result.005 file - promoters50/1572151
ttttaattttgtt

SEQ ID NO: 175950 - DNA, 13 bp, Unknown
  misc_feature (1)..( 13): Result.005 file - promoters50/1572151
ttttaaatcttag

SEQ ID NO: 175951 - DNA, 13 bp, Unknown
  misc_feature (1)..( 13): Result.005 file - promoters50/1572151
tattaattattat

SEQ ID NO: 175952 - DNA, 13 bp, Unknown
  misc_feature (1)..( 13): Result.005 file - promoters50/1572151
tagtaatttaaaa

SEQ ID NO: 175953 - DNA, 13 bp, Unknown
  misc_feature (1)..( 13): Result.005 file - promoters50/1572151
atataattttaga

SEQ ID NO: 175954 - DNA, 13 bp, Unknown
  misc_feature (1)..( 13): Result.005 file - promoters50/1572151
catctatttttat

SEQ ID NO: 175955 - DNA, 13 bp, Unknown
  misc_feature (1)..( 13): Result.005 file - promoters50/1572151
catttatttatat

SEQ ID NO: 175956 - DNA, 13 bp, Unknown
  misc_feature (1)..( 13): Result.005 file - promoters50/1572151
agtgtatatatat

SEQ ID NO: 175957 - DNA, 13 bp, Unknown
  misc_feature (1)..( 13): Result.005 file - promoters50/1572151
tttgtatatatat

SEQ ID NO: 175958 - DNA, 13 bp, Unknown
  misc_feature (1)..( 13): Result.005 file - promoters50/1572151
ccactatatatat

SEQ ID NO: 175959 - DNA, 13 bp, Unknown
  misc_feature (1)..( 13): Result.005 file - promoters50/1572151
gtagtatataagc

SEQ ID NO: 175960 - DNA, 10 bp, Unknown
  misc_feature (1)..( 10): Result.005 file - promoters50/1572151
aaagtttgga

SEQ ID NO: 175961 - DNA, 10 bp, Unknown
  misc_feature (1)..( 10): Result.005 file - promoters50/1572151
ttagtttgag

SEQ ID NO: 175962 - DNA, 10 bp, Unknown
  misc_feature (1)..( 10): Result.005 file - promoters50/1572151
ttaattttgt

SEQ ID NO: 175963 - DNA, 11 bp, Unknown
  misc_feature (1)..( 11): Result.005 file - promoters50/1572151
tgaatgttgat

SEQ ID NO: 175964 - DNA, 11 bp, Unknown
  misc_feature (1)..( 11): Result.005 file - promoters50/1572151
tttattttacc

SEQ ID NO: 175965 - DNA, 11 bp, Unknown
  misc_feature (1)..( 11): Result.005 file - promoters50/1572151
tatatgatgat

SEQ ID NO: 175966 - DNA, 11 bp, Unknown
  misc_feature (1)..( 11): Result.005 file - promoters50/1572151
ctaattttaat

SEQ ID NO: 175967 - DNA, 11 bp, Unknown
  misc_feature (1)..( 11): Result.005 file - promoters50/1572151
ttgaatattcc

SEQ ID NO: 175968 - DNA, 11 bp, Unknown
  misc_feature (1)..( 11): Result.005 file - promoters50/1572151
ttgaatatttt

SEQ ID NO: 175969 - DNA, 11 bp, Unknown
  misc_feature (1)..( 11): Result.005 file - promoters50/1572151
taaaattttca

SEQ ID NO: 175970 - DNA, 11 bp, Unknown
  misc_feature (1)..( 11): Result.005 file - promoters50/1572151
tataattttag

SEQ ID NO: 175971 - DNA, 11 bp, Unknown
  misc_feature (1)..( 11): Result.005 file - promoters50/1572151
ccttattttat

SEQ ID NO: 175972 - DNA, 11 bp, Unknown
  misc_feature (1)..( 11): Result.005 file - promoters50/1572151
tagtatatttc

SEQ ID NO: 175973 - DNA, 11 bp, Unknown
  misc_feature (1)..( 11): Result.005 file - promoters50/1572151
acgtacatttg

SEQ ID NO: 175974 - DNA, 11 bp, Unknown
  misc_feature (1)..( 11): Result.005 file - promoters50/1572151
ctcaattttaa

SEQ ID NO: 175975 - DNA, 15 bp, Unknown
  misc_feature (1)..( 15): Result.005 file - promoters50/1572151
agagaaagtgtctag

SEQ ID NO: 175976 - DNA, 15 bp, Unknown
  misc_feature (1)..( 15): Result.005 file - promoters50/1572151
ccaaaaaatgtacat

SEQ ID NO: 175977 - DNA, 16 bp, Unknown
  misc_feature (1)..( 16): Result.005 file - promoters50/1572151
tccaaacaatcatttt

SEQ ID NO: 175978 - DNA, 16 bp, Unknown
  misc_feature (1)..( 16): Result.005 file - promoters50/1572151
cgtttacaatttacct

SEQ ID NO: 175979 - DNA, 16 bp, Unknown
  misc_feature (1)..( 16): Result.005 file - promoters50/1572151
gtgatactatttacat

SEQ ID NO: 175980 - DNA, 16 bp, Unknown
  misc_feature (1)..( 16): Result.005 file - promoters50/1572151
tttttagacttttcat

SEQ ID NO: 175981 - DNA, 9 bp, Unknown
  misc_feature (1)..( 9): Result.005 file - promoters50/1572151
agtatataa

SEQ ID NO: 175982 - DNA, 9 bp, Unknown
  misc_feature (1)..( 9): Result.005 file - promoters50/1572151
agtatattt

SEQ ID NO: 175983 - DNA, 9 bp, Unknown
  misc_feature (1)..( 9): Result.005 file - promoters50/1572151
catatatta

SEQ ID NO: 175984 - DNA, 9 bp, Unknown
  misc_feature (1)..( 9): Result.005 file - promoters50/1572151
cgtacattt

SEQ ID NO: 175985 - DNA, 9 bp, Unknown
  misc_feature (1)..( 9): Result.005 file - promoters50/1572151
tatatatca

SEQ ID NO: 175986 - DNA, 9 bp, Unknown
  misc_feature (1)..( 9): Result.005 file - promoters50/1572151
agtatataa

SEQ ID NO: 175987 - DNA, 10 bp, Unknown
  misc_feature (1)..( 10): Result.005 file - promoters50/1572151
ataattttag

SEQ ID NO: 175988 - DNA, 10 bp, Unknown
  misc_feature (1)..( 10): Result.005 file - promoters50/1572151
aaaatattac

SEQ ID NO: 175989 - DNA, 10 bp, Unknown
  misc_feature (1)..( 10): Result.005 file - promoters50/1572151
atatttttag

SEQ ID NO: 175990 - DNA, 10 bp, Unknown
  misc_feature (1)..( 10): Result.005 file - promoters50/1572151
cttattttat

SEQ ID NO: 175991 - DNA, 10 bp, Unknown
  misc_feature (1)..( 10): Result.005 file - promoters50/1572151
aaaatattat

SEQ ID NO: 175992 - DNA, 10 bp, Unknown
  misc_feature (1)..( 10): Result.005 file - promoters50/1572151
tcaattttaa

SEQ ID NO: 175993 - DNA, 10 bp, Unknown
  misc_feature (1)..( 10): Result.005 file - promoters50/1572151
gcaatgttaa

SEQ ID NO: 175994 - DNA, 12 bp, Unknown
  misc_feature (1)..( 12): Result.005 file - promoters50/1572236
gtaaattaacca

SEQ ID NO: 175995 - DNA, 12 bp, Unknown
  misc_feature (1)..( 12): Result.005 file - promoters50/1572236
taaaattaaaaa

SEQ ID NO: 175996 - DNA, 12 bp, Unknown
  misc_feature (1)..( 12): Result.005 file - promoters50/1572236
agttattaactt

SEQ ID NO: 175997 - DNA, 12 bp, Unknown
  misc_feature (1)..( 12): Result.005 file - promoters50/1572236
taaaaataaaaa

SEQ ID NO: 175998 - DNA, 7 bp, Unknown
  misc_feature (1)..( 7): Result.005 file - promoters50/1572796
aatttca

SEQ ID NO: 175999 - DNA, 7 bp, Unknown
  misc_feature (1)..( 7): Result.005 file - promoters50/1572796
gatttca

SEQ ID NO: 176000 - DNA, 7 bp, Unknown
  misc_feature (1)..( 7): Result.005 file - promoters50/1572796
aatttcg

SEQ ID NO: 176001 - DNA, 8 bp, Unknown
  misc_feature (1)..( 8): Result.005 file - promoters50/1572796
tacagtaa

SEQ ID NO: 176002 - DNA, 8 bp, Unknown
  misc_feature (1)..( 8): Result.005 file - promoters50/1572796
tactgtat

SEQ ID NO: 176003 - DNA, 8 bp, Unknown
  misc_feature (1)..( 8): Result.005 file - promoters50/1572796
cgctgtat

SEQ ID NO: 176004 - DNA, 10 bp, Unknown
  misc_feature (1)..( 10): Result.005 file - promoters50/1573594
ttaaaaaaaa

SEQ ID NO: 176005 - DNA, 10 bp, Unknown
  misc_feature (1)..( 10): Result.005 file - promoters50/1573594
ttaaaacaag

SEQ ID NO: 176006 - DNA, 11 bp, Unknown
  misc_feature (1)..( 11): Result.005 file - promoters50/1573594
ttagaaaactc

SEQ ID NO: 176007 - DNA, 11 bp, Unknown
  misc_feature (1)..( 11): Result.005 file - promoters50/1573594
ttaaaacgtaa

SEQ ID NO: 176008 - DNA, 11 bp, Unknown
  misc_feature (1)..( 11): Result.005 file - promoters50/1573594
tgaaaatcgta

SEQ ID NO: 176009 - DNA, 11 bp, Unknown
  misc_feature (1)..( 11): Result.005 file - promoters50/1573594
ctaacacaccg

SEQ ID NO: 176010 - DNA, 7 bp, Unknown
  misc_feature (1)..( 7): Result.005 file - promoters50/1573651
ctacaaa

SEQ ID NO: 176011 - DNA, 7 bp, Unknown
  misc_feature (1)..( 7): Result.005 file - promoters50/1573651
ctacaat

SEQ ID NO: 176012 - DNA, 7 bp, Unknown
  misc_feature (1)..( 7): Result.005 file - promoters50/1573651
ctataaa

SEQ ID NO: 176013 - DNA, 7 bp, Unknown
  misc_feature (1)..( 7): Result.005 file - promoters50/1573651
ctacaaa

SEQ ID NO: 176014 - DNA, 8 bp, Unknown
  misc_feature (1)..( 8): Result.005 file - promoters50/1573651
caaactca

SEQ ID NO: 176015 - DNA, 8 bp, Unknown
  misc_feature (1)..( 8): Result.005 file - promoters50/1573651
caatctct

SEQ ID NO: 176016 - DNA, 8 bp, Unknown
  misc_feature (1)..( 8): Result.005 file - promoters50/1573651
caaactca

SEQ ID NO: 176017 - DNA, 8 bp, Unknown
  misc_feature (1)..( 8): Result.005 file - promoters50/1573651
taatctct

SEQ ID NO: 176018 - DNA, 9 bp, Unknown
  misc_feature (1)..( 9): Result.005 file - promoters50/1573651
aatcataac

SEQ ID NO: 176019 - DNA, 9 bp, Unknown
  misc_feature (1)..( 9): Result.005 file - promoters50/1573651
aatcataaa

SEQ ID NO: 176020 - DNA, 9 bp, Unknown
  misc_feature (1)..( 9): Result.005 file - promoters50/1573651
aatcataac

SEQ ID NO: 176021 - DNA, 9 bp, Unknown
  misc_feature (1)..( 9): Result.005 file - promoters50/1573651
aatcaaaaa

SEQ ID NO: 176022 - DNA, 8 bp, Unknown
  misc_feature (1)..( 8): Result.005 file - promoters50/1573713
taaacata

SEQ ID NO: 176023 - DNA, 8 bp, Unknown
  misc_feature (1)..( 8): Result.005 file - promoters50/1573713
gaaatata

SEQ ID NO: 176024 - DNA, 8 bp, Unknown
  misc_feature (1)..( 8): Result.005 file - promoters50/1573713
taaaaata

SEQ ID NO: 176025 - DNA, 8 bp, Unknown
  misc_feature (1)..( 8): Result.005 file - promoters50/1573713
tatatata

SEQ ID NO: 176026 - DNA, 10 bp, Unknown
  misc_feature (1)..( 10): Result.005 file - promoters50/1573713
ataaacgaca

SEQ ID NO: 176027 - DNA, 10 bp, Unknown
  misc_feature (1)..( 10): Result.005 file - promoters50/1573713
ataagcgaca

SEQ ID NO: 176028 - DNA, 10 bp, Unknown
  misc_feature (1)..( 10): Result.005 file - promoters50/1573713
ccaaacgatt

SEQ ID NO: 176029 - DNA, 10 bp, Unknown
  misc_feature (1)..( 10): Result.005 file - promoters50/1573713
taaaacaatt

SEQ ID NO: 176030 - DNA, 9 bp, Unknown
  misc_feature (1)..( 9): Result.005 file - promoters50/1573713
tttatatga

SEQ ID NO: 176031 - DNA, 9 bp, Unknown
  misc_feature (1)..( 9): Result.005 file - promoters50/1573713
tttatttga

SEQ ID NO: 176032 - DNA, 9 bp, Unknown
  misc_feature (1)..( 9): Result.005 file - promoters50/1573713
tttatatta

SEQ ID NO: 176033 - DNA, 7 bp, Unknown
  misc_feature (1)..( 7): Result.005 file - promoters50/1573713
taatctc

SEQ ID NO: 176034 - DNA, 7 bp, Unknown
  misc_feature (1)..( 7): Result.005 file - promoters50/1573713
taatctt

SEQ ID NO: 176035 - DNA, 7 bp, Unknown
  misc_feature (1)..( 7): Result.005 file - promoters50/1573713
aaatctc

SEQ ID NO: 176036 - DNA, 10 bp, Unknown
  misc_feature (1)..( 10): Result.005 file - promoters50/1573713
attaataatt

SEQ ID NO: 176037 - DNA, 10 bp, Unknown
  misc_feature (1)..( 10): Result.005 file - promoters50/1573713
attagtaatt

SEQ ID NO: 176038 - DNA, 10 bp, Unknown
  misc_feature (1)..( 10): Result.005 file - promoters50/1573713
gttattaagg

SEQ ID NO: 176039 - DNA, 10 bp, Unknown
  misc_feature (1)..( 10): Result.005 file - promoters50/1573713
tagagttatt

SEQ ID NO: 176040 - DNA, 14 bp, Unknown
  misc_feature (1)..( 14): Result.005 file - promoters50/1573980
aaaccaatagaaaa

SEQ ID NO: 176041 - DNA, 14 bp, Unknown
  misc_feature (1)..( 14): Result.005 file - promoters50/1573980
gttaaaatataaac

SEQ ID NO: 176042 - DNA, 15 bp, Unknown
  misc_feature (1)..( 15): Result.005 file - promoters50/1573980
tgtaaaattatatct

SEQ ID NO: 176043 - DNA, 15 bp, Unknown
  misc_feature (1)..( 15): Result.005 file - promoters50/1573980
tttaaagttaatcac

SEQ ID NO: 176044 - DNA, 15 bp, Unknown
  misc_feature (1)..( 15): Result.005 file - promoters50/1573980
cagtagcatacaaac

SEQ ID NO: 176045 - DNA, 15 bp, Unknown
  misc_feature (1)..( 15): Result.005 file - promoters50/1573980
ttttcctttacaaaa

SEQ ID NO: 176046 - DNA, 11 bp, Unknown
  misc_feature (1)..( 11): Result.005 file - promoters50/1573980
taattttgtta

SEQ ID NO: 176047 - DNA, 11 bp, Unknown
  misc_feature (1)..( 11): Result.005 file - promoters50/1573980
gaaatttgttc

SEQ ID NO: 176048 - DNA, 11 bp, Unknown
  misc_feature (1)..( 11): Result.005 file - promoters50/1573980
tctttttcttc

SEQ ID NO: 176049 - DNA, 11 bp, Unknown
  misc_feature (1)..( 11): Result.005 file - promoters50/1573980
aaaattagttt

SEQ ID NO: 176050 - DNA, 11 bp, Unknown
  misc_feature (1)..( 11): Result.005 file - promoters50/1573980
aaagttatgcg

SEQ ID NO: 176051 - DNA, 11 bp, Unknown
  misc_feature (1)..( 11): Result.005 file - promoters50/1573980
ttatttatttt

SEQ ID NO: 176052 - DNA, 11 bp, Unknown
  misc_feature (1)..( 11): Result.005 file - promoters50/1573980
aaagttatgaa

SEQ ID NO: 176053 - DNA, 10 bp, Unknown
  misc_feature (1)..( 10): Result.005 file - promoters50/1573980
ggaaatgact

SEQ ID NO: 176054 - DNA, 10 bp, Unknown
  misc_feature (1)..( 10): Result.005 file - promoters50/1573980
ttttatgact

SEQ ID NO: 176055 - DNA, 10 bp, Unknown
  misc_feature (1)..( 10): Result.005 file - promoters50/1573980
ttaaaagact

SEQ ID NO: 176056 - DNA, 10 bp, Unknown
  misc_feature (1)..( 10): Result.005 file - promoters50/1573980
ccaaaagaga

SEQ ID NO: 176057 - DNA, 10 bp, Unknown
  misc_feature (1)..( 10): Result.005 file - promoters50/1573980
ggaaatgact

SEQ ID NO: 176058 - DNA, 10 bp, Unknown
  misc_feature (1)..( 10): Result.005 file - promoters50/1573980
ggagatgtgc

SEQ ID NO: 176059 - DNA, 9 bp, Unknown
  misc_feature (1)..( 9): Result.005 file - promoters50/1573982
atatttttt

SEQ ID NO: 176060 - DNA, 9 bp, Unknown
  misc_feature (1)..( 9): Result.005 file - promoters50/1573982
atatctttt

SEQ ID NO: 176061 - DNA, 9 bp, Unknown
  misc_feature (1)..( 9): Result.005 file - promoters50/1573982
aagtttttg

SEQ ID NO: 176062 - DNA, 8 bp, Unknown
  misc_feature (1)..( 8): Result.005 file - promoters50/1573982
gattcatt

SEQ ID NO: 176063 - DNA, 8 bp, Unknown
  misc_feature (1)..( 8): Result.005 file - promoters50/1573982
aattgatt

SEQ ID NO: 176064 - DNA, 8 bp, Unknown
  misc_feature (1)..( 8): Result.005 file - promoters50/1573982
aattgatc

SEQ ID NO: 176065 - DNA, 9 bp, Unknown
  misc_feature (1)..( 9): Result.005 file - promoters50/1574021
gttaaataa

SEQ ID NO: 176066 - DNA, 9 bp, Unknown
  misc_feature (1)..( 9): Result.005 file - promoters50/1574021
cttagataa

SEQ ID NO: 176067 - DNA, 9 bp, Unknown
  misc_feature (1)..( 9): Result.005 file - promoters50/1574021
tataaatac

SEQ ID NO: 176068 - DNA, 9 bp, Unknown
  misc_feature (1)..( 9): Result.005 file - promoters50/1574021
gtttaatat

SEQ ID NO: 176069 - DNA, 13 bp, Unknown
  misc_feature (1)..( 13): Result.005 file - promoters50/1574021
tgttatctattgt

SEQ ID NO: 176070 - DNA, 13 bp, Unknown
  misc_feature (1)..( 13): Result.005 file - promoters50/1574021
acctatgtatcct

SEQ ID NO: 176071 - DNA, 13 bp, Unknown
  misc_feature (1)..( 13): Result.005 file - promoters50/1574021
tgttatcaattgt

SEQ ID NO: 176072 - DNA, 13 bp, Unknown
  misc_feature (1)..( 13): Result.005 file - promoters50/1574021
aattataaataat

SEQ ID NO: 176073 - DNA, 7 bp, Unknown
  misc_feature (1)..( 7): Result.005 file - promoters50/1574029
atgagga

SEQ ID NO: 176074 - DNA, 7 bp, Unknown
  misc_feature (1)..( 7): Result.005 file - promoters50/1574029
atgtgga

SEQ ID NO: 176075 - DNA, 7 bp, Unknown
  misc_feature (1)..( 7): Result.005 file - promoters50/1574029
atgtggt

SEQ ID NO: 176076 - DNA, 7 bp, Unknown
  misc_feature (1)..( 7): Result.005 file - promoters50/1574044
taataca

SEQ ID NO: 176077 - DNA, 7 bp, Unknown
  misc_feature (1)..( 7): Result.005 file - promoters50/1574044
taaaaca

SEQ ID NO: 176078 - DNA, 7 bp, Unknown
  misc_feature (1)..( 7): Result.005 file - promoters50/1574044
taagaca

SEQ ID NO: 176079 - DNA, 10 bp, Unknown
  misc_feature (1)..( 10): Result.005 file - promoters50/1574044
ttaattaaaa

SEQ ID NO: 176080 - DNA, 10 bp, Unknown
  misc_feature (1)..( 10): Result.005 file - promoters50/1574044
ataaataaaa

SEQ ID NO: 176081 - DNA, 10 bp, Unknown
  misc_feature (1)..( 10): Result.005 file - promoters50/1574044
ttaactaaac

SEQ ID NO: 176082 - DNA, 10 bp, Unknown
  misc_feature (1)..( 10): Result.005 file - promoters50/1574044
atacatagca

SEQ ID NO: 176083 - DNA, 12 bp, Unknown
  misc_feature (1)..( 12): Result.005 file - promoters50/1574044
tgtctaaaacaa

SEQ ID NO: 176084 - DNA, 12 bp, Unknown
  misc_feature (1)..( 12): Result.005 file - promoters50/1574044
tgtgtaaaagtt

SEQ ID NO: 176085 - DNA, 12 bp, Unknown
  misc_feature (1)..( 12): Result.005 file - promoters50/1574044
ccactaaaccaa

SEQ ID NO: 176086 - DNA, 11 bp, Unknown
  misc_feature (1)..( 11): Result.005 file - promoters50/1574044
atagtaaataa

SEQ ID NO: 176087 - DNA, 11 bp, Unknown
  misc_feature (1)..( 11): Result.005 file - promoters50/1574044
atagtcaataa

SEQ ID NO: 176088 - DNA, 11 bp, Unknown
  misc_feature (1)..( 11): Result.005 file - promoters50/1574044
ataataattgg

SEQ ID NO: 176089 - DNA, 7 bp, Unknown
  misc_feature (1)..( 7): Result.005 file - promoters50/1574059
ctaaaac

SEQ ID NO: 176090 - DNA, 7 bp, Unknown
  misc_feature (1)..( 7): Result.005 file - promoters50/1574059
gtaaaac

SEQ ID NO: 176091 - DNA, 7 bp, Unknown
  misc_feature (1)..( 7): Result.005 file - promoters50/1574059
gtaaaac

SEQ ID NO: 176092 - DNA, 11 bp, Unknown
  misc_feature (1)..( 11): Result.005 file - promoters50/1580171
aaaaaattcag

SEQ ID NO: 176093 - DNA, 11 bp, Unknown
  misc_feature (1)..( 11): Result.005 file - promoters50/1580171
gtaaaattccc

SEQ ID NO: 176094 - DNA, 11 bp, Unknown
  misc_feature (1)..( 11): Result.005 file - promoters50/1580171
tttaaattctt

SEQ ID NO: 176095 - DNA, 11 bp, Unknown
  misc_feature (1)..( 11): Result.005 file - promoters50/1580171
gacaaataaat

SEQ ID NO: 176096 - DNA, 11 bp, Unknown
  misc_feature (1)..( 11): Result.005 file - promoters50/1580171
cttatattttt

SEQ ID NO: 176097 - DNA, 11 bp, Unknown
  misc_feature (1)..( 11): Result.005 file - promoters50/1580171
tttgaattgtg

SEQ ID NO: 176098 - DNA, 10 bp, Unknown
  misc_feature (1)..( 10): Result.005 file - promoters50/1580171
aatttgtaaa

SEQ ID NO: 176099 - DNA, 10 bp, Unknown
  misc_feature (1)..( 10): Result.005 file - promoters50/1580171
tttttataat

SEQ ID NO: 176100 - DNA, 10 bp, Unknown
  misc_feature (1)..( 10): Result.005 file - promoters50/1580171
aatatgttaa

SEQ ID NO: 176101 - DNA, 11 bp, Unknown
  misc_feature (1)..( 11): Result.005 file - promoters50/1580171
cgtttgatata

SEQ ID NO: 176102 - DNA, 11 bp, Unknown
  misc_feature (1)..( 11): Result.005 file - promoters50/1580171
acattgatata

SEQ ID NO: 176103 - DNA, 11 bp, Unknown
  misc_feature (1)..( 11): Result.005 file - promoters50/1580171
acagtgatcac

SEQ ID NO: 176104 - DNA, 12 bp, Unknown
  misc_feature (1)..( 12): Result.005 file - promoters50/1580171
ttgggttgaaca

SEQ ID NO: 176105 - DNA, 12 bp, Unknown
  misc_feature (1)..( 12): Result.005 file - promoters50/1580171
ttggattgatga

SEQ ID NO: 176106 - DNA, 12 bp, Unknown
  misc_feature (1)..( 12): Result.005 file - promoters50/1580171
ctctgttaaacc

SEQ ID NO: 176107 - DNA, 12 bp, Unknown
  misc_feature (1)..( 12): Result.005 file - promoters50/1580171
ctttattgaatt

SEQ ID NO: 176108 - DNA, 12 bp, Unknown
  misc_feature (1)..( 12): Result.005 file - promoters50/1580171
agctgtcaaaac

SEQ ID NO: 176109 - DNA, 12 bp, Unknown
  misc_feature (1)..( 12): Result.005 file - promoters50/1580171
ttttgtgaaaaa

SEQ ID NO: 176110 - DNA, 10 bp, Unknown
  misc_feature (1)..( 10): Result.005 file - promoters50/1580263
ctaattttag

SEQ ID NO: 176111 - DNA, 10 bp, Unknown
  misc_feature (1)..( 10): Result.005 file - promoters50/1580263
ctaattaaat

SEQ ID NO: 176112 - DNA, 10 bp, Unknown
  misc_feature (1)..( 10): Result.005 file - promoters50/1580263
ttaatgaaat

SEQ ID NO: 176113 - DNA, 15 bp, Unknown
  misc_feature (1)..( 15): Result.005 file - promoters50/1580298
tgaaaacatttttag

SEQ ID NO: 176114 - DNA, 15 bp, Unknown
  misc_feature (1)..( 15): Result.005 file - promoters50/1580298
tgtaaacattacata

SEQ ID NO: 176115 - DNA, 16 bp, Unknown
  misc_feature (1)..( 16): Result.005 file - promoters50/1580298
atgaaatcatgtattt

SEQ ID NO: 176116 - DNA, 16 bp, Unknown
  misc_feature (1)..( 16): Result.005 file - promoters50/1580298
tcgaaatcatcacccc

SEQ ID NO: 176117 - DNA, 16 bp, Unknown
  misc_feature (1)..( 16): Result.005 file - promoters50/1580298
cacatgacattacata

SEQ ID NO: 176118 - DNA, 16 bp, Unknown
  misc_feature (1)..( 16): Result.005 file - promoters50/1580298
aaaaggttattccatg

SEQ ID NO: 176119 - DNA, 8 bp, Unknown
  misc_feature (1)..( 8): Result.005 file - promoters50/1580481
tttataca

SEQ ID NO: 176120 - DNA, 8 bp, Unknown
  misc_feature (1)..( 8): Result.005 file - promoters50/1580481
tttataaa

SEQ ID NO: 176121 - DNA, 8 bp, Unknown
  misc_feature (1)..( 8): Result.005 file - promoters50/1580481
attatact

SEQ ID NO: 176122 - DNA, 8 bp, Unknown
  misc_feature (1)..( 8): Result.005 file - promoters50/1580481
tttgtaaa

SEQ ID NO: 176123 - DNA, 8 bp, Unknown
  misc_feature (1)..( 8): Result.005 file - promoters50/1580481
tttgtatt

SEQ ID NO: 176124 - DNA, 10 bp, Unknown
  misc_feature (1)..( 10): Result.005 file - promoters50/1580481
tttctttaac

SEQ ID NO: 176125 - DNA, 10 bp, Unknown
  misc_feature (1)..( 10): Result.005 file - promoters50/1580481
tttctttatt

SEQ ID NO: 176126 - DNA, 10 bp, Unknown
  misc_feature (1)..( 10): Result.005 file - promoters50/1580481
cttcatttgt

SEQ ID NO: 176127 - DNA, 10 bp, Unknown
  misc_feature (1)..( 10): Result.005 file - promoters50/1580481
tttcatttgt

SEQ ID NO: 176128 - DNA, 10 bp, Unknown
  misc_feature (1)..( 10): Result.005 file - promoters50/1580481
ttttatctca

SEQ ID NO: 176129 - DNA, 11 bp, Unknown
  misc_feature (1)..( 11): Result.005 file - promoters50/1580481
ttcatttgtta

SEQ ID NO: 176130 - DNA, 11 bp, Unknown
  misc_feature (1)..( 11): Result.005 file - promoters50/1580481
tagctttttta

SEQ ID NO: 176131 - DNA, 11 bp, Unknown
  misc_feature (1)..( 11): Result.005 file - promoters50/1580481
ttcatttgtaa

SEQ ID NO: 176132 - DNA, 11 bp, Unknown
  misc_feature (1)..( 11): Result.005 file - promoters50/1580481
tcttgttgtta

SEQ ID NO: 176133 - DNA, 11 bp, Unknown
  misc_feature (1)..( 11): Result.005 file - promoters50/1580481
cttgtttgtat

SEQ ID NO: 176134 - DNA, 19 bp, Unknown
  misc_feature (1)..( 19): Result.005 file - promoters50/1580500
tgtaaagcatataaattgt

SEQ ID NO: 176135 - DNA, 19 bp, Unknown
  misc_feature (1)..( 19): Result.005 file - promoters50/1580500
agaaaatcattaacaaata

SEQ ID NO: 176136 - DNA, 19 bp, Unknown
  misc_feature (1)..( 19): Result.005 file - promoters50/1580500
tttaaatcatatagaatgg

SEQ ID NO: 176137 - DNA, 19 bp, Unknown
  misc_feature (1)..( 19): Result.005 file - promoters50/1580500
gtttaatccttaaccaata

SEQ ID NO: 176138 - DNA, 19 bp, Unknown
  misc_feature (1)..( 19): Result.005 file - promoters50/1580500
ttatcttcatataggaatt

SEQ ID NO: 176139 - DNA, 19 bp, Unknown
  misc_feature (1)..( 19): Result.005 file - promoters50/1580500
aacaaattttttttttaga

SEQ ID NO: 176140 - DNA, 14 bp, Unknown
  misc_feature (1)..( 14): Result.005 file - promoters50/1580500
taaagcatataaat

SEQ ID NO: 176141 - DNA, 14 bp, Unknown
  misc_feature (1)..( 14): Result.005 file - promoters50/1580500
gtcattatagaaaa

SEQ ID NO: 176142 - DNA, 14 bp, Unknown
  misc_feature (1)..( 14): Result.005 file - promoters50/1580500
atcttcatatagga

SEQ ID NO: 176143 - DNA, 14 bp, Unknown
  misc_feature (1)..( 14): Result.005 file - promoters50/1580500
agaagataataaat

SEQ ID NO: 176144 - DNA, 14 bp, Unknown
  misc_feature (1)..( 14): Result.005 file - promoters50/1580500
tattttttataaag

SEQ ID NO: 176145 - DNA, 14 bp, Unknown
  misc_feature (1)..( 14): Result.005 file - promoters50/1580500
taaatcatatagaa

SEQ ID NO: 176146 - DNA, 14 bp, Unknown
  misc_feature (1)..( 14): Result.005 file - promoters50/1580500
tttgacatttagtt

SEQ ID NO: 176147 - DNA, 11 bp, Unknown
  misc_feature (1)..( 11): Result.005 file - promoters50/1580511
tttcatttaat

SEQ ID NO: 176148 - DNA, 11 bp, Unknown
  misc_feature (1)..( 11): Result.005 file - promoters50/1580511
tttgatttgat

SEQ ID NO: 176149 - DNA, 11 bp, Unknown
  misc_feature (1)..( 11): Result.005 file - promoters50/1580511
tttgattaaaa

SEQ ID NO: 176150 - DNA, 11 bp, Unknown
  misc_feature (1)..( 11): Result.005 file - promoters50/1580511
tttaattgaca

SEQ ID NO: 176151 - DNA, 11 bp, Unknown
  misc_feature (1)..( 11): Result.005 file - promoters50/1580511
tttcattgaaa

SEQ ID NO: 176152 - DNA, 11 bp, Unknown
  misc_feature (1)..( 11): Result.005 file - promoters50/1580511
tattattcaaa

SEQ ID NO: 176153 - DNA, 15 bp, Unknown
  misc_feature (1)..( 15): Result.005 file - promoters50/1580511
gcaatttgtcttatg

SEQ ID NO: 176154 - DNA, 15 bp, Unknown
  misc_feature (1)..( 15): Result.005 file - promoters50/1580511
ttgatttgtatttgt

SEQ ID NO: 176155 - DNA, 15 bp, Unknown
  misc_feature (1)..( 15): Result.005 file - promoters50/1580511
gcaatttgtcttatg

SEQ ID NO: 176156 - DNA, 15 bp, Unknown
  misc_feature (1)..( 15): Result.005 file - promoters50/1580511
ttgttttgtttgtgg

SEQ ID NO: 176157 - DNA, 15 bp, Unknown
  misc_feature (1)..( 15): Result.005 file - promoters50/1580511
cacttttgtttttgg

SEQ ID NO: 176158 - DNA, 15 bp, Unknown
  misc_feature (1)..( 15): Result.005 file - promoters50/1580511
cttccatgtttttgc

SEQ ID NO: 176159 - DNA, 9 bp, Unknown
  misc_feature (1)..( 9): Result.005 file - promoters50/1580787
gatccttct

SEQ ID NO: 176160 - DNA, 9 bp, Unknown
  misc_feature (1)..( 9): Result.005 file - promoters50/1580787
catccatct

SEQ ID NO: 176161 - DNA, 9 bp, Unknown
  misc_feature (1)..( 9): Result.005 file - promoters50/1580787
catccacat

SEQ ID NO: 176162 - DNA, 9 bp, Unknown
  misc_feature (1)..( 9): Result.005 file - promoters50/1580870
tttccaaac

SEQ ID NO: 176163 - DNA, 9 bp, Unknown
  misc_feature (1)..( 9): Result.005 file - promoters50/1580870
tttctaaaa

SEQ ID NO: 176164 - DNA, 9 bp, Unknown
  misc_feature (1)..( 9): Result.005 file - promoters50/1580870
attctaact

SEQ ID NO: 176165 - DNA, 10 bp, Unknown
  misc_feature (1)..( 10): Result.005 file - promoters50/1580870
ggcctacaat

SEQ ID NO: 176166 - DNA, 9 bp, Unknown
  misc_feature (1)..( 9): Result.005 file - promoters50/1580870
aatgtctat

SEQ ID NO: 176167 - DNA, 9 bp, Unknown
  misc_feature (1)..( 9): Result.005 file - promoters50/1580870
cttgtatat

SEQ ID NO: 176168 - DNA, 9 bp, Unknown
  misc_feature (1)..( 9): Result.005 file - promoters50/1580870
aatatctga

SEQ ID NO: 176169 - DNA, 9 bp, Unknown
  misc_feature (1)..( 9): Result.005 file - promoters50/1580870
gaagtatat

SEQ ID NO: 176170 - DNA, 12 bp, Unknown
  misc_feature (1)..( 12): Result.005 file - promoters50/1580932
aattaaaataaa

SEQ ID NO: 176171 - DNA, 12 bp, Unknown
  misc_feature (1)..( 12): Result.005 file - promoters50/1580932
gatttaaattat

SEQ ID NO: 176172 - DNA, 12 bp, Unknown
  misc_feature (1)..( 12): Result.005 file - promoters50/1580932
aatgaaatttcc

SEQ ID NO: 176173 - DNA, 12 bp, Unknown
  misc_feature (1)..( 12): Result.005 file - promoters50/1580932
ggataaaaaaaa

SEQ ID NO: 176174 - DNA, 12 bp, Unknown
  misc_feature (1)..( 12): Result.005 file - promoters50/1580932
aatgaaatcatg

SEQ ID NO: 176175 - DNA, 12 bp, Unknown
  misc_feature (1)..( 12): Result.005 file - promoters50/1580932
tctgagatcggc

SEQ ID NO: 176176 - DNA, 12 bp, Unknown
  misc_feature (1)..( 12): Result.005 file - promoters50/1580932
tatgaaacgaag

SEQ ID NO: 176177 - DNA, 9 bp, Unknown
  misc_feature (1)..( 9): Result.005 file - promoters50/1580932
gaactaata

SEQ ID NO: 176178 - DNA, 9 bp, Unknown
  misc_feature (1)..( 9): Result.005 file - promoters50/1580932
aaactaatc

SEQ ID NO: 176179 - DNA, 9 bp, Unknown
  misc_feature (1)..( 9): Result.005 file - promoters50/1580932
aaacaaatt

SEQ ID NO: 176180 - DNA, 9 bp, Unknown
  misc_feature (1)..( 9): Result.005 file - promoters50/1580932
ccacttata

SEQ ID NO: 176181 - DNA, 9 bp, Unknown
  misc_feature (1)..( 9): Result.005 file - promoters50/1580932
gaaccaata

SEQ ID NO: 176182 - DNA, 9 bp, Unknown
  misc_feature (1)..( 9): Result.005 file - promoters50/1580932
caaccaact

SEQ ID NO: 176183 - DNA, 9 bp, Unknown
  misc_feature (1)..( 9): Result.005 file - promoters50/1580983
tatttttta

SEQ ID NO: 176184 - DNA, 9 bp, Unknown
  misc_feature (1)..( 9): Result.005 file - promoters50/1580983
aatttttgt

SEQ ID NO: 176185 - DNA, 9 bp, Unknown
  misc_feature (1)..( 9): Result.005 file - promoters50/1580983
tgtttttta

SEQ ID NO: 176186 - DNA, 9 bp, Unknown
  misc_feature (1)..( 9): Result.005 file - promoters50/1580983
gattttttt

SEQ ID NO: 176187 - DNA, 9 bp, Unknown
  misc_feature (1)..( 9): Result.005 file - promoters50/1580983
aattttaat

SEQ ID NO: 176188 - DNA, 12 bp, Unknown
  misc_feature (1)..( 12): Result.005 file - promoters50/1580983
tattcgacagaa

SEQ ID NO: 176189 - DNA, 12 bp, Unknown
  misc_feature (1)..( 12): Result.005 file - promoters50/1580983
ttttcaacattt

SEQ ID NO: 176190 - DNA, 12 bp, Unknown
  misc_feature (1)..( 12): Result.005 file - promoters50/1580983
tttttaactttt

SEQ ID NO: 176191 - DNA, 12 bp, Unknown
  misc_feature (1)..( 12): Result.005 file - promoters50/1580983
ctcacaacatgt

SEQ ID NO: 176192 - DNA, 12 bp, Unknown
  misc_feature (1)..( 12): Result.005 file - promoters50/1580983
aagtcaacagct

SEQ ID NO: 176193 - DNA, 14 bp, Unknown
  misc_feature (1)..( 14): Result.005 file - promoters50/1581038
ccaagaatattagt

SEQ ID NO: 176194 - DNA, 14 bp, Unknown
  misc_feature (1)..( 14): Result.005 file - promoters50/1581038
attcatatattagt

SEQ ID NO: 176195 - DNA, 14 bp, Unknown
  misc_feature (1)..( 14): Result.005 file - promoters50/1581038
atataaatatttaa

SEQ ID NO: 176196 - DNA, 14 bp, Unknown
  misc_feature (1)..( 14): Result.005 file - promoters50/1581038
tttaaaatctttca

SEQ ID NO: 176197 - DNA, 14 bp, Unknown
  misc_feature (1)..( 14): Result.005 file - promoters50/1581038
tctaaaatcttcca

SEQ ID NO: 176198 - DNA, 14 bp, Unknown
  misc_feature (1)..( 14): Result.005 file - promoters50/1581038
tttataatcatgct

SEQ ID NO: 176199 - DNA, 11 bp, Unknown
  misc_feature (1)..( 11): Result.005 file - promoters50/1581038
aataaataact

SEQ ID NO: 176200 - DNA, 11 bp, Unknown
  misc_feature (1)..( 11): Result.005 file - promoters50/1581038
tttaattaaaa

SEQ ID NO: 176201 - DNA, 11 bp, Unknown
  misc_feature (1)..( 11): Result.005 file - promoters50/1581038
aatatatatat

SEQ ID NO: 176202 - DNA, 11 bp, Unknown
  misc_feature (1)..( 11): Result.005 file - promoters50/1581038
tatatatatgt

SEQ ID NO: 176203 - DNA, 11 bp, Unknown
  misc_feature (1)..( 11): Result.005 file - promoters50/1581038
cctaattaacc

SEQ ID NO: 176204 - DNA, 11 bp, Unknown
  misc_feature (1)..( 11): Result.005 file - promoters50/1581038
gaactttaatt

SEQ ID NO: 176205 - DNA, 11 bp, Unknown
  misc_feature (1)..( 11): Result.005 file - promoters50/1581038
agaaattataa

SEQ ID NO: 176206 - DNA, 11 bp, Unknown
  misc_feature (1)..( 11): Result.005 file - promoters50/1581038
agaaattctat

SEQ ID NO: 176207 - DNA, 10 bp, Unknown
  misc_feature (1)..( 10): Result.005 file - promoters50/1581038
tatatataat

SEQ ID NO: 176208 - DNA, 10 bp, Unknown
  misc_feature (1)..( 10): Result.005 file - promoters50/1581038
tatttataac

SEQ ID NO: 176209 - DNA, 10 bp, Unknown
  misc_feature (1)..( 10): Result.005 file - promoters50/1581038
tatataaatc

SEQ ID NO: 176210 - DNA, 10 bp, Unknown
  misc_feature (1)..( 10): Result.005 file - promoters50/1581038
tataaataga

SEQ ID NO: 176211 - DNA, 10 bp, Unknown
  misc_feature (1)..( 10): Result.005 file - promoters50/1581038
gatataatac

SEQ ID NO: 176212 - DNA, 10 bp, Unknown
  misc_feature (1)..( 10): Result.005 file - promoters50/1581038
tgtttaaaac

SEQ ID NO: 176213 - DNA, 12 bp, Unknown
  misc_feature (1)..( 12): Result.005 file - promoters50/1581038
tatgtatttttc

SEQ ID NO: 176214 - DNA, 12 bp, Unknown
  misc_feature (1)..( 12): Result.005 file - promoters50/1581038
gttccatttttg

SEQ ID NO: 176215 - DNA, 12 bp, Unknown
  misc_feature (1)..( 12): Result.005 file - promoters50/1581038
cttatatttttc

SEQ ID NO: 176216 - DNA, 12 bp, Unknown
  misc_feature (1)..( 12): Result.005 file - promoters50/1581038
gtggtaatttga

SEQ ID NO: 176217 - DNA, 12 bp, Unknown
  misc_feature (1)..( 12): Result.005 file - promoters50/1581038
tagacattttat

SEQ ID NO: 176218 - DNA, 12 bp, Unknown
  misc_feature (1)..( 12): Result.005 file - promoters50/1581038
gtgttaattgtc

SEQ ID NO: 176219 - DNA, 9 bp, Unknown
  misc_feature (1)..( 9): Result.005 file - promoters50/1581165
taaaatacc

SEQ ID NO: 176220 - DNA, 9 bp, Unknown
  misc_feature (1)..( 9): Result.005 file - promoters50/1581165
aaaaataag

SEQ ID NO: 176221 - DNA, 9 bp, Unknown
  misc_feature (1)..( 9): Result.005 file - promoters50/1581165
taaaattag

SEQ ID NO: 176222 - DNA, 9 bp, Unknown
  misc_feature (1)..( 9): Result.005 file - promoters50/1581165
taaaataat

SEQ ID NO: 176223 - DNA, 9 bp, Unknown
  misc_feature (1)..( 9): Result.005 file - promoters50/1581165
acaaataaa

SEQ ID NO: 176224 - DNA, 9 bp, Unknown
  misc_feature (1)..( 9): Result.005 file - promoters50/1581165
ataaataag

SEQ ID NO: 176225 - DNA, 7 bp, Unknown
  misc_feature (1)..( 7): Result.005 file - promoters50/1581165
gaaaaaa

SEQ ID NO: 176226 - DNA, 7 bp, Unknown
  misc_feature (1)..( 7): Result.005 file - promoters50/1581165
caaaaaa

SEQ ID NO: 176227 - DNA, 8 bp, Unknown
  misc_feature (1)..( 8): Result.005 file - promoters50/1581165
taaataaa

SEQ ID NO: 176228 - DNA, 8 bp, Unknown
  misc_feature (1)..( 8): Result.005 file - promoters50/1581165
taaaaacg

SEQ ID NO: 176229 - DNA, 8 bp, Unknown
  misc_feature (1)..( 8): Result.005 file - promoters50/1581165
caaataaa

SEQ ID NO: 176230 - DNA, 8 bp, Unknown
  misc_feature (1)..( 8): Result.005 file - promoters50/1581165
caaacaaa

SEQ ID NO: 176231 - DNA, 8 bp, Unknown
  misc_feature (1)..( 8): Result.005 file - promoters50/1581165
aaattaaa

SEQ ID NO: 176232 - DNA, 12 bp, Unknown
  misc_feature (1)..( 12): Result.005 file - promoters50/1581165
tctatctctaag

SEQ ID NO: 176233 - DNA, 12 bp, Unknown
  misc_feature (1)..( 12): Result.005 file - promoters50/1581165
tctttctttttt

SEQ ID NO: 176234 - DNA, 12 bp, Unknown
  misc_feature (1)..( 12): Result.005 file - promoters50/1581165
tatatctccaag

SEQ ID NO: 176235 - DNA, 12 bp, Unknown
  misc_feature (1)..( 12): Result.005 file - promoters50/1581165
tttatttcggta

SEQ ID NO: 176236 - DNA, 12 bp, Unknown
  misc_feature (1)..( 12): Result.005 file - promoters50/1581165
catatttcagag

SEQ ID NO: 176237 - DNA, 12 bp, Unknown
  misc_feature (1)..( 12): Result.005 file - promoters50/1581165
tttatttactct

SEQ ID NO: 176238 - DNA, 12 bp, Unknown
  misc_feature (1)..( 12): Result.005 file - promoters50/1581165
cttcttttgtag

SEQ ID NO: 176239 - DNA, 9 bp, Unknown
  misc_feature (1)..( 9): Result.005 file - promoters50/1581165
aaaaaaaaa

SEQ ID NO: 176240 - DNA, 9 bp, Unknown
  misc_feature (1)..( 9): Result.005 file - promoters50/1581165
aaataaatg

SEQ ID NO: 176241 - DNA, 9 bp, Unknown
  misc_feature (1)..( 9): Result.005 file - promoters50/1581165
aaataaacc

SEQ ID NO: 176242 - DNA, 9 bp, Unknown
  misc_feature (1)..( 9): Result.005 file - promoters50/1581165
atatacatg

SEQ ID NO: 176243 - DNA, 9 bp, Unknown
  misc_feature (1)..( 9): Result.005 file - promoters50/1581165
acatatatg

SEQ ID NO: 176244 - DNA, 9 bp, Unknown
  misc_feature (1)..( 9): Result.005 file - promoters50/1581165
aaacacata

SEQ ID NO: 176245 - DNA, 9 bp, Unknown
  misc_feature (1)..( 9): Result.005 file - promoters50/1581165
aaataaggt

SEQ ID NO: 176246 - DNA, 8 bp, Unknown
  misc_feature (1)..( 8): Result.005 file - promoters50/1581223
tttaaatt

SEQ ID NO: 176247 - DNA, 8 bp, Unknown
  misc_feature (1)..( 8): Result.005 file - promoters50/1581223
tttgaatt

SEQ ID NO: 176248 - DNA, 9 bp, Unknown
  misc_feature (1)..( 9): Result.005 file - promoters50/1581223
tttcgaaat

SEQ ID NO: 176249 - DNA, 10 bp, Unknown
  misc_feature (1)..( 10): Result.005 file - promoters50/1581223
tcctagataa

SEQ ID NO: 176250 - DNA, 10 bp, Unknown
  misc_feature (1)..( 10): Result.005 file - promoters50/1581223
atctaaataa

SEQ ID NO: 176251 - DNA, 10 bp, Unknown
  misc_feature (1)..( 10): Result.005 file - promoters50/1581223
atcgaaatgt

SEQ ID NO: 176252 - DNA, 10 bp, Unknown
  misc_feature (1)..( 10): Result.005 file - promoters50/1581454
aagtaaaaaa

SEQ ID NO: 176253 - DNA, 10 bp, Unknown
  misc_feature (1)..( 10): Result.005 file - promoters50/1581454
tgtgaaaaaa

SEQ ID NO: 176254 - DNA, 10 bp, Unknown
  misc_feature (1)..( 10): Result.005 file - promoters50/1581454
acataaaaag

SEQ ID NO: 176255 - DNA, 10 bp, Unknown
  misc_feature (1)..( 10): Result.005 file - promoters50/1581454
cgtgagaaat

SEQ ID NO: 176256 - DNA, 10 bp, Unknown
  misc_feature (1)..( 10): Result.005 file - promoters50/1581454
cattaaacta

SEQ ID NO: 176257 - DNA, 12 bp, Unknown
  misc_feature (1)..( 12): Result.005 file - promoters50/1581987
atgtgtttctca

SEQ ID NO: 176258 - DNA, 12 bp, Unknown
  misc_feature (1)..( 12): Result.005 file - promoters50/1581987
ttatgtttctcg

SEQ ID NO: 176259 - DNA, 12 bp, Unknown
  misc_feature (1)..( 12): Result.005 file - promoters50/1581987
atgggtttgaaa

SEQ ID NO: 176260 - DNA, 12 bp, Unknown
  misc_feature (1)..( 12): Result.005 file - promoters50/1581987
gggcttttctcg

SEQ ID NO: 176261 - DNA, 12 bp, Unknown
  misc_feature (1)..( 12): Result.005 file - promoters50/1581987
tagtgattccac

SEQ ID NO: 176262 - DNA, 12 bp, Unknown
  misc_feature (1)..( 12): Result.005 file - promoters50/1581987
gattgattctca

SEQ ID NO: 176263 - DNA, 10 bp, Unknown
  misc_feature (1)..( 10): Result.005 file - promoters50/1582293
acatacatta

SEQ ID NO: 176264 - DNA, 10 bp, Unknown
  misc_feature (1)..( 10): Result.005 file - promoters50/1582293
atataaatta

SEQ ID NO: 176265 - DNA, 10 bp, Unknown
  misc_feature (1)..( 10): Result.005 file - promoters50/1582293
atatgaatca

SEQ ID NO: 176266 - DNA, 11 bp, Unknown
  misc_feature (1)..( 11): Result.005 file - promoters50/1582293
aaattacttac

SEQ ID NO: 176267 - DNA, 11 bp, Unknown
  misc_feature (1)..( 11): Result.005 file - promoters50/1582293
atattactata

SEQ ID NO: 176268 - DNA, 11 bp, Unknown
  misc_feature (1)..( 11): Result.005 file - promoters50/1582293
atagtacaata

SEQ ID NO: 176269 - DNA, 9 bp, Unknown
  misc_feature (1)..( 9): Result.005 file - promoters50/1582293
actaatgat

SEQ ID NO: 176270 - DNA, 9 bp, Unknown
  misc_feature (1)..( 9): Result.005 file - promoters50/1582293
tataatgat

SEQ ID NO: 176271 - DNA, 9 bp, Unknown
  misc_feature (1)..( 9): Result.005 file - promoters50/1582293
aataattac

SEQ ID NO: 176272 - DNA, 11 bp, Unknown
  misc_feature (1)..( 11): Result.005 file - promoters50/1582322
cacctttctct

SEQ ID NO: 176273 - DNA, 11 bp, Unknown
  misc_feature (1)..( 11): Result.005 file - promoters50/1582322
aatttttttct

SEQ ID NO: 176274 - DNA, 11 bp, Unknown
  misc_feature (1)..( 11): Result.005 file - promoters50/1582322
tctatttatct

SEQ ID NO: 176275 - DNA, 12 bp, Unknown
  misc_feature (1)..( 12): Result.005 file - promoters50/1582322
atgattgttttg

SEQ ID NO: 176276 - DNA, 10 bp, Unknown
  misc_feature (1)..( 10): Result.005 file - promoters50/1582322
aatatttata

SEQ ID NO: 176277 - DNA, 10 bp, Unknown
  misc_feature (1)..( 10): Result.005 file - promoters50/1582322
aatatatatg

SEQ ID NO: 176278 - DNA, 10 bp, Unknown
  misc_feature (1)..( 10): Result.005 file - promoters50/1582322
ggtatttgtt

SEQ ID NO: 176279 - DNA, 7 bp, Unknown
  misc_feature (1)..( 7): Result.005 file - promoters50/1582322
atttttt

SEQ ID NO: 176280 - DNA, 7 bp, Unknown
  misc_feature (1)..( 7): Result.005 file - promoters50/1582322
atttttc

SEQ ID NO: 176281 - DNA, 8 bp, Unknown
  misc_feature (1)..( 8): Result.005 file - promoters50/1582322
attgtttt

SEQ ID NO: 176282 - DNA, 10 bp, Unknown
  misc_feature (1)..( 10): Result.005 file - promoters50/1582322
ggtgtttgca

SEQ ID NO: 176283 - DNA, 10 bp, Unknown
  misc_feature (1)..( 10): Result.005 file - promoters50/1582322
ggtatttgtt

SEQ ID NO: 176284 - DNA, 10 bp, Unknown
  misc_feature (1)..( 10): Result.005 file - promoters50/1582322
tatatatgtt

SEQ ID NO: 176285 - DNA, 10 bp, Unknown
  misc_feature (1)..( 10): Result.005 file - promoters50/1582322
ttataattat

SEQ ID NO: 176286 - DNA, 10 bp, Unknown
  misc_feature (1)..( 10): Result.005 file - promoters50/1582322
ttacaataat

SEQ ID NO: 176287 - DNA, 10 bp, Unknown
  misc_feature (1)..( 10): Result.005 file - promoters50/1582322
aaataattat

SEQ ID NO: 176288 - DNA, 12 bp, Unknown
  misc_feature (1)..( 12): Result.005 file - promoters50/1582322
ccggaattttaa

SEQ ID NO: 176289 - DNA, 12 bp, Unknown
  misc_feature (1)..( 12): Result.005 file - promoters50/1582322
ataaaattataa

SEQ ID NO: 176290 - DNA, 12 bp, Unknown
  misc_feature (1)..( 12): Result.005 file - promoters50/1582322
atacaatgatat

SEQ ID NO: 176291 - DNA, 10 bp, Unknown
  misc_feature (1)..( 10): Result.005 file - promoters50/1582322
cttgaatcaa

SEQ ID NO: 176292 - DNA, 10 bp, Unknown
  misc_feature (1)..( 10): Result.005 file - promoters50/1582322
cttaaatatt

SEQ ID NO: 176293 - DNA, 10 bp, Unknown
  misc_feature (1)..( 10): Result.005 file - promoters50/1582322
aataaaaatt

SEQ ID NO: 176294 - DNA, 10 bp, Unknown
  misc_feature (1)..( 10): Result.005 file - promoters50/1582322
tcaatatttt

SEQ ID NO: 176295 - DNA, 10 bp, Unknown
  misc_feature (1)..( 10): Result.005 file - promoters50/1582322
taaatatttt

SEQ ID NO: 176296 - DNA, 10 bp, Unknown
  misc_feature (1)..( 10): Result.005 file - promoters50/1582322
taaaaattat

SEQ ID NO: 176297 - DNA, 12 bp, Unknown
  misc_feature (1)..( 12): Result.005 file - promoters50/1582339
cgaaagattaag

SEQ ID NO: 176298 - DNA, 12 bp, Unknown
  misc_feature (1)..( 12): Result.005 file - promoters50/1582339
agaaatattatt

SEQ ID NO: 176299 - DNA, 12 bp, Unknown
  misc_feature (1)..( 12): Result.005 file - promoters50/1582339
gaaaatgttatt

SEQ ID NO: 176300 - DNA, 12 bp, Unknown
  misc_feature (1)..( 12): Result.005 file - promoters50/1582339
atatatatgatt

SEQ ID NO: 176301 - DNA, 12 bp, Unknown
  misc_feature (1)..( 12): Result.005 file - promoters50/1582339
agaaatctcgac

SEQ ID NO: 176302 - DNA, 12 bp, Unknown
  misc_feature (1)..( 12): Result.005 file - promoters50/1582339
tatctaatatat

SEQ ID NO: 176303 - DNA, 12 bp, Unknown
  misc_feature (1)..( 12): Result.005 file - promoters50/1582339
cttttaatatta

SEQ ID NO: 176304 - DNA, 12 bp, Unknown
  misc_feature (1)..( 12): Result.005 file - promoters50/1582339
tatctaatttta

SEQ ID NO: 176305 - DNA, 12 bp, Unknown
  misc_feature (1)..( 12): Result.005 file - promoters50/1582339
ctttttataaat

SEQ ID NO: 176306 - DNA, 15 bp, Unknown
  misc_feature (1)..( 15): Result.005 file - promoters50/1582339
aaaaaaaactatcta

SEQ ID NO: 176307 - DNA, 15 bp, Unknown
  misc_feature (1)..( 15): Result.005 file - promoters50/1582339
attataaaatattat

SEQ ID NO: 176308 - DNA, 15 bp, Unknown
  misc_feature (1)..( 15): Result.005 file - promoters50/1582339
aaataaaacttctca

SEQ ID NO: 176309 - DNA, 15 bp, Unknown
  misc_feature (1)..( 15): Result.005 file - promoters50/1582339
ttttataaataaact

SEQ ID NO: 176310 - DNA, 9 bp, Unknown
  misc_feature (1)..( 9): Result.005 file - promoters50/1582349
atgttttta

SEQ ID NO: 176311 - DNA, 9 bp, Unknown
  misc_feature (1)..( 9): Result.005 file - promoters50/1582349
atgtttgct

SEQ ID NO: 176312 - DNA, 9 bp, Unknown
  misc_feature (1)..( 9): Result.005 file - promoters50/1582349
ttgttgtta

SEQ ID NO: 176313 - DNA, 10 bp, Unknown
  misc_feature (1)..( 10): Result.005 file - promoters50/1582349
ggtattattt

SEQ ID NO: 176314 - DNA, 10 bp, Unknown
  misc_feature (1)..( 10): Result.005 file - promoters50/1582349
tcaatttttt

SEQ ID NO: 176315 - DNA, 10 bp, Unknown
  misc_feature (1)..( 10): Result.005 file - promoters50/1582349
tcaagttttt

SEQ ID NO: 176316 - DNA, 11 bp, Unknown
  misc_feature (1)..( 11): Result.005 file - promoters50/1582551
aaaaaaaaaag

SEQ ID NO: 176317 - DNA, 11 bp, Unknown
  misc_feature (1)..( 11): Result.005 file - promoters50/1582551
aaaaagaaaag

SEQ ID NO: 176318 - DNA, 11 bp, Unknown
  misc_feature (1)..( 11): Result.005 file - promoters50/1582551
ttaaagtaaag

SEQ ID NO: 176319 - DNA, 9 bp, Unknown
  misc_feature (1)..( 9): Result.005 file - promoters50/1582551
aacacaaaa

SEQ ID NO: 176320 - DNA, 9 bp, Unknown
  misc_feature (1)..( 9): Result.005 file - promoters50/1582551
cccactaaa

SEQ ID NO: 176321 - DNA, 9 bp, Unknown
  misc_feature (1)..( 9): Result.005 file - promoters50/1582551
cccactaga

SEQ ID NO: 176322 - DNA, 9 bp, Unknown
  misc_feature (1)..( 9): Result.005 file - promoters50/1582576
aaagtaaaa

SEQ ID NO: 176323 - DNA, 9 bp, Unknown
  misc_feature (1)..( 9): Result.005 file - promoters50/1582576
agagtgaaa

SEQ ID NO: 176324 - DNA, 9 bp, Unknown
  misc_feature (1)..( 9): Result.005 file - promoters50/1582576
agagagaaa

SEQ ID NO: 176325 - DNA, 12 bp, Unknown
  misc_feature (1)..( 12): Result.005 file - promoters50/1582576
aaattaaaatat

SEQ ID NO: 176326 - DNA, 12 bp, Unknown
  misc_feature (1)..( 12): Result.005 file - promoters50/1582576
taattaatgggc

SEQ ID NO: 176327 - DNA, 12 bp, Unknown
  misc_feature (1)..( 12): Result.005 file - promoters50/1582576
aaaataatatat

SEQ ID NO: 176328 - DNA, 12 bp, Unknown
  misc_feature (1)..( 12): Result.005 file - promoters50/1582576
gaaaaaatgtat

SEQ ID NO: 176329 - DNA, 8 bp, Unknown
  misc_feature (1)..( 8): Result.005 file - promoters50/1582576
aataaaag

SEQ ID NO: 176330 - DNA, 8 bp, Unknown
  misc_feature (1)..( 8): Result.005 file - promoters50/1582576
aataaaaa

SEQ ID NO: 176331 - DNA, 8 bp, Unknown
  misc_feature (1)..( 8): Result.005 file - promoters50/1582576
aataaata

SEQ ID NO: 176332 - DNA, 8 bp, Unknown
  misc_feature (1)..( 8): Result.005 file - promoters50/1582576
aatagata

SEQ ID NO: 176333 - DNA, 7 bp, Unknown
  misc_feature (1)..( 7): Result.005 file - promoters50/1582576
aaagact

SEQ ID NO: 176334 - DNA, 7 bp, Unknown
  misc_feature (1)..( 7): Result.005 file - promoters50/1582576
aaaaact

SEQ ID NO: 176335 - DNA, 8 bp, Unknown
  misc_feature (1)..( 8): Result.005 file - promoters50/1582576
aaatgaca

SEQ ID NO: 176336 - DNA, 8 bp, Unknown
  misc_feature (1)..( 8): Result.005 file - promoters50/1582576
aaaataaa

SEQ ID NO: 176337 - DNA, 8 bp, Unknown
  misc_feature (1)..( 8): Result.005 file - promoters50/1582576
aaagtaaa

SEQ ID NO: 176338 - DNA, 8 bp, Unknown
  misc_feature (1)..( 8): Result.005 file - promoters50/1582576
aaaacaaa

SEQ ID NO: 176339 - DNA, 7 bp, Unknown
  misc_feature (1)..( 7): Result.005 file - promoters50/1582576
tatttag

SEQ ID NO: 176340 - DNA, 7 bp, Unknown
  misc_feature (1)..( 7): Result.005 file - promoters50/1582576
tatgtag

SEQ ID NO: 176341 - DNA, 7 bp, Unknown
  misc_feature (1)..( 7): Result.005 file - promoters50/1582576
tatttaa

SEQ ID NO: 176342 - DNA, 11 bp, Unknown
  misc_feature (1)..( 11): Result.005 file - promoters50/1582576
ttaaaatatat

SEQ ID NO: 176343 - DNA, 11 bp, Unknown
  misc_feature (1)..( 11): Result.005 file - promoters50/1582576
aaaaaatgtat

SEQ ID NO: 176344 - DNA, 11 bp, Unknown
  misc_feature (1)..( 11): Result.005 file - promoters50/1582576
ctaaaataata

SEQ ID NO: 176345 - DNA, 11 bp, Unknown
  misc_feature (1)..( 11): Result.005 file - promoters50/1582576
ctacaattttg

SEQ ID NO: 176346 - DNA, 8 bp, Unknown
  misc_feature (1)..( 8): Result.005 file - promoters50/1582576
gaataaat

SEQ ID NO: 176347 - DNA, 8 bp, Unknown
  misc_feature (1)..( 8): Result.005 file - promoters50/1582576
taattaat

SEQ ID NO: 176348 - DNA, 8 bp, Unknown
  misc_feature (1)..( 8): Result.005 file - promoters50/1582576
taactaat

SEQ ID NO: 176349 - DNA, 7 bp, Unknown
  misc_feature (1)..( 7): Result.005 file - promoters50/1582576
ttaaaat

SEQ ID NO: 176350 - DNA, 7 bp, Unknown
  misc_feature (1)..( 7): Result.005 file - promoters50/1582576
ctaaaat

SEQ ID NO: 176351 - DNA, 7 bp, Unknown
  misc_feature (1)..( 7): Result.005 file - promoters50/1582576
ctacaat

SEQ ID NO: 176352 - DNA, 7 bp, Unknown
  misc_feature (1)..( 7): Result.005 file - promoters50/1582576
taataat

SEQ ID NO: 176353 - DNA, 7 bp, Unknown
  misc_feature (1)..( 7): Result.005 file - promoters50/1582576
aaataat

SEQ ID NO: 176354 - DNA, 7 bp, Unknown
  misc_feature (1)..( 7): Result.005 file - promoters50/1582576
aaataac

SEQ ID NO: 176355 - DNA, 8 bp, Unknown
  misc_feature (1)..( 8): Result.005 file - promoters50/1582654
aaacaaag

SEQ ID NO: 176356 - DNA, 8 bp, Unknown
  misc_feature (1)..( 8): Result.005 file - promoters50/1582654
aaagaaag

SEQ ID NO: 176357 - DNA, 9 bp, Unknown
  misc_feature (1)..( 9): Result.005 file - promoters50/1582654
aaatcaacg

SEQ ID NO: 176358 - DNA, 8 bp, Unknown
  misc_feature (1)..( 8): Result.005 file - promoters50/1582654
aaaacaat

SEQ ID NO: 176359 - DNA, 8 bp, Unknown
  misc_feature (1)..( 8): Result.005 file - promoters50/1582654
taaacaaa

SEQ ID NO: 176360 - DNA, 8 bp, Unknown
  misc_feature (1)..( 8): Result.005 file - promoters50/1582654
aaaaaaaa

SEQ ID NO: 176361 - DNA, 8 bp, Unknown
  misc_feature (1)..( 8): Result.005 file - promoters50/1582654
taatcaat

SEQ ID NO: 176362 - DNA, 10 bp, Unknown
  misc_feature (1)..( 10): Result.005 file - promoters50/1582654
taaaaagaat

SEQ ID NO: 176363 - DNA, 10 bp, Unknown
  misc_feature (1)..( 10): Result.005 file - promoters50/1582654
aaaaaaaaat

SEQ ID NO: 176364 - DNA, 10 bp, Unknown
  misc_feature (1)..( 10): Result.005 file - promoters50/1582654
caaataaagg

SEQ ID NO: 176365 - DNA, 8 bp, Unknown
  misc_feature (1)..( 8): Result.005 file - promoters50/1582654
tgttttgt

SEQ ID NO: 176366 - DNA, 8 bp, Unknown
  misc_feature (1)..( 8): Result.005 file - promoters50/1582654
tgtttttg

SEQ ID NO: 176367 - DNA, 9 bp, Unknown
  misc_feature (1)..( 9): Result.005 file - promoters50/1582654
tgttcttgg

SEQ ID NO: 176368 - DNA, 11 bp, Unknown
  misc_feature (1)..( 11): Result.005 file - promoters50/1582658
cagcccagtca

SEQ ID NO: 176369 - DNA, 11 bp, Unknown
  misc_feature (1)..( 11): Result.005 file - promoters50/1582658
aataccaatca

SEQ ID NO: 176370 - DNA, 11 bp, Unknown
  misc_feature (1)..( 11): Result.005 file - promoters50/1582658
aatacaaatct

SEQ ID NO: 176371 - DNA, 11 bp, Unknown
  misc_feature (1)..( 11): Result.005 file - promoters50/1582658
gctacaaataa

SEQ ID NO: 176372 - DNA, 11 bp, Unknown
  misc_feature (1)..( 11): Result.005 file - promoters50/1582658
aaaacacataa

SEQ ID NO: 176373 - DNA, 11 bp, Unknown
  misc_feature (1)..( 11): Result.005 file - promoters50/1582658
tatacaaaaga

SEQ ID NO: 176374 - DNA, 8 bp, Unknown
  misc_feature (1)..( 8): Result.005 file - promoters50/1582786
ttcttttt

SEQ ID NO: 176375 - DNA, 8 bp, Unknown
  misc_feature (1)..( 8): Result.005 file - promoters50/1582786
atctattt

SEQ ID NO: 176376 - DNA, 8 bp, Unknown
  misc_feature (1)..( 8): Result.005 file - promoters50/1582786
ttcttttg

SEQ ID NO: 176377 - DNA, 8 bp, Unknown
  misc_feature (1)..( 8): Result.005 file - promoters50/1582786
ttcttttg

SEQ ID NO: 176378 - DNA, 8 bp, Unknown
  misc_feature (1)..( 8): Result.005 file - promoters50/1582786
gttttttg

SEQ ID NO: 176379 - DNA, 8 bp, Unknown
  misc_feature (1)..( 8): Result.005 file - promoters50/1583044
ttgtgtat

SEQ ID NO: 176380 - DNA, 8 bp, Unknown
  misc_feature (1)..( 8): Result.005 file - promoters50/1583044
ttgtatat

SEQ ID NO: 176381 - DNA, 8 bp, Unknown
  misc_feature (1)..( 8): Result.005 file - promoters50/1583044
aagtatat

SEQ ID NO: 176382 - DNA, 8 bp, Unknown
  misc_feature (1)..( 8): Result.005 file - promoters50/1583044
aaggatat

SEQ ID NO: 176383 - DNA, 9 bp, Unknown
  misc_feature (1)..( 9): Result.005 file - promoters50/1583350
tatagtttt

SEQ ID NO: 176384 - DNA, 9 bp, Unknown
  misc_feature (1)..( 9): Result.005 file - promoters50/1583350
catattttt

SEQ ID NO: 176385 - DNA, 9 bp, Unknown
  misc_feature (1)..( 9): Result.005 file - promoters50/1583350
tatatttaa

SEQ ID NO: 176386 - DNA, 13 bp, Unknown
  misc_feature (1)..( 13): Result.005 file - promoters50/1595585
attaaataattaa

SEQ ID NO: 176387 - DNA, 13 bp, Unknown
  misc_feature (1)..( 13): Result.005 file - promoters50/1595585
cccaaaaaatctg

SEQ ID NO: 176388 - DNA, 13 bp, Unknown
  misc_feature (1)..( 13): Result.005 file - promoters50/1595585
taaaaataattag

SEQ ID NO: 176389 - DNA, 13 bp, Unknown
  misc_feature (1)..( 13): Result.005 file - promoters50/1595585
aaaacaaaatcat

SEQ ID NO: 176390 - DNA, 13 bp, Unknown
  misc_feature (1)..( 13): Result.005 file - promoters50/1595585
taagaaaaaccat

SEQ ID NO: 176391 - DNA, 13 bp, Unknown
  misc_feature (1)..( 13): Result.005 file - promoters50/1595585
aaaaaaaaattat

SEQ ID NO: 176392 - DNA, 14 bp, Unknown
  misc_feature (1)..( 14): Result.005 file - promoters50/1595585
tgtgaaaaacgtgt

SEQ ID NO: 176393 - DNA, 14 bp, Unknown
  misc_feature (1)..( 14): Result.005 file - promoters50/1595585
taagaaaaaccata

SEQ ID NO: 176394 - DNA, 14 bp, Unknown
  misc_feature (1)..( 14): Result.005 file - promoters50/1595585
aaacaaaatcatta

SEQ ID NO: 176395 - DNA, 14 bp, Unknown
  misc_feature (1)..( 14): Result.005 file - promoters50/1595585
aaagataaattgtc

SEQ ID NO: 176396 - DNA, 14 bp, Unknown
  misc_feature (1)..( 14): Result.005 file - promoters50/1595585
gtaaaaaaaaaaat

SEQ ID NO: 176397 - DNA, 14 bp, Unknown
  misc_feature (1)..( 14): Result.005 file - promoters50/1595585
aaataaaaattggg

SEQ ID NO: 176398 - DNA, 9 bp, Unknown
  misc_feature (1)..( 9): Result.005 file - promoters50/1595635
acctgaatc

SEQ ID NO: 176399 - DNA, 9 bp, Unknown
  misc_feature (1)..( 9): Result.005 file - promoters50/1595635
accagaaaa

SEQ ID NO: 176400 - DNA, 9 bp, Unknown
  misc_feature (1)..( 9): Result.005 file - promoters50/1595635
tgctggatc

SEQ ID NO: 176401 - DNA, 7 bp, Unknown
  misc_feature (1)..( 7): Result.005 file - promoters50/1595635
caaactg

SEQ ID NO: 176402 - DNA, 7 bp, Unknown
  misc_feature (1)..( 7): Result.005 file - promoters50/1595635
aaaactg

SEQ ID NO: 176403 - DNA, 8 bp, Unknown
  misc_feature (1)..( 8): Result.005 file - promoters50/1595635
taacactc

SEQ ID NO: 176404 - DNA, 8 bp, Unknown
  misc_feature (1)..( 8): Result.005 file - promoters50/1595635
aaacatat

SEQ ID NO: 176405 - DNA, 8 bp, Unknown
  misc_feature (1)..( 8): Result.005 file - promoters50/1595635
aaatatag

SEQ ID NO: 176406 - DNA, 8 bp, Unknown
  misc_feature (1)..( 8): Result.005 file - promoters50/1595635
taacttat

SEQ ID NO: 176407 - DNA, 7 bp, Unknown
  misc_feature (1)..( 7): Result.005 file - promoters50/1595663
atctaac

SEQ ID NO: 176408 - DNA, 7 bp, Unknown
  misc_feature (1)..( 7): Result.005 file - promoters50/1595663
ttctaac

SEQ ID NO: 176409 - DNA, 7 bp, Unknown
  misc_feature (1)..( 7): Result.005 file - promoters50/1595663
ttctaaa

SEQ ID NO: 176410 - DNA, 7 bp, Unknown
  misc_feature (1)..( 7): Result.005 file - promoters50/1595663
tttcagt

SEQ ID NO: 176411 - DNA, 7 bp, Unknown
  misc_feature (1)..( 7): Result.005 file - promoters50/1595663
cttcagt

SEQ ID NO: 176412 - DNA, 7 bp, Unknown
  misc_feature (1)..( 7): Result.005 file - promoters50/1595663
cttcaga

SEQ ID NO: 176413 - DNA, 7 bp, Unknown
  misc_feature (1)..( 7): Result.005 file - promoters50/1595663
caatatg

SEQ ID NO: 176414 - DNA, 7 bp, Unknown
  misc_feature (1)..( 7): Result.005 file - promoters50/1595663
caatatt

SEQ ID NO: 176415 - DNA, 7 bp, Unknown
  misc_feature (1)..( 7): Result.005 file - promoters50/1595663
caaaatt

SEQ ID NO: 176416 - DNA, 9 bp, Unknown
  misc_feature (1)..( 9): Result.005 file - promoters50/1595663
caaacttat

SEQ ID NO: 176417 - DNA, 9 bp, Unknown
  misc_feature (1)..( 9): Result.005 file - promoters50/1595663
caaaattat

SEQ ID NO: 176418 - DNA, 9 bp, Unknown
  misc_feature (1)..( 9): Result.005 file - promoters50/1595663
caatatttg

SEQ ID NO: 176419 - DNA, 7 bp, Unknown
  misc_feature (1)..( 7): Result.005 file - promoters50/1595663
tttaatt

SEQ ID NO: 176420 - DNA, 7 bp, Unknown
  misc_feature (1)..( 7): Result.005 file - promoters50/1595663
tttgatt

SEQ ID NO: 176421 - DNA, 7 bp, Unknown
  misc_feature (1)..( 7): Result.005 file - promoters50/1595663
attaatt

SEQ ID NO: 176422 - DNA, 9 bp, Unknown
  misc_feature (1)..( 9): Result.005 file - promoters50/1595674
caaacataa

SEQ ID NO: 176423 - DNA, 9 bp, Unknown
  misc_feature (1)..( 9): Result.005 file - promoters50/1595674
taaagataa

SEQ ID NO: 176424 - DNA, 9 bp, Unknown
  misc_feature (1)..( 9): Result.005 file - promoters50/1595674
taaagacta

SEQ ID NO: 176425 - DNA, 9 bp, Unknown
  misc_feature (1)..( 9): Result.005 file - promoters50/1595678
aatgatttt

SEQ ID NO: 176426 - DNA, 9 bp, Unknown
  misc_feature (1)..( 9): Result.005 file - promoters50/1595678
tctgagttt

SEQ ID NO: 176427 - DNA, 9 bp, Unknown
  misc_feature (1)..( 9): Result.005 file - promoters50/1595678
aattattgc

SEQ ID NO: 176428 - DNA, 8 bp, Unknown
  misc_feature (1)..( 8): Result.005 file - promoters50/1595678
ctacaaaa

SEQ ID NO: 176429 - DNA, 8 bp, Unknown
  misc_feature (1)..( 8): Result.005 file - promoters50/1595678
tcacaaaa

SEQ ID NO: 176430 - DNA, 8 bp, Unknown
  misc_feature (1)..( 8): Result.005 file - promoters50/1595678
acacaaat

SEQ ID NO: 176431 - DNA, 8 bp, Unknown
  misc_feature (1)..( 8): Result.005 file - promoters50/1595678
ttataaat

SEQ ID NO: 176432 - DNA, 8 bp, Unknown
  misc_feature (1)..( 8): Result.005 file - promoters50/1595678
ttacaaaa

SEQ ID NO: 176433 - DNA, 9 bp, Unknown
  misc_feature (1)..( 9): Result.005 file - promoters50/1595678
ttacacaaa

SEQ ID NO: 176434 - DNA, 9 bp, Unknown
  misc_feature (1)..( 9): Result.005 file - promoters50/1595687
ttttgaaat

SEQ ID NO: 176435 - DNA, 9 bp, Unknown
  misc_feature (1)..( 9): Result.005 file - promoters50/1595687
tttggaaaa

SEQ ID NO: 176436 - DNA, 9 bp, Unknown
  misc_feature (1)..( 9): Result.005 file - promoters50/1595687
aaatgaaat

SEQ ID NO: 176437 - DNA, 9 bp, Unknown
  misc_feature (1)..( 9): Result.005 file - promoters50/1595687
caaggaaac

SEQ ID NO: 176438 - DNA, 9 bp, Unknown
  misc_feature (1)..( 9): Result.005 file - promoters50/1595687
aaagtaaag

SEQ ID NO: 176439 - DNA, 9 bp, Unknown
  misc_feature (1)..( 9): Result.005 file - promoters50/1595687
aaagaaaag

SEQ ID NO: 176440 - DNA, 10 bp, Unknown
  misc_feature (1)..( 10): Result.005 file - promoters50/1595703
aataatacaa

SEQ ID NO: 176441 - DNA, 10 bp, Unknown
  misc_feature (1)..( 10): Result.005 file - promoters50/1595703
cttaattcaa

SEQ ID NO: 176442 - DNA, 10 bp, Unknown
  misc_feature (1)..( 10): Result.005 file - promoters50/1595703
ctttatttta

SEQ ID NO: 176443 - DNA, 11 bp, Unknown
  misc_feature (1)..( 11): Result.005 file - promoters50/1595707
aataccaatca

SEQ ID NO: 176444 - DNA, 11 bp, Unknown
  misc_feature (1)..( 11): Result.005 file - promoters50/1595707
aatacaaatct

SEQ ID NO: 176445 - DNA, 11 bp, Unknown
  misc_feature (1)..( 11): Result.005 file - promoters50/1595707
cagcccagtca

SEQ ID NO: 176446 - DNA, 11 bp, Unknown
  misc_feature (1)..( 11): Result.005 file - promoters50/1595707
aatacaaatct

SEQ ID NO: 176447 - DNA, 11 bp, Unknown
  misc_feature (1)..( 11): Result.005 file - promoters50/1595707
tttactaatag

SEQ ID NO: 176448 - DNA, 11 bp, Unknown
  misc_feature (1)..( 11): Result.005 file - promoters50/1595707
tttactaatag

SEQ ID NO: 176449 - DNA, 11 bp, Unknown
  misc_feature (1)..( 11): Result.005 file - promoters50/1595707
gttattaactt

SEQ ID NO: 176450 - DNA, 12 bp, Unknown
  misc_feature (1)..( 12): Result.005 file - promoters50/1595707
attttcatttga

SEQ ID NO: 176451 - DNA, 12 bp, Unknown
  misc_feature (1)..( 12): Result.005 file - promoters50/1595707
actttcttttta

SEQ ID NO: 176452 - DNA, 12 bp, Unknown
  misc_feature (1)..( 12): Result.005 file - promoters50/1595707
attttaattttg

SEQ ID NO: 176453 - DNA, 12 bp, Unknown
  misc_feature (1)..( 12): Result.005 file - promoters50/1595707
tgattctttgac

SEQ ID NO: 176454 - DNA, 12 bp, Unknown
  misc_feature (1)..( 12): Result.005 file - promoters50/1595707
ctattctaaccc

SEQ ID NO: 176455 - DNA, 12 bp, Unknown
  misc_feature (1)..( 12): Result.005 file - promoters50/1595707
tatataatttta

SEQ ID NO: 176456 - DNA, 11 bp, Unknown
  misc_feature (1)..( 11): Result.005 file - promoters50/1595741
aatttcaataa

SEQ ID NO: 176457 - DNA, 11 bp, Unknown
  misc_feature (1)..( 11): Result.005 file - promoters50/1595741
aatttcatttg

SEQ ID NO: 176458 - DNA, 11 bp, Unknown
  misc_feature (1)..( 11): Result.005 file - promoters50/1595741
ttttttaataa

SEQ ID NO: 176459 - DNA, 11 bp, Unknown
  misc_feature (1)..( 11): Result.005 file - promoters50/1595741
tgtctaaaaag

SEQ ID NO: 176460 - DNA, 11 bp, Unknown
  misc_feature (1)..( 11): Result.005 file - promoters50/1595741
tattttattgt

SEQ ID NO: 176461 - DNA, 11 bp, Unknown
  misc_feature (1)..( 11): Result.005 file - promoters50/1595741
gctttcgtttt

SEQ ID NO: 176462 - DNA, 11 bp, Unknown
  misc_feature (1)..( 11): Result.005 file - promoters50/1595741
gtatttttgat

SEQ ID NO: 176463 - DNA, 11 bp, Unknown
  misc_feature (1)..( 11): Result.005 file - promoters50/1595741
ctattttccta

SEQ ID NO: 176464 - DNA, 11 bp, Unknown
  misc_feature (1)..( 11): Result.005 file - promoters50/1595741
ctattttattg

SEQ ID NO: 176465 - DNA, 11 bp, Unknown
  misc_feature (1)..( 11): Result.005 file - promoters50/1595741
ctatttgtaat

SEQ ID NO: 176466 - DNA, 11 bp, Unknown
  misc_feature (1)..( 11): Result.005 file - promoters50/1595741
taatttcattt

SEQ ID NO: 176467 - DNA, 11 bp, Unknown
  misc_feature (1)..( 11): Result.005 file - promoters50/1595741
agctttcgttt

SEQ ID NO: 176468 - DNA, 7 bp, Unknown
  misc_feature (1)..( 7): Result.005 file - promoters50/1595752
ataattt

SEQ ID NO: 176469 - DNA, 7 bp, Unknown
  misc_feature (1)..( 7): Result.005 file - promoters50/1595752
atatttt

SEQ ID NO: 176470 - DNA, 7 bp, Unknown
  misc_feature (1)..( 7): Result.005 file - promoters50/1595752
atatttc

SEQ ID NO: 176471 - DNA, 8 bp, Unknown
  misc_feature (1)..( 8): Result.005 file - promoters50/1595752
aaatctat

SEQ ID NO: 176472 - DNA, 8 bp, Unknown
  misc_feature (1)..( 8): Result.005 file - promoters50/1595752
aaatctaa

SEQ ID NO: 176473 - DNA, 8 bp, Unknown
  misc_feature (1)..( 8): Result.005 file - promoters50/1595752
acatctaa

SEQ ID NO: 176474 - DNA, 9 bp, Unknown
  misc_feature (1)..( 9): Result.005 file - promoters50/1595752
acaaccata

SEQ ID NO: 176475 - DNA, 9 bp, Unknown
  misc_feature (1)..( 9): Result.005 file - promoters50/1595752
acaaccacc

SEQ ID NO: 176476 - DNA, 9 bp, Unknown
  misc_feature (1)..( 9): Result.005 file - promoters50/1595752
ataaccacc

SEQ ID NO: 176477 - DNA, 9 bp, Unknown
  misc_feature (1)..( 9): Result.005 file - promoters50/1595752
atataaata

SEQ ID NO: 176478 - DNA, 9 bp, Unknown
  misc_feature (1)..( 9): Result.005 file - promoters50/1595752
atatatata

SEQ ID NO: 176479 - DNA, 9 bp, Unknown
  misc_feature (1)..( 9): Result.005 file - promoters50/1595752
ctatatata

SEQ ID NO: 176480 - DNA, 9 bp, Unknown
  misc_feature (1)..( 9): Result.005 file - promoters50/1595752
gaatctctt

SEQ ID NO: 176481 - DNA, 9 bp, Unknown
  misc_feature (1)..( 9): Result.005 file - promoters50/1595752
aaatttctt

SEQ ID NO: 176482 - DNA, 10 bp, Unknown
  misc_feature (1)..( 10): Result.005 file - promoters50/1595752
taagtttgca

SEQ ID NO: 176483 - DNA, 8 bp, Unknown
  misc_feature (1)..( 8): Result.005 file - promoters50/1595772
ataatttc

SEQ ID NO: 176484 - DNA, 8 bp, Unknown
  misc_feature (1)..( 8): Result.005 file - promoters50/1595772
gaaatttc

SEQ ID NO: 176485 - DNA, 8 bp, Unknown
  misc_feature (1)..( 8): Result.005 file - promoters50/1595772
atagttta

SEQ ID NO: 176486 - DNA, 8 bp, Unknown
  misc_feature (1)..( 8): Result.005 file - promoters50/1595772
ctaatttt

SEQ ID NO: 176487 - DNA, 9 bp, Unknown
  misc_feature (1)..( 9): Result.005 file - promoters50/1595772
agaacttta

SEQ ID NO: 176488 - DNA, 9 bp, Unknown
  misc_feature (1)..( 9): Result.005 file - promoters50/1595772
tacaatttt

SEQ ID NO: 176489 - DNA, 11 bp, Unknown
  misc_feature (1)..( 11): Result.005 file - promoters50/1595772
cttataaatac

SEQ ID NO: 176490 - DNA, 11 bp, Unknown
  misc_feature (1)..( 11): Result.005 file - promoters50/1595772
aatataaataa

SEQ ID NO: 176491 - DNA, 11 bp, Unknown
  misc_feature (1)..( 11): Result.005 file - promoters50/1595772
tatataaacaa

SEQ ID NO: 176492 - DNA, 11 bp, Unknown
  misc_feature (1)..( 11): Result.005 file - promoters50/1595772
cttaaaaacca

SEQ ID NO: 176493 - DNA, 11 bp, Unknown
  misc_feature (1)..( 11): Result.005 file - promoters50/1595772
tatataagtgt

SEQ ID NO: 176494 - DNA, 11 bp, Unknown
  misc_feature (1)..( 11): Result.005 file - promoters50/1595772
tatacaaatcc

SEQ ID NO: 176495 - DNA, 11 bp, Unknown
  misc_feature (1)..( 11): Result.005 file - promoters50/1595772
tatttaagtaa

SEQ ID NO: 176496 - DNA, 15 bp, Unknown
  misc_feature (1)..( 15): Result.005 file - promoters50/1595772
tttaaataaaattaa

SEQ ID NO: 176497 - DNA, 15 bp, Unknown
  misc_feature (1)..( 15): Result.005 file - promoters50/1595772
aataattaaattaaa

SEQ ID NO: 176498 - DNA, 15 bp, Unknown
  misc_feature (1)..( 15): Result.005 file - promoters50/1595772
aaacaataaaattaa

SEQ ID NO: 176499 - DNA, 15 bp, Unknown
  misc_feature (1)..( 15): Result.005 file - promoters50/1595772
tttaattaaacatat

SEQ ID NO: 176500 - DNA, 15 bp, Unknown
  misc_feature (1)..( 15): Result.005 file - promoters50/1595772
ttttaatatgaagaa

SEQ ID NO: 176501 - DNA, 15 bp, Unknown
  misc_feature (1)..( 15): Result.005 file - promoters50/1595772
acattataaaataca

SEQ ID NO: 176502 - DNA, 11 bp, Unknown
  misc_feature (1)..( 11): Result.005 file - promoters50/1595772
atgcaaaatta

SEQ ID NO: 176503 - DNA, 11 bp, Unknown
  misc_feature (1)..( 11): Result.005 file - promoters50/1595772
ttttaaaatta

SEQ ID NO: 176504 - DNA, 11 bp, Unknown
  misc_feature (1)..( 11): Result.005 file - promoters50/1595772
caataaaaaaa

SEQ ID NO: 176505 - DNA, 11 bp, Unknown
  misc_feature (1)..( 11): Result.005 file - promoters50/1595772
aaataaatttt

SEQ ID NO: 176506 - DNA, 11 bp, Unknown
  misc_feature (1)..( 11): Result.005 file - promoters50/1595772
agttaaaaagt

SEQ ID NO: 176507 - DNA, 11 bp, Unknown
  misc_feature (1)..( 11): Result.005 file - promoters50/1595772
gtatatattaa

SEQ ID NO: 176508 - DNA, 11 bp, Unknown
  misc_feature (1)..( 11): Result.005 file - promoters50/1595772
taataagactt

SEQ ID NO: 176509 - DNA, 12 bp, Unknown
  misc_feature (1)..( 12): Result.005 file - promoters50/1595772
atctaataattt

SEQ ID NO: 176510 - DNA, 12 bp, Unknown
  misc_feature (1)..( 12): Result.005 file - promoters50/1595772
gtttaaaaatta

SEQ ID NO: 176511 - DNA, 12 bp, Unknown
  misc_feature (1)..( 12): Result.005 file - promoters50/1595772
gtctagtaacta

SEQ ID NO: 176512 - DNA, 12 bp, Unknown
  misc_feature (1)..( 12): Result.005 file - promoters50/1595772
gtgtaacaattc

SEQ ID NO: 176513 - DNA, 12 bp, Unknown
  misc_feature (1)..( 12): Result.005 file - promoters50/1595772
ttgtcacaagtt

SEQ ID NO: 176514 - DNA, 12 bp, Unknown
  misc_feature (1)..( 12): Result.005 file - promoters50/1595772
gttaaaaaattg

SEQ ID NO: 176515 - DNA, 12 bp, Unknown
  misc_feature (1)..( 12): Result.005 file - promoters50/1595772
atgcaaagatta

SEQ ID NO: 176516 - DNA, 12 bp, Unknown
  misc_feature (1)..( 12): Result.005 file - promoters50/1595772
atacaaagagta

SEQ ID NO: 176517 - DNA, 9 bp, Unknown
  misc_feature (1)..( 9): Result.005 file - promoters50/1595772
ataaaatta

SEQ ID NO: 176518 - DNA, 9 bp, Unknown
  misc_feature (1)..( 9): Result.005 file - promoters50/1595772
ttaatattt

SEQ ID NO: 176519 - DNA, 9 bp, Unknown
  misc_feature (1)..( 9): Result.005 file - promoters50/1595772
ataaaatac

SEQ ID NO: 176520 - DNA, 9 bp, Unknown
  misc_feature (1)..( 9): Result.005 file - promoters50/1595772
gtaatgttt

SEQ ID NO: 176521 - DNA, 9 bp, Unknown
  misc_feature (1)..( 9): Result.005 file - promoters50/1595772
caaatatta

SEQ ID NO: 176522 - DNA, 9 bp, Unknown
  misc_feature (1)..( 9): Result.005 file - promoters50/1595772
ttaatatga

SEQ ID NO: 176523 - DNA, 12 bp, Unknown
  misc_feature (1)..( 12): Result.005 file - promoters50/1595772
tagattattttt

SEQ ID NO: 176524 - DNA, 12 bp, Unknown
  misc_feature (1)..( 12): Result.005 file - promoters50/1595772
atgtttatttaa

SEQ ID NO: 176525 - DNA, 13 bp, Unknown
  misc_feature (1)..( 13): Result.005 file - promoters50/1595772
ttctttaattttc

SEQ ID NO: 176526 - DNA, 13 bp, Unknown
  misc_feature (1)..( 13): Result.005 file - promoters50/1595772
tactgtaatgttc

SEQ ID NO: 176527 - DNA, 13 bp, Unknown
  misc_feature (1)..( 13): Result.005 file - promoters50/1595772
ttcattaataaga

SEQ ID NO: 176528 - DNA, 13 bp, Unknown
  misc_feature (1)..( 13): Result.005 file - promoters50/1595772
aaatttaattaac

SEQ ID NO: 176529 - DNA, 10 bp, Unknown
  misc_feature (1)..( 10): Result.005 file - promoters50/1595772
taattttatt

SEQ ID NO: 176530 - DNA, 10 bp, Unknown
  misc_feature (1)..( 10): Result.005 file - promoters50/1595772
gaatttttat

SEQ ID NO: 176531 - DNA, 10 bp, Unknown
  misc_feature (1)..( 10): Result.005 file - promoters50/1595772
taatttgtat

SEQ ID NO: 176532 - DNA, 10 bp, Unknown
  misc_feature (1)..( 10): Result.005 file - promoters50/1595772
ctctttttat

SEQ ID NO: 176533 - DNA, 10 bp, Unknown
  misc_feature (1)..( 10): Result.005 file - promoters50/1595772
ttattttgca

SEQ ID NO: 176534 - DNA, 10 bp, Unknown
  misc_feature (1)..( 10): Result.005 file - promoters50/1595772
atcttcttag

SEQ ID NO: 176535 - DNA, 12 bp, Unknown
  misc_feature (1)..( 12): Result.005 file - promoters50/1595772
aattttattata

SEQ ID NO: 176536 - DNA, 12 bp, Unknown
  misc_feature (1)..( 12): Result.005 file - promoters50/1595772
atttttattgcc

SEQ ID NO: 176537 - DNA, 12 bp, Unknown
  misc_feature (1)..( 12): Result.005 file - promoters50/1595772
ctttttatttct

SEQ ID NO: 176538 - DNA, 12 bp, Unknown
  misc_feature (1)..( 12): Result.005 file - promoters50/1595772
ttatttatttac

SEQ ID NO: 176539 - DNA, 13 bp, Unknown
  misc_feature (1)..( 13): Result.005 file - promoters50/1595772
tctggttattaat

SEQ ID NO: 176540 - DNA, 13 bp, Unknown
  misc_feature (1)..( 13): Result.005 file - promoters50/1595772
aatttgtatctat

SEQ ID NO: 176541 - DNA, 13 bp, Unknown
  misc_feature (1)..( 13): Result.005 file - promoters50/1595772
tataattattttg

SEQ ID NO: 176542 - DNA, 12 bp, Unknown
  misc_feature (1)..( 12): Result.005 file - promoters50/1595794
cagctaaacttg

SEQ ID NO: 176543 - DNA, 12 bp, Unknown
  misc_feature (1)..( 12): Result.005 file - promoters50/1595794
taattaatcttt

SEQ ID NO: 176544 - DNA, 12 bp, Unknown
  misc_feature (1)..( 12): Result.005 file - promoters50/1595794
aatttattctga

SEQ ID NO: 176545 - DNA, 13 bp, Unknown
  misc_feature (1)..( 13): Result.005 file - promoters50/1595794
gaagatatcgttt

SEQ ID NO: 176546 - DNA, 13 bp, Unknown
  misc_feature (1)..( 13): Result.005 file - promoters50/1595794
aatttatttctgc

SEQ ID NO: 176547 - DNA, 13 bp, Unknown
  misc_feature (1)..( 13): Result.005 file - promoters50/1595794
cttttatttcctc

SEQ ID NO: 176548 - DNA, 13 bp, Unknown
  misc_feature (1)..( 13): Result.005 file - promoters50/1595794
catttatttgact

SEQ ID NO: 176549 - DNA, 10 bp, Unknown
  misc_feature (1)..( 10): Result.005 file - promoters50/1595794
acagtctttc

SEQ ID NO: 176550 - DNA, 10 bp, Unknown
  misc_feature (1)..( 10): Result.005 file - promoters50/1595794
tttgtctttt

SEQ ID NO: 176551 - DNA, 10 bp, Unknown
  misc_feature (1)..( 10): Result.005 file - promoters50/1595794
acattcttca

SEQ ID NO: 176552 - DNA, 10 bp, Unknown
  misc_feature (1)..( 10): Result.005 file - promoters50/1595794
ttagtctttg

SEQ ID NO: 176553 - DNA, 10 bp, Unknown
  misc_feature (1)..( 10): Result.005 file - promoters50/1595794
tgcttctttg

SEQ ID NO: 176554 - DNA, 11 bp, Unknown
  misc_feature (1)..( 11): Result.005 file - promoters50/1595794
tagttctcttg

SEQ ID NO: 176555 - DNA, 11 bp, Unknown
  misc_feature (1)..( 11): Result.005 file - promoters50/1595794
cataatgtctg

SEQ ID NO: 176556 - DNA, 11 bp, Unknown
  misc_feature (1)..( 11): Result.005 file - promoters50/1595794
taaaatgtctt

SEQ ID NO: 176557 - DNA, 11 bp, Unknown
  misc_feature (1)..( 11): Result.005 file - promoters50/1595794
gtaaatgtatc

SEQ ID NO: 176558 - DNA, 11 bp, Unknown
  misc_feature (1)..( 11): Result.005 file - promoters50/1595794
gtaaaagtact

SEQ ID NO: 176559 - DNA, 11 bp, Unknown
  misc_feature (1)..( 11): Result.005 file - promoters50/1595794
agaaaagtaat

SEQ ID NO: 176560 - DNA, 11 bp, Unknown
  misc_feature (1)..( 11): Result.005 file - promoters50/1595794
cgtcaagaaat

SEQ ID NO: 176561 - DNA, 15 bp, Unknown
  misc_feature (1)..( 15): Result.005 file - promoters50/1595794
ttaaaaaatcaaaat

SEQ ID NO: 176562 - DNA, 15 bp, Unknown
  misc_feature (1)..( 15): Result.005 file - promoters50/1595794
atttgaaatcaaata

SEQ ID NO: 176563 - DNA, 15 bp, Unknown
  misc_feature (1)..( 15): Result.005 file - promoters50/1595794
ttaacaaaacaattc

SEQ ID NO: 176564 - DNA, 15 bp, Unknown
  misc_feature (1)..( 15): Result.005 file - promoters50/1595794
aaagtaattcaaata

SEQ ID NO: 176565 - DNA, 15 bp, Unknown
  misc_feature (1)..( 15): Result.005 file - promoters50/1595794
tgtcattttccaatc

SEQ ID NO: 176566 - DNA, 15 bp, Unknown
  misc_feature (1)..( 15): Result.005 file - promoters50/1595794
gcatataaccaaagt

SEQ ID NO: 176567 - DNA, 13 bp, Unknown
  misc_feature (1)..( 13): Result.005 file - promoters50/1595794
tttcttaaaaaat

SEQ ID NO: 176568 - DNA, 13 bp, Unknown
  misc_feature (1)..( 13): Result.005 file - promoters50/1595794
gaaatcaaataat

SEQ ID NO: 176569 - DNA, 13 bp, Unknown
  misc_feature (1)..( 13): Result.005 file - promoters50/1595794
ttaacaaaacaat

SEQ ID NO: 176570 - DNA, 13 bp, Unknown
  misc_feature (1)..( 13): Result.005 file - promoters50/1595794
taattcaaatacg

SEQ ID NO: 176571 - DNA, 13 bp, Unknown
  misc_feature (1)..( 13): Result.005 file - promoters50/1595794
attttccaatcct

SEQ ID NO: 176572 - DNA, 13 bp, Unknown
  misc_feature (1)..( 13): Result.005 file - promoters50/1595794
ataaccaaagttg

SEQ ID NO: 176573 - DNA, 13 bp, Unknown
  misc_feature (1)..( 13): Result.005 file - promoters50/1595829
ctaattttaaaac

SEQ ID NO: 176574 - DNA, 13 bp, Unknown
  misc_feature (1)..( 13): Result.005 file - promoters50/1595829
tgtattttacagt

SEQ ID NO: 176575 - DNA, 13 bp, Unknown
  misc_feature (1)..( 13): Result.005 file - promoters50/1595829
acaatttgaaaac

SEQ ID NO: 176576 - DNA, 13 bp, Unknown
  misc_feature (1)..( 13): Result.005 file - promoters50/1595829
gaaatattactca

SEQ ID NO: 176577 - DNA, 13 bp, Unknown
  misc_feature (1)..( 13): Result.005 file - promoters50/1595829
taaattttaaatt

SEQ ID NO: 176578 - DNA, 13 bp, Unknown
  misc_feature (1)..( 13): Result.005 file - promoters50/1595829
aaaaaattcaagt

SEQ ID NO: 176579 - DNA, 10 bp, Unknown
  misc_feature (1)..( 10): Result.005 file - promoters50/1595829
acaatttata

SEQ ID NO: 176580 - DNA, 10 bp, Unknown
  misc_feature (1)..( 10): Result.005 file - promoters50/1595829
ataattaata

SEQ ID NO: 176581 - DNA, 10 bp, Unknown
  misc_feature (1)..( 10): Result.005 file - promoters50/1595829
aaaataaata

SEQ ID NO: 176582 - DNA, 10 bp, Unknown
  misc_feature (1)..( 10): Result.005 file - promoters50/1595829
tcaataaaac

SEQ ID NO: 176583 - DNA, 10 bp, Unknown
  misc_feature (1)..( 10): Result.005 file - promoters50/1595829
aaaataaaaa

SEQ ID NO: 176584 - DNA, 10 bp, Unknown
  misc_feature (1)..( 10): Result.005 file - promoters50/1595829
tcaatcaaat

SEQ ID NO: 176585 - DNA, 16 bp, Unknown
  misc_feature (1)..( 16): Result.005 file - promoters50/1595829
gatatcttagagtaat

SEQ ID NO: 176586 - DNA, 16 bp, Unknown
  misc_feature (1)..( 16): Result.005 file - promoters50/1595829
cgtatctaagacctaa

SEQ ID NO: 176587 - DNA, 16 bp, Unknown
  misc_feature (1)..( 16): Result.005 file - promoters50/1595829
gatttcttagaatata

SEQ ID NO: 176588 - DNA, 15 bp, Unknown
  misc_feature (1)..( 15): Result.005 file - promoters50/1595829
tttttttaaaatata

SEQ ID NO: 176589 - DNA, 16 bp, Unknown
  misc_feature (1)..( 16): Result.005 file - promoters50/1595829
attttcttcgttaagc

SEQ ID NO: 176590 - DNA, 16 bp, Unknown
  misc_feature (1)..( 16): Result.005 file - promoters50/1595829
ttttttttagatagat

SEQ ID NO: 176591 - DNA, 14 bp, Unknown
  misc_feature (1)..( 14): Result.005 file - promoters50/1595829
atataattttaatc

SEQ ID NO: 176592 - DNA, 14 bp, Unknown
  misc_feature (1)..( 14): Result.005 file - promoters50/1595829
catctattttatat

SEQ ID NO: 176593 - DNA, 14 bp, Unknown
  misc_feature (1)..( 14): Result.005 file - promoters50/1595829
ttctttttttaaca

SEQ ID NO: 176594 - DNA, 14 bp, Unknown
  misc_feature (1)..( 14): Result.005 file - promoters50/1595829
atataagtttaaat

SEQ ID NO: 176595 - DNA, 14 bp, Unknown
  misc_feature (1)..( 14): Result.005 file - promoters50/1595829
tgcaaatataatca

SEQ ID NO: 176596 - DNA, 15 bp, Unknown
  misc_feature (1)..( 15): Result.005 file - promoters50/1595829
ttgacattttcaaca

SEQ ID NO: 176597 - DNA, 18 bp, Unknown
  misc_feature (1)..( 18): Result.005 file - promoters50/1595829
cgactaattttaaaacac

SEQ ID NO: 176598 - DNA, 18 bp, Unknown
  misc_feature (1)..( 18): Result.005 file - promoters50/1595829
aaactaatatattttgga

SEQ ID NO: 176599 - DNA, 18 bp, Unknown
  misc_feature (1)..( 18): Result.005 file - promoters50/1595829
aaattaaaatattggtca

SEQ ID NO: 176600 - DNA, 18 bp, Unknown
  misc_feature (1)..( 18): Result.005 file - promoters50/1595829
aaaagaaaaaattcaagt

SEQ ID NO: 176601 - DNA, 18 bp, Unknown
  misc_feature (1)..( 18): Result.005 file - promoters50/1595829
aatctgaaatattactca

SEQ ID NO: 176602 - DNA, 18 bp, Unknown
  misc_feature (1)..( 18): Result.005 file - promoters50/1595829
ggaagtgaatgttgatca

SEQ ID NO: 176603 - DNA, 7 bp, Unknown
  misc_feature (1)..( 7): Result.005 file - promoters50/1662819
acttatc

SEQ ID NO: 176604 - DNA, 7 bp, Unknown
  misc_feature (1)..( 7): Result.005 file - promoters50/1662819
acttatt

SEQ ID NO: 176605 - DNA, 7 bp, Unknown
  misc_feature (1)..( 7): Result.005 file - promoters50/1662819
actgatt

SEQ ID NO: 176606 - DNA, 9 bp, Unknown
  misc_feature (1)..( 9): Result.005 file - promoters50/1662819
ttatctaaa

SEQ ID NO: 176607 - DNA, 9 bp, Unknown
  misc_feature (1)..( 9): Result.005 file - promoters50/1662819
ttatctaaa

SEQ ID NO: 176608 - DNA, 9 bp, Unknown
  misc_feature (1)..( 9): Result.005 file - promoters50/1662819
ttatataac

SEQ ID NO: 176609 - DNA, 12 bp, Unknown
  misc_feature (1)..( 12): Result.005 file - promoters50/1662827
aaactatttaaa

SEQ ID NO: 176610 - DNA, 12 bp, Unknown
  misc_feature (1)..( 12): Result.005 file - promoters50/1662827
cttctatataag

SEQ ID NO: 176611 - DNA, 12 bp, Unknown
  misc_feature (1)..( 12): Result.005 file - promoters50/1662827
tgactattatcc

SEQ ID NO: 176612 - DNA, 12 bp, Unknown
  misc_feature (1)..( 12): Result.005 file - promoters50/1662827
aattcatttaag

SEQ ID NO: 176613 - DNA, 12 bp, Unknown
  misc_feature (1)..( 12): Result.005 file - promoters50/1662827
tgattatccttg

SEQ ID NO: 176614 - DNA, 12 bp, Unknown
  misc_feature (1)..( 12): Result.005 file - promoters50/1662827
gaattatccaaa

SEQ ID NO: 176615 - DNA, 12 bp, Unknown
  misc_feature (1)..( 12): Result.005 file - promoters50/1662827
aaaatatgcaaa

SEQ ID NO: 176616 - DNA, 10 bp, Unknown
  misc_feature (1)..( 10): Result.005 file - promoters50/1662827
ttttattttt

SEQ ID NO: 176617 - DNA, 10 bp, Unknown
  misc_feature (1)..( 10): Result.005 file - promoters50/1662827
tttcattcaa

SEQ ID NO: 176618 - DNA, 10 bp, Unknown
  misc_feature (1)..( 10): Result.005 file - promoters50/1662827
cttaatttaa

SEQ ID NO: 176619 - DNA, 10 bp, Unknown
  misc_feature (1)..( 10): Result.005 file - promoters50/1662827
atttattatt

SEQ ID NO: 176620 - DNA, 10 bp, Unknown
  misc_feature (1)..( 10): Result.005 file - promoters50/1662827
tttgattttt

SEQ ID NO: 176621 - DNA, 10 bp, Unknown
  misc_feature (1)..( 10): Result.005 file - promoters50/1662827
aataatgtaa

SEQ ID NO: 176622 - DNA, 11 bp, Unknown
  misc_feature (1)..( 11): Result.005 file - promoters50/1662827
attttacatta

SEQ ID NO: 176623 - DNA, 11 bp, Unknown
  misc_feature (1)..( 11): Result.005 file - promoters50/1662827
tttttaccatc

SEQ ID NO: 176624 - DNA, 11 bp, Unknown
  misc_feature (1)..( 11): Result.005 file - promoters50/1662827
cttttcattaa

SEQ ID NO: 176625 - DNA, 11 bp, Unknown
  misc_feature (1)..( 11): Result.005 file - promoters50/1662827
tttttaaaaaa

SEQ ID NO: 176626 - DNA, 11 bp, Unknown
  misc_feature (1)..( 11): Result.005 file - promoters50/1662827
catttataaag

SEQ ID NO: 176627 - DNA, 11 bp, Unknown
  misc_feature (1)..( 11): Result.005 file - promoters50/1662827
attctcttctt

SEQ ID NO: 176628 - DNA, 9 bp, Unknown
  misc_feature (1)..( 9): Result.005 file - promoters50/1662827
tttttttgg

SEQ ID NO: 176629 - DNA, 9 bp, Unknown
  misc_feature (1)..( 9): Result.005 file - promoters50/1662827
tttttttaa

SEQ ID NO: 176630 - DNA, 9 bp, Unknown
  misc_feature (1)..( 9): Result.005 file - promoters50/1662827
tttatttgt

SEQ ID NO: 176631 - DNA, 9 bp, Unknown
  misc_feature (1)..( 9): Result.005 file - promoters50/1662827
cttatttca

SEQ ID NO: 176632 - DNA, 10 bp, Unknown
  misc_feature (1)..( 10): Result.005 file - promoters50/1662827
ttctgtttga

SEQ ID NO: 176633 - DNA, 10 bp, Unknown
  misc_feature (1)..( 10): Result.005 file - promoters50/1662827
ttatatctgt

SEQ ID NO: 176634 - DNA, 17 bp, Unknown
  misc_feature (1)..( 17): Result.005 file - promoters50/1662827
gtataccaaatttaatg

SEQ ID NO: 176635 - DNA, 17 bp, Unknown
  misc_feature (1)..( 17): Result.005 file - promoters50/1662827
ggctaccaaacttatct

SEQ ID NO: 176636 - DNA, 17 bp, Unknown
  misc_feature (1)..( 17): Result.005 file - promoters50/1662827
gtatcccaaaaattatt

SEQ ID NO: 176637 - DNA, 17 bp, Unknown
  misc_feature (1)..( 17): Result.005 file - promoters50/1662827
ttaaaacaaactcttat

SEQ ID NO: 176638 - DNA, 17 bp, Unknown
  misc_feature (1)..( 17): Result.005 file - promoters50/1662827
ggcttttctacttctct

SEQ ID NO: 176639 - DNA, 17 bp, Unknown
  misc_feature (1)..( 17): Result.005 file - promoters50/1662827
taaataataacctatct

SEQ ID NO: 176640 - DNA, 10 bp, Unknown
  misc_feature (1)..( 10): Result.005 file - promoters50/1662843
ttcacattat

SEQ ID NO: 176641 - DNA, 10 bp, Unknown
  misc_feature (1)..( 10): Result.005 file - promoters50/1662843
ttcacatggg

SEQ ID NO: 176642 - DNA, 10 bp, Unknown
  misc_feature (1)..( 10): Result.005 file - promoters50/1662843
atcacactat

SEQ ID NO: 176643 - DNA, 9 bp, Unknown
  misc_feature (1)..( 9): Result.005 file - promoters50/1662843
taaatagta

SEQ ID NO: 176644 - DNA, 9 bp, Unknown
  misc_feature (1)..( 9): Result.005 file - promoters50/1662843
taaatacgg

SEQ ID NO: 176645 - DNA, 9 bp, Unknown
  misc_feature (1)..( 9): Result.005 file - promoters50/1662843
caaagagta

SEQ ID NO: 176646 - DNA, 10 bp, Unknown
  misc_feature (1)..( 10): Result.005 file - promoters50/1662843
aattcaactc

SEQ ID NO: 176647 - DNA, 10 bp, Unknown
  misc_feature (1)..( 10): Result.005 file - promoters50/1662843
aatacaatta

SEQ ID NO: 176648 - DNA, 10 bp, Unknown
  misc_feature (1)..( 10): Result.005 file - promoters50/1662843
aattccactc

SEQ ID NO: 176649 - DNA, 7 bp, Unknown
  misc_feature (1)..( 7): Result.005 file - promoters50/1662872
ttttctt

SEQ ID NO: 176650 - DNA, 7 bp, Unknown
  misc_feature (1)..( 7): Result.005 file - promoters50/1662872
tttcctt

SEQ ID NO: 176651 - DNA, 7 bp, Unknown
  misc_feature (1)..( 7): Result.005 file - promoters50/1662872
cttcctt

SEQ ID NO: 176652 - DNA, 9 bp, Unknown
  misc_feature (1)..( 9): Result.005 file - promoters50/1662872
taagatctt

SEQ ID NO: 176653 - DNA, 9 bp, Unknown
  misc_feature (1)..( 9): Result.005 file - promoters50/1662872
ctagatctt

SEQ ID NO: 176654 - DNA, 9 bp, Unknown
  misc_feature (1)..( 9): Result.005 file - promoters50/1662872
ctagatcat

SEQ ID NO: 176655 - DNA, 9 bp, Unknown
  misc_feature (1)..( 9): Result.005 file - promoters50/1662895
attcgtaag

SEQ ID NO: 176656 - DNA, 9 bp, Unknown
  misc_feature (1)..( 9): Result.005 file - promoters50/1662895
tttcctaag

SEQ ID NO: 176657 - DNA, 9 bp, Unknown
  misc_feature (1)..( 9): Result.005 file - promoters50/1662895
tttcataat

SEQ ID NO: 176658 - DNA, 9 bp, Unknown
  misc_feature (1)..( 9): Result.005 file - promoters50/1662895
attgagaaa

SEQ ID NO: 176659 - DNA, 9 bp, Unknown
  misc_feature (1)..( 9): Result.005 file - promoters50/1662895
taagagaaa

SEQ ID NO: 176660 - DNA, 9 bp, Unknown
  misc_feature (1)..( 9): Result.005 file - promoters50/1662895
attgagaaa

SEQ ID NO: 176661 - DNA, 11 bp, Unknown
  misc_feature (1)..( 11): Result.005 file - promoters50/1662899
aacatttttca

SEQ ID NO: 176662 - DNA, 11 bp, Unknown
  misc_feature (1)..( 11): Result.005 file - promoters50/1662899
tgaattgttca

SEQ ID NO: 176663 - DNA, 11 bp, Unknown
  misc_feature (1)..( 11): Result.005 file - promoters50/1662899
acaatttaaaa

SEQ ID NO: 176664 - DNA, 11 bp, Unknown
  misc_feature (1)..( 11): Result.005 file - promoters50/1662899
ccaatttttgg

SEQ ID NO: 176665 - DNA, 11 bp, Unknown
  misc_feature (1)..( 11): Result.005 file - promoters50/1662899
gtaatagttat

SEQ ID NO: 176666 - DNA, 11 bp, Unknown
  misc_feature (1)..( 11): Result.005 file - promoters50/1662899
ttaattttgta

SEQ ID NO: 176667 - DNA, 9 bp, Unknown
  misc_feature (1)..( 9): Result.005 file - promoters50/1662899
tatatgttt

SEQ ID NO: 176668 - DNA, 9 bp, Unknown
  misc_feature (1)..( 9): Result.005 file - promoters50/1662899
catatgtgc

SEQ ID NO: 176669 - DNA, 9 bp, Unknown
  misc_feature (1)..( 9): Result.005 file - promoters50/1662899
tatatgcag

SEQ ID NO: 176670 - DNA, 9 bp, Unknown
  misc_feature (1)..( 9): Result.005 file - promoters50/1662899
tatatttta

SEQ ID NO: 176671 - DNA, 9 bp, Unknown
  misc_feature (1)..( 9): Result.005 file - promoters50/1662899
tttatgtgt

SEQ ID NO: 176672 - DNA, 9 bp, Unknown
  misc_feature (1)..( 9): Result.005 file - promoters50/1662899
tttttgtag

SEQ ID NO: 176673 - DNA, 10 bp, Unknown
  misc_feature (1)..( 10): Result.005 file - promoters50/1662917
aaattctctt

SEQ ID NO: 176674 - DNA, 10 bp, Unknown
  misc_feature (1)..( 10): Result.005 file - promoters50/1662917
aaatcctcca

SEQ ID NO: 176675 - DNA, 10 bp, Unknown
  misc_feature (1)..( 10): Result.005 file - promoters50/1662917
aaattcaaaa

SEQ ID NO: 176676 - DNA, 10 bp, Unknown
  misc_feature (1)..( 10): Result.005 file - promoters50/1662917
aaacccttat

SEQ ID NO: 176677 - DNA, 10 bp, Unknown
  misc_feature (1)..( 10): Result.005 file - promoters50/1662917
ggacccgtat

SEQ ID NO: 176678 - DNA, 11 bp, Unknown
  misc_feature (1)..( 11): Result.005 file - promoters50/1662917
tttataagtat

SEQ ID NO: 176679 - DNA, 11 bp, Unknown
  misc_feature (1)..( 11): Result.005 file - promoters50/1662917
tttgtaacttc

SEQ ID NO: 176680 - DNA, 11 bp, Unknown
  misc_feature (1)..( 11): Result.005 file - promoters50/1662917
cttataattat

SEQ ID NO: 176681 - DNA, 11 bp, Unknown
  misc_feature (1)..( 11): Result.005 file - promoters50/1662917
tttaaaagtaa

SEQ ID NO: 176682 - DNA, 11 bp, Unknown
  misc_feature (1)..( 11): Result.005 file - promoters50/1662917
tttttaaattt

SEQ ID NO: 176683 - DNA, 17 bp, Unknown
  misc_feature (1)..( 17): Result.005 file - promoters50/1662917
aatcttttgattctaaa

SEQ ID NO: 176684 - DNA, 17 bp, Unknown
  misc_feature (1)..( 17): Result.005 file - promoters50/1662917
taaattttgaaataatt

SEQ ID NO: 176685 - DNA, 17 bp, Unknown
  misc_feature (1)..( 17): Result.005 file - promoters50/1662917
ttgatttagataccgga

SEQ ID NO: 176686 - DNA, 17 bp, Unknown
  misc_feature (1)..( 17): Result.005 file - promoters50/1662917
taaattttaaaattatt

SEQ ID NO: 176687 - DNA, 17 bp, Unknown
  misc_feature (1)..( 17): Result.005 file - promoters50/1662917
aattttttaaaatatat

SEQ ID NO: 176688 - DNA, 17 bp, Unknown
  misc_feature (1)..( 17): Result.005 file - promoters50/1662917
aaaatgttagataggaa

SEQ ID NO: 176689 - DNA, 14 bp, Unknown
  misc_feature (1)..( 14): Result.005 file - promoters50/1662917
cccttgtgaatgtc

SEQ ID NO: 176690 - DNA, 14 bp, Unknown
  misc_feature (1)..( 14): Result.005 file - promoters50/1662917
ttttgatgaatgta

SEQ ID NO: 176691 - DNA, 14 bp, Unknown
  misc_feature (1)..( 14): Result.005 file - promoters50/1662917
atttgctgaataag

SEQ ID NO: 176692 - DNA, 14 bp, Unknown
  misc_feature (1)..( 14): Result.005 file - promoters50/1662917
ttttgaagaatttt

SEQ ID NO: 176693 - DNA, 14 bp, Unknown
  misc_feature (1)..( 14): Result.005 file - promoters50/1662917
ataataataatgta

SEQ ID NO: 176694 - DNA, 17 bp, Unknown
  misc_feature (1)..( 17): Result.005 file - promoters50/1662917
ttgattctaaaatattg

SEQ ID NO: 176695 - DNA, 17 bp, Unknown
  misc_feature (1)..( 17): Result.005 file - promoters50/1662917
taaattttaaaattatt

SEQ ID NO: 176696 - DNA, 17 bp, Unknown
  misc_feature (1)..( 17): Result.005 file - promoters50/1662917
aattttttaaaatatat

SEQ ID NO: 176697 - DNA, 17 bp, Unknown
  misc_feature (1)..( 17): Result.005 file - promoters50/1662917
ccgggtctaaaactccg

SEQ ID NO: 176698 - DNA, 17 bp, Unknown
  misc_feature (1)..( 17): Result.005 file - promoters50/1662917
taaattttgaaataatt

SEQ ID NO: 176699 - DNA, 17 bp, Unknown
  misc_feature (1)..( 17): Result.005 file - promoters50/1662917
tttccataaaaatgtta

SEQ ID NO: 176700 - DNA, 20 bp, Unknown
  misc_feature (1)..( 20): Result.005 file - promoters50/1662917
gattctaaaatattgttcat

SEQ ID NO: 176701 - DNA, 20 bp, Unknown
  misc_feature (1)..( 20): Result.005 file - promoters50/1662917
taaattttaaaattattcat

SEQ ID NO: 176702 - DNA, 20 bp, Unknown
  misc_feature (1)..( 20): Result.005 file - promoters50/1662917
taaattttgaaataatttca

SEQ ID NO: 176703 - DNA, 20 bp, Unknown
  misc_feature (1)..( 20): Result.005 file - promoters50/1662917
acaatttttaaattttttaa

SEQ ID NO: 176704 - DNA, 20 bp, Unknown
  misc_feature (1)..( 20): Result.005 file - promoters50/1662917
cggatcgggtcataattccg

SEQ ID NO: 176705 - DNA, 8 bp, Unknown
  misc_feature (1)..( 8): Result.005 file - promoters50/1662981
aatcttag

SEQ ID NO: 176706 - DNA, 8 bp, Unknown
  misc_feature (1)..( 8): Result.005 file - promoters50/1662981
gatcttaa

SEQ ID NO: 176707 - DNA, 8 bp, Unknown
  misc_feature (1)..( 8): Result.005 file - promoters50/1662981
aatcttag

SEQ ID NO: 176708 - DNA, 10 bp, Unknown
  misc_feature (1)..( 10): Result.005 file - promoters50/1662981
aaagacagcg

SEQ ID NO: 176709 - DNA, 10 bp, Unknown
  misc_feature (1)..( 10): Result.005 file - promoters50/1662981
aaaaacagta

SEQ ID NO: 176710 - DNA, 10 bp, Unknown
  misc_feature (1)..( 10): Result.005 file - promoters50/1662981
aaaaataaaa

SEQ ID NO: 176711 - DNA, 11 bp, Unknown
  misc_feature (1)..( 11): Result.005 file - promoters50/1663082
aaatatataca

SEQ ID NO: 176712 - DNA, 11 bp, Unknown
  misc_feature (1)..( 11): Result.005 file - promoters50/1663082
aaatatttgtc

SEQ ID NO: 176713 - DNA, 11 bp, Unknown
  misc_feature (1)..( 11): Result.005 file - promoters50/1663082
aaatctttatt

SEQ ID NO: 176714 - DNA, 11 bp, Unknown
  misc_feature (1)..( 11): Result.005 file - promoters50/1663082
aaatttttaaa

SEQ ID NO: 176715 - DNA, 11 bp, Unknown
  misc_feature (1)..( 11): Result.005 file - promoters50/1663082
cattcttgatt

SEQ ID NO: 176716 - DNA, 11 bp, Unknown
  misc_feature (1)..( 11): Result.005 file - promoters50/1663127
ccaaaaatggg

SEQ ID NO: 176717 - DNA, 11 bp, Unknown
  misc_feature (1)..( 11): Result.005 file - promoters50/1663127
tcaagaatctc

SEQ ID NO: 176718 - DNA, 11 bp, Unknown
  misc_feature (1)..( 11): Result.005 file - promoters50/1663127
ccaagaataat

SEQ ID NO: 176719 - DNA, 11 bp, Unknown
  misc_feature (1)..( 11): Result.005 file - promoters50/1663127
tgaagattaat

SEQ ID NO: 176720 - DNA, 7 bp, Unknown
  misc_feature (1)..( 7): Result.005 file - promoters50/1663135
tacatag

SEQ ID NO: 176721 - DNA, 7 bp, Unknown
  misc_feature (1)..( 7): Result.005 file - promoters50/1663135
aacatag

SEQ ID NO: 176722 - DNA, 7 bp, Unknown
  misc_feature (1)..( 7): Result.005 file - promoters50/1663135
aacataa

SEQ ID NO: 176723 - DNA, 8 bp, Unknown
  misc_feature (1)..( 8): Result.005 file - promoters50/1663135
acactttc

SEQ ID NO: 176724 - DNA, 8 bp, Unknown
  misc_feature (1)..( 8): Result.005 file - promoters50/1663135
acattttc

SEQ ID NO: 176725 - DNA, 8 bp, Unknown
  misc_feature (1)..( 8): Result.005 file - promoters50/1663135
atactttc

SEQ ID NO: 176726 - DNA, 7 bp, Unknown
  misc_feature (1)..( 7): Result.005 file - promoters50/1663135
tttttaa

SEQ ID NO: 176727 - DNA, 7 bp, Unknown
  misc_feature (1)..( 7): Result.005 file - promoters50/1663135
tttgtaa

SEQ ID NO: 176728 - DNA, 7 bp, Unknown
  misc_feature (1)..( 7): Result.005 file - promoters50/1663135
tttttaa

SEQ ID NO: 176729 - DNA, 9 bp, Unknown
  misc_feature (1)..( 9): Result.005 file - promoters50/1663135
aataaaatt

SEQ ID NO: 176730 - DNA, 9 bp, Unknown
  misc_feature (1)..( 9): Result.005 file - promoters50/1663135
aataaatga

SEQ ID NO: 176731 - DNA, 9 bp, Unknown
  misc_feature (1)..( 9): Result.005 file - promoters50/1663135
tataaaatt

SEQ ID NO: 176732 - DNA, 10 bp, Unknown
  misc_feature (1)..( 10): Result.005 file - promoters50/1663135
caaaactagt

SEQ ID NO: 176733 - DNA, 10 bp, Unknown
  misc_feature (1)..( 10): Result.005 file - promoters50/1663135
caaaacaaaa

SEQ ID NO: 176734 - DNA, 10 bp, Unknown
  misc_feature (1)..( 10): Result.005 file - promoters50/1663135
aaaaagaaaa

SEQ ID NO: 176735 - DNA, 9 bp, Unknown
  misc_feature (1)..( 9): Result.005 file - promoters50/1663147
ccatccact

SEQ ID NO: 176736 - DNA, 9 bp, Unknown
  misc_feature (1)..( 9): Result.005 file - promoters50/1663147
acatacact

SEQ ID NO: 176737 - DNA, 9 bp, Unknown
  misc_feature (1)..( 9): Result.005 file - promoters50/1663147
ccatttata

SEQ ID NO: 176738 - DNA, 12 bp, Unknown
  misc_feature (1)..( 12): Result.005 file - promoters50/1663147
taactccataca

SEQ ID NO: 176739 - DNA, 12 bp, Unknown
  misc_feature (1)..( 12): Result.005 file - promoters50/1663147
taaatccattta

SEQ ID NO: 176740 - DNA, 12 bp, Unknown
  misc_feature (1)..( 12): Result.005 file - promoters50/1663147
tctttccacaca

SEQ ID NO: 176741 - DNA, 10 bp, Unknown
  misc_feature (1)..( 10): Result.005 file - promoters50/1663217
acatgatata

SEQ ID NO: 176742 - DNA, 10 bp, Unknown
  misc_feature (1)..( 10): Result.005 file - promoters50/1663217
tgatgatata

SEQ ID NO: 176743 - DNA, 10 bp, Unknown
  misc_feature (1)..( 10): Result.005 file - promoters50/1663217
acacgatctc

SEQ ID NO: 176744 - DNA, 9 bp, Unknown
  misc_feature (1)..( 9): Result.005 file - promoters50/1663217
accaaataa

SEQ ID NO: 176745 - DNA, 9 bp, Unknown
  misc_feature (1)..( 9): Result.005 file - promoters50/1663217
tccaaatcg

SEQ ID NO: 176746 - DNA, 9 bp, Unknown
  misc_feature (1)..( 9): Result.005 file - promoters50/1663217
accaaacca

SEQ ID NO: 176747 - DNA, 9 bp, Unknown
  misc_feature (1)..( 9): Result.005 file - promoters50/1663217
accaatcca

SEQ ID NO: 176748 - DNA, 7 bp, Unknown
  misc_feature (1)..( 7): Result.005 file - promoters50/1663217
tcataaa

SEQ ID NO: 176749 - DNA, 7 bp, Unknown
  misc_feature (1)..( 7): Result.005 file - promoters50/1663217
tcacaaa

SEQ ID NO: 176750 - DNA, 7 bp, Unknown
  misc_feature (1)..( 7): Result.005 file - promoters50/1663217
tcataat

SEQ ID NO: 176751 - DNA, 9 bp, Unknown
  misc_feature (1)..( 9): Result.005 file - promoters50/1663217
tttaaataa

SEQ ID NO: 176752 - DNA, 9 bp, Unknown
  misc_feature (1)..( 9): Result.005 file - promoters50/1663217
attaagtaa

SEQ ID NO: 176753 - DNA, 9 bp, Unknown
  misc_feature (1)..( 9): Result.005 file - promoters50/1663217
attatgtag

SEQ ID NO: 176754 - DNA, 12 bp, Unknown
  misc_feature (1)..( 12): Result.005 file - promoters50/1663221
gtttttaatctg

SEQ ID NO: 176755 - DNA, 12 bp, Unknown
  misc_feature (1)..( 12): Result.005 file - promoters50/1663221
gtttttattgct

SEQ ID NO: 176756 - DNA, 12 bp, Unknown
  misc_feature (1)..( 12): Result.005 file - promoters50/1663221
tattttattttt

SEQ ID NO: 176757 - DNA, 12 bp, Unknown
  misc_feature (1)..( 12): Result.005 file - promoters50/1663221
acttttatgggc

SEQ ID NO: 176758 - DNA, 12 bp, Unknown
  misc_feature (1)..( 12): Result.005 file - promoters50/1663221
ccttgtatttac

SEQ ID NO: 176759 - DNA, 12 bp, Unknown
  misc_feature (1)..( 12): Result.005 file - promoters50/1663221
atttgtaattac

SEQ ID NO: 176760 - DNA, 12 bp, Unknown
  misc_feature (1)..( 12): Result.005 file - promoters50/1663261
attcttttttac

SEQ ID NO: 176761 - DNA, 12 bp, Unknown
  misc_feature (1)..( 12): Result.005 file - promoters50/1663261
attctttaaatt

SEQ ID NO: 176762 - DNA, 12 bp, Unknown
  misc_feature (1)..( 12): Result.005 file - promoters50/1663261
catctataaatt

SEQ ID NO: 176763 - DNA, 12 bp, Unknown
  misc_feature (1)..( 12): Result.005 file - promoters50/1663261
cacatatatctc

SEQ ID NO: 176764 - DNA, 8 bp, Unknown
  misc_feature (1)..( 8): Result.005 file - promoters50/1663261
aatgtaat

SEQ ID NO: 176765 - DNA, 8 bp, Unknown
  misc_feature (1)..( 8): Result.005 file - promoters50/1663261
aatataaa

SEQ ID NO: 176766 - DNA, 8 bp, Unknown
  misc_feature (1)..( 8): Result.005 file - promoters50/1663261
tatataaa

SEQ ID NO: 176767 - DNA, 8 bp, Unknown
  misc_feature (1)..( 8): Result.005 file - promoters50/1663261
tatataag

SEQ ID NO: 176768 - DNA, 8 bp, Unknown
  misc_feature (1)..( 8): Result.005 file - promoters50/1663261
agaaaatt

SEQ ID NO: 176769 - DNA, 8 bp, Unknown
  misc_feature (1)..( 8): Result.005 file - promoters50/1663261
ataaaatt

SEQ ID NO: 176770 - DNA, 8 bp, Unknown
  misc_feature (1)..( 8): Result.005 file - promoters50/1663261
agaaaata

SEQ ID NO: 176771 - DNA, 11 bp, Unknown
  misc_feature (1)..( 11): Result.005 file - promoters50/1663261
taaaaaaaaaa

SEQ ID NO: 176772 - DNA, 11 bp, Unknown
  misc_feature (1)..( 11): Result.005 file - promoters50/1663261
taacaaacaaa

SEQ ID NO: 176773 - DNA, 11 bp, Unknown
  misc_feature (1)..( 11): Result.005 file - promoters50/1663261
agacatacaat

SEQ ID NO: 176774 - DNA, 8 bp, Unknown
  misc_feature (1)..( 8): Result.005 file - promoters50/1663261
aattaatc

SEQ ID NO: 176775 - DNA, 8 bp, Unknown
  misc_feature (1)..( 8): Result.005 file - promoters50/1663261
aataaatt

SEQ ID NO: 176776 - DNA, 8 bp, Unknown
  misc_feature (1)..( 8): Result.005 file - promoters50/1663261
actaaatt

SEQ ID NO: 176777 - DNA, 9 bp, Unknown
  misc_feature (1)..( 9): Result.005 file - promoters50/1663261
ttaatcttc

SEQ ID NO: 176778 - DNA, 9 bp, Unknown
  misc_feature (1)..( 9): Result.005 file - promoters50/1663261
taaattttc

SEQ ID NO: 176779 - DNA, 9 bp, Unknown
  misc_feature (1)..( 9): Result.005 file - promoters50/1663261
taaatttga

SEQ ID NO: 176780 - DNA, 8 bp, Unknown
  misc_feature (1)..( 8): Result.005 file - promoters50/1663261
aaatatgc

SEQ ID NO: 176781 - DNA, 8 bp, Unknown
  misc_feature (1)..( 8): Result.005 file - promoters50/1663261
aaatatat

SEQ ID NO: 176782 - DNA, 8 bp, Unknown
  misc_feature (1)..( 8): Result.005 file - promoters50/1663261
caatatat

SEQ ID NO: 176783 - DNA, 12 bp, Unknown
  misc_feature (1)..( 12): Result.005 file - promoters50/1663278
tatttaaaacgt

SEQ ID NO: 176784 - DNA, 12 bp, Unknown
  misc_feature (1)..( 12): Result.005 file - promoters50/1663278
aattgaaacttt

SEQ ID NO: 176785 - DNA, 12 bp, Unknown
  misc_feature (1)..( 12): Result.005 file - promoters50/1663278
tattgaaaaaga

SEQ ID NO: 176786 - DNA, 12 bp, Unknown
  misc_feature (1)..( 12): Result.005 file - promoters50/1663278
gagggaaagaga

SEQ ID NO: 176787 - DNA, 12 bp, Unknown
  misc_feature (1)..( 12): Result.005 file - promoters50/1663278
acaagaaaaaca

SEQ ID NO: 176788 - DNA, 12 bp, Unknown
  misc_feature (1)..( 12): Result.005 file - promoters50/1663278
tttcgaagaagt

SEQ ID NO: 176789 - DNA, 14 bp, Unknown
  misc_feature (1)..( 14): Result.005 file - promoters50/1663278
cgtcgagatcagtc

SEQ ID NO: 176790 - DNA, 14 bp, Unknown
  misc_feature (1)..( 14): Result.005 file - promoters50/1663278
cgttgagttcaata

SEQ ID NO: 176791 - DNA, 14 bp, Unknown
  misc_feature (1)..( 14): Result.005 file - promoters50/1663278
tgataagtagtaac

SEQ ID NO: 176792 - DNA, 14 bp, Unknown
  misc_feature (1)..( 14): Result.005 file - promoters50/1663278
acatgggttcaaat

SEQ ID NO: 176793 - DNA, 14 bp, Unknown
  misc_feature (1)..( 14): Result.005 file - promoters50/1663278
tcgtcaattcaaat

SEQ ID NO: 176794 - DNA, 14 bp, Unknown
  misc_feature (1)..( 14): Result.005 file - promoters50/1663278
acttagattcaatt

SEQ ID NO: 176795 - DNA, 7 bp, Unknown
  misc_feature (1)..( 7): Result.005 file - promoters50/1663332
acttttt

SEQ ID NO: 176796 - DNA, 7 bp, Unknown
  misc_feature (1)..( 7): Result.005 file - promoters50/1663332
actttta

SEQ ID NO: 176797 - DNA, 7 bp, Unknown
  misc_feature (1)..( 7): Result.005 file - promoters50/1663332
actctta

SEQ ID NO: 176798 - DNA, 10 bp, Unknown
  misc_feature (1)..( 10): Result.005 file - promoters50/1663332
ttttgtcaaa

SEQ ID NO: 176799 - DNA, 10 bp, Unknown
  misc_feature (1)..( 10): Result.005 file - promoters50/1663332
ttttgacaaa

SEQ ID NO: 176800 - DNA, 10 bp, Unknown
  misc_feature (1)..( 10): Result.005 file - promoters50/1663332
aaatgacaat

SEQ ID NO: 176801 - DNA, 13 bp, Unknown
  misc_feature (1)..( 13): Result.005 file - promoters50/1663353
ctccatttaattt

SEQ ID NO: 176802 - DNA, 13 bp, Unknown
  misc_feature (1)..( 13): Result.005 file - promoters50/1663353
gtggagttacttt

SEQ ID NO: 176803 - DNA, 13 bp, Unknown
  misc_feature (1)..( 13): Result.005 file - promoters50/1663353
tctagactaattt

SEQ ID NO: 176804 - DNA, 13 bp, Unknown
  misc_feature (1)..( 13): Result.005 file - promoters50/1663353
gaaactttaatga

SEQ ID NO: 176805 - DNA, 13 bp, Unknown
  misc_feature (1)..( 13): Result.005 file - promoters50/1663353
taaacgttactgt

SEQ ID NO: 176806 - DNA, 13 bp, Unknown
  misc_feature (1)..( 13): Result.005 file - promoters50/1663353
gaaagtttaaaaa

SEQ ID NO: 176807 - DNA, 8 bp, Unknown
  misc_feature (1)..( 8): Result.005 file - promoters50/1664727
caagtaaa

SEQ ID NO: 176808 - DNA, 8 bp, Unknown
  misc_feature (1)..( 8): Result.005 file - promoters50/1664727
aaagaaaa

SEQ ID NO: 176809 - DNA, 8 bp, Unknown
  misc_feature (1)..( 8): Result.005 file - promoters50/1664727
aaagaata

SEQ ID NO: 176810 - DNA, 10 bp, Unknown
  misc_feature (1)..( 10): Result.005 file - promoters50/1664731
tttttagatt

SEQ ID NO: 176811 - DNA, 10 bp, Unknown
  misc_feature (1)..( 10): Result.005 file - promoters50/1664731
ggcttagatt

SEQ ID NO: 176812 - DNA, 10 bp, Unknown
  misc_feature (1)..( 10): Result.005 file - promoters50/1664731
ggctttgatg

SEQ ID NO: 176813 - DNA, 7 bp, Unknown
  misc_feature (1)..( 7): Result.005 file - promoters50/1664755
attattt

SEQ ID NO: 176814 - DNA, 7 bp, Unknown
  misc_feature (1)..( 7): Result.005 file - promoters50/1664755
tttattt

SEQ ID NO: 176815 - DNA, 8 bp, Unknown
  misc_feature (1)..( 8): Result.005 file - promoters50/1664755
tttaattt

SEQ ID NO: 176816 - DNA, 8 bp, Unknown
  misc_feature (1)..( 8): Result.005 file - promoters50/1664755
taaaattt

SEQ ID NO: 176817 - DNA, 8 bp, Unknown
  misc_feature (1)..( 8): Result.005 file - promoters50/1664755
caaaattc

SEQ ID NO: 176818 - DNA, 8 bp, Unknown
  misc_feature (1)..( 8): Result.005 file - promoters50/1664755
caaagttc

SEQ ID NO: 176819 - DNA, 11 bp, Unknown
  misc_feature (1)..( 11): Result.005 file - promoters50/1664797
aatccaatata

SEQ ID NO: 176820 - DNA, 11 bp, Unknown
  misc_feature (1)..( 11): Result.005 file - promoters50/1664797
aatcaaataga

SEQ ID NO: 176821 - DNA, 11 bp, Unknown
  misc_feature (1)..( 11): Result.005 file - promoters50/1664797
tgctcaatata

SEQ ID NO: 176822 - DNA, 11 bp, Unknown
  misc_feature (1)..( 11): Result.005 file - promoters50/1664797
ctttaaaaaga

SEQ ID NO: 176823 - DNA, 11 bp, Unknown
  misc_feature (1)..( 11): Result.005 file - promoters50/1664797
atttttttttt

SEQ ID NO: 176824 - DNA, 11 bp, Unknown
  misc_feature (1)..( 11): Result.005 file - promoters50/1664797
atttatttata

SEQ ID NO: 176825 - DNA, 11 bp, Unknown
  misc_feature (1)..( 11): Result.005 file - promoters50/1664797
ctttttttttt

SEQ ID NO: 176826 - DNA, 7 bp, Unknown
  misc_feature (1)..( 7): Result.005 file - promoters50/1664797
tttctac

SEQ ID NO: 176827 - DNA, 7 bp, Unknown
  misc_feature (1)..( 7): Result.005 file - promoters50/1664797
tttctaa

SEQ ID NO: 176828 - DNA, 7 bp, Unknown
  misc_feature (1)..( 7): Result.005 file - promoters50/1664797
tttttaa

SEQ ID NO: 176829 - DNA, 10 bp, Unknown
  misc_feature (1)..( 10): Result.005 file - promoters50/1664870
gtttctgtgg

SEQ ID NO: 176830 - DNA, 10 bp, Unknown
  misc_feature (1)..( 10): Result.005 file - promoters50/1664870
tattctgtga

SEQ ID NO: 176831 - DNA, 10 bp, Unknown
  misc_feature (1)..( 10): Result.005 file - promoters50/1664870
ttttttgttg

SEQ ID NO: 176832 - DNA, 10 bp, Unknown
  misc_feature (1)..( 10): Result.005 file - promoters50/1664870
tatactggat

SEQ ID NO: 176833 - DNA, 10 bp, Unknown
  misc_feature (1)..( 10): Result.005 file - promoters50/1664870
tcttttgttt

SEQ ID NO: 176834 - DNA, 12 bp, Unknown
  misc_feature (1)..( 12): Result.005 file - promoters50/1664870
tgtttaatgact

SEQ ID NO: 176835 - DNA, 12 bp, Unknown
  misc_feature (1)..( 12): Result.005 file - promoters50/1664870
attctaataact

SEQ ID NO: 176836 - DNA, 13 bp, Unknown
  misc_feature (1)..( 13): Result.005 file - promoters50/1664870
gttctaagtaaaa

SEQ ID NO: 176837 - DNA, 13 bp, Unknown
  misc_feature (1)..( 13): Result.005 file - promoters50/1664870
ctagtaatatcca

SEQ ID NO: 176838 - DNA, 13 bp, Unknown
  misc_feature (1)..( 13): Result.005 file - promoters50/1664870
atcttaaaaactc

SEQ ID NO: 176839 - DNA, 12 bp, Unknown
  misc_feature (1)..( 12): Result.005 file - promoters50/1664870
aacaaatccaaa

SEQ ID NO: 176840 - DNA, 12 bp, Unknown
  misc_feature (1)..( 12): Result.005 file - promoters50/1664870
tacaaatttgtt

SEQ ID NO: 176841 - DNA, 12 bp, Unknown
  misc_feature (1)..( 12): Result.005 file - promoters50/1664870
aacaaacatctt

SEQ ID NO: 176842 - DNA, 12 bp, Unknown
  misc_feature (1)..( 12): Result.005 file - promoters50/1664870
gacatacatctt

SEQ ID NO: 176843 - DNA, 12 bp, Unknown
  misc_feature (1)..( 12): Result.005 file - promoters50/1664870
aacagattcaat

SEQ ID NO: 176844 - DNA, 11 bp, Unknown
  misc_feature (1)..( 11): Result.005 file - promoters50/1664931
aaagaattttt

SEQ ID NO: 176845 - DNA, 11 bp, Unknown
  misc_feature (1)..( 11): Result.005 file - promoters50/1664931
gtataatttta

SEQ ID NO: 176846 - DNA, 11 bp, Unknown
  misc_feature (1)..( 11): Result.005 file - promoters50/1664931
taaaaattttt

SEQ ID NO: 176847 - DNA, 11 bp, Unknown
  misc_feature (1)..( 11): Result.005 file - promoters50/1664931
acctaagttta

SEQ ID NO: 176848 - DNA, 11 bp, Unknown
  misc_feature (1)..( 11): Result.005 file - promoters50/1664931
ataaaagtttg

SEQ ID NO: 176849 - DNA, 11 bp, Unknown
  misc_feature (1)..( 11): Result.005 file - promoters50/1664931
tctgaagtttc

SEQ ID NO: 176850 - DNA, 15 bp, Unknown
  misc_feature (1)..( 15): Result.005 file - promoters50/1664931
ataaaaaattttttt

SEQ ID NO: 176851 - DNA, 15 bp, Unknown
  misc_feature (1)..( 15): Result.005 file - promoters50/1664931
agaaaaaaaaaaaag

SEQ ID NO: 176852 - DNA, 15 bp, Unknown
  misc_feature (1)..( 15): Result.005 file - promoters50/1664931
atataaaatggtgtt

SEQ ID NO: 176853 - DNA, 15 bp, Unknown
  misc_feature (1)..( 15): Result.005 file - promoters50/1664931
atgaaatattttttt

SEQ ID NO: 176854 - DNA, 15 bp, Unknown
  misc_feature (1)..( 15): Result.005 file - promoters50/1664931
gataaatattcaact

SEQ ID NO: 176855 - DNA, 15 bp, Unknown
  misc_feature (1)..( 15): Result.005 file - promoters50/1664931
agaagaaacaaagta

SEQ ID NO: 176856 - DNA, 13 bp, Unknown
  misc_feature (1)..( 13): Result.005 file - promoters50/1664931
aataacatatgac

SEQ ID NO: 176857 - DNA, 13 bp, Unknown
  misc_feature (1)..( 13): Result.005 file - promoters50/1664931
gcaaacatttgaa

SEQ ID NO: 176858 - DNA, 13 bp, Unknown
  misc_feature (1)..( 13): Result.005 file - promoters50/1664931
aatgacataaatt

SEQ ID NO: 176859 - DNA, 13 bp, Unknown
  misc_feature (1)..( 13): Result.005 file - promoters50/1664931
cataacagttgta

SEQ ID NO: 176860 - DNA, 13 bp, Unknown
  misc_feature (1)..( 13): Result.005 file - promoters50/1664931
agtttaagttgta

SEQ ID NO: 176861 - DNA, 13 bp, Unknown
  misc_feature (1)..( 13): Result.005 file - promoters50/1664931
gtgaacttttaat

SEQ ID NO: 176862 - DNA, 15 bp, Unknown
  misc_feature (1)..( 15): Result.005 file - promoters50/1664931
caataatttacgaaa

SEQ ID NO: 176863 - DNA, 15 bp, Unknown
  misc_feature (1)..( 15): Result.005 file - promoters50/1664931
acttaagttactacc

SEQ ID NO: 176864 - DNA, 15 bp, Unknown
  misc_feature (1)..( 15): Result.005 file - promoters50/1664931
aaatagtttactatt

SEQ ID NO: 176865 - DNA, 15 bp, Unknown
  misc_feature (1)..( 15): Result.005 file - promoters50/1664931
aaaaaagtttttgta

SEQ ID NO: 176866 - DNA, 15 bp, Unknown
  misc_feature (1)..( 15): Result.005 file - promoters50/1664931
ctcgactttagtttt

SEQ ID NO: 176867 - DNA, 15 bp, Unknown
  misc_feature (1)..( 15): Result.005 file - promoters50/1664931
caaatttttactttt

SEQ ID NO: 176868 - DNA, 15 bp, Unknown
  misc_feature (1)..( 15): Result.005 file - promoters50/1664931
tttattgttacaaat

SEQ ID NO: 176869 - DNA, 11 bp, Unknown
  misc_feature (1)..( 11): Result.005 file - promoters50/1664931
caccaatcata

SEQ ID NO: 176870 - DNA, 11 bp, Unknown
  misc_feature (1)..( 11): Result.005 file - promoters50/1664931
tgagaatcatt

SEQ ID NO: 176871 - DNA, 11 bp, Unknown
  misc_feature (1)..( 11): Result.005 file - promoters50/1664931
caccactcatc

SEQ ID NO: 176872 - DNA, 11 bp, Unknown
  misc_feature (1)..( 11): Result.005 file - promoters50/1664931
aaagagtcaaa

SEQ ID NO: 176873 - DNA, 11 bp, Unknown
  misc_feature (1)..( 11): Result.005 file - promoters50/1664931
ttagactcatc

SEQ ID NO: 176874 - DNA, 11 bp, Unknown
  misc_feature (1)..( 11): Result.005 file - promoters50/1664931
tgccactcgac

SEQ ID NO: 176875 - DNA, 15 bp, Unknown
  misc_feature (1)..( 15): Result.005 file - promoters50/1664981
tcaaaaattgaacca

SEQ ID NO: 176876 - DNA, 15 bp, Unknown
  misc_feature (1)..( 15): Result.005 file - promoters50/1664981
ttagaaatcgaaaca

SEQ ID NO: 176877 - DNA, 15 bp, Unknown
  misc_feature (1)..( 15): Result.005 file - promoters50/1664981
tatcaaattgaatga

SEQ ID NO: 176878 - DNA, 15 bp, Unknown
  misc_feature (1)..( 15): Result.005 file - promoters50/1664981
aatcttcttgaacgt

SEQ ID NO: 176879 - DNA, 15 bp, Unknown
  misc_feature (1)..( 15): Result.005 file - promoters50/1664981
ttacaaatctatcct

SEQ ID NO: 176880 - DNA, 15 bp, Unknown
  misc_feature (1)..( 15): Result.005 file - promoters50/1664981
ctggtggttgattga

SEQ ID NO: 176881 - DNA, 16 bp, Unknown
  misc_feature (1)..( 16): Result.005 file - promoters50/1664981
aaaataaatcgaaaac

SEQ ID NO: 176882 - DNA, 16 bp, Unknown
  misc_feature (1)..( 16): Result.005 file - promoters50/1664981
ttatcaaattgaatga

SEQ ID NO: 176883 - DNA, 16 bp, Unknown
  misc_feature (1)..( 16): Result.005 file - promoters50/1664981
aaagtaaatcattttt

SEQ ID NO: 176884 - DNA, 16 bp, Unknown
  misc_feature (1)..( 16): Result.005 file - promoters50/1664981
gtggttgattgatagg

SEQ ID NO: 176885 - DNA, 16 bp, Unknown
  misc_feature (1)..( 16): Result.005 file - promoters50/1664981
tgtacatattgagagg

SEQ ID NO: 176886 - DNA, 16 bp, Unknown
  misc_feature (1)..( 16): Result.005 file - promoters50/1664981
gaagtaaagttgatta

SEQ ID NO: 176887 - DNA, 12 bp, Unknown
  misc_feature (1)..( 12): Result.005 file - promoters50/1664981
gaactttggttt

SEQ ID NO: 176888 - DNA, 12 bp, Unknown
  misc_feature (1)..( 12): Result.005 file - promoters50/1664981
gaagtttctggt

SEQ ID NO: 176889 - DNA, 12 bp, Unknown
  misc_feature (1)..( 12): Result.005 file - promoters50/1664981
gaattttgtttt

SEQ ID NO: 176890 - DNA, 12 bp, Unknown
  misc_feature (1)..( 12): Result.005 file - promoters50/1664981
aaagtttgttat

SEQ ID NO: 176891 - DNA, 12 bp, Unknown
  misc_feature (1)..( 12): Result.005 file - promoters50/1664981
taagtttaagtt

SEQ ID NO: 176892 - DNA, 12 bp, Unknown
  misc_feature (1)..( 12): Result.005 file - promoters50/1664981
aaagttgattaa

SEQ ID NO: 176893 - DNA, 14 bp, Unknown
  misc_feature (1)..( 14): Result.005 file - promoters50/1664981
taatatataaagga

SEQ ID NO: 176894 - DNA, 14 bp, Unknown
  misc_feature (1)..( 14): Result.005 file - promoters50/1664981
atttatatagataa

SEQ ID NO: 176895 - DNA, 14 bp, Unknown
  misc_feature (1)..( 14): Result.005 file - promoters50/1664981
acatatatacttag

SEQ ID NO: 176896 - DNA, 14 bp, Unknown
  misc_feature (1)..( 14): Result.005 file - promoters50/1664981
ctatataaagataa

SEQ ID NO: 176897 - DNA, 14 bp, Unknown
  misc_feature (1)..( 14): Result.005 file - promoters50/1664981
tactataaatctaa

SEQ ID NO: 176898 - DNA, 14 bp, Unknown
  misc_feature (1)..( 14): Result.005 file - promoters50/1664981
tactataaattctt

SEQ ID NO: 176899 - DNA, 12 bp, Unknown
  misc_feature (1)..( 12): Result.005 file - promoters50/1665056
caaagaaataac

SEQ ID NO: 176900 - DNA, 12 bp, Unknown
  misc_feature (1)..( 12): Result.005 file - promoters50/1665056
gaaaaaaataac

SEQ ID NO: 176901 - DNA, 12 bp, Unknown
  misc_feature (1)..( 12): Result.005 file - promoters50/1665056
gaaagaagaaaa

SEQ ID NO: 176902 - DNA, 12 bp, Unknown
  misc_feature (1)..( 12): Result.005 file - promoters50/1665056
ataaaaaattga

SEQ ID NO: 176903 - DNA, 12 bp, Unknown
  misc_feature (1)..( 12): Result.005 file - promoters50/1665056
agaagaaaacgt

SEQ ID NO: 176904 - DNA, 12 bp, Unknown
  misc_feature (1)..( 12): Result.005 file - promoters50/1665056
tatacaaaagct

SEQ ID NO: 176905 - DNA, 10 bp, Unknown
  misc_feature (1)..( 10): Result.005 file - promoters50/1665056
tatctataaa

SEQ ID NO: 176906 - DNA, 10 bp, Unknown
  misc_feature (1)..( 10): Result.005 file - promoters50/1665056
cgactaaaaa

SEQ ID NO: 176907 - DNA, 10 bp, Unknown
  misc_feature (1)..( 10): Result.005 file - promoters50/1665056
taacaaaaaa

SEQ ID NO: 176908 - DNA, 10 bp, Unknown
  misc_feature (1)..( 10): Result.005 file - promoters50/1665056
agagaaaaaa

SEQ ID NO: 176909 - DNA, 10 bp, Unknown
  misc_feature (1)..( 10): Result.005 file - promoters50/1665056
tggtaataaa

SEQ ID NO: 176910 - DNA, 10 bp, Unknown
  misc_feature (1)..( 10): Result.005 file - promoters50/1665056
tttctacaaa

SEQ ID NO: 176911 - DNA, 10 bp, Unknown
  misc_feature (1)..( 10): Result.005 file - promoters50/1665056
cgaagacaaa

SEQ ID NO: 176912 - DNA, 16 bp, Unknown
  misc_feature (1)..( 16): Result.005 file - promoters50/1665056
atagatttaattgggc

SEQ ID NO: 176913 - DNA, 16 bp, Unknown
  misc_feature (1)..( 16): Result.005 file - promoters50/1665056
ttttattttatttagg

SEQ ID NO: 176914 - DNA, 16 bp, Unknown
  misc_feature (1)..( 16): Result.005 file - promoters50/1665056
ataaatttaacgaatg

SEQ ID NO: 176915 - DNA, 16 bp, Unknown
  misc_feature (1)..( 16): Result.005 file - promoters50/1665056
gcaatgtttattaaaa

SEQ ID NO: 176916 - DNA, 16 bp, Unknown
  misc_feature (1)..( 16): Result.005 file - promoters50/1665056
tccaaatttcttaaaa

SEQ ID NO: 176917 - DNA, 16 bp, Unknown
  misc_feature (1)..( 16): Result.005 file - promoters50/1665056
ccagtgtttattttaa

SEQ ID NO: 176918 - DNA, 11 bp, Unknown
  misc_feature (1)..( 11): Result.005 file - promoters50/1665056
tacctttttac

SEQ ID NO: 176919 - DNA, 11 bp, Unknown
  misc_feature (1)..( 11): Result.005 file - promoters50/1665056
tgaatttgtac

SEQ ID NO: 176920 - DNA, 11 bp, Unknown
  misc_feature (1)..( 11): Result.005 file - promoters50/1665056
tatatttttaa

SEQ ID NO: 176921 - DNA, 11 bp, Unknown
  misc_feature (1)..( 11): Result.005 file - promoters50/1665056
aatctttttat

SEQ ID NO: 176922 - DNA, 11 bp, Unknown
  misc_feature (1)..( 11): Result.005 file - promoters50/1665056
tcccttattat

SEQ ID NO: 176923 - DNA, 11 bp, Unknown
  misc_feature (1)..( 11): Result.005 file - promoters50/1665056
aatatttctat

SEQ ID NO: 176924 - DNA, 7 bp, Unknown
  misc_feature (1)..( 7): Result.005 file - promoters50/1665080
tttctta

SEQ ID NO: 176925 - DNA, 7 bp, Unknown
  misc_feature (1)..( 7): Result.005 file - promoters50/1665080
tttgtta

SEQ ID NO: 176926 - DNA, 7 bp, Unknown
  misc_feature (1)..( 7): Result.005 file - promoters50/1665080
tttgttt

SEQ ID NO: 176927 - DNA, 10 bp, Unknown
  misc_feature (1)..( 10): Result.005 file - promoters50/1665080
tcccttttgg

SEQ ID NO: 176928 - DNA, 10 bp, Unknown
  misc_feature (1)..( 10): Result.005 file - promoters50/1665080
tccctttttt

SEQ ID NO: 176929 - DNA, 10 bp, Unknown
  misc_feature (1)..( 10): Result.005 file - promoters50/1665080
cttctttttt

SEQ ID NO: 176930 - DNA, 9 bp, Unknown
  misc_feature (1)..( 9): Result.005 file - promoters50/1665080
attaaacta

SEQ ID NO: 176931 - DNA, 9 bp, Unknown
  misc_feature (1)..( 9): Result.005 file - promoters50/1665080
attcaacta

SEQ ID NO: 176932 - DNA, 9 bp, Unknown
  misc_feature (1)..( 9): Result.005 file - promoters50/1665080
tttaaacca

SEQ ID NO: 176933 - DNA, 11 bp, Unknown
  misc_feature (1)..( 11): Result.005 file - promoters50/1665080
aatcttccaag

SEQ ID NO: 176934 - DNA, 11 bp, Unknown
  misc_feature (1)..( 11): Result.005 file - promoters50/1665080
tttcttccaag

SEQ ID NO: 176935 - DNA, 11 bp, Unknown
  misc_feature (1)..( 11): Result.005 file - promoters50/1665080
tttcttcaagg

SEQ ID NO: 176936 - DNA, 13 bp, Unknown
  misc_feature (1)..( 13): Result.005 file - promoters50/1665080
taaaaatatttat

SEQ ID NO: 176937 - DNA, 13 bp, Unknown
  misc_feature (1)..( 13): Result.005 file - promoters50/1665080
gaaaaatatatat

SEQ ID NO: 176938 - DNA, 13 bp, Unknown
  misc_feature (1)..( 13): Result.005 file - promoters50/1665080
taaaaaaagattc

SEQ ID NO: 176939 - DNA, 8 bp, Unknown
  misc_feature (1)..( 8): Result.005 file - promoters50/1665080
attccttg

SEQ ID NO: 176940 - DNA, 8 bp, Unknown
  misc_feature (1)..( 8): Result.005 file - promoters50/1665080
atttcttc

SEQ ID NO: 176941 - DNA, 8 bp, Unknown
  misc_feature (1)..( 8): Result.005 file - promoters50/1665080
ttttcttc

SEQ ID NO: 176942 - DNA, 9 bp, Unknown
  misc_feature (1)..( 9): Result.005 file - promoters50/1665080
tgtcatttc

SEQ ID NO: 176943 - DNA, 9 bp, Unknown
  misc_feature (1)..( 9): Result.005 file - promoters50/1665080
tgtgattta

SEQ ID NO: 176944 - DNA, 9 bp, Unknown
  misc_feature (1)..( 9): Result.005 file - promoters50/1665080
aatgactta

SEQ ID NO: 176945 - DNA, 9 bp, Unknown
  misc_feature (1)..( 9): Result.005 file - promoters50/1665243
attattttc

SEQ ID NO: 176946 - DNA, 9 bp, Unknown
  misc_feature (1)..( 9): Result.005 file - promoters50/1665243
atttttttg

SEQ ID NO: 176947 - DNA, 10 bp, Unknown
  misc_feature (1)..( 10): Result.005 file - promoters50/1665243
tttcagtttc

SEQ ID NO: 176948 - DNA, 10 bp, Unknown
  misc_feature (1)..( 10): Result.005 file - promoters50/1665243
caagattttt

SEQ ID NO: 176949 - DNA, 9 bp, Unknown
  misc_feature (1)..( 9): Result.005 file - promoters50/1665243
ttaaagagt

SEQ ID NO: 176950 - DNA, 9 bp, Unknown
  misc_feature (1)..( 9): Result.005 file - promoters50/1665243
ataaaaagt

SEQ ID NO: 176951 - DNA, 9 bp, Unknown
  misc_feature (1)..( 9): Result.005 file - promoters50/1665243
ataaaacaa

SEQ ID NO: 176952 - DNA, 9 bp, Unknown
  misc_feature (1)..( 9): Result.005 file - promoters50/1665243
atcaaaagt

SEQ ID NO: 176953 - DNA, 11 bp, Unknown
  misc_feature (1)..( 11): Result.005 file - promoters50/1665272
aatttgatttt

SEQ ID NO: 176954 - DNA, 11 bp, Unknown
  misc_feature (1)..( 11): Result.005 file - promoters50/1665272
attttgatcta

SEQ ID NO: 176955 - DNA, 11 bp, Unknown
  misc_feature (1)..( 11): Result.005 file - promoters50/1665272
catttgaaatt

SEQ ID NO: 176956 - DNA, 11 bp, Unknown
  misc_feature (1)..( 11): Result.005 file - promoters50/1665272
aattcgattct

SEQ ID NO: 176957 - DNA, 11 bp, Unknown
  misc_feature (1)..( 11): Result.005 file - promoters50/1665272
attttgattca

SEQ ID NO: 176958 - DNA, 11 bp, Unknown
  misc_feature (1)..( 11): Result.005 file - promoters50/1665272
ccgttgttcta

SEQ ID NO: 176959 - DNA, 11 bp, Unknown
  misc_feature (1)..( 11): Result.005 file - promoters50/1673798
gtaaactaaaa

SEQ ID NO: 176960 - DNA, 11 bp, Unknown
  misc_feature (1)..( 11): Result.005 file - promoters50/1673798
caaaaataaaa

SEQ ID NO: 176961 - DNA, 11 bp, Unknown
  misc_feature (1)..( 11): Result.005 file - promoters50/1673798
aaaaagtaaac

SEQ ID NO: 176962 - DNA, 11 bp, Unknown
  misc_feature (1)..( 11): Result.005 file - promoters50/1673798
ttaaacaaaat

SEQ ID NO: 176963 - DNA, 12 bp, Unknown
  misc_feature (1)..( 12): Result.005 file - promoters50/1673798
ttagcaataaat

SEQ ID NO: 176964 - DNA, 12 bp, Unknown
  misc_feature (1)..( 12): Result.005 file - promoters50/1673798
ttaacaataagg

SEQ ID NO: 176965 - DNA, 11 bp, Unknown
  misc_feature (1)..( 11): Result.005 file - promoters50/1673806
taaagaatttt

SEQ ID NO: 176966 - DNA, 11 bp, Unknown
  misc_feature (1)..( 11): Result.005 file - promoters50/1673806
taaaaaatgtt

SEQ ID NO: 176967 - DNA, 11 bp, Unknown
  misc_feature (1)..( 11): Result.005 file - promoters50/1673806
aaaataataat

SEQ ID NO: 176968 - DNA, 11 bp, Unknown
  misc_feature (1)..( 11): Result.005 file - promoters50/1673806
gaaataatttt

SEQ ID NO: 176969 - DNA, 11 bp, Unknown
  misc_feature (1)..( 11): Result.005 file - promoters50/1673806
gaaagaataat

SEQ ID NO: 176970 - DNA, 11 bp, Unknown
  misc_feature (1)..( 11): Result.005 file - promoters50/1673806
tgaaaaattca

SEQ ID NO: 176971 - DNA, 10 bp, Unknown
  misc_feature (1)..( 10): Result.005 file - promoters50/1673826
ataggttcca

SEQ ID NO: 176972 - DNA, 10 bp, Unknown
  misc_feature (1)..( 10): Result.005 file - promoters50/1673826
atagattcta

SEQ ID NO: 176973 - DNA, 10 bp, Unknown
  misc_feature (1)..( 10): Result.005 file - promoters50/1673826
ataagttagc

SEQ ID NO: 176974 - DNA, 10 bp, Unknown
  misc_feature (1)..( 10): Result.005 file - promoters50/1673826
ggagtttaga

SEQ ID NO: 176975 - DNA, 8 bp, Unknown
  misc_feature (1)..( 8): Result.005 file - promoters50/1673826
atcgttat

SEQ ID NO: 176976 - DNA, 8 bp, Unknown
  misc_feature (1)..( 8): Result.005 file - promoters50/1673826
atctttag

SEQ ID NO: 176977 - DNA, 8 bp, Unknown
  misc_feature (1)..( 8): Result.005 file - promoters50/1673826
ttctttaa

SEQ ID NO: 176978 - DNA, 8 bp, Unknown
  misc_feature (1)..( 8): Result.005 file - promoters50/1673826
ttctatag

SEQ ID NO: 176979 - DNA, 8 bp, Unknown
  misc_feature (1)..( 8): Result.005 file - promoters50/1673830
aaccaaat

SEQ ID NO: 176980 - DNA, 8 bp, Unknown
  misc_feature (1)..( 8): Result.005 file - promoters50/1673830
aacaaaaa

SEQ ID NO: 176981 - DNA, 8 bp, Unknown
  misc_feature (1)..( 8): Result.005 file - promoters50/1673830
aacaaaaa

SEQ ID NO: 176982 - DNA, 10 bp, Unknown
  misc_feature (1)..( 10): Result.005 file - promoters50/1673830
attaaagaaa

SEQ ID NO: 176983 - DNA, 10 bp, Unknown
  misc_feature (1)..( 10): Result.005 file - promoters50/1673830
attaaaggaa

SEQ ID NO: 176984 - DNA, 10 bp, Unknown
  misc_feature (1)..( 10): Result.005 file - promoters50/1673830
agtaagggaa

SEQ ID NO: 176985 - DNA, 10 bp, Unknown
  misc_feature (1)..( 10): Result.005 file - promoters50/1673830
ttcttgtttc

SEQ ID NO: 176986 - DNA, 10 bp, Unknown
  misc_feature (1)..( 10): Result.005 file - promoters50/1673830
ttcttcttta

SEQ ID NO: 176987 - DNA, 10 bp, Unknown
  misc_feature (1)..( 10): Result.005 file - promoters50/1673830
aagatcttta

SEQ ID NO: 176988 - DNA, 10 bp, Unknown
  misc_feature (1)..( 10): Result.005 file - promoters50/1673830
aaaacaaaat

SEQ ID NO: 176989 - DNA, 10 bp, Unknown
  misc_feature (1)..( 10): Result.005 file - promoters50/1673830
aaaacaaaaa

SEQ ID NO: 176990 - DNA, 10 bp, Unknown
  misc_feature (1)..( 10): Result.005 file - promoters50/1673830
tcaacaaaaa

SEQ ID NO: 176991 - DNA, 8 bp, Unknown
  misc_feature (1)..( 8): Result.005 file - promoters50/1673847
taatataa

SEQ ID NO: 176992 - DNA, 8 bp, Unknown
  misc_feature (1)..( 8): Result.005 file - promoters50/1673847
aaatttaa

SEQ ID NO: 176993 - DNA, 8 bp, Unknown
  misc_feature (1)..( 8): Result.005 file - promoters50/1673847
taatatta

SEQ ID NO: 176994 - DNA, 11 bp, Unknown
  misc_feature (1)..( 11): Result.005 file - promoters50/1673847
atacatcttta

SEQ ID NO: 176995 - DNA, 11 bp, Unknown
  misc_feature (1)..( 11): Result.005 file - promoters50/1673847
atagatcttat

SEQ ID NO: 176996 - DNA, 11 bp, Unknown
  misc_feature (1)..( 11): Result.005 file - promoters50/1673847
tctaatcttat

SEQ ID NO: 176997 - DNA, 11 bp, Unknown
  misc_feature (1)..( 11): Result.005 file - promoters50/1673847
tttgtatgatt

SEQ ID NO: 176998 - DNA, 11 bp, Unknown
  misc_feature (1)..( 11): Result.005 file - promoters50/1673847
tttgtatacca

SEQ ID NO: 176999 - DNA, 11 bp, Unknown
  misc_feature (1)..( 11): Result.005 file - promoters50/1673847
tttgtttgatt

SEQ ID NO: 177000 - DNA, 14 bp, Unknown
  misc_feature (1)..( 14): Result.005 file - promoters50/1673849
tattaaataatcca

SEQ ID NO: 177001 - DNA, 14 bp, Unknown
  misc_feature (1)..( 14): Result.005 file - promoters50/1673849
aattacatactaaa

SEQ ID NO: 177002 - DNA, 14 bp, Unknown
  misc_feature (1)..( 14): Result.005 file - promoters50/1673849
tatcaaaggaaatg

SEQ ID NO: 177003 - DNA, 14 bp, Unknown
  misc_feature (1)..( 14): Result.005 file - promoters50/1673849
gagaaaattatcca

SEQ ID NO: 177004 - DNA, 14 bp, Unknown
  misc_feature (1)..( 14): Result.005 file - promoters50/1673849
aatcacacaattaa

SEQ ID NO: 177005 - DNA, 9 bp, Unknown
  misc_feature (1)..( 9): Result.005 file - promoters50/1673849
aaaattatc

SEQ ID NO: 177006 - DNA, 9 bp, Unknown
  misc_feature (1)..( 9): Result.005 file - promoters50/1673849
aaatttatt

SEQ ID NO: 177007 - DNA, 9 bp, Unknown
  misc_feature (1)..( 9): Result.005 file - promoters50/1673849
ttattaatt

SEQ ID NO: 177008 - DNA, 9 bp, Unknown
  misc_feature (1)..( 9): Result.005 file - promoters50/1673849
acttttatt

SEQ ID NO: 177009 - DNA, 8 bp, Unknown
  misc_feature (1)..( 8): Result.005 file - promoters50/1673853
agaatatt

SEQ ID NO: 177010 - DNA, 8 bp, Unknown
  misc_feature (1)..( 8): Result.005 file - promoters50/1673853
ggaagatt

SEQ ID NO: 177011 - DNA, 8 bp, Unknown
  misc_feature (1)..( 8): Result.005 file - promoters50/1673853
agaatact

SEQ ID NO: 177012 - DNA, 8 bp, Unknown
  misc_feature (1)..( 8): Result.005 file - promoters50/1673853
agattata

SEQ ID NO: 177013 - DNA, 7 bp, Unknown
  misc_feature (1)..( 7): Result.005 file - promoters50/1673853
ctttgaa

SEQ ID NO: 177014 - DNA, 7 bp, Unknown
  misc_feature (1)..( 7): Result.005 file - promoters50/1673853
atttgaa

SEQ ID NO: 177015 - DNA, 7 bp, Unknown
  misc_feature (1)..( 7): Result.005 file - promoters50/1673853
ttttgaa

SEQ ID NO: 177016 - DNA, 7 bp, Unknown
  misc_feature (1)..( 7): Result.005 file - promoters50/1673853
attagaa

SEQ ID NO: 177017 - DNA, 9 bp, Unknown
  misc_feature (1)..( 9): Result.005 file - promoters50/1710026
atttgaatc

SEQ ID NO: 177018 - DNA, 9 bp, Unknown
  misc_feature (1)..( 9): Result.005 file - promoters50/1710026
atttcaatc

SEQ ID NO: 177019 - DNA, 9 bp, Unknown
  misc_feature (1)..( 9): Result.005 file - promoters50/1710026
gtttcaaat

SEQ ID NO: 177020 - DNA, 9 bp, Unknown
  misc_feature (1)..( 9): Result.005 file - promoters50/1710026
ttttaaata

SEQ ID NO: 177021 - DNA, 9 bp, Unknown
  misc_feature (1)..( 9): Result.005 file - promoters50/1710026
atttcaatc

SEQ ID NO: 177022 - DNA, 8 bp, Unknown
  misc_feature (1)..( 8): Result.005 file - promoters50/1710026
tttcaaat

SEQ ID NO: 177023 - DNA, 8 bp, Unknown
  misc_feature (1)..( 8): Result.005 file - promoters50/1710026
tttcaatc

SEQ ID NO: 177024 - DNA, 8 bp, Unknown
  misc_feature (1)..( 8): Result.005 file - promoters50/1710026
tttcaatc

SEQ ID NO: 177025 - DNA, 8 bp, Unknown
  misc_feature (1)..( 8): Result.005 file - promoters50/1710026
ttttaaat

SEQ ID NO: 177026 - DNA, 7 bp, Unknown
  misc_feature (1)..( 7): Result.005 file - promoters50/1710051
tttttcc

SEQ ID NO: 177027 - DNA, 7 bp, Unknown
  misc_feature (1)..( 7): Result.005 file - promoters50/1710051
tttttca

SEQ ID NO: 177028 - DNA, 7 bp, Unknown
  misc_feature (1)..( 7): Result.005 file - promoters50/1710051
tttatca

SEQ ID NO: 177029 - DNA, 8 bp, Unknown
  misc_feature (1)..( 8): Result.005 file - promoters50/1710051
tttaaata

SEQ ID NO: 177030 - DNA, 8 bp, Unknown
  misc_feature (1)..( 8): Result.005 file - promoters50/1710051
cttaaata

SEQ ID NO: 177031 - DNA, 8 bp, Unknown
  misc_feature (1)..( 8): Result.005 file - promoters50/1710051
cttgaatc

SEQ ID NO: 177032 - DNA, 10 bp, Unknown
  misc_feature (1)..( 10): Result.005 file - promoters50/1710051
aaatctataa

SEQ ID NO: 177033 - DNA, 10 bp, Unknown
  misc_feature (1)..( 10): Result.005 file - promoters50/1710051
caatttataa

SEQ ID NO: 177034 - DNA, 10 bp, Unknown
  misc_feature (1)..( 10): Result.005 file - promoters50/1710051
caatttaaaa

SEQ ID NO: 177035 - DNA, 8 bp, Unknown
  misc_feature (1)..( 8): Result.005 file - promoters50/1710645
aatttcgt

SEQ ID NO: 177036 - DNA, 8 bp, Unknown
  misc_feature (1)..( 8): Result.005 file - promoters50/1710645
gatttcgt

SEQ ID NO: 177037 - DNA, 8 bp, Unknown
  misc_feature (1)..( 8): Result.005 file - promoters50/1710645
aatttcgg

SEQ ID NO: 177038 - DNA, 9 bp, Unknown
  misc_feature (1)..( 9): Result.005 file - promoters50/1710645
gaagatgaa

SEQ ID NO: 177039 - DNA, 9 bp, Unknown
  misc_feature (1)..( 9): Result.005 file - promoters50/1710645
tttgatgaa

SEQ ID NO: 177040 - DNA, 9 bp, Unknown
  misc_feature (1)..( 9): Result.005 file - promoters50/1710645
tttgttgac

SEQ ID NO: 177041 - DNA, 9 bp, Unknown
  misc_feature (1)..( 9): Result.005 file - promoters50/1710759
caccttttc

SEQ ID NO: 177042 - DNA, 9 bp, Unknown
  misc_feature (1)..( 9): Result.005 file - promoters50/1710759
atcctttta

SEQ ID NO: 177043 - DNA, 9 bp, Unknown
  misc_feature (1)..( 9): Result.005 file - promoters50/1710759
atcatttta

SEQ ID NO: 177044 - DNA, 9 bp, Unknown
  misc_feature (1)..( 9): Result.005 file - promoters50/1710759
atttaccaa

SEQ ID NO: 177045 - DNA, 9 bp, Unknown
  misc_feature (1)..( 9): Result.005 file - promoters50/1710759
ttttaacaa

SEQ ID NO: 177046 - DNA, 9 bp, Unknown
  misc_feature (1)..( 9): Result.005 file - promoters50/1710759
ttttaaagt

SEQ ID NO: 177047 - DNA, 8 bp, Unknown
  misc_feature (1)..( 8): Result.005 file - promoters50/1710759
caatttta

SEQ ID NO: 177048 - DNA, 8 bp, Unknown
  misc_feature (1)..( 8): Result.005 file - promoters50/1710759
aaattttt

SEQ ID NO: 177049 - DNA, 8 bp, Unknown
  misc_feature (1)..( 8): Result.005 file - promoters50/1710759
caatttta

SEQ ID NO: 177050 - DNA, 10 bp, Unknown
  misc_feature (1)..( 10): Result.005 file - promoters50/1711228
ttcttaagat

SEQ ID NO: 177051 - DNA, 10 bp, Unknown
  misc_feature (1)..( 10): Result.005 file - promoters50/1711228
ttcttaggtg

SEQ ID NO: 177052 - DNA, 10 bp, Unknown
  misc_feature (1)..( 10): Result.005 file - promoters50/1711228
atctttagat

SEQ ID NO: 177053 - DNA, 10 bp, Unknown
  misc_feature (1)..( 10): Result.005 file - promoters50/1711228
tgattagatt

SEQ ID NO: 177054 - DNA, 10 bp, Unknown
  misc_feature (1)..( 10): Result.005 file - promoters50/1711228
aattttagaa

SEQ ID NO: 177055 - DNA, 10 bp, Unknown
  misc_feature (1)..( 10): Result.005 file - promoters50/1711228
ttctttggat

SEQ ID NO: 177056 - DNA, 13 bp, Unknown
  misc_feature (1)..( 13): Result.005 file - promoters50/1711228
cattaggctttaa

SEQ ID NO: 177057 - DNA, 13 bp, Unknown
  misc_feature (1)..( 13): Result.005 file - promoters50/1711228
aattgggcccaat

SEQ ID NO: 177058 - DNA, 13 bp, Unknown
  misc_feature (1)..( 13): Result.005 file - promoters50/1711228
aaatgggcctaat

SEQ ID NO: 177059 - DNA, 13 bp, Unknown
  misc_feature (1)..( 13): Result.005 file - promoters50/1711228
aaataggcccatt

SEQ ID NO: 177060 - DNA, 13 bp, Unknown
  misc_feature (1)..( 13): Result.005 file - promoters50/1711228
gtttgggccaact

SEQ ID NO: 177061 - DNA, 13 bp, Unknown
  misc_feature (1)..( 13): Result.005 file - promoters50/1711228
agatgggcctgac

SEQ ID NO: 177062 - DNA, 19 bp, Unknown
  misc_feature (1)..( 19): Result.005 file - promoters50/1711318
aatttattttccaattccc

SEQ ID NO: 177063 - DNA, 19 bp, Unknown
  misc_feature (1)..( 19): Result.005 file - promoters50/1711318
catacggtttgcaaaatct

SEQ ID NO: 177064 - DNA, 19 bp, Unknown
  misc_feature (1)..( 19): Result.005 file - promoters50/1711318
gatctaacttccaaaaacg

SEQ ID NO: 177065 - DNA, 19 bp, Unknown
  misc_feature (1)..( 19): Result.005 file - promoters50/1711318
aatttattttccaaagctc

SEQ ID NO: 177066 - DNA, 19 bp, Unknown
  misc_feature (1)..( 19): Result.005 file - promoters50/1711318
gaaactcttttcaagaagt

SEQ ID NO: 177067 - DNA, 19 bp, Unknown
  misc_feature (1)..( 19): Result.005 file - promoters50/1711318
ccagggatgtgaaatatat

SEQ ID NO: 177068 - DNA, 19 bp, Unknown
  misc_feature (1)..( 19): Result.005 file - promoters50/1711318
tgattaatttctctacttg

SEQ ID NO: 177069 - DNA, 19 bp, Unknown
  misc_feature (1)..( 19): Result.005 file - promoters50/1711318
atatgcaacaccaaatatc

SEQ ID NO: 177070 - DNA, 13 bp, Unknown
  misc_feature (1)..( 13): Result.005 file - promoters50/1711318
ttttttgttgtta

SEQ ID NO: 177071 - DNA, 13 bp, Unknown
  misc_feature (1)..( 13): Result.005 file - promoters50/1711318
gaattttttggca

SEQ ID NO: 177072 - DNA, 14 bp, Unknown
  misc_feature (1)..( 14): Result.005 file - promoters50/1711318
gatttatgttgtta

SEQ ID NO: 177073 - DNA, 14 bp, Unknown
  misc_feature (1)..( 14): Result.005 file - promoters50/1711318
tacggctgttgttg

SEQ ID NO: 177074 - DNA, 14 bp, Unknown
  misc_feature (1)..( 14): Result.005 file - promoters50/1711318
attgtttgttgcgt

SEQ ID NO: 177075 - DNA, 14 bp, Unknown
  misc_feature (1)..( 14): Result.005 file - promoters50/1711318
atcgtttgtattat

SEQ ID NO: 177076 - DNA, 10 bp, Unknown
  misc_feature (1)..( 10): Result.005 file - promoters50/1711318
tatttgataa

SEQ ID NO: 177077 - DNA, 10 bp, Unknown
  misc_feature (1)..( 10): Result.005 file - promoters50/1711318
atttttataa

SEQ ID NO: 177078 - DNA, 10 bp, Unknown
  misc_feature (1)..( 10): Result.005 file - promoters50/1711318
tattagatcc

SEQ ID NO: 177079 - DNA, 10 bp, Unknown
  misc_feature (1)..( 10): Result.005 file - promoters50/1711318
catgttataa

SEQ ID NO: 177080 - DNA, 10 bp, Unknown
  misc_feature (1)..( 10): Result.005 file - promoters50/1711318
cggattataa

SEQ ID NO: 177081 - DNA, 10 bp, Unknown
  misc_feature (1)..( 10): Result.005 file - promoters50/1711318
gagcttatta

SEQ ID NO: 177082 - DNA, 9 bp, Unknown
  misc_feature (1)..( 9): Result.005 file - promoters50/1711318
aaattgaat

SEQ ID NO: 177083 - DNA, 9 bp, Unknown
  misc_feature (1)..( 9): Result.005 file - promoters50/1711318
taattgaac

SEQ ID NO: 177084 - DNA, 9 bp, Unknown
  misc_feature (1)..( 9): Result.005 file - promoters50/1711318
ggattgaag

SEQ ID NO: 177085 - DNA, 9 bp, Unknown
  misc_feature (1)..( 9): Result.005 file - promoters50/1711318
agattgaaa

SEQ ID NO: 177086 - DNA, 9 bp, Unknown
  misc_feature (1)..( 9): Result.005 file - promoters50/1711318
aaattgatt

SEQ ID NO: 177087 - DNA, 9 bp, Unknown
  misc_feature (1)..( 9): Result.005 file - promoters50/1711318
gcatttaac

SEQ ID NO: 177088 - DNA, 16 bp, Unknown
  misc_feature (1)..( 16): Result.005 file - promoters50/1711318
tataatactaattaat

SEQ ID NO: 177089 - DNA, 16 bp, Unknown
  misc_feature (1)..( 16): Result.005 file - promoters50/1711318
aataataataagtaaa

SEQ ID NO: 177090 - DNA, 16 bp, Unknown
  misc_feature (1)..( 16): Result.005 file - promoters50/1711318
taaagctttaattagc

SEQ ID NO: 177091 - DNA, 16 bp, Unknown
  misc_feature (1)..( 16): Result.005 file - promoters50/1711318
tataatttaatgcatc

SEQ ID NO: 177092 - DNA, 16 bp, Unknown
  misc_feature (1)..( 16): Result.005 file - promoters50/1711318
taaagagataagtctg

SEQ ID NO: 177093 - DNA, 16 bp, Unknown
  misc_feature (1)..( 16): Result.005 file - promoters50/1711318
aaaacttaaaagtaaa

SEQ ID NO: 177094 - DNA, 16 bp, Unknown
  misc_feature (1)..( 16): Result.005 file - promoters50/1711318
aagatggttatttatt

SEQ ID NO: 177095 - DNA, 16 bp, Unknown
  misc_feature (1)..( 16): Result.005 file - promoters50/1711318
ttgtctgttacttagc

SEQ ID NO: 177096 - DNA, 11 bp, Unknown
  misc_feature (1)..( 11): Result.005 file - promoters50/1711318
tgttttgacta

SEQ ID NO: 177097 - DNA, 11 bp, Unknown
  misc_feature (1)..( 11): Result.005 file - promoters50/1711318
tgtcttggacc

SEQ ID NO: 177098 - DNA, 11 bp, Unknown
  misc_feature (1)..( 11): Result.005 file - promoters50/1711318
gattttgataa

SEQ ID NO: 177099 - DNA, 11 bp, Unknown
  misc_feature (1)..( 11): Result.005 file - promoters50/1711318
tgtattttatc

SEQ ID NO: 177100 - DNA, 11 bp, Unknown
  misc_feature (1)..( 11): Result.005 file - promoters50/1711318
aatttttataa

SEQ ID NO: 177101 - DNA, 11 bp, Unknown
  misc_feature (1)..( 11): Result.005 file - promoters50/1711318
acatgttataa

SEQ ID NO: 177102 - DNA, 11 bp, Unknown
  misc_feature (1)..( 11): Result.005 file - promoters50/1711318
acggattataa

SEQ ID NO: 177103 - DNA, 10 bp, Unknown
  misc_feature (1)..( 10): Result.005 file - promoters50/1711318
gatgaattta

SEQ ID NO: 177104 - DNA, 10 bp, Unknown
  misc_feature (1)..( 10): Result.005 file - promoters50/1711318
gatcaatggc

SEQ ID NO: 177105 - DNA, 10 bp, Unknown
  misc_feature (1)..( 10): Result.005 file - promoters50/1711318
gattaatttc

SEQ ID NO: 177106 - DNA, 10 bp, Unknown
  misc_feature (1)..( 10): Result.005 file - promoters50/1711318
atctaacttc

SEQ ID NO: 177107 - DNA, 10 bp, Unknown
  misc_feature (1)..( 10): Result.005 file - promoters50/1711318
atgtaattta

SEQ ID NO: 177108 - DNA, 10 bp, Unknown
  misc_feature (1)..( 10): Result.005 file - promoters50/1711318
tatcagtggt

SEQ ID NO: 177109 - DNA, 12 bp, Unknown
  misc_feature (1)..( 12): Result.005 file - promoters50/1711318
gtatcgattatg

SEQ ID NO: 177110 - DNA, 12 bp, Unknown
  misc_feature (1)..( 12): Result.005 file - promoters50/1711318
ccatcaattagt

SEQ ID NO: 177111 - DNA, 12 bp, Unknown
  misc_feature (1)..( 12): Result.005 file - promoters50/1711318
atatctattggg

SEQ ID NO: 177112 - DNA, 12 bp, Unknown
  misc_feature (1)..( 12): Result.005 file - promoters50/1711318
tgcacaatcagt

SEQ ID NO: 177113 - DNA, 12 bp, Unknown
  misc_feature (1)..( 12): Result.005 file - promoters50/1711318
acatcaaatagt

SEQ ID NO: 177114 - DNA, 12 bp, Unknown
  misc_feature (1)..( 12): Result.005 file - promoters50/1711318
ccatgaatttaa

SEQ ID NO: 177115 - DNA, 11 bp, Unknown
  misc_feature (1)..( 11): Result.005 file - promoters50/1711318
gatgaatttat

SEQ ID NO: 177116 - DNA, 11 bp, Unknown
  misc_feature (1)..( 11): Result.005 file - promoters50/1711318
gtgaaatatat

SEQ ID NO: 177117 - DNA, 11 bp, Unknown
  misc_feature (1)..( 11): Result.005 file - promoters50/1711318
gattaatttct

SEQ ID NO: 177118 - DNA, 11 bp, Unknown
  misc_feature (1)..( 11): Result.005 file - promoters50/1711318
aacctatatat

SEQ ID NO: 177119 - DNA, 11 bp, Unknown
  misc_feature (1)..( 11): Result.005 file - promoters50/1711318
atctaacttcc

SEQ ID NO: 177120 - DNA, 11 bp, Unknown
  misc_feature (1)..( 11): Result.005 file - promoters50/1711318
atgtaatttat

SEQ ID NO: 177121 - DNA, 11 bp, Unknown
  misc_feature (1)..( 11): Result.005 file - promoters50/1711318
accaaatatca

SEQ ID NO: 177122 - DNA, 8 bp, Unknown
  misc_feature (1)..( 8): Result.005 file - promoters50/1711318
gttttttt

SEQ ID NO: 177123 - DNA, 8 bp, Unknown
  misc_feature (1)..( 8): Result.005 file - promoters50/1711318
gttattta

SEQ ID NO: 177124 - DNA, 8 bp, Unknown
  misc_feature (1)..( 8): Result.005 file - promoters50/1711318
attttttt

SEQ ID NO: 177125 - DNA, 8 bp, Unknown
  misc_feature (1)..( 8): Result.005 file - promoters50/1711318
tttaatta

SEQ ID NO: 177126 - DNA, 8 bp, Unknown
  misc_feature (1)..( 8): Result.005 file - promoters50/1711318
tttaatgc

SEQ ID NO: 177127 - DNA, 8 bp, Unknown
  misc_feature (1)..( 8): Result.005 file - promoters50/1711318
gttactta

SEQ ID NO: 177128 - DNA, 16 bp, Unknown
  misc_feature (1)..( 16): Result.005 file - promoters50/1711586
ttgcccaaaaaataat

SEQ ID NO: 177129 - DNA, 16 bp, Unknown
  misc_feature (1)..( 16): Result.005 file - promoters50/1711586
atatatgaaatataaa

SEQ ID NO: 177130 - DNA, 16 bp, Unknown
  misc_feature (1)..( 16): Result.005 file - promoters50/1711586
ttattcaaaacataaa

SEQ ID NO: 177131 - DNA, 16 bp, Unknown
  misc_feature (1)..( 16): Result.005 file - promoters50/1711586
agtgtcaaaaaataat

SEQ ID NO: 177132 - DNA, 16 bp, Unknown
  misc_feature (1)..( 16): Result.005 file - promoters50/1711586
ctttacggtatataat

SEQ ID NO: 177133 - DNA, 16 bp, Unknown
  misc_feature (1)..( 16): Result.005 file - promoters50/1711586
tatatcaaaagtgtat

SEQ ID NO: 177134 - DNA, 16 bp, Unknown
  misc_feature (1)..( 16): Result.005 file - promoters50/1711586
ttattcaaaacccaac

SEQ ID NO: 177135 - DNA, 11 bp, Unknown
  misc_feature (1)..( 11): Result.005 file - promoters50/1711586
gatatatcaat

SEQ ID NO: 177136 - DNA, 11 bp, Unknown
  misc_feature (1)..( 11): Result.005 file - promoters50/1711586
gatatagcaaa

SEQ ID NO: 177137 - DNA, 11 bp, Unknown
  misc_feature (1)..( 11): Result.005 file - promoters50/1711586
catatatcgtg

SEQ ID NO: 177138 - DNA, 11 bp, Unknown
  misc_feature (1)..( 11): Result.005 file - promoters50/1711586
aatacatccct

SEQ ID NO: 177139 - DNA, 11 bp, Unknown
  misc_feature (1)..( 11): Result.005 file - promoters50/1711586
tatattgcaag

SEQ ID NO: 177140 - DNA, 11 bp, Unknown
  misc_feature (1)..( 11): Result.005 file - promoters50/1711586
aatattgcaaa

SEQ ID NO: 177141 - DNA, 10 bp, Unknown
  misc_feature (1)..( 10): Result.005 file - promoters50/1711626
aattaatctc

SEQ ID NO: 177142 - DNA, 10 bp, Unknown
  misc_feature (1)..( 10): Result.005 file - promoters50/1711626
aataaattat

SEQ ID NO: 177143 - DNA, 10 bp, Unknown
  misc_feature (1)..( 10): Result.005 file - promoters50/1711626
tgttactctc

SEQ ID NO: 177144 - DNA, 6 bp, Unknown
  misc_feature (1)..( 6): Result.005 file - promoters50/1711626
attcga

SEQ ID NO: 177145 - DNA, 6 bp, Unknown
  misc_feature (1)..( 6): Result.005 file - promoters50/1711626
attcga

SEQ ID NO: 177146 - DNA, 6 bp, Unknown
  misc_feature (1)..( 6): Result.005 file - promoters50/1711626
attcga

SEQ ID NO: 177147 - DNA, 8 bp, Unknown
  misc_feature (1)..( 8): Result.005 file - promoters50/1711626
aattcaac

SEQ ID NO: 177148 - DNA, 8 bp, Unknown
  misc_feature (1)..( 8): Result.005 file - promoters50/1711626
aatacaat

SEQ ID NO: 177149 - DNA, 8 bp, Unknown
  misc_feature (1)..( 8): Result.005 file - promoters50/1711626
tatataat

SEQ ID NO: 177150 - DNA, 7 bp, Unknown
  misc_feature (1)..( 7): Result.005 file - promoters50/1711626
atttgat

SEQ ID NO: 177151 - DNA, 7 bp, Unknown
  misc_feature (1)..( 7): Result.005 file - promoters50/1711626
attcgat

SEQ ID NO: 177152 - DNA, 7 bp, Unknown
  misc_feature (1)..( 7): Result.005 file - promoters50/1711626
attcgac

SEQ ID NO: 177153 - DNA, 10 bp, Unknown
  misc_feature (1)..( 10): Result.005 file - promoters50/1711638
taattaatta

SEQ ID NO: 177154 - DNA, 10 bp, Unknown
  misc_feature (1)..( 10): Result.005 file - promoters50/1711638
caattaatta

SEQ ID NO: 177155 - DNA, 11 bp, Unknown
  misc_feature (1)..( 11): Result.005 file - promoters50/1711638
atatctattta

SEQ ID NO: 177156 - DNA, 11 bp, Unknown
  misc_feature (1)..( 11): Result.005 file - promoters50/1711638
cgatctttttg

SEQ ID NO: 177157 - DNA, 8 bp, Unknown
  misc_feature (1)..( 8): Result.005 file - promoters50/1711638
gtaaaaag

SEQ ID NO: 177158 - DNA, 8 bp, Unknown
  misc_feature (1)..( 8): Result.005 file - promoters50/1711638
agaaaaag

SEQ ID NO: 177159 - DNA, 8 bp, Unknown
  misc_feature (1)..( 8): Result.005 file - promoters50/1711638
agaataag

SEQ ID NO: 177160 - DNA, 8 bp, Unknown
  misc_feature (1)..( 8): Result.005 file - promoters50/1711638
agaaaaat

SEQ ID NO: 177161 - DNA, 10 bp, Unknown
  misc_feature (1)..( 10): Result.005 file - promoters50/1711638
tttggattta

SEQ ID NO: 177162 - DNA, 10 bp, Unknown
  misc_feature (1)..( 10): Result.005 file - promoters50/1711638
ttttgatgat

SEQ ID NO: 177163 - DNA, 10 bp, Unknown
  misc_feature (1)..( 10): Result.005 file - promoters50/1711638
catggaatta

SEQ ID NO: 177164 - DNA, 10 bp, Unknown
  misc_feature (1)..( 10): Result.005 file - promoters50/1711638
gtttgatatc

SEQ ID NO: 177165 - DNA, 12 bp, Unknown
  misc_feature (1)..( 12): Result.005 file - promoters50/1711638
attagatttttt

SEQ ID NO: 177166 - DNA, 12 bp, Unknown
  misc_feature (1)..( 12): Result.005 file - promoters50/1711638
attcgatctttt

SEQ ID NO: 177167 - DNA, 12 bp, Unknown
  misc_feature (1)..( 12): Result.005 file - promoters50/1711638
cgattgtttttt

SEQ ID NO: 177168 - DNA, 13 bp, Unknown
  misc_feature (1)..( 13): Result.005 file - promoters50/1711638
ttgatatctattt

SEQ ID NO: 177169 - DNA, 9 bp, Unknown
  misc_feature (1)..( 9): Result.005 file - promoters50/1711650
taaactttt

SEQ ID NO: 177170 - DNA, 9 bp, Unknown
  misc_feature (1)..( 9): Result.005 file - promoters50/1711650
taaacgttt

SEQ ID NO: 177171 - DNA, 9 bp, Unknown
  misc_feature (1)..( 9): Result.005 file - promoters50/1711650
gaaagtttt

SEQ ID NO: 177172 - DNA, 13 bp, Unknown
  misc_feature (1)..( 13): Result.005 file - promoters50/1711650
tgtgataaataag

SEQ ID NO: 177173 - DNA, 13 bp, Unknown
  misc_feature (1)..( 13): Result.005 file - promoters50/1711650
tgttataaatttc

SEQ ID NO: 177174 - DNA, 13 bp, Unknown
  misc_feature (1)..( 13): Result.005 file - promoters50/1711650
ccatgtaattttc

SEQ ID NO: 177175 - DNA, 10 bp, Unknown
  misc_feature (1)..( 10): Result.005 file - promoters50/1711650
tttttacttt

SEQ ID NO: 177176 - DNA, 10 bp, Unknown
  misc_feature (1)..( 10): Result.005 file - promoters50/1711650
tgtttatttt

SEQ ID NO: 177177 - DNA, 10 bp, Unknown
  misc_feature (1)..( 10): Result.005 file - promoters50/1711650
tgtttatttg

SEQ ID NO: 177178 - DNA, 7 bp, Unknown
  misc_feature (1)..( 7): Result.005 file - promoters50/1711650
aaatttc

SEQ ID NO: 177179 - DNA, 7 bp, Unknown
  misc_feature (1)..( 7): Result.005 file - promoters50/1711650
caatttc

SEQ ID NO: 177180 - DNA, 7 bp, Unknown
  misc_feature (1)..( 7): Result.005 file - promoters50/1711650
caattta

SEQ ID NO: 177181 - DNA, 16 bp, Unknown
  misc_feature (1)..( 16): Result.005 file - promoters50/1711662
tcggttaatttacata

SEQ ID NO: 177182 - DNA, 16 bp, Unknown
  misc_feature (1)..( 16): Result.005 file - promoters50/1711662
tcggttaatttgcata

SEQ ID NO: 177183 - DNA, 16 bp, Unknown
  misc_feature (1)..( 16): Result.005 file - promoters50/1711662
cagtctaaattgggtt

SEQ ID NO: 177184 - DNA, 7 bp, Unknown
  misc_feature (1)..( 7): Result.005 file - promoters50/1711666
gattaaa

SEQ ID NO: 177185 - DNA, 7 bp, Unknown
  misc_feature (1)..( 7): Result.005 file - promoters50/1711666
aattaaa

SEQ ID NO: 177186 - DNA, 7 bp, Unknown
  misc_feature (1)..( 7): Result.005 file - promoters50/1711666
atttaaa

SEQ ID NO: 177187 - DNA, 7 bp, Unknown
  misc_feature (1)..( 7): Result.005 file - promoters50/1711666
attattt

SEQ ID NO: 177188 - DNA, 7 bp, Unknown
  misc_feature (1)..( 7): Result.005 file - promoters50/1711666
attattt

SEQ ID NO: 177189 - DNA, 7 bp, Unknown
  misc_feature (1)..( 7): Result.005 file - promoters50/1711666
atttttt

SEQ ID NO: 177190 - DNA, 9 bp, Unknown
  misc_feature (1)..( 9): Result.005 file - promoters50/1711666
ttaatcaaa

SEQ ID NO: 177191 - DNA, 9 bp, Unknown
  misc_feature (1)..( 9): Result.005 file - promoters50/1711666
taaataaaa

SEQ ID NO: 177192 - DNA, 9 bp, Unknown
  misc_feature (1)..( 9): Result.005 file - promoters50/1711666
ttaataaaa

SEQ ID NO: 177193 - DNA, 9 bp, Unknown
  misc_feature (1)..( 9): Result.005 file - promoters50/1711666
ttatgtttt

SEQ ID NO: 177194 - DNA, 9 bp, Unknown
  misc_feature (1)..( 9): Result.005 file - promoters50/1711666
ttatttttt

SEQ ID NO: 177195 - DNA, 9 bp, Unknown
  misc_feature (1)..( 9): Result.005 file - promoters50/1711666
atatttttg

SEQ ID NO: 177196 - DNA, 11 bp, Unknown
  misc_feature (1)..( 11): Result.005 file - promoters50/1711691
tattgaacaca

SEQ ID NO: 177197 - DNA, 11 bp, Unknown
  misc_feature (1)..( 11): Result.005 file - promoters50/1711691
aattgaaccaa

SEQ ID NO: 177198 - DNA, 11 bp, Unknown
  misc_feature (1)..( 11): Result.005 file - promoters50/1711691
tatcgaactct

SEQ ID NO: 177199 - DNA, 11 bp, Unknown
  misc_feature (1)..( 11): Result.005 file - promoters50/1711691
gactgaaacaa

SEQ ID NO: 177200 - DNA, 8 bp, Unknown
  misc_feature (1)..( 8): Result.005 file - promoters50/1711691
gtaaattt

SEQ ID NO: 177201 - DNA, 8 bp, Unknown
  misc_feature (1)..( 8): Result.005 file - promoters50/1711691
tcaaattt

SEQ ID NO: 177202 - DNA, 8 bp, Unknown
  misc_feature (1)..( 8): Result.005 file - promoters50/1711691
gtacatta

SEQ ID NO: 177203 - DNA, 10 bp, Unknown
  misc_feature (1)..( 10): Result.005 file - promoters50/1711691
aaaccaaaat

SEQ ID NO: 177204 - DNA, 10 bp, Unknown
  misc_feature (1)..( 10): Result.005 file - promoters50/1711691
aaaccaaaat

SEQ ID NO: 177205 - DNA, 10 bp, Unknown
  misc_feature (1)..( 10): Result.005 file - promoters50/1711691
aaaacaagga

SEQ ID NO: 177206 - DNA, 8 bp, Unknown
  misc_feature (1)..( 8): Result.005 file - promoters50/1711691
ttttctta

SEQ ID NO: 177207 - DNA, 8 bp, Unknown
  misc_feature (1)..( 8): Result.005 file - promoters50/1711691
ttttttta

SEQ ID NO: 177208 - DNA, 8 bp, Unknown
  misc_feature (1)..( 8): Result.005 file - promoters50/1711691
tttttttt

SEQ ID NO: 177209 - DNA, 8 bp, Unknown
  misc_feature (1)..( 8): Result.005 file - promoters50/1711691
tttttttt

SEQ ID NO: 177210 - DNA, 8 bp, Unknown
  misc_feature (1)..( 8): Result.005 file - promoters50/1711691
ttttttct

SEQ ID NO: 177211 - DNA, 8 bp, Unknown
  misc_feature (1)..( 8): Result.005 file - promoters50/1711691
tttttttt

SEQ ID NO: 177212 - DNA, 25 bp, Unknown
  misc_feature (1)..( 25): Result.005 file - promoters50/1711691
ccgtgcacgtagaccacaccactct

SEQ ID NO: 177213 - DNA, 25 bp, Unknown
  misc_feature (1)..( 25): Result.005 file - promoters50/1711691
gcgttcacgtagacttccactagtt

SEQ ID NO: 177214 - DNA, 25 bp, Unknown
  misc_feature (1)..( 25): Result.005 file - promoters50/1711691
ccgtgcacgtacaccacacaactct

SEQ ID NO: 177215 - DNA, 9 bp, Unknown
  misc_feature (1)..( 9): Result.005 file - promoters50/1712122
agtactaat

SEQ ID NO: 177216 - DNA, 9 bp, Unknown
  misc_feature (1)..( 9): Result.005 file - promoters50/1712122
agttctaat

SEQ ID NO: 177217 - DNA, 9 bp, Unknown
  misc_feature (1)..( 9): Result.005 file - promoters50/1712122
agttataac

SEQ ID NO: 177218 - DNA, 9 bp, Unknown
  misc_feature (1)..( 9): Result.005 file - promoters50/1712122
tatattaca

SEQ ID NO: 177219 - DNA, 7 bp, Unknown
  misc_feature (1)..( 7): Result.005 file - promoters50/1712122
atataaa

SEQ ID NO: 177220 - DNA, 7 bp, Unknown
  misc_feature (1)..( 7): Result.005 file - promoters50/1712122
atataac

SEQ ID NO: 177221 - DNA, 8 bp, Unknown
  misc_feature (1)..( 8): Result.005 file - promoters50/1712122
atatgaat

SEQ ID NO: 177222 - DNA, 8 bp, Unknown
  misc_feature (1)..( 8): Result.005 file - promoters50/1712122
ataaaacg

SEQ ID NO: 177223 - DNA, 8 bp, Unknown
  misc_feature (1)..( 8): Result.005 file - promoters50/1712134
ctttttct

SEQ ID NO: 177224 - DNA, 8 bp, Unknown
  misc_feature (1)..( 8): Result.005 file - promoters50/1712134
atttttcc

SEQ ID NO: 177225 - DNA, 8 bp, Unknown
  misc_feature (1)..( 8): Result.005 file - promoters50/1712134
atttttga

SEQ ID NO: 177226 - DNA, 8 bp, Unknown
  misc_feature (1)..( 8): Result.005 file - promoters50/1712134
gtttgtga

SEQ ID NO: 177227 - DNA, 8 bp, Unknown
  misc_feature (1)..( 8): Result.005 file - promoters50/1712134
attttgaa

SEQ ID NO: 177228 - DNA, 8 bp, Unknown
  misc_feature (1)..( 8): Result.005 file - promoters50/1712134
tttttgaa

SEQ ID NO: 177229 - DNA, 8 bp, Unknown
  misc_feature (1)..( 8): Result.005 file - promoters50/1712134
tttttgcc

SEQ ID NO: 177230 - DNA, 9 bp, Unknown
  misc_feature (1)..( 9): Result.005 file - promoters50/1712134
ttttctgcc

SEQ ID NO: 177231 - DNA, 11 bp, Unknown
  misc_feature (1)..( 11): Result.005 file - promoters50/1712134
aagtttttaca

SEQ ID NO: 177232 - DNA, 11 bp, Unknown
  misc_feature (1)..( 11): Result.005 file - promoters50/1712134
aagtttttgaa

SEQ ID NO: 177233 - DNA, 11 bp, Unknown
  misc_feature (1)..( 11): Result.005 file - promoters50/1712134
ttttttttgcc

SEQ ID NO: 177234 - DNA, 12 bp, Unknown
  misc_feature (1)..( 12): Result.005 file - promoters50/1712134
gtcttttctgcc

SEQ ID NO: 177235 - DNA, 10 bp, Unknown
  misc_feature (1)..( 10): Result.005 file - promoters50/1712134
taactttttc

SEQ ID NO: 177236 - DNA, 10 bp, Unknown
  misc_feature (1)..( 10): Result.005 file - promoters50/1712134
taatttttga

SEQ ID NO: 177237 - DNA, 10 bp, Unknown
  misc_feature (1)..( 10): Result.005 file - promoters50/1712134
ttttttttgc

SEQ ID NO: 177238 - DNA, 10 bp, Unknown
  misc_feature (1)..( 10): Result.005 file - promoters50/1712134
cggtttgtga

SEQ ID NO: 177239 - DNA, 11 bp, Unknown
  misc_feature (1)..( 11): Result.005 file - promoters50/1712150
tctatataaat

SEQ ID NO: 177240 - DNA, 11 bp, Unknown
  misc_feature (1)..( 11): Result.005 file - promoters50/1712150
cccatataaaa

SEQ ID NO: 177241 - DNA, 11 bp, Unknown
  misc_feature (1)..( 11): Result.005 file - promoters50/1712150
caaatatatat

SEQ ID NO: 177242 - DNA, 11 bp, Unknown
  misc_feature (1)..( 11): Result.005 file - promoters50/1712150
tttatttattc

SEQ ID NO: 177243 - DNA, 11 bp, Unknown
  misc_feature (1)..( 11): Result.005 file - promoters50/1712150
cccaaataaag

SEQ ID NO: 177244 - DNA, 11 bp, Unknown
  misc_feature (1)..( 11): Result.005 file - promoters50/1712150
tagttataaaa

SEQ ID NO: 177245 - DNA, 12 bp, Unknown
  misc_feature (1)..( 12): Result.005 file - promoters50/1712150
tataaatacaga

SEQ ID NO: 177246 - DNA, 12 bp, Unknown
  misc_feature (1)..( 12): Result.005 file - promoters50/1712150
cccaaataaaga

SEQ ID NO: 177247 - DNA, 12 bp, Unknown
  misc_feature (1)..( 12): Result.005 file - promoters50/1712150
caaatatatata

SEQ ID NO: 177248 - DNA, 12 bp, Unknown
  misc_feature (1)..( 12): Result.005 file - promoters50/1712150
tttatttattcc

SEQ ID NO: 177249 - DNA, 12 bp, Unknown
  misc_feature (1)..( 12): Result.005 file - promoters50/1712150
cccatataaaac

SEQ ID NO: 177250 - DNA, 12 bp, Unknown
  misc_feature (1)..( 12): Result.005 file - promoters50/1712150
tagttataaaaa

SEQ ID NO: 177251 - DNA, 7 bp, Unknown
  misc_feature (1)..( 7): Result.005 file - promoters50/1712174
ttttatc

SEQ ID NO: 177252 - DNA, 7 bp, Unknown
  misc_feature (1)..( 7): Result.005 file - promoters50/1712174
atttatc

SEQ ID NO: 177253 - DNA, 7 bp, Unknown
  misc_feature (1)..( 7): Result.005 file - promoters50/1712174
ttttatc

SEQ ID NO: 177254 - DNA, 7 bp, Unknown
  misc_feature (1)..( 7): Result.005 file - promoters50/1712174
aaatcta

SEQ ID NO: 177255 - DNA, 7 bp, Unknown
  misc_feature (1)..( 7): Result.005 file - promoters50/1712174
gaatcta

SEQ ID NO: 177256 - DNA, 7 bp, Unknown
  misc_feature (1)..( 7): Result.005 file - promoters50/1712174
gaatctc

SEQ ID NO: 177257 - DNA, 8 bp, Unknown
  misc_feature (1)..( 8): Result.005 file - promoters50/1712174
actatttg

SEQ ID NO: 177258 - DNA, 8 bp, Unknown
  misc_feature (1)..( 8): Result.005 file - promoters50/1712174
attatttg

SEQ ID NO: 177259 - DNA, 8 bp, Unknown
  misc_feature (1)..( 8): Result.005 file - promoters50/1712174
attgtttt

SEQ ID NO: 177260 - DNA, 9 bp, Unknown
  misc_feature (1)..( 9): Result.005 file - promoters50/1712174
gtcaaatcc

SEQ ID NO: 177261 - DNA, 9 bp, Unknown
  misc_feature (1)..( 9): Result.005 file - promoters50/1712174
gtcaaaaaa

SEQ ID NO: 177262 - DNA, 9 bp, Unknown
  misc_feature (1)..( 9): Result.005 file - promoters50/1712174
ctcaaaaaa

SEQ ID NO: 177263 - DNA, 10 bp, Unknown
  misc_feature (1)..( 10): Result.005 file - promoters50/1713776
ttttgtcttt

SEQ ID NO: 177264 - DNA, 10 bp, Unknown
  misc_feature (1)..( 10): Result.005 file - promoters50/1713776
ttttatcttt

SEQ ID NO: 177265 - DNA, 10 bp, Unknown
  misc_feature (1)..( 10): Result.005 file - promoters50/1713776
atttatccgg

SEQ ID NO: 177266 - DNA, 14 bp, Unknown
  misc_feature (1)..( 14): Result.005 file - promoters50/1713780
tattcaaaacataa

SEQ ID NO: 177267 - DNA, 14 bp, Unknown
  misc_feature (1)..( 14): Result.005 file - promoters50/1713780
tgcccaaaaaataa

SEQ ID NO: 177268 - DNA, 14 bp, Unknown
  misc_feature (1)..( 14): Result.005 file - promoters50/1713780
tatacaaaatatat

SEQ ID NO: 177269 - DNA, 14 bp, Unknown
  misc_feature (1)..( 14): Result.005 file - promoters50/1713780
tcctttaaacatta

SEQ ID NO: 177270 - DNA, 14 bp, Unknown
  misc_feature (1)..( 14): Result.005 file - promoters50/1713780
catttctaatctat

SEQ ID NO: 177271 - DNA, 11 bp, Unknown
  misc_feature (1)..( 11): Result.005 file - promoters50/1713780
cacaaattatc

SEQ ID NO: 177272 - DNA, 11 bp, Unknown
  misc_feature (1)..( 11): Result.005 file - promoters50/1713780
aataaaatatg

SEQ ID NO: 177273 - DNA, 11 bp, Unknown
  misc_feature (1)..( 11): Result.005 file - promoters50/1713780
taaaaaataga

SEQ ID NO: 177274 - DNA, 11 bp, Unknown
  misc_feature (1)..( 11): Result.005 file - promoters50/1713780
aataaaataac

SEQ ID NO: 177275 - DNA, 11 bp, Unknown
  misc_feature (1)..( 11): Result.005 file - promoters50/1713780
tgtaaaagatg

SEQ ID NO: 177276 - DNA, 12 bp, Unknown
  misc_feature (1)..( 12): Result.005 file - promoters50/1713780
aacttaaaaata

SEQ ID NO: 177277 - DNA, 12 bp, Unknown
  misc_feature (1)..( 12): Result.005 file - promoters50/1713780
agactaaatata

SEQ ID NO: 177278 - DNA, 12 bp, Unknown
  misc_feature (1)..( 12): Result.005 file - promoters50/1713780
ataacaaatatg

SEQ ID NO: 177279 - DNA, 12 bp, Unknown
  misc_feature (1)..( 12): Result.005 file - promoters50/1713780
ttgtaaaaaata

SEQ ID NO: 177280 - DNA, 12 bp, Unknown
  misc_feature (1)..( 12): Result.005 file - promoters50/1713780
ttgtaaaagatg

SEQ ID NO: 177281 - DNA, 10 bp, Unknown
  misc_feature (1)..( 10): Result.005 file - promoters50/1713780
aaaaaaaatt

SEQ ID NO: 177282 - DNA, 10 bp, Unknown
  misc_feature (1)..( 10): Result.005 file - promoters50/1713780
taaaacaata

SEQ ID NO: 177283 - DNA, 10 bp, Unknown
  misc_feature (1)..( 10): Result.005 file - promoters50/1713780
accaactata

SEQ ID NO: 177284 - DNA, 10 bp, Unknown
  misc_feature (1)..( 10): Result.005 file - promoters50/1713780
taacacattt

SEQ ID NO: 177285 - DNA, 10 bp, Unknown
  misc_feature (1)..( 10): Result.005 file - promoters50/1713780
caaaacacgg

SEQ ID NO: 177286 - DNA, 10 bp, Unknown
  misc_feature (1)..( 10): Result.005 file - promoters50/1713804
cataagtttc

SEQ ID NO: 177287 - DNA, 10 bp, Unknown
  misc_feature (1)..( 10): Result.005 file - promoters50/1713804
tatatgtttc

SEQ ID NO: 177288 - DNA, 10 bp, Unknown
  misc_feature (1)..( 10): Result.005 file - promoters50/1713804
aatatttgta

SEQ ID NO: 177289 - DNA, 10 bp, Unknown
  misc_feature (1)..( 10): Result.005 file - promoters50/1713804
caaaattata

SEQ ID NO: 177290 - DNA, 11 bp, Unknown
  misc_feature (1)..( 11): Result.005 file - promoters50/1713804
ccatagattca

SEQ ID NO: 177291 - DNA, 11 bp, Unknown
  misc_feature (1)..( 11): Result.005 file - promoters50/1713804
taaaagaatca

SEQ ID NO: 177292 - DNA, 11 bp, Unknown
  misc_feature (1)..( 11): Result.005 file - promoters50/1713804
taaaaaaatta

SEQ ID NO: 177293 - DNA, 11 bp, Unknown
  misc_feature (1)..( 11): Result.005 file - promoters50/1713804
tattagaaata

SEQ ID NO: 177294 - DNA, 10 bp, Unknown
  misc_feature (1)..( 10): Result.005 file - promoters50/1713804
tgatatttat

SEQ ID NO: 177295 - DNA, 10 bp, Unknown
  misc_feature (1)..( 10): Result.005 file - promoters50/1713804
caatatttgt

SEQ ID NO: 177296 - DNA, 10 bp, Unknown
  misc_feature (1)..( 10): Result.005 file - promoters50/1713804
ttatatatgt

SEQ ID NO: 177297 - DNA, 10 bp, Unknown
  misc_feature (1)..( 10): Result.005 file - promoters50/1713804
caaaattata

SEQ ID NO: 177298 - DNA, 9 bp, Unknown
  misc_feature (1)..( 9): Result.005 file - promoters50/1713804
tatgattaa

SEQ ID NO: 177299 - DNA, 9 bp, Unknown
  misc_feature (1)..( 9): Result.005 file - promoters50/1713804
tatcatttt

SEQ ID NO: 177300 - DNA, 10 bp, Unknown
  misc_feature (1)..( 10): Result.005 file - promoters50/1713804
catcaatttt

SEQ ID NO: 177301 - DNA, 10 bp, Unknown
  misc_feature (1)..( 10): Result.005 file - promoters50/1713804
tactaatttt

SEQ ID NO: 177302 - DNA, 7 bp, Unknown
  misc_feature (1)..( 7): Result.005 file - promoters50/1713804
ttatatc

SEQ ID NO: 177303 - DNA, 7 bp, Unknown
  misc_feature (1)..( 7): Result.005 file - promoters50/1713804
ttagatc

SEQ ID NO: 177304 - DNA, 7 bp, Unknown
  misc_feature (1)..( 7): Result.005 file - promoters50/1713804
ttatatc

SEQ ID NO: 177305 - DNA, 7 bp, Unknown
  misc_feature (1)..( 7): Result.005 file - promoters50/1713804
ttatatt

SEQ ID NO: 177306 - DNA, 13 bp, Unknown
  misc_feature (1)..( 13): Result.005 file - promoters50/1713839
tatacaaaatata

SEQ ID NO: 177307 - DNA, 13 bp, Unknown
  misc_feature (1)..( 13): Result.005 file - promoters50/1713839
tattcaaaacata

SEQ ID NO: 177308 - DNA, 13 bp, Unknown
  misc_feature (1)..( 13): Result.005 file - promoters50/1713839
cattggatagata

SEQ ID NO: 177309 - DNA, 7 bp, Unknown
  misc_feature (1)..( 7): Result.005 file - promoters50/1713839
aaaatat

SEQ ID NO: 177310 - DNA, 7 bp, Unknown
  misc_feature (1)..( 7): Result.005 file - promoters50/1713839
aaattat

SEQ ID NO: 177311 - DNA, 7 bp, Unknown
  misc_feature (1)..( 7): Result.005 file - promoters50/1713839
aaaataa

SEQ ID NO: 177312 - DNA, 7 bp, Unknown
  misc_feature (1)..( 7): Result.005 file - promoters50/1713839
aaactaa

SEQ ID NO: 177313 - DNA, 10 bp, Unknown
  misc_feature (1)..( 10): Result.005 file - promoters50/1713839
actaaataaa

SEQ ID NO: 177314 - DNA, 10 bp, Unknown
  misc_feature (1)..( 10): Result.005 file - promoters50/1713839
ccaaaataac

SEQ ID NO: 177315 - DNA, 10 bp, Unknown
  misc_feature (1)..( 10): Result.005 file - promoters50/1713839
actaaagaaa

SEQ ID NO: 177316 - DNA, 10 bp, Unknown
  misc_feature (1)..( 10): Result.005 file - promoters50/1713839
tagaaaaaaa

SEQ ID NO: 177317 - DNA, 11 bp, Unknown
  misc_feature (1)..( 11): Result.005 file - promoters50/1713839
aaccaaagata

SEQ ID NO: 177318 - DNA, 11 bp, Unknown
  misc_feature (1)..( 11): Result.005 file - promoters50/1713839
aacgaaagatc

SEQ ID NO: 177319 - DNA, 11 bp, Unknown
  misc_feature (1)..( 11): Result.005 file - promoters50/1713839
aaagaaaaatc

SEQ ID NO: 177320 - DNA, 9 bp, Unknown
  misc_feature (1)..( 9): Result.005 file - promoters50/1713839
agaaaagaa

SEQ ID NO: 177321 - DNA, 9 bp, Unknown
  misc_feature (1)..( 9): Result.005 file - promoters50/1713839
ggaaaagag

SEQ ID NO: 177322 - DNA, 9 bp, Unknown
  misc_feature (1)..( 9): Result.005 file - promoters50/1713839
agagaagaa

SEQ ID NO: 177323 - DNA, 9 bp, Unknown
  misc_feature (1)..( 9): Result.005 file - promoters50/1713842
agatacagt

SEQ ID NO: 177324 - DNA, 9 bp, Unknown
  misc_feature (1)..( 9): Result.005 file - promoters50/1713842
agagacatc

SEQ ID NO: 177325 - DNA, 9 bp, Unknown
  misc_feature (1)..( 9): Result.005 file - promoters50/1713842
cgatccaga

SEQ ID NO: 177326 - DNA, 9 bp, Unknown
  misc_feature (1)..( 9): Result.005 file - promoters50/1713842
ttataaagt

SEQ ID NO: 177327 - DNA, 11 bp, Unknown
  misc_feature (1)..( 11): Result.005 file - promoters50/1713895
attttctttat

SEQ ID NO: 177328 - DNA, 11 bp, Unknown
  misc_feature (1)..( 11): Result.005 file - promoters50/1713895
aatttatttgt

SEQ ID NO: 177329 - DNA, 11 bp, Unknown
  misc_feature (1)..( 11): Result.005 file - promoters50/1713895
cttttctgcct

SEQ ID NO: 177330 - DNA, 11 bp, Unknown
  misc_feature (1)..( 11): Result.005 file - promoters50/1713895
aatatatgctt

SEQ ID NO: 177331 - DNA, 11 bp, Unknown
  misc_feature (1)..( 11): Result.005 file - promoters50/1713895
tgtttatgcct

SEQ ID NO: 177332 - DNA, 11 bp, Unknown
  misc_feature (1)..( 11): Result.005 file - promoters50/1713895
tttttctcatt

SEQ ID NO: 177333 - DNA, 13 bp, Unknown
  misc_feature (1)..( 13): Result.005 file - promoters50/1713895
taatttatttgtg

SEQ ID NO: 177334 - DNA, 13 bp, Unknown
  misc_feature (1)..( 13): Result.005 file - promoters50/1713895
tcgtttacttgct

SEQ ID NO: 177335 - DNA, 13 bp, Unknown
  misc_feature (1)..( 13): Result.005 file - promoters50/1713895
acatttattagtg

SEQ ID NO: 177336 - DNA, 13 bp, Unknown
  misc_feature (1)..( 13): Result.005 file - promoters50/1713895
acatttttttctg

SEQ ID NO: 177337 - DNA, 13 bp, Unknown
  misc_feature (1)..( 13): Result.005 file - promoters50/1713895
tactttattctta

SEQ ID NO: 177338 - DNA, 13 bp, Unknown
  misc_feature (1)..( 13): Result.005 file - promoters50/1713895
taaattattctca

SEQ ID NO: 177339 - DNA, 13 bp, Unknown
  misc_feature (1)..( 13): Result.005 file - promoters50/1713895
cgatttttcattt

SEQ ID NO: 177340 - DNA, 12 bp, Unknown
  misc_feature (1)..( 12): Result.005 file - promoters50/1713895
ttaatatcttct

SEQ ID NO: 177341 - DNA, 12 bp, Unknown
  misc_feature (1)..( 12): Result.005 file - promoters50/1713895
attatattttca

SEQ ID NO: 177342 - DNA, 12 bp, Unknown
  misc_feature (1)..( 12): Result.005 file - promoters50/1713895
tatttattttct

SEQ ID NO: 177343 - DNA, 12 bp, Unknown
  misc_feature (1)..( 12): Result.005 file - promoters50/1713895
gttagatttttg

SEQ ID NO: 177344 - DNA, 12 bp, Unknown
  misc_feature (1)..( 12): Result.005 file - promoters50/1713895
ccaatatttcat

SEQ ID NO: 177345 - DNA, 12 bp, Unknown
  misc_feature (1)..( 12): Result.005 file - promoters50/1713895
tttttatttctt

SEQ ID NO: 177346 - DNA, 12 bp, Unknown
  misc_feature (1)..( 12): Result.005 file - promoters50/1713895
gtttgatctttt

SEQ ID NO: 177347 - DNA, 13 bp, Unknown
  misc_feature (1)..( 13): Result.005 file - promoters50/1713895
ataagaaaacatt

SEQ ID NO: 177348 - DNA, 13 bp, Unknown
  misc_feature (1)..( 13): Result.005 file - promoters50/1713895
acaagaaataaat

SEQ ID NO: 177349 - DNA, 13 bp, Unknown
  misc_feature (1)..( 13): Result.005 file - promoters50/1713895
atatgaaattatc

SEQ ID NO: 177350 - DNA, 13 bp, Unknown
  misc_feature (1)..( 13): Result.005 file - promoters50/1713895
ataataaatatga

SEQ ID NO: 177351 - DNA, 14 bp, Unknown
  misc_feature (1)..( 14): Result.005 file - promoters50/1713895
gtaatgtaattata

SEQ ID NO: 177352 - DNA, 14 bp, Unknown
  misc_feature (1)..( 14): Result.005 file - promoters50/1713895
ataataggttttta

SEQ ID NO: 177353 - DNA, 16 bp, Unknown
  misc_feature (1)..( 16): Result.005 file - promoters50/1713895
atgaaaaagtcaaaaa

SEQ ID NO: 177354 - DNA, 16 bp, Unknown
  misc_feature (1)..( 16): Result.005 file - promoters50/1713895
aaaaaaaagttcgtaa

SEQ ID NO: 177355 - DNA, 16 bp, Unknown
  misc_feature (1)..( 16): Result.005 file - promoters50/1713895
atgagaaagagaaaga

SEQ ID NO: 177356 - DNA, 16 bp, Unknown
  misc_feature (1)..( 16): Result.005 file - promoters50/1713895
ttaaaagagtttttag

SEQ ID NO: 177357 - DNA, 16 bp, Unknown
  misc_feature (1)..( 16): Result.005 file - promoters50/1713895
aacaaaaactcataaa

SEQ ID NO: 177358 - DNA, 16 bp, Unknown
  misc_feature (1)..( 16): Result.005 file - promoters50/1713895
caataaaactgtgagt

SEQ ID NO: 177359 - DNA, 8 bp, Unknown
  misc_feature (1)..( 8): Result.005 file - promoters50/1714500
tattttta

SEQ ID NO: 177360 - DNA, 8 bp, Unknown
  misc_feature (1)..( 8): Result.005 file - promoters50/1714500
tatttttt

SEQ ID NO: 177361 - DNA, 8 bp, Unknown
  misc_feature (1)..( 8): Result.005 file - promoters50/1714500
cattgtta

SEQ ID NO: 177362 - DNA, 8 bp, Unknown
  misc_feature (1)..( 8): Result.005 file - promoters50/1714500
tattttcg

SEQ ID NO: 177363 - DNA, 9 bp, Unknown
  misc_feature (1)..( 9): Result.005 file - promoters50/1714500
tatgttttc

SEQ ID NO: 177364 - DNA, 12 bp, Unknown
  misc_feature (1)..( 12): Result.005 file - promoters50/1714500
tttaagaaaata

SEQ ID NO: 177365 - DNA, 12 bp, Unknown
  misc_feature (1)..( 12): Result.005 file - promoters50/1714500
ggaatgaacata

SEQ ID NO: 177366 - DNA, 12 bp, Unknown
  misc_feature (1)..( 12): Result.005 file - promoters50/1714500
ttcgaaaaaatc

SEQ ID NO: 177367 - DNA, 12 bp, Unknown
  misc_feature (1)..( 12): Result.005 file - promoters50/1714500
ttttcgaaaaat

SEQ ID NO: 177368 - DNA, 10 bp, Unknown
  misc_feature (1)..( 10): Result.005 file - promoters50/1714541
tctcattcat

SEQ ID NO: 177369 - DNA, 10 bp, Unknown
  misc_feature (1)..( 10): Result.005 file - promoters50/1714541
cgtcatccat

SEQ ID NO: 177370 - DNA, 10 bp, Unknown
  misc_feature (1)..( 10): Result.005 file - promoters50/1714541
tctaattatt

SEQ ID NO: 177371 - DNA, 9 bp, Unknown
  misc_feature (1)..( 9): Result.005 file - promoters50/1714541
aatgttaca

SEQ ID NO: 177372 - DNA, 9 bp, Unknown
  misc_feature (1)..( 9): Result.005 file - promoters50/1714541
gatgttaac

SEQ ID NO: 177373 - DNA, 9 bp, Unknown
  misc_feature (1)..( 9): Result.005 file - promoters50/1714541
aatggtgtt

SEQ ID NO: 177374 - DNA, 8 bp, Unknown
  misc_feature (1)..( 8): Result.005 file - promoters50/1714639
ttaaaaca

SEQ ID NO: 177375 - DNA, 8 bp, Unknown
  misc_feature (1)..( 8): Result.005 file - promoters50/1714639
ataaaacc

SEQ ID NO: 177376 - DNA, 8 bp, Unknown
  misc_feature (1)..( 8): Result.005 file - promoters50/1714639
atacaacc

SEQ ID NO: 177377 - DNA, 8 bp, Unknown
  misc_feature (1)..( 8): Result.005 file - promoters50/1714682
atcagatt

SEQ ID NO: 177378 - DNA, 8 bp, Unknown
  misc_feature (1)..( 8): Result.005 file - promoters50/1714682
ctcaaatt

SEQ ID NO: 177379 - DNA, 8 bp, Unknown
  misc_feature (1)..( 8): Result.005 file - promoters50/1714682
atcagaaa

SEQ ID NO: 177380 - DNA, 10 bp, Unknown
  misc_feature (1)..( 10): Result.005 file - promoters50/1714682
ccttataacc

SEQ ID NO: 177381 - DNA, 10 bp, Unknown
  misc_feature (1)..( 10): Result.005 file - promoters50/1714682
aattaaaacc

SEQ ID NO: 177382 - DNA, 10 bp, Unknown
  misc_feature (1)..( 10): Result.005 file - promoters50/1714682
ccttttaaat

SEQ ID NO: 177383 - DNA, 8 bp, Unknown
  misc_feature (1)..( 8): Result.005 file - promoters50/1714682
attatctg

SEQ ID NO: 177384 - DNA, 8 bp, Unknown
  misc_feature (1)..( 8): Result.005 file - promoters50/1714682
attttctt

SEQ ID NO: 177385 - DNA, 8 bp, Unknown
  misc_feature (1)..( 8): Result.005 file - promoters50/1714682
tttttctt

SEQ ID NO: 177386 - DNA, 8 bp, Unknown
  misc_feature (1)..( 8): Result.005 file - promoters50/1714682
gaaccaac

SEQ ID NO: 177387 - DNA, 8 bp, Unknown
  misc_feature (1)..( 8): Result.005 file - promoters50/1714682
gaaacaat

SEQ ID NO: 177388 - DNA, 8 bp, Unknown
  misc_feature (1)..( 8): Result.005 file - promoters50/1714682
aaaacaat

SEQ ID NO: 177389 - DNA, 8 bp, Unknown
  misc_feature (1)..( 8): Result.005 file - promoters50/1714682
gaaacata

SEQ ID NO: 177390 - DNA, 10 bp, Unknown
  misc_feature (1)..( 10): Result.005 file - promoters50/1714682
tctatttata

SEQ ID NO: 177391 - DNA, 10 bp, Unknown
  misc_feature (1)..( 10): Result.005 file - promoters50/1714682
tctatatata

SEQ ID NO: 177392 - DNA, 10 bp, Unknown
  misc_feature (1)..( 10): Result.005 file - promoters50/1714682
tgtatataaa

SEQ ID NO: 177393 - DNA, 7 bp, Unknown
  misc_feature (1)..( 7): Result.005 file - promoters50/1714682
atcaaaa

SEQ ID NO: 177394 - DNA, 7 bp, Unknown
  misc_feature (1)..( 7): Result.005 file - promoters50/1714682
gtcaaaa

SEQ ID NO: 177395 - DNA, 7 bp, Unknown
  misc_feature (1)..( 7): Result.005 file - promoters50/1714682
atcgaaa

SEQ ID NO: 177396 - DNA, 8 bp, Unknown
  misc_feature (1)..( 8): Result.005 file - promoters50/1714682
aaaacaat

SEQ ID NO: 177397 - DNA, 8 bp, Unknown
  misc_feature (1)..( 8): Result.005 file - promoters50/1714682
aaaagaat

SEQ ID NO: 177398 - DNA, 8 bp, Unknown
  misc_feature (1)..( 8): Result.005 file - promoters50/1714682
gaaacaat

SEQ ID NO: 177399 - DNA, 8 bp, Unknown
  misc_feature (1)..( 8): Result.005 file - promoters50/1714682
catataaa

SEQ ID NO: 177400 - DNA, 8 bp, Unknown
  misc_feature (1)..( 8): Result.005 file - promoters50/1714682
tatataaa

SEQ ID NO: 177401 - DNA, 8 bp, Unknown
  misc_feature (1)..( 8): Result.005 file - promoters50/1714682
tatatata

SEQ ID NO: 177402 - DNA, 9 bp, Unknown
  misc_feature (1)..( 9): Result.005 file - promoters50/1714682
tcttaaaga

SEQ ID NO: 177403 - DNA, 9 bp, Unknown
  misc_feature (1)..( 9): Result.005 file - promoters50/1714682
tctttaagt

SEQ ID NO: 177404 - DNA, 9 bp, Unknown
  misc_feature (1)..( 9): Result.005 file - promoters50/1714682
aatttaagt

SEQ ID NO: 177405 - DNA, 7 bp, Unknown
  misc_feature (1)..( 7): Result.005 file - promoters50/1714682
ctataaa

SEQ ID NO: 177406 - DNA, 7 bp, Unknown
  misc_feature (1)..( 7): Result.005 file - promoters50/1714682
atataaa

SEQ ID NO: 177407 - DNA, 7 bp, Unknown
  misc_feature (1)..( 7): Result.005 file - promoters50/1714682
atatagc

SEQ ID NO: 177408 - DNA, 7 bp, Unknown
  misc_feature (1)..( 7): Result.005 file - promoters50/1714694
attgctt

SEQ ID NO: 177409 - DNA, 7 bp, Unknown
  misc_feature (1)..( 7): Result.005 file - promoters50/1714694
tttgctt

SEQ ID NO: 177410 - DNA, 7 bp, Unknown
  misc_feature (1)..( 7): Result.005 file - promoters50/1714694
tttactt

SEQ ID NO: 177411 - DNA, 8 bp, Unknown
  misc_feature (1)..( 8): Result.005 file - promoters50/1714694
ttgtattt

SEQ ID NO: 177412 - DNA, 8 bp, Unknown
  misc_feature (1)..( 8): Result.005 file - promoters50/1714694
ttgtatat

SEQ ID NO: 177413 - DNA, 8 bp, Unknown
  misc_feature (1)..( 8): Result.005 file - promoters50/1714694
atgtctat

SEQ ID NO: 177414 - DNA, 11 bp, Unknown
  misc_feature (1)..( 11): Result.005 file - promoters50/1714694
gttcaattttt

SEQ ID NO: 177415 - DNA, 11 bp, Unknown
  misc_feature (1)..( 11): Result.005 file - promoters50/1714694
tatcatttttt

SEQ ID NO: 177416 - DNA, 11 bp, Unknown
  misc_feature (1)..( 11): Result.005 file - promoters50/1714694
tatgattaagc

SEQ ID NO: 177417 - DNA, 7 bp, Unknown
  misc_feature (1)..( 7): Result.005 file - promoters50/1714772
aaacaaa

SEQ ID NO: 177418 - DNA, 7 bp, Unknown
  misc_feature (1)..( 7): Result.005 file - promoters50/1714772
aaacaaa

SEQ ID NO: 177419 - DNA, 7 bp, Unknown
  misc_feature (1)..( 7): Result.005 file - promoters50/1714772
aaagaaa

SEQ ID NO: 177420 - DNA, 9 bp, Unknown
  misc_feature (1)..( 9): Result.005 file - promoters50/1714772
aaattaagt

SEQ ID NO: 177421 - DNA, 9 bp, Unknown
  misc_feature (1)..( 9): Result.005 file - promoters50/1714772
aaagtaaag

SEQ ID NO: 177422 - DNA, 9 bp, Unknown
  misc_feature (1)..( 9): Result.005 file - promoters50/1714772
aaagaaaag

SEQ ID NO: 177423 - DNA, 9 bp, Unknown
  misc_feature (1)..( 9): Result.005 file - promoters50/1714772
gtttgtaaa

SEQ ID NO: 177424 - DNA, 9 bp, Unknown
  misc_feature (1)..( 9): Result.005 file - promoters50/1714772
ttttttaaa

SEQ ID NO: 177425 - DNA, 9 bp, Unknown
  misc_feature (1)..( 9): Result.005 file - promoters50/1714772
atttgttat

SEQ ID NO: 177426 - DNA, 8 bp, Unknown
  misc_feature (1)..( 8): Result.005 file - promoters50/1714772
aaaaagaa

SEQ ID NO: 177427 - DNA, 8 bp, Unknown
  misc_feature (1)..( 8): Result.005 file - promoters50/1714772
aaaaagtt

SEQ ID NO: 177428 - DNA, 8 bp, Unknown
  misc_feature (1)..( 8): Result.005 file - promoters50/1714772
aaaataaa

SEQ ID NO: 177429 - DNA, 9 bp, Unknown
  misc_feature (1)..( 9): Result.005 file - promoters50/1714772
aaaagaaaa

SEQ ID NO: 177430 - DNA, 9 bp, Unknown
  misc_feature (1)..( 9): Result.005 file - promoters50/1714772
taaataaaa

SEQ ID NO: 177431 - DNA, 9 bp, Unknown
  misc_feature (1)..( 9): Result.005 file - promoters50/1714772
aaaataaat

SEQ ID NO: 177432 - DNA, 6 bp, Unknown
  misc_feature (1)..( 6): Result.005 file - promoters50/1714806
atggga

SEQ ID NO: 177433 - DNA, 6 bp, Unknown
  misc_feature (1)..( 6): Result.005 file - promoters50/1714806
atggga

SEQ ID NO: 177434 - DNA, 6 bp, Unknown
  misc_feature (1)..( 6): Result.005 file - promoters50/1714806
atggga

SEQ ID NO: 177435 - DNA, 12 bp, Unknown
  misc_feature (1)..( 12): Result.005 file - promoters50/1714806
aaagatgggaaa

SEQ ID NO: 177436 - DNA, 12 bp, Unknown
  misc_feature (1)..( 12): Result.005 file - promoters50/1714806
aaaaatgaaaca

SEQ ID NO: 177437 - DNA, 12 bp, Unknown
  misc_feature (1)..( 12): Result.005 file - promoters50/1714806
aaagaaataaaa

SEQ ID NO: 177438 - DNA, 10 bp, Unknown
  misc_feature (1)..( 10): Result.005 file - promoters50/1714831
aaataatagt

SEQ ID NO: 177439 - DNA, 10 bp, Unknown
  misc_feature (1)..( 10): Result.005 file - promoters50/1714831
aaaaaattcc

SEQ ID NO: 177440 - DNA, 11 bp, Unknown
  misc_feature (1)..( 11): Result.005 file - promoters50/1714831
cacataatatt

SEQ ID NO: 177441 - DNA, 11 bp, Unknown
  misc_feature (1)..( 11): Result.005 file - promoters50/1714831
aaacaaataga

SEQ ID NO: 177442 - DNA, 11 bp, Unknown
  misc_feature (1)..( 11): Result.005 file - promoters50/1714831
ccaaaaatggc

SEQ ID NO: 177443 - DNA, 11 bp, Unknown
  misc_feature (1)..( 11): Result.005 file - promoters50/1714831
ataaaaacagt

SEQ ID NO: 177444 - DNA, 11 bp, Unknown
  misc_feature (1)..( 11): Result.005 file - promoters50/1714831
ctataaatatg

SEQ ID NO: 177445 - DNA, 9 bp, Unknown
  misc_feature (1)..( 9): Result.005 file - promoters50/1714837
aaaacaaaa

SEQ ID NO: 177446 - DNA, 9 bp, Unknown
  misc_feature (1)..( 9): Result.005 file - promoters50/1714837
ataacaaag

SEQ ID NO: 177447 - DNA, 10 bp, Unknown
  misc_feature (1)..( 10): Result.005 file - promoters50/1714837
taaacacaaa

SEQ ID NO: 177448 - DNA, 8 bp, Unknown
  misc_feature (1)..( 8): Result.005 file - promoters50/1714837
aatttaaa

SEQ ID NO: 177449 - DNA, 8 bp, Unknown
  misc_feature (1)..( 8): Result.005 file - promoters50/1714837
aatataac

SEQ ID NO: 177450 - DNA, 8 bp, Unknown
  misc_feature (1)..( 8): Result.005 file - promoters50/1714837
gattcaaa

SEQ ID NO: 177451 - DNA, 9 bp, Unknown
  misc_feature (1)..( 9): Result.005 file - promoters50/1714837
taaattagt

SEQ ID NO: 177452 - DNA, 9 bp, Unknown
  misc_feature (1)..( 9): Result.005 file - promoters50/1714837
caaattagt

SEQ ID NO: 177453 - DNA, 9 bp, Unknown
  misc_feature (1)..( 9): Result.005 file - promoters50/1714837
caaattgtt

SEQ ID NO: 177454 - DNA, 8 bp, Unknown
  misc_feature (1)..( 8): Result.005 file - promoters50/1714837
tataatta

SEQ ID NO: 177455 - DNA, 8 bp, Unknown
  misc_feature (1)..( 8): Result.005 file - promoters50/1714837
tataatta

SEQ ID NO: 177456 - DNA, 8 bp, Unknown
  misc_feature (1)..( 8): Result.005 file - promoters50/1714837
gctaatta

SEQ ID NO: 177457 - DNA, 11 bp, Unknown
  misc_feature (1)..( 11): Result.005 file - promoters50/1714857
tcatgaatacg

SEQ ID NO: 177458 - DNA, 11 bp, Unknown
  misc_feature (1)..( 11): Result.005 file - promoters50/1714857
agatgaattta

SEQ ID NO: 177459 - DNA, 11 bp, Unknown
  misc_feature (1)..( 11): Result.005 file - promoters50/1714857
tcaagaagaaa

SEQ ID NO: 177460 - DNA, 11 bp, Unknown
  misc_feature (1)..( 11): Result.005 file - promoters50/1714857
gtttgaactta

SEQ ID NO: 177461 - DNA, 11 bp, Unknown
  misc_feature (1)..( 11): Result.005 file - promoters50/1714857
tggagaggaag

SEQ ID NO: 177462 - DNA, 11 bp, Unknown
  misc_feature (1)..( 11): Result.005 file - promoters50/1714857
acatgtagagg

SEQ ID NO: 177463 - DNA, 15 bp, Unknown
  misc_feature (1)..( 15): Result.005 file - promoters50/1714857
attaatattatttta

SEQ ID NO: 177464 - DNA, 15 bp, Unknown
  misc_feature (1)..( 15): Result.005 file - promoters50/1714857
tttagacttaatttg

SEQ ID NO: 177465 - DNA, 15 bp, Unknown
  misc_feature (1)..( 15): Result.005 file - promoters50/1714857
atatgatttaatgat

SEQ ID NO: 177466 - DNA, 15 bp, Unknown
  misc_feature (1)..( 15): Result.005 file - promoters50/1714857
acatcttttaattaa

SEQ ID NO: 177467 - DNA, 15 bp, Unknown
  misc_feature (1)..( 15): Result.005 file - promoters50/1714857
cttataaaaaatttg

SEQ ID NO: 177468 - DNA, 15 bp, Unknown
  misc_feature (1)..( 15): Result.005 file - promoters50/1714857
gccacagctgatttc

SEQ ID NO: 177469 - DNA, 13 bp, Unknown
  misc_feature (1)..( 13): Result.005 file - promoters50/1714865
caaaacaaaacag

SEQ ID NO: 177470 - DNA, 13 bp, Unknown
  misc_feature (1)..( 13): Result.005 file - promoters50/1714865
caaaaaaaaaaaa

SEQ ID NO: 177471 - DNA, 14 bp, Unknown
  misc_feature (1)..( 14): Result.005 file - promoters50/1714865
aaaaatcaaaacga

SEQ ID NO: 177472 - DNA, 14 bp, Unknown
  misc_feature (1)..( 14): Result.005 file - promoters50/1714865
aaaaaacaaatcag

SEQ ID NO: 177473 - DNA, 14 bp, Unknown
  misc_feature (1)..( 14): Result.005 file - promoters50/1714865
gtaaataaagtaca

SEQ ID NO: 177474 - DNA, 12 bp, Unknown
  misc_feature (1)..( 12): Result.005 file - promoters50/1714865
ctttctaataaa

SEQ ID NO: 177475 - DNA, 12 bp, Unknown
  misc_feature (1)..( 12): Result.005 file - promoters50/1714865
ctttcaaataaa

SEQ ID NO: 177476 - DNA, 12 bp, Unknown
  misc_feature (1)..( 12): Result.005 file - promoters50/1714865
tcataaaataag

SEQ ID NO: 177477 - DNA, 12 bp, Unknown
  misc_feature (1)..( 12): Result.005 file - promoters50/1714865
cataaaaataaa

SEQ ID NO: 177478 - DNA, 12 bp, Unknown
  misc_feature (1)..( 12): Result.005 file - promoters50/1714865
tggtgaaaaaaa

SEQ ID NO: 177479 - DNA, 11 bp, Unknown
  misc_feature (1)..( 11): Result.005 file - promoters50/1714865
ataaaattcaa

SEQ ID NO: 177480 - DNA, 11 bp, Unknown
  misc_feature (1)..( 11): Result.005 file - promoters50/1714865
tggaaatacaa

SEQ ID NO: 177481 - DNA, 11 bp, Unknown
  misc_feature (1)..( 11): Result.005 file - promoters50/1714865
ataaaattggt

SEQ ID NO: 177482 - DNA, 11 bp, Unknown
  misc_feature (1)..( 11): Result.005 file - promoters50/1714865
aagaaataccc

SEQ ID NO: 177483 - DNA, 11 bp, Unknown
  misc_feature (1)..( 11): Result.005 file - promoters50/1714865
ataaaataagt

SEQ ID NO: 177484 - DNA, 12 bp, Unknown
  misc_feature (1)..( 12): Result.005 file - promoters50/1714865
atttataaataa

SEQ ID NO: 177485 - DNA, 12 bp, Unknown
  misc_feature (1)..( 12): Result.005 file - promoters50/1714865
ttttataaaaaa

SEQ ID NO: 177486 - DNA, 12 bp, Unknown
  misc_feature (1)..( 12): Result.005 file - promoters50/1714865
ctatataaatgc

SEQ ID NO: 177487 - DNA, 12 bp, Unknown
  misc_feature (1)..( 12): Result.005 file - promoters50/1714865
tctaataaataa

SEQ ID NO: 177488 - DNA, 12 bp, Unknown
  misc_feature (1)..( 12): Result.005 file - promoters50/1714865
ctatttaaaccg

SEQ ID NO: 177489 - DNA, 11 bp, Unknown
  misc_feature (1)..( 11): Result.005 file - promoters50/1714865
aaaaatatcaa

SEQ ID NO: 177490 - DNA, 11 bp, Unknown
  misc_feature (1)..( 11): Result.005 file - promoters50/1714865
aaaaatcaaaa

SEQ ID NO: 177491 - DNA, 11 bp, Unknown
  misc_feature (1)..( 11): Result.005 file - promoters50/1714865
aaaaaaaaaaa

SEQ ID NO: 177492 - DNA, 11 bp, Unknown
  misc_feature (1)..( 11): Result.005 file - promoters50/1714865
gtaaataaagt

SEQ ID NO: 177493 - DNA, 11 bp, Unknown
  misc_feature (1)..( 11): Result.005 file - promoters50/1714865
ggaaatacaaa

SEQ ID NO: 177494 - DNA, 9 bp, Unknown
  misc_feature (1)..( 9): Result.005 file - promoters50/1714865
aaaaatgca

SEQ ID NO: 177495 - DNA, 9 bp, Unknown
  misc_feature (1)..( 9): Result.005 file - promoters50/1714865
aaaaatttg

SEQ ID NO: 177496 - DNA, 9 bp, Unknown
  misc_feature (1)..( 9): Result.005 file - promoters50/1714865
aaaaatcaa

SEQ ID NO: 177497 - DNA, 9 bp, Unknown
  misc_feature (1)..( 9): Result.005 file - promoters50/1714865
ataaatttt

SEQ ID NO: 177498 - DNA, 12 bp, Unknown
  misc_feature (1)..( 12): Result.005 file - promoters50/1714865
gaaaaaaaaaaa

SEQ ID NO: 177499 - DNA, 12 bp, Unknown
  misc_feature (1)..( 12): Result.005 file - promoters50/1714865
gaaaaaaaaaaa

SEQ ID NO: 177500 - DNA, 12 bp, Unknown
  misc_feature (1)..( 12): Result.005 file - promoters50/1714865
gaagaaactacg

SEQ ID NO: 177501 - DNA, 12 bp, Unknown
  misc_feature (1)..( 12): Result.005 file - promoters50/1714865
gaaatacaaaaa

SEQ ID NO: 177502 - DNA, 10 bp, Unknown
  misc_feature (1)..( 10): Result.005 file - promoters50/1714865
aaaataaaat

SEQ ID NO: 177503 - DNA, 10 bp, Unknown
  misc_feature (1)..( 10): Result.005 file - promoters50/1714865
aaaaaaaaac

SEQ ID NO: 177504 - DNA, 10 bp, Unknown
  misc_feature (1)..( 10): Result.005 file - promoters50/1714865
aatataaaat

SEQ ID NO: 177505 - DNA, 10 bp, Unknown
  misc_feature (1)..( 10): Result.005 file - promoters50/1714865
caaataaatg

SEQ ID NO: 177506 - DNA, 10 bp, Unknown
  misc_feature (1)..( 10): Result.005 file - promoters50/1714865
ctcataaaat

SEQ ID NO: 177507 - DNA, 11 bp, Unknown
  misc_feature (1)..( 11): Result.005 file - promoters50/1714865
aaataatatta

SEQ ID NO: 177508 - DNA, 11 bp, Unknown
  misc_feature (1)..( 11): Result.005 file - promoters50/1714865
aaatattattt

SEQ ID NO: 177509 - DNA, 11 bp, Unknown
  misc_feature (1)..( 11): Result.005 file - promoters50/1714865
aatgtttattt

SEQ ID NO: 177510 - DNA, 11 bp, Unknown
  misc_feature (1)..( 11): Result.005 file - promoters50/1714865
tgatatgattc

SEQ ID NO: 177511 - DNA, 7 bp, Unknown
  misc_feature (1)..( 7): Result.005 file - promoters50/1714877
ataattt

SEQ ID NO: 177512 - DNA, 7 bp, Unknown
  misc_feature (1)..( 7): Result.005 file - promoters50/1714877
ttaattt

SEQ ID NO: 177513 - DNA, 7 bp, Unknown
  misc_feature (1)..( 7): Result.005 file - promoters50/1714877
ttagttt

SEQ ID NO: 177514 - DNA, 11 bp, Unknown
  misc_feature (1)..( 11): Result.005 file - promoters50/1714912
aagaagaaaag

SEQ ID NO: 177515 - DNA, 11 bp, Unknown
  misc_feature (1)..( 11): Result.005 file - promoters50/1714912
aaaaagaaaaa

SEQ ID NO: 177516 - DNA, 11 bp, Unknown
  misc_feature (1)..( 11): Result.005 file - promoters50/1714912
aaaaataaaaa

SEQ ID NO: 177517 - DNA, 10 bp, Unknown
  misc_feature (1)..( 10): Result.005 file - promoters50/1714942
cattgcttag

SEQ ID NO: 177518 - DNA, 10 bp, Unknown
  misc_feature (1)..( 10): Result.005 file - promoters50/1714942
cattgctgtt

SEQ ID NO: 177519 - DNA, 10 bp, Unknown
  misc_feature (1)..( 10): Result.005 file - promoters50/1714942
tattgctcgg

SEQ ID NO: 177520 - DNA, 10 bp, Unknown
  misc_feature (1)..( 10): Result.005 file - promoters50/1714942
acttgattag

SEQ ID NO: 177521 - DNA, 10 bp, Unknown
  misc_feature (1)..( 10): Result.005 file - promoters50/1714974
ttgtatttat

SEQ ID NO: 177522 - DNA, 10 bp, Unknown
  misc_feature (1)..( 10): Result.005 file - promoters50/1714974
ttgaatttag

SEQ ID NO: 177523 - DNA, 10 bp, Unknown
  misc_feature (1)..( 10): Result.005 file - promoters50/1714974
gtggatttat

SEQ ID NO: 177524 - DNA, 11 bp, Unknown
  misc_feature (1)..( 11): Result.005 file - promoters50/1714974
tttgattatat

SEQ ID NO: 177525 - DNA, 10 bp, Unknown
  misc_feature (1)..( 10): Result.005 file - promoters50/1714974
aaacgaaatt

SEQ ID NO: 177526 - DNA, 10 bp, Unknown
  misc_feature (1)..( 10): Result.005 file - promoters50/1714974
aaaccaaata

SEQ ID NO: 177527 - DNA, 10 bp, Unknown
  misc_feature (1)..( 10): Result.005 file - promoters50/1714974
aaatgaaaaa

SEQ ID NO: 177528 - DNA, 10 bp, Unknown
  misc_feature (1)..( 10): Result.005 file - promoters50/1714974
cttgcaaata

SEQ ID NO: 177529 - DNA, 10 bp, Unknown
  misc_feature (1)..( 10): Result.005 file - promoters50/1714974
tattaaagga

SEQ ID NO: 177530 - DNA, 10 bp, Unknown
  misc_feature (1)..( 10): Result.005 file - promoters50/1714974
tataaaacca

SEQ ID NO: 177531 - DNA, 10 bp, Unknown
  misc_feature (1)..( 10): Result.005 file - promoters50/1714974
atttagagga

SEQ ID NO: 177532 - DNA, 10 bp, Unknown
  misc_feature (1)..( 10): Result.005 file - promoters50/1714974
aatacaacat

SEQ ID NO: 177533 - DNA, 11 bp, Unknown
  misc_feature (1)..( 11): Result.005 file - promoters50/1714974
taaaatttatt

SEQ ID NO: 177534 - DNA, 11 bp, Unknown
  misc_feature (1)..( 11): Result.005 file - promoters50/1714974
atgcattcatt

SEQ ID NO: 177535 - DNA, 11 bp, Unknown
  misc_feature (1)..( 11): Result.005 file - promoters50/1714974
aaaactttatc

SEQ ID NO: 177536 - DNA, 11 bp, Unknown
  misc_feature (1)..( 11): Result.005 file - promoters50/1714974
aaaccttgtgg

SEQ ID NO: 177537 - DNA, 10 bp, Unknown
  misc_feature (1)..( 10): Result.005 file - promoters50/1714974
aaattttact

SEQ ID NO: 177538 - DNA, 10 bp, Unknown
  misc_feature (1)..( 10): Result.005 file - promoters50/1714974
aaactttatc

SEQ ID NO: 177539 - DNA, 10 bp, Unknown
  misc_feature (1)..( 10): Result.005 file - promoters50/1714974
aaaccttgtg

SEQ ID NO: 177540 - DNA, 10 bp, Unknown
  misc_feature (1)..( 10): Result.005 file - promoters50/1714974
agccttgatc

SEQ ID NO: 177541 - DNA, 12 bp, Unknown
  misc_feature (1)..( 12): Result.005 file - promoters50/1714989
aatcaacatata

SEQ ID NO: 177542 - DNA, 12 bp, Unknown
  misc_feature (1)..( 12): Result.005 file - promoters50/1714989
aaactacatatt

SEQ ID NO: 177543 - DNA, 12 bp, Unknown
  misc_feature (1)..( 12): Result.005 file - promoters50/1714989
aataaacatatt

SEQ ID NO: 177544 - DNA, 12 bp, Unknown
  misc_feature (1)..( 12): Result.005 file - promoters50/1714989
accattcatata

SEQ ID NO: 177545 - DNA, 12 bp, Unknown
  misc_feature (1)..( 12): Result.005 file - promoters50/1714989
cccaaaaataag

SEQ ID NO: 177546 - DNA, 12 bp, Unknown
  misc_feature (1)..( 12): Result.005 file - promoters50/1714989
aacaaaaaaggt

SEQ ID NO: 177547 - DNA, 12 bp, Unknown
  misc_feature (1)..( 12): Result.005 file - promoters50/1714989
tacaaaaaaagc

SEQ ID NO: 177548 - DNA, 10 bp, Unknown
  misc_feature (1)..( 10): Result.005 file - promoters50/1714989
caaagattta

SEQ ID NO: 177549 - DNA, 10 bp, Unknown
  misc_feature (1)..( 10): Result.005 file - promoters50/1714989
aaaatattaa

SEQ ID NO: 177550 - DNA, 10 bp, Unknown
  misc_feature (1)..( 10): Result.005 file - promoters50/1714989
taaaaattaa

SEQ ID NO: 177551 - DNA, 10 bp, Unknown
  misc_feature (1)..( 10): Result.005 file - promoters50/1714989
aaaataagat

SEQ ID NO: 177552 - DNA, 10 bp, Unknown
  misc_feature (1)..( 10): Result.005 file - promoters50/1714989
agaatactaa

SEQ ID NO: 177553 - DNA, 10 bp, Unknown
  misc_feature (1)..( 10): Result.005 file - promoters50/1714989
taaacatatt

SEQ ID NO: 177554 - DNA, 10 bp, Unknown
  misc_feature (1)..( 10): Result.005 file - promoters50/1714989
gaaacaaatt

SEQ ID NO: 177555 - DNA, 10 bp, Unknown
  misc_feature (1)..( 10): Result.005 file - promoters50/1714989
aaaacaaacg

SEQ ID NO: 177556 - DNA, 10 bp, Unknown
  misc_feature (1)..( 10): Result.005 file - promoters50/1714989
gaaaaaaaag

SEQ ID NO: 177557 - DNA, 10 bp, Unknown
  misc_feature (1)..( 10): Result.005 file - promoters50/1714989
taaataaatt

SEQ ID NO: 177558 - DNA, 10 bp, Unknown
  misc_feature (1)..( 10): Result.005 file - promoters50/1714989
taaaaaaaga

SEQ ID NO: 177559 - DNA, 10 bp, Unknown
  misc_feature (1)..( 10): Result.005 file - promoters50/1714989
ttaactaatt

SEQ ID NO: 177560 - DNA, 10 bp, Unknown
  misc_feature (1)..( 10): Result.005 file - promoters50/1714989
taatataact

SEQ ID NO: 177561 - DNA, 16 bp, Unknown
  misc_feature (1)..( 16): Result.005 file - promoters50/1714989
tccaactaaagtatac

SEQ ID NO: 177562 - DNA, 16 bp, Unknown
  misc_feature (1)..( 16): Result.005 file - promoters50/1714989
tttaacaaaaaaaata

SEQ ID NO: 177563 - DNA, 16 bp, Unknown
  misc_feature (1)..( 16): Result.005 file - promoters50/1714989
aaaaaccaaagacaag

SEQ ID NO: 177564 - DNA, 16 bp, Unknown
  misc_feature (1)..( 16): Result.005 file - promoters50/1714989
tccaaataaaatatct

SEQ ID NO: 177565 - DNA, 16 bp, Unknown
  misc_feature (1)..( 16): Result.005 file - promoters50/1714989
agagacaaaaacaata

SEQ ID NO: 177566 - DNA, 16 bp, Unknown
  misc_feature (1)..( 16): Result.005 file - promoters50/1714989
ggttacaaaatatcaa

SEQ ID NO: 177567 - DNA, 16 bp, Unknown
  misc_feature (1)..( 16): Result.005 file - promoters50/1714989
tttctttaaactatga

SEQ ID NO: 177568 - DNA, 9 bp, Unknown
  misc_feature (1)..( 9): Result.005 file - promoters50/1714989
ttacaaaca

SEQ ID NO: 177569 - DNA, 9 bp, Unknown
  misc_feature (1)..( 9): Result.005 file - promoters50/1714989
agacaaacg

SEQ ID NO: 177570 - DNA, 9 bp, Unknown
  misc_feature (1)..( 9): Result.005 file - promoters50/1714989
ttaaaaaat

SEQ ID NO: 177571 - DNA, 9 bp, Unknown
  misc_feature (1)..( 9): Result.005 file - promoters50/1714989
ttaaaaagt

SEQ ID NO: 177572 - DNA, 9 bp, Unknown
  misc_feature (1)..( 9): Result.005 file - promoters50/1714989
ttaaaatcg

SEQ ID NO: 177573 - DNA, 9 bp, Unknown
  misc_feature (1)..( 9): Result.005 file - promoters50/1714989
caaaagagt

SEQ ID NO: 177574 - DNA, 12 bp, Unknown
  misc_feature (1)..( 12): Result.005 file - promoters50/1714989
catatacaagaa

SEQ ID NO: 177575 - DNA, 12 bp, Unknown
  misc_feature (1)..( 12): Result.005 file - promoters50/1714989
agtatacaaaaa

SEQ ID NO: 177576 - DNA, 12 bp, Unknown
  misc_feature (1)..( 12): Result.005 file - promoters50/1714989
aataaacatatt

SEQ ID NO: 177577 - DNA, 12 bp, Unknown
  misc_feature (1)..( 12): Result.005 file - promoters50/1714989
gaattacaaaac

SEQ ID NO: 177578 - DNA, 12 bp, Unknown
  misc_feature (1)..( 12): Result.005 file - promoters50/1714989
ttttaacaaaaa

SEQ ID NO: 177579 - DNA, 12 bp, Unknown
  misc_feature (1)..( 12): Result.005 file - promoters50/1714989
ctcccaaaaata

SEQ ID NO: 177580 - DNA, 12 bp, Unknown
  misc_feature (1)..( 12): Result.005 file - promoters50/1714989
agtacacagagt

SEQ ID NO: 177581 - DNA, 11 bp, Unknown
  misc_feature (1)..( 11): Result.005 file - promoters50/1714989
aattattttgt

SEQ ID NO: 177582 - DNA, 11 bp, Unknown
  misc_feature (1)..( 11): Result.005 file - promoters50/1714989
ttttatttctt

SEQ ID NO: 177583 - DNA, 11 bp, Unknown
  misc_feature (1)..( 11): Result.005 file - promoters50/1714989
aattattttgc

SEQ ID NO: 177584 - DNA, 11 bp, Unknown
  misc_feature (1)..( 11): Result.005 file - promoters50/1714989
gtttgtttaac

SEQ ID NO: 177585 - DNA, 11 bp, Unknown
  misc_feature (1)..( 11): Result.005 file - promoters50/1714989
acttatatctt

SEQ ID NO: 177586 - DNA, 11 bp, Unknown
  misc_feature (1)..( 11): Result.005 file - promoters50/1714989
gtatatatcca

SEQ ID NO: 177587 - DNA, 20 bp, Unknown
  misc_feature (1)..( 20): Result.005 file - promoters50/1714989
tccaactaaagtatacttac

SEQ ID NO: 177588 - DNA, 20 bp, Unknown
  misc_feature (1)..( 20): Result.005 file - promoters50/1714989
tttctttaaactatgacagt

SEQ ID NO: 177589 - DNA, 20 bp, Unknown
  misc_feature (1)..( 20): Result.005 file - promoters50/1714989
gggttacaaaatatcaaaga

SEQ ID NO: 177590 - DNA, 20 bp, Unknown
  misc_feature (1)..( 20): Result.005 file - promoters50/1714989
tccaaataaaatatctttaa

SEQ ID NO: 177591 - DNA, 20 bp, Unknown
  misc_feature (1)..( 20): Result.005 file - promoters50/1714989
aacaaaaaaaataagaatgt

SEQ ID NO: 177592 - DNA, 20 bp, Unknown
  misc_feature (1)..( 20): Result.005 file - promoters50/1714989
cggtctaaagtcatccaaag

SEQ ID NO: 177593 - DNA, 20 bp, Unknown
  misc_feature (1)..( 20): Result.005 file - promoters50/1714989
cacttatatcttataaccaa

SEQ ID NO: 177594 - DNA, 15 bp, Unknown
  misc_feature (1)..( 15): Result.005 file - promoters50/1714989
ccacaaaacgacgac

SEQ ID NO: 177595 - DNA, 15 bp, Unknown
  misc_feature (1)..( 15): Result.005 file - promoters50/1714989
agacaaaaacaatat

SEQ ID NO: 177596 - DNA, 15 bp, Unknown
  misc_feature (1)..( 15): Result.005 file - promoters50/1714989
ttacaaaatatcaaa

SEQ ID NO: 177597 - DNA, 15 bp, Unknown
  misc_feature (1)..( 15): Result.005 file - promoters50/1714989
taacaaaaaaaataa

SEQ ID NO: 177598 - DNA, 15 bp, Unknown
  misc_feature (1)..( 15): Result.005 file - promoters50/1714989
aaagaaaataataat

SEQ ID NO: 177599 - DNA, 15 bp, Unknown
  misc_feature (1)..( 15): Result.005 file - promoters50/1714989
aattttaataaacca

SEQ ID NO: 177600 - DNA, 11 bp, Unknown
  misc_feature (1)..( 11): Result.005 file - promoters50/1714989
ttgagtttagg

SEQ ID NO: 177601 - DNA, 11 bp, Unknown
  misc_feature (1)..( 11): Result.005 file - promoters50/1714989
gatagtttaaa

SEQ ID NO: 177602 - DNA, 11 bp, Unknown
  misc_feature (1)..( 11): Result.005 file - promoters50/1714989
ttgatttttgt

SEQ ID NO: 177603 - DNA, 11 bp, Unknown
  misc_feature (1)..( 11): Result.005 file - promoters50/1714989
ttgattttaaa

SEQ ID NO: 177604 - DNA, 11 bp, Unknown
  misc_feature (1)..( 11): Result.005 file - promoters50/1714989
tttatttttgt

SEQ ID NO: 177605 - DNA, 11 bp, Unknown
  misc_feature (1)..( 11): Result.005 file - promoters50/1714989
acaattctaat

SEQ ID NO: 177606 - DNA, 11 bp, Unknown
  misc_feature (1)..( 11): Result.005 file - promoters50/1715054
atattgattta

SEQ ID NO: 177607 - DNA, 11 bp, Unknown
  misc_feature (1)..( 11): Result.005 file - promoters50/1715054
gagtagattta

SEQ ID NO: 177608 - DNA, 11 bp, Unknown
  misc_feature (1)..( 11): Result.005 file - promoters50/1715054
caaatgattta

SEQ ID NO: 177609 - DNA, 11 bp, Unknown
  misc_feature (1)..( 11): Result.005 file - promoters50/1715054
atattgatttg

SEQ ID NO: 177610 - DNA, 15 bp, Unknown
  misc_feature (1)..( 15): Result.005 file - promoters50/1715054
atattatattattta

SEQ ID NO: 177611 - DNA, 15 bp, Unknown
  misc_feature (1)..( 15): Result.005 file - promoters50/1715054
taattatgttatcag

SEQ ID NO: 177612 - DNA, 15 bp, Unknown
  misc_feature (1)..( 15): Result.005 file - promoters50/1715054
taattttgttaataa

SEQ ID NO: 177613 - DNA, 15 bp, Unknown
  misc_feature (1)..( 15): Result.005 file - promoters50/1715054
cttttttcttaataa

SEQ ID NO: 177614 - DNA, 7 bp, Unknown
  misc_feature (1)..( 7): Result.005 file - promoters50/1715054
agcattt

SEQ ID NO: 177615 - DNA, 7 bp, Unknown
  misc_feature (1)..( 7): Result.005 file - promoters50/1715054
agccttt

SEQ ID NO: 177616 - DNA, 7 bp, Unknown
  misc_feature (1)..( 7): Result.005 file - promoters50/1715054
agcattt

SEQ ID NO: 177617 - DNA, 10 bp, Unknown
  misc_feature (1)..( 10): Result.005 file - promoters50/1715054
ccagaattta

SEQ ID NO: 177618 - DNA, 10 bp, Unknown
  misc_feature (1)..( 10): Result.005 file - promoters50/1715054
aaagaagtta

SEQ ID NO: 177619 - DNA, 10 bp, Unknown
  misc_feature (1)..( 10): Result.005 file - promoters50/1715054
aaaaaagaac

SEQ ID NO: 177620 - DNA, 8 bp, Unknown
  misc_feature (1)..( 8): Result.005 file - promoters50/1715054
aataatta

SEQ ID NO: 177621 - DNA, 8 bp, Unknown
  misc_feature (1)..( 8): Result.005 file - promoters50/1715054
tttaatta

SEQ ID NO: 177622 - DNA, 8 bp, Unknown
  misc_feature (1)..( 8): Result.005 file - promoters50/1715054
ttttattg

SEQ ID NO: 177623 - DNA, 7 bp, Unknown
  misc_feature (1)..( 7): Result.005 file - promoters50/1715054
aatcttc

SEQ ID NO: 177624 - DNA, 7 bp, Unknown
  misc_feature (1)..( 7): Result.005 file - promoters50/1715054
aatgttc

SEQ ID NO: 177625 - DNA, 7 bp, Unknown
  misc_feature (1)..( 7): Result.005 file - promoters50/1715054
aatgtta

SEQ ID NO: 177626 - DNA, 7 bp, Unknown
  misc_feature (1)..( 7): Result.005 file - promoters50/1715146
ttccata

SEQ ID NO: 177627 - DNA, 7 bp, Unknown
  misc_feature (1)..( 7): Result.005 file - promoters50/1715146
ttctata

SEQ ID NO: 177628 - DNA, 7 bp, Unknown
  misc_feature (1)..( 7): Result.005 file - promoters50/1715146
ttccata

SEQ ID NO: 177629 - DNA, 9 bp, Unknown
  misc_feature (1)..( 9): Result.005 file - promoters50/1715146
tttaaattc

SEQ ID NO: 177630 - DNA, 9 bp, Unknown
  misc_feature (1)..( 9): Result.005 file - promoters50/1715146
tataaattc

SEQ ID NO: 177631 - DNA, 9 bp, Unknown
  misc_feature (1)..( 9): Result.005 file - promoters50/1715146
tataaatat

SEQ ID NO: 177632 - DNA, 7 bp, Unknown
  misc_feature (1)..( 7): Result.005 file - promoters50/1715146
atccaaa

SEQ ID NO: 177633 - DNA, 7 bp, Unknown
  misc_feature (1)..( 7): Result.005 file - promoters50/1715146
atccaat

SEQ ID NO: 177634 - DNA, 7 bp, Unknown
  misc_feature (1)..( 7): Result.005 file - promoters50/1715146
atcaaat

SEQ ID NO: 177635 - DNA, 8 bp, Unknown
  misc_feature (1)..( 8): Result.005 file - promoters50/1715146
gaatttct

SEQ ID NO: 177636 - DNA, 8 bp, Unknown
  misc_feature (1)..( 8): Result.005 file - promoters50/1715146
gaatttaa

SEQ ID NO: 177637 - DNA, 8 bp, Unknown
  misc_feature (1)..( 8): Result.005 file - promoters50/1715146
aaatttaa

SEQ ID NO: 177638 - DNA, 9 bp, Unknown
  misc_feature (1)..( 9): Result.005 file - promoters50/1715146
agaaaatca

SEQ ID NO: 177639 - DNA, 9 bp, Unknown
  misc_feature (1)..( 9): Result.005 file - promoters50/1715146
agataataa

SEQ ID NO: 177640 - DNA, 9 bp, Unknown
  misc_feature (1)..( 9): Result.005 file - promoters50/1715146
tgatagtaa

SEQ ID NO: 177641 - DNA, 10 bp, Unknown
  misc_feature (1)..( 10): Result.005 file - promoters50/1715146
aaactatctc

SEQ ID NO: 177642 - DNA, 10 bp, Unknown
  misc_feature (1)..( 10): Result.005 file - promoters50/1715146
aaattattaa

SEQ ID NO: 177643 - DNA, 10 bp, Unknown
  misc_feature (1)..( 10): Result.005 file - promoters50/1715146
agattagtaa

SEQ ID NO: 177644 - DNA, 7 bp, Unknown
  misc_feature (1)..( 7): Result.005 file - promoters50/1715146
aagaaaa

SEQ ID NO: 177645 - DNA, 7 bp, Unknown
  misc_feature (1)..( 7): Result.005 file - promoters50/1715146
aagaaat

SEQ ID NO: 177646 - DNA, 8 bp, Unknown
  misc_feature (1)..( 8): Result.005 file - promoters50/1715146
aagtaaat

SEQ ID NO: 177647 - DNA, 8 bp, Unknown
  misc_feature (1)..( 8): Result.005 file - promoters50/1715146
aatttaag

SEQ ID NO: 177648 - DNA, 8 bp, Unknown
  misc_feature (1)..( 8): Result.005 file - promoters50/1715146
cctttaag

SEQ ID NO: 177649 - DNA, 8 bp, Unknown
  misc_feature (1)..( 8): Result.005 file - promoters50/1715146
aatttaat

SEQ ID NO: 177650 - DNA, 7 bp, Unknown
  misc_feature (1)..( 7): Result.005 file - promoters50/1715204
aaaagtc

SEQ ID NO: 177651 - DNA, 7 bp, Unknown
  misc_feature (1)..( 7): Result.005 file - promoters50/1715204
aaaagtt

SEQ ID NO: 177652 - DNA, 7 bp, Unknown
  misc_feature (1)..( 7): Result.005 file - promoters50/1715204
aaaattg

SEQ ID NO: 177653 - DNA, 9 bp, Unknown
  misc_feature (1)..( 9): Result.005 file - promoters50/1715204
aagtgttta

SEQ ID NO: 177654 - DNA, 9 bp, Unknown
  misc_feature (1)..( 9): Result.005 file - promoters50/1715204
aagtgttgg

SEQ ID NO: 177655 - DNA, 10 bp, Unknown
  misc_feature (1)..( 10): Result.005 file - promoters50/1715204
ctgtgcttat

SEQ ID NO: 177656 - DNA, 10 bp, Unknown
  misc_feature (1)..( 10): Result.005 file - promoters50/1715204
attcaacata

SEQ ID NO: 177657 - DNA, 10 bp, Unknown
  misc_feature (1)..( 10): Result.005 file - promoters50/1715204
attcaagatt

SEQ ID NO: 177658 - DNA, 10 bp, Unknown
  misc_feature (1)..( 10): Result.005 file - promoters50/1715204
gttcatgatt

SEQ ID NO: 177659 - DNA, 10 bp, Unknown
  misc_feature (1)..( 10): Result.005 file - promoters50/1715220
ctgtcattaa

SEQ ID NO: 177660 - DNA, 10 bp, Unknown
  misc_feature (1)..( 10): Result.005 file - promoters50/1715220
ctgtcaaagg

SEQ ID NO: 177661 - DNA, 10 bp, Unknown
  misc_feature (1)..( 10): Result.005 file - promoters50/1715220
ttgtctaagt

SEQ ID NO: 177662 - DNA, 10 bp, Unknown
  misc_feature (1)..( 10): Result.005 file - promoters50/1715220
ttgactaatc

SEQ ID NO: 177663 - DNA, 10 bp, Unknown
  misc_feature (1)..( 10): Result.005 file - promoters50/1715220
aagactagac

SEQ ID NO: 177664 - DNA, 11 bp, Unknown
  misc_feature (1)..( 11): Result.005 file - promoters50/1715220
ccaaacatgga

SEQ ID NO: 177665 - DNA, 11 bp, Unknown
  misc_feature (1)..( 11): Result.005 file - promoters50/1715220
agaaaaatgtg

SEQ ID NO: 177666 - DNA, 11 bp, Unknown
  misc_feature (1)..( 11): Result.005 file - promoters50/1715220
ccaaacagaaa

SEQ ID NO: 177667 - DNA, 11 bp, Unknown
  misc_feature (1)..( 11): Result.005 file - promoters50/1715220
caaaaggaaaa

SEQ ID NO: 177668 - DNA, 11 bp, Unknown
  misc_feature (1)..( 11): Result.005 file - promoters50/1715220
ccaaatttgta

SEQ ID NO: 177669 - DNA, 12 bp, Unknown
  misc_feature (1)..( 12): Result.005 file - promoters50/1715220
tttcactttaga

SEQ ID NO: 177670 - DNA, 12 bp, Unknown
  misc_feature (1)..( 12): Result.005 file - promoters50/1715220
aggttcttaaga

SEQ ID NO: 177671 - DNA, 12 bp, Unknown
  misc_feature (1)..( 12): Result.005 file - promoters50/1715220
tttcaatttaat

SEQ ID NO: 177672 - DNA, 12 bp, Unknown
  misc_feature (1)..( 12): Result.005 file - promoters50/1715220
gaccaattttag

SEQ ID NO: 177673 - DNA, 12 bp, Unknown
  misc_feature (1)..( 12): Result.005 file - promoters50/1715220
caacaattttga

SEQ ID NO: 177674 - DNA, 8 bp, Unknown
  misc_feature (1)..( 8): Result.005 file - promoters50/1715224
ttataaaa

SEQ ID NO: 177675 - DNA, 8 bp, Unknown
  misc_feature (1)..( 8): Result.005 file - promoters50/1715224
ttattaaa

SEQ ID NO: 177676 - DNA, 8 bp, Unknown
  misc_feature (1)..( 8): Result.005 file - promoters50/1715224
ctatgaaa

SEQ ID NO: 177677 - DNA, 10 bp, Unknown
  misc_feature (1)..( 10): Result.005 file - promoters50/1715224
ttttattaaa

SEQ ID NO: 177678 - DNA, 10 bp, Unknown
  misc_feature (1)..( 10): Result.005 file - promoters50/1715224
aattactaaa

SEQ ID NO: 177679 - DNA, 10 bp, Unknown
  misc_feature (1)..( 10): Result.005 file - promoters50/1715224
aattactata

SEQ ID NO: 177680 - DNA, 8 bp, Unknown
  misc_feature (1)..( 8): Result.005 file - promoters50/1715224
ggtgaaaa

SEQ ID NO: 177681 - DNA, 8 bp, Unknown
  misc_feature (1)..( 8): Result.005 file - promoters50/1715224
tatgaaaa

SEQ ID NO: 177682 - DNA, 8 bp, Unknown
  misc_feature (1)..( 8): Result.005 file - promoters50/1715224
tattaaag

SEQ ID NO: 177683 - DNA, 8 bp, Unknown
  misc_feature (1)..( 8): Result.005 file - promoters50/1715329
atctaaag

SEQ ID NO: 177684 - DNA, 8 bp, Unknown
  misc_feature (1)..( 8): Result.005 file - promoters50/1715329
ttctaaaa

SEQ ID NO: 177685 - DNA, 8 bp, Unknown
  misc_feature (1)..( 8): Result.005 file - promoters50/1715329
ttcaaaaa

SEQ ID NO: 177686 - DNA, 9 bp, Unknown
  misc_feature (1)..( 9): Result.005 file - promoters50/1715329
ccttcttct

SEQ ID NO: 177687 - DNA, 9 bp, Unknown
  misc_feature (1)..( 9): Result.005 file - promoters50/1715329
tctttttct

SEQ ID NO: 177688 - DNA, 9 bp, Unknown
  misc_feature (1)..( 9): Result.005 file - promoters50/1715329
ccttctcga

SEQ ID NO: 177689 - DNA, 10 bp, Unknown
  misc_feature (1)..( 10): Result.005 file - promoters50/1715329
agattttagc

SEQ ID NO: 177690 - DNA, 10 bp, Unknown
  misc_feature (1)..( 10): Result.005 file - promoters50/1715329
atattttatt

SEQ ID NO: 177691 - DNA, 10 bp, Unknown
  misc_feature (1)..( 10): Result.005 file - promoters50/1715329
atattttgcc

SEQ ID NO: 177692 - DNA, 10 bp, Unknown
  misc_feature (1)..( 10): Result.005 file - promoters50/1715329
gaatttcatt

SEQ ID NO: 177693 - DNA, 7 bp, Unknown
  misc_feature (1)..( 7): Result.005 file - promoters50/1715329
ttttatt

SEQ ID NO: 177694 - DNA, 7 bp, Unknown
  misc_feature (1)..( 7): Result.005 file - promoters50/1715329
ttttatt

SEQ ID NO: 177695 - DNA, 7 bp, Unknown
  misc_feature (1)..( 7): Result.005 file - promoters50/1715329
ttttatt

SEQ ID NO: 177696 - DNA, 10 bp, Unknown
  misc_feature (1)..( 10): Result.005 file - promoters50/1715329
ttaggtcaat

SEQ ID NO: 177697 - DNA, 10 bp, Unknown
  misc_feature (1)..( 10): Result.005 file - promoters50/1715329
ttagatcatt

SEQ ID NO: 177698 - DNA, 10 bp, Unknown
  misc_feature (1)..( 10): Result.005 file - promoters50/1715329
gcagatcatt

SEQ ID NO: 177699 - DNA, 11 bp, Unknown
  misc_feature (1)..( 11): Result.005 file - promoters50/1715347
tttttaataac

SEQ ID NO: 177700 - DNA, 11 bp, Unknown
  misc_feature (1)..( 11): Result.005 file - promoters50/1715347
gtgttaatagc

SEQ ID NO: 177701 - DNA, 11 bp, Unknown
  misc_feature (1)..( 11): Result.005 file - promoters50/1715347
ttgtaaatgta

SEQ ID NO: 177702 - DNA, 11 bp, Unknown
  misc_feature (1)..( 11): Result.005 file - promoters50/1715347
tcttaaatgct

SEQ ID NO: 177703 - DNA, 11 bp, Unknown
  misc_feature (1)..( 11): Result.005 file - promoters50/1715347
tcttaaataac

SEQ ID NO: 177704 - DNA, 11 bp, Unknown
  misc_feature (1)..( 11): Result.005 file - promoters50/1715347
attttaattaa

SEQ ID NO: 177705 - DNA, 17 bp, Unknown
  misc_feature (1)..( 17): Result.005 file - promoters50/1715347
tatcccaaaaattattt

SEQ ID NO: 177706 - DNA, 17 bp, Unknown
  misc_feature (1)..( 17): Result.005 file - promoters50/1715347
ttgattcaaaattctct

SEQ ID NO: 177707 - DNA, 17 bp, Unknown
  misc_feature (1)..( 17): Result.005 file - promoters50/1715347
ttgaatcaatattttat

SEQ ID NO: 177708 - DNA, 17 bp, Unknown
  misc_feature (1)..( 17): Result.005 file - promoters50/1715347
aggatcttaaatgcttt

SEQ ID NO: 177709 - DNA, 17 bp, Unknown
  misc_feature (1)..( 17): Result.005 file - promoters50/1715347
gcttgctctaattgctt

SEQ ID NO: 177710 - DNA, 17 bp, Unknown
  misc_feature (1)..( 17): Result.005 file - promoters50/1715347
attaaaacaaactctta

SEQ ID NO: 177711 - DNA, 11 bp, Unknown
  misc_feature (1)..( 11): Result.005 file - promoters50/1715400
aggttctcaga

SEQ ID NO: 177712 - DNA, 11 bp, Unknown
  misc_feature (1)..( 11): Result.005 file - promoters50/1715400
agggtctgaga

SEQ ID NO: 177713 - DNA, 11 bp, Unknown
  misc_feature (1)..( 11): Result.005 file - promoters50/1715400
tttttctcaaa

SEQ ID NO: 177714 - DNA, 8 bp, Unknown
  misc_feature (1)..( 8): Result.005 file - promoters50/1715478
ttaaaatc

SEQ ID NO: 177715 - DNA, 8 bp, Unknown
  misc_feature (1)..( 8): Result.005 file - promoters50/1715478
tcaaaatc

SEQ ID NO: 177716 - DNA, 8 bp, Unknown
  misc_feature (1)..( 8): Result.005 file - promoters50/1715478
ttataatg

SEQ ID NO: 177717 - DNA, 7 bp, Unknown
  misc_feature (1)..( 7): Result.005 file - promoters50/1715490
agatact

SEQ ID NO: 177718 - DNA, 7 bp, Unknown
  misc_feature (1)..( 7): Result.005 file - promoters50/1715490
agaaact

SEQ ID NO: 177719 - DNA, 7 bp, Unknown
  misc_feature (1)..( 7): Result.005 file - promoters50/1715490
agaaacc

SEQ ID NO: 177720 - DNA, 9 bp, Unknown
  misc_feature (1)..( 9): Result.005 file - promoters50/1715516
ttatttcca

SEQ ID NO: 177721 - DNA, 9 bp, Unknown
  misc_feature (1)..( 9): Result.005 file - promoters50/1715516
gaattacca

SEQ ID NO: 177722 - DNA, 9 bp, Unknown
  misc_feature (1)..( 9): Result.005 file - promoters50/1715516
ttatatcca

SEQ ID NO: 177723 - DNA, 9 bp, Unknown
  misc_feature (1)..( 9): Result.005 file - promoters50/1715516
atatgataa

SEQ ID NO: 177724 - DNA, 13 bp, Unknown
  misc_feature (1)..( 13): Result.005 file - promoters50/1715516
ctcctataaattg

SEQ ID NO: 177725 - DNA, 13 bp, Unknown
  misc_feature (1)..( 13): Result.005 file - promoters50/1715516
ctcttatatattc

SEQ ID NO: 177726 - DNA, 13 bp, Unknown
  misc_feature (1)..( 13): Result.005 file - promoters50/1715516
ttcctatatatca

SEQ ID NO: 177727 - DNA, 13 bp, Unknown
  misc_feature (1)..( 13): Result.005 file - promoters50/1715516
ggtgtataaattg

SEQ ID NO: 177728 - DNA, 10 bp, Unknown
  misc_feature (1)..( 10): Result.005 file - promoters50/1715516
ttaatttaca

SEQ ID NO: 177729 - DNA, 10 bp, Unknown
  misc_feature (1)..( 10): Result.005 file - promoters50/1715516
aaaattgaca

SEQ ID NO: 177730 - DNA, 10 bp, Unknown
  misc_feature (1)..( 10): Result.005 file - promoters50/1715516
taaatttgct

SEQ ID NO: 177731 - DNA, 10 bp, Unknown
  misc_feature (1)..( 10): Result.005 file - promoters50/1715516
taactttttc

SEQ ID NO: 177732 - DNA, 12 bp, Unknown
  misc_feature (1)..( 12): Result.005 file - promoters50/1715516
tgcaatttaata

SEQ ID NO: 177733 - DNA, 12 bp, Unknown
  misc_feature (1)..( 12): Result.005 file - promoters50/1715516
aaaaatataaga

SEQ ID NO: 177734 - DNA, 12 bp, Unknown
  misc_feature (1)..( 12): Result.005 file - promoters50/1715516
aactatttaaaa

SEQ ID NO: 177735 - DNA, 12 bp, Unknown
  misc_feature (1)..( 12): Result.005 file - promoters50/1715516
aagattttcata

SEQ ID NO: 177736 - DNA, 12 bp, Unknown
  misc_feature (1)..( 12): Result.005 file - promoters50/1715516
aaaaaaataaat

SEQ ID NO: 177737 - DNA, 8 bp, Unknown
  misc_feature (1)..( 8): Result.005 file - promoters50/1715516
aacttttt

SEQ ID NO: 177738 - DNA, 8 bp, Unknown
  misc_feature (1)..( 8): Result.005 file - promoters50/1715516
gactcttt

SEQ ID NO: 177739 - DNA, 8 bp, Unknown
  misc_feature (1)..( 8): Result.005 file - promoters50/1715516
aactattt

SEQ ID NO: 177740 - DNA, 8 bp, Unknown
  misc_feature (1)..( 8): Result.005 file - promoters50/1715516
ttctattt

SEQ ID NO: 177741 - DNA, 12 bp, Unknown
  misc_feature (1)..( 12): Result.005 file - promoters50/1715516
cgatagtttaac

SEQ ID NO: 177742 - DNA, 12 bp, Unknown
  misc_feature (1)..( 12): Result.005 file - promoters50/1715516
caatattttaac

SEQ ID NO: 177743 - DNA, 12 bp, Unknown
  misc_feature (1)..( 12): Result.005 file - promoters50/1715516
caaaattgacaa

SEQ ID NO: 177744 - DNA, 12 bp, Unknown
  misc_feature (1)..( 12): Result.005 file - promoters50/1715516
ataaatttgctc

SEQ ID NO: 177745 - DNA, 11 bp, Unknown
  misc_feature (1)..( 11): Result.005 file - promoters50/1715535
tggattttctt

SEQ ID NO: 177746 - DNA, 11 bp, Unknown
  misc_feature (1)..( 11): Result.005 file - promoters50/1715535
caaattttcac

SEQ ID NO: 177747 - DNA, 11 bp, Unknown
  misc_feature (1)..( 11): Result.005 file - promoters50/1715535
cagattttcag

SEQ ID NO: 177748 - DNA, 11 bp, Unknown
  misc_feature (1)..( 11): Result.005 file - promoters50/1715535
caaaatttcac

SEQ ID NO: 177749 - DNA, 11 bp, Unknown
  misc_feature (1)..( 11): Result.005 file - promoters50/1715535
gaaaattatta

SEQ ID NO: 177750 - DNA, 11 bp, Unknown
  misc_feature (1)..( 11): Result.005 file - promoters50/1715535
tgaaatttccg

SEQ ID NO: 177751 - DNA, 11 bp, Unknown
  misc_feature (1)..( 11): Result.005 file - promoters50/1715535
cgtcatttcaa

SEQ ID NO: 177752 - DNA, 11 bp, Unknown
  misc_feature (1)..( 11): Result.005 file - promoters50/1715535
caaaatttcac

SEQ ID NO: 177753 - DNA, 11 bp, Unknown
  misc_feature (1)..( 11): Result.005 file - promoters50/1715535
caaattttcac

SEQ ID NO: 177754 - DNA, 12 bp, Unknown
  misc_feature (1)..( 12): Result.005 file - promoters50/1715535
aaaaatattcgg

SEQ ID NO: 177755 - DNA, 12 bp, Unknown
  misc_feature (1)..( 12): Result.005 file - promoters50/1715535
tgaaatttccgg

SEQ ID NO: 177756 - DNA, 12 bp, Unknown
  misc_feature (1)..( 12): Result.005 file - promoters50/1715535
taaactatttat

SEQ ID NO: 177757 - DNA, 12 bp, Unknown
  misc_feature (1)..( 12): Result.005 file - promoters50/1715535
ttttgattttgc

SEQ ID NO: 177758 - DNA, 12 bp, Unknown
  misc_feature (1)..( 12): Result.005 file - promoters50/1715535
atatgatttatt

SEQ ID NO: 177759 - DNA, 12 bp, Unknown
  misc_feature (1)..( 12): Result.005 file - promoters50/1715535
atgtgattttgt

SEQ ID NO: 177760 - DNA, 12 bp, Unknown
  misc_feature (1)..( 12): Result.005 file - promoters50/1715535
atataatttaaa

SEQ ID NO: 177761 - DNA, 12 bp, Unknown
  misc_feature (1)..( 12): Result.005 file - promoters50/1715535
ttacaatttaca

SEQ ID NO: 177762 - DNA, 12 bp, Unknown
  misc_feature (1)..( 12): Result.005 file - promoters50/1715535
gtttgatatatt

SEQ ID NO: 177763 - DNA, 12 bp, Unknown
  misc_feature (1)..( 12): Result.005 file - promoters50/1715595
aaatcaaacata

SEQ ID NO: 177764 - DNA, 12 bp, Unknown
  misc_feature (1)..( 12): Result.005 file - promoters50/1715595
gagacaaacaaa

SEQ ID NO: 177765 - DNA, 12 bp, Unknown
  misc_feature (1)..( 12): Result.005 file - promoters50/1715595
taattaaacttt

SEQ ID NO: 177766 - DNA, 12 bp, Unknown
  misc_feature (1)..( 12): Result.005 file - promoters50/1715595
aggaaaaatata

SEQ ID NO: 177767 - DNA, 12 bp, Unknown
  misc_feature (1)..( 12): Result.005 file - promoters50/1715595
taattaagcata

SEQ ID NO: 177768 - DNA, 12 bp, Unknown
  misc_feature (1)..( 12): Result.005 file - promoters50/1715595
agattcagcctt

SEQ ID NO: 177769 - DNA, 8 bp, Unknown
  misc_feature (1)..( 8): Result.005 file - promoters50/1715615
taaagaca

SEQ ID NO: 177770 - DNA, 8 bp, Unknown
  misc_feature (1)..( 8): Result.005 file - promoters50/1715615
taaagata

SEQ ID NO: 177771 - DNA, 8 bp, Unknown
  misc_feature (1)..( 8): Result.005 file - promoters50/1715615
gaaaaaca

SEQ ID NO: 177772 - DNA, 8 bp, Unknown
  misc_feature (1)..( 8): Result.005 file - promoters50/1715615
caaaaata

SEQ ID NO: 177773 - DNA, 11 bp, Unknown
  misc_feature (1)..( 11): Result.005 file - promoters50/1715810
acaattaaatt

SEQ ID NO: 177774 - DNA, 11 bp, Unknown
  misc_feature (1)..( 11): Result.005 file - promoters50/1715810
gaaatgaaata

SEQ ID NO: 177775 - DNA, 12 bp, Unknown
  misc_feature (1)..( 12): Result.005 file - promoters50/1715810
ttaatttaaaga

SEQ ID NO: 177776 - DNA, 12 bp, Unknown
  misc_feature (1)..( 12): Result.005 file - promoters50/1715810
ggaaaagaaaat

SEQ ID NO: 177777 - DNA, 12 bp, Unknown
  misc_feature (1)..( 12): Result.005 file - promoters50/1715810
ggattttcaatt

SEQ ID NO: 177778 - DNA, 9 bp, Unknown
  misc_feature (1)..( 9): Result.005 file - promoters50/1715994
aataaacaa

SEQ ID NO: 177779 - DNA, 9 bp, Unknown
  misc_feature (1)..( 9): Result.005 file - promoters50/1715994
tatatacac

SEQ ID NO: 177780 - DNA, 9 bp, Unknown
  misc_feature (1)..( 9): Result.005 file - promoters50/1715994
tgtaaacac

SEQ ID NO: 177781 - DNA, 9 bp, Unknown
  misc_feature (1)..( 9): Result.005 file - promoters50/1715994
aataaacaa

SEQ ID NO: 177782 - DNA, 9 bp, Unknown
  misc_feature (1)..( 9): Result.005 file - promoters50/1715994
acaaaacaa

SEQ ID NO: 177783 - DNA, 9 bp, Unknown
  misc_feature (1)..( 9): Result.005 file - promoters50/1715994
gagaaaaaa

SEQ ID NO: 177784 - DNA, 11 bp, Unknown
  misc_feature (1)..( 11): Result.005 file - promoters50/1716037
atatttttatt

SEQ ID NO: 177785 - DNA, 11 bp, Unknown
  misc_feature (1)..( 11): Result.005 file - promoters50/1716037
atattttattt

SEQ ID NO: 177786 - DNA, 11 bp, Unknown
  misc_feature (1)..( 11): Result.005 file - promoters50/1716037
atatattagcc

SEQ ID NO: 177787 - DNA, 11 bp, Unknown
  misc_feature (1)..( 11): Result.005 file - promoters50/1716037
ataaattgtta

SEQ ID NO: 177788 - DNA, 11 bp, Unknown
  misc_feature (1)..( 11): Result.005 file - promoters50/1716037
atgtttctttg

SEQ ID NO: 177789 - DNA, 11 bp, Unknown
  misc_feature (1)..( 11): Result.005 file - promoters50/1716037
ttaaaaaaata

SEQ ID NO: 177790 - DNA, 15 bp, Unknown
  misc_feature (1)..( 15): Result.005 file - promoters50/1716037
tatatttttattctt

SEQ ID NO: 177791 - DNA, 15 bp, Unknown
  misc_feature (1)..( 15): Result.005 file - promoters50/1716037
tcatattttatttgt

SEQ ID NO: 177792 - DNA, 16 bp, Unknown
  misc_feature (1)..( 16): Result.005 file - promoters50/1716037
ataaattgttactttt

SEQ ID NO: 177793 - DNA, 16 bp, Unknown
  misc_feature (1)..( 16): Result.005 file - promoters50/1716037
aggaatgtttctttgc

SEQ ID NO: 177794 - DNA, 16 bp, Unknown
  misc_feature (1)..( 16): Result.005 file - promoters50/1716037
tgggcgttttcttaat

SEQ ID NO: 177795 - DNA, 16 bp, Unknown
  misc_feature (1)..( 16): Result.005 file - promoters50/1716037
gccattctttaaaaaa

SEQ ID NO: 177796 - DNA, 15 bp, Unknown
  misc_feature (1)..( 15): Result.005 file - promoters50/1716037
tattcttttgttttt

SEQ ID NO: 177797 - DNA, 15 bp, Unknown
  misc_feature (1)..( 15): Result.005 file - promoters50/1716037
attttatttgtttct

SEQ ID NO: 177798 - DNA, 15 bp, Unknown
  misc_feature (1)..( 15): Result.005 file - promoters50/1716037
ggaatgtttctttgc

SEQ ID NO: 177799 - DNA, 15 bp, Unknown
  misc_feature (1)..( 15): Result.005 file - promoters50/1716037
ttttaattttttttt

SEQ ID NO: 177800 - DNA, 15 bp, Unknown
  misc_feature (1)..( 15): Result.005 file - promoters50/1716037
gggcgttttcttaat

SEQ ID NO: 177801 - DNA, 15 bp, Unknown
  misc_feature (1)..( 15): Result.005 file - promoters50/1716037
aaaatatttaaataa

SEQ ID NO: 177802 - DNA, 15 bp, Unknown
  misc_feature (1)..( 15): Result.005 file - promoters50/1716037
aaaaaattgaaactt

SEQ ID NO: 177803 - DNA, 9 bp, Unknown
  misc_feature (1)..( 9): Result.005 file - promoters50/1716037
tttttgaat

SEQ ID NO: 177804 - DNA, 9 bp, Unknown
  misc_feature (1)..( 9): Result.005 file - promoters50/1716037
tttctgatc

SEQ ID NO: 177805 - DNA, 9 bp, Unknown
  misc_feature (1)..( 9): Result.005 file - promoters50/1716037
gtttagaat

SEQ ID NO: 177806 - DNA, 9 bp, Unknown
  misc_feature (1)..( 9): Result.005 file - promoters50/1716037
ttttttttt

SEQ ID NO: 177807 - DNA, 9 bp, Unknown
  misc_feature (1)..( 9): Result.005 file - promoters50/1716037
tcttagaaa

SEQ ID NO: 177808 - DNA, 9 bp, Unknown
  misc_feature (1)..( 9): Result.005 file - promoters50/1716037
attctgaat

SEQ ID NO: 177809 - DNA, 17 bp, Unknown
  misc_feature (1)..( 17): Result.005 file - promoters50/1716037
atttttattcttttgtt

SEQ ID NO: 177810 - DNA, 17 bp, Unknown
  misc_feature (1)..( 17): Result.005 file - promoters50/1716037
ggaatgtttctttgctc

SEQ ID NO: 177811 - DNA, 17 bp, Unknown
  misc_feature (1)..( 17): Result.005 file - promoters50/1716037
attttaattttttttta

SEQ ID NO: 177812 - DNA, 17 bp, Unknown
  misc_feature (1)..( 17): Result.005 file - promoters50/1716037
ttcatattttatttgtt

SEQ ID NO: 177813 - DNA, 17 bp, Unknown
  misc_feature (1)..( 17): Result.005 file - promoters50/1716037
tgggcgttttcttaatt

SEQ ID NO: 177814 - DNA, 17 bp, Unknown
  misc_feature (1)..( 17): Result.005 file - promoters50/1716037
aataaaatatttaaata

SEQ ID NO: 177815 - DNA, 17 bp, Unknown
  misc_feature (1)..( 17): Result.005 file - promoters50/1716037
gaacaaaaaaattgaaa

SEQ ID NO: 177816 - DNA, 16 bp, Unknown
  misc_feature (1)..( 16): Result.005 file - promoters50/1716037
atttatcaatcacata

SEQ ID NO: 177817 - DNA, 16 bp, Unknown
  misc_feature (1)..( 16): Result.005 file - promoters50/1716037
atttattaattatttt

SEQ ID NO: 177818 - DNA, 16 bp, Unknown
  misc_feature (1)..( 16): Result.005 file - promoters50/1716037
gcgtatcaaccaatgt

SEQ ID NO: 177819 - DNA, 16 bp, Unknown
  misc_feature (1)..( 16): Result.005 file - promoters50/1716037
taattttaattttttt

SEQ ID NO: 177820 - DNA, 16 bp, Unknown
  misc_feature (1)..( 16): Result.005 file - promoters50/1716037
aaaataaaatatttaa

SEQ ID NO: 177821 - DNA, 16 bp, Unknown
  misc_feature (1)..( 16): Result.005 file - promoters50/1716037
acaaaaaaattgaaac

SEQ ID NO: 177822 - DNA, 10 bp, Unknown
  misc_feature (1)..( 10): Result.005 file - promoters50/1716037
aaaaatgttc

SEQ ID NO: 177823 - DNA, 10 bp, Unknown
  misc_feature (1)..( 10): Result.005 file - promoters50/1716037
caaaattttc

SEQ ID NO: 177824 - DNA, 10 bp, Unknown
  misc_feature (1)..( 10): Result.005 file - promoters50/1716037
caaaagtttt

SEQ ID NO: 177825 - DNA, 10 bp, Unknown
  misc_feature (1)..( 10): Result.005 file - promoters50/1716037
aaaaatcaat

SEQ ID NO: 177826 - DNA, 10 bp, Unknown
  misc_feature (1)..( 10): Result.005 file - promoters50/1716037
tcatattttc

SEQ ID NO: 177827 - DNA, 10 bp, Unknown
  misc_feature (1)..( 10): Result.005 file - promoters50/1716037
gaaactttag

SEQ ID NO: 177828 - DNA, 12 bp, Unknown
  misc_feature (1)..( 12): Result.005 file - promoters50/1716040
agacattgttgg

SEQ ID NO: 177829 - DNA, 12 bp, Unknown
  misc_feature (1)..( 12): Result.005 file - promoters50/1716040
atttattgtttg

SEQ ID NO: 177830 - DNA, 12 bp, Unknown
  misc_feature (1)..( 12): Result.005 file - promoters50/1716040
gtttaatgttat

SEQ ID NO: 177831 - DNA, 12 bp, Unknown
  misc_feature (1)..( 12): Result.005 file - promoters50/1716040
accaaatcttaa

SEQ ID NO: 177832 - DNA, 12 bp, Unknown
  misc_feature (1)..( 12): Result.005 file - promoters50/1716040
accaaatattat

SEQ ID NO: 177833 - DNA, 12 bp, Unknown
  misc_feature (1)..( 12): Result.005 file - promoters50/1716040
gttaaatgtata

SEQ ID NO: 177834 - DNA, 11 bp, Unknown
  misc_feature (1)..( 11): Result.005 file - promoters50/1806991
ttaacaaaaaa

SEQ ID NO: 177835 - DNA, 11 bp, Unknown
  misc_feature (1)..( 11): Result.005 file - promoters50/1806991
ggaactaaaaa

SEQ ID NO: 177836 - DNA, 11 bp, Unknown
  misc_feature (1)..( 11): Result.005 file - promoters50/1806991
ttaccaaaaat

SEQ ID NO: 177837 - DNA, 9 bp, Unknown
  misc_feature (1)..( 9): Result.005 file - promoters50/1806991
catatgttt

SEQ ID NO: 177838 - DNA, 9 bp, Unknown
  misc_feature (1)..( 9): Result.005 file - promoters50/1806991
catttgtat

SEQ ID NO: 177839 - DNA, 9 bp, Unknown
  misc_feature (1)..( 9): Result.005 file - promoters50/1806991
aatttctat

SEQ ID NO: 177840 - DNA, 12 bp, Unknown
  misc_feature (1)..( 12): Result.005 file - promoters50/1806998
ataacaaagttt

SEQ ID NO: 177841 - DNA, 12 bp, Unknown
  misc_feature (1)..( 12): Result.005 file - promoters50/1806998
aacacaaagtca

SEQ ID NO: 177842 - DNA, 12 bp, Unknown
  misc_feature (1)..( 12): Result.005 file - promoters50/1806998
aaatgaaaattt

SEQ ID NO: 177843 - DNA, 12 bp, Unknown
  misc_feature (1)..( 12): Result.005 file - promoters50/1806998
aaaacaaaaatt

SEQ ID NO: 177844 - DNA, 12 bp, Unknown
  misc_feature (1)..( 12): Result.005 file - promoters50/1806998
aactcaaaaagt

SEQ ID NO: 177845 - DNA, 12 bp, Unknown
  misc_feature (1)..( 12): Result.005 file - promoters50/1806998
agaacattggaa

SEQ ID NO: 177846 - DNA, 10 bp, Unknown
  misc_feature (1)..( 10): Result.005 file - promoters50/1807014
aatattttcc

SEQ ID NO: 177847 - DNA, 10 bp, Unknown
  misc_feature (1)..( 10): Result.005 file - promoters50/1807014
ttctttttcc

SEQ ID NO: 177848 - DNA, 10 bp, Unknown
  misc_feature (1)..( 10): Result.005 file - promoters50/1807014
aattttttct

SEQ ID NO: 177849 - DNA, 10 bp, Unknown
  misc_feature (1)..( 10): Result.005 file - promoters50/1807014
ctaaaataaa

SEQ ID NO: 177850 - DNA, 10 bp, Unknown
  misc_feature (1)..( 10): Result.005 file - promoters50/1807014
ttaaaagaaa

SEQ ID NO: 177851 - DNA, 10 bp, Unknown
  misc_feature (1)..( 10): Result.005 file - promoters50/1807014
ttaaaagaat

SEQ ID NO: 177852 - DNA, 13 bp, Unknown
  misc_feature (1)..( 13): Result.005 file - promoters50/1807067
gataaaacaagtt

SEQ ID NO: 177853 - DNA, 13 bp, Unknown
  misc_feature (1)..( 13): Result.005 file - promoters50/1807067
attaaaacacaca

SEQ ID NO: 177854 - DNA, 13 bp, Unknown
  misc_feature (1)..( 13): Result.005 file - promoters50/1807067
tttaaaacatgtt

SEQ ID NO: 177855 - DNA, 13 bp, Unknown
  misc_feature (1)..( 13): Result.005 file - promoters50/1807067
ttcaaaacacggc

SEQ ID NO: 177856 - DNA, 13 bp, Unknown
  misc_feature (1)..( 13): Result.005 file - promoters50/1807067
tttacaactgagc

SEQ ID NO: 177857 - DNA, 13 bp, Unknown
  misc_feature (1)..( 13): Result.005 file - promoters50/1807067
ttcataactataa

SEQ ID NO: 177858 - DNA, 15 bp, Unknown
  misc_feature (1)..( 15): Result.005 file - promoters50/1807067
gtgtaatatttattg

SEQ ID NO: 177859 - DNA, 15 bp, Unknown
  misc_feature (1)..( 15): Result.005 file - promoters50/1807067
atgtattatgtgagc

SEQ ID NO: 177860 - DNA, 15 bp, Unknown
  misc_feature (1)..( 15): Result.005 file - promoters50/1807067
atgtattattgtgta

SEQ ID NO: 177861 - DNA, 15 bp, Unknown
  misc_feature (1)..( 15): Result.005 file - promoters50/1807067
atgaattagcttgct

SEQ ID NO: 177862 - DNA, 15 bp, Unknown
  misc_feature (1)..( 15): Result.005 file - promoters50/1807067
tcgtatcatttgtat

SEQ ID NO: 177863 - DNA, 15 bp, Unknown
  misc_feature (1)..( 15): Result.005 file - promoters50/1807067
attcatcctttttat

SEQ ID NO: 177864 - DNA, 19 bp, Unknown
  misc_feature (1)..( 19): Result.005 file - promoters50/1807067
acaactaattttattataa

SEQ ID NO: 177865 - DNA, 19 bp, Unknown
  misc_feature (1)..( 19): Result.005 file - promoters50/1807067
tcaacttatttgcttcata

SEQ ID NO: 177866 - DNA, 19 bp, Unknown
  misc_feature (1)..( 19): Result.005 file - promoters50/1807067
ataacttattgtataataa

SEQ ID NO: 177867 - DNA, 19 bp, Unknown
  misc_feature (1)..( 19): Result.005 file - promoters50/1807067
gcaacaaatcaaagggaaa

SEQ ID NO: 177868 - DNA, 19 bp, Unknown
  misc_feature (1)..( 19): Result.005 file - promoters50/1807067
acaattaaaaaaaaagtta

SEQ ID NO: 177869 - DNA, 19 bp, Unknown
  misc_feature (1)..( 19): Result.005 file - promoters50/1807067
tcaacaaccaaagcctaga

SEQ ID NO: 177870 - DNA, 14 bp, Unknown
  misc_feature (1)..( 14): Result.005 file - promoters50/1807067
atcaattttaagta

SEQ ID NO: 177871 - DNA, 14 bp, Unknown
  misc_feature (1)..( 14): Result.005 file - promoters50/1807067
atcaagtttctata

SEQ ID NO: 177872 - DNA, 14 bp, Unknown
  misc_feature (1)..( 14): Result.005 file - promoters50/1807067
tcggatttttagta

SEQ ID NO: 177873 - DNA, 14 bp, Unknown
  misc_feature (1)..( 14): Result.005 file - promoters50/1807067
gatgattttaatta

SEQ ID NO: 177874 - DNA, 14 bp, Unknown
  misc_feature (1)..( 14): Result.005 file - promoters50/1807067
acatatttttcttc

SEQ ID NO: 177875 - DNA, 14 bp, Unknown
  misc_feature (1)..( 14): Result.005 file - promoters50/1807067
ggtgatttgaatta

SEQ ID NO: 177876 - DNA, 14 bp, Unknown
  misc_feature (1)..( 14): Result.005 file - promoters50/1807067
gatggtttttgtag

SEQ ID NO: 177877 - DNA, 13 bp, Unknown
  misc_feature (1)..( 13): Result.005 file - promoters50/1807067
catgttagtgtaa

SEQ ID NO: 177878 - DNA, 13 bp, Unknown
  misc_feature (1)..( 13): Result.005 file - promoters50/1807067
tgtattattgtgt

SEQ ID NO: 177879 - DNA, 13 bp, Unknown
  misc_feature (1)..( 13): Result.005 file - promoters50/1807067
acatgtattatgt

SEQ ID NO: 177880 - DNA, 13 bp, Unknown
  misc_feature (1)..( 13): Result.005 file - promoters50/1807067
tatcgtatcattt

SEQ ID NO: 177881 - DNA, 13 bp, Unknown
  misc_feature (1)..( 13): Result.005 file - promoters50/1807067
atcctttttatca

SEQ ID NO: 177882 - DNA, 13 bp, Unknown
  misc_feature (1)..( 13): Result.005 file - promoters50/1807067
gctgccatcgttt

SEQ ID NO: 177883 - DNA, 9 bp, Unknown
  misc_feature (1)..( 9): Result.005 file - promoters50/1807244
cgtccgaat

SEQ ID NO: 177884 - DNA, 9 bp, Unknown
  misc_feature (1)..( 9): Result.005 file - promoters50/1807244
tgtcctaat

SEQ ID NO: 177885 - DNA, 9 bp, Unknown
  misc_feature (1)..( 9): Result.005 file - promoters50/1807244
tgtcttaac

SEQ ID NO: 177886 - DNA, 8 bp, Unknown
  misc_feature (1)..( 8): Result.005 file - promoters50/1807415
gtttgtcc

SEQ ID NO: 177887 - DNA, 8 bp, Unknown
  misc_feature (1)..( 8): Result.005 file - promoters50/1807415
ctttgtct

SEQ ID NO: 177888 - DNA, 8 bp, Unknown
  misc_feature (1)..( 8): Result.005 file - promoters50/1807415
ctttttct

SEQ ID NO: 177889 - DNA, 6 bp, Unknown
  misc_feature (1)..( 6): Result.005 file - promoters50/1807415
attttt

SEQ ID NO: 177890 - DNA, 6 bp, Unknown
  misc_feature (1)..( 6): Result.005 file - promoters50/1807415
attttt

SEQ ID NO: 177891 - DNA, 7 bp, Unknown
  misc_feature (1)..( 7): Result.005 file - promoters50/1807415
attcttt

SEQ ID NO: 177892 - DNA, 8 bp, Unknown
  misc_feature (1)..( 8): Result.005 file - promoters50/1807415
tttctctc

SEQ ID NO: 177893 - DNA, 8 bp, Unknown
  misc_feature (1)..( 8): Result.005 file - promoters50/1807415
tttctctc

SEQ ID NO: 177894 - DNA, 8 bp, Unknown
  misc_feature (1)..( 8): Result.005 file - promoters50/1807415
attctctg

SEQ ID NO: 177895 - DNA, 7 bp, Unknown
  misc_feature (1)..( 7): Result.005 file - promoters50/1807415
caaataa

SEQ ID NO: 177896 - DNA, 7 bp, Unknown
  misc_feature (1)..( 7): Result.005 file - promoters50/1807415
caaataa

SEQ ID NO: 177897 - DNA, 7 bp, Unknown
  misc_feature (1)..( 7): Result.005 file - promoters50/1807415
taaataa

SEQ ID NO: 177898 - DNA, 7 bp, Unknown
  misc_feature (1)..( 7): Result.005 file - promoters50/1807415
ttcttta

SEQ ID NO: 177899 - DNA, 7 bp, Unknown
  misc_feature (1)..( 7): Result.005 file - promoters50/1807415
atcttta

SEQ ID NO: 177900 - DNA, 7 bp, Unknown
  misc_feature (1)..( 7): Result.005 file - promoters50/1807415
atttttt

SEQ ID NO: 177901 - DNA, 11 bp, Unknown
  misc_feature (1)..( 11): Result.005 file - promoters50/1807554
aatatattttt

SEQ ID NO: 177902 - DNA, 11 bp, Unknown
  misc_feature (1)..( 11): Result.005 file - promoters50/1807554
aatatgttttt

SEQ ID NO: 177903 - DNA, 11 bp, Unknown
  misc_feature (1)..( 11): Result.005 file - promoters50/1807554
aatgagttttt

SEQ ID NO: 177904 - DNA, 7 bp, Unknown
  misc_feature (1)..( 7): Result.005 file - promoters50/1807554
tttcacc

SEQ ID NO: 177905 - DNA, 7 bp, Unknown
  misc_feature (1)..( 7): Result.005 file - promoters50/1807554
tttgacc

SEQ ID NO: 177906 - DNA, 7 bp, Unknown
  misc_feature (1)..( 7): Result.005 file - promoters50/1807554
tttcacc

SEQ ID NO: 177907 - DNA, 6 bp, Unknown
  misc_feature (1)..( 6): Result.005 file - promoters50/1807554
taaaac

SEQ ID NO: 177908 - DNA, 6 bp, Unknown
  misc_feature (1)..( 6): Result.005 file - promoters50/1807554
taaaac

SEQ ID NO: 177909 - DNA, 6 bp, Unknown
  misc_feature (1)..( 6): Result.005 file - promoters50/1807554
taaaac

SEQ ID NO: 177910 - DNA, 10 bp, Unknown
  misc_feature (1)..( 10): Result.005 file - promoters50/1807554
tccatcccta

SEQ ID NO: 177911 - DNA, 10 bp, Unknown
  misc_feature (1)..( 10): Result.005 file - promoters50/1807554
gtcatctcta

SEQ ID NO: 177912 - DNA, 10 bp, Unknown
  misc_feature (1)..( 10): Result.005 file - promoters50/1807554
tccttccgtg

SEQ ID NO: 177913 - DNA, 11 bp, Unknown
  misc_feature (1)..( 11): Result.005 file - promoters50/1807736
ctatgaataat

SEQ ID NO: 177914 - DNA, 11 bp, Unknown
  misc_feature (1)..( 11): Result.005 file - promoters50/1807736
gtataaatatc

SEQ ID NO: 177915 - DNA, 11 bp, Unknown
  misc_feature (1)..( 11): Result.005 file - promoters50/1807736
acctgaatact

SEQ ID NO: 177916 - DNA, 11 bp, Unknown
  misc_feature (1)..( 11): Result.005 file - promoters50/1807736
gtagaaagtca

SEQ ID NO: 177917 - DNA, 11 bp, Unknown
  misc_feature (1)..( 11): Result.005 file - promoters50/1807736
atctgaacact

SEQ ID NO: 177918 - DNA, 11 bp, Unknown
  misc_feature (1)..( 11): Result.005 file - promoters50/1807736
cattgaacatt

SEQ ID NO: 177919 - DNA, 8 bp, Unknown
  misc_feature (1)..( 8): Result.005 file - promoters50/1807740
aaacttaa

SEQ ID NO: 177920 - DNA, 8 bp, Unknown
  misc_feature (1)..( 8): Result.005 file - promoters50/1807740
aaacttaa

SEQ ID NO: 177921 - DNA, 8 bp, Unknown
  misc_feature (1)..( 8): Result.005 file - promoters50/1807740
aaaattat

SEQ ID NO: 177922 - DNA, 8 bp, Unknown
  misc_feature (1)..( 8): Result.005 file - promoters50/1807771
aaaaacag

SEQ ID NO: 177923 - DNA, 8 bp, Unknown
  misc_feature (1)..( 8): Result.005 file - promoters50/1807771
aaatacac

SEQ ID NO: 177924 - DNA, 8 bp, Unknown
  misc_feature (1)..( 8): Result.005 file - promoters50/1807771
aaaaacaa

SEQ ID NO: 177925 - DNA, 8 bp, Unknown
  misc_feature (1)..( 8): Result.005 file - promoters50/1807771
tgaaacag

SEQ ID NO: 177926 - DNA, 8 bp, Unknown
  misc_feature (1)..( 8): Result.005 file - promoters50/1807771
taaaacac

SEQ ID NO: 177927 - DNA, 8 bp, Unknown
  misc_feature (1)..( 8): Result.005 file - promoters50/1807771
aaatatat

SEQ ID NO: 177928 - DNA, 10 bp, Unknown
  misc_feature (1)..( 10): Result.005 file - promoters50/1807771
agaaagtatt

SEQ ID NO: 177929 - DNA, 10 bp, Unknown
  misc_feature (1)..( 10): Result.005 file - promoters50/1807771
ccaaaatatt

SEQ ID NO: 177930 - DNA, 10 bp, Unknown
  misc_feature (1)..( 10): Result.005 file - promoters50/1807771
ttaaaatata

SEQ ID NO: 177931 - DNA, 10 bp, Unknown
  misc_feature (1)..( 10): Result.005 file - promoters50/1807771
acaaaatctc

SEQ ID NO: 177932 - DNA, 10 bp, Unknown
  misc_feature (1)..( 10): Result.005 file - promoters50/1807771
acaaaaacaa

SEQ ID NO: 177933 - DNA, 10 bp, Unknown
  misc_feature (1)..( 10): Result.005 file - promoters50/1807771
agaaaataga

SEQ ID NO: 177934 - DNA, 10 bp, Unknown
  misc_feature (1)..( 10): Result.005 file - promoters50/1807771
ataaaataga

SEQ ID NO: 177935 - DNA, 10 bp, Unknown
  misc_feature (1)..( 10): Result.005 file - promoters50/1807774
taaaaagctc

SEQ ID NO: 177936 - DNA, 10 bp, Unknown
  misc_feature (1)..( 10): Result.005 file - promoters50/1807774
taaaaatttt

SEQ ID NO: 177937 - DNA, 10 bp, Unknown
  misc_feature (1)..( 10): Result.005 file - promoters50/1807774
taaaaaatat

SEQ ID NO: 177938 - DNA, 10 bp, Unknown
  misc_feature (1)..( 10): Result.005 file - promoters50/1807774
taacaatttt

SEQ ID NO: 177939 - DNA, 10 bp, Unknown
  misc_feature (1)..( 10): Result.005 file - promoters50/1807774
ttttggaaat

SEQ ID NO: 177940 - DNA, 10 bp, Unknown
  misc_feature (1)..( 10): Result.005 file - promoters50/1807774
ccaaggaaat

SEQ ID NO: 177941 - DNA, 10 bp, Unknown
  misc_feature (1)..( 10): Result.005 file - promoters50/1807774
ttttcgaaag

SEQ ID NO: 177942 - DNA, 7 bp, Unknown
  misc_feature (1)..( 7): Result.005 file - promoters50/1807774
aaagttt

SEQ ID NO: 177943 - DNA, 7 bp, Unknown
  misc_feature (1)..( 7): Result.005 file - promoters50/1807774
aaatttt

SEQ ID NO: 177944 - DNA, 7 bp, Unknown
  misc_feature (1)..( 7): Result.005 file - promoters50/1807774
aaattta

SEQ ID NO: 177945 - DNA, 8 bp, Unknown
  misc_feature (1)..( 8): Result.005 file - promoters50/1807774
atatcaac

SEQ ID NO: 177946 - DNA, 8 bp, Unknown
  misc_feature (1)..( 8): Result.005 file - promoters50/1807774
ataccaac

SEQ ID NO: 177947 - DNA, 8 bp, Unknown
  misc_feature (1)..( 8): Result.005 file - promoters50/1807774
ttacaaac

SEQ ID NO: 177948 - DNA, 8 bp, Unknown
  misc_feature (1)..( 8): Result.005 file - promoters50/1807774
cactgttc

SEQ ID NO: 177949 - DNA, 8 bp, Unknown
  misc_feature (1)..( 8): Result.005 file - promoters50/1807774
cactgttt

SEQ ID NO: 177950 - DNA, 8 bp, Unknown
  misc_feature (1)..( 8): Result.005 file - promoters50/1807774
tactattt

SEQ ID NO: 177951 - DNA, 8 bp, Unknown
  misc_feature (1)..( 8): Result.005 file - promoters50/1807774
tataaaac

SEQ ID NO: 177952 - DNA, 8 bp, Unknown
  misc_feature (1)..( 8): Result.005 file - promoters50/1807774
tataaata

SEQ ID NO: 177953 - DNA, 8 bp, Unknown
  misc_feature (1)..( 8): Result.005 file - promoters50/1807774
tatatata

SEQ ID NO: 177954 - DNA, 8 bp, Unknown
  misc_feature (1)..( 8): Result.005 file - promoters50/1807774
attaattg

SEQ ID NO: 177955 - DNA, 8 bp, Unknown
  misc_feature (1)..( 8): Result.005 file - promoters50/1807774
atttattt

SEQ ID NO: 177956 - DNA, 8 bp, Unknown
  misc_feature (1)..( 8): Result.005 file - promoters50/1807774
atttgttt

SEQ ID NO: 177957 - DNA, 7 bp, Unknown
  misc_feature (1)..( 7): Result.005 file - promoters50/1808030
ggtccaa

SEQ ID NO: 177958 - DNA, 7 bp, Unknown
  misc_feature (1)..( 7): Result.005 file - promoters50/1808030
ggtccat

SEQ ID NO: 177959 - DNA, 7 bp, Unknown
  misc_feature (1)..( 7): Result.005 file - promoters50/1808030
tgtccat

SEQ ID NO: 177960 - DNA, 8 bp, Unknown
  misc_feature (1)..( 8): Result.005 file - promoters50/1808030
atacaaat

SEQ ID NO: 177961 - DNA, 8 bp, Unknown
  misc_feature (1)..( 8): Result.005 file - promoters50/1808030
atacaaaa

SEQ ID NO: 177962 - DNA, 8 bp, Unknown
  misc_feature (1)..( 8): Result.005 file - promoters50/1808030
caacaaat

SEQ ID NO: 177963 - DNA, 7 bp, Unknown
  misc_feature (1)..( 7): Result.005 file - promoters50/1808030
caaaaac

SEQ ID NO: 177964 - DNA, 7 bp, Unknown
  misc_feature (1)..( 7): Result.005 file - promoters50/1808030
caataac

SEQ ID NO: 177965 - DNA, 7 bp, Unknown
  misc_feature (1)..( 7): Result.005 file - promoters50/1808030
caaaaaa

SEQ ID NO: 177966 - DNA, 12 bp, Unknown
  misc_feature (1)..( 12): Result.005 file - promoters50/1808072
tccataattatt

SEQ ID NO: 177967 - DNA, 12 bp, Unknown
  misc_feature (1)..( 12): Result.005 file - promoters50/1808072
taaataattaaa

SEQ ID NO: 177968 - DNA, 12 bp, Unknown
  misc_feature (1)..( 12): Result.005 file - promoters50/1808072
aatataattgac

SEQ ID NO: 177969 - DNA, 12 bp, Unknown
  misc_feature (1)..( 12): Result.005 file - promoters50/1808072
taaacaatggtt

SEQ ID NO: 177970 - DNA, 12 bp, Unknown
  misc_feature (1)..( 12): Result.005 file - promoters50/1808072
atcataagtaat

SEQ ID NO: 177971 - DNA, 12 bp, Unknown
  misc_feature (1)..( 12): Result.005 file - promoters50/1808072
caaacgatggtc

SEQ ID NO: 177972 - DNA, 8 bp, Unknown
  misc_feature (1)..( 8): Result.005 file - promoters50/1808072
taatttaa

SEQ ID NO: 177973 - DNA, 8 bp, Unknown
  misc_feature (1)..( 8): Result.005 file - promoters50/1808072
aaatataa

SEQ ID NO: 177974 - DNA, 8 bp, Unknown
  misc_feature (1)..( 8): Result.005 file - promoters50/1808072
taattttt

SEQ ID NO: 177975 - DNA, 8 bp, Unknown
  misc_feature (1)..( 8): Result.005 file - promoters50/1808072
aaatataa

SEQ ID NO: 177976 - DNA, 8 bp, Unknown
  misc_feature (1)..( 8): Result.005 file - promoters50/1808072
taatttaa

SEQ ID NO: 177977 - DNA, 8 bp, Unknown
  misc_feature (1)..( 8): Result.005 file - promoters50/1808072
ttatataa

SEQ ID NO: 177978 - DNA, 13 bp, Unknown
  misc_feature (1)..( 13): Result.005 file - promoters50/1808072
tgacaaaatttaa

SEQ ID NO: 177979 - DNA, 13 bp, Unknown
  misc_feature (1)..( 13): Result.005 file - promoters50/1808072
ctacaaaataaac

SEQ ID NO: 177980 - DNA, 13 bp, Unknown
  misc_feature (1)..( 13): Result.005 file - promoters50/1808072
attgaaaatttta

SEQ ID NO: 177981 - DNA, 13 bp, Unknown
  misc_feature (1)..( 13): Result.005 file - promoters50/1808072
tgactaaagatta

SEQ ID NO: 177982 - DNA, 13 bp, Unknown
  misc_feature (1)..( 13): Result.005 file - promoters50/1808072
aaaggaaattaaa

SEQ ID NO: 177983 - DNA, 13 bp, Unknown
  misc_feature (1)..( 13): Result.005 file - promoters50/1808072
attataaattagg

SEQ ID NO: 177984 - DNA, 15 bp, Unknown
  misc_feature (1)..( 15): Result.005 file - promoters50/1808072
aaaatttaaaattgt

SEQ ID NO: 177985 - DNA, 15 bp, Unknown
  misc_feature (1)..( 15): Result.005 file - promoters50/1808072
taaatttaaaaacca

SEQ ID NO: 177986 - DNA, 15 bp, Unknown
  misc_feature (1)..( 15): Result.005 file - promoters50/1808072
aaaattttatatata

SEQ ID NO: 177987 - DNA, 15 bp, Unknown
  misc_feature (1)..( 15): Result.005 file - promoters50/1808072
ggaaattaaaatcta

SEQ ID NO: 177988 - DNA, 15 bp, Unknown
  misc_feature (1)..( 15): Result.005 file - promoters50/1808072
aagagttaaaatcaa

SEQ ID NO: 177989 - DNA, 16 bp, Unknown
  misc_feature (1)..( 16): Result.005 file - promoters50/1808072
aaagattacaaaacat

SEQ ID NO: 177990 - DNA, 10 bp, Unknown
  misc_feature (1)..( 10): Result.005 file - promoters50/1808072
aaaattatcc
